United States Patent 9,675,668 (MODIFIED POLYNUCLEOTIDES ENCODING HEPATITIS A VIRUS CELLULAR RECEPTOR 2) - sequence listing, part 25

SEQ ID NO: 53289 - DNA, 1857 bp, Artificial Sequence
  Description of Artificial Sequence: Synthetic coding sequence
atgcataagacagcttctcagcgactatttccgggtccttcctatcagaacattaagtcaatcatggaggactcaaccattctttcagattggaccaattcaaacaagcagaagatgaagtatgacttctcgtgcgaactgtaccggatgtctacatatagtacattccccgctggcgttccggtatctgagaggtctctcgccagagccggattctactatactggggtgaatgacaaagtgaaatgtttctgttgcgggcttatgctagacaattggaaacttggagactctcccatccagaaacacaaacagctatatcccagttgttcctttatccagaacttggttagtgcatcattgggaagcacctctaaaaatacatcgcccatgcgaaactcattcgctcactccctgagtcccaccctggagcactcctccttgttctccggaagttacagcagcctcagccccaatccgctcaactcgagggctgtggaggacatttcttcatccagaactaacccctacagttacgcaatgtccacagaggaagcaagattccttacatatcatatgtggcccctgacatttctgagccctagcgagttagccagagcgggtttctattacattggtccaggggatcgtgtggcctgctttgcttgcggaggcaagttgtctaattgggaacccaaggatgacgctatgtccgagcacaggcggcacttccctaattgccctttcctggagaacagcttagaaactctgagatttagcatcagtaacctgtcaatgcagactcacgctgccaggatgcggacatttatgtactggccctcatctgtgcctgtacagcccgaacagctggcttctgctggattctattacgtcggcaggaatgacgacgtgaagtgcttctgctgtgacggcggtctaagatgctgggaatccggagacgacccttgggtggaacacgcgaaatggtttccacggtgcgaattcctgatccggatgaagggccaggaatttgtcgacgaaattcagggcaggtacccccatcttctggaacagctgctgtccacctccgacaccacaggcgaggagaacgccgacccgcctatcatccactttgggccaggggagtcttcctccgaggacgccgtcatgatgaatacacccgtggtgaaatccgccctggagatgggcttcaatcgagatctggtaaagcagactgtacagagcaaaatattgactacgggtgagaattataaaacagtgaatgacatagtaagcgcccttctcaatgccgaagatgaaaagcgagaagaagagaaggagaagcaagccgaagagatggcgtctgacgatcttagtttaatcaggaagaaccgcatggcgctgttccagcagttgacttgtgtcttacccatactagataatctgctgaaggctaacgtgatcaataaacaggagcacgacattatcaagcaaaagactcagataccgttacaggccagggagcttattgacactattttggttaaaggcaacgcagccgctaacatcttcaagaactgcctgaaagaaatagacagcacactctataagaacctatttgtggacaaaaatatgaagtacatccccactgaagatgtgagcggcctcagccttgaggaacagctgagaaggctgcaggaggaaagaacttgtaaggtgtgtatggacaaggaagtttcggtggtctttataccatgtggccacctggtagtttgccaggaatgcgccccttcactgagaaagtgcccaatatgtcgtgggattattaaaggaacggtccgaactttcctgtcttag

SEQ ID NO: 53290 - DNA, 1461 bp, Artificial Sequence
  Description of Artificial Sequence: Synthetic coding sequence
atgcagagtgggggagccgaaggatctccaggagccggtcgcacaggcaggggacctggcagcggaaaggctccaccagcggaaattagctccggcgcaccagacttccctggcggagatcccattaaaatactaatgccctcactgagtcccaccatggaggaaggtaacattgtcaagtggctcaagaaggagggagaggctgtatccgccggtgacgccctttgcgagatcgaaaccgataaagcagtggtgacactggatgcttcagacgacggtatcctagccaagatcgtagtggaggaaggatccaagaatatcaggttaggatccctaattggcctcatcgtggaagaaggagaagactggaagcatgtggaaatcccgaaagacgtgggccctccacctccagttagtaagccctccgaacctcgcccatctcctgagccacagatcagtatacctgtgaagaaggaacatatccctggcacccttaggttccggttatcacctgccgcacgcaatatcctggaaaagcatagtctggacgcttctcagggaacagcaactggccctaggggcatatttacaaaagaggacgctctgaaacttgtgcagctgaagcaaacagggaagatcacagaatcacggccaactccggcaccaacagccacccccacagctccctcaccactgcaggccaccgctggaccatcatatcctcgccctgtgatccctcctgtgagtacccccggacagccgaatgcagttgggacatttacagagatccccgcttcgaacatccgcagggtgatcgcaaaaagattgactgagtcaaagtccactgtaccccacgcatacgctacagcggattgcgatctgggggctgtcctgaaagtgcgtcaggacctggtgaaagacgacatcaaggtttctgtcaacgatttcattattaaagctgccgcagtgacactcaagcaaatgccggatgtcaacgtttcttgggatggcgagggacccaagcagctgccatttatcgacatctccgttgctgtggctaccgataaaggtctgctcacccctatcataaaagacgctgctgccaaaggtatccaagagattgccgatagcgttaaagcgcttagtaaaaaagctagagatggcaagctcttgcctgaggagtatcaggggggttctttctcaatctcgaacctaggtatgttcggaattgatgaattcaccgccgtcattaatcccccacaggcatgcatcctcgccgtgggtcgttttaggccagttctgaaactgacggaagacgaggaggggaatgcgaaacttcagcaaagacagctgattaccgttacaatgagtagtgactctcgtgtggtggacgacgaattggccacccgtttcctcaagagttttaaggccaacttggaaaatcccattcgactagcatag

SEQ ID NO: 53291 - DNA, 1221 bp, Artificial Sequence
  Description of Artificial Sequence: Synthetic coding sequence
atgagattatttcggtggttgctgaaacagcctgtgcccaagcagatcgagcgctactctcgattctcaccaagtcctctttctatcaagcaatttcttgacttcgggagagataacgcatgtgaaaagacatcttacatgtttcttaggaaggagttgcccgttcgcctggcgaacacaatgagagaggttaatctcctgcccgacaacctcttgaaccgcccaagcgttggccttgttcagtcatggtatatgcaatcatttttagagctgcttgaatatgagaacaagtcacctgaggatccccaagtgctggataactttctccaggtgctgatcaaagtgagaaatcggcacaatgatgttgtccctactatggctcagggagtgatcgaatataaggaaaagttcggtttcgacccctttatcagtacaaacatccagtatttcctagaccggttttacacaaaccggattagcttcaggatgctcatcaatcagcacaccttgctgtttggcggagataccaatccagtccatcctaagcacataggctctattgatcctacttgcaacgtcgcagatgttgtaaaagacgcatacgaaacagcaaagatgctatgtgaacagtattatcttgtagctcccgagttggaggtggaagaatttaacgcgaaagcacctgataaaccgatccaagtcgtctacgtgccgtctcatttgttccacatgctgtttgagctctttaagaactctatgcgcgctacagtggaactgtatgaagacagaaaagaagggtatcctgctgtgaaaacgttagtgactctgggcaaggaggatctgagtatcaaaataagcgacttgggaggtggggtcccactcaggaaaatagaccggttgtttaactacatgtacagcacagcccctagacccagcctagaacctacaagggcagcccctctggcaggatttggatacgggttgccaatttcacggttgtatgccagatattttcagggagacctcaaactgtattcaatggagggcgtcggcactgatgccgtgatctatctgaaggccctgtctagtgagtctttcgaacggctcccagtctttaataagagcgcctggagacactataaaacaacacccgaagcagatgattggagcaatccctcctccgaaccgagagatgcctctaagtataaagcaaagcagtag

SEQ ID NO: 53292 - DNA, 1248 bp, Artificial Sequence
  Description of Artificial Sequence: Synthetic coding sequence
atgagactgttcagatggttgcttaaacaaccagtcccaaagcagatcgaacgctattctcggttttccccctcgccactgagtattaagcagttcctggactttggtagagataatgcctgcgagaaaacttcctacatgtttcttcgcaaggagctcccagtgcggctggcaaacaccatgagagaagtgaatctgctgccagacaacctgctcaaccgcccaagtgtgggcctggttcagagctggtatatgcagtctttcctggaattgctggaatatgagaataaaagccccgaagatcctcaggtcctggataatttcctccaagtcctgataaaggttagaaatcgacataacgatgtagttccaacaatggcgcagggcgtgatagagtataaagagaagttcggctttgatccctttatcagtaccaacatccagtactttctcgaccgattctacacgaaccgtatcagtttccgaatgctgatcaaccaacataccctgctgttcggcggagacactaatcccgtgcatccaaagcacatagggagcatcgaccccacatgcaacgtggccgatgttgtgaaagatgcgtacgagaccgcaaaaatgctgtgtgagcaatactatttggtcgcccctgaactggaagtggaggaattcaacgcgaaagctcccgacaaacccatacaggtggtgtatgtcccttcacatctattccatatgctctttgagctgtttaagaacagtatgcgcgcaaccgtggaactgtacgaagataggaaggaagggtatccagccgtcaagaccctggtgacgcttggaaaagaagatttgagcatcaagatttccgatctgggtggtggggtgcccctccgtaaaatcgaccggctttttaactatatgtactcaacggctccacgcccaagtttggaacctacccgcgctgcccctcttgccggatttggatatggattaccaatctctcgcctctacgccaggtactttcaaggggacctaaaattatattccatggagggagtcggaacggacgcagtaatctatctgaaggccttgtctagcgaatcttttgagcgactgcccgtgttcaacaagtccgcctggagacactataaaacaacaccggaggccgatgactggagtaacccctcctcagaacctagggatgcctctaagtataaggccaagcaggacaagataaagactaatcgcaccttctag

SEQ ID NO: 53293 - DNA, 1590 bp, Artificial Sequence
  Description of Artificial Sequence: Synthetic coding sequence
atgtcctcaacagtgtcctattggatcctgaattcgaccagaaacagcattgctactctccaaggtggaaggcgactgtacagccggtatgttagcaaccgcaacaagctgaagtggcggttgttttctcgcgtccccccaacattgaattcttcgccttgtgggggtttcaccctctgtaaggcgtacaggcatacttcgactgaggaggatgacttccacctgcagttgtccccagagcaaatcaatgaggtcctccgggctggtgaaaccacccacaagatactggacctcgagagcagagttccaaatagcgttctccggttcgaatctaaccagctagccgctaattctccagttgaagatcggagaggggtggcttcctgtctgcaaacgaatggtttgatgttcgggatcttcgacggtcatggcggacacgcctgcgcccaggcggtatctgagaggctgttttactacgtagctgtgtcgttgatgtcacaccagaccttggagcatatggagggcgctatggaatccatgaaaccactccttcctatcttgcactggctgaaacaccccggagacagtatctacaaggacgtgacaagtgtgcacctggaccatcttagagtctactggcaggagcttctcgatctgcatatggaaatgggtctgagcatcgaagaagcgcttatgtattctttccagagactggacagtgatatttccctagagatccaagcaccgttggaggacgaagtaaccagaaatctcagcttacaggtggcatttagcggcgctacggcttgtatggcccatgtagatggcattcatctgcacgttgccaatgctggtgattgtcgcgctatcctgggcgtgcaagaagacaacgggatgtggtcatgccttcctctgacaagggaccacaatgcctggaaccaggccgaattgtcacggctgaaacgcgagcatcccgaatccgaggatcgcaccatcatcatggaggacaggctgctgggtgtgctgattccctgccgtgcctttggagacgtccagctgaaatggagcaaagaacttcagcgcagtatattagaacgtggttttaatacagaagcactcaatatttaccagttcacgccacctcactactatactcccccttatctcacggctgaacctgaggtgacataccataggttacgacctcaggataaattcctcgtgctggccagtgatggcctctgggatatgctaagcaatgaggacgtggtccgtctggtcgtgggccacctggccgaagcagactggcacaaaacggatttggcacagaggccagctaacctcggcctcatgcagtccctgctccttcagcggaaggctagtggccttcacgaagccgaccagaatgccgcaaccagactgattcgacacgccattggtaacaatgagtatggcgagatggaggccgaaagactggccgctatgctgactctgccagaagacctggcacgcatgtatcgggatgacataactgtcacagttgtgtatttcaacagcgagagtattggggcttattataagggaggctag

SEQ ID NO: 53294 - DNA, 978 bp, Artificial Sequence
  Description of Artificial Sequence: Synthetic coding sequence
atggtgggtgagatggagacaaaagagaagcccaagcctacccccgattatttgatgcagctgatgaacgacaaaaagctgatgtccagtctacctaacttctgcgggatctttaaccacttagagaggctactcgacgaagaaatttcaagagtaaggaaagatatgtacaacgatacgctgaacgggtcaaccgagaagagatcagcggagctaccggatgccgtgggccctattgtgcaactacaggaaaaactgtacgttcctgtgaaggaatacccagactttaattttgtgggccgtatcctcggcccacggggattgaccgcaaagcagttagaggcagaaacaggttgtaagatcatggtgagaggcaaaggaagtatgagagataagaagaaagaggagcagaatagagggaagccaaactgggagcatctaaacgaagatctccacgtgctgataaccgtcgaggacgctcagaaccgggctgagataaaactcaagcgggctgtcgaagaagtgaaaaaactcctggtccctgccgctgaaggggaggattcccttaaaaagatgcagttaatggaactcgccatcctgaatggaacttatcgcgacgccaatattaagagcccagccttggcattctccctggcagctacagcacaagccgcacctcgcattatcaccgggccagccccagtactgcctcctgcggctctcaggacacctacgccagcaggtcccaccatcatgcccctcattcggcagatccagactgcagttatgccaaatggaacaccccacccaaccgctgcaattgtgccgccaggcccagaggccggtttgatctatactccatatgagtatccttatacactcgctcctgctactagtatcctcgagtatccgatcgaaccttctggggtgctagagtggattgagatgcctgttatgccagatatatctgctcactag

SEQ ID NO: 53295 - DNA, 1002 bp, Artificial Sequence
  Description of Artificial Sequence: Synthetic coding sequence
atggtcggcgagatggaaaccaaggagaagcccaagccaacccccgactacctgatgcagcttatgaacgataaaaagctcatgagtagtcttcctaacttctgtgggatcttcaaccatctggagcggttgctagacgaagagatttcccgtgtcaggaaagacatgtataatgatactttgaacgggagtacagaaaaaagaagcgccgagttgcccgacgccgtgggacctattgtgcagttacaggaaaaactctacgttccagtgaaagagtatccagacttcaacttcgttgggcgaattctgggcccacgcggtctgacggccaaacagctggaagccgagactggctgtaagatcatggtgagaggaaaggggagtatgagggacaagaagaaggaagaacagaacaggggcaaaccaaactgggaacatctcaatgaagacctgcatgtgttgattacagtcgaagatgcccaaaaccgggcagagattaaactcaaaagagctgtggaagaggtcaaaaagctcctggttcctgccgcagaaggagaggatagtcttaagaagatgcagctgatggagctggcgattcttaatgggacgtaccgtgacgccaacattaaaagtcccaccgctcaggcagcgccacggataattactgggcctgccccagttctgcctcctgccgctttgcggacacctacgcccgctggacccacaattatgccactcataaggcagatacaaaccgctgtgatgcctaatggaacccctcaccccacagcagcgatcgtgccaccaggacctgaggccggactcatttatacgccctatgaatacccatataccctggcccctgccacgagcatccttgaatatccaatcgagcctagtggggtgcttggggctgtggccacaaaggtgagaagacatgacatgcgcgtacacccttaccagcggatcgtgacagctgatcgcgctgccactggaaattag

SEQ ID NO: 53296 - DNA, 1026 bp, Artificial Sequence
  Description of Artificial Sequence: Synthetic coding sequence
atggtgggagagatggagactaaggagaaacctaaaccgacgcccgactatttgatgcagttgatgaatgacaaaaagctgatgagtagcctccccaacttctgtggcatcttcaaccacctcgagcgcctgcttgatgaggaaatatcacgggtcaggaaagatatgtataatgacactttgaatggcagcaccgaaaagcggtctgccgagctacccgacgccgtgggaccaatcgttcagctgcaagaaaagctgtacgttccggtcaaggaatatccagactttaacttcgtggggcgtatcttaggccctcgcggtctgacagcaaaacagctggaggctgagaccggctgcaagatcatggtccgcggtaagggcagcatgcgtgacaagaaaaaggaagagcaaaatcggggaaagccaaactgggagcacctgaacgaagatctgcatgttctgataaccgtggaagacgcccagaaccgggctgaaattaagcttaaaagggccgttgaggaagtcaagaaattgctggtccctgcagctgaaggtgaggattccctgaagaagatgcagctgatggagctggcaattctaaacggtacctaccgcgacgcgaatataaagtctccagccctggctttctctctggcggctacagcgcaagctgcgccaagaatcatcaccggtccagcccctgtgcttcctcccgctgctcttcgcacccctaccccagctggtccaaccatcatgcccttgatcaggcagatccaaacagctgtcatgcccaacgggacacctcacccgacagccgcaatcgttcccccaggccctgaggcaggccttatctatacaccgtacgagtacccttacacacttgctccagcaacctcaattctagagtaccccatcgaaccctccggtgtgcttggggcagtcgcaacaaaagtccgccgacatgacatgcgagttcatccgtatcagcgcatcgtaactgcggacagagcggcaaccggcaattag

SEQ ID NO: 53297 - DNA, 960 bp, Artificial Sequence
  Description of Artificial Sequence: Synthetic coding sequence
atggtgggagaaatggaaacaaaggaaaagccaaaaccaaccccagattacctcatgcagttgatgaacgacaagaagcttatgagttccctgcctaatttttgcggaatatttaatcacctggaacggctgctggatgaagaaattagccgtgtcagaaaagacatgtataacgacaccctgaacgggtccacggaaaaacgcagcgcagaactcccagacgccgtgggtccaattgtacagttacaggaaaagttgtacgtaccagtgaaggaataccccgacttcaactttgtgggacgcatcctaggcccaaggggcctgaccgccaaacaattggaggccgaaaccggctgtaaaataatggtgcgcggaaaaggctccatgagggacaagaaaaaggaggagcagaacaggggcaaacccaattgggaacatttgaacgaggacctgcacgtactgatcacagtagaggatgctcagaaccgagccgaaatcaaactgaaaagagctgtagaggaggtcaaaaaattgctggtcccagccgcagaaggcgaggatagcctgaaaaagatgcagctgatggagttagctatcctgaatggcacttatagagatgccaacattaagtcaccagccctcgccttcagtttagcagcaactgcacaagccgcacctcgtatcattaccgggcctgccccagtgctgcccccagctgctctgaggacaccaactccagcaggacctaccatcatgccactcattcgccaaatccaaaccgctgtcatgcccaacgggaccccccaccctacagccgctattgtccccccaggtcctgaggcgggactgatctatacaccatacgaatatccttacactctcgcacccgctacctccatcttagagtacccgattgagccatccggggtgctgggaaaatttttcagcccttggggctag

SEQ ID NO: 53298 - DNA, 960 bp, Artificial Sequence
  Description of Artificial Sequence: Synthetic coding sequence
atggtgggcgagatggaaactaaagaaaaacctaagcctacacctgattatcttatgcagctgatgaatgacaaaaaactgatgagctccctccctaatttttgcggcatcttcaatcatctggaacggctgttagacgaggagatatctcgggtgagaaaagacatgtataacgatacactgaacggtagtaccgagaaaaggtctgcagagcttccagatgcggttggccctatcgtgcagcttcaggaaaagctatacgtgcccgtgaaggagtaccctgactttaacttcgtgggaagaattttgggcccacgtggactgaccgctaaacagctggaagctgaaaccgggtgcaaaatcatggtgcgtggaaagggctcaatgagggataagaagaaggaggagcagaataggggaaaacccaattgggaacatcttaatgaagacctccacgttttaattaccgtggaagatgcccaaaatcgtgcagaaattaaactaaagcgagcagtagaggaagtgaagaagctgctcgtgcccgcagcagaaggtgaggatagcctaaagaaaatgcagttgatggagctcgccatcctcaacgggacctacagagatgccaatattaaatcccctgccctcgcttttagtctggctgccaccgcccaagcagccccaagaatcatcaccggcccagcaccggttctcccaccagctgcactacggacacctacgccagccggaccgacaatcatgcctctgattcgccagatccagacggctgtgatgccaaacggaaccccacatcctaccgcagccatcgtgccgcctgggcctgaggctggtttgatatacacaccctacgaatatccctacacactcgcccctgccacgtctatcctggagtatcccattgagccctcaggcgtcctgggtatggccttcccaacgaaaggatag

SEQ ID NO: 53299 - DNA, 1137 bp, Artificial Sequence
  Description of Artificial Sequence: Synthetic coding sequence
atggtggattacagcgtgtgggaccatatcgaagtttcagacgacgaagatgaaacacacccaaatatcgacacagcttcattgttccgctggagacatcaggcaagagtcgagcgtatggaacaattccagaaggagaaggaagaactggaccgcggatgtcgggagtgcaagcggaaagttgctgagtgccaacgcaagctgaaagaactggaggttgccgagggtggaaaagctgagcttgagagacttcaggccgaggctcagcagctcaggaaagaagagcgttcttgggagcagaaactggaagagatgcgcaaaaaagaaaagtctatgccttggaacgtggacacattgagcaaggacggcttttctaaatccatggtaaacactaagcccgaaaaaactgaggaagattcagaggaggttagagaacagaagcacaaaacatttgtggagaagtacgagaagcagattaagcacttcggaatgctgagacgctgggatgactctcagaagtacctgtctgacaatgtacacctggtgtgtgaagagacggcaaattacctggtgatttggtgtattgacctggaagtggaagaaaaatgcgcgctgatggagcaggtcgctcaccaaactatcgtcatgcagtttattttggaattggcgaaatctcttaaggtggatccccgagcctgctttcgtcagttcttcacgaaaatcaagacagccgatcgacagtatatggagggctttaacgatgaactcgaggcctttaaagagcgagtccgtgggcgagcaaaactccgtatcgagaaggcaatgaaggagtacgaggaggaggaacggaaaaagcggctcggacccggagggctcgatcccgttgaagtgtacgagtcgttacccgaagagcttcaaaaatgtttcgatgtgaaggatgtgcagatgctccaggatgctatcagcaaaatggaccccactgacgccaagtaccacatgcagaggtgtattgatagcggactctgggtgccaaatagcaaggcatcagaggccaaagagggcgaggaagccggtccaggggatcctctactagaggcggtcccaaaaacaggagatgagaaggatgtatccgtgtag

SEQ ID NO: 53300 - DNA, 1962 bp, Artificial Sequence
  Description of Artificial Sequence: Synthetic coding sequence
atggccctggtccgaggggctgaaccagccgctggcccatcgcgatggctccccacccacgtccaggttactgttctgcgcgctcgcggactacgtggtaaaagctccggcgcagggagcactagtgacgcttacactgttattcaagtgggacgggaaaaatacagtaccagtgtcgtcgaaaagacccacgggtgtcctgagtggagggaggaatgcagctttgaactccctccgggagccctggatgggctgctgcgtgctcaggaggccgacgctggacctgctccatgggcggcatcttctgccgcagcttgcgaactagtactgacaaccatgcacagaagtcttatcggcgtggacaagtttcttgggcaggcgactgtggcgctggatgaagtgtttggcgcaggacgagcccaacatactcagtggtacaagctacactccaaacccggaaagaaggagaaggagcggggagagattgaagtgacaatccagtttactcgcaataatcttagtgcatctatgtttgacctatccatgaaagataagccacgtagccctttcagtaagataagggataaaatgaaggggaaaaaaaaatacgacctcgagtcggcttctgcaatactgccttcttctgctatagaggatccagatcttggttctctcggcaaaatgggcaaggcgaaaggatttttcttgaggaacaaattgcggaagagctccttgacccagtcaaatacttccttggggtccgattccaccctaagctcggcatctgggagcctggcatatcagggaccaggcgctgagttgttgacccggtctccctcccgctccagttggctgtccacagagggaggcagggactccgcacaaagtcctaagctgtttacccacaagcggacctattcagacgaggccaatcagatgcgtgttgcccctcccagagccctgctggacctccaagggcacctggacgcagcttccagatcctccttgtgcgtcaacggctctcacatctacaacgaggaaccacagggccctgtccgccaccgcagcagcatttctggaagtctgcctagcagcggcagcctccaagcagtgtcttctagattcagcgaagagggaccccgatccactgatgatacttggcccagggggtcacgcagcaacagcagtagtgaggccgttctcggacaggaggaactctccgctcaggccaaagttcttgcacctggcgcttctcacccaggtgaggaggagggcgcacggctaccagaggggaaacccgtgcaggtggccactcccattgtcgcctcctctgaagctgtggccgaaaaagagggtgctcggaaggaggaaagaaagcccaggatgggcctgttccatcaccaccatcagggcctcagcaggtccgagctcggacggaggtctagccttggagaaaagggtgggccaatattaggagctagtccgcaccacagctccagtggggaggaaaaggcaaagtctagttggtttggcttgagggaagcaaaggacccaacacagaaaccttcaccacatcctgtcaaaccattgtccgccgctcccgtggaaggttcccctgaccgaaagcagagccgttcgtccctctctatcgcgttgagctcgggcctcgagaaactgaagaccgtgaccagtggttcaattcagcccgtgacacaggccccacaggcagggcagatggttgacacgaaacggctgaaagactccgcagttctcgatcaatccgctaagtattaccacctgacacacgacgaattaatttccctgctcttgcagcgggagcgtgagctaagccaaagagacgagcacgtccaggagttagagtcttacattgatcgattgctggttagaattatggaaacgtctccaacactgctgcagatccccccaggaccacctaaatag

SEQ ID NO: 53301 - DNA, 657 bp, Artificial Sequence
  Description of Artificial Sequence: Synthetic coding sequence
atgggaacccgtgacgatgagtacgactacctgtttaaagtagttctgatcggggactccggggtgggtaagtccaacttactgtctagattcaccagaaacgagttcaatctggagtccaaaagcactataggagtggaatttgcaacacgatccatccaagtggatgggaagaccatcaaagcccagatctgggataccgccggacaagagaggtaccgggctatcacctccgcctactatcgaggcgctgtcggagcattattggtctatgacatagccaagcacctcacctacgaaaatgtcgaacgttggctaaaggagttgcgggaccacgccgacagcaacatcgtgatcatgctcgttggaaataaaagcgatctgcggcacctgcgagcagtgcccactgatgaagccagagcattcgcggagaagaacaatcttagttttatagaaacctctgccttggacagcactaatgtcgaggaagcctttaaaaacatcctgactgagatctacaggattgtgtcccagaagcagattgctgatcgggctgcccatgatgagagtccaggcaacaacgtagtagatattagtgtgccgccaacaacggatggccagaagcccaataaactgcagtgctgtcagaacctctag

SEQ ID NO: 53302 - DNA, 627 bp, Artificial Sequence
  Description of Artificial Sequence: Synthetic coding sequence
atggctaagcagtatgacgtgctgttccgactgctgctgatcggcgatagcggtgtgggtaagacgtgtcttctttgcaggttcacagacaacgaattccactctagccacattagtacgattggagtggatttcaaaatgaaaactatcgaggtcgacggcataaaagtacgcatacagatatgggacacagcgggacaggaaaggtatcagacaatcacaaagcagtactatcgccgtgcccagggtatttttctagtttatgatatctcaagcgagagatcctatcaacatattatgaaatgggtgagtgacgttgacgaagtaggggatgccacctccctgcccggatgcggtgagggggctagccctggaaaggcccgtcgaggcccagatggaaaagccaatgcatcccggaagttatgcctgcctcagccctggatgaagaccagcggaacccaccagaaggcatcaaggaggagtctgcttggtattcgactcatgagaagccgcaacggcaggtgggaggagagcaagggctctagttggagaaggagcatggcctggactagcatgaagcaggtacccgctcctacaagcacactcaaatcccattcccgggtttag

SEQ ID NO: 53303 - DNA, 639 bp, Artificial Sequence
  Description of Artificial Sequence: Synthetic coding sequence
atggcaaagcagtacgatgtactatttcggctattgctcattggtgacagtggtgtgggaaaaacctgtcttctgtgtcgattcactgataacgaattccactcgagccatatttccaccatcggggtcgatttcaagatgaagactatcgaggtggacggcatcaaggtccgaatccagatctgggacaccgccggtcaggaacgctatcaaacgatcaccaagcaatactatagaagggcacaggggatcttcctcgtgtacgatatatcatctgagcgcagttatcagcacatcatgaaatgggtatccgatgtcgacgagtacgctccagagggtgtacagaagatactgatcggcaacaaggcagacgaggaacaaaagcggcaggtaggtagggagcaggggcaacagcttgccaaggaatatggtatggatttctacgaaacatccgcatgtacaaacttgaatattaaggaatctttcacaagacttacagaactcgtgctacaggctcatcgcaaggaacttgaaggcctgagaatgcgggcaagcaatgagctggctctcgcagaattggaggaggaagagggtaaaccagaaggccctgccaattccagtaaaacgtgttggtgttag

SEQ ID NO: 53304 - DNA, 795 bp, Artificial Sequence
  Description of Artificial Sequence: Synthetic coding sequence
atgcactttagctcctccgcccgtgccgctgacgagaactttgattacctttttaagattatcctgattggtgatagtaacgtgggaaaaacatgcgtggtgcaacactttaaaagcggtgtatacacggagacccagcagaataccatcggcgtggattttactgtccgctcattggacattgacgggaagaaagtcaagaactccagtgcaagcattataacgtttgcctcaatccagattcacggacaaacacagaagatgtccccacagatctggacaaaatcttcgcattacctctgggagccactgatctggaccttgttgcccgtgcttctgcagatgcaggtatgggatactgcaggtcaggaaaggttcagaaccatcacacagtcatactaccggagtgcccacgcggctattattgcatatgatctcacacgcagaagcacatttgagtccattccacactggattcatgagattgagaaatacggcgctgcgaatgttgtcatcatgttgattggcaataagtgcgacctgtgggaaaaacgccacgtgctcttcgaagatgcatgcactctcgccgaaaagtacggcctgctcgccgtgttagagacctctgccaaggaatccaagaacattgaggaggtcttcgttctcatggctaaggagctgatcgcgagaaatagcctgcatctgtacggggagtcggcgcttaacggattacccttagatagctcccccgttctgatggcgcagggcccttccgagaagacccactgcacatgttag

SEQ ID NO: 53305 - DNA, 654 bp, Artificial Sequence
  Description of Artificial Sequence: Synthetic coding sequence
atgcacttctcaagttccgcgagggcagccgatgaaaacttcgattacttgttcaagataatcctcatcggggacagtaacgtagggaaaacttgtgtggttcagcacttcaaatctggagtgtacaccgagacccagcagaataccatcggagttgattttaccgtccgcagtctggatattgatggcaaaaaagtgaaaatgcaggtctgggatacagcgggacaggaaagatttcgcaccattacacagtcctactaccgcagcgctcacgccgcaatcattgcttacgacctaacccggagatcaacattcgaaagcatccctcactggatccacgaaattgagaaatacggagcggctaacgtggtcataatgctgatcgggaataagtgtgacttgtgggagaaaagacatgttttgttcgaagatgcatgtaccttggccgagaaatacggcctcctggccgtgttggagacgtcagcgaaagagtcaaagaacattgaggaggtttttgtgttgatggccaaggagctaatcgcgaggaattctttgcatctgtatggagagtcagctctgaacggactgcccctggactctagcccagtgctgatggcccagggcccatcagaaaaaacacactgtacctgttag

SEQ ID NO: 53306 - DNA, 450 bp, Artificial Sequence
  Description of Artificial Sequence: Synthetic coding sequence
atgcacttcagctcatccgcccgtgccgcagatgaaaactttgattatctctttaagattatcctcataggggactccaacgtcggaaaaacctgtgtggtccaacatttcaaaagcggggtatataccgagacacaacagaataccatcggagtggattttacagtgcggtctctggacatcgacggcaagaaggtgaagatgcaggtttgggacacagccggtcaggaacggtttcgaactatcacacaaagctattaccgtagcgcccatgcagccatcatcgcctacgacctcactcgcagaagcacatttgaatcaatcccccactggatccatgagatcgaaaaatatggcgcagctaacgttgtcatcatgctcatcggaaacaaatgtgatctgtgggagaaacgacatgtacttttcgaagatgcatgtaccttggcctag

SEQ ID NO: 53307 - DNA, 654 bp, Artificial Sequence
  Description of Artificial Sequence: Synthetic coding sequence
atgcacttcagctcctcagccagagctgccgatgaaaacttcgattacctgttcaaaatcattctgataggtgacagcaacgtgggcaagacatgtgtcgtccaacattttaaatctggcgtgtatacggaaacacagcagaacaccatcggcgttgatttcacagtgagatccctggacatcgacgggaaaaaagtaaaaatgcaggtctgggacacggccggtcaagagcgtttcaggactattacacagagttattacagatcagcccatgccgcaatcattgcgtatgatctaaccagacggtcaaccttcgagtcaatcccccattggattcacgaaatagaaaagtacggcgcagcaaatgtcgtgataatgcttattgggaacaagtgcgacttgtgggaaaagagacacgttctctttgaagatgcctgcactctggccgagaagtatggactcctcgcagttctcgagactagtgcgaaagaatccaagaatatcgaggaagtgtttgtgctcatggctaaggagcttattgcacgaaacagcttacatctgtatggcgagagcgcactgaacgggctgcctttagactcttcccccgttctgatggctcaaggcccaagtgagaagacgcactgcacttgttag

SEQ ID NO: 53308 - DNA, 705 bp, Artificial Sequence
  Description of Artificial Sequence: Synthetic coding sequence
atgagaaagcctgacagcaaaatcgttcttctcggggacatgaatgtcggaaaaacgtccctcctgcagaggtatatggaaaggcggttcccggatacagtcagcactgtggggggagccttctacctgaagcagtggagaagctacaatatcagcatttgggataccgccggaagggaacaattccacggattgggaagtatgtattgtcgcggtgccgctgccatcattctgacctacgacgttaatcaccgccagtccctggtggagctggaggataggttcctggggctcaccgataccgcctcaaaggattgcctatttgcaattgttggtaataaggtggatctgacagaggagggcgcacttgcagggcaagagaaggaagaatgcagtcccaacatggatgccggtgacagggttagtccacgagctcccaaacaagttcagctagaggacgccgtggccctgtacaagaagatacttaagtacaagatgctggacgaacaagatgtgcctgcagctgaacagatgtgttttgaaacgtctgccaaaactgggtataacgttgacctgctttttgaaactttgttcgatctggtggtgccaatgatactgcagcagcgagcggaacgcccatctcatacagtggacatcagtagccacaagccgccaaagcgaacacgtagtggatgttgtgcctag

SEQ ID NO: 53309 - DNA, 657 bp, Artificial Sequence
  Description of Artificial Sequence: Synthetic coding sequence
atgaccgatggtgactacgactatcttattaaactactggccctgggcgactccggagttggaaaaaccaccttcttatacagatacaccgacaataagttcaaccctaaattcatcactaccgtcggcattgatttccgggagaaacgggtggtgtacaatgcccaaggaccaaatggatcaagtggtaaggcattcaaagtgcacctgcagctctgggacaccgccggtcaggagcgattcaggtcacttaccaccgctttcttcagagacgcgatgggattcctccttatgttcgatctcacgagccaacagagctttctgaatgttaggaattggatgagccagttgcaggcaaatgcctactgtgaaaaccccgatatcgtcctgatagggaacaaggccgatcttccagatcagagagaagtcaacgaacgtcaagcgcgagagctggccgataagtatggaataccgtactttgagacgtccgccgctacaggacagaatgtcgagaaagcagtagaaacactattggatttgatcatgaagcgcatggaacagtgcgtcgaaaaaacacagattccagatacggtgaatggcggaaactccgggaacttggatggcgaaaagccaccggaaaagaaatgtatttgctag

SEQ ID NO: 53310 - DNA, 654 bp, Artificial Sequence
  Description of Artificial Sequence: Synthetic coding sequence
atggagacaatttggatttaccaattcagacttatcgttatcggggacagtacggtgggaaagtcctgtctgttacaccgtttcactcagggcaggttccccggactgaggagtcccgcttgcgatcccaccgtgggagtggacttcttttcaagactccttgaaattgagccgggtaaacggataaagctgcagctctgggataccgccggtcaagaacggtttcggtccattacccgatcatactaccggaattctgtgggcggattccttgttttcgacatcacaaaccggcgaagctttgagcacgttaaggattggctcgaagaagccaagatgtatgttcagccatttcggatcgttttcctcctggttggtcataaatgcgacctggcctcgcagagacaagtcacacgggaggaagctgaaaaactaagcgcggactgtggtatgaagtatatcgagacgtccgctaaagacgccaccaacgttgaggagtccttcaccatcctgacgcgggacatttacgagctgattaaaaaaggcgagatctgcatccaagacggctgggagggagttaagagtgggttcgtccccaacacagtgcattccagcgaagaggcagttaagccccgtaaggaatgcttctgttag

SEQ ID NO: 53311 - DNA, 1737 bp, Artificial Sequence
  Description of Artificial Sequence: Synthetic coding sequence
atgaggcagcaggacgcaccgaaaccaactcccgctgcctgccgttgttctggattggctaggagagtattgactattgcatttgccctgcttatcctgggactcatgacctgggcttacgcagccggagtgcccctggcgtctgaccgttacggactcttagctttcggcctttacggagcttttctgagcgcccacctcgttgctcagtcgcttttcgcgtatctggagcaccgccgagtcgccgcagcagctagagggcctcttgacgcagcaacggcacgcagcgtggcgctcacaatctccgcttaccaggaagacccagcttatctgcggcagtgcctcgcctcagcacgtgccctgctttatcctcgcgcacggcttagagttctcatggttgtggacggaaatcgcgctgaggacctctacatggttgacatgtttcgagaagtatttgctgacgaggacccagctacttatgtgtgggatggcaactatcaccagccctgggagcccgctgcagccggagccgttggcgcaggcgcttatcgcgaggttgaagcggaagatcccggtagactggccgtcgaagctcttgtcagaacccgtaggtgtgtgtgtgtggcccaacgttggggcggaaagagggaagtgatgtacaccgcgtttaaagctctcggcgactcagttgattatgtgcaggtctgcgattcagatacacgcctcgatcctatggctctgctggagctcgtgcgggtgttggacgaagacccacgcgtgggtgccgtcgggggtgacgtaaggattctgaacccactcgacagctgggtgtctttcctaagttctctgcggtactgggtggccttcaacgtggagagagcttgccagagttattttcattgtgtgtcatgcataagcggtcctcttggactatataggaacaacctgctgcagcagtttctcgaggcctggtacaatcagaagttcttaggaacccattgcactttcggtgatgatcggcatctcactaatcggatgttgagtatgggatacgctacgaaatacactagcagaagccggtgctactccgagacgccgtcctcttttctgaggtggctgagccagcagactaggtggagtaaaagttacttcagggagtggctctacaatgctctatggtggcaccgccatcacgcttggatgacatatgaagccgtggtcagcgggctgttccccttcttcgtcgccgctactgtgctgcgcttgttctacgcaggtaggccatgggccttgctgtgggtgctcctatgcgtgcagggcgtagccctggcaaaagccgcattcgctgcctggctcagaggctgtctgcgtatggtcttgcttagcctctatgcacccctgtatatgtgtggcctcctccctgcaaaatttcttgccctcgttacaatgaatcagagcggatggggtacgtctggcaggagaaaactcgccgcaaactacgtcccattgttaccattagcactgtgggccctgctccttctcgggggactcgtccggtcggtggctcacgaagccagggcggactggtctggcccttcaagagcggctgaggcctaccatctcgctgccggtgcaggagcctatgttgggtattgggtggccatgctgaccttgtattgggtgggggtccgtcgcctgtgccggagacgcactggcggatacagagtgcaggtttag

SEQ ID NO: 53312 - DNA, 834 bp, Artificial Sequence
  Description of Artificial Sequence: Synthetic coding sequence
atgtccgctcctggctcccctgaccaggcctacgatttcctccttaagttcctgctggtgggagatcgtgacgtgggcaaatcagagatcttagaatccctacaggacggcgctgcagagagtccttattcccatctgggaggcattgattataaaaccactacaatcctattagatggccaaagggttaagctgaagctatgggatacctccggccaaggacggttctgcaccatttttcgttcatactcccgaggtgcgcaaggtgtcatattggtgtatgacatcgctaataggtggtccttcgagggtatggaccgctggattaagaagattgaggaacacgcaccaggagttcccaagatcctcgtgggaaacagactgcacctggccttcaaacgccaggtgccccgagagcaggcacaggcatatgcagagcgcctgggtgtgacttttttcgaggtgtctcctctgtgtaatttcaacatcatagaatccttcactgaactagcgcgaatcgtcctcctccgacacaggatgaactggctggggagaccatctaaggtattgtcactgcaggacctgtgttgcaggactattgtgagctgcacgcctgtccatctggtcgacaagctcccgttgccgtccactctaaggagtcacctaaagtccttttctatggctaaagggctgaacgccagaatgatgcggggactatcatactccttaacaacctctagcactcataaaagctctttgtgcaaagtggaaatagtttgtccccctcagtctccaccaaagaactgtactcggaattcctgtaaaatttcctag

SEQ ID NO: 53313 - DNA, 834 bp, Artificial Sequence
  Description of Artificial Sequence: Synthetic coding sequence
atgagcgctccaggcagtcccgatcaggcgtacgatttcctcctgaagttcttactggtgggtgacagagacgtaggcaagtccgagatattagagtcattgcaggacggtgcagccgagagcccctactctcacttgggaggtattgattacaaaacaactacgatcctgctcgacggacagcgcgtcaaactcaagctctgggataccagcggccaggggagattttgtacaatcttccggtcgtacagccggggagctcagggggtcatcttagtctatgacatcgccaatcgttggtcattcgaaggcatggaccggtggattaagaagatcgaagaacacgccccaggtgtccccaaaattttggtgggaaacaggctgcatctggccttcaaacgacaggtccctcgggaacaagctcaggcttacgctgaacgcttgggagtgacttttttcgaggtctcaccactttgtaatttcaatatcattgagagctttacagaactggctaggatagttttgctacggcaccggatgaactggctggggaggcctagtaaagtgctgtccttacaggacctgtgttgccggactatagtgtcttgcactccagtgcatttggtggacaagctcccgcttccctctacactgcgctctcacctgaaaagcttcagcatggcgaaaggcctgaatgcccgtatgatgcgaggcctctcttactctctaactacatctagcacccataagagttcactgtgcaaggttgaaattgtctgcccaccacagtcccccccaaaaaattgcacgcgtaattcatgcaagatatcatag

SEQ ID NO: 53314 - DNA, 837 bp, Artificial Sequence
  Description of Artificial Sequence: Synthetic coding sequence
atgtccgccttgggatcacctgtgagggcctatgatttcctgcttaagtttttgctggttggcgactcggatgtgggcaagggcgagatcctggcctctctacaggatggagctgccgaaagcccctatggacaccctgccggaatcgactacaagacaacgacaatcttgctggatggaaggagggtgaaactgcaactgtgggatacaagtggccagggtcgcttttgcaccatcttcagatcatatagtagaggggcacagggagtgattttagtgtatgacattgccaaccgatggtccttcgatggcattgaccggtggattaaagagattgacgagcacgccccaggtgtccccaagatactggttggtaatcgtttacacctggccttcaaacgccaagttcccactgaacaggcacaggcctatgcggaacggctgggcgtgacatttttcgaggtcagcccgctctgcaacttcaacataactgagtcatttacagaactggcccgaattgtcctgctgcgtcacggaatggaccggttgtggaggccttcgaaggtattgtctctccaggacctgtgttgccgggctgtggtctcctgtacgcccgtgcatcttgtggacaagttgccgttacccatagcgctccgctctcaccttaaaagcttcagcatggcgaacgggttgaatgctcgcatgatgcacggagggtcctactcgctcacaacttcctctacacacaaacgctcttcactgcgtaaagtgaaattggtgagaccgccacagtcacctccaaagaactgcaccaggaatagctgcaagatctcctag

SEQ ID NO: 53315 - DNA, 837 bp, Artificial Sequence
  Description of Artificial Sequence: Synthetic coding sequence
atgagcgcgctcgggtcacccgtaagggcctacgattttctgctcaaattcctgctggtcggcgacagcgacgtggggaaaggagagatcctcgccagcctgcaggacggggcagcagaaagcccgtatgggcaccctgctggcatcgactacaaaacgaccaccatcctcttagacggtagaagagtaaagctccaattatgggacacgtctgggcaggggaggttttgcacaattttccggtcttacagtcgtggagcccagggggtgattttggtgtacgacatagctaaccgttggtccttcgatggaatcgacaggtggattaaagaaattgacgaacacgcgcctggcgtccctaagatcttggtcggaaacaggttgcatcttgcatttaaaaggcaagtccctaccgagcaggcacaggcctatgccgaaaggctgggggtgactttcttcgaggtcagtccactctgtaacttcaatatcaccgagtcatttacagagctggcaagaatcgtgctccttcgccacggaatggatcggctttggaggccaagcaaagtactaagcctacaggacttatgctgccgggctgtcgtgagctgcactcccgtgcacctagtcgataagcttccactcccgattgctctaaggtcccatcttaagtccttctcaatggctaacggtctgaacgcaaggatgatgcatgggggatcgtatagcctgacaaccagctccactcacaagcggtcatctctgcgtaaggttaaactcgtaaggccaccacagagcccacctaagaattgcacgaggaacagttgcaagatttcatag

SEQ ID NO: 53316 - DNA, 1140 bp, Artificial Sequence
  Description of Artificial Sequence: Synthetic coding sequence
gaacaaggcctgggggcacgagcggcacctctgggagcagggccacctccactccgcagcgctcctcaagcaggacatggatgggggcgtcgagcggtgacaatgtctgcccttggatccccagtgcgggcttacgacttcctcttaaaatttctgttagtaggcgactccgatgtgggaaagggagagatcctggcctccttacaggacggagccgcagagagtccctacggtcaccctgcaggtattgattataaaactaccacaattttactcgacggtcgcagagtgaaactccagttgtgggacacctccgggcagggtagattctgtactattttccggtcctactcaagaggtgctcaaggtgtgatccttgtctatgatatcgcaaaccgctggtcttttgatggtatcgaccgctggataaaagaaatcgatgaacacgcccctggagtgccgaaaatcctcgtgggcaacagactgcatttggcttttaaaagacaggtgccaacagaacaggctcaggcgtatgccgaacgcctaggcgtaacattcttcgaagtgagtcctctttgcaattttaatatcactgaaagtttcaccgagctggcgagaatcgtgctcttacggcacggcatggaccgactgtggcggcctagcaaagtgttgagcctacaggacctttgctgtagagccgtagtatcatgcacacctgtgcatctggtcgacaagctccccctgccaatcgccctgcgcagccaccttaagtccttcagcatggcaaacggactgaatgccagaatgatgcatggaggaagctacagcctcactacctcaagcactcataaacggtcatcactcaggaaggtgaagctggtccgtccccctcagccccctcaaaagctgcaccagaaacagctgcagaatttcttgcggaaagctcttaaagagacccgaagaaatttgtccagaaggtcatccgcccttccaccagccgcaggaggctgcatctcagacccaggaagcagcagaagaatgttgctggcaaacgtgtgcgacgcatttcgagtcatggaaacgcattacccagtcggccttcgcattagcacttggatgtgtatgaagctgctcttttag

SEQ ID NO: 53317 - DNA, 846 bp, Artificial Sequence
  Description of Artificial Sequence: Synthetic coding sequence
atggggtcccaagggagcccagtgaagtcttatgattacctcctgaagttccttttggttggcgatagcgatgtcggaaaaggcgagatcctcgaatcgctgcaggacggcgcagcggagagcccatatgcctactccaacggtatcgactataagactaccacaatcctcctcgacggcagacgggtgaagttggaactgtgggacactagtggccaggggagattttgtacgatctttaggtcttatagcaggggagcccagggtattctgctcgtgtatgacattacaaacagatggtcattcgatggaatcgatcggtggatcaaagagatagacgagcacgctccgggtgtccccaggatcctcgtcggaaaccgcttacatttggcattcaaaaggcaagtcccgaccgagcaggccagggcttacgccgagaagaattgtatgaccttcttcgaggtgtcacctctctgtaattttaatgtaattgagtctttcactgagctcagccggattgtcctgatgaggcacggaatggaaaagatatggaggcccaaccgtgtattttcactgcaggatctgtgttgtagggctatagtatcttgcacgcctgtccacctgattgataagttgcctctgcctgtgaccatcaaatctcacttaaagtctttttctatggccaatgggatgaacgctgtcatgatgcacggcaggagctatagtctggcaagtggcgctggcggtgggggaagtaaaggaaatagtctgaagcggtctaagtcgattcgacctcctcagtcgccaccccaaaattgcagccgctccaactgcaagatctcttag

SEQ ID NO: 53318 - DNA, 846 bp, Artificial Sequence
  Description of Artificial Sequence: Synthetic coding sequence
atgggaagccaaggctccccagtcaaaagctacgattacctgctgaaatttctattagtgggagattccgatgtgggcaaaggcgaaatccttgagtctctccaggatggtgccgctgaatcaccttacgcatattctaacggaatcgattacaagacaaccactatcttactggatggacgccgtgtcaagctcgaactgtgggacaccagcgggcaaggacgattctgcaccatctttcgctcctactctcgcggagcccaaggaattctgctggtgtacgacatcactaaccgatggtcgttcgacggtattgatagatggataaaggagatcgacgagcatgctcctggggtgccgagaatcttggtcggaaaccggttgcatttagccttcaagaggcaggtgcccaccgagcaggccagggcatatgctgagaagaactgcatgactttctttgaggtgagccccctgtgtaacttcaacgtgatagagtcctttactgagttgtcgcggattgtgctcatgagacacgggatggagaaaatatggcgcccaaaccgcgtgttcagtctccaggacctctgttgccgggctattgtaagctgcacccccgtgcacctcatcgacaagcttcctttgcccgtgaccatcaaaagtcatctcaaaagcttcagcatggcaaacggcatgaatgccgtgatgatgcatggaagaagctatagcctagcatccggcgcaggtggcggaggcagcaaggggaacagtctcaagagatctaagtctatccggcctccacagtcaccacctcaaaactgtagccgatccaattgcaagatcagctag

SEQ ID NO: 53319 - DNA, 846 bp, Artificial Sequence
  Description of Artificial Sequence: Synthetic coding sequence
atgggttctcaaggaagccctgtaaaatcttatgactacctgttaaagtttttgctggttggggacagcgacgttgggaagggcgagatcctcgagtctttgcaggatggcgcagcagagtccccgtacgcctatagtaatggtattgactacaaaacaacaaccattctacttgacggtcggagggtcaaacttgagctatgggatacatctggacaagggcgtttctgcacaatttttagatcttattccagaggggctcaggggatccttctggtgtacgacatcacaaacaggtggagcttcgatgggatcgaccgctggatcaaagaaatcgatgagcatgctccaggcgttccgagaatcctcgtgggcaacagactccacctcgcctttaagcggcaggttcccacggaacaggcacgcgcatacgccgagaaaaactgcatgaccttttttgaagtcagtccactgtgcaacttcaatgttatcgagtccttcacggagttgagcagaattgtcctgatgagacatggcatggagaagatatggcgtccaaacagagttttctcactccaggatttatgctgccgagctattgtcagttgcactcctgttcacttgattgacaagctgcccctcccagtgactattaagagccaccttaaatctttttcaatggccaacggcatgaacgcagtgatgatgcacgggcgaagctactccttggccagtggcgctggagggggagggtctaagggcaacagcttgaagaggtccaaaagcattcggccaccacagagcccacctcagaactgcagcagatctaactgcaaaatcagctag

SEQ ID NO: 53320 - DNA, 846 bp, Artificial Sequence
  Description of Artificial Sequence: Synthetic coding sequence
atgggcagtcaagggtctccggtgaagtcttatgattacctccttaaattcctgctagtcggggacagtgatgtgggaaagggagaaatcttggaatcactgcaagatggcgctgccgagtctccatacgcttatagtaatggcattgactacaagaccaccactatccttctggacggtcgaagggtcaagctggaactttgggatacttctggacaaggcagattctgcaccattttccggtcttactctcggggagctcagggcatacttttagtgtatgatattactaatcggtggagctttgacgggatcgaccggtggataaaagagatcgacgaacacgccccaggcgtgcctcggatcctggtgggcaatagactccatctggcgttcaaacgccaggtccccactgagcaggctcgcgcttacgccgagaagaattgtatgacatttttcgaggtaagccctctgtgtaattttaacgtgatcgagtcatttactgaactatcccgaattgtgctgatgagacatggcatggaaaagatttggaggccaaatagggtgttttctctacaggacctgtgttgtcgggcaatcgttagttgcactcccgtgcacttgatcgacaagttgcccctccccgtaaccataaaatcacaccttaagtccttttctatggctaacggcatgaacgcagtcatgatgcacggtcgcagctattctcttgcctctggagccggaggcggtgggtcaaaaggaaattcactgaagaggtcaaaaagtattcggcctccccagtcccctccccagaattgcagtcggtctaactgtaagattagctag

SEQ ID NO: 53321 - DNA, 468 bp, Artificial Sequence
  Description of Artificial Sequence: Synthetic coding sequence
atggctgggccaggacctggtcctggagatcctgacgagcagtatgactttctattcaagcttgtgcttgtcggagacgcaagcgtagggaaaacctgcgttgtgcagaggtttaaaacgggcgctttttccgaacggcaggggtcaacgatcggcgtggattttactatgaaaacgctcgaaattcagggcaaaagagtgaaactgcaaatttgggacaccgcaggccaggagcgtttccgcacgattacccagagttactacagaagcgctaacggagcaatcctggcctatgacatcacgaaaaggtcctcctttctgtctgtcccacattggatagaagacgtccgcaaatatgcagggagtaacatcgtgcaactgctgatcgagatgcagtcctgttacgttgcacaggccgatctggagcttctagcatccagtaacccacctgccagtacttccaaatag

SEQ ID NO: 53322 - DNA, 639 bp, Artificial Sequence
  Description of Artificial Sequence: Synthetic coding sequence
atggccggtcctggccctggccctggcgaccccgacgagcagtacgacttcctgtttaaattggttctggtgggtgacgcctccgttggaaagacctgtgtcgtgcagcggtttaagactggagccttctctgagaggcagggatcaacaatcggagttgacttcactatgaagaccctggaaattcaggggaagagagttaagctgcagatttgggatacagccggtcaagaaaggtttcgcaccattacgcagtcatattaccggagcgctaacggcgctattttggcttacgacattacgaagaggtcctctttcctgtccgtccctcactggattgaggacgtgcgcaagtacgctggatctaacatcgtgcagctactgatcggcaacaaaagcgacttgagcgagttacgcgaggtgtctctggcagaggctcaatctctggccgagcactacgacattctatgtgccattgaaacatcggccaaggacagcagcaacgtggaagaggcattccttcgagtcgcgacggagcttatcatgaggcatggaggaccccttttctcggagaaatctcctgaccatatccagctcaatagcaaggatattggggaggggtgggggtgcgggtgctag

SEQ ID NO: 53323 - DNA, 639 bp, Artificial Sequence
  Description of Artificial Sequence: Synthetic coding sequence
atggcaggtccagggccagggcctggcgaccccgacgaacaatatgatttcctgttcaagttggtcctggtaggagacgcatcagtcggaaagacttgcgtggtgcagaggttcaagaccggcgctttctctgaaagacagggctcgactataggcgtggatttcactatgaagaccttagagatccagggtaaacgggtgaagcttcagatatgggataccgccggtcaagagcgcttccgcaccatcacccagagctattaccgatctgctaacggagcaattctggcctatgacataacgaagcggtcttctttcctctctgtaccgcactggattgaagatgtgaggaagtatgccggaagcaacatcgtccagctccttatcggtaacaaatctgacctgtcagaattacgggaggtcagtctagcagaggcccaaagtttggccgagcactacgacatcctatgcgccattgaaactagtgctaaggattcatccaacgtggaagaagcttttctgcgggtggcaaccgagctgatcatgcgtcacggcggacctttgttcagtgagaaatctcctgaccacattcagctcaacagcaaggacatcggcgaagggtgggggtgtggttgttag

SEQ ID NO: 53324 - DNA, 639 bp, Artificial Sequence
  Description of Artificial Sequence: Synthetic coding sequence
atggcaggacccggacccggacccggagatcccgacgaacagtacgactttttgttcaaactggttcttgtgggggatgcctcagtcgggaaaacctgtgtagttcagcggtttaaaaccggagcattcagtgagcggcaggggagcaccattggcgtggactttactatgaaaaccctggaaatccaagggaaacgggtcaaactacagatatgggataccgctgggcaagaacggtttcgcaccattacacaaagttactaccgctctgccaacggcgctatccttgcgtatgacatcaccaagcggtcctcctttctaagcgtacctcattggattgaggacgtccgcaagtatgctgggtccaatatcgtccagcttctgataggtaataaatccgacctttccgagctccgtgaggttagcctagctgaagcgcagtctctcgctgagcactacgacatcctttgcgccatagagacctcggcaaaggatagctcaaacgtggaggaggcctttcttagagtggcaactgagctgatcatgcgccacggagggcctctcttctcggagaaatctccagatcacatccagttaaattccaaggacatcggtgaaggctggggctgcgggtgttag

SEQ ID NO: 53325 - DNA, 639 bp, Artificial Sequence
  Description of Artificial Sequence: Synthetic coding sequence
atggctggtcccggaccaggacccggagatcccgatgagcagtatgactttctttttaaactcgtgctggtgggtgacgccagtgtgggcaagacctgtgtggtacaaagatttaaaactggtgcttttagcgagagacaggggtcaactattggggtggactttaccatgaaaaccttggagatccagggtaagcgggtgaagctccagatttgggatacagccggacaggagaggtttcggactataacgcaatcttactaccggagtgcaaatggggctatcttggcttacgacattaccaaacggtcgagctttctgtccgtgcctcattggattgaggacgttagaaagtatgcaggctcaaatattgtgcagctgctgatcgggaataaaagcgacctaagtgaactgcgggaagtgtccctcgctgaagcacagagtctggcagaacactacgacatcctttgcgctatagaaacgtcggcaaaggacagcagtaatgtggaagaggcctttttgcgggtagccaccgaactcattatgcgccatggcggacctcttttctccgaaaagtctcctgatcacatacagctgaattcaaaagacataggggaaggctgggggtgcggttgctag

SEQ ID NO: 53326 - DNA, 639 bp, Artificial Sequence
  Description of Artificial Sequence: Synthetic coding sequence
atggccggtccagggccaggcccaggcgatcctgatgaacagtacgacttcttattcaagctcgtgcttgtgggcgacgcttccgtaggaaagacttgtgtagtgcaacggtttaagactggagcctttagcgaacggcaaggttctaccatcggagttgatttcacgatgaagacattagaaatccaggggaagcgtgtgaaactgcagatctgggacacggcaggacaggaacgattccgaactataacccagtcatattaccgtagcgccaatggcgctatcctcgcatacgacatcactaagcgctcctcatttctgtccgtgcctcattggatcgaggatgtgcggaaatatgctggatccaacatcgtgcaattgctgatcggtaacaagagtgatctgtcggagctgcgggaggtgagtctggccgaggcgcagtctttagctgagcactatgatattttgtgtgctatcgagacctctgcgaaggactctagtaatgtggaagaagcatttctgcgggtcgccactgaactcatcatgcgccatggtggcccattgttttctgagaagagtccagatcacattcagcttaatagtaaggatattggcgaaggttggggctgcggctgttag

SEQ ID NO: 53327 - DNA, 261 bp, Artificial Sequence
  Description of Artificial Sequence: Synthetic coding sequence
atggcaggacccggtcccggacctggcgaccccgacgaacagtatgactttctcttcaagctggtgctggtgggcgatgcctccgtcggtaagacatgcgtggtccagcgattcaagaccggcgcattcagtgagcggcaggggagcacaattggggtcgactttacaatgaagactctcgagattcaaggaaaaagagtcaaacttcagatatgggataccgcagggcaggagaggttcagaactatcacgcaaagctag

SEQ ID NO: 53328 - DNA, 624 bp, Artificial Sequence
  Description of Artificial Sequence: Synthetic coding sequence
atggccaaaacttatgattacctattcaagctgctcctgattggcgacagcggcgtcggaaaaacatgcctcctctttaggttcagcgaagacgcttttaacacaacctttatctctacaattggaattgacttcaagatacgaacaattgagctggacggcaagaaaatcaagctgcagatatgggatactgcagggcaggagcgcttccgtactattactaccgcctattataggggtgccatggggataatgctggtgtacgacatcacaaatgaaaagagcttcgacaatattaagaactggattaggaatatagaagaacatgccagctctgatgtggagcgtatgatattgggcaacaagtgcgatatgaatgacaaaagacaggtctctaaagagcggggagagaagctggccatcgactacggtattaagttcctggagacttccgctaagtcctcggctaatgtagaggaggcattttttaccttggccagagacattatgacgaagctgaaccggaagatgaacgactccaattcagcaggcgctggaggtccagtaaagataactgaaaaccggagcaaaaagacttcattttttagatgtagcctgctttag

SEQ ID NO: 53329 - DNA, 573 bp, Artificial Sequence
  Description of Artificial Sequence: Synthetic coding sequence
atggccaagacctatgactatctcttcaaactgctgcttatcggagactctggggtgggaaaaacttgcctcctgttcaggttcagtgaggacgcttttaacacaacgttcatcagtacaattggaattgattttaaaattagaactattgaactggatggtaaaaaaatcaaactgcagatttgggacaccgccggacaggagagattccggacaatcacaaccgcatactacagaggtgccatgggcatcatgctggtatacgatattacaaacgagaagagtttcgataatatcaaaaactggatcaggaatattgaggagcacgcaagcagtgacgtcgaacggatgattctggggaataaatgcgacatgaacgataagcgacaggtctctaaggaacgcggtgagaaactggccatcgactacggaattaaatttctagaaacgtctgccaaaagcagtgcaaacgtggaagagaacgactcaaactccgccggagccggaggaccagtaaagataaccgagaatcgctcaaaaaaaaccagcttcttccgatgctcgctcttatag

SEQ ID NO: 53330 - DNA, 966 bp, Artificial Sequence
  Description of Artificial Sequence: Synthetic coding sequence
atgaagcagctgccagtgctggaacctggggacaagccccgaaaagccacctggtatactcttactgtccctggcgatagtccctgtgctcgagtgggccactcctgtagctacctcccccctgttggcaacgccaaacgtggtaaggtgtttattgtgggcggagcaaatcccaatcgctccttctcagatgtgcacaccatggaccttgagactcgcacctggactaccccggaagtaacctcaccacctccctcccctagaactttccacaccagctccgccgcaatcggcaaccagctctacgtatttgggggaggagaaaggggagcacagcccgtgcaggacacgaaactgcacgtgttcgatgccaacacactcacctggtcccagcctgaaacgttgggtaaccctccgtcaccacgccacggccatgtgatggtagcggctgggactaaactgttcattcacggcggactggctggggacagattctatgacgacctgcactgtattgacatcagcgatatgaagtggcagaagttaaaccccacaggcgcagcccctgccggatgtgcagcccatagcgcagtggccatgggcaagcacgtgtatatctttggtggcatgactcccgctggggctctggatacaatgtatcagtaccatactgaagagcagcactggactcttttaaagttcgacacgctgttgcccccaggaagactcgatcacagcatgtgtatcatcccttggccagtgacctgcgcaagcgagaaggaagacagcaacagcctgacgctcaatcatgaagcggagaaagaggacagcgctgacaaggtgatgtcacacagcggagactcccatgaagagtcccaaaccgccacactgctgtgcctcgtgttcggcggaatgaacacagagggagagatctatgatgactgtattgtcaccgtggttgactag

SEQ ID NO: 53331 - DNA, 1119 bp, Artificial Sequence
  Description of Artificial Sequence: Synthetic coding sequence
atgaaacagcttcctgtgctggagcccggtgataagcccagaaaagctacatggtacacattgacagtgcccggagacagtccatgcgcaagggtggggcacagctgtagctacctccccccagtgggtaacgctaagcgcggtaaggtgtttatcgtgggcggagcaaaccccaaccgttcctttagcgacgttcatacgatggatctcgggaaacaccaatgggaccttgacacatgcaagggactgctgcccaggtatgagcatgcatcttttatcccgtcctgcactccagatagaatttgggtatttgggggtgctaaccagtcgggcaatagaaactgtctgcaggttctgaatcccgaaacacgcacctggaccacccccgaagtgacctctccgcctccttcacccagaacctttcacacatcatccgccgctatcggaaatcagctatacgtgtttggtggaggcgagcggggagctcagcctgtccaggatactaagttgcacgttttcgacgcgaatacccttacttggtctcagcctgaaaccctgggaaaccctcccagcccccgacatgggcatgtcatggttgcggctggcaccaagcttttcatccatggaggcctggctggcgatcgtttctacgatgacttacattgcatcgacatttctgatatgaagtggcagaaacttaatcccacgggagcggctcctgccggttgtgccgcacactctgcagtcgctatgggtaagcacgtatatatcttcggcggtatgacccccgctggggctctcgacacaatgtatcaatatcataccgaggagcaacattggacactcctgaaatttgatacactccttcctcccggacgcctagaccactccatgtgcattatcccttggccggtaacctgtgcgagtgagaaggaggattctaactccctgacactcaatcatgaggcagaaaaagaagacagcgcagacaaagtaatgtctcacagtggcgattcacacgaagaaagccaaacggctaccttactgtgtctggtgttcgggggaatgaatacagagggcgaaatctatgatgactgcattgtgacagtagtggactag

SEQ ID NO: 53332 - DNA, 465 bp, Artificial Sequence
  Description of Artificial Sequence: Synthetic coding sequence
atgaagcagctccccgttcttgaaccaggcgataagccacggaaggcaacgtggtatactctgaccgtacctggcgattctccctgcgcacgggtcggacactcatgcagctacctgccccctgtcggcaacgccaaacgcggaaaagtgtttatagttggaggggcaaatcccaatcgatcattctctgatgtgcatactatggacctcggcaagcatcaatgggacctcgacacttgcaagggactgctgccgcgttatgagcacgcaagcttcatccctagctgtacaccagaccggatctgggttttcggcggagctaatcagtccggtaatcggaattgccttcaggtgctgaatccggcattcaaatcctggggtttctggaccgtgctggctaaccctaagtatcatctgcactcctccctcatgtttaagcccggacggggaccgaggcaaaagtag

SEQ ID NO: 53333 - DNA, 465 bp, Artificial Sequence
  Description of Artificial Sequence: Synthetic coding sequence
atgaagcaattgccagtgcttgagcccggtgacaaaccaaggaaagccacttggtacacgctcaccgtgcctggcgattccccatgtgcacgggttggccacagctgttcctatctgccacctgtgggcaatgcaaaacgcggtaaagtgtttatagtgggaggcgcaaacccaaatcgctcattctcagatgtccacacgatggacctgggaaaacatcagtgggatttggatacatgcaaaggcctgcttccacggtacgaacatgcctcatttatcccttcctgtactcctgaccgcatctgggtattcggcggtgccaatcagagtggaaacaggaattgcctccaggtgctcaatcctgccttcaaatcttggggcttctggactgtccttgctaatcccaaataccacctccactcctctctgatgtttaaacccggacgcggaccgaggcagaagtag

SEQ ID NO: 53334 - DNA, 1119 bp, Artificial Sequence
  Description of Artificial Sequence: Synthetic coding sequence
atgaagcaattacccgtcctcgagccgggtgacaagcctcgcaaagccacgtggtacactttgacggttccgggagactctccctgcgctagagtcggccattcctgtagttatctaccgcctgtggggaacgccaagaggggcaaggtgtttattgtcggaggggcaaaccctaacagatcattctcagatgtgcacacgatggaccttggaaaacaccaatgggacctcgacacttgtaaggggctgttaccccgatatgagcacgcttccttcatcccctcctgtacccctgacaggatttgggtgtttgggggagccaatcagtctgggaatcgaaactgccttcaggtcttaaaccccgaaacccggacatggaccaccccagaggtgacgtctcctcccccttcccctaggacttttcatacctcatccgcagctatcgggaatcaactatatgtgtttggcggtggggagcggggagcccagcccgtccaggatacgaagctacacgtgttcgacgccaatacactcacctggagtcagcctgagaccttgggcaaccctccttccccaagacatggacacgtgatggtggctgcaggcaccaagctctttattcatgggggacttgccggtgataggttctacgatgacctccactgtatagatattagcgatatgaaatggcagaagctgaacccaaccggggctgccccagctggatgcgccgctcattccgcagtggctatgggaaagcatgtatacatcttcgggggaatgactcctgccggtgcactggatactatgtatcagtaccacactgaggaacagcactggacactgctgaaattcgacactctactgcccccaggcagactggaccattcaatgtgcattattccatggccagtgacctgcgcctctgagaaagaagactccaacagtttgacgctgaatcatgaggcggagaaggaggatagcgccgataaggtgatgtcccacagcggtgacagtcacgaagaatctcaaaccgcaactctgctctgtttggtatttggtgggatgaacaccgaaggagagatttacgacgactgtatcgtcactgttgtggattag

SEQ ID NO: 53335 - DNA, 735 bp, Artificial Sequence
  Description of Artificial Sequence: Synthetic coding sequence
ggacggggaagccctgacactggatctataaccgtgtccggacgggaatccgagtccttccgcggagtaggcccatcccgcgtacagcgaaccgggaaaggcctgccttggctgcgtccgggacactttgacaggatatcgctgttcttccccgatcctgtgtcttacccactggagctgccaaggggggacgaaatctgttgggctgggtctggcggttgttgtggcaggtccagacccagggaagcctctctgacagaactgtggactctgggtactgcggtgtccggactcggcagaaggtatactcttaccgtcccaggtgactcgccttgcgctcgcgtgggacatagctgcagttatctgcccccagtgggcaatgctaaacgcggaaaggttttcatagtgggaggagctaacccgaatcgaagcttctccgacgtccatacaatggacctgggtaagcaccagtgggatctggatacctgcaaagggttgctgccacgctacgagcatgccagctttattccatcatgtacgcctgaccggatttgggtgttcggcggagcaaatcagtccggaaatagaaattgtctccaggtcctgaaccctgagacacggacttggaccactcctgaggtgacctctcctccgccatcccctcgaactttccacacgagctccgcggctatcggtaatcagctatacgtttttggcggaggtgagagaggctag

SEQ ID NO: 53336 - DNA, 606 bp, Artificial Sequence
  Description of Artificial Sequence: Synthetic coding sequence
atggcgggaaaaagctctctgtttaaggtgattcttctgggagatggaggcgttggcaaatcaagtttaatgaatcggtatgtgaccaacaagtttgacacccaactctttcacactatcggagtagaattcctcaataaggatctggaagtagacggccattttgttaccatgcagatttgggatacagcgggacaggagaggttcagaagcctgaggaccccgttctaccggggaagtgactgctgtctgctgacattctcggttgacgactctcagtctttccagaatttaagcaactggaaaaaggagtttatttactacgccgatgtgaaagaacccgagagctttccattcgtaatcctgggcaacaagatcgatatatcagaacggcaggtctccaccgaggaggcgcaagcctggtgtcgcgacaatggggattatccttatttcgagactagcgctaaagacgctaccaacgtggctgccgcatttgaggaggcagtgaggagggtcctcgctaccgaggaccgtagcgatcatcttattcaaactgataccgttaaccttcatcgtaagcctaagccctcatcctcctgctgttag

SEQ ID NO: 53337 - DNA, 1506 bp, Artificial Sequence
  Description of Artificial Sequence: Synthetic coding sequence
atgggatgtggcttaagaaaactcgaagaccctgatgattccagtccaggaaaaattttcagcacgctgaaaaggccacaagtggagaccaagactgagtttgcatatgaatatgtattgctggactttacactgcaagcaagcagcaatcctgaggtgataaaaattaacagcattctcgatatagtgaccaaagttgaaaattattacttaaaaggctacatcgtgggagcaatccacccagttattcagcccgtgggtcagaggaaacacttgcccgcatcctatctgtatcgcgttgtgctgctccggctgaaactctcacctaaaaatagtgccgcacccagcgggcagagaagaccgcgattagtgattgaggagtgtccactaaccagtgaagcgcagacgaacgacgccgcaaaagagctcatagaaaagattaatgtagctgcaaagaggggtatgaagttcgttgggttcatctcacagcactattccccttccaagttctgtaatggaaccaatcatgacggggatatcgagagcatgctgcacgtgcggcatggatccgacgagaattgccgttcatggaacgaaggaactttatccgggcagtccagcgaatccgggattgaggaggagctccaccatgaaagcggacagtaccagatggaacagaatgggtctcctacctcttccaaatcacgtaagggggaagccagcgacaataagctgtataccgtgttcaacgcctttgacgatgattccacgagctgggcctaccaggagggaatcctgtctatgaaggtaaccaggaagggatctgtgatatcgactctcgatgctgattggttggagctcactactttctattataagcagggattgagcctgattgattctttcgtgttctgggagacgagtaagggtgaacatctgcctaagagcctggaagggttctttatctacgaagaggaaggttctggagtcccagggtcttccagaaagggcaacgacgcaatcgttgttgagcagtggactgtcatagaaggatgcgagataaaaacggactatggacctctccttcacacgcttgctgaatttggatggctactgacttcggttctcccgacacctgtacttcgccacgattctgagggcaacctggcaacaaagcaaatcgtttttctgcagcgacccgttatgtggaatagcgctgcccagacgcctgataagaaggcgtcaaggcatattaaaggcgaggacaaaaacaaggcaacctccagatccatcggtctggataccacaagctctcaacccgctgagtctcggcatctgcctgaagagtgtagactaagtccctcgagagagtgctggaccaaagagggcaggctggcacagcataatagtttttctggcttctcatcctccgacaatgtcctgcgggagctcgatgatggccagttcgatcaggaggatggcgtgactcaagttacctgtatgtag

SEQ ID NO: 53338 - DNA, 1737 bp, Artificial Sequence
  Description of Artificial Sequence: Synthetic coding sequence
atgggctgtggcttgaataaactggagaaacgtgatgagaagaggcccggaaatatctattcaaccctgaagaggccccaggtagagacaaaaattgatgtctcttacgagtaccgatttctggagttcacaacacttagcgcagccgaactgcctgggtcatccgcggtgaggctggcttccttacgcgaccttccagcccagcttttggaactttaccagcagggtttctcgctcgcagcactgcatcctttcgttcagccaactcacgagagagaaaagacaccactggagcatatattccgagccattctgataaagaaaaccgacaggtcccagaaaaccgacctacataatgaagggtatatcctggaattagactgttgttcctcactcgatcacccaacagatcaaaagttgattccagaatttatcaaaaaaattcaggaagcggctagccagggcctgaagtttgtgggagtaatcccacagtaccatagcagtgtcaacagcgccggttccagtgctccagtgagcaccgccaacagtacagaagacgctcgagatgctaaaaacgccagaggcgaccatgctagcctcgagaacgagaaaccaggaactggcgatgtttgttctgctcccgctggtagaaaccagtcccctgagccctcttccggccctcgtggcgaggtgcctcttgccaagcagccctcatcacctagtggcgaaggcgacgggggtgagctgagcccccagggagtgtcgaagactctcgacggcccagaatccaatcccctggaagtgcatgaggaacccttgtccggaaagatggagatttttacactgttcaataaaccaaagtctcatcagaaatgtcgccagtattacccggtgacaataccacttcacgtctctaagaacggacagaccgtgtccggccttgacgccaattggctggagcatatgagcgaccattttcgtaagggtgggatgctggttaatgctgtgttttatctgggaatcgtgaatgactctctgcacggcctgactgatggtgtctttatctttgaggccgtgtctacagaggattcaaagacgattcaaggctacgatgccatagtggttgaacaatggaccgtactggaaggcgtagaagttcaaactgattacgtgcctctgttaaattccttagcggcatacggctggcagctcacctgtgtgctgccgacccccgtcgtaaagacaacaagcgaaggctctgtgtcaactaagcaaatcgtctttctccagaggccctgtctccctcagaaaattaaaaagaaagagtcaaaattccaatggaggttctccagggaagagatgcataacaggcaaatgagaaagtctaagggtaaactatctgcgagagataagcagcaggcagaggagaacgagaaaaacttagaagaccagtccagcaaggccggagacatgggtaactgcgtgtcaggccagcagcaggagggaggagtaagcgaggagatgaaaggcccagtacaggaggataagggcgaacaactgagccctggaggtctgctatgcggtgtcggcgtggagggtgaggccgtgcagaacgggccagcatctcactcccgtgcactcgtggggatctgcacaggacactccaatccaggagaggacgcacgggacggagacgcggaagaagttcgcgagcttgggaccgtggaagaaaattag

SEQ ID NO: 53339 - DNA, 345 bp, Artificial Sequence
  Description of Artificial Sequence: Synthetic coding sequence
atgggatgtgggctgaacaaattagagaagcgggacgaaaagcgcccagggaatatctactcaacactgaagcgcccacaggttgaaacaaagattgatgtgtcatatgagtaccgatttctggagtttacaaccctatccgctgctgaactccccggttcatctgccgtgaggcttgctagcctgagagacctgcctgctcaattgctggaactataccagcagggattcagtcttgccgctttgcatccattcgtacaaccgacgcatgagagggagaagacgcccctggaacacatttttcgggcaattctaatcaaaaagactgaccggtctcagaagtag

SEQ ID NO: 53340 - DNA, 450 bp, Artificial Sequence
  Description of Artificial Sequence: Synthetic coding sequence
atgggctgtggtctgaacaaattggagaagcgcgacgagaagagacccggaaacatttacagcaccttgaaacggccacaggtggagaccaagattgatgtgtcttacgagtacagatttcttgagttcacaaccctgtctgcagccgaattacccggatcttcggctgtgcggttggcatctctgcgtgacctgcccgcacagctcctagaactgtaccagcaggggttcagtctcgcagctctccaccccttcgtccagcccactcacgaacgtgaaaagacaccgctggagcacattttccgggctattctcattaagaagacggatcggtcccagaaaactgatctccacaatgagggctacatcctggaactggactgttgcagttcactggaccatccgactgatcagaaactgatccccgagtttatcaaaaagatccaatag

SEQ ID NO: 53341 - DNA, 450 bp, Artificial Sequence
  Description of Artificial Sequence: Synthetic coding sequence
atgggatgcggactgaataagctcgaaaaaagggacgagaagcgcccaggtaacatttactccacgcttaagcgccctcaagttgagaccaagatcgatgtgagctacgaatatagatttcttgagttcactactttgtcagctgccgaactgccaggctcctcagcagtgcgcctggctagcctccgagacttaccagcccaactgttagaactttatcagcaggggttttccttggccgctttgcatccattcgtccagcctactcacgaacgggagaagacaccacttgaacatatctttagggccatcctgattaaaaagaccgatcgttcacagaagaccgacctgcataatgagggttacattctggaactggactgctgctcaagcttagaccacccaactgaccagaagcttatccccgaattcataaaaaaaatccagtag

SEQ ID NO: 53342 - DNA, 828 bp, Artificial Sequence
  Description of Artificial Sequence: Synthetic coding sequence
atggggtgtggacttaataagcttgaaaaacgcgacgagaaaaggcccggaaacatatacagtactttaaagagaccgcaggtggaaactaagatcgacgtaagctacgagtataggttccttgaatttactactctttctgctgctgaattgccgggatcttctgccgtccgactggccagcttaagagacctcccggctcagttgctagagctttatcaacaggggttttccctggcagcactccatcctttcgttcaaccaacccacgagagggagaaaacccctctggagcatatattccgcgcaatccttattaagaagactgacaggagccagaaaaccgacctccacaatgaaggctatatactagaattggattgttgctccagcctggaccacccaaccgaccagaaactgataccagagttcatcaaaaagatccaggaggccgcttcccagggactgaagttcgttggagtaatcccccagtatcacagcagcgtaaattcggctggcagctctgcgccagtctctacagcgaatagcacggaggacgccagggatgcgaagaacgcaaggggggaccacgcaagtctggaaaatgagaaaccaggtaccggagacgtgtgtagtgcacccgcaggcaggaaccagagccccgagccatcttccggcccacggggagaggtgccactcgccaaacagccctcttcaccaagcggcgagggtgacggcggagaactgagtccccagggtgtctccaagaccctggatggcccagagagcaacccactggaagtgcacgaagaaccactgtctggctag

SEQ ID NO: 53343 - DNA, 1647 bp, Artificial Sequence
  Description of Artificial Sequence: Synthetic coding sequence
atggacctgatgaacgggcaggctagttctgtcaatatcgcggcaacagccagcgaagggcagataaccctgatggacgtgccggtgtttaaagcaatccagccggatgagttgtcctcctgcgggtggaataaaaaggagaagtacagctctgcacctaatgcagtggcctttacacgcagattcaaccacgtttccttctgggtggttcgggagattctccatgcacagacgcttaagatcagagctgaggtgctgagtcactacatcaaaaccgccaaaaagctgtacgagctaaacaacctgcatgctctgatggcagttgtgtctgggttacaaagtgctccgatcttccggctgacgaaaacgtgggccctactgagtagaaaggataagacaacgtttgaaaagttggaatatgtgatgtccaaagaagataattataaaagattgagagattatatatcttcgctgaagatgacaccttgtataccatatttagggatatatctcagcgatctaacatacattgattcagcttatccctccaccggatctattctggaaaatgaacagcgttcaaacttgatgaataatatactacggattatcagtgacctccagcagtcctgtgagtacgacatcccaatgctgcctcatgtgcagaagtacctgaacagtgtccagtacatagaagagcttcagaaattcgtggaggatgacaactataaactgtctcttaaaatagagcccggaaccagcacaccaagaagcgccgctagccgggaagaccttgttggacctgaagttggggctagccctcaaagtggaaggaaatccgttgcagctgagggtgccctgctccctcagacacctccgtccccccgaaatctgatcccccacggccaccgcaaatgccatagccttggctacaactttatccacaagatgaataccgcggaattcaagtctgctaccttccctaatgccggtcccagacacctgctggatgatagtgtgatggaacctcatgccccatcaaggggacaggccgaaagttctaccctgtcctcagggatctcaatcgggtcaagtgacgggtctgaactgagcgaggaaactagttggcctgcattcgaaagaaaccggttataccattcactgggccctgtgacccgcgtggctcggaatggctatagatcacatatgaaggcctccagctccgcagaaagcgaggatcttgctgtccatttatacccaggagctgtgacaattcaaggggtgctgaggaggaaaactctgctcaaggaggggaagaagcccacggttgcttcctggactaagtattgggctgccctttgcgggactcaactgttctactatgcagccaagagtcttaaagctaccgagcggaaacacttcaagtcgacatccaataaaaatgtgagcgtgatagggtggatggtgatgatggcagacgaccctgaacatcctgacctgtttctcctcaccgactcagagaaaggcaatagctacaaatttcaggccggaaaccgaatgaacgccatgctgtggtttaagcatctgtccgccgcttgtcagtctaacaaacagcaagtaccgaccaacttaatgacgttcgagtag

SEQ ID NO: 53344 - DNA, 1674 bp, Artificial Sequence
  Description of Artificial Sequence: Synthetic coding sequence
atggatctgatgaatggacaggccagtagtgtgaacattgcggcaaccgcgtcggagaaatcgtcctccagcgagtctttgtccgacaagggctcagaattgaagaagagcttcgacgccgtggtcttcgatgttcttaaagttacaccagaagagtatgctggtcagattaccctgatggacgtccctgtttttaaagccatccagccagacgagctgtcctcctgtgggtggaataagaaggaaaagtacagctcggctcctaatgccgtggcatttactcgcagattcaatcatgtctccttttgggttgtccgtgagatcctgcacgcgcagaccttaaagattagagctgaagtgttatctcactatattaaaacagccaagaaactgtacgagttaaataacttgcacgcactaatggccgtcgtttcaggactgcaatctgcccctatttttaggttaaccaagacttgggcactcctctctcgcaaggataagacaacgttcgagaagctcgaatatgtaatgagcaaagaggataactacaagagactcagggactacattagttccctgaaaatgaccccttgtattccttatctgggaatctacctctctgatttgacatacatcgacagcgcttatcctagcactggttccatcttagagaacgagcaacgatcgaacttgatgaacaacatcctgcgtattataagcgatctgcaacagagctgcgaatatgacatcccgatgttgccacacgtgcaaaagtacctgaattctgtgcagtacattgaagagctgcagaagttcgtcgaagacgataactacaagttaagtttgaagattgagccaggcacatcaacaccacggagtgctgcgtcacgcgaggatttggtgggccctgaggtcggagccagcccccagtctggtagaaagtcagtggctgcagagggcgcactgcttccccagactcctccttcacctagaaatctgataccacatggccatagaaagtgtcattccctcgggtataattttatccataagatgaacacagccgaattcaagagcgcaacttttcctaacgctggcccacggcaccttctggatgattccgtcatggagccacacgctccctcccggggacaagccgagagctctacactgtctagcgggatctccataggctcatcggacggctccgaactcagtgaggagaccagctggcctgcttttgaatcaagcgcggagtccgaggacctggccgtacatctttatcctggagctgtgacaatccagggagtgctgcgaaggaagacactgctgaaagagggcaagaagcctacagttgcaagttggactaaatactgggccgctctctgcggaacgcaactcttttattacgcagcgaagtccctgaaagcgacagaacggaaacacttcaaaagcacttctaataaaaacgtgagtgttatcggatggatggtgatgatggccgatgatcccgaacatcctgatctcttcttgttgacagactcagaaaagggaaactcctacaaatttcaggccggaaacagaatgaacgccatgctgtggttcaagcacctgagcgctgcttgccagtctaacaagcaacaggtgcccactaacctaatgacatttgaatag

SEQ ID NO: 53345 - DNA, 1752 bp, Artificial Sequence
  Description of Artificial Sequence: Synthetic coding sequence
atggacctcatgaatggacaggcttcttccgttaacattgccgcaaccgccagcgaaaagagcagttccagcgaatctctctccgataagggcagcgaattaaaaaagagctttgatgccgtggtatttgacgtgctgaaggtgacacctgaagagtatgcgggtcaaattacactcatggacgttcctgttttcaaagccatacagcctgatgagctgtccagctgcggatggaacaagaaagaaaagtactcctcagctcccaacgccgtggcattcacacgcagattcaaccatgtttccttttgggtcgtgagagagatcctgcacgctcagactttgaaaatccgtgctgaagtcctctcccattacattaagaccgcaaaaaagctttatgagctcaataacttacatgctctgatggctgtggtaagcggactccagagcgccccaatctttcgactgactaagacctgggctctgctcagcagaaaagataaaaccactttcgaaaaattggaatacgtcatgtccaaggaagacaactacaagcggcttcgcgattatattagcagtctgaaaatgaccccatgtattccctaccttggcatttatctgtctgatttgacgtacatagactctgcgtacccgagtaccggctctattcttgagaatgagcagaggagcaatctgatgaataacattcttagaattatctccgatcttcagcagtcctgtgaatatgatatcccgatgttgccccatgtgcagaaatatctaaattcagtccaatacatcgaggaactgcagaagttcgtggaagacgataactacaagctgtcgctgaagatcgagcccggaacctctacacccagatccgctgccagccgggaggatcttgtcggccctgaggtgggagcgtctccacaatctgggcgtaagtctgtagctgcagaaggtgcactccttcctcagacacccccaagtccacgaaaccttattcctcacggccacagaaagtgtcacagcttgggttacaatttcattcacaagatgaacaccgccgaatttaagtccgcaacattccccaatgcgggacctagacacttgttggatgactctgttatggaacctcatgcgccttccagaggtcaagccgagtctagtacgctcagcagtgggatcagtattgggtccagtgacggcagcgagcttagcgaagaaacaagctggcccgctttcgagagaaatcgcctgtatcacagtttggggcctgttacacgagtagctcgcaacggataccgtagccacatgaaagcatcatcaagcgccgaatccgaggatttggccgtgcacttataccccggagccgtaacaatccagggggttctgaggcggaagaccctgctcaaggaggggaaaaagccaacagttgctagctggacaaaatactgggcagccctgtgcggcacccagttgttctattacgcggctaagtccctgaaggcaactgagcgcaaacattttaagagcacaagcaataaaaacgtgtcggtgatagggtggatggtgatgatggctgacgaccccgagcatcctgatctatttcttcttactgactctgagaaaggcaattcttacaagttccaggccggaaatcggatgaatgctatgctgtggtttaagcacttgtccgcggcttgccaaagcaataagcaacaggttcctacaaacttgatgacttttgaatag

SEQ ID NO: 53346 - DNA, 699 bp, Artificial Sequence
  Description of Artificial Sequence: Synthetic coding sequence
atgaacactgccgagtttaagtctgctactttccccaacgccggacctcggcatctcctcgatgatagtgttatggaacctcacgcaccatcccggggacaagcagagagctcaaccctaagcagcgggatctcaattggtagttccgacggaagtgagttatccgaggaaacctcttggccagccttcgaacggaatagattataccatagtctgggccctgtgaccagggtcgccagaaatggataccgctctcacatgaaggcgagcagctccgccgagtctgaagacctagctgtgcatctctatcctggtgctgtaactattcaaggagttctgcggaggaaaaccctcctaaaggagggaaagaagccaactgtcgcttcctggacaaaatattgggctgccctgtgcggcacacagctcttctattatgccgcaaaatcactcaaagccacggagcggaagcactttaaatcaacatccaacaagaacgttagcgtgatcgggtggatggttatgatggctgatgacccagagcaccctgaccttttcctcctgactgattccgaaaagggaaattcttataagttccaagcaggaaatcgcatgaacgcgatgctctggttcaagcacctatccgccgcatgccagtcaaataaacagcaggtccccaccaacctgatgacgttcgagtag

SEQ ID NO: 53347 - DNA, 2388 bp, Artificial Sequence
  Description of Artificial Sequence: Synthetic coding sequence
atggaggggctcacccttagtgatgccgagcaaaagtactacagtgatctgttctcatattgcgacatagagtcaacgaagaaagtggtggtgaatggacgggtgctggagctctttagggctgctcagctacccaatgacgtggtgctccagataatggaactttgcggggcaactagactgggctattttggccgtagtcagttctatatcgccctcaaactcgttgcggtggcacaatccggcttccccctgcgggttgaatctattaatacagtgaaggacctcccactcccaaggttcgtggcatcaaaaaacgaacaagagagtcggcatgccgcaagctactcaagtgacagcgagaatcaaggcagctatagcggggtcataccgcctccacctggacgaggtcaggtaaaaaagggttccgttagccacgatacagtgcagcccagaacctccgccgacgcccaagaacctgcatcacctgtggtcagcccacagcagagccctcctaccagtcctcacacttggcggaagcactccaggcacccttctggtggcaacagcgagagaccccttgcgggacctggccctttctggtccccatttggggaagctcagagtggctcatccgccggagacgcagtatggtctggtcactcgccccctccaccgcaagaaaattgggtcagcttcgctgacacaccaccgacatccacccttttgaccatgcaccccgcatcagtgcaggatcaaacgactgtgcggaccgtggcctctgccaccactgctatcgagatcagacgtcagtcgtcatcttacgatgatccgtggaagatcactgatgaacagagacaatattatgtgaatcagtttaagacaatccagcccgatctaaacggcttcatccctggatctgccgctaaggaattcttcaccaaatccaagctgcctatcctggagctgagccacatttgggagctgagtgacttcgacaaggacggcgcactgactctagacgaattttgcgccgcattccacttggtcgttgccagaaaaaatgggtatgatcttccggaaaagctccccgagagtctgatgcccaagttgatcgatctggaggacagcgccgatgtcggggaccagcccggagaagtcgggtactcgggatcacctgccgaagcaccccctagtaaatccccgtccatgccctcacttaaccagacatggcccgaactgaaccagagctcagaacagtgggagacattctccgaaagatcttcttccagccaaacacttacacagttcgactctaacatcgcccctgccgaccctgataccgccatcgtccatcccgtgcctattaggatgacacctagcaagatacacatgcaggagatggagctgaagcgaaccggatctgaccatacaaaccccacctcccccctcctggtgaagccatccgacctcctcgaggagaataaaataaactcctccgtgaaattcgctagtggaaatactgtggatggatacagcagcagtgactcattcacctcggacccagagcagattggaagcaatgtgacccgccagcggagtcactctgggacatcccccgacaacaccgctccaccacctcctcctccgaggccacagcctagtcattctaggtcaagctcccttgatatgaatagaacatttactgtgacaaccggtcagcaacaggccggtgtggtggcacaccccccagccgtgccacccagacctcagcccagccaggctccaggtcccgcagtgcacagacccgtcgacgcagatggcctgatcacgcacactagcacatcgccacagcaaatccctgaacagccaaatttcgcagactttagtcaatttgaagtatttgccgcttcgaatgtgaatgacgagcaggacgacgaggccgaaaagcaccctgaggtgttacctgccgaaaaagctagcgaccccgcttcctctctaagagttgctaaaactgactccaaaactgaagagaaaacagctgcctctgcaccggcaaatgtctcaaaagggactacgccccttgcccctcctcccaagcccgtccgcaggcgtctgaaatcggaagacgaactgcgccctgaggtggatgaacatacacagaaaaccggtgtgctggcggcagtcttggcctcccagccttccatcccacgcagcgtgggcaaggataaaaaagcaatccaagcctcaatccgcagaaacaaggagactaataccgtgcttgctagattgaattccgagctccagcagcagcttaaggacgtcctagaagagcggattagtctggaagtccagctggagcagctcaggccattctcacatctgtag

SEQ ID NO: 53348 - DNA, 2310 bp, Artificial Sequence
  Description of Artificial Sequence: Synthetic coding sequence
atggaaggactcaccctgtcagatgccgaacagaaatattacagcgatcttttttcttactgtgacatagaaagtaccaagaaggtcgtcgtgaacgggagggtgctggagttattccgagcagcccagctgcccaacgatgtcgtgcttcagataatggaactgtgcggggcaaccaggcttggatacttcggcaggagccagttctacatcgcactgaagctggttgccgttgcgcaaagcgggttcccgctgcgagttgagagcatcaacaccgttaaagaccttccgttgcccagattcgtggcgtcgaagaatgagcaggagtcacgtcatgcggcttcatacagttcagacagtgagaatcagggaagttactcaggcgtgattcctcctcctcctgggaggggtcaagtcaaaaaagggtctgtgtctcatgacaccgtgcagccgagaacgtcggctgatgctcaggagcccgctagtccagtggtctccccccagcagagtccaccgacatccccacacacatggcgtaagcacagccggcatcctagtggtggtaacagcgagaggcctctggctgggccagggcctttctggtcaccttttggcgaggcccagtcgggaagctccgcaggcgacgctgtttggtctgggcattccccgccaccgcctcaggagaactgggttagcttcgccgatacaccacccacaagtacactcctgaccatgcatcccgcttccgttcaagatcagacaaccgtaaggaccgtggccagtgccacaaccgccatagaaatcaggcgtcagagcagctcatatgacgatccatggaagattactgacgaacagcggcagtattatgtgaatcaatttaagaccatccaacccgatctgaatgggttcattccaggcagcgctgctaaagaattcttcacaaaaagtaagctgccgatcctggagcttagtcatatctgggaactgagcgactttgacaaggatggagctctcacactagacgaattctgtgcagcctttcacctcgtggttgcccgtaaaaatggctacgacctgcccgagaaactccctgaatccttaatgcctaagctcatcgacctggaggactcagccgatgtaggcgaccaacccggtgaggtcggctatagtggatcacccgcagaggcgcctcctagtaagagtccctccatgccttccctcaatcagacttggccggaattaaaccaatcaagcgaagacaccgccatcgtacatcccgtcccgattagaatgacaccgtctaaaattcacatgcaggagatggagcttaaaagaaccggctccgatcacacaaatccgacgtctccgttgttggtgaaaccgagtgatctgctggaagagaataagattaatagctccgtcaagttcgcaagcggcaatacagttgcagatggctacagctccagcgattcgtttacttctgatcccgagcagatcgggagcaatgttactcgacagcgctcgcattctggtacctctcccgacaacaccgcgccaccaccccctcctcctagacctcagccgtctcactcacgaagctcctctttggacatgaatagaacatttactgttaccacagggcaacagcaggcaggagtcgtcgcgcacccaccggcagtgcctcctaggcctcagccctcccaggcccctggcccagcagttcaccggcctgtagacgcggacggcctgatcacacacacgtctacatcaccccagcagatccccgagcagcccaactttgctgatttctcacagttcgaggtttttgctgcttctaacgtgaatgatgagcaagacgacgaggcagagaaacatcccgaggtactgcccgcagagaaggcctccgacccagctagctccctgcgcgtggctaaaaccgatagtaagaccgaggagaagaccgccgctagcgcgcctgctaacgtttctaagggcactaccccgctcgcaccgcctcctaagccggtccgcagacggctcaagtcagaagatgaactgagacctgaggtggatgaacatactcagaagactggggtgctggccgcagtcctcgcttcccagccctccattccccgtagtgttgggaaagataaaaaggccatccaggcaagtattcgaaggaacaaggaaaccaacacggtgctggcccgtctcaatagtgaacttcaacagcagctgaaagacgtgctggaggagcgtatcagtttagaggtgcagctggaacagctgcggccattctcacacctttag

SEQ ID NO: 53349 - DNA, 2235 bp, Artificial Sequence
  Description of Artificial Sequence: Synthetic coding sequence
atggagctgtgtggagccacgcgcctgggatatttcgggagatcacagttctacatcgcattaaaactggttgcagtggctcagtccgggtttcccttacgtgtagaatccatcaataccgtgaaggatttacccctacctcgctttgttgcttcaaaaaatgaacaggaatcgcgccatgccgcaagttattcttcggactcagagaaccaagggtcctactcaggcgtgattcctccccctcccggacgaggccaggtgaaaaaaggctcagttagccatgataccgtgcagccacggacttcagccgatgcacaggagcccgcttctccagtggtctctccgcaacagtccccacccactagtccacacacgtggcggaaacactcccgacacccatctggcggaaactccgagagaccactggctggtcccggacctttttggtctccgtttggcgaggcacagtctggtagttctgcgggtgatgccgtctggtccggacactctcccccacccccacaagagaactgggtcagtttcgctgacacaccaccaaccagcacgcttctcacgatgcaccctgctagcgttcaagaccagacaacagtccgcacagtggcgtccgccactaccgccatagaaattcggcgacagtcaagctcttatgacgatccatggaagattactgacgaacagcgccagtactatgtcaaccaattcaaaactatacagccggatcttaacggatttatacctgggtctgctgcaaaagaattttttacaaagtccaaattgccaattctcgagctgtctcacatctgggagttgtccgactttgacaaggacggcgcactaacgctcgacgaattttgcgctgcctttcacttagtcgtagcgaggaaaaatggctatgatttacctgagaaactgcccgaatccctcatgccgaaattaatcgatctcgaggattcagcagacgtgggcgaccagcccggagaggtgggatacagcggcagccccgctgaggctcccccaagcaaatccccttccatgccctctcttaatcagacatggccagaactgaatcagtcaagcgagcagtgggaaaccttctccgagcgaagtagttcaagccagacgctgactcagttcgactccaatattgcccctgcagaccctgataccgcaatcgtacatccagtacctatcaggatgacaccttctaaaatccatatgcaagagatggaattaaagcgaacaggctccgaccataccaatcccaccagccccttgcttgttaagccctctgatctgctcgaagaaaacaagatcaactcctctgtcaagttcgcatctgggaacactgtggccgatggctactcctcttcagatagctttacatcagacccagaacagattggttcaaatgtgacacgacagaggtctcacagcggaactagccccgacaatactgcccctccaccacctcctccacgcccacagccatctcattccagatcaagctctcttgacatgaatagaacttttacagtaacaactggacagcagcaggccggtgtggtcgcccatccacccgctgtccctccacgtcctcagccatcacaggctccaggtccagccgtgcaccgaccagttgatgccgatgggctgattacccacacctcaacaagcccgcagcaaataccagagcagcccaatttcgcggatttcagtcaatttgaagtgtttgccgcaagcaatgtaaatgatgagcaggacgacgaggccgagaaacaccctgaggtcctgcctgctgaaaaggcctccgacccagcatcttctctcagggtggcaaagacagactcaaaaacagaagagaagacagcagcctcagcccctgctaatgtatccaaaggcaccacccccctcgcaccaccccctaagcctgttagacggaggctgaagtctgaggacgaattgaggcctgaggtggacgagcacacgcaaaaaaccggagtgctggccgctgtgctggccagccagccctctatcccaaggagcgtgggcaaggacaagaaagccatccaagcttccatccgacgcaataaagagacgaacactgtgcttgccagattaaactctgagctgcagcagcagctgaaggatgtgctcgaggagcgcatttctctagaagtacagctcgagcagctccggccattctctcatctttag

SEQ ID NO: 53350 - DNA, 2118 bp, Artificial Sequence
  Description of Artificial Sequence: Synthetic coding sequence
atggagggactgaccctctctgacgccgaacagaagtattatagcgatctctttagctattgcgacatcgagagcactaaaaaggtcgtcgttaacggccgagttttggagctatttcgagccgcacaattaccgaatgatgtcgtcttgcagataatggagttgtgtggtgccacacggctgggttattttggtagatcccagttctatatagcactgaaactcgtggcggtagcccagtcaggattcccgctccgggttgagagtatcaataccgttaaggatttgccattaccgcgtttcgtggctagtaagaacgagcaggaatccagacatgccgcttcctactcctcagactcggagaatcaggggtcatattctggcgtgatcccgccaccccctggcagaggccaggtgaaaaagggaagcgtgtctcatgacacagtgcagccgagaacttctgctgacgcccaagagccggcatccccggttgtgagccctcagcaatcacctccaacaagtccccatacttggcgcaagcacagtcgccatccaagcggagggaattcagagcggccactagccggaccaggccctttctggtcccctttcggcgaggcgcagagcggttcttctgctggtgatgccgtctggtctggccacagtccacctccaccccaggaaaattgggttagtttcgcagacacccccccaacatcaacactcttaaccatgcatccggcttcagtccaggatcagaccactgtgcgcactgtggcatccgcaacaaccgctatcgagattcgcagacagagttcttcatacgacgacccttggaagattacagatgaacagcgacagtactatgtgaatcagttcaaaaccattcagcctgacttgaacgggtttatccctggaagcgcggcaaaggagttttttactaaatctaaactccctatccttgagcttagccacatctgggaactaagcgactttgataaagacggtgctcttaccttagatgagttctgcgcagcgtttcatctggtcgttgcaaggaaaaatggctacgacttgccagaaaaacttcctgaatccctcatgccaaagctcatcgatctggaagatagtgcagacgtcggtgaccagcccggtgaggtggggtattcaggaagtcccgcagaggcacccccttctaaaagcccatcaatgcccagtctcaaccagacctggccggaactaaatcagagttccgaggatacagcgattgttcaccccgttccgattagaatgaccccttcgaaaattcatatgcaggaaatggagctcaagagaacaggatctgatcacactaatccaacttccccgctgctggtcaaacccagcgacctgttagaggagaataagatcaattcatcagtgaaattcgcctccggcaatacggtagggcaacagcaagccggagttgtagcacatccccctgccgtgcctccccgaccccagccctcccaggcccctggacctgccgtgcaccgaccagtggatgccgacgggctgataacccataccagcaccagcccacagcagatacccgagcagcccaattttgccgatttttcccaattcgaagtctttgccgcaagcaacgtcaacgacgaacaggatgatgaggctgaaaaacatccagaagtcctcccagccgagaaagcttccgatccagcatcttccttgagagtggccaaaactgacagcaagactgaggaaaagactgctgccagtgctcccgctaatgtgtcaaaaggcactacacctttggctccgcctcccaagcccgtccggaggaggttaaagtcagaggatgaactgcgccctgaggtggatgaacacacccagaagacaggggttcttgcggcagttctggcctcgcaaccctccatccctaggtccgtcggcaaggacaagaaggccatacaagccagtattagacgaaacaaggagacaaacacggtactcgctcgcctgaactctgagctgcagcagcagctgaaagacgtgctggaggaacggatctccctggaggtgcaacttgagcaactgcgccctttttctcacctgtag

SEQ ID NO: 53351 - DNA, 2391 bp, Artificial Sequence
  Description of Artificial Sequence: Synthetic coding sequence
atggaaggcctgactctgtccgatgcggaacagaaatactactctgatctcttctcgtattgcgacatagaaagtactaagaaagtggtcgtcaatggtcgcgttcttgaactgttccgagctgcccagctgcctaatgacgtcgtcctgcagatcatggagctttgtggggctacccgtctcggctatttcgggcgttcccagttttatatcgcgctcaagctggtggctgtcgcccagtccggcttccctttaagagtggaaagcattaataccgtgaaagatctacccctgcctaggttcgtggcgtcaaaaaatgagcaagagtcccggcacgccgcatcgtacagcagcgacagcgaaaaccaggggtcttattccggtgtcatcccccctcctcctggcaggggccaggtgaaaaagggctcagtcagccatgataccgtgcagcctagaacctcagcagacgctcaggaacctgcctcccctgtcgttagtccccagcagtctcccccaactagcccgcatacctggaggaaacacagtagacatccttccggtggcaactccgaaagacccctggctggcccaggaccattttggtcccccttcggagaggctcagagcggatctagcgccggagatgccgtgtggtctggacactcccctccacctcctcaggagaattgggtgtcgtttgccgatacgccgcctacttctaccttgctgactatgcacccagcaagcgtgcaagaccagacgactgtgaggacagtagcttcagccaccacggctatcgaaatacggaggcagagctcttcctatgatgacccttggaagatcacagacgaacaacggcagtattacgtgaatcagttcaagaccatccagcccgacctcaacggctttattcccggatccgccgcaaaagagtttttcacgaagagtaagcttccgatactggaactctcccatatatgggagctcagtgactttgacaaagacggtgctttgactctggacgagttttgcgctgcctttcatcttgtggtggccagaaagaacggctacgacctgccagagaaactaccagagtccctcatgccgaaactaattgacctggaggactctgccgacgttggcgatcaacccggagaggtgggctactccgggagccctgccgaggccccacctagtaagtctccgagtatgcctagcctcaatcagacctggcctgagcttaatcagtccagcgaacagtgggaaacttttagtgaacgcagcagttcgagtcaaaccctgacacagtttgactcaaacattgctcccgcagacccggatacggccatcgtgcatccagtgccgattagaatgacgccaagcaaaatccacatgcaggagatggagcttaagcggacgggcagcgaccacaccaatcccacaagccccctcctcgtgaagccctcggacctcctggaagaaaataaaatcaattcaagtgtaaagttcgcatcgggaaacaccgtggcagatgggtacagctccagtgacagcttcactagcgaccctgaacaaataggatccaatgtgaccagacagcggtcacactcaggcaccagtccagacaacaccgctccacctcccccacctccacgcccacaaccttcacattcaagatcatcctccctggatatgaatcggactttcactgtgactacagggcagcagcaggctggagttgtcgcccacccccctgcagtaccacctaggccacagccctctcaggcacctggccctgcagtccataggcccgttgacgcggatggtcttatcacgcatacttctaccagcccacagcagatccccgagcagcctaacttcgcagacttcagtcagttcgaggtgttcgccgcttctaatgtcaacgatgagcaggacgatgaggccgaaaagcaccctgaagtgctgcctgccgagaaggcatccgatcctgccagctccctgcgggtcgcaaagaccgactccaagaccgaggagaagactgctgcctcagcacccgcaaacgtatccaaaggcactactcccctggccccaccccctaagccggtgagacgacggctcaagagtgaagacgaactgcggcctgaggtcgatgagcatactcagaaaacgggcgtcctggccgcagtcctcgcatcacagccatcaatccctcgctctgtcggcaaagataagaaagccattcaggcctcgatacgcagaaacaaggaaacaaataccgttttagctcggcttaactcagagcttcagcagcagctcaaagacgtcctcgaggagcggataagcttggaagtgcagctggagcagctgcgcccattctctcacctgtag

SEQ ID NO: 53352 - DNA, 441 bp, Artificial Sequence
  Description of Artificial Sequence: Synthetic coding sequence
gagctgaaccagtcttctgaatgggaaaccttctctgagaggagctccagctctcaaacactgactcagttcgactcgaacattgctccagcagacccagatacggctatcgtccacccagtccccatccgcatgaccccttctaaaatccacatgcaggagatggaacttaagaggaccggatccgaccatacaaaccccacaagccccctgctcgtcaaacccagcgacctgctggaagaaaataagatcaattctagcgtcaaattcgcatctggcaacactgtgggccagcagcaagcgggtgtggtggcccacccacctgcagttcctcctcgtccacagccgtctcaggccccagggcctgccgtccaccggccagttgatgccgacgggctgataacgcatacgagtacatcacctcaacaaatccctgaatag

SEQ ID NO: 53353 - DNA, 1398 bp, Artificial Sequence
  Description of Artificial Sequence: Synthetic coding sequence
atgacaaccatcccgcgaaaaggatctagccacttacctggctccttacatacttgtaaactgaagttacaggaagacagacggcaacaagagaagtccgtaatcgctcaaccgatcttcgtgttcgagaaaggtgagcagacttttaagcgacccgctgaggatacgctctacgaagcagcagaacccgagtgtaatggcttccccaccaagagagttcgaagctccagcttcacttttcacataacagactctcagagccaaggcgttagaaaaaataacgtgttcatgacatccgcgctggtgcagtcctctgtggacatcaaatcggcggagcagggtcctgtaaagcactccaagcatgtgattaggcccgctatcctgcagctgccccaggccaggtcatgtgcgaaggtgcggaagacattcggccataaggcactggagtcctgcaagaccaaggagaaaacaaacaataaaatctctgaagggaatagctacctgctttctgagaacctgtccagggcacgcatttcagttcaactcagcacaaatcaggactttctgggagcgacctccgtggggtgccaacctaatgaggataagtgcagcttcaaatcgtgttcatccaacttcgtgttcggcgaaaatatggtggagcgcgttctcggaacccaaaaactgactcaaccccagctagaaaatgacagctatgccaaagaaaagccttttaagagcatccccaagtttccagtgaactttctgagctcaaggaccgacagtatcaagaacactagtctgatagaatctgccgctgccttttcttcacagcccagccgcaagtgcctcttagaaaaaattgacgtaattaccggcgaggagacagagcacaatgtcttgaaaatcaactgcaaactgtttatctttaacaagactactcagagttggattgaaagaggaaggggaaccctccggctgaacgacaccgctagcacagactgtggcactttacagagcaggcttatcatgcggaatcagggatcacttcggctcatccttaattcaaaactctgggcacaaatgaaaatccagcgggcaaaccacaagaacgtgagaatcacagccaccgacttggaggactatagtattaagatcttcctgatccaggctagcgcacaggatactgcatacctctatgctgccattcaccatcggctcgtggccctgcagtcctttaataaacaacgggatgttaaccaggctgagtctctgtccgagactgctcaacagctgaattgcgagagctgcgatgagaacgaagacgatttcattcaggtgaccaagaatggttctgacccgtccagttggacccacagacagtccgtggcctgttcttag

SEQ ID NO: 53354 - DNA, 327 bp, Artificial Sequence
  Description of Artificial Sequence: Synthetic coding sequence
atgacaaccataccacggaagggatcgtctcatctgcctgggtctctacatacatgcaaactgaaactgcaggaggaccggcgtcagcaggaaaagagcgtgattgcacagcccatttttgtcttcgagaagggtgaacagaccttcaagaggccagcagaagacacattatacgaagccgcagagcccgagtgcaacggattccccacaaagagggtgcggtcgagcagtttcacatttcacatcacagatagtcagagtcagggcgtacgcaagaataacgtatttatgacatccgcattagtacagagctcagtggatatttag

SEQ ID NO: 53355 - DNA, 1473 bp, Artificial Sequence
  Description of Artificial Sequence: Synthetic coding sequence
atgaccacaatcccccgaaaagggagctctcatctgccaggtagcctgcacacctgcaaacttaagctccaggaggataggagacaacaagagaaatccgtcatcgcccagcctatcttcgtgtttgagaagggcgagcagacatttaagcgtccggcagaagacacactgtacgaggcggctgaacctgagtgtaacggatttcctacaaagcgcgtgcggtctagctccttcacgtttcatattaccgattcccagtcacagggagtgtccactctttctcagaagcagatgaggtgctcctcggtgacaaacttgccaacattcccacactcagggccagtgagaaagaacaatgtgttcatgacttccgccctcgtgcagtcgtcagtcgacattaagagcgccgaacagggacccgtgaagcactccaagcatgtgatccggccagctatcctgcagctgcctcaggccaggtcctgtgcaaaagtgcgtaaaaccttcggccacaaagcactcgagtcatgtaaaacaaaagagaagacaaataataagatcagcgagggaaatagctatctgttatctgagaacctgtccagagctcgcatctccgtccaactcagtactaaccaagatttccttggagcgacaagcgtagggtgtcagccaaacgaagataagtgtagttttaagtcgtgctctagtaattttgtgttcggagaaaacatggtagagagggtgcttgggacccagaagctgacacagccccaactggagaatgatagttacgccaaggaaaagcctttcaaaagcataccaaagttccccgtgaattttctcagctctcgtacagactcaatcaaaaatacgagtctgatcgagtctgctgccgcttttagcagccagcctagtcgcaagtgcctgctcgagaagattgacgtcattactggggaggaaaccgaacacaacgtgctcaagattaattgcaaactatttatcttcaataaaacaacgcagtcatggatcgaaaggggcagaggcacactccgtctgaatgataccgcttcgacggactgtggaactctgcagtcccgtttgatcatgagaaatcagggcagcctgcgtctgatcctgaacagcaagctgtgggcccagatgaaaattcaaagagcaaaccataaaaacgttcgcattactgccacggatctcgaagactattccatcaagatcttcctcatccaggcctccgcccaggatacagcctatctttatgctgcaatccaccatcggctggtcgctctccaatcttttaacaagcagcgcgatgtgaatcaggcagagtctctgtccgagactgcacaacagctgaattgtgaatcatgtgatgaaaacgaggacgactttatccaggtcactaaaaatggcagtgatccatcctcttggacacaccgccagtccgtggcatgcagctag

SEQ ID NO: 53356 - DNA, 4500 bp, Artificial Sequence
  Description of Artificial Sequence: Synthetic coding sequence
atgaaaccactggctatacccgcaaaccatggggtgatgggccaacaggagaagcactcacttcccgctgacttcacaaagcttcatctgacagattctcttcacccccaggtgactcatgtgtcctcctcccattcgggatgttcaattacttccgatagcgggtcatcgtctctttccgatatctaccaggcgactgagagcgaggccggagacatggatctgtctggattgcctgagacggccgtagattcggaggacgacgatgacgaagaggacatcgaacgcgcatcagaccccttaatgtctagagacatcgtgagggactgcctggagaaggatccaatcgatcggaccgatgatgacatagaacaactgctggagtttatgcaccaactgccagcatttgctaatatgacaatgagtgtcagacgagagctatgtgccgtgatggtgttcgccgtggtcgagagagccggtacaatcgtcctcaatgatggggaagagctggattcgtggtccgtcatcttaaacggtagcgtcgaagtgacttaccctgatggcaaggccgagatactgtgtatggggaattccttcggagtgagccccactatggacaaggaatacatgaaaggggttatgcggaccaaggtggacgattgccaatttgtgtgcatcgcacagcaagattactgcaggatcttgaaccaagtggaaaagaatatgcagaaagtagaagaagagggagagatcgtaatggtcaaggaacaccgtgaactggatcgcaccgggactaggaagggccacatcgttatcaagggtacctcggagcgactcaccatgcatctggtagaggagcatagcgtcgtggaccccaccttcattgaggacttcctactgacatatagaacattcttgtcatcgcctatggaagtggggaagaaattgctcgagtggttcaatgacccttctctccgggataaggttacccgggtagtgcttctgtgggtgaataatcactttaatgatttcgaaggagaccccgctatgacgagattcttggaggaattcgaaaacaacctggagagagagaaaatgggcggtcatttgcgtctgctgaacatcgcttgcgcagcaaaggcgaagagacgcctgatgactcttaccaaaccatctcgggaggcgcctctaccctttattctactggggggatccgagaaagggttcggtatcttcgtggactctgtggattctgggagtaaagcaactgaagccggtctcaagaggggagatcagatcctcgaggtcaacggccagaatttcgagaacattcagttatccaaggcgatggaaatcctgagaaataatactcatctgtctatcactgttaagacaaatctgtttgtgtttaaggaattacttacaagactcagcgaggagaagcgcaacggagcaccacatttgcctaagattggggacattaaaaaggctagtcggtactcaattcctgacttagctgtggacgtcgagcaggtaattggcctggaaaaggtgaacaagaaaagcaaggcgaacaccgtaggcggtcggaacaaattgaaaaaaatactggacaaaacgcgtataagtatattgccccagaagccctataacgacatagggattgggcagtcccaggatgactcaattgttggactccggcagaccaagcatatcccaacagctttgccagtgtcaggcacactgagctcttcaaatccagatctgctccagagccatcatcgcattctggacttctcagctactcccgatttgcccgaccaggtgctgagggtattcaaggccgaccaacaatcacggtacatcatgatcagcaaggatacaacagctaaagaagtggtcattcaggccattagggagtttgcggtgaccgctacgccagaccagtacagtctgtgcgaggtttccgtgacaccggaaggcgttataaaacagcgtcgactgccagaccagttatccaagcttgctgatcgaatccagctgtctggtcgatattacttgaagaacaacatggaaacagagacattgtgctctgatgaggacgcacaggaactgctgagggagtcacagattagtttgctgcagctgtcaacagttgaggtagcaacccagctgagcatgcgtaactttgaacttttcaggaatatagaacccaccgagtacatcgacgacctattcaagttgcgatcgaaaacgagctgtgccaacttaaagagatttgaggaggtgatcaaccaggagactttttgggtcgcatcagagattctacgggagactaatcagctcaagcggatgaagattatcaagcacttcattaaaatagccctgcactgcagggaatgtaagaattttaacagcatgtttgcgattatctccggactgaatcttgcccctgtcgccaggttgcgcaccacatgggaaaagttgcctaataagtatgagaagctgttccaagacctccaggatctgtttgaccctagccggaacatggccaaataccgcaacgtgctgaatagccagaatcttcagccacctataatccccctctttccagttattaaaaaggatctcacttttctccatgagggcaacgattccaaagtggacggtttggtcaatttcgaaaaactgcgtatgatcgccaaggagatacgccatgtaggccgaatggctagcgtgaatatggacccggctttgatgttccgtacccgtaaaaaaaaatggagatcactgggatctctgtcccagggttctacaaatgccaccgtgcttgacgtcgcccaaactggtgggcataaaaagcgggtgcggaggtcatcctttcttaacgcaaaaaagctctatgaggacgcccagatggcaagaaaggtgaaacaatatctctctaatctggaactagagatggatgaagaaagtttgcagactctgtccctccaatgcgaaccagccacaaacactctaccaaagaaccccggtgataaaaagcccgtaaaaagcgagactagccccgtggcaccaagggcgggttctcagcagaaagcccagtctttaccacagccccaacagcagccacccccagcacataagatcaatcaaggtttacaggttcccgctgtttctttgtatccttctcgcaagaaagttcccgtgaaggaccttccacctttcggcataaactctccacaagctctgaaaaaaattctgtctctaagcgaagagggctcattagagaggcacaagaaacaagccgaggacactatcagcaacgcctcaagccagctaagcagccctcctacaagcccccagtcatctccacgaaaagggtacacacttgcacctagtggcaccgtggataacttctctgactccggccatagcgagatttcatccaggagctctatcgtgtctaactctagctttgacagcgtgcctgtgagcctccacgacgaaaggcgccaaaggcattcagtaagcatcgtggaaacgaacctcggcatgggaagaatggagagacgaacgatgattgagcccgaccaatatagtctgggctcatacgctcctatgagcgagggcaggggtctgtacgccaccgctaccgtgatcagttcccccagcactgaagagctgagccaggatcagggagatcgcgcaagtttggacgctgcggactctgggcgaggctcatggacttcttgtagttctggctcccatgataatatacagacgatccagcaccaacggtcctgggagactctaccctttgggcacacccattttgattacagcggagatccagctgggctgtgggccagttctagccacatggaccagattatgttctcagatcacagtactaagtacaatcggcagaaccagtcacgagaatccctagagcaggcccagtcccgcgctagctgggcgtcaagtacaggatactggggggaggacagcgagggtgacactgggaccatcaagagacggggaggcaaagacgtgtccatcgaagcagagagcagcagtctgacgtcagttaccaccgaagaaactaaacccgttcctatgcccgctcatattgccgtggcctcctcaactactaaggggctgatcgcgagaaaagaaggcagatatagagagcctcctcctacgccacccggatacataggcatccccattacagattttccagaaggccactcacatccagcgcgtaaaccacccgattacaatgtggctctgcagcgttcgcgaatggtggctcggtcatctgatactgccggaccgagctcggtgcagcagcctcacggtcaccccacgtcctccaggcctgtgaataaaccgcaatggcacaagcccaacgagtcagacccacgccttgccccttaccagtctcagggatttagtactgaggaagatgaggatgaacaggtgtctgctgtgtag

SEQ ID NO: 53357 - DNA, 2646 bp, Artificial Sequence
  Description of Artificial Sequence: Synthetic coding sequence
atggtgttgcgccgaatgcatcgacctcgctcttgttcttaccagctccttctggagcaccagcgtccttcctgcatccaaggtctgcggtggacaccacttactaactccgaagaatccctggatttcagcgaatccctggagcaagcatcgactgagcgagtcctgagggctggcaggcagctccataggcacctgctcgccacctgccctaatctcataagagataggaagtaccatctgagattatataggcagtgctgcagcggcagggaactcgtggacgggatccttgccctcgggcttggagttcacagtcggtcccaggtggtggggatttgccaggtgctgctcgatgagggggcattatgtcacgtaaaacacgactgggcctttcaggaccgcgacgcacagttttacagatttcctgggcctgaacctgaaccagtcaggacccacgagatggaagaggaactggctgaggccgtggccctgctgtctcagcggggtcccgacgccctcctgacagtagcccttaggaaaccacccggtcaaagaacagatgaggaactggatttgattttcgaagagttgttgcatattaaggcagtagcccacctctcgaattccgtgaagagagagctagcggctgtgctcctcttcgagcctcatagcaaagccggaactgtgttattctcacaaggagataagggaaccagttggtacatcatttggaagggctcagtaaatgtagtgacacacgggaaagggctggtcacgacacttcatgagggagatgatttcgggcagctcgccctggtaaatgacgctccccgagccgctaccattatcctgagggaggataactgtcactttctccgggtggacaagcaggattttaataggattattaaagacgtcgaggcaaagactatgcggctggaggagcacggtaaagtcgtgttggtactggaacgcgcatcccagggagcaggtccaagtaggccaccaacccccggtaggaaccggtacaccgtcatgagtggcacaccagagaaaatccttgagctgctgctggaggcaatggggcctgattcaagtgctcatgaccctacagaaacatttttatctgacttcctgctcacacaccgggtcttcatgccctctgcgcaactttgcgcagccctattgcaccactttcacgtagagcctgccggaggtagcgagcaggagaggtcgacttatgtctgcaataaacgacagcagatcctccgactggtcagccagtgggtggccctgtatggttcaatgctgcacacagatcctgtcgctaccagtttccttcagaagctctcggatctcgtgggacgcgacaccaggctctcaaatctcctccgggagcaatggcctgagaggaggcggtgccatcgcttggaaaacggttgtgggaatgcgtccccccagatgaaagctcgcaacctgcctgtctggctgcctaaccaggatgagcccctgcccggttccagctgtgccatacaagtgggggacaaagtgccatatgatatatgtagacctgatcactctgtccttacactccagttgcccgtaaccgcgtcagtgcgcgaagtcatggctgctctggcccaggaggacggatggaccaaagggcaagttctcgtgaaggtcaactccgctggtgacgccatcgggttacagccagatgccagaggagtggccacctcattgggcctgaatgagcgattgttcgttgtgaatccccaggaggttcatgagctgattcctcacccggatcagttggggcctaccgtgggaagtgccgagggactggatctcgtcagcgccaaagatctggctggccaactgaccgatcatgactggagcttgtttaacagtatccaccaggtggaactaatccactatgtccttggccctcagcacctgcgggatgtgacaaccgctaatctggaacggtttatgaggagattcaacgagcttcagtactgggtggctaccgaattgtgcctgtgtcctgttcccggtccgagagcccaattactccggaaattcataaagctcgcagcccatctgaaggagcagaagaatctgaactcctttttcgctgtgatgttcggactgtcaaatagtgctatctcaagactggcccacacctgggaacgcctcccacacaaggtccgcaagctgtacagtgccctggagcgtctgctggacccatcatggaaccacagggtgtacaggcttgctctagccaaactgagcccccctgtgattcccttcatgccacttctcctgaaagatatgacctttatacacgaggggaaccacaccctggttgaaaacctcatcaattttgagaaaatgcgtatgatggcaagagcagccaggatgctgcaccattgcaggtcccataacccagtccccctttcacctttgcgttcacgggtgagtcacctacacgaggactcccaagttgccaggataagcacatgctccgagcagagtttgtccacccggagcccggcatctacttgggcatatgtccagcagctgaaggtgattgacaaccaacgtgaactaagccgtcttagcagggaactagaaccatag

SEQ ID NO: 53358 - DNA, 2646 bp, Artificial Sequence
  Description of Artificial Sequence: Synthetic coding sequence
atggtgctccgcaggatgcatagaccgagaagctgctcttaccagctgctcctcgaacatcagcgccctagctgtattcaggggctacggtggacccctcttactaactcggaggagtcgctggatttctcagaaagcttggaacaggcatcaacagaacgcgtcctgcgcgcagggcgacagttgcaccgacatcttctggctacatgcccaaacctgatcagagaccgaaaataccatttgcgcctgtatcggcagtgctgcagtgggagagagctcgtcgacggcatcctcgctctcgggctcggtgtgcattccaggagccaggtggttggaatttgccaggtgctgctcgacgagggggcactctgtcatgtgaagcacgactgggcctttcaggatcgtgacgcgcagttctaccgcttccctgggcctgagcccgagcccgtgcggacacatgagatggaggaagaattggctgaagctgttgctttattatctcagagaggtcccgatgccctgctgactgtggctctgcggaagcctccagggcagcgaacagacgaggaattggatcttatctttgaggaactgctgcatattaaagccgtcgcacatctgtccaattcagtcaagagggaattagcagctgtgttgctgtttgaaccgcactccaaagccggtaccgtgctgttctcacagggtgacaaaggcacgtcttggtatattatttggaagggctctgtgaacgtggtgacccacggcaaaggtttggtcacaactctacacgaaggtgacgatttcgggcagttagctctcgtaaacgatgctcccagagccgctacaattattttgagagaagacaactgccacttcctgcgtgtggataagcaggacttcaaccggatcattaaggacgtcgaggccaagacaatgcgactggaggaacatggaaaggtcgtgctcgtactggagcgcgcttcgcagggtgcaggcccttctagacccccaacaccaggtagaaatcggtacaccgtcatgtccggaacccctgagaagatcctggagctcctgctggaggccatgggaccagacagcagcgcacatgatcccaccgagacatttttatctgacttcctgctgactcaccgcgtgttcatgccttcagctcagctatgcgctgccctgctccaccatttccatgtagagcccgctgggggaagcgagcaagagcggtcaacatatgtatgcaataagcggcagcagatcttgagactggtgtctcaatgggtggctttgtacgggtccatgttacatacagatccagtggcgacttcattcctgcagaaactctctgatctagtggggagagataccagactctctaacctgctgagggagcaatggcccgaacgaaggcgatgtcataggcttgagaatggatgcggaaacgcctcgcctcagatgaaggccagaaatctacccgtttggctgcctaaccaggatgagcctcttcccggatccagctgtgccatccaggtaggggataaagtaccctacgacatttgtcggccagaccattctgtgctgaccctgcagttgcctgtgaccgcaagtgtccgcgaagtgatggccgctctggcacaggaggatgggtggacaaagggccaagtgctggtgaaagtcaattcggccggtgacgccatcggtctccagcctgacgctaggggagtagctacttcgttgggattgaatgaacgtctgttcgtggttaacccacaggaggtgcatgagctgatcccccatcccgatcagttaggacccactgtcgggtccgccgagggtctggatctggtgagcgccaaggacctggctgggcagctgactgaccacgactggagtctttttaactcaattcaccaggttgagcttattcactacgtgctcggtccccagcatttgagagatgtcaccaccgcaaatctggagcgctttatgcgcagatttaacgaactgcagtattgggtggcgactgagttgtgcctgtgtcccgtccccggaccccgtgctcaactcttgcgaaaattcattaaacttgctgcccacctcaaggagcagaagaatctgaattcttttttcgcagtcatgtttggattgagcaacagcgcgatttcacgcctcgctcatacatgggaacgattgccacacaaagttaggaaactgtatagcgcactcgaacgactgctggatccatcctggaaccaccgcgtatatcgcctagcattagccaaactttctcctccagtgattcccttcatgcctctgctcctgaaagacatgaccttcattcacgagggcaaccacactctggtggagaatcttattaatttcgagaaaatgagaatgatggctagggccgctagaatgcttcatcactgtagatctcacaaccctgtgcctctgtccccccttcgctcgcgggtctcccacctgcacgaggattcccaggtggcaaggatatccacatgttcggaacagtccctgtcaacccgcagtcccgcttccacctgggcctatgttcagcagctcaaggtcatcgataaccagcgtgaactgagcaggctgagtcgggagctggaaccctag

SEQ ID NO: 53359 - DNA, 2772 bp, Artificial Sequence
  Description of Artificial Sequence: Synthetic coding sequence
atgaaggtagggtggccaggagaaagttgttggcaggtagggctggcagtagaggactctcctgccttgggcgcacccagagtgggggctctgcctgacgttgttcctgaggggaccttactcaacatggtgcttcggaggatgcacagacctcgctcctgttcctatcaactgctgctggagcatcagcgccctagctgcatccaggggttaagatggacacctctgacaaacagcgaggagtctctggactttagcgaaagccttgaacaggcctccactgaacgggtgcttagagctggacgacaactgcatagacacctgttagcaacctgtcccaacctcatccgcgatcgaaagtaccatctccgtctgtaccggcagtgctgcagcggcagggagctcgtcgacggcatactcgctcttggtctcggggtgcactccaggtcccaggtggtggggatctgtcaggtgctgctggatgaaggggctctttgtcatgttaagcatgactgggcattccaggatcgggacgcccagttttaccggtttcccggacctgagcccgaacctgtgcgcacacacgaaatggaagaggaacttgccgaagccgtagccctcttgtcacagagagggcctgacgctctcctgacagtggccttgcggaagccacccggacagcgcacagatgaagagctggaccttatctttgaagaactgttgcatattaaggccgtggctcatctgagcaacagtgtgaaaagagaactggccgcagtcttgttattcgaacctcatagtaaagccggtacagtgctcttctcgcaaggagacaaaggtacctcctggtatatcatttggaaaggctctgtcaatgttgtgacccacggtaaaggattggtcacgactttgcacgaaggagatgacttcgggcaattagcccttgtcaacgatgcccctcgtgcagcaaccatcatcttgagggaagataattgccactttctgcgcgtcgacaaacaggacttcaatagaatcataaaggatgtcgaggcaaaaactatgcgccttgaggagcatggcaaagtggtcctggtccttgagagagcctcacaaggcgcaggccctagccgacccccaaccccagggaggaataggtacactgtcatgagcggcacacccgagaaaatcctggagctgctgctggaggctatgggcccagactcgagtgctcacgaccccactgaaactttcttgtctgattttctactgacacaccgggtgttcatgccctctgcccagctgtgcgccgctctgctccaccattttcacgtggagccggcaggcggatccgagcaagagcgcagtacttatgtgtgtaacaagagacagcagatactcagattggtatcacaatgggtcgcattgtacggttcaatgctccacacagaccccgtcgccacttctttcctacagaaactatctgatttggtgggcagggacactcgcctgtccaatctcctgagagaacagtggccggagcgaaggcggtgtcatcgtctcgagaacggctgtggaaatgcgagtccgcaaatgaaagctagaaatctgccagtgtggctgcctaatcaggacgagcctctgcctggatcaagctgcgcaatacaggtgggagacaaagtaccatatgacatctgtaggccagaccatagcgtgctgactctgcaactaccggtgacggcttcggttcgtgaagtaatggcagcactggcgcaagaggacggttggacaaagggccaggtcttggtcaaagtaaatagcgctggtgacgcgataggattgcagccagatgcgcgtggtgtggccacgtcattgggcctgaatgagcggctgttcgtagtcaacccccaggaggtgcacgagctgatcccccatccagaccagctaggccctactgtgggttccgctgaggggctggatttggtctccgctaaagatctcgccggtcagctgaccgaccacgactggtccctatttaatagtattcaccaggttgagcttatacattatgtgttgggccctcagcacctgagggatgtaaccacagcgaacctagaacgattcatgcggaggttcaatgaattacagtattgggtggccactgagctctgtctgtgtcctgtacccggacctagagcccagctcctgaggaagttcatcaaactggccgctcatttgaaagagcagaagaacttaaacagctttttcgccgtcatgttcggtctgagcaactccgctatatccagactggcacacacttgggaacgtctcccacacaaggtgaggaagctttacagcgctcttgaaagattgttggacccctcatggaaccacagggtgtaccgcttagctctggcaaaacttagcccgcctgtgattccattcatgccactattactgaaggatatgacttttatccacgagggaaatcacaccctcgttgaaaacctaattaacttcgagaaaatgagaatgatggccagggctgccaggatgctgcaccactgtaggtcccacaatccagtccctctcagccctctccgtagtagggttagtcatctccacgaagattcacaggtggcaagaatcagcacgtgcagcgaacaatccctctctacacgtagtccggcaagcacgtgggcttacgtgcagcagctgaaagtcatcgataaccaaagggagcttagtcgcctctccagagaactcgagccctag

SEQ ID NO: 53360 - DNA, 1797 bp, Artificial Sequence
  Description of Artificial Sequence: Synthetic coding sequence
atgaaagttgggtggccaggagaaagctgctggcaggtgggactagctgtggaagatagcccggctctgggagctccgagggtgggtgctttgccggatgtggtccctgagggaaccctcttgaacatggttcttcggaggatgcatcgcccaagatcctgtagttaccaactgttgctggaacatcaaaggccctcatgcattcagggtctgaggtggacacctctgacgaattcggaagagagcctggatttcagtgagagcctggagcaggcaagcaccgaaagggtgctccgcgctggacgccagcttcacagacacctcttagccacttgtccgaacctgatcagggatagaaagtaccacctgcgcctgtatcggcagtgctgcagtggccgagagctggtcgacgggatcttagctttgggtctgggcgtgcactcaagatcacaagtcgttggaatctgtcaggtgttgctggacgagggtgctctttgccatgtgaaacatgactgggcctttcaagaccgggatgcccagttttaccggttccccggaccagagcctgagccagttagaacccacgagatggaagaggaactggccgaagctgtggcactcttgtcccagaggggcccagacgcactgctcacagtggcactgcgcaagccaccaggacaacgaactgacgaggaactggacttaatcttcgaggagctcctgcacattaaagccgtggctcacctcagtaatagtgtgaagagggaactggctgctgtgttgctttttgaaccccatagcaaagcaggcacggtgctgttcagccagggggacaaaggtaccagttggtatataatatggaaaggatccgtgaacgtggtgacacatggaaagggcctcgtgactactttacatgaaggagatgattttggtcagttggctcttgttaatgacgcccctagagcggctactatcatcctgagggaagacaactgccactttttacgcgtagataagcaagattttaatcgtataataaaagacgtggaggcaaagacaatgaggctggaggagcacggcaaagtggttctcgtcttagagagagcctcccagggagcaggcccttcgcgaccgcctactcccggtagaaatcggtatacggttatgtctggcacacccgaaaagatactggagctgttgctggaagcaatgggcccagactcctccgcacacgacccaaccgagaccttcttatcagacttcctcctcacacacagggtgtttatgcctagcgctcaactctgcgcagccctcctgcaccacttccatgtggaacctgcaggcggaagcgaacaggaacgaagcacttacgtttgtaacaaaaggcagcagatcttgcggctggtgagtcagtgggtggccctgtacggaagtatgttgcacactgaccctgtggctacaagcttcctccaaaaactgtcagacctggtaggaagggacaccagactcagcaatctgctaagggaacaatggcctgagcggcgacggtgtcacagactggaaaatggttgtgggaacgccagtccacagatgaaagtaagtgcctggcctcagttcctttcatctgcccctccagggcttcaggccccaccgtcaccgcctgaccctgagggactgtgcggcagggggaaactttctagtcatcggcacactctggggagtctgatcggagtgcacggtgccctggctgcctgtggtgctctcggacaagcagtgccaggcggagccgaggcctag

SEQ ID NO: 53361 - DNA, 2607 bp, Artificial Sequence
  Description of Artificial Sequence: Synthetic coding sequence
atggcccagagggaggaaatcaaaagacctctgtgggagaccgtaggctggcccggagagtcatgctggcaagtgggacttgccgtggaggattctcctgcgctaggcgctccaagggtcggggcactgcccgacgtggtgcctgaaggcacattactcaatatggttctgcggcgtatgcacaggccacgttcttgttcctatcagctcctgctggagcaccagaggcctagttgtattcagggacttagatggacacccctgactaactccgaagagagtctcgacttctccgaatcactggagcaggcctcaactgaacgcgtcctgcgcgcaggcaggcagctccacaggcatttgcttgcaacgtgtcctaaccttattagagacagaaaataccacttgagattgtatcgtcagtgttgcagtggaagggagctcgtggatggaattcttgccctgggcttgggcgtccattctcgctctcaggtggtcggcatctgccaggtcctcctggacgaaggagctctctgccacgtcaaacatgactgggcttttcaggaccgcgatgcccaattttaccgattccccggacctgaacctgaacccgtgcgaacccacgagatggaagaagagctggccgaggccgttgcgctactatcacagagaggtccggacgctctgctcaccgtggctcttaggaagcctcctggacagagaaccgacgaggagctggacctgattttcgaagagctccttcatataaaggccgtggcccacttgagcaatagcgtcaagcgagagctagccgctgtcctcttatttgaaccacattctaaggccggtaccgtgctcttcagtcagggagataagggaacctcctggtacatcatctggaaaggcagcgtgaacgtggtcacccatggcaaaggactggtgacgactttgcacgagggggacgatttcggtcagttggccttagttaacgacgctccacgcgctgccacaatcatcctgagagaggataattgccacttcctgagggtcgataagcaagattttaaccgaattatcaaagatgtggaggctaaaaccatgaggctggaggagcacggcaaggtcgtccttgtgctggagcgcgcttcccagggggctggccctagtcggccaccaacacctggcaggaacaggtataccgtaatgagtggaactcccgaaaagatactggagcttctcctcgaagctatgggtcctgattcctctgcccacgaccccacagaaaccttcttaagcgactttctgctgactcacagggtgttcatgccctctgctcagctgtgcgcagctctattgcaccactttcacgtagaaccagccggagggtccgaacaggagagatccacttatgtctgtaacaagcggcagcagatactccggctggtaagccagtgggttgccttgtatggtagcatgcttcacactgatccagtggcaactagtttcctgcagaagctttctgatctggtcggtagagatacacggctgtcgaatctactccgggagcaatggcctgagcgcagaaggtgccacaggctggaaaatggctgtggcaacgcaagccctcaaatgaaggccaggaacctccccgtgtggctcccgaaccaggacgagcctcttcccggttcctcctgtgccatccaggtgggggacaaagacgcgattggcttacagccagatgccagaggcgtggcgacttccttggggctgaacgagcgcctgtttgtggtcaacccacaggaggtgcatgaattaattccccatcctgaccaattagggcctactgttgggtcagctgaaggactcgatctcgtctcagccaaggacctcgctggacagcttactgaccatgactggagtttattcaactctatccaccaggtggaactgatccactacgtcttgggaccacagcacctaagggacgtcacaacagccaatcttgagagattcatgagaagattcaacgagctgcaatactgggtggctacagaattgtgtctttgtcctgtccctggtccaagagcccaattgttgagaaagttcattaagttagctgctcataacagcgcaattagccgccttgctcacacctgggagcgactccctcataaagttcgaaaactgtatagcgccctggagcggctgttggatcccagctggaaccatcgtgtctatcgcctcgcactcgcaaagttgagcccaccagtgattcctttcatgcctctgctgcttaaagacatgacgtttatacacgaaggaaaccacactcttgttgaaaatctcatcaatttcgaaaaaatgcggatgatggctcgggcagcccgtatgctgcatcactgtcggtcacacaatcccgtccctctgagccccctgcgcagcagggttagccacctccatgaggactcccaagtagcacgcatttctacatgcagcgaacagtccctttcaactcgttcgcctgccagcacttgggcttacgttcagcagttaaaggtcatagacaaccagagagaactgtccaggctgagtagggagcttgagccatag

SEQ ID NO: 53362 - DNA, 2646 bp, Artificial Sequence
  Description of Artificial Sequence: Synthetic coding sequence
atggtccttagaaggatgcaccgcccacgctcttgttcctatcagcttctcctagaacaccaaaggccttcttgtatccagggactgcgttggacaccactgaccaactctgaggaaagtctggattttagtgaatcgctggagcaggccagtacagagcgggttctgcgcgctgggaggcagcttcatagacatctgctggccacttgccctaaccttatacgagataggaagtatcacctccgtctctatcgccaatgctgctcgggccgtgagctcgtggatggcatactcgctttggggttaggggtgcactccaggtcccaggtggtcggaatatgtcaggttttattggatgaaggtgccctatgtcatgtcaagcatgactgggcattccaagatagagatgctcaattttacaggttcccaggcccagagccggagcccgtgaggacccacgagatggaagaggaactggctgaggctgttgcgctgctttcccaacgcggaccagacgcccttttgactgttgccttacgtaagcctcctggccagagaaccgacgaggagctggacctcatttttgaggagcttctgcatatcaaagcggttgctcaccttagcaattccgtaaagagggagttggccgctgttcttctcttcgagccccactccaaggctgggaccgttttatttagccaaggcgacaagggcacaagctggtatatcatctggaaaggctccgtgaacgtagttacccacggcaagggcctggtgaccacgctgcatgaaggcgatgacttcggacagctagccctggtgaatgacgcccctcgagccgctaccattattctccgcgaggataattgccacttcttgcgagtcgataaacaggactttaatcgaatcattaaagacgtcgaggccaagacaatgcggctcgaggaacatggaaaggtggtgctcgtcttggaaagggccagccaaggcgcaggccctagccgacctcccacaccaggaagaaaccggtacactgtaatgagcggcaccccagagaaaatcctggaactcttgctcgaggccatgggacctgattcctcggcgcatgatcccaccgaaaccttcctaagtgatttcctcctgacacaccgcgtgtttatgccctcagcacagttgtgtgccgcactgctgcaccacttccacgtggagccggctggaggttccgagcaggaaagaagcacctatgtgtgcaataagcgacagcagatccttcgcctggtgtctcagtgggtagccctctacggatctatgttgcacacagatcccgtcgcaacatccttccttcagaaactctctgacttggtaggcagggatacaaggctgtctaatctactgagagaacaatggcctgaacgcaggagatgtcacagattggaaaatggttgtggaaacgcgtccccccagatgaaagctagaaacctgccagtctggctgcccaaccaggatgagcctttacccggtagttcctgcgcaatacaagtgggtgacaaggtgccctatgatatctgcaggccagaccacagcgtgttaactttacagctgcccgtcaccgcgtccgtgagggaggtgatggccgctctggcccaggaagacggatggacgaaagggcaggtgctcgtgaaggttaattcagcaggagacgccatcggtctccagcccgacgcgcgaggcgtggctacttccttgggactcaacgaacgactctttgtcgtgaaccctcaggaagtacatgagctaattcctcacccagaccaacttgggcctactgtcggtagtgctgaggggctggatctcgtgagtgcaaaggatcttgctggacagcttacagatcatgactggtctctctttaattcgatccatcaggtggagctcatccattatgtgttgggaccccaacacttacgggacgttactacagccaacctcgagcggttcatgagacggtttaatgagctccaatactgggtggctactgaactgtgtctctgccctgtgcctgggccacgcgctcagctgctgaggaaatttatcaaactggctgcccacttaaaggaacagaagaatttgaactcctttttcgctgttatgttcggcctgagtaattcagccatatcccggttggcccacacctgggagcgcttaccgcataaggtgaggaagctatatagtgcattagaacggcttcttgaccccagctggaatcaccgagtgtatcggctggccctggccaaactatctcccccagtgatcccctttatgcccctgctcctgaaagatatgaccttcatacatgaaggtaaccacacgctggtagagaacttgatcaacttcgagaaaatgcgcatgatggccagggctgcacgtatgctacaccactgtcggagtcacaaccccgtcccattatctcctcttagatccagggtgagccatttgcacgaggatagtcaagtggctaggatcagtacttgcagtgagcagagcctctcaaccagatcacctgcgtctacatgggcttacgtccagcagctaaaagtaattgataaccaaagagaattgagcagactctcccgggaactggagccatag

SEQ ID NO: 53363 - DNA, 2772 bp, Artificial Sequence
  Description of Artificial Sequence: Synthetic coding sequence
atgaaggtagggtggccaggtgagtcatgttggcaggtcggcttggccgtggaggatagcccagccctgggggcaccacgggttggggcattacccgacgtggtacctgaagggaccctcctgaacatggtgctaagaaggatgcataggccacgttcctgctcctatcaactgcttctggagcatcagcgcccttcctgcattcaaggactccgttggacacccctgacaaactctgaggagtcactggatttcagtgagagccttgaacaggcctctacagaaagggttcttagagccggtaggcagcttcatcgccacttgctggctacatgccccaacctgattagggacaggaagtatcatctcaggttgtatcggcaatgctgctcaggcagggaactggttgatggtattctggcattggggctaggggtgcattccagatcccaagttgttggcatttgtcaggtattgcttgatgaaggcgcactgtgccacgtgaaacatgattgggcgttccaggatagggatgcccagttctaccgttttcccggaccggaaccggagccagtgcgtacgcacgagatggaagaggagctggctgaggccgttgccctattatcacaaaggggacctgacgccttgctcaccgtggccctcagaaagccaccaggccaacggacagacgaggaactggacctgatcttcgaagaactgctgcatattaaagctgtagcacatctctccaatagtgtcaaacgagagctggctgcagtgctcttgttcgagccacattctaaggccggaactgtgctgttctcccaaggcgataaggggacatcctggtacataatttggaaaggttcagtaaatgtggtgacacatggaaagggtctggttaccacactccatgaaggtgacgacttcggtcaactcgccctcgtgaacgatgcaccgagagctgcaactatcatactgagagaggataattgtcacttcctcagagtggacaagcaggacttcaataggattatcaaagacgtcgaggccaaaacaatgcgcctcgaagagcatggcaaggtggtgctcgtgctggagcgcgcttcacagggagcgggtccctctcgcccaccaacaccaggacgcaatagatataccgtaatgagtgggacgcccgaaaagatcctcgagctgcttttggaggccatgggcccagactcttccgcacatgatccaacagagacgttccttagcgattttctgttaactcatcgcgtcttcatgccttctgcacagctctgcgccgctctgttacaccacttccacgttgaaccagccggtggaagtgagcaggagagaagcacctacgtgtgcaataagaggcagcaaattctgcgcctcgtttctcagtgggtagcactgtacgggtctatgctacataccgatccggtggcaaccagcttcttgcagaagttatctgaccttgttgggcgtgatactagattgagcaacctgctgcgtgagcagtggcccgaacggcgtagatgccatcgcctcgaaaatggttgtgggaatgctagcccacagatgaaggccaggaatttgccggtttggctgcccaatcaggatgagcctcttccaggatccagttgcgcgattcaggtgggtgacaaagtgccttatgatatttgtcgcccagaccattcagttttaaccctccaactgcctgtaaccgcatctgtccgggaagtcatggccgcactcgctcaagaggatggttggactaaggggcaagtcttggtgaaagttaacagcgctggtgacgctatcggcttacagcccgacgctagaggagtggccaccagcctgggactaaatgagcgcctcttcgttgtcaatccccaggaagtgcacgagctgatcccccatcccgatcaattaggacctacagtgggctccgccgaaggactcgacctggtgtctgcaaaagacttggccggacagttaaccgatcatgactggagcttgttcaactcgatccaccaggtcgagcttatccactatgtcttgggaccacaacacctgagggacgtaacaactgcaaatcttgaacgctttatgagaaggtttaatgaactgcagtattgggttgccactgaactttgcctttgtcctgtaccagggcctcgcgctcagctgctccgcaagttcatcaagcttgccgcacatttgaaggaacagaagaacctgaattcctttttcgccgtgatgtttggtctgtcaaatagcgccatctcccgcctggcccacacatgggagcggctgccgcataaggtccgaaagctttacagtgctcttgagcgtttgctcgatcccagctggaaccaccgggtttaccgacttgctctcgccaagcttagcccccctgtgatcccattcatgcctctcctgctaaaagatatgacgttcattcacgaggggaaccacaccctagttgagaatctcataaacttcgagaagatgcgtatgatggcccgtgcagcgagaatgctgcatcactgtcgctcccacaatccggttccactgtctccgctaagatcccgggtaagccacctccacgaagatagccaggtagctagaattagcacatgcagcgagcagagcctgtcaacccgttctcctgctagcacgtgggcttatgtgcagcaattaaaagtgatagacaatcagcgagagctgtcccgtctatcccgagagctcgaaccctag

SEQ ID NO: 53364 - DNA, 672 bp, Artificial Sequence
  Description of Artificial Sequence: Synthetic coding sequence
atggtacttcgacgaatgcacagacccaggtcttgctcctaccaactcctgttggaacatcagcggcctagctgtattcaaggtttgagatggacacccctgacaaactctgaggaaagtttggacttcagtgagtcattggaacaggcttccaccgaacgcgtactgagagccggtagacagctgcatcggcatcttctcgctacctgccccaatttgatccgcgatcgcaagtaccatctccgcctatatcgacagtgttgctctgggagggagcttgttgatggaattctggctctcggactgggggtccacagccggagtcaggtagtgggaatctgtcaagtgctgctggacgagggggctttgtgtcatgttaagcacgactgggcattccaggatagagatgctcagttttacaggtttcctgggcctgagcctgaacccgtgaggactcatgaaatggaggaagagttggcggaggctgtagctctgctgagccaaagggggcctgatgcactgctgactgtcgcactgcgcaagccgcctggccagcggaccgacgaggaactggacttgatcttcgaggagcttcttcacattaaagctgtcgcccatctgtctaacagtgtgaagagagagctcgccgctgtgttgctctttgagccgtag

SEQ ID NO: 53365 - DNA, 426 bp, Artificial Sequence
  Description of Artificial Sequence: Synthetic coding sequence
atggtcttgcggaggatgcaccgtcctcgctcctgtagctatcagttgcttctggaacaccagcggccaagttgcattcagggtctgcggtggacccccctgaccaattccgaggagtcactggacttctccgaaagcctcgaacaggctagcactgagcgtgtgctgcgcgctggacgacagctgcacaggcacctattagccacatgtcccaacctcatcagggatagaaaatatcacctccggctttatcgccaatgttgttcaggacgcgagttggttgatggaattctggctctggggctgggcgtccatagccgatcacaggtggtgggtatctgccaggtgttgctcgatgaaggagctctgtgtcatgtgaaacacgattgggctttccaggatcgagacgcccagttctataggtag

SEQ ID NO: 53366 - DNA, 1713 bp, Artificial Sequence
  Description of Artificial Sequence: Synthetic coding sequence
atgaggctggaggagcatggtaaagtggtgcttgtcctagaacgcgcttcccaaggggcaggcccttcacggcctcccacccccggaagaaatagatacactgtcatgagcggcactcctgaaaagattctcgagctgctgctcgaagctatgggaccagattcgagtgcacacgatccaaccgagacatttctttctgattttcttctgacacacagggtgttcatgcccagcgcccagttatgtgcagcactgctgcatcacttccatgtggagccagctggaggcagcgagcaggagcggtcaacttacgtatgtaacaaaaggcaacagattctgcgtctcgtttcccagtgggtagctttgtacggttccatgttacacactgatcccgtcgctactagcttcctgcagaagctgtctgatctggtagggcgtgacacccgattgagtaaccttctcagagaacagtggccagagcgaaggcggtgccacagactcgaaaacggttgcggcaacgcttcccctcaaatgaaggccagaaatctgccggtgtggctgcctaaccaagatgaacccctgcccggttctagctgcgcaatccaggtgggtgacaaggtcccctatgatatttgccgacccgatcactctgtgctaaccttacagctgccagttactgctagcgttagggaagtgatggcagccctggcacaggaggacggatggactaaaggtcaggtgttagtgaaggtgaactccgcaggggacgccattggattgcagcccgacgctagaggcgtagccaccagtctgggcttgaacgagaggctcttcgtggtcaacccccaggaagttcatgaacttattccacatcccgaccagctaggacctactgtcggcagcgctgaggggctggatcttgtaagcgctaaggacctcgcgggtcagctcacagatcacgactggagtctgttcaatagcatccatcaagtggaactcatccactacgtcttgggaccacaacatttgagagatgtcacaaccgccaacctcgagcgctttatgcgccgtttcaacgagctgcaatactgggtcgctacggaactgtgcttatgtcctgtgcccggtccaagagctcagctgctccggaagttcatcaagttggctgcacatcttaaggaacagaaaaatctgaattcattcttcgcagttatgtttggattaagcaattcagctatcagtcgactggcccatacctgggaacgcctgccacataaggtgaggaagctttacagcgccctggaacgcttgcttgaccccagctggaatcatagggtctaccgccttgcgctggctaagttgtctccacccgtcattccctttatgccgctgttgcttaaggacatgacttttatacatgaggggaaccatactctggtggaaaatttaatcaactttgaaaaaatgcgtatgatggcccgtgccgcacggatgttacatcattgccggagtcataacccagtgcctctatcaccattgcggtcacgcgtgtcccacctgcacgaagacagccaagtggcaaggatctctacctgtagtgagcagtccctttcgacccggtcaccagccagcacttgggcctatgttcagcaactgaaggtgattgacaaccaacgcgagttgagtagactctcaagggagctggagccctag

SEQ ID NO: 53367 - DNA, 2646 bp, Artificial Sequence
  Description of Artificial Sequence: Synthetic coding sequence
atggttttgcgtcggatgcatcgacctcgcagttgcagttatcagctgctcctagagcatcaacgcccaagttgcatccagggcctgagatggacgcctctgaccaacagtgaggagtctcttgacttttctgagtccttggagcaggcctccaccgagcgggttctcagggccggaaggcagcttcaccgacacctgttggcaacctgtcccaacctgatccgagaccgaaaataccatctgagattgtaccgtcaatgttgcagtggtcgcgaactagtggatggaattcttgcactgggcctgggcgtccacagtagaagccaagtggtaggcatttgtcaggtgctgctggacgagggtgccctctgtcacgtgaaacatgattgggcctttcaagaccgagatgcacagttctacaggtttccaggaccagagcccgagcccgtccgaacacacgagatggaggaggagctggcagaagctgtggccctgctgtcccagcgagggccagatgctctgctgaccgtcgcactgaggaagccacccggacagcggaccgacgaggaacttgatttgatttttgaagagctccttcacatcaaggcggtggcccatctgtccaattctgtgaaaagagaactcgccgcagtgctcctgtttgaaccacattctaaagcaggaacagtccttttcagccagggggacaaaggcacttcatggtacataatctggaagggcagtgtcaatgttgtgacgcatgggaaaggactcgtcactactctacacgagggcgacgatttcggccagttggccttggtcaacgatgcacctagggctgcaaccatcattctgagggaggacaactgccacttcctccgcgtggacaagcaggactttaataggatcatcaaggatgtggaggccaagaccatgcgcttggaagaacacggaaaggtggtgctggtgctggaaagggccagtcagggggcaggtcccagccggcctccaacaccaggcagaaatagatatacagtcatgtcaggaactcccgagaagatcctggagctcttgctggaggctatggggcctgactcaagcgcccacgaccccacagagaccttcctcagtgacttcctacttactcatcgagtgttcatgcccagcgctcagctgtgtgctgctctactgcaccacttccatgtggaacctgcaggcggaagtgaacaggagcgatcaacgtacgtgtgtaacaagcgccagcagattctcaggttagtgtcccagtgggtggctctttatggatccatgttgcacaccgaccctgtggcgacaagctttttgcagaaactctctgatcttgtaggacgagacaccagactctctaatctgctgcgggaacagtggcctgagagacggagatgccatcgactcgagaacggctgcggcaatgcctctccccagatgaaggctagaaatctgcctgtgtggctacccaatcaggacgaacctctcccgggtagctcatgtgctattcaggtgggagacaaagtgccatacgatatctgcaggcccgatcactcagtcctgactctacaactgccagttaccgcctctgtccgggaggttatggcagcgttagcacaggaggacggttggaccaaaggacaggtgctggtgaaggtgaatagtgccggagacgccattgggctccaacctgacgctcggggtgtggccacatcactcggcttaaatgaacgcctattcgtggtgaacccacaggaagtgcacgagctcattccgcacccagatcaacttggcccaaccgtcgggagcgccgagggcctggatctggtgtccgccaaagacctcgcaggccagctgacggaccacgattggagcctctttaatagtattcaccaggtcgaacttattcactatgttctgggaccacaacacctcagagacgtcacgactgctaatttggagaggttcatgagacggtttaacgagttgcagtactgggttgccactgagctttgcctgtgtcctgtcccagggcctcgcgcacagctacttcggaagtttattaaactcgccgctcacttgaaggagcagaagaacctgaactccttctttgcagttatgttcggactctccaatagtgcaatcagtcggctggcccacacttgggagcgccttccacacaaggtgcggaagctttatagcgccctcgagcgcttactggacccatcctggaaccacagagtgtacagacttgccctggccaagctctcccctccagtgatcccctttatgcccctgcttctcaaggatatgacattcatacacgaggggaatcacacactggttgagaacctcatcaatttcgagaaaatgagaatgatggctcgcgctgctcggatgttgcaccattgtcggtctcataaccctgtccccctgtcgccactgagatctagagtcagtcatctgcacgaagactcacaggtggccaggataagtacctgtagcgaacagtctctttctacaaggtcccccgcatccacttgggcatacgtacaacagctcaaggtcatcgacaatcagagagaactctcacgcctgagtcgtgagctggagccatag

SEQ ID NO: 53368 - DNA, 3033 bp, Artificial Sequence
  Description of Artificial Sequence: Synthetic coding sequence
atggtggcggcacacgcagcccacagctcttccagcgctgagtggattgcctgtctggacaagcgtcctttggagaggtctagcgaggacgtggatatcatcttcacgagactcaaggaagttaaggcttttgaaaaattccatccaaacttgctgcatcaaatttgcctttgtgggtactatgagaaccttgaaaaaggcatcactctgttccgtcagggggacattggcacgaactggtatgccgtgctggccggttcactcgatgtcaaggtcagtgaaacaagcagtcaccaggatgcggttacgatctgcacactcggcatcggaacagcctttggagaaagtattcttgacaatacaccgcgacacgccacgatagtcacaagggaaagcagcgagctcctcagaattgagcagaaggacttcaaggccctgtgggagaagtatagacagtatatggctggcttgttggccccaccatatggggtaatggaaaccgggtccaacaatgataacatcttcaaagaaatgaccccactgattgaacctcatgtccctctccggcctgctaatactattaccaaggttcctagtgaaaagatcctccgagcgggaaaaatcctgcgcaacgcaatcctatcaagggcaccccacatgattcgcgaccgcaaatatcacctaaagacataccgacaatgctgtgtcgggacagaactagttgattggatgatgcagcaaaccccgtgtgtccacagccgcacacaagcggtgggcatgtggcaggtcttactggaagacggtgtgcttaatcatgtggatcaggagcatcactttcaggacaagtacctgttttataggttcttggatgacgagcatgaggacgctccacttccaaccgaagaagagaagaaggaatgtgacgaggaattgcaggatacaatgttgttgctgtctcagatgggcccagacgcacatatgaggatgatcctgaggaagccccctggccagcgcactgtcgacgacctggaaattatttacgaagagctgctgcatatcaaagccctttcacacctgtccaccaccgtgaaacgagagttggccggtgtgctgatcttcgagagccacgcaaaagggggtacagtactctttaaccagggcgaggagggtacctcttggtacattatattgaaagggagtgtgaacgtggtgatttacggcaagggggttgtgtgcacacttcacgaaggagatgacttcgggaaactggccttagttaacgacgctcccagggccgcttccatcgtgctccgcgaggataattgtcatttcctgcgtgtcgataaggaggattttaatcggattctccgtgacgtggaagctaatacagtaagactcaaggagcacgatcaggatgtgctcgtcctggagaaagttcccgcaggtaaccgagcaagcaatcagggcaattctcagccccagcagaaatacacagtgatgagcggaacaccggagaagatcctagaacactttctggagaccattagattggaggccaccctgaacgaggcaacagattctgtcctgaacgatttcatcatgatgcactgcgtgttcatgccgaacacacagctatgtccagccttggttgctcattaccatgctcagcctagtcaggggacggagcaggaaaaaatggattatgctttaaacaacaaacgtagggtgattcgcttggtcctccagtgggccgctatgtatggagatttattgcaggaagacgacgtcagcatggcctttttggaagaattttacgtcagtgtgtccgacgatgccaggatgatcgccgctctgaaagaacagctgccagagttggaaaagattgtgaagcagatctctgaggacgccaaggccccacagaagaaacacaaggttcttttacagcaattcaacaccggcgatgaacgggctcagaagagacagccaattcgcggaagtgacgaggtattattcaaggtgtattgcatggaccacacttacacaactatcagagtgcccgtcgctacctcagtaaaggaggtcatttctgccgtggctgataagctcggatcaggggagggcctgattatcgtcaagatgtcatctggaggcgagaaggtggtcttaaagcctaacgacgtgagcgtgttcactacactgactatcaacggccgattgtttgcgtgtccacgggaacagttcgactcactcacacctctacccgagcaagaaggcccaaccgtcggcaccgtgggcacttttgagctcatgtcttccaaagacttggcctaccagatgacaatttacgattgggagctcttcaattgcgtgcacgaactagagttgatttatcacacttttggtagacacaacttcaagaagacgaccgcaaacctggatcttttccttcgaagattcaacgaaatccagttctgggtggttactgagatttgtctctgctctcagctgtcgaagcgtgtccaactgttaaaaaaatttatcaagatagccgctcattgtaaagagtataagaacctgaattcgtttttcgccattgtgatgggcctttcaaacgttgccgtctcacgactcgctctgacatgggaaaaactgccttccaagtttaaaaagttctatgcggagtttgagagcctgatggatccatctagaaaccatcgggcatatcgtttaacagtggctaaacttgagcctccactcattcccttcatgcccctgctgataaaggacatgacctttacccacgaaggaaacaagacttttattgacaatttagtaaactttgagaagatgcgcatgattgccaatacagcaaggacagtgcgctattatcgctcccagcccttcaaccccgatgcagcccaggctaacaagaatcatcaagacgtgcgcagctatgtgcgccagcttaatgttatcgacaatcagcgtaccctgtcccaaatgtcacatagactggagccacgcaggccatag

SEQ ID NO: 53369 - DNA, 3036 bp, Artificial Sequence
  Description of Artificial Sequence: Synthetic coding sequence
atggtggccgcacatgctgcacacagctcctcctccgcagaatggatagcctgtctcgataagaggcccctggagcggtcatcagaggatgtggatataatcttcacccgactgaaggaagtgaaggcatttgaaaagtttcaccctaacctgcttcatcagatttgcctgtgtggctattacgagaatctagagaagggcatcacactatttaggcagggagatattggcaccaattggtacgcagtccttgccggatcccttgatgtcaaggttagtgagaccagttcacatcaagatgctgtgactatttgtacgctcggcattggaacagcgttcggagagagcatcttagacaacactcctagacacgccactatagtcacaagagagtccagcgagctcctccgcatagaacagaaggatttcaaggctctgtgggaaaaatatcgtcagtatatggctggccttttggcgccaccatacggagtaatggaaacaggcagtaacaacgaccggattcctgataaagagaacaccccccttatagagccacacgtaccacttcgccctgcaaataccatcaccaaggtgccctctgaaaaaatcctgcgcgcagggaaaattctgcgcaacgctatcctgtcgagagcccctcacatgatccgcgaccgtaaataccatctgaaaacctacagacagtgctgcgtgggaaccgagctggtcgactggatgatgcagcagaccccttgcgtacatagtcggacccaggcagtgggaatgtggcaggtgcttcttgaggatggagtcctgaatcacgtggaccaggagcaccacttccaggacaaatatctcttctatagatttctagatgacgaacatgaggatgccccattgcccacggaagaggaaaagaaggaatgtgatgaagaactccaggacactatgttgcttctgtcccagatggggccagatgctcacatgaggatgatactccgcaaacccccagggcagcggactgtggatgacctcgaaataatttacgaggagctgctccacataaaggccctgagtcatctgagcaccactgtcaagagagagctggccggagtgcttattttcgaatcccacgctaaggggggtaccgtcctttttaaccagggagaggagggaacaagctggtatattatactgaagggctctgtgaacgtagtgatctatggcaaaggcgttgtctgtacacttcacgagggagatgacttcgggaagctggcgctagtaaatgatgcaccacgagccgcttccattgttttgagggaagacaactgtcattttctcagagttgacaaagaggactttaaccgtatcctgcgggatgtggaagccaacaccgtgaggctcaaggaacacgaccaagatgtgctggtgctggagaaggtccctgccggaaaccgcgcaagtaatcagggtaattctcaacctcagcagaagtacacagtaatgtcagggacaccggaaaagattctggagcacttcctggagacaatacggctcgaggccactctgaacgaggctactgacagcgtgcttaacgacttcataatgatgcattgcgtattcatgccgaatactcagctgtgtcccgctttagtcgcccattatcacgctcaaccaagccagggaacagagcaggaaaagatggattatgccttaaataataaaaggcgggtgatccgcctggtgctgcagtgggcagctatgtatggcgatttgctccaggaagacgacgtgtcaatggcattcctcgaggagttttacgtgtcagtgtcggacgacgcgcgaatgatagccgcactcaaagagcaactccccgagttggaaaagatcgtcaagcagatatctgaggatgccaaggcacctcaaaagaagcacaaagttctgctgcagcagtttaacactggagacgaacgcgctcagaaaagacagccaataaggggatccgacgaggtgctgttcaaagtatactgtatggatcacacttatacaacaattagagtccctgtggcaacttccgtgaaagaggttatcagcgccgttgcggacaagctcggaagcggcgaggggcttatcatcgtaaagatgagctctggtggggagaaggtggtgctgaaacctaacgacgtgtctgtgtttaccacacttactattaacggcagactgttcgcctgcccaagggagcaattcgactcactaacgcccctacccgagcaagaaggcccaacagtgggtaccgtgggtaccttcgaactgatgtcctcaaaagatctggcgtaccagatgacaatttatgactgggagctgttcaattgcgtgcacgagttagagttgatttaccacacatttggcagacataattttaagaaaacgaccgctaatctggatttgttcctaagaaggttcaatgaaatccagttttgggtggtcactgaaatatgcctatgttcacagctttcgaaacgagtgcagctcctgaagaagtttattaaaattgccgcacactgcaaagaatataaaaatctgaatagcttcttcgccattgtgatgggtttgtcgaatgtcgctgtttccagactggccctgacctgggagaagctcccctccaaatttaagaagttctatgccgaattcgaatccctaatggatccctcgaggaatcatagagcctacaggttaaccgtggcaaagttggagccaccactgatcccgtttatgcctcttctaattaaggacatgaccttcacccatgagggcaacaaaacattcattgataacctagttaacttcgagaaaatgcggatgatcgccaacacagcgaggaccgtgcgttattatcgatcgcagcccttcaaccccgacgctgcccaggccaataagaatcatcaagacgtccgcagctacgtgcgacagctgaacgtgattgacaatcagaggaccctcagtcaaatgtctcatcggttagagcccaggaggccctag

SEQ ID NO: 53370 - DNA, 2604 bp, Artificial Sequence
  Description of Artificial Sequence: Synthetic coding sequence
atgttgtacaagaagtacaggcaatacatggcaggactcctcgcacccccatacggggtaatggaaaccggctcaaacaacgatagaattcctgacaaagagaacacaccactgattgaaccacacgttcctcttcggcctgctaataccattacgaaggtgccctccgaaaaaatcctgcgggcagggaagatcctgcgcaacgccatcctgtccagggctccacatatgattagagatcgaaaataccacctgaagacctatcggcaatgttgtgttggcaccgaactggtggactggatgatgcagcagactccttgcgtgcactcccgcacccaggctgtcgggatgtggcaggttctactcgaagacggggtcctgaaccatgtggatcaggaacaccatttccaggacaaatatctcttttatcgttttctggatgatgaacacgaggatgccccactgcctaccgaggaggaaaagaaagaatgcgacgaggaacttcaggacaccatgctactgctgtctcagatgggccctgatgctcatatgcgaatgattcttaggaaaccaccaggacagcggactgtggacgatttagagatcatttacgaagaactccttcacatcaaggcactgtcacaccttagtaccacagtgaagagggagctggctggcgtcctgatattcgaatcacacgccaaaggaggcacagtcctgttcaatcagggcgaggagggtaccagctggtacatcattctcaagggcagcgtgaacgtggtgatctatgggaaaggagtcgtctgtactctccatgaaggggatgacttcgggaagctggctttggtgaatgatgcgcctagggccgcaagtatagtgcttcgagaggataactgtcattttctccgcgtggacaaggaggacttcaaccggatactgcgtgacgttgaggccaacacggtgcgcctgaaggaacatgaccaggatgtccttgtcttggagaaagtgccagccggtaatcgcgcatccaaccagggcaattctcagcctcagcaaaagtataccgttatgtctggcaccccagaaaagatccttgagcacttcttggagaccattaggctggaggctacgctgaacgaagctactgattctgtgctgaatgactttatcatgatgcactgcgtgttcatgccaaacacccagctctgccccgctttggtggcacactaccacgcccagcctagccagggaactgaacaagagaagatggattacgctttaaataacaaacggcgagtgatacgcctggtgttacaatgggctgcaatgtatggcgacctgctgcaggaggatgatgtttccatggcctttctcgaggaattttacgtgtccgtcagcgacgacgccagaatgatcgcagccttaaaagaacaactccccgaactcgagaagattgtgaaacaaatctcggaagatgcgaaggcccctcagaaaaaacacaaggtgctgcttcagcaattcaatacaggagacgagagggctcagaagagacagccaatcagagggtccgacgaagtgctgtttaaagtatactgtatggaccatacctataccaccatacgcgtccccgtggccacctcagtgaaggaagtaatcagtgctgtcgctgataagctcggatccggagaagggctcattatcgtcaaaatgtcttccggcggtgagaaggttgtgctgaaacccaatgacgtgtctgtctttacaacattaacaattaacggtaggctattcgcatgtcccagggagcagtttgattctttgacccctttacccgagcaagaagggcctaccgtggggactgttggcacgtttgagctgatgtcctcgaaggacctggcctaccagatgacgatctacgattgggaattgttcaattgtgtgcacgagttggagctgatctatcacacttttggacgccacaactttaagaaaacgacagctaacttggacctatttcttcgccgttttaacgaaatccagttttgggtcgtaaccgagatctgcctctgcagtcaactgagtaagcgagtgcagctgctgaagaagttcatcaaaattgcagctcactgtaaggaatacaagaacctgaacagttttttcgccattgtcatggggctgtccaatgtagcggtcagtcgccttgcgctgacttgggaaaagctgccatcaaagttcaagaagttctacgcggagtttgagtctttgatggaccccagcagaaaccatcgcgcttataggctcacagtggccaagctcgagcctcccctcattcccttcatgcccctgttaatcaaagacatgactttcacacacgaggggaacaaaaccttcattgacaacctcgtcaattttgagaagatgcggatgattgccaatacagcaagaactgtgcgatactatcggtcacagcccttcaatcctgatgcagcccaggctaataagaaccaccaggacgtgaggtcgtatgttaggcagctgaacgtgatcgacaaccagcgtaccctttcacagatgtcccatcgactggagccccgtcgcccttag

SEQ ID NO: 53371 - DNA, 2832 bp, Artificial Sequence
  Description of Artificial Sequence: Synthetic coding sequence
atggttgccgctcatgccgctcatagttcctcttcagcagagtggatcgcatgtctggacaaacgaccgttagaacgctcctctgaggacgtggacattatctttacgagattgaaggaggtgaaggcatttgagaaattccacccaaatctgttacatcagatatgtttgtgcggctactacgagaacttagaaaagggcatcacactgttccggcaaggcgatattggcacaaattggtatgctgtcctggccggttcactcgacgtcaaggtgtctgagacctcaagccaccaggatgctgtgaccatatgtactttagggattgggactgcattcggcgagagcatcctcgacaacacccctaggcacgccaccatagtgacgagggaatctagtgaattgctgagaatcgaacagaaagatttcaaggctttatgggaaaagtaccgacaatatatggcagggctgctggcccctccctatggcgtgatggaaactgggtccaataatgatagaattcctgacaaagaaaatactccactgattgagcctcacgtcccacttagacctgctaataccatcacaaaagtaccgtcagagaagatactgagggccggaaagatcttgcgaaacgcaatactaagcagggcaccgcacatgattcgggatcgaaagtatcacctcaagacctataggcagtgctgtgtcggcaccgagctggtggactggatgatgcagcagacaccttgtgtccacagcagaacccaagccgtcggtatgtggcaagtgctgcttgaggatggtgtccttaatcacgtcgaccaggagcatcactttcaggataagtatctattctatcggtttctggacgatgaacacgaggacgctcccttgccaacggaagaggaaaaaaaggagtgcgacgaagaactacaggacacaatgttactcttatcacaaatggggcctgacgcacatatgaggatgattttgaggaagcctcctggacaacgcacagtggatgatttggaaattatctacgaagaactcctccatattaaggcactgtctcaccttagcacaaccgtgaaaagagagctcgccggtgtcctgattttcgagagccacgccaagggaggcaccgtgttgtttaatcaaggtgaggaaggtacaagctggtacataatactcaagggcagcgtcaatgtggtgatctatgggaaaggggtcgtgtgcacgctccacgagggagacgattttgggaagctggcactggttaacgatgcccctcgggctgccagcatcgttctgagagaagataactgtcactttctgagagtggataaggaagactttaaccgcatcctccgcgatgtggaagccaacactgttaggctgaaagaacatgatcaagatgtgcttgtgctggagaaggtgccagcaggtaatagagcctctaatcaaggtaactctcagcctcaacagaaatatactgttatgtcaggcacccctgagaagattcttgagcacttcctcgagactattagactggaggccaccttgaatgaagcaaccgattctgtactgaatgatttcataatgatgcactgcgtcttcatgccgaacacccaactgtgtccagccctcgtggcccattatcacgcccaaccctctcagggcaccgagcaggaaaagatggattacgccttaaataacaaacgcagggtcatcagattggtcctccagtgggccgcaatgtacggagacttactgcaggaagatgacgtctcgatggccttccttgaagaattctacgtgtccgtgtcggacgatgccaggatgatagccgcattaaaggagcagctgccagaactggagaaaatcgttaaacagattagcgaggatgccaaggcacctcaaaagaaacacaaagtcctgctgcaacagttcaacaccggtgacgaaagggcacagaagagacaacccatacgtgggtccgacgaggtgctgttcaaggtgtattgtatggaccatacctatacaaccatcagggtacccgtagctacttccgtaaaggaggtgattagcgctgtggccgacaagctgggatccggagaaggcctgatcatagtgaaaatgtccagcgggggagagaaggtggtcctcaagcccaatgatgtgtctgtgttcacaaccctcacgattaatggtagactcttcgcatgtccacgcgagcaattcgattcactgactcctctgcctgagcaggagggccctacagtcgggaccgtgggaactttcgagcttatgagcagcaaagatctggcttaccagatgactatctacgattgggagttattcaattgcgtacatgaacttgagctcatataccacacatttgggagacataattttaaaaagaccacagctaatctggatctgtttctccgtcgctttaatgaaatccaattttgggtggtgacagaaatttgtctctgcagtcagctcagcaagcgagttcagctcctgaagaagttcatcaaaattgccgctcactgcaaggagtataagaatcttaactcattttttgccattgtgatgggcctttccaacgtggccgttagtcggctggcgctgacctgggagagaatgatcgctaacaccgctcgtactgtccggtattataggtcgcaacctttcaatcccgacgccgctcaggctaataaaaaccaccaggacgtcaggtcatatgtaagacagctgaacgtgatagacaatcaacgaacccttagccagatgtctcacaggctcgaaccgagaagaccatag

SEQ ID NO: 53372 - DNA, 2376 bp, Artificial Sequence
  Description of Artificial Sequence: Synthetic coding sequence
atgattagagaccgcaagtatcatctgaaaacgtatcgccagtgctgcgtaggaacagaattagttgactggatgatgcaacagacaccctgtgtacattctagaacccaggccgtggggatgtggcaggttctcctggaagatggagtgctgaaccacgtggatcaggagcaccattttcaggataaatacctgttttacaggtttctggatgacgagcatgaggatgcccctctgcccacagaggaggaaaaaaaagaatgtgacgaggagttgcaagacaccatgctactgctgagccagatgggccctgatgctcatatgcgcatgatcctcagaaagcccccaggtcagcgcaccgttgacgatttggaaatcatatatgaggaactgctccatataaaggccctgagccatctttcgacaactgtgaagagagagttggccggagtgttgatattcgaatcccacgccaagggcggaactgttttgtttaaccagggggaggagggtacatcctggtatattattctcaagggatcagtaaacgtcgtaatatacggcaaaggcgtcgtgtgtacactgcacgaaggcgacgacttcgggaagctagccctggtgaacgacgctccccgagctgcatctattgtcctgcgcgaagataattgtcattttctgagagtggacaaggaggattttaataggatactcagggacgtggaggccaataccgttaggctgaaggagcacgatcaggacgtcctggtgctagagaaggtcccagctgggaacagagcctctaaccagggaaattctcaacctcagcaaaagtatactgttatgagtggcacaccagagaaaatactggaacacttcttggaaactatacggctggaagccaccctgaatgaagccaccgacagtgtcctgaatgattttatcatgatgcattgcgtatttatgcctaacacacagctctgccctgcattggttgcacattaccacgcacagccttcacaggggacagagcaggaaaagatggattacgcactgaataacaagcgccgtgtgatcaggttagtgttacagtgggcagcaatgtatggcgacctgctgcaagaggacgatgtgagtatggcttttctcgaggagttctacgtgagcgtcagcgatgacgcacgcatgatcgctgccctgaaggagcagttacccgaactagagaagatagtcaagcaaatatcagaggacgctaaggcgccacaaaaaaagcataaagtcttgctacagcagtttaacacaggcgatgagagggcccaaaagcgtcaacctattaggggctctgacgaggttcttttcaaggtgtactgcatggaccatacttacacaaccataagggtccccgttgccacctcggtgaaggaggtgatttccgcagtcgccgataaacttggcagtggagagggtctaatcatagtgaagatgagttcaggcggtgaaaaggtggtgttgaagcccaatgacgtgtccgtgttcacaaccctcactatcaacggaaggcttttcgcatgcccgcgagaacagtttgatagtctgactccgcttccagagcaggaggggccaacagttggaaccgtggggactttcgagctgatgagctccaaggacctggcttaccagatgacaatctatgattgggagctgtttaactgcgttcacgaactagagctgatttaccacaccttcggtcgacacaactttaaaaaaacgactgccaatctggacctctttctcaggcggttcaatgagatccagttctgggtggtgactgagatctgcttatgctcacaactttcaaagcgcgtgcagctgctcaagaaattcatcaaaatcgcggctcattgcaaggaatacaagaaccttaattcctttttcgccatagtcatgggcttgtctaacgtggcggtgtcaaggctggcccttacatgggaaaagctgccgagcaaatttaaaaaattctatgccgagtttgagtctcttatggatccatcccgcaaccaccgcgcttatagactgacggtagccaaactagagccaccactgatcccctttatgccacttctgattaaggatatgaccttcacccatgagggaaacaaaacttttatcgacaatctggtgaactttgaaaagatgcggatgatagccaacactgctcgtaccgttcggtactaccggtcccagcccttcaatcccgacgcagctcaggccaacaagaatcatcaggatgtccgctcatatgtaagacagttgaacgttatagataaccagcggacccttagccaaatgtcacaccgcctcgagccacgacgtccctag

SEQ ID NO: 53373 - DNA, 2523 bp, Artificial Sequence
  Description of Artificial Sequence: Synthetic coding sequence
atggccggtctgctcgccccaccatatggggtgatggaaacgggttctaataacgacagaattcctgataaagagaacgtcccgagcgagaaaattctgcgcgctggaaaaattctaagaaacgccattctctcaagggccccacatatgatcagggatcggaaatatcacttaaaaacttaccggcaatgttgtgtggggacagaactagtcgattggatgatgcagcaaacaccttgcgtgcactcacggacgcaagccgtcggcatgtggcaagtactgctagaggacggcgtgttaaatcacgtcgatcaagagcatcacttccaggacaaatacctattctataggtttctggatgacgagcatgaggatgccccactaccaacagaggaggagaagaaggaatgcgacgaggagctgcaagacacgatgttattgttaagccaaatggggccagacgctcacatgcgaatgatacttaggaagccccctgggcaacggacagtggacgatctggaaattatctacgaagaactgttacacatcaaggccttgtcacacctgagtacaaccgtgaaaagggagctcgcgggagtgctgatcttcgagagccatgccaaaggcggaacagtcctttttaatcagggagaggaaggtacctcctggtatatcatcctgaaggggtccgtcaacgtggtgatctacggcaaaggcgtcgtgtgtaccttacatgaaggcgacgatttcgggaagctggcgctggtcaacgacgctccaagggctgcaagcattgttctgagagaagataactgccactttctgagggtcgataaggaggacttcaatcggatcctcagggacgtggaagctaatacagtacgcctcaaggaacatgatcaggacgtcttggttttagaaaaggtgcctgctgggaatcgagcctctaaccagggtaacagtcagccccagcagaagtacacagtgatgtcaggcaccccggaaaaaattttagagcactttctggagactatcagacttgaagccacgctgaacgaggcgacagatagcgtgttaaacgatttcataatgatgcactgtgtgtttatgcctaacacacaattgtgccctgctttggtggcccactaccacgcgcagccgtctcagggaacagaacaagaaaaaatggactacgccctgaataataaacgcagagtcatcagacttgtgctacaatgggccgctatgtatggcgacttgctgcaggaagatgatgtatccatggcctttttggaagaattctacgtatcagtttccgacgatgcacgtatgattgcagccttgaaggaacagttgccggaacttgagaagatagtgaagcagattagcgaggatgctaaagccccacagaaaaaacacaaggtattgctgcagcagttcaatactggcgatgagagggctcaaaaaaggcagcctatcagaggtagtgatgaggtcctgttcaaagtgtattgtatggaccacacatacaccaccattcgagttccagtggcgacatccgtgaaggaggtcatctctgccgtagctgataagctgggttccggcgagggattaattattgtcaagatgagctccggcggagagaaagtggtcctgaagcccaatgatgtgtctgtgtttactaccctcaccattaacggcagactgtttgcatgccctcgtgagcagtttgatagtctgaccccattacctgaacaggagggacccaccgtagggactgtgggaacctttgagttaatgtccagtaaggacctggcataccagatgaccatctatgactgggaactgttcaattgcgtccacgagctggagttaatttaccatacttttggtagacacaactttaagaagacaacggcgaacctcgacttgttcctgcgcaggtttaacgagattcaattctgggtcgtgacagaaatctgtctctgtagccagttaagtaaacgcgtgcaactgctcaaaaaattcatcaagatcgcagcacattgtaaggaatacaagaatctcaacagcttcttcgcaatagtaatgggcctgtcaaatgtggccgtgtctcgacttgctcttacgtgggaaaaattaccgtctaagttcaagaaattttatgctgagtttgagtcactcatggacccatccagaaaccaccgtgcctacagattaactgtcgcgaaattggagccccctcttattccatttatgccactgttgataaaggacatgacgttcactcacgaggggaacaaaacgtttatcgacaatctggtgaatttcgagaagatgaggatgattgcaaatacggctcgaacagtgcgttattatagatcccagccttttaatcccgacgccgctcaggcaaacaagaatcatcaggacgtcaggtcctacgttaggcagttaaatgtgatcgataaccagcgcaccctgagtcagatgagccacaggctggaacctaggagaccttag

SEQ ID NO: 53374 - DNA, 2577 bp, Artificial Sequence
  Description of Artificial Sequence: Synthetic coding sequence
atggcaggccttctagctcctccttacggagtgatggagaccggctctaacaacgataggattcctgataaggagaacacacctcttattgaaccccatgtgccgctcaggcccgctaacacaattaccaaggtcccctcagagaagatactgcgcgcaggtaagatactgcggaacgctatactatcaagggcccctcacatgatccgcgatcgtaagtatcaccttaagacctaccgacaatgctgcgtcggaacagaactagtcgactggatgatgcaacagaccccttgtgtgcactctagaacacaggccgtaggcatgtggcaagtgctgctggaggacggagtgcttaaccacgtagatcaggaacaccactttcaggataagtaccttttctacaggtttctggatgacgaacatgaagacgcccctcttcctacagaagaggaaaagaaagagtgcgacgaagagctccaagacaccatgttgcttctttcacaaatgggccctgacgcccacatgagaatgatccttaggaaacctcctgggcaaaggacagtggatgacctcgaaattatttacgaagagctcctgcatataaaagcactgtctcaccttagcactacagtgaaacgggagctcgctggagtcctgatctttgagagccacgcaaaagggggaaccgtcctcttcaaccaaggcgaggaggggacgtcctggtatataatcttgaagggcagtgtgaatgttgtcatctacggaaagggcgtggtttgcaccctccatgaaggggacgactttggtaagctggcactggttaacgacgcgccacgagccgcttcgattgtattgcgcgaagataattgtcactttctccgggtggacaaggaggacttcaatcgtattcttagggacgtagaagccaacactgtgcgcctcaaagagcacgaccaggatgtcctggtgctggaaaaggtgcctgccggaaatcgtgcgagcaatcaaggtaatagtcaaccccagcagaaatatacagtaatgtccggtaccccagaaaaaatattggaacatttcctcgaaacaatccgattagaagctactttaaatgaggcgaccgactccgttcttaacgacttcatcatgatgcactgcgtttttatgcccaacacacagctttgccctgcgttagtggcacattatcatgcccagcccagtcaaggcacagagcaggagaagatggactatgcactgaataacaaaaggcgagttattcggctcgtgcttcagtgggctgccatgtatggtgacctgctgcaggaggacgatgtgagcatggcctttctggaagaattctacgtttccgtctcagacgacgccagaatgattgcagctctcaaagagcaactcccggagttggagaagatagtaaaacagatatctgaggatgcaaaggctcctcaaaagaagcataaggtgctgctccagcaattcaacacaggggacgagagagctcagaaaaggcagccgatcaggggtagcgacgaagtcttgttcaaggtctactgtatggaccacacttatacaactatccgagtccctgttgccacgagtgtgaaggaggtgatttcagctgtcgcagataagctcggctctggagaaggtctgattattgtgaagatgagttccggaggagagaaggtggtgctcaagcccaacgacgtttcagtattcacaaccctgaccataaatggacgtttgtttgcctgtcccagggagcagttcgattctttaacaccgcttccagaacaagaaggccctaccgtgggaactgtgggcacattcgagctgatgagctccaaagatctggcttatcagatgaccatatacgattgggaactgtttaactgcgttcacgagctcgagctaatataccatacctttggtcggcacaacttcaagaagacaaccgccaatttggatttgtttcttcgccgttttaatgagattcaattctgggtggtcacggagatctgtctttgttcccagcttagcaagcgtgtacagttactgaagaaattcatcaagatcgccgctcattgtaaggagtataaaaatttgaatagcttcttcgccattgtgatgggactgtcaaatgtggccgtgagcagattggcactgacctgggaaaagttacctagcaaattcaagaagttttacgctgagtttgaatctctgatggaccccagccgcaatcatagagcgtatcgactgactgtggcaaagctggaaccccctttgatcccatttatgcctctcttaataaaggatatgaccttcacccatgagggtaacaaaaccttcatcgacaatctggtcaattttgagaaaatgaggatgatcgcaaacaccgctcggaccgtaagatactacagaagtcaaccctttaaccccgacgccgctcaggctaacaaaaatcatcaggatgtcaggagctacgtaagacagttaaacgtgattgataaccagaggaccttatctcaaatgtcccatcggctggagccaagacgcccttag

SEQ ID NO: 53375 - DNA, 1200 bp, Artificial Sequence
  Description of Artificial Sequence: Synthetic coding sequence
atgtttgtttttgtgctgacaccgctaatcgaaccccatgtccccctaaggcccgctaacactatcaccaaggtcccctctgaaaagattctccgcgcaggaaagattctacgcaatgccatattgagtcgggctccgcacatgatcagggaccgcaaatatcacctgaagacctacagacaatgttgtgtggggaccgagcttgttgactggatgatgcagcagaccccttgcgtacatagccgcacacaggcagtcgggatgtggcaggtgcttctcgaagatggggtcctgaaccacgtcgatcaagagcatcatttccaggataaatacttattctaccgatttctggacgacgagcacgaggatgctcctcttcccacagaggaggagaaaaaagaatgcgacgaagaactgcaagatacaatgctattactgtcacagatggggcctgacgcccacatgcggatgattctacggaagccgcctggccagaggaccgtggacgatttagagataatctatgaggagctcctgcatataaaagctctgagtcacctgagtaccaccgtgaaacgggagcttgcaggggtcctgatcttcgaaagtcatgcaaaggggggaactgtcctcttcaaccaaggtgaggagggcacctcttggtacatcatcctcaagggcagcgttaacgtggtgatctacggtaagggggtggtgtgtaccttgcacgaaggggacgattttggcaaactggccctggtgaatgacgccccacgcgcagcgtcaatcgtcctccgagaagacaattgtcactttctgagggttgataaggaagatttcaacaggatcttacgggatgtggaggctaacactgtgagactgaaggaacatgaccaggatgttctggttctcgagaaggtaccagcaggaaacagagcgtccaaccagggaaatagccagccgcaacagaaatacaccgtaatgtccggtaccccagagaagattctagagcactttcttgagaccattagactcgaggcaactctgaatgaggcaactgactccgtgctcaacgatttcatcatgatgcattgcgtatttatgcctaacacccagttatgcccagctttggtggcccactaccatgctcagccttcaaggtatcgaactggcgagaatggcttgtgcccacagcagtag

SEQ ID NO: 53376 - DNA, 2577 bp, Artificial Sequence
  Description of Artificial Sequence: Synthetic coding sequence
atggccggattgctggcccctccgtacggtgtgatggaaacgggctcaaacaatgaccgaatacctgacaaggagaacacccccctaatcgaaccacatgtgcctcttcggccagccaacacaattactaaagtaccctctgagaaaatcctcagagcaggcaaaatcttgcgaaatgccattctgagtcgggctccccacatgatcagagatcgaaagtatcatctcaagacctacagacaatgctgcgttggaaccgaactggtggattggatgatgcagcagaccccatgtgtgcatagtaggacccaggccgtcgggatgtggcaagttctgcttgaggatggtgtgcttaatcacgtggatcaggagcaccatttccaggataagtacctcttctacaggtttttggatgatgagcacgaagatgcacccttgcccactgaagaggaaaagaaagagtgtgacgaggagcttcaggataccatgctgctgctcagtcaaatgggacctgacgcccacatgcgtatgatcctcagaaagcctcctgggcagagaactgtggatgacctggagattatctacgaagagctgctgcacatcaaggccctgtctcacctgtccaccaccgtcaagcgcgagctggctggggtgctgatattcgagtctcatgccaagggaggtaccgtattattcaatcagggcgaagagggaacgtcatggtacattatccttaaaggaagcgtgaatgtggtgatctatggtaagggggttgtgtgcactctccacgagggcgatgatttcggaaagctggcactggttaacgatgcgccaagagcagcgtctattgttttgcgcgaagataattgccacttcctgagagtggataaagaggattttaaccgaattctgagggacgtagaggccaataccgtccgactgaaagagcacgaccaagatgtcctagtgctagagaaagtgcctgccggaaacagagccagcaaccagggtaattctcagccgcagcagaaatacaccgtgatgtctgggactccagaaaagatattggagcactttctggagactataaggctagaagctactcttaacgaggccactgacagcgtgcttaatgacttcattatgatgcattgtgtcttcatgcctaatactcaactttgtccagctcttgttgcacactatcatgctcagccatcccaggggaccgaacaagaaaaaatggattacgcccttaataacaagcggagagtgatcaggctcgtgcttcaatgggccgctatgtatggcgatctccttcaggaggacgatgttagcatggccttccttgaggagttttacgtatcagtttcagacgacgcccgaatgatcgcggcactgaaggagcagctgcccgagcttgagaagattgtaaagcaaatctccgaggacgccaaggcaccacagaaaaaacataaggtgctgttacaacagttcaacaccggcgacgagagagctcagaaaagacaacccattcgcggtagcgacgaggtgctgtttaaggtgtactgcatggaccacacctatacaaccattcgcgttccagtggcaacaagcgttaaagaggtcatttcggctgtggctgataagctcggtagtggggaggggctcattatcgtaaagatgtcttcgggaggggagaaggtcgtcttaaaaccaaacgacgttagtgttttcacgacgctgacaatcaacgggcgactctttgcctgtcccagagaacagttcgactctctcacaccccttccagaacaggaaggcccaaccgttgggactgtaggaaccttcgagctgatgagctccaaggatcttgcataccagatgactatctacgattgggagctttttaattgcgtacacgagctggagttgatctaccatacatttggccgtcacaatttcaaaaagaccaccgctaaccttgacctgtttctccgtcgcttcaatgagatccagttctgggtggtgacagagatctgcctatgctcacagctctccaagagggttcagcttctgaaaaaattcattaaaatcgcagcacattgtaaggaatacaagaacctgaatagcttttttgccatcgttatgggcttgtctaacgtggctgtgtcaaggctagctctgacctgggaaaaactaccctccaaattcaagaaattttacgccgagttcgaaagtttgatggatcctagcaggaatcatagggcctatcgcctcaccgtggctaagttggaacccccactcataccctttatgccactcctgataaaggacatgacatttacccacgagggcaacaaaacctttattgacaatttagtcaactttgagaagatgaggatgatcgccaacaccgctcgtacggttcggtactaccgaagtcagcctttcaacccagacgctgcacaggccaacaaaaatcatcaggacgtgcggagctacgtgcggcagcttaatgtgatcgacaatcagaggactctgtctcagatgagccaccggctcgagccacgaagaccgtag

SEQ ID NO: 53377 - DNA, 552 bp, Artificial Sequence
  Description of Artificial Sequence: Synthetic coding sequence
atgcgcgagtacaaagtcgtggtgctggggtctggcggagttgggaaatccgccctgacagtacaattcgtgacgggatcctttattgagaagtacgatcccactattgaagacttttacaggaaggaaatagaagttgactccagcccaagcgtactcgaaatcctcgacacagccggaacggagcagttcgctagcatgagggacctttatattaagaacggtcagggattcatcctggtttacagcctggtgaatcaacagagtttccaggacattaagcctatgcgggatcagataatccgcgtcaagcggtacgagagagtccccatgattctcgttgggaataaggtagaccttgagggggaacgagaagtgagttacggagaaggcaaggcgctagcagaggaatggtcctgcccatttatggagaccagcgctaagaacaaggctagcgtggatgagctctttgctgagatagtgcgccagatgaattacgcggcacagcccaatggtgatgagggatgttgctccgcatgcgtgatcctgtag

SEQ ID NO: 53378 - DNA, 552 bp, Artificial Sequence
  Description of Artificial Sequence: Synthetic coding sequence
atgcgggaatacaaggtcgtcgtattagggtcaggaggggtcggaaagagcgccctgacggtccagtttgtgaccggtacctttatcgagaaatatgatccaacgatagaggacttttaccgcaaagaaatcgaggtggactccagcccatcggttctggagatactggacacagctggcaccgaacagtttgccagcatgcgcgacctgtatatcaagaatggccagggctttatattagtgtacagcctggttaaccaacagagcttccaggacatcaagccaatgagggaccagatagtcagggtgaagaggtatgaaaaagtgccgcttattttggttgggaacaaggttgacctggagccagaaagggaagtcatgtcatctgagggcagagctctagcccaggaatggggatgccccttcatggaaacttcagccaagagcaaaagcatggtcgatgagctctttgctgagattgtcaggcagatgaactactctagcttacccgagaaacaggatcagtgctgtactacctgtgtcgttcagtag

SEQ ID NO: 53379 - DNA, 552 bp, Artificial Sequence
  Description of Artificial Sequence: Synthetic coding sequence
atgagggaatacaaagtggtggtcttggggagtggcggagttggcaaaagcgcactgaccgtgcagtttgtcaccggcaccttcatagagaaatacgaccccaccatcgaggatttctatcgtaaagaaattgaggtggactccagtcccagcgtcctagagattctggacactgctggcaccgagcaatttgcttctatgagggacctttatataaagaacggccagggctttatcttagtgtattctctggtgaaccaacagagctttcaagacattaagcccatgagagaccaaattgtgcgcgtgaagaggtacgagaaggtgcccttgattctggtgggcaacaaggttgatctggagcccgaaagagaggtgatgagttctgaaggtagagctctcgcgcaggagtggggctgtccctttatggagacctcagccaagtcaaaatctatggtggatgaactgttcgcagaaatcgtacggcagatgaactattccagtcttcctgaaaaacaggatcagtgttgtactacatgtgtcgtacagtag

SEQ ID NO: 53380 - DNA, 1023 bp, Artificial Sequence
  Description of Artificial Sequence: Synthetic coding sequence
atgcataccgacctcgacacagacatggatatggataccgagactactgctctctgtccctccggcagtcgcagagccagtcctccgggaacccccactcctgaagctgatgcaaccctgcttaaaaaatcagagaagctcctggccgagctggatcgaagcggtctgccctccgccccaggcgctccacgcaggcggggaagtatgcctgtgccttataagcaccagctgagacgcgctcaggcggtggacgaactagactggcccccacaagctagttctagtgggagttccgattcactgggatccggtgaagcggctcccgctcaaaaagacggtattttcaaagtgatgctggtgggcgagtccggggtgggcaagagtaccttggctggcacgttcgggggactccaaggtgactccgcccacgagcctgagaaccccgaggatacttatgagaggagaatcatggtggataaagaggaggtaaccctggtggtctatgacatctgggaacagggcgatgccggaggatggctgcgggaccattgcttgcagaccggcgacgcgtttctaatcgttttctctgtgactgaccgaaggtccttctcaaaggttcctgaaacgctgttgaggttgcgcgcagggagaccccatcatgatctgccagtcattctggtgggcaacaaatctgatttggccagatcccgcgaagtcagcttggaggagggccgacacctggcaggcaccctgtcatgcaagcatatcgagacatcggctgcactgcaccacaacacccgcgagctgttcgagggagcggttcgtcaaattcggctccgccgtgggaggaaccacgccggaggacagcgcccagaccctgggagccccgagggacctgctcctcctgcacggagggagtccctcaccaaaaaagcgaagcggttcctagcgaacttggtgccccgaaacgccaagtttttcaagcaaagatcgaggtcttgccacgatctgagcgtcctgtag

SEQ ID NO: 53381 - DNA, 666 bp, Artificial Sequence
  Description of Artificial Sequence: Synthetic coding sequence
atgcatacagatttggacacagacatggatatggatacggaaaccaccgcactctgcccatccggctcaagacgcgcatccccacctggcacaccaacccccgaggcagacgctacgttgctcaagaaatctgagaagttattagcggaactggaccgatccggtctccctagcgcacctggtgcaccaagaaggcggggttccatgccagtgccttataagcaccagctccggcgagctcaggccgtggacgagttagactggccacctcaggccagctcaagtggctcgtctgacagtcttggctcaggggaagccgctccagcgcagaaagatggtatttttaaggtgatgctggttggcgagtctggagttggcaagagcactctggctgggacttttggcggtctgcaaggcgatagcgcacacgaaccggagaacccaggcggatgcagacgggtggcagcgggtccgctgccttctgatcggggacgattgagccaccgcctgctgagtcatcggcctaccgaatttctccagtcaagtcgtgaccctacttcggcacccggttgggaagctgctcctcggcctacaagatatccacgatggaaacaggaaagactggggccattgccaggaggaattacgggcggatgcgtttcttag

SEQ ID NO: 53382 - DNA, 897 bp, Artificial Sequence
  Description of Artificial Sequence: Synthetic coding sequence
atgactcttaataccgagcaggaggctaagacgccactccacagaagagccagtactcccttacccctgtcaccaaggggccatcagcccggtaggttgtccacagtcccatctacccaatcacagcaccccagactcggtcaaagcgcgagcctgaacccccctactcagaaaccctcccctgctcccgacgactggagttcagagtcaagtgatagtgaaggctcctgggaggccctatacagggtggtgctgctcggagatccaggggttggcaaaacgagcctggcctcactgttcgctggaaagcaggaacgtgacctacacgagcaattgggagaagacgtgtacgaaaggacccttactgtggacggggaggatacaacgctggtcgtcgtagatacatgggaggcggaaaaactggacaaatcctggtcccaagagtcctgtctccagggaggctctgcatatgtgatcgtgtacagtattgcagatcggggttcctttgagtccgctagtgaactccgcattcaactgagacggactcatcaagccgaccatgtccccataatcctggtcgggaacaaggcagacctggcacgctgtcgcgaggtgagtgttgaggagggacgggcttgtgctgtcgtcttcgattgcaagttcatcgaaacttccgccactctgcaacataacgtcgctgagctgtttgagggtgtcgtgcgtcagctgcgcctaagaagaagagattccgcagccaaagaaccacccgcacctcgcagaccagcttcactggcccagcgggcaagaagattcctggctagactcactgcgaggtccgccaggaggcgcgctttgaaagcccgatctaaaagctgccataacctggccgtcctttag

SEQ ID NO: 53383 - DNA, 2352 bp, Artificial Sequence
  Description of Artificial Sequence: Synthetic coding sequence
atggagagccccggtgagagtggggctggatcccccggagcaccgagtccgtcctccttcaccactggtcatctcgcccgtgagaagcctgctcaggatcccctgtacgatgtgcctaatgccagtggcggacaggctggcggtccacagcgcccaggacgagtcgtaagcctccgggagcgcctgcttctgacccgaccagtctggctgcagttacaggcgaatgctgcagcggcactccatatgctgcggaccgagcctcctggcaccttcctggtgaggaaaagtaacacccggcagtgccaggctttatgcatgagactgcctgaagcttccggcccatcctttgtttccagccactacattctagagtccccaggtggcgtctcactcgaaggaagcgagctcatgtttcccgatctcgtccagttaatctgcgcttattgccacactcgggatatactgctgctgcccctacagctgcctagagccatccaccacgcagccacccacaaagaactggaagcaatctcacacctgggtatcgagttctggtcctcatcactgaacattaaggcgcagaggggccctgctggcggacccgtcctgccccagcttaaggccagaagtccacaagaattggatcagggcacgggcgcagccctgtgctttttcaacccactgtttccaggagaccttgggcctaccaaacgggaaaaatttaagcggtcctttaaggtgcgcgtttcgaccgaaacgtccagcccgcttagtcccccagcagtgcccccacccccagtccccgtgctgccgggagcagttccgagccagaccgaacgactgcccccttgccagttgttgcgtagagaaagttcagtgggatatcgagttcctgctggtagtggcccttcgttaccacccatgcccagtttgcaggaggtagactgtgggtcgccaagctcatcggaggaagagggagttcctgggtcaaggggctctccggcaacttcccctcacttggggaggaggcgccctctactgaggagcatgagtgcagctttttgtagcctcctggctcccgagcgacaggtcgggagggctgctgctgctcttatgcaagaccgacatactgctgctgggcagctcgtgcaggatctcctcacccaggttcgcgcaggccctgaaccccaagagctccaagggatccgtcaggcattgtctagggctagagcaatgctaagtgccgagctgggtccggagaagctgttgtctccaaaaaggcttgagcacgtgcttgagaagtctttacactgctctgttctgaagcctcttcgtccgattctagccgcaaggctgaggcgcagactggcagccgatggctctttgggcaggctcgctgagggattgaggcttgcaagggctcagggacctggcgcattcggctcccacttatcactgccgtctccagtcgaactggaacaggtgaggcaaaaactgttgcagctcctgcgcacatacagtccaagcgctcaggttaaaagacttctgcaggcttgcaaacttctgtatatggctttgcgaacccaagagggcgagggcgcaggcgcagacgagttcctgccattattaagcctcgttcttgcgcattgcgatctgcccgaacttcttcttgaagccgagtacatgtcagagctcctggagccaagtctgcttacaggagagggcggttactatctgacgtccctcagtgccagccttgcactcctaagcgggctcggccaggcgcacacactccccctcagccctgtgcaggagctgagacgcagccttagcttatgggagcagagacgcctgcccgcaacccactgttttcagcatctactcagagtggcctatcaggacccttcctccggttgtacaagcaaaacattagctgttccacctgaagccagcatcgctactctgaaccagttgtgcgctactaagttccgggtgacgcagccaaacacattcgggctttttctgtacaaagaacagggctaccaccgcctgccacctggagccctggcccaccggttgcctacaaccggctacctcgtttatagaagagcggaatggcccgagacacaaggagcagtgacggaggaagaaggctcaggtcaaagtgaggctaggtccagaggagaagagcagggctgccaaggtgacggcgatgccggagtcaaggcctctcccagggacattcgagagcagtctgaaaccacagccgaaggcggtcaaggccaagcccaagagggcccagcccaacccggtgaacctgaagctgaggggagcagggccgctgaggagtag

SEQ ID NO: 53384 - DNA, 1818 bp, Artificial Sequence
  Description of Artificial Sequence: Synthetic coding sequence
atgcgtttaccagaggcttctgggccatcattcgtctcgtcgcactatatcctggaaagccccggaggagtttcactggagggttccgaactcatgtttcctgacctggtgcagctcatatgtgcctattgccataccagagatatactgctgctgccccttcaactgcccagggctatccaccacgctgcgactcacaaggaattggaggccatttcacatttaggaattgagttttggtcgtcaagcctgaacatcaaagctcagcggggacccgctggaggccctgtactgccacagctcaaggctcgtagcccccaagagcttgatcagggtacaggagcagctttgtgtttcttcaaccccctgttccccggagatttaggcccaacgaaaagagagaagttcaagcgaagtttcaaagtgagggttagcacagaaacgtcgtcccctctctccccccctgccgtgcctcctccacccgttcccgtgcttcctggcgcagtaccaagtcagacagagcgactacctccctgccagctgctgcggagggagtcctctgtcgggtacagggtgcctgcaggctctggaccctctctgccgccaatgccgagcttacaggaggttgactgtggtagtccttcgagctcagaagaagagggcgtccctggtagccggggttcccctgcgaccagcccacatctgggcagaaggaggcccctgctgcgctctatgtcagctgctttctgttccctgctcgctccagagagacaggttgggagggccgctgctgccttaatgcaggatcggcacacagccgctggccaactggtgcaggatctgttgacccaggtgagggctggccctgaaccccaggagcttcaggggatacgccaggctctgtcccgggctagggccatgctgagcgctgagctgggccctgagaaactgctgagccccaagagactggaacacgtgctggaaaaatccctgcactgtagtgtgctcaagccacttcggccaatcctcgcagctaggctgagacgccgactggccgcagatgggagtttgggtaggctcgcagaaggactcaggttggccagggctcagggtccaggggctttcggctcgcacctgtcacttccaagccctgtggaactggaacaggtgcggcagaaattactgcagttgctgcggacatactcaccctctgcgcaagttaaaaggcttctgcaggcctgcaagctgctgtacatggctctacggacgcaggaaggcgagggagcaggtgcggacgaatttttgcccttattatccctcgtgctggcccactgtgaccttcccgaattattgttagaggctgagtacatgagcgagcttttggagccctccttgctaaccggcgaaggcggatactacctgacatcccttagtgcttccctggcactcctttcagggctggggcaggctcacacactccctctgtcccctgtccaggaacttaggagaagtctgagtttgtgggagcagcggaggcttccggctacccattgttttcagcacctccttagggttgcttaccaggacccctcatcagggtgcacttctaagactctagctgttcctcctgaggcctccattgccacattgaaccaactttgcgcaacaaagttcagggtaacacagcccaacacattcggcttattcctacagggaaaccagcgacagcgcgaggccggtcagcagagaagctcattgaagtggcccgagggaagctttggtgccggtgatccagaacccgcagagaagtcgttctag

SEQ ID NO: 53385 - DNA, 1935 bp, Artificial Sequence
  Description of Artificial Sequence: Synthetic coding sequence
atggagcagcttagcgatgaagagatcgatcacggcgcagaagaggactctgataaagaggatcaggatctcgataaaatgtttggagcatggcttggggagctggacaaactcacccagtctctcgacagtgacaagcccatggaaccggtcaagagatctccgctaaggcaagagacgaacatggcaaacttctcctaccgattcagcatatacaatctgaatgaggctctcaatcagggcgagaccgtcgatctggacgcactcatggcagatttatgctcgatcgaacaggagttgagttctataggttcaggaaactcaaaaagacagattaccgagaccaaggccacacaaaagctccctgtgagtcgccacactctgaagcacggcaccctcaagggcctgagctcttcatctaatcgaattgccaaacctagtcacgcaagctacagtctggacgatgtgacagctcagctagagcaagcgtctttatccatggacgaggccgctcagcaatctgttctggaggataccaagcccctggtgaccaaccagcaccgtcggacagctagcgctggcaccgtgtccgacgccgaggtgcatagcatcagcaatagttctcactcgagtatcaccagtgcggcttcaagcatggactcactggacatagacaaagttaccaggccgcaagaactggacctgacgcaccaggggcagccgatcactgagcatgcaattagtctgcgttgcagtagtaaacaagctaagcggcacatcgatttcaccgaggaacaggctgagcttaccccccactcgtaccttgatagggagaccagcctactactccgcaacatcgccggaaaaccaagccacctcctgacgaaagaggaacaagcagccaaactaaaagccgaaaagatccgcgtggctttggagaaaatcaaggaggcccaagtgaagaaactagtcatcagggtccatatgtcagatgattcatcgaaaaccatgatggtggatgagagacaaaccgtccggcaggtgctcgacaatcttatggacaaatcacactgcggctattcacttgactggtccctcgtggagaccgtatcagaactccagatggagcgcattttcgaggaccatgagaatctggtcgagaacctgctgaattggacccgggattcacagaataagctcatctttatggagaggattgagaaatacgcgctgtttaagaatccacagaactacctgctgggcaagaaagagacggcagagatggctgatcggaataaggaggttttgctggaggagtgtttctgcgggtccagcgtgacggtccctgagatcgagggggtgctgtggctcaaggacgacggcaaaaagtcctggaagaaaaggtacttcctgctgcgcgcaagcgggatttattatgtccccaaaggcaaagcaaaggtctcccgcgacctggtgtgctttcttcaattagatcacgtaaatgtgtactatggccaggactatcggaacaagtataaagccccaacagactattgcctcgtgctgaaacatccacagatccagaagaagtcacagtacattaagtatctgtgttgtgatgacgtgcgaacccttcaccaatgggtgaatggtatcaggatcgctaagtacggaaagcaattgtacatgaattaccaggaggcactgaagaggactgaatcagcttacgactggacctcgttgagtagttccagcattaagtccggaagctcttcaagctctatccctgagtctcagtcaaatcattcaaatcagtcagattccggcgtcagtgatacgcaaccagccggacacgtgagatcacagtccattgtctcatccgtgttcagtgaagcttggaaacgcggtacccagctcgaggagtctagtaagtag

SEQ ID NO: 53386 - DNA, 3753 bp, Artificial Sequence
  Description of Artificial Sequence: Synthetic coding sequence
atggagcagctgagtgacgaggaaatcgaccacggagcagaagaggactccgacaaggaggaccaggatctagataagatgttcggagcttggctgggtgagcttgacaaactgacccaatcactggattccgacaaacctatggagcccgttaagcgctctcctctgcgacaggaaaccaatatggcgaatttctcatatagattttctatttataacctcaatgaggccctcaatcaaggggaaactgtggacctagacgcacttatggctgatctatgttctattgagcaggagctaagcagcattggctccggtaattccaagcggcaaattactgaaactaaggccacacaaaaactcccagtgtccagacatacactcaagcatgggaccctaaagggactatcaagctcctccaaccggatcgcaaagccgtctcatgctagttacagcctggacgacgtcaccgcgcagctggagcaggccagcctctccatggacgaagcggctcagcagtcagtgctagaagatacaaagcccctcgtgactaaccaacaccgaaggacagctagcgccggtaccgtatccgatgccgaagtgcacagtatcagtaactccagtcatagctctatcacctcagctgcttcctccatggactcacttgatattgataaagtgactagaccgcaggagctggacttgacgcatcagggtcaaccgattaccgaggaggaacaggctgcaaagctcaaagcggaaaagattagggtggccctggagaaaataaaggaagcacaagtcaagaaactcgtcatccgggtccacatgagcgatgattcctcgaaaactatgatggtcgatgagcggcagaccgtgcgacaggtcctggataacctaatggacaagtctcattgcggatatagcctggactggagtttagtagaaactgtaagtgagctccagatggagcggatcttcgaagaccacgaaaatctagtggaaaacctattaaattggaccagggacagccagaataaactcatctttatggagaggatcgaaaaatacgccctgttcaagaatccccagaactacttgttagggaagaaggaaaccgccgagatggcagatcggaataaagaggtcctgcttgaagaatgcttttgcggatcaagcgtaactgtgccagaaatcgaaggcgttctgtggctcaaagatgacggtaaaaaatcatggaagaagcgctacttcctgctccgagcctctggaatttattatgtgcctaaaggtaaggcaaaggtctcccgcgacttagtttgcttcttacagctcgaccatgttaacgtgtactatggccaggattatcgaaacaagtataaggccccaacagattactgtctggtactcaagcatccccagatacagaaaaagagccagtacatcaaatatctgtgttgtgatgatgtaaggacgctgcatcagtgggtgaatggaattagaatcgctaagtatgggaaacagctctacatgaattaccaggaggcccttaaacggacggaatcggcctatgattggaccagcctgtctagttccagcatcaagtctggatcctcctcctcaagtattccggagagccagtcaaaccactcgaatcagtcggattccggcgtctcagacacacaaccggctgggcacgtgagatcccagagcattgtaagctccgtgttcagtgaggcatggaaacgcggtacacagctggaagagagctccaaagccaggatggagtccatgaatagaccgtacaccagcttggtgcctcccctctctccccagccaaagatcgtgaccccctacaccgcttctcaaccgagcccacctctgccccctccaccgccacccccacctcctcctccaccgcctcctccccctccccctcctcctttgccttcccagagcgcgccatcagctggatctgccgctcctatgtttgttaaatatagtactatcacccgcctccagaacgcaagccagcatagcggtgcactgttcaagccgccaaccccccctgtgatgcagagccagtctgtcaagccccagattctggtccctcccaacggggtagtgccgcctcctcctcctccaccacccccacccactcccggatccgctatggctcagctgaaacctgcgccttgcgccccttctttaccgcaattcagcgctcctccccctccactgaagatccaccaggtgcaacatatcacccaagtcgcacctcctactcccccacctccccctcctattcctgccccactgccaccccaagctcctccaaagccactggtcactattccagcccctacttctaccaagaccgtagccccagtcgtgacccaagcagctcccccaacccctacgcccccagttccccctgccaaaaagcagcctgcctttcctgcctcttacatcccccctagtcctccgactcccccagtccccgtgcctcccccaacactgccaaaacaacaatcattctgtgcaaagccgcctccaagtcccctctcccctgttcctagcgttgtcaagcagatagccagccaatttcctccccctccaactccccctgcaatggaatcccagccgcttaagcccgtgccggctaatgtagcccctcagtcgccaccggctgttaaagccaaaccgaagtggcaaccctcttcaattcccgtgccttcgcctgactttccccctcccccacccgagtccagtttagtgtttccccctcctcccccttccccagtccccgctccgccaccccctccccctcctaccgcctccccgaccccagacaaatccggatcaccagggaaaaaaacttctaagacaagcagtcccggaggaaagaagcctcctccaaccccccagagaaactcgtccataaagtcctcctccggggctgaacatcctgaacctaagcgtccatccgtagactccttggtaagcaaatttacacccccagccgagtcgggctccccatctaaagagacactgcctcctcccgctgctccccctaagccaggcaagctgaatctctccggagtcaacctgcccggagtgctgcagcaaggttgtgtgtccgctaaggctcctgtgctgtcaggacggggtaaagacagcgtggtcgagtttcccagcccgccatctgactccgactttcccccaccaccccctgaaacagagctgcctctccctcctatcgagattcctgccgtcttttccggcaacacttcccctaaggtcgcggtagtcaacccgcaaccccagcagtggtctaaaatgagcgtgaagaaagccccaccccctactcgcccaaagagaaatgatagcacccgcttgactcaagccgagattagcgagcagcctaccatggcaaccgttgtgccccaagtccctacgagtcccaagtcctctctctctgtccagcccggatttcttgccgacctcaatcgaaccctccagcgaaaatcaatcacccggcatggctctttgtcctcccggatgtccagggccgagcccacagctactatggatgacatggcactgcccccaccgcctcctgaactgttaagcgatcagcagaaagccggttacgggggtagccatatctctggctacgcgacattaagaagaggtccacccccagcccctcccaaacgcgatcagaacaccaagctgagcagagattggtag

SEQ ID NO: 53387 - DNA, 1854 bp, Artificial Sequence
  Description of Artificial Sequence: Synthetic coding sequence
atggaacagttgtccgacgaagagatcgaccacggggcagaggaggacagcgataaagaggaccaagatctcgacaagatgtttggagcctggctcggggaactcgacaaactgacgcagagtctggacagcgataagcccatggaacctgtaaagcggagtccgcttaggcaggagactaacatggcaaacttttcctatcgcttctccatctataatctcaacgaggcgctgaaccagggcgagacagtcgatttggatgccctgatggccgatttgtgttcaattgagcaggagctttcctccattggttcagggaatagcaaaagacagataacagagacaaaggctacccaaaagctgccagtctcaaggcacacactgaaacacgggacactcaagggcctctcctcttccagtaaccgcatcgcaaaacctagtcatgccagttacagcctggacgatgtgaccgctcagttagagcaagcctcactttctatggatgaggctgcccagcagtccgtcttagaggacacgaaacctctagttacgaaccagcacaggcgcaccgcatcagccggtaccgtgtctgatgctgaggtgcacagtatttccaacagttcccactcatcgatcacctcagctgcttcctctatggacagcctcgacatagacaaggttacaagaccccaggaactggacttaactcaccaaggccagcccattaccgaacactcctacctcgacagagagacgtctctcctgcttcgaaatatcgccggtaagccaagtcatcttctcaccaaggaagagcaagctgccaaactcaaggccgaaaagattcgcgttgctcttgaaaaaattaaagaagcgcaagtaaaaaagctggtgatccgggtgcatatgagcgacgatagttcaaagaccatgatggtggacgaacgtcaaactgtgaggcaggtgttagacaatctaatggacaagagtcactgcgggtattctctcgactggagtttggtcgaaactgttagcgaactgcaaatggagcgtatttttgaggatcatgagaacctcgttgagaaccttttgaattggaccagggattctcagaataaactgatatttatggaaaggatcgagaagtatgcactgtttaagaatccccagaactatttattgggcaaaaaagaaactgcagagatggccgatagaaataaggaggtcctgctggaagagtgtttttgcgggagcagcgtaacagtgcccgagatcgagggtgtgttgtggctaaaggacgatggcaagaagtcctggaaaaagaggtactttttgctgagggcgagcgggatttactatgtgccgaaggggaaagccaaagtcagcagagacttagtatgtttcctgcaactagaccatgtgaatgtgtactatggccaagactataggaataaatataaggcacccacagattattgtcttgttttgaaacacccgcagatccagaagaaatctcaatacatcaagtacctgtgttgtgatgacgtgcgcaccctccatcaatgggtgaatgggatccggatcgctaagtacgggaagcagttgtacatgaattaccaggaggcactcaaaaggactgaaagcgcctatgactggacatctctgtcttccagctctatcaagagcggctcatcttcttcttccattccagaatctcagagtaatcatagcaaccagtcagatagtggtgtttccgacacacagcctgctgggcatgtgcgaagccagagtatagtgagttcagtcttcagcgaagcttggaaacgtggtacgcaattagaggaaagcagcaagtag

SEQ ID NO: 53388 - DNA, 1860 bp, Artificial Sequence
  Description of Artificial Sequence: Synthetic coding sequence
atggaacagctctctgatgaagaaattgaccatggcgctgaggaagactcagataaagaggatcaagatctcgataagatgtttggcgcttggctgggtgagctggacaaacttacccaatcactagattccgataaacctatggaaccagtgaaacgttctccccttcggcaagaaacaaacatggcaaattttagctataggttcagcatttataacctgaatgaggcactgaaccagggggaaaccgtcgacttggacgccttgatggcagacctgtgctccatcgagcaggagctgagcagtattggatcaggaaattcaaagcgacagattacagagacaaaggccactcagaaactgcctgtttctaggcatacattaaagcatggcacattaaaagggctttccagctcttcaaaccgcattgcaaagccaagtcacgcctcctattctctcgatgatgtgaccgcccagttagagcaggcttccttgtccatggatgaggccgcacagcaaagcgtgctggaagacactaaaccactggtgactaaccaacaccggcgaacagcgagcgctgggaccgtgagtgatgccgaggtccactctatctcaaacagcagtcacagcagcatcacatccgccgctagctccatggactctctggacatcgataaagtgacccgccctcaggagctcgatctgacccaccaaggtcagcctattacggagcacgcaatttcgctgaggtgctcttcgaaacaggctaaacgtcacattgactttacggaggagcaggctgagctaactccagaggaacaggcagccaagctgaaggccgagaagataagggtagcgctagagaagataaaggaagcccaagttaaaaaactggtgatcagagtgcatatgagcgatgactctagtaaaaccatgatggtggacgagaggcaaacagtgcgtcaggtgttggacaatctgatggacaaatctcattgtgggtactctctagattggtctcttgtcgagaccgtatcagaactccagatggagagaatcttcgaagatcacgaaaatctggtggagaaccttctcaattggactagagacagccaaaataaactcatctttatggaacgcattgagaagtatgccttgtttaaaaatccacagaactaccttctgggtaagaaagaaacagcagaaatggcagacagaaataaggaagtattgctggaggagtgcttttgcgggtcctcagtgactgtgcctgagattgaaggagtgctctggttaaaggacgatggcaagaagtcttggaaaaagaggtattttcttcttagggcttcaggcatctactacgtgcccaagggaaaagcaaaagtttcccgagacctggtctgcttcctgcagctggaccatgtgaatgtttactatggacaagactataggaataaatataaagcaccaaccgactactgcctcgtgctcaagcatccacagatacagaaaaaatcccagtacataaagtacctgtgctgtgatgacgtgaggaccctgcaccagtgggtcaatggaatccggatcgccaagtatggtaagcagctgtatatgaactatcaggaggcactaaagcgcacagaaagtgcatacgactggacatcactgtcgtcttcaagcattaagagcggatcctcatccagttctatacccgagagtcaaagcaatcactcaaatcagtcagattcaggcgtttccgatacccagcctgctggccatgtgagaagccagtcaattgtgagttccgtgttcagtgaagcctggaaaagggggacccagctagaagagagcagcaaatag

SEQ ID NO: 53389 - DNA, 3909 bp, Artificial Sequence
  Description of Artificial Sequence: Synthetic coding sequence
atggaacagttgtcggacgaggaaatcgatcacggggcagaagaggacagcgataaagaagaccaagatcttgacaagatgttcggagcctggcttggggagctggacaaacttacacaatcactcgactcagataagccgatggaacccgtgaaacgctcccctctgaggcaggagactaatatggcaaatttcagctataggttctccatctataacttgaacgaggccttaaaccagggggagaccgttgacctggatgctctgatggctgacctctgcagcattgagcaagaactgtcatctatcggctcagggaatagtaagcgacagataacggagactaaggcaacccagaaacttccagtgagtagacataccctcaaacacggcacactaaagggactatcctccagcagcaaccggattgccaaacctagtcacgcttcctatagtcttgacgatgtgacggcccagctggagcaagccagtctgtccatggatgaagctgcacagcagagcgtgcttgaggacactaaaccccttgtgacgaatcagcacagacgcaccgcgtcggccggaactgtctccgacgcagaagtgcattcaattagcaattcatcccactcttccatcacaagcgcggctagctctatggattccttggacatcgataaggtgaccagaccccaggaacttgaccttacccaccaaggccagccaatcaccgagcatgccatctcccttcgctgttctagtaaacaggctaagcggcatatcgattttaccgaggagcaggcagagttgactccccactcttatttggatcgggagacctcactcctcttgcggaatattgccggaaagccatctcacctcttaaccaaggaagagcaggccgctaagttgaaggcagagaaaatccgagttgctctcgagaagattaaagaagcacaggtgaagaagcttgtaatcagggtacatatgtccgacgatagctccaagactatgatggtagatgagaggcaaaccgtccgacaggttcttgacaatctcatggataaatcccactgcggatactccctcgattggagcctggtagagaccgtgagcgaactccaaatggagcggatcttcgaagatcatgaaaatttagtggaaaatctgttaaattggacacgcgactcacagaacaaactgatattcatggagagaatcgagaagtatgccctctttaaaaacccgcagaactacttattagggaagaaggaaactgccgagatggccgataggaataaagaggtgttgctcgaggaatgtttttgtgggtctagcgttacagtgccagagatcgagggcgttctctggctaaaggacgatgggaagaagagttggaagaagcggtactttctcttgagggcaagcggaatctactacgtacctaagggcaaggccaaagtatctcgcgatttggtgtgtttcttgcaacttgatcacgtcaatgtgtactatggtcaggactatcgcaacaaatataaggcaccaactgattattgtctcgtgctaaaacacccccaaatacagaagaagagccagtatatcaagtacctgtgttgtgacgacgtacgcacgctccaccagtgggtaaacggtataagaatcgcaaagtatggcaaacaactgtatatgaactaccaggaggcccttaaaaggaccgagagtgcatatgactggaccagtctgtcttcctcctcaatcaaatctggaagctcatccagttccataccggaaagccagagcaatcacagtaaccagtccgactccggagtcagcgatacacagcccgcaggacacgtccgatcccaatcgattgtgtctagcgtgttctcagaggcctggaaacgcggtactcagctagaggagtcgtccaaagcgcgaatggagtcaatgaaccgcccttatacctcgctggttccccctctgtctccgcagccaaagatcgtgacaccctacactgctagccagcctagccctccactgcctcctcctcccccaccccctccgccacccccacctccaccaccaccaccaccaccccctctgccctcccagtcagcccctagcgcgggatccgccgcacccatgttcgtcaagtattccaccatcacccgccttcagaacgcatcccaacatagtggggctctgtttaaaccccctacacccccagtcatgcagagtcagagcgtcaagccacaaattttggtacctcctaatggggtcgttcccccacctccaccacctccccctccacccacgccaggcagcgcaatggcccagctcaagcccgctccctgtgccccatctctgccacaattcagtgctccccctcctcccttaaaaatacaccaggtgcagcacatcacgcaggtcgcaccacccaccccgcctcctcccccacctataccggctcctctgccccctcaggcccctcccaagcccctggtgactatacctgcacctacaagcacaaagactgtggctcctgtggttacgcaagcagccccacccaccccaaccccacccgtcccgcctgcgaaaaagcagcccgctttccccgcttcgtatatcccgccatcacctcctacgccccctgttccggtgccacctccaacgctccctaagcaacaatctttttgtgcaaaaccgcctccaagccccttgtccccagtgcccagtgtcgtgaagcagattgccagtcagttcccacctccaccgactccccctgcaatggaatcccagccactgaaaccggtgcccgctaacgtcgccccacagtctccacctgcagtcaaagccaaacctaagtggcagccttcctccatcccagtcccgtccccagactttccccctcccccaccagaatcttcacttgtgttcccaccacctccacctagcccagtgcccgctccacctcccccaccccctccaacagcttctcccactccagataaaagcgggtccccaggcaaaaaaactagcaagaccagctcacccggtggtaaaaagcctcccccaaccccccagaggaattcttctattaaatcttcgtccggagctgaacaccctgaacccaaaagacctagcgtggacagtctggtaagtaagtttaccccacctgccgagtcgggaagcccttcaaaggaaacactgccaccacccgctgccccacctaaaccaggtaagctgaatctgtctggtgtcaacttgcccggagttctccagcagggttgtgtgagcgctaaggctccagttttatcaggacgcggaaaagattccgtggtcgagttcccctcccccccaagcgatagtgactttcctcctccacctcctgagaccgagctcccattacccccaatcgaaatcccagccgtcttttcgggcaacaccagcccaaaggttgctgtggtcaacccacagccccagcaatggtccaagatgtcagtgaagaaagcgccaccacccactcggcctaaacggaacgactcaacgcgacttacacaagcggagataagcgagcaacctacaatggcaacagttgtaccacaggtaccaacatcccctaaaagcagtttatctgttcaacccggttttctggctgatctcaatcggacactgcaacgtaagagcattaccagacatggctcactgagttccagaatgagccgggcagagccaactgctacaatggacgatatggccctaccccctcctcccccagagttgttgtcagatcagcagaaagcaggatacggtggaagtcacatatccggttacgctacacttcggcgaggacctcccccagctcctcccaagcgggatcagaacacaaagctgtcccgggactggtag

SEQ ID NO: 53390 - DNA, 1875 bp, Artificial Sequence
  Description of Artificial Sequence: Synthetic coding sequence
atggagcagctgagcgatgaggaaatcgaccacggggcagaagaggactcggacaaagaagatcaagacctggacaagatgtttggcgcatggctgggggagctcgataagcttacccagagcctggactccgataaacctatggaacctgtcaagaggagccctttgagacaagagaccaacatggccaacttctcttaccgctttagtatatacaatctgaacgaggcattgaaccagggcgaaactgtggacttagatgctcttatggccgacctgtgttcaatcgaacaggagctctcatcgatcggcagcggcaactcaaagcgccagatcacagaaacaaaagcaacacagaaactgcccgtatctagacacacgctcaaacacgggaccctgaaaggattaagcagctcttccaataggattgctaaaccatcccatgccagctactccctggatgacgtcacggctcagttagaacaggcatccctctcaatggacgaagctgcacagcaaagcgtgctcgaggacacaaagccacttgtgactaaccagcatcgcagaactgctagcgcaggtacggtctccgacgcggaggtgcactcaatttctaattcttcacattcttctatcacctccgctgctagctctatggactccctcgacatcgacaaggtgacccgtccccaggagctggacttgacgcatcagggccaacccattacagagcacgctatatctttaaggtgttctagcaagcaggctaagaggcatattgacttcacagaggagcaagccgaactgacaccggaggaacaggccgctaagctaaaggcagagaagatccgagtggcgctggagaagattaaggaggctcaggtgaagaagttagtgatccgagtgcacatgtccgacgactcatcaaaaaccatgatggtggatgaaaggcagaccgttagacaagtgcttgacaatctgatggataagagtcactgcggatacagcctagattggagtctggtggagacggtgtcagagctacagatggagcgaatctttgaggatcatgaaaacctggtggagaatctcctcaactggactcgggactcccagaataaactgattttcatggagcgtattgagaagtatgcactgtttaaaaatcctcagaattatttgctgggcaagaaggagacagcagaaatggccgaccgcaataaagaggtgcttttggaggagtgcttctgcggctcatccgtgaccgtccccgaaatcgaaggagtgctgtggctgaaagacgatggaaagaagtcctggaaaaagagatacttcctgctcagagccagtggaatctattacgtacctaagggcaaagccaaagtgtcacgcgatctggtgtgcttcctgcagctcgaccatgtgaatgtttactacggccaggattatcgcaacaagtataaagctccaacagactactgtcttgtcctcaaacacccacaaatacagaagaaaagtcagtatataaaatacctctgttgtgatgatgttagaacattgcaccagtgggtgaacggcatccggattgccaagtacggaaagcagctgtacatgaactaccaggaggcgctgaagaggacggaaagcgcctatgactggacttcgctctctagttctagcattaaaagtgggtcttccagttctagcatccctgaatctcagtctaaccatagtaaccagtccgactccggtgtgagcgacacccagcctgctggccacgtgaggtctcagtccatcgtatcttctgtattttcagaggcgtggaagcggggtacccaactggaagagagttccaaggtgactgcctccttttag

SEQ ID NO: 53391 - DNA, 1794 bp, Artificial Sequence
  Description of Artificial Sequence: Synthetic coding sequence
atggagcagttgtccgacgaagagattgaccatggagcagaggaggattctgacaaggaggatcaagatcttgataagatgtttggcgcatggctgggcgagctcgacaaactgacccagtccctcgacagcgacaagccaatggagccagtaaagagaagcccactgagacaggagacgaatatggccaacttctcgtatagattctccatctacaacctgaatgaggccctgaatcaaggtgaaacagttgacctggacgccctcatggctgacctatgtagcatcgagcaggagctgtctagcatcggatcagggaacagtaaaagacaaattacagagactaaggcaacacagaaactgccggtgtctagacacaccctgaagcatggcacgctgaagggcttgtcatccagcagtaaccggatcgctaaaccaagccatgccagttattccctagacgacgtaacagctcaactggaacaggccagtttgtccatggacgaggcggctcaacagagtgtcctggaggacacgaagccactcgtgacaaatcagcaccggaggacagcttccgccggtacggtcagcgacgccgaggtccatagcatttctaattcctctcattcaagtattacctccgcggcaagctccatggactcattagacattgataaggttacgcgaccccaggaattggacctcacacatcaggggcagccaattacagaggaggagcaggccgctaaactgaaggccgaaaagatccgcgtggctctggagaaaattaaggaggcccaggttaagaaactggtaattcgggtgcatatgagtgacgacagctctaaaacaatgatggtagatgaaagacaaactgttaggcaggtactggacaacctgatggacaaaagtcactgtggttattccctggactggagtcttgtcgaaactgtctcagagctgcagatggagcgcatcttcgaggatcacgaaaatttggttgaaaatctgctgaattggacccgcgactcgcagaataaattgatttttatggagcggattgagaaatatgcgctttttaagaacccacagaactacctgctgggtaaaaaagaaacggcagagatggcggataggaataaggaggtgcttctcgaagagtgcttttgtggaagctcggtaaccgttcctgagattgagggcgtgctgtggttgaaggacgacggaaagaaatcttggaagaagcggtattttcttctccgggctagtggcatatactacgtgccaaagggaaaggcaaaagtgtccagagacctggtatgttttctccagcttgaccacgttaacgtctactatggtcaggactaccggaataaatataaggcccctacagattactgcctggtcctgaagcacccacaaatccagaagaaatctcagtatatcaaatacttgtgttgtgacgacgtccgcaccctccaccaatgggttaatggtatcagaatcgctaagtatgggaagcaattgtacatgaactaccaagaagccctgaagagaacagagagtgcatacgattggacctcattgagctccagttcaataaaatctggaagcagcagctctagcatcccagaaagccagtccaatcacagcaatcagtccgattccggcgtgtcagatacccaaccagccggacatgtgaggagccagagcatcgttagctctgtattttcggaagcttggaagaggggcacccagttggaggaatcctcaaaagtaacagctagcttctag

SEQ ID NO: 53392 - DNA, 1779 bp, Artificial Sequence
  Description of Artificial Sequence: Synthetic coding sequence
atggagcagttatccgatgaggagatcgaccacggtgccgaggaggactcagataaagaggaccaggatctcgataagatgtttggagcgtggctgggagagttggataaactcacacagtcgctagattcagacaagcctatggagccagtgaaacggtccccactccggcaggagaccaacatggccaacttcagctatagattctccatatataacctgaatgaggcccttaaccaaggagagacagtcgatctggatgccctgatggccgatctttgttcaatcgagcaggagctgagctctattggatccggcaactccaagaggcaaatcaccgagactaaggcaacgcagaagctgccagttagcagacataccttgaagcatggcactctgaagggcttgtcctcgtccagcaatcgaattgccaagccttcacacgcttcttacagtcttgacgatgtcacagcgcaactggaacaggcttctttgtctatggatgaggccgcacagcaatctgtgcttgaggataccaaaccccttgtcacaaaccaacatcggaggacagcatcagctgggacagtatcagacgctgaagtgcactctatttctaatagctcccacagtagcattacaagcgcagcctctagtatggactccctcgatatcgataaggtaacgagaccccaggagcttgatctaacccaccaaggacagcctatcaccgaggaagaacaggctgccaagctgaaagcggaaaaaatccgcgtcgctctggagaaaatcaaagaggcacaggtcaagaaattggttatccgcgtgcatatgtctgatgactcttctaagactatgatggtggacgaaagacagaccgtgagacaggtgctggacaacctgatggacaagagccactgtggatattcacttgactggtctttagtggaaaccgtgagcgagctgcagatggaaagaatctttgaagaccacgaaaatctcgttgagaacttattaaactggactcgggattctcagaataagctcatattcatggaaaggattgaaaagtacgccctctttaagaacccccagaactaccttcttgggaagaaagagaccgccgagatggccgatagaaacaaggaggtcctcctcgaagagtgcttttgtggttctagcgtcaccgtgcccgaaatcgagggagtgttatggctgaaggatgacggaaaaaagtcttggaaaaaacgctattttctcctgagagcgtctggtatctattacgtgcccaaggggaaggcgaaggtctcaagagatctagtctgcttcctgcagttggatcacgtgaatgtgtactatgggcaagactatcggaataagtataaggccccaactgactattgcctagttctgaagcacccccaaatccaaaaaaagagccaatacataaagtacctgtgctgtgacgacgtgcgtactctgcatcagtgggtcaacggtatacgcattgcaaagtatggaaagcagctgtatatgaattaccaggaagctttgaagcggacagaatccgcatacgactggacttccctatcaagctccagcattaaatctggatcatcttcttcatcaatcccggagtctcagtctaatcactccaatcagtctgacagcggagtgagtgacacacagcctgccggtcacgttaggtctcaaagcattgtctccagtgtcttctccgaggcatggaagagaggaacccagctcgaggagagcagtaagtag

SEQ ID NO: 53393 - DNA, 270 bp, Artificial Sequence
  Description of Artificial Sequence: Synthetic coding sequence
atggagcaactttctgacgaagaaatcgatcacggggctgaagaggattccgataaggaggaccaggatctggacaaaatgttcggcgcatggctgggcgaattagataagctcacacagtcccttgacagcgacaagcctatggagccggtgaagcgctccccgcttcgacaggagacaaatatggcaaacttttcatatcggttttcgatttataacctgaatgccttaaatcaaggcgagacggtcgatttggacgccctgatgtag

SEQ ID NO: 53394 - DNA, 1860 bp, Artificial Sequence
  Description of Artificial Sequence: Synthetic coding sequence
atggagcagctgtccgatgaagagatagatcatggtgctgaagaggacagcgacaaagaagatcaggatctagataaaatgttcggtgcctggctcggagagctcgacaaactgacacagtcacttgactccgataaaccaatggaaccagttaaaaggagcccactgaggcaggagaccaacatggctaatttctcttatcgcttctctatttataatttgaatgaagcgctgaatcagggcgagacagtggacctcgatgccctgatggccgacctttgctctatcgagcaggagttgtcctctatcggctcagggaattctaagcggcagatcaccgaaactaaagccacacagaagttgcccgtgtcccgacatacgctaaaacacggaactctgaaaggtttgagttcctcttccaatcggatagcgaagccatctcacgcctcttattcgttggatgatgtgaccgcacagctcgaacaggcgagtctctcaatggacgaggctgcacaacagagcgtgcttgaagacacaaaaccgctcgtgactaaccagcataggcgtaccgcttctgctggcaccgtctcagacgctgaagtccactcaattagcaattcaagtcactcctcaattacttccgccgcatctagtatggactcgcttgatattgacaaggtgacccggccacaggagcttgacctgacacaccaagggcagccgataacggagcatgctatcagcctgcgatgctcttctaaacaggctaagcggcacatcgacttcacagaagagcaggccgagctaacccccgaagaacaggcagcaaaactaaaggccgagaaaattcgagtcgccctggagaagatcaaggaggctcaggtcaaaaagctggtaatcagggtccacatgagtgacgacagctcaaaaaccatgatggtagatgaaagacagacagttcgccaggtgctggataacctcatggacaaatctcactgtggctattcgttggattggtccttggttgagactgtgagcgagctccaaatggaacgcatctttgaggaccacgagaatctggtggagaatctactgaattggacaagagacagccagaacaagctgatcttcatggaacgcattgagaagtacgctctgtttaaaaatcctcagaactacctcttaggcaagaaggaaaccgccgagatggcggaccggaacaaggaggttttactggaggaatgcttttgtgggtccagtgtcactgtgcctgaaatagagggggtgctctggcttaaggatgacggcaaaaagtcctggaaaaagaggtattttcttctgagagcaagcggtatctactatgtgcccaaaggcaaagcaaaggtcagtcgcgatctcgtgtgcttcctccagctcgaccacgttaacgtgtattacggccaggattacagaaacaaatataaagcacctaccgattactgtctagtgcttaaacatcctcaaattcaaaagaaatcgcagtacatcaaatacctctgttgtgatgatgtcagaacgttacaccagtgggtcaacggaatcagaatcgccaagtatggtaaacagctgtatatgaattatcaggaggccttgaaacgtacagagtccgcatatgattggacatcactcagttctagcagtattaaatccggcagttcatcttccagtattcctgagtcccagtccaatcattctaatcagagtgacagtggggtctcagatactcagccggctggccacgtgagaagtcaatctattgtgtcatcggtcttcagcgaagcctggaagcgaggtacccagttggaagagtctagcaagtag

SEQ ID NO: 53395 - DNA, 519 bp, Artificial Sequence
  Description of Artificial Sequence: Synthetic coding sequence
atggagcagttaagcgatgaggagatagatcatggagcggaagaggactctgataaggaagatcaggacctggacaaaatgtttggcgcatggctgggcgagctcgataaattaacacaatccctcgattccgacaagcccatggagcccgtgaaacgaagccccctaaggcaggagaccaacatggcaaacttctcctatagattcagcatctataaccttaatgaagcgctcaaccagggggagaccgttgatttagatgcgttaatggccgacttatgctcaatcgagcaggagctgtcatcaatcgggtctggcaattcgaaacgtcagattacagagaccaaggccacacagaagctgccggtgtctcgccataccctcaagcacggaaccctaaagggactgagttcttcttccaatcggattgccaagccctcgcatgcctcatattccctggatgacgttactgcccaactggagcaggcaagcctgtctatggacgaagcagcccagtag

SEQ ID NO: 53396 - DNA, 1869 bp, Artificial Sequence
  Description of Artificial Sequence: Synthetic coding sequence
atggagcagctttctgacgaggagatagatcacggcgcagaggaggattcagacaaagaggatcaagacctggataagatgtttggggcatggttgggagaacttgacaagctgacgcagtccctcgattcggataaacctatggagcctgttaagcggtctccccttcgacaggagacgaacatggctaactttagctaccgcttctctatttacaatctcaacgaagccctgaaccagggcgagacagtggatttagacgcgctaatggccgacctatgctcaattgaacaggaattgtcgagcattgggtccggaaacagtaagcgtcagataaccgagactaaggccacccaaaagctgcccgtgagccggcacacgctgaaacatggaacgttgaagggtctctccagtagtagtaatcggatagccaaaccttcccatgcttcctattccctggacgatgtaacagctcaactggaacaggcttctctgagcatggatgaagcggcacagcagtctgtattggaggacactaaacccctggtaactaatcagcacagaagaaccgcctccgcgggaactgtgtccgacgccgaagtgcacagcatttccaacagcagccacagctccatcacctccgccgcttccagcatggatagcctcgacattgacaaagttactcgaccccaggagttggacttaacacatcaaggtcagcccattaccgagcacagttacctcgatcgcgagacctctttactcctacggaatatcgccggaaagccttcacatctgctgactaaagaggagcaagcagcaaaacttaaggcagaaaagattcgggtggccctcgagaagatcaaggaggcccaggtcaaaaaattggtgatcagggtacatatgtccgacgattccagcaaaacaatgatggtcgacgagcggcagactgtacgccaggtgctggacaatctgatggacaaaagtcattgtggatatagcctggactggtctcttgtggaaaccgtatcggaacttcagatggagcgtatcttcgaagaccacgagaatctggttgaaaaccttctgaattggacacgcgactctcagaataagctgatcttcatggagcgcatagagaaatacgctctatttaaaaatccacagaactacctactcggaaaaaaggaaaccgcggaaatggcagatcggaacaaggaagtgcttctggaggagtgcttctgtggcagttcggttacagtacccgagattgaaggcgtgctgtggctgaaggacgatggcaaaaaatcctggaagaagcggtactttttgcttcgcgcttctggaatttattacgttcctaaagggaaggccaaggtgagcagggacctggtgtgtttcctgcagctggaccacgtgaatgtgtactatggacaagactaccgaaataaatacaaggctcccacggactactgtctggtattgaagcatccgcaaatccagaagaagtcccagtatataaagtacttatgttgcgatgatgtgcggaccctacaccagtgggtcaacggcatccgaatcgccaagtatggaaaacagctctacatgaattatcaagaagctcttaagcgtaccgaaagtgcttacgactggaccagcttatcatcaagttccattaaatcaggatccagctccagcagcattcccgaaagtcaaagcaatcactccaaccaaagcgatagcggggtatcagatacacagcccgcaggccacgttcggagtcagtcgatcgtcagctccgtgttctccgaggcctggaaacgtggaacccagctcgaggagtcttccaaagtgacagcatccttctag

SEQ ID NO: 53397 - DNA, 1854 bp, Artificial Sequence
  Description of Artificial Sequence: Synthetic coding sequence
atggagcagctgtccgacgaagagatcgaccacggcgctgaagaggatagtgataaggaggaccaggatctggacaagatgttcggagcctggctaggcgaacttgataaactcacccaatctctggactcggataagcccatggagccagttaagaggtccccactgagacaggagacaaatatggcaaacttcagttacagattctccatttacaacttaaacgaagccttaaaccaaggagaaacagtagaccttgacgcactcatggcagatctttgttctatagagcaggaactctcgtctattggctctgggaacagcaagcggcagattacggagaccaaagccacacaaaaactacctgtgtcacggcatacattaaagcacggcactctaaagggcctgagctcgtcatcaaacagaatcgctaaaccaagccatgcctcttactctctggacgacgtcactgctcagctggagcaggccagtctgagcatggacgaggccgcacaacagtctgttctcgaagacactaagcccctcgtgacaaaccaacacagacgcacggccagcgccggaactgtgagcgacgctgaggtgcactctatctcaaacagcagccactcatcaatcacttccgccgcatcctcaatggactcccttgatatcgacaaagtaactagaccccaggagctggacttaacccaccaagggcagccgatcaccgagcatagttacctcgatagagagacgtctcttcttctgaggaatatagcaggtaaaccttcgcatcttctcacaaaggaagaacaggccgcaaaattgaaggctgagaagatccgtgtcgctttggaaaagatcaaagaggcccaggtgaagaaactcgttattcgggtgcatatgtcagacgacagcagtaaaaccatgatggtcgacgagcgtcagacggtaagacaagtcctagataaccttatggataagtcccactgcggatatagtttggactggtctcttgtggagaccgtgagtgagttgcagatggagcggatctttgaggatcatgaaaacctcgtggagaacttgctcaattggacccgggattcccagaacaagctgatcttcatggaaaggattgagaagtacgccctgtttaagaatccccagaactatctgctgggtaagaaggagacagccgagatggctgacaggaataaggaggtgctactggaagagtgcttctgcgggtcttccgtgacagtcccggaaattgagggggtgctgtggctgaaagatgacggaaagaaatcctggaaaaaaagatatttcctgctgagagcgagtggaatatactacgttcccaaggggaaggccaaagtctccagggatctagtgtgcttcctccaactcgatcacgtcaatgtctactatggccaagactaccggaataaatacaaggcgccaacggattattgtctcgtgctcaagcaccctcaaatccagaagaagagtcagtacatcaaatatctgtgttgcgatgacgtcaggacactgcaccagtgggtaaatggaatccgcatcgccaagtatggcaagcagctttacatgaattaccaggaagccctaaagagaaccgagagcgcatacgactggacctctctgtccagcagtagcatcaagtcaggttcatcatcctctagcattccagagtcgcagagtaaccattctaaccagagcgactccggtgtatccgacacccaaccggcagggcacgttcgcagccaatctatcgtgtcctcagtgttctcagaggcgtggaaaaggggcactcagttggaggaatcatctaaatag

SEQ ID NO: 53398 - DNA, 1950 bp, Artificial Sequence
  Description of Artificial Sequence: Synthetic coding sequence
atggagcagttgagtgatgaggaaattgaccacggagcagaagaggactcagacaaggaggaccaggacctggataagatgttcggcgcatggctaggcgaattggataaactgactcagtcactggatagcgataaacctatggaacccgttaaacgttccccactgcgtcaggagaccaacatggccaactttagttaccgcttctccatctataacttgaatgaggctctgaaccagggggagacggtggaccttgacgccctgatggccgatctgtgtagtattgaacaggaacttagctctatcggaagtgggaatagcaagagacagatcaccgagaccaaagccacacaaaaactgcctgtcagtaggcatactctgaaacacgggacactcaaagggctctcttcttcatccaatagaattgccaagccgagccacgcttcttattcgctggacgatgtaaccgctcagctcgaacaggcatcactctccatggacgaagcagcccagcagtcggtgctggaggataccaagccccttgtgaccaaccagcaccgtaggaccgcgagtgcgggaacagtgtccgacgcagaagtgcactccatttcaaattctagccacagctctattaccagcgcagcctccagcatggactcactggacatagataaagtgacgcggccacaggagttggacctaacacatcagggtcagcccattaccgaacacgctatttctctcaggtgctccagcaagcaggccaagcggcatatcgactttaccgaggagcaggccgaactgactccgcatagctacctggaccgggagactagtctcctgctccggaacatcgccggaaagccaagccatctcctgacaaaggaggaacaggctgctaagcttaaagcagagaagatacgcgtcgcgttagagaagatcaaggaggcccaggtgaagaagttggtgatccgagtccacatgtctgacgattcgagcaaaaccatgatggtcgacgaaaggcagacagtgagacaggttttagacaacctcatggacaagtcccactgcggatactctctggactggagtttggttgagaccgtgagcgaattgcaaatggaaaggatatttgaggaccacgaaaacctggtggagaatctgcttaactggacaagagacagccagaataagcttattttcatggagcggattgagaaatatgcgctctttaaaaatccacaaaactatttactcggcaagaaagagactgcagagatggctgatcgaaataaagaagtgttacttgaggagtgcttttgcggcagttctgtgacagttcctgaaatagaaggagtgttgtggctaaaggatgacggaaagaaaagctggaaaaagcgctactttctactgcgagctagtggcatctattatgtgcccaagggaaaagctaaagtgagtagagatttggtttgcttcttacagttggaccacgtgaacgtttactatggccaagactataggaataagtataaagcacctaccgattattgtcttgtgttaaaacatccacagatccagaagaaatcccaatatataaagtatctgtgctgcgacgatgtgagaacactgcaccagtgggtgaacgggattcggatcgccaagtacggcaaacagctgtatatgaactaccaggaagccctgaaacggacggagtccgcctacgactggacttccctcagctcctcatccatcaagtcaggctccagtagcagctccatcccggagagtcagagcaaccactccaaccagagcgattcaggcgtgtccgatacacagcctgccggtcatgtgcggtctcaaagcattgtgtccagtgttttctctgaagcttggaaacggggaactcagttggaggaaagctcaaaggtcacagcttcattctag

SEQ ID NO: 53399 - DNA, 2073 bp, Artificial Sequence
  Description of Artificial Sequence: Synthetic coding sequence
atggggtcctctgggttgggtaaggcagcgacactggatgagctcctctgcacctgcatcgaaatgttcgacgataacggtgaattagacaatagctacttgccgaggattgtgctcctcatgcataggtggtacctttcttccaccgagctcgctgagaaactactgtgcatgtatcggaacgccaccggggagagctgtaacgagttcaggctgaaaatctgttactttatgcggtactggatcctcaaattccctgccgaatttaatctggacttgggactaattaggatgaccgaagaattccgagaagttgcctctcagctgggttacgagaagcatgtctcccttatcgacatctctagcattccctcttatgactggatgcgcagagtcacacagcgaaagaaagtcagcaagaagggtaaagcctgtctcctgtttgatcacctcgagcctatcgagctcgccgaacaccttactttccttgagcacaaaagctttcgcagaatcagctttacggactatcagtcctacgttatccacggttgtctggagaacaatcctacccttgaacggtctattgccctcttcaatggtatttcaaaatgggtacagttgatggtactgagtaaacctacacctcaacagcgcgctgaagttatcacaaagttcattaatgtggccaagaaactgctccaattgaagaactttaacactctgatggcagtggtcggtgggttatcgcactcatcaataagccgtctgaaggaaacgcacagtcatctgtcgagcgaggtcacaaaaaattggaacgagatgacagaacttgtcagttcgaatggcaattactgcaactatcggaaagcttttgcggattgtgacggatttaaaattcccatcctgggagtacacctcaaggacctgatagctgtacacgttattttccccgactggaccgaggagaacaaggtgaatatcgtgaaaatgcaccagttgtctgtgacactgagtgagctagtctccctgcagaatgcaagccatcacctggagccgaacatggatctgatcaatttgctaaccttgtccctggatttgtatcataccgaggatgacatttacaagctctctttggtgctggagccccgaaactctaaatcacagcccacctctcccacgacacccaacaaaccagtggtcccactggagtgggccttaggggtgatgcccaagcccgacccaactgtgattaataagcatatccggaagcttgttgaatcagtgtttcgcaattatgatcacgatcatgatgggtacatcagtcaggaagactttgagtccattgcagccaatttccccttcctcgactcattctgcgttctagataaagatcaagatggactgatctcaaaggatgagatgatggcctatttcttgagggctaaaagtcagctgcactgtaagatgggacctggatttattcataactttcaggaaatgacgtatttgaagcctaccttctgtgaacactgcgctggcttcctgtgggggattatcaaacagggctataagtgtaaggactgcggggctaactgccacaaacagtgtaaggaccttcttgtgctcgcctgcaggcgctttgcacgagctccgagcctgtcttccggccacggctccctgcccggttcaccatcccttccccctgctcaggatgaggtgttcgagttccctggggtgacagctggccatcgcgaccttgattcacgcgctataaccctggtgaccggtagcagccgaaagattagcgtccgcctgcagcgcgcaacaactagccaggcaacacagactgagcccgtgtggtctgaggccggttggggagactccggatctcatactttcccaaaaatgaaatcaaaatttcacgataaggccgctaaggataaaggctttgcgaagtgggaaaatgaaaaaccccgagttcatgcgggagtggatgtggtcgatcgcggaactgagttcgagctcgaccaggacgaaggggaggagactaggcaagacggagaggacggatag

SEQ ID NO: 53400 - DNA, 2073 bp, Artificial Sequence
  Description of Artificial Sequence: Synthetic coding sequence
atgggctcttctggcttggggaaagccgctaccttagacgaactcctttgcacctgcattgaaatgttcgacgataatggcgagctggacaatagctatctacctaggattgtgctgcttatgcatcgctggtatctgtcatccacagagctcgcagagaaacttctgtgcatgtacaggaacgctaccggggagagttgtaacgaatttagattgaaaatctgctacttcatgagatattggatcctgaagttcccagccgagttcaaccttgacttaggccttatccgaatgacagaagagttcagagaggtggcgtcccagctcggctacgagaaacatgtcagcctgatcgacatcagtagcatcccatcttatgactggatgcgtcgagtgactcagagaaagaaggtgtccaaaaaaggtaaggcctgcctattattcgaccaccttgagcctatcgagcttgccgagcacttgacattcctcgaacacaaatcttttagaaggatctctttcactgattaccagagctacgtcatacacgggtgcctggagaacaatccgaccctggagcgatcgattgccctgtttaacgggatatctaaatgggtccagctcatggtgctgagtaagcccacgccgcagcagcgggctgaagtgattactaagttcattaacgttgccaaaaagcttctccaattgaaaaatttcaacaccctgatggctgtcgtaggagggttgtcacacagctcaatcagccggttaaaagagacccattcacatctctcttctgaagtcacaaagaattggaacgaaatgactgagctggtgagctccaacggaaattattgcaattaccgaaaggcctttgcagactgcgacggattcaagattccaatcttgggtgtgcatttaaaagatctcatcgccgtgcacgtaatctttcccgactggaccgaggaaaataaggtgaacattgtcaaaatgcaccagctgagcgtgaccttgtcagagcttgtgtcccttcaaaacgcgagtcaccatttggagcccaacatggaccttatcaaccttctcacactcagtctggatttgtaccacactgaagatgatatctacaagctgagccttgttctggaaccaaggaactctaagagccaacccacttcaccgacaacacctaataaaccagtggtcccactggaatgggccctgggtgtgatgcctaagccagatcccacagtgataaataaacatatccgcaaactggttgagagcgtttttagaaactatgatcatgaccacgatgggtacatctcccaggaagatttcgaaagcattgcggcaaacttcccatttcttgactccttctgtgtgctggacaaggatcaagatgggttgatttccaaggacgagatgatggcatatttcctgcgggcaaaatcccagctgcactgtaaaatggggcctggttttattcataatttccaagaaatgacgtatctgaagcctactttctgtgagcattgtgctggctttctctggggcatcattaaacagggctataagtgcaaagattgcggcgcaaattgccataagcagtgtaaagatttgctggttctagcatgccggaggttcgcgagggcccctagcctctcctcaggccacgggtcgctccccggttcaccctccctgcccccagctcaggacgaagtgtttgaattccccggagtgaccgccggacacagagacctggactcccgagccatcacactcgtgacaggaagttccagaaagatttccgtgagactgcagagggccactacgagccaagccactcagactgagcctgtttggtccgaggcgggatggggagattctggcagccacacattcccaaagatgaagtcaaaattccacgacaaggctgccaaggacaaggggttcgcaaagtgggagaatgaaaagccacgcgtgcacgccggtgtggacgtggtggaccggggtactgaattcgaactggaccaggacgaaggagaagagaccaggcaggatggggaagatgggtag

SEQ ID NO: 53401 - DNA, 2070 bp, Artificial Sequence
  Description of Artificial Sequence: Synthetic coding sequence
atgggatcgtccggacttggaaaagctgctactctggatgagctgctctgcacctgcatcgagatgttcgacgacaacggcgagttagacaattcttacctgcccagaatcgtccttctgatgcacagatggtatctgagcagcaccgagcttgctgagaaacttttatgcatgtacagaaacgctaccggcgagtcctgcaatgaattccgcctcaaaatttgttactttatgcgttattggatcttgaagtttccagccgagttcaacctggatctgggccttatcaggatgacagaagaattccgcgaggtggccagccagctgggatatgagaagcacgtcagcctcatcgacatttcttctatcccgtcatacgactggatgcggagggtcacacaaagaaagaaggtctctaaaaaagggaaggcctgtctgctttttgaccacctggagcctattgagttggccgagcacctgactttcttagagcataagtcattccgcaggattagctttaccgactaccagtcatatgtaatccacggatgtctggaaaacaacccaacgctcgaaaggtcaattgccctgttcaacggtatcagtaaatgggtgcagttgatggtgctctctaagcctactccacagcagcgggctgaagtgattactaagtttataaatgtggcaaagaaactcctccaactcaaaaactttaacacacttatggcggtagtgggcggtctctctcacagtagcatcagccgcctgaaggagacacattcgcatctttcatctgaggtcactaaaaactggaacgaaatgactgaactggtgagctccaacgggaactactgcaattacaggaaagcgttcgcggattgtgatggttttaagataccgatactcggggtccacttaaaagacttgatcgcagtccatgttatcttccccgactggactgaagaaaacaaagttaatatcgtgaaaatgcatcagcttagtgtcaccttatctgagcttgtctcccttcaaaatgcttcccatcatctggagcctaacatggacctcattaatttgttgactctctccctcgatctgtatcacacagaagatgatatctacaagctgtctctcgtgttggaacccagaaacagcaagtcccccacatcccctactacgcccaacaaaccagttgtccccctggagtgggcgctaggagttatgccgaagcctgatcctacagtgataaacaagcatatccgcaaattagtggaaagtgtcttccggaactacgaccacgaccacgacggttacataagccaggaagacttcgagtctattgcagctaatttcccattcctcgatagtttttgtgttctagataaggatcaggacggcctcatcagcaaagatgagatgatggcctactttctgagagccaaaagccagttgcactgcaagatgggtccaggctttatacataacttccaagagatgacatacctcaagcccactttttgcgagcactgtgccggatttctctggggaataatcaaacagggctacaagtgtaaggattgtggcgctaactgtcacaaacagtgcaaagacttgctggtccttgcatgtcgtcgcttcgccagggcaccgtcactttcaagcggccatggctctctccccggttccccttccctgcctcctgctcaggatgaggtattcgaattccctggagtcaccgctggacatcgagatttggatagtagagccatcactctggtgaccggtagctcccgcaaaatttccgtccgcctgcaaagggctaccacgtcccaagccacacaaactgagccagtgtggtccgaggccggttggggagacagcggctcacatacctttcccaagatgaaatccaagttccacgataaggcagcaaaggataaagggttcgctaagtgggagaacgaaaaacctagagtgcatgctggcgtggatgttgtcgaccggggtacggaatttgaactggaccaggatgagggggaggagacgaggcaggacggggaggatggctag

SEQ ID NO: 53402 - DNA, 342 bp, Artificial Sequence
  Description of Artificial Sequence: Synthetic coding sequence
atggggtcctcaggcttgggcaaggctgctaccctggacgaactgctttgcacttgtatcgagatgttcgatgacaatggtgaactggacaattcatatctgccccgaatcgtgctgctaatgcacagatggtatctgtcatctaccgagctcgcggaaaaactgctgtgtatgtaccgtaacgccaccggggagtcctgtaacgaatttcgacttaagatttgctattttatgcgttactggatcctgaagtttcccgctgaatttaaccttgacctcggactaattcgcatgactgaagaattcagagaggtcgcttctcagcttggttacgaaaagtag

SEQ ID NO: 53403 - DNA, 105 bp, Artificial Sequence
  Description of Artificial Sequence: Synthetic coding sequence
atgggatctagcgggctcggcaaagcggctacactggatgagctgttgtgcacgtgtatcgaaatgttcgacgataacggtgagctggataatagttacctgtag

SEQ ID NO: 53404 - DNA, 519 bp, Artificial Sequence
  Description of Artificial Sequence: Synthetic coding sequence
atggggtcgtcaggtctgggcaaggcggcaactctggatgagctactgtgtacctgtatcgagatgtttgatgataacggggaactcgataattcttaccttccccgtatagtgttgctgatgcacagatggtatctgtcctcgacagaactggccgagaaacttctctgtatgtaccgcaacgctacaggtgaatcgtgtaatgagtttcgccttaagatttgttatttcatgagatactggattctgaagttcccggcagagtttaacttggacctgggcctcatccgcatgaccgaagaattccgcgaagtggcgtcccaactgggatatgaaaaacacgtcagcctcattgatataagctctatcccttcgtatgattggatgcggcgtgtgacgcagaggaagaaagtctccaaaaagggtaaggcctgtctcctgtttgatcacctcgagcctatagagctcgcagaacatcttacctttttggagcataaaagtttcagacgcatctcttag

SEQ ID NO: 53405 - DNA, 234 bp, Artificial Sequence
  Description of Artificial Sequence: Synthetic coding sequence
atggggtctagcgggctggggaaggcagcgaccctggacgagctcctgtgtacgtgtatagaaatgttcgacgacaatggggagctcgacaattcgtacttgccacggattgttttgcttatgcaccgatggtacctgagtagcactgagctggcagagaagctgctgtgtatgtatagaaatgctaccggcgagtcgtgtaatgagtttaggctgaaaatttgctacttttag

SEQ ID NO: 53406 - DNA, 339 bp, Artificial Sequence
  Description of Artificial Sequence: Synthetic coding sequence
atggggtcatcagggctgggaaaggcagctacccttgatgaactgctgtgtacatgtatcgagatgttcgacgacaacggagaactagataattcctacctgcctagaatcgtcctcctcatgcatcggtggtatcttagcagtaccgagttggccgaaaagctactgtgcatgtataggaacgccaccggggaatcatgcaacgaatttagacttaagatatgctattttatgagatactggattctgaagttcccggctgagtttaatcttgatctcggcctgatcaggatgacagaggagttccgtgaggtcgcctcacaactgggctacgaatag

SEQ ID NO: 53407 - DNA, 552 bp, Artificial Sequence
  Description of Artificial Sequence: Synthetic coding sequence
atgcccttggtgcggtatcggaaggtcgtgatcctggggtatcgctgcgttggaaaaaccagcctggctcatcagtttgtagaaggcgagttctcggagggctacgatccgaccgtggaaaatacgtactccaagattgtgacgttgggaaaagacgaattccatttacatctggtggacactgcaggtcaagatgagtacagcattcttccctactcgtttatcatcggtgtgcacggatacgtgctggtgtactccgtcacatccctacactcgtttcaggtgatcgagagtctgtaccaaaagctccatgagggacatgggaagactagggtgcccgtagttctcgtggggaacaaagcggacctgagtccagaacgcgaagtgcaggcagttgagggaaaaaagttggcagaatcttggggagccacattcatggagtcaagcgcccgagaaaatcagttgacccaaggaatcttcactaaagtaattcaggaaattgctcgggttgagaattcctacgggcaggagcgcagatgtcatctgatgtag

SEQ ID NO: 53408 - DNA, 633 bp, Artificial Sequence
  Description of Artificial Sequence: Synthetic coding sequence
atgactgccgctcaggccgcaggtgaggaggcaccgcctggggttaggtctgtgaaggttgtgctggtcggcgatggcggttgtggcaaaacctccctgttgatggtatttgcagatggggcattcccagaatcttataccccgaccgtcttcgaaagatacatggtcaacttgcaagttaaaggaaaacctgtccatttgcacatttgggacaccgccggtcaggatgactacgatagacttaggccgctgttctacccagacgccagcgtgcttcttctgtgtttcgacgtgactagtccgaattcctttgacaacatctttaatcggtggtacccagaagtcaaccacttctgcaagaaagtcccaataattgttgtagggtgcaaaaccgacctttgtaaagacaaaagcctggtgaacaagttacggagaaacggcctggagccagttacctatcaccgagggcaggaaatggctcgctcagtcggggcagtcgcctatctcgagtgctccgcacggctgcacgacaatgtgcatgctgtgtttcaggaggccgctgaggtcgcactgtccagccgagggcgtaacttttggcgtcgcattacacagggattttgcgtggttacgtag

SEQ ID NO: 53409 - DNA, 636 bp, Artificial Sequence
  Description of Artificial Sequence: Synthetic coding sequence
atggatgcaccaggcgcactcgcccaaactgccgctccaggaccgggaaggaaggaactgaaaattgtgatcgtcggcgacggtggctgtggaaagacatccctgctgatggtgtactcacagggttcatttcctgagcattacgcgccttcagtgttcgaaaaatatacggcgagcgtcaccgttggaagtaaggaggtcaccctgaacctatatgacacagccggtcaggaagattacgacagactgcgcccactctcataccagaacacacatctggttctgatttgctatgatgttatgaaccccacatcatatgacaatgtgctgatcaagtggtttcctgaggtaacacacttttgtagaggtatccccatggtgttgatcggatgtaaaacagatttacggaaggacaaggaacagttgcgaaaactgcgggcagcgcagctggagcccatcacatatatgcagggactatccgcctgtgaacagatcagggctgctctttatctggagtgtagtgccaaatttcgggaaaacgtcgaggacgtgttccgggaggccgcaaaggtcgcactgagtgcactcaagaaggcccagagacaaaagaagagaagactgtgtctgttgttgtag

SEQ ID NO: 53410 - DNA, 342 bp, Artificial Sequence
  Description of Artificial Sequence: Synthetic coding sequence
atggacgccccaggcgcactggcccagactgctgcacccggtccagggcgaaaggagctgaagatcgttattgtgggggacggcggttgtggcaagacctcgctgctgatggtatatagtcagggctcatttccagaacattacgcccctagtgtgtttgaaaaatacacagctagcgtgaccgtcggatctaaggaagtaacccttaacttgtacgatacggccggtcaagaggattatgatcgcctgcgcccattgagctatcagaatactcacctggtacttatctgctatgatgtgatgaatccaacctcttacgataatgtcctgattaaggtctag

SEQ ID NO: 53411 - DNA, 576 bp, Artificial Sequence
  Description of Artificial Sequence: Synthetic coding sequence
atgcagtctattaagtgtgtggtcgtgggggacggggctgtgggaaaaacctgcctgcttatctgctacactacaaacgcatttccaaaagaatatatacccaccgtcttcgacaactattccgcccagtccgccgtagacggcaggactgtgaatctgaatttgtgggataccgctgggcaggaagaatatgatcggctgagaactctctcctatccacagacaaacgtgtttgttatctgtttttccatcgcatccccaccaagctatgagaatgtccggcacaagtggcatcctgaggtctgtcaccactgtccagatgtcccaatcttgttagtcggcactaagaaggaccttagggcccagcccgatacccttcgaagattaaaagaacagggccaggctcctatcaccccccagcaggggcaagcgctggcgaagcagatccacgccgtaaggtatctagagtgctccgccttgcagcaagatggtgttaaggaggtcttcgcggaggctgtgagagcagttctaaacccaacccccattaaaagaggaaggagctgcatcctcctgtag

SEQ ID NO: 53412 - DNA, 576 bp, Artificial Sequence
  Description of Artificial Sequence: Synthetic coding sequence
atgcaatctatcaagtgcgtggtggtgggcgacggggctgtcggaaagacctgtctcctgatttgttataccactaacgcctttcctaaggagtacattcccacagtgtttgataattactcagctcagtcagctgtggacggcaggacagtcaatcttaatctgtgggacaccgccggtcaggaggaatatgatagactgcggactctcagctatcctcaaactaatgtgtttgttatatgtttctccattgcatcgccacccagttatgagaatgtgcggcacaaatggcatcctgaggtgtgccatcactgtcctgacgttcctatcctgctagtgggcacgaaaaaggatctgcgcgcacagccagacacattgcggcgactgaaagagcaaggacaggcgccaataactccacagcagggacaagctctggccaaacaaattcacgccgtccgttatctggagtgctccgcccttcagcaagacggagtgaaagaggtctttgctgaagccgtgcgggcagtcttaaaccccaccccaataaagagaggacgttcctgcatacttctgtag

SEQ ID NO: 53413 - DNA, 576 bp, Artificial Sequence
  Description of Artificial Sequence: Synthetic coding sequence
atgcagagtatcaaatgtgtggtagtcggcgacggagccgtcggcaagacttgcctgttgatctgttacaccaccaatgccttccctaaagagtacattccaacagtattcgacaattactcggcccagtctgcagtggacgggagaacagttaatctgaatctgtgggacaccgccggacaggaggaatacgatcggcttcgtacgctgtcatacccccaaactaacgtcttcgttatttgtttttctatcgcctcccccccatcctacgagaacgtgcgccataagtggcaccctgaggtctgccaccactgcccggatgttcccattttactcgtgggcacaaaaaaagatcttcgcgctcagcctgacacactccggcgattgaaggaacagggacaagctcccataaccccccagcagggccaggctctcgccaagcagatacatgccgtgcggtacctagaatgctccgctctgcaacaggacggcgttaaggaggtgttcgctgaagccgttcgagccgttcttaacccgacgcccatcaaacgcggtaggtcatgtatcctcttatag

SEQ ID NO: 53414 - DNA, 576 bp, Artificial Sequence
  Description of Artificial Sequence: Synthetic coding sequence
atgcagtcgatcaagtgcgtagtcgtgggagacggggcagtgggcaaaacctgtctgctgatctgttacaccacaaacgcctttcccaaagaatacatccccacggtgttcgataattatagtgcacagagcgcagttgacggcaggacagttaacctgaacctatgggacacagccggacaggaggaatacgaccggctcagaacattgagctatccccaaacaaacgtttttgtgatatgcttctctatcgcgtcccctcccagttacgagaacgtacggcacaagtggcatccagaggtgtgtcatcactgtcccgatgtgcctatactattggttggaacaaaaaaggacttgcgggctcagcctgataccctccggagactgaaagagcaggggcaagccccaattacccctcagcaaggccaagctctggctaagcaaatccacgccgtgagatacctggagtgttcagcccttcagcaagatggagtgaaggaagtgttcgctgaggcagtgcgagccgtgctgaatcccacgccaatcaagcgtgggcgaagctgcatcttgctgtag

SEQ ID NO: 53415 - DNA, 576 bp, Artificial Sequence
  Description of Artificial Sequence: Synthetic coding sequence
atgctctcaagtataaaatgtgtactcgttggtgactcagcggtgggaaagacaagcttattggttagatttacatctgaaacctttcccgaagcctataagcctaccgtctacgaaaacaccggtgtggatgttttcatggacggtatacagatttctcttggtttgtgggacactgccggaaatgatgcctttcggtcaatccggccacttagttaccaacaagctgacgtggtgctcatgtgttatagtgttgctaaccataactctttcttaaatctgaagaacaagtggatcggagagatcagaagcaacctaccatgcacacccgtactggtggtggcaacgcagactgaccaacgcgaaatgggaccccatcgtgccagttgtgttaatgcgatggaaggcaagaaactcgcccaggacgtgagagctaagggttatctggagtgctcagctctgagtaaccggggagttcagcaggtgtttgaatgcgctgtccggacagctgtgaatcaggccagaaggcgcaatcgacgccgtttgttttcaataaatgagtgcaagatcttctag

SEQ ID NO: 53416 - DNA, 312 bp, Artificial Sequence
  Description of Artificial Sequence: Synthetic coding sequence
atgctttcctccatcaaatgtgtgctcgtgggcgactctgccgtcggcaaaacatcgctgctggttcgcttcacttcagagacatttcctgaagcttacaaacctaccgtgtatgaaaacacaggcgtggacgtctttatggacggtatccaaatctcactggggttgtgggacacagcaggcaacgatgcgtttcgatctatccggcctctgagctaccagcaggccgatgtggtattgatgtgctactctgtagctaaccataattccttcctgaatctcaagaataagtggattggggaaattcggtag

SEQ ID NO: 53417 - DNA, 576 bp, Artificial Sequence
  Description of Artificial Sequence: Synthetic coding sequence
atgctcagcagcattaagtgtgtgcttgtgggggacagcgctgtcggaaaaacatcactcctggtccggttcacatccgagactttccctgaggcctacaagcctacggtctacgagaatactggggttgatgtcttcatggatgggattcagattagcctggggctgtgggacaccgccggaaacgatgcttttcgctcaattcgacccctctcataccaacaggcggatgtcgtcctaatgtgttattcagtggcaaatcacaactcatttttgaatttgaaaaacaaatggattggcgagatcagatccaacctgccttgtacacccgtcctcgttgtggctacacaaacagatcagcgtgaaatgggcccacacagagccagctgtgtgaatgcaatggagggcaaaaaattagcccaagatgtgcgggctaagggttacctggaatgtagtgccctgtcaaacaggggagtccaacaggtctttgaatgtgcagtaaggaccgccgtgaatcaggctcggagaaggaatagacgcaggctgttttccattaatgaatgtaagatattctag

SEQ ID NO: 53418 - DNA, 330 bp, Artificial Sequence
  Description of Artificial Sequence: Synthetic coding sequence
atgctctcatcaattaagtgcgttttggtcggagactccgcagtcggaaaaacgtccttgctggtgagattcacatctgagacatttcccgaagcatataagccgacagtatacgagaacacaggggtagatgtcttcatggatggaatacagattagcctgggcttgtgggacaccgcagggaacgatgcattcaggtccattagaccactgagttaccagcaggcagatgtagtgctgatgtgttattccgttgccaaccacaattctttcctaaacctgaagaacaagtggatcggagaaatcagatccaatctgccttgcacgtag

SEQ ID NO: 53419 - DNA, 51 bp, Artificial Sequence
  Description of Artificial Sequence: Synthetic coding sequence
atgctgtcctctataaagtgcgtgttggtgggggatagcgcggtgggatag

SEQ ID NO: 53420 - DNA, 21 bp, Artificial Sequence
  Description of Artificial Sequence: Synthetic coding sequence
atgttgagctccattaagtag

SEQ ID NO: 53421 - DNA, 645 bp, Artificial Sequence
  Description of Artificial Sequence: Synthetic coding sequence
atgaactgcaaagaaggtaccgatagcagttgcggctgccgcggtaatgacgaaaaaaagatgctgaagtgtgtggtcgtcggcgacggcgctgtgggcaaaacttgcttactgatgtcttatgcaaacgatgcttttccagaggagtatgtgccgacggtcttcgatcattatgctgtgaccgttacagtcgggggaaagcagcacctcctcggcttgtacgatacggctggccaggaagattataatcagctgcggcctctgtcataccccaatactgatgtgttcctgatatgtttcagcgtcgtaaaccctgccagctatcacaacgtgcaggaagaatgggtgccagagttgaaggactgcatgccacacgtgccatacgtgcttatcggcacccagatcgacttgagggatgatcccaagacactggccaggttgttgtatatgaaggagaagcctttaacatacgagcatggagtcaaactcgccaaggccattggggcacagtgttacctcgagtgttctgcactgacccagaagggcctgaaggcagttttcgacgaggcaatcttaaccatcttccatccaaagaaaaagaaaaaaaggtgcagtgagggacactcttgctgcagtattatttag

SEQ ID NO: 53422 - DNA, 618 bp, Artificial Sequence
  Description of Artificial Sequence: Synthetic coding sequence
atggcacatggccctggcgctctcatgctgaagtgtgttgtcgttggggacggggctgtcggaaagacctgtctactaatgtcttacgcaaatgacgcctttccagaggaatatgttcccaccgtattcgaccattatgccgtcagcgtcactgtgggcggtaagcagtatttattggggctatacgacactgccggtcaggaagattatgatcggctccggccactgagctaccctatgactgatgtctttctcatttgcttctctgtggtgaatccggcatctttccagaatgttaaagaagagtgggttcccgagctgaaggaatacgcgccaaacgtgccttttctgctgatcggtacccagatagaccttcgcgatgacccaaagaccttagccaggctgaatgatatgaaagaaaagcccatttgcgttgaacaggggcagaaacttgctaaggaaattggcgcatgctgttacgtggagtgctccgcgcttactcagaaaggtctaaagaccgtgttcgacgaagccattattgcgatactaacacccaaaaaacacacagttaagaagaggataggtagtaggtgcataaattgctgtttgatcacctag

SEQ ID NO: 53423 - DNA, 915 bp, Artificial Sequence
  Description of Artificial Sequence: Synthetic coding sequence
atggcagtcactaaggaactactgcagatggacttatacgccttgttagggatcgaagagaaggccgctgataaagaagtcaagaaagcttaccggcagaaggccctgtcatgtcatccagataagaaccccgacaacccgagggccgcagaattgttccaccagctctcccaggccttggaggtgttgaccgacgcagcagccagagctgcctacgataaggtgcggaaagcaaagaaacaggccgctgagcgaacccagaagcttgatgagaagcgcaagaaagtgaagctggacctggaggctagagagcgccaagctcaggctcaagaaagcgaggaggaggaagaatccaggtccactaggactctggagcaggaaatcgaacgactgcgggaggaaggctctcgccagctcgaggagcagcagcggttgatccgagagcagatcagacaggagagggatcagaggctcagagggaaagccgagaacactgaagggcaggggacacccaaactgaaactcaagtggaagtgcaagaaggaggacgagtcaaaaggcggatatagtaaggatgtgctccttcgccttcttcagaaatacggagaagtgttgaatttggtattatcatccaagaagccagggacagccgtggtggagttcgctaccgttaaggcagcggagctggcagtgcagaacgaggtcggactcgtggacaatccactgaagatctcctggcttgaaggccagccccaggacgccgtgggtaggagtcatagtggactctcaaagggtagcgttctctctgaaagagattacgagagcctcgtgatgatgaggatgagacaggccgcagagagacaacaactcattgccagaatgcaacaggaggaccaggagggcccaccaacctag

SEQ ID NO: 53424 - DNA, 258 bp, Artificial Sequence
  Description of Artificial Sequence: Synthetic coding sequence
atggccgtggaggaagaactgaaaaaggatcatgctgaaatgcaagctgtgatagatgcaaaacagaagataatcgatgcccaggtgatcaatggtgacgagatcattcagacaggcaaaactgaccgagtccccggatttagccaacatcagactgatgagcgagcggatccatccgaaggggcagttcaacacgcaggccctcagtggcacttgccccatcaaccccaccaggcttttcatcacggtgagtggtag

SEQ ID NO: 53425 - DNA, 3843 bp, Artificial Sequence
  Description of Artificial Sequence: Synthetic coding sequence
atggagctgtcccccagctctggtggggctgccgaagccctgtcctggcctgagatgtttcctgccttggagtctgattcaccactgccaccagaggatctggatgcggtcgtcccagtaagcggggcagtggccggtggtatgctggataggattttactggagtctgtttgtcagcagcagagttgggtgcgtgtttacgacgtcaaagggccacctacacacagattatcctgtggtcagtctccgtacactgaaactactacatgggaaaggaagtactgtatccttacagactcacagctggtcctactcaacaaagagaaagagatccctgtggagggtggtcaggagcagcagaccgactcaactaaggggagatgcttgaggcggacagtgtctgtgccttccgagggccagtttcctgagtatcccccagagggagcgaccaaactcgaggtgccggctgagagatccccaaggcggaggagcatttccggaacgagcacgtccgaaaaaccgaactctatggacactgccaatacttcccccttcaaggtccctggcttcttttctaaaagactgaagggcagcatcaagaggactaagtctcagagcaagttggatcgtaatacaagttttagattgcccagcctgcgaagcactgatgacaggtccagaggtttacctaaactgaaagagtccaggtctcatgagagccttctgtcgccctgcagcacagtcgagtgcctggatttgggcaggggtgagcccgtgtctgttaagcctttgcattcctctatcctcggacaggacttttgttttgaggttacctacctctctgggagcaaatgctttagctgcaacagcgcatccgaaagagataaatggatggaaaacctcagacgtacggtacagcccaataaggacaactgtcgacgagcagagaacgtgctgcggctttggatcatcgaggctaaggacctggcccctaaaaagaagtatttttgcgaactctgtttagatgatactctgtttgccagaacaacgagtaagactaaggctgacaatatattctggggagagcacttcgaattcttttctcttcctccgttgcacagcataaccgtccatatttacaaggacgtagagaaaaagaagaaaaaggataaaaacaactacgttggcctagtcaacatccctaccgcctctgtgaccggtcgccagttcgtcgagaagtggtatcctgttagtacaccaacccccaacaaagggaagacaggagggccatccattaggatcaaatcacgattccagaccataacaattctgccaatggagcagtataaggagttcgccgaatttgttacctccaattacactatgctctgttccgtcctcgagccagtaatcagcgtgcgtaataaggaggaactcgcttgcgcactcgtccacatcctacagagcaccgggagggctaaggattttctgacagatctggtcatgtcagaggtagacaggtgtggagagcatgacgtactcattttccgtgagaatactattgctacgaagagcatagaggagtacttgaagctcgtgggacagcagtatttacatgatgcattaggagagtttatcaaggcactgtacgagagcgacgagaactgtgaagtcgacccctctaaatgttcctcaagcgagttgattgatcaccagagcaacctgaaaatgtgctgcgagctggctttttgcaaaattatcaatagctactgcgtcttccctagagagcttaaagaagtgttcgcctcctggaagcagcaatgcctgaatcggggaaagcaggatatcagtgaaaggttaatctccgcctccctgttcctccgctttctctgccctgccattatgtctccctcactgttcaacctgatgcaagagtaccccgatgatcgaacatcaaggaccctgacgcttattgcaaaggtaatccaaaatctcgcaaattttgcaaagttcgggaataaggaggaatacatggccttcatgaacgacttcctggaacacgaatgggggggaatgaaacgctttttactagaaatttcaaatcccgacacgatcagtaatactccaggatttgacgggtacattgacctcgggagagagttatccgttttgcacagtcttctgtgggaagttgtctcacagttagataaagcgaccgtggcaaaactggggcctttgcctagggtactggccgatatcacaaagtcccttaccaaccctaccccgattcagcagcagttgcggaggtttaccgagcataatagttcccccaatgtgtccggttccctgtcatccgggcttcagaaaatctttgaagaccccacagactcagacctgcacaaactgaagtctccatcccaagataatacggactcctacttccggggtaagacactgcttttggtgcagcaagcgtcatcccagagcatgacttactccgagaaggatgaacgagaaagctcattgcccaacggacgcagcgtatcattaatggatctgcaggacacgcatgcagcccaagtggagcatgcttccgtgatgctcgatgtgcctattagactgaccggttctcagctgagtatcactcaggtcgcaagcatcaagcaactgagagaaacacagagtactccacagtctgcaccacaggtgaggcgccctttgcatcctgccttgaaccagccaggagggctgcagcccttgagttttcaaaaccctgtctaccatctgaataacccaatccctgcaatgcccaaggctagcattgattcttctcttgaaaacttgagcacagcttctagtcggagccagtccaacagcgaggattttaagttgtcaggcccatcaaattcttcaatggaggattttactaaaaggtcaacccagagtgaggacttttcacgcaggcataccgtgcccgatagacatatcccacttgctctcccacggcagaattccacaggtcaggcgcaaatccggaaggtggatcagggagggctgggtgccagggccaaggcacctcccagcttaccccactcagcttccctccggtccactgggtctatgagcgtcgtctccgcagcgctcgtcgccgaacccgtccagaatggatctcgatcacggcagcaaagctcttcaagtcgggagagcccagtccctaaggtgagggccattcagcgtcaacagacccagcaggttcaaagccctgtggactccgccactatgagccccgttgaaaggactgctgcatgggttctgaacaatgggcagtatgaagaggatgtggaagaaacggagcaaaatctcgatgaagcgaaacacgccgagaaatacgaacaggaaatcactaagctgaaggaacgcttgcgcgtttcatctcgtcggttggaagaatacgagagacgccttctggtgcaggagcagcagatgcagaagctcctgctggagtacaaggctaggctggaagacagtgaagaaagacttcgcagacagcaagaagagaaggacagccagatgaagtcaataatctctaggcttatggccgtggaagaagagcttaaaaaggatcacgcagaaatgcaggctgtaatcgatgccaagcagaagataatcgacgcccaggagaagagaattgtgtcacttgatagcgctaataccagattaatgtcagctctaactcaggtaaaagagcggtacagcatgcaggtgcggaatggcatttctcccacaaaccctaccaaacttagtattactgagaacggcgagttcaaaaactctagctgttag

SEQ ID NO: 53426 - DNA, 2082 bp, Artificial Sequence
  Description of Artificial Sequence: Synthetic coding sequence
tgagaagtctttgcctcttggaagcagcagtgtctgaaccgtggcaagcaggatataagcgagagactgatatcggctagcctttttctacgctttttgtgtcccgcaattatgtcgccttccctgttcaaccttatgcaagagtatcctgacgaccggacctctcgaacgctcacactgatagctaaggttattcagaacttagcgaatttcgcaaaatttggcaacaaagaggagtacatggccttcatgaatgacttcctggagcacgaatggggcggaatgaagcgattcctactcgagatctcaaatcctgacacaatatcaaacacacccggtttcgatggatatattgacctgggacgggagctctccgtcctccactctctgctgtgggaggtggtatcgcagctcgataaaggcgagaacagttttctgcaggccacagttgcaaaactcgggccactcccccgtgtactggccgacatcaccaagagcttgaccaaccccactccaattcagcagcaattaaggcgattcactgagcataatagttccccaaacgtgtctggcagtctgagctccgggctgcagaagatttttgaagatcccacagattctgacctgcataagttaaagagccctagccaggacaatacagacagctattttcgcggtaaaacccttctgttggtccagcaggcctcctcccagagtatgacctactctgaaaaggacgaacgcgagagctcattgccgaatggtcgctccgtctctcttatggatttgcaagatacgcacgctgcccaggtcgaacacgcaagcgtgatgcttgacgtccctatccgtctgacaggttctcagctttcaatcacacaggtggcctctatcaagcagcttagagagacccagtctacaccccagagcgcccctcaggtaaggaggcctctgcatcctgctctaaatcagcctgggggactacagcctctcagcttccagaatccggtgtaccatctgaataaccctatcccagccatgccaaaggccagtattgatagcagcttagaaaacctgagcacggcatcttcccggagccagtcaaacagcgaagacttcaagctgtcaggtccaagtaacagctctatggaggatttcacaaaaagatctacccaaagtgaagattttagtcgccgacacactgtcccagataggcacataccactcgcgctgcccaggcagaacagcactggccaggcacagatccgcaaggtagatcaaggtgggctcggagccagggcgaaggccccaccttctctgccccacagtgcgtcccttcgcagtacaggatctatgtcggtggtgagtgctgccttagtggccgaaccagtccaaaacggctcacgctcccggcagcagtccagcagcagccgggaaagcccagttcccaaagtgcgtgccattcagagacagcaaacccagcaagtgcagtccccagtcgactcggcaactatgtcccccgtggaaaggaccgccgcttgggtgctaaataacggccagtacgaagaggacgtggaggagactgagcagaacctggatgaggctaaacacgctgaaaagtacgagcaggaaataaccaaacttaaggaaagactaagagtcagtagtagacggctggaggagtacgagagaagattacttgtgcaagaacagcagatgcagaaactgctcttagagtacaaagcaagactggaggacagcgaggagaggctgcgacgccagcaggaagaaaaagattcccagatgaagagcatcatttcccgcctgatggcggtggaagaggagcttaagaaagatcacgctgagatgcaagctgttatcgacgccaaacagaagattatagatgctcaagtgatcaacggggatgaaatcatccaaaccggaaagactgatagggtgcccggtttctctcaacaccaaacagatgagagggctgatccatcagagggggcagtacagcatgcagggcctcagtggcacctgcctcatcagccccatcaggcgttccaccatggcgaatggtag

SEQ ID NO: 53427 - DNA, 3810 bp, Artificial Sequence
  Description of Artificial Sequence: Synthetic coding sequence
atgttcccagccctggagagtgatagtccactccccccagaagatctggatgcagtggtgcctgtttctggcgctgtcgcaggaggaatgctggaccgcatactacttgagagtgtgtgtcagcagcagagctgggtcagggtgtatgacgtaaagggtccccctacccatcgactcagttgcggacaatcaccatacaccgaaaccacgacgtgggagaggaaatattgcatcctgacagactctcagctagttctcctgaataaggaaaaagaaatccccgtagaaggtggacaggaacagcagacagattctaccaaaggccgttgccttaggaggaccgtcagcgtcccatcggaagggcaatttcccgaatatcctcctgagggagccaccaaactggaagtcccagccgagcggtctccacgacggcgttcgatttctggcacctcgacctcggaaaaaccaaattccatggacacggctaacacgtcgccattcaaggtgccaggattctttagtaaaagactcaaggggtctattaagagaacgaaatctcaatccaagttggaccgaaacacctctttcagacttccaagtttacgtagcacagacgacaggtcccggggtttgcccaagctgaaagagtctcgctcccacgagagccttctgagcccctgctccacggttgaatgcctcgatcttggaagaggtgaacccgtcagcgttaaacccttgcattcctcaattcttggacaggacttttgcttcgaggttacctatttgtcgggttccaaatgcttctcatgcaatagtgccagcgagagggacaaatggatggagaatctccggagaaccgttcaaccgaacaaagacaattgtcggagggcggagaacgttttgcggctgtggatcattgaggccaaagacctggcccctaaaaagaagtacttctgtgaactctgcctggacgatacactgtttgccagaaccacatcaaaaactaaagccgacaacattttttggggcgaacactttgagtttttctctttgcctccattgcatagtattacagtgcatatttataaggacgtagagaaaaagaaaaagaaggataaaaataactatgtcggtctggtgaatattcccacagcatccgtaaccggcagacagtttgtagaaaagtggtatcctgtttccaccccaacaccgaacaagggaaagacggggggacctagcatccggatcaaatcccgcttccagacgatcactattctccctatggaacagtataaagagttcgcagaatttgttaccagtaactataccatgctttgctccgtactagaaccggtaatttccgttcgcaataaagaagagctagcatgcgctctggtgcacatcctgcagagcactggtcgggctaaggactttctgactgatctcgtaatgtctgaagtggatagatgcggcgagcatgatgtcctcatattccgtgagaacacaatcgcgactaaatctatcgaagagtatctgaagctagtagggcagcagtaccttcatgacgccctgggggagtttataaaagccttgtacgagagcgatgagaattgcgaggtggaccctagcaaatgctcatcaagtgagctcatagatcaccagtccaacctgaagatgtgttgcgaattggccttctgcaagataataaactcatattgtgtgtttcctcgcgaactgaaggaggtgttcgccagctggaagcagcagtgcctgaatcggggtaaacaagatatctcagaaaggctgatttccgcaagcctgtttctgcggtttttatgtcctgccataatgtccccatctctgtttaatctcatgcaggagtaccctgacgatcgtacgtccagaactttgacactgatagcaaaagtgatccagaacctcgccaactttgcgaagttcggcaacaaggaagaatacatggcgtttatgaacgatttcctggagcacgagtggggcggaatgaagagatttctcctggagatcagtaaccctgacacaatctctaacacgcccggttttgacgggtacatcgacctcggacgcgaactctctgttctccactccctgctctgggaggtggtgtcacagctcgataagggagaaaattcatttttacaagcgacagtggccaagctggggccactgccacgggtgctggcagacatcactaaatcactcaccaatcctacacccattcagcaacaactgaggcggtttactgagcataattcgagcccaaatgtgtctgggagtctgagctccgggttgcaaaagatctttgaagatcccacagacagcgatctgcacaaactgaaaagtccctcacaggataacaccgatagctacttcagagggaagactctgttgctggtgcagcaggcctcatctcaatctatgacgtattccgaaaaggacgagagagaatctagcctccctaacggccgatccgttagtctgatggacctgcaggatacccatgccgctcaggttgagcatgcttcagtgatgctcgacgtccccatccgccttaccggatcacagctgtccatcactcaggttgcatccataaaacagctccgcgagacccagagtaccccacagagcgcccctcaagtcaggcgcccattgcatcccgctttaaaccagcctgggggactgcagcctctctcattccagaaccccgtctaccacctgaacaatcccattcccgctatgcccaaagcatcaatagactcaagcttggagaacttgagcacggcctccagtagaagtcagtctaattctgaggacttcaaattatcaggcccatctaattcatctatggaagacttcactaaacgctcaacccagtcagaggacttctcgcgccgtcacactgtccccgatcggcacatccccctggctctgccccgacaaaatagcactgggcaagctcagatcaggaaggtagaccaaggcggactcggggctcgcgcaaaagccccaccctcactcccacactccgcttccctccggtcaacgggcagcatgtctgtcgtgtcagcggcactcgttgccgagccagtccagaacggttcgaggtcgcgtcagcaatcgtccagcagtcgggagagccccgtgccaaaagtgcgggctatccagcgacagcagacccagcaggtccaaagccctgtggactccgcaacaatgagtccagtggagcggactgccgcatgggttttaaacaacggccagtacgaggaggatgtggaagaaactgagcaaaacttggacgaggcaaaacatgctgagaaatacgaacaggagataaccaagttgaaagaaaggttaagggtgtcctcacgacgactggaagagtacgaaagaaggctcctggtgcaggagcagcagatgcagaaactgcttctagagtataaagcacgcctagaggatagcgaggagcgcttaagaagacagcaggaagagaaagacagccagatgaagtccattataagcaggctcatggccgtggaggaggagctaaagaaggatcatgcggaaatgcaagctgtgattgatgccaagcaaaagatcattgatgctcaagagaaaagaattgtgtcattagactctgccaatactaggctgatgtccgctctaacgcaagtcaaagaaaggtatagtatgcaggttcggaatggaatcagccccacaaacccaacaaagctcagcattactgaaaacggcgaatttaagaacagcagctgctag

SEQ ID NO: 53428 - DNA, 3420 bp, Artificial Sequence
  Description of Artificial Sequence: Synthetic coding sequence
atgcagactcccgaggtccctgctgagcggtctccaaggcgcaggagtatcagtggcacgagcaccagcgagaagcccaattctatggacaccgccaacacctccccgttcaaagtccctggctttttttccaagagactgaaaggctccatcaaaagaactaagtcccagagtaagttggaccgcaacacttctttcagactgccaagccttagatctacagacgacaggagccggggattacccaagctcaaagagtcccgaagccatgagtctctccttagcccatgttcaacagtggaatgcttggacctcggtagaggcgagcctgtgtcggtcaaacccctccactcctctatcctcgggcaggacttctgctttgaggttacctacctgtccggaagcaaatgtttttcctgcaacagcgcctcggagagagacaagtggatggagaatctccggaggaccgtacagcctaacaaggacaactgccgtcgcgctgagaacgtgctgaggctatggatcatcgaagcaaaagatctcgcgcctaaaaagaagtacttctgtgaattgtgtctagatgataccttgtttgcacgcaccaccagtaagactaaagcagacaacatcttctggggcgaacacttcgaattctttagcctgcccccactccactctattactgtgcacatttacaaggatgttgaaaaaaaaaagaagaaagacaaaaataactacgtcgggctcgtcaatattcctaccgcctccgtgactggtcggcagttcgtggagaaatggtacccagtctctactcccacccccaacaagggaaaaactggtggccctagcataagaatcaaatcccgtttccagactatcaccatactgccaatggaacagtacaaggaatttgctgagttcgttacgtctaactacactatgctgtgttccgtcctagaacccgtcatttccgtgaggaataaagaggagttagcctgcgccctggtccacattcttcagtcaaccgggcgtgctaaagatttcctgaccgacttagtgatgagtgaggtcgatagatgtggggagcatgatgtgttaatcttcagggagaataccattgctaccaagtctatagaagaatacttgaaacttgtcggccagcagtacctgcacgatgcactgggggaatttataaaagcactctacgagtctgacgagaactgcgaggtggatccttcaaagtgttcctcctccgagcttatcgaccaccaaagtaacctaaaaatgtgctgtgagctggccttctgcaaaatcattaacagctattgcgtctttcctcgggaactcaaagaagtctttgccagctggaagcaacagtgcctcaatcgtggaaagcaggacatttctgagaggttgatttccgctagcctcttcttgaggtttttgtgtcctgcaattatgagtccaagtctattcaaccttatgcaggagtacccggacgatagaacaagccggacgttaactcttatagccaaggtgatacagaacctggccaattttgccaagttcggcaacaaagaagagtatatggcttttatgaacgattttctggaacacgagtggggcggaatgaagagattcctgcttgaaatcagcaaccctgacacaatttctaacacacccggtttcgacggatatatcgatttgggccgtgagctgtcagtgctgcattctctgctgtgggaagtcgtaagccagctggataaaggcgagaactcctttttacaggcgacggtagcaaaactcggacctctcccaagggttctggctgacatcaccaaatctcttaccaaccccacccccatccagcaacagttacggcgtttcacggagcacaactcctcccctaatgtcagtggcagcctctcttctggcctgcagaagatcttcgaagatcctacggactcagaccttcacaagctgaagagtcccagccaagacaacacagactcctattttcgcggtaagaccctgctgttggtccagcaagcgagcagccaatcaatgacatactctgaaaaggacgagcgtgaaagctccttgccaaatgggcgaagtgtcagcttgatggatttgcaggacacacacgccgcacaggttgagcacgcaagtgtgatgcttgatgtgcccattcggctgacaggctcgcagctgagcattacccaagttgcttccataaaacagctgagggaaacccagtccacccctcagtcggcgcctcaggtcagaagaccgctccaccccgctttgaaccagcctggagggcttcagccgctttccttccagaaccccgtgtaccacctcaataacccgatacctgccatgcccaaggctagtattgattccagcctcgagaatctatcaactgcctcctctcgcagccaatccaatagcgaggacttcaagttgtcagggccttctaactccagtatggaagattttactaaaagaagtacgcagtctgaagattttagccggagacacacagtgcctgaccggcatattccactggctctgcctcggcaaaattctactggacaggcccagatccgcaaagtggatcaagggggactgggcgctagggctaaagcccctccctcccttccacacagcgcaagtctgaggtctacaggctctatgagcgtggttagtgccgcattggtggctgaacctgtgcaaaatggatcccggtctcgacagcagagcagcagcagtcgggaaagcccagttccgaaggtgagagcaatccagcgacaacagacacagcaggtacaaagtcctgtggacagtgctaccatgagcccagtagagcgcaccgccgcatgggtgcttaataatggtcagtacgaagaagatgttgaagaaacagagcagaatcttgacgaggcaaaacatgctgagaagtacgagcaggaaatcaccaaactaaaagaaagactgcgcgtgagctctagacgactggaagagtacgagagacggttgctcgtgcaagagcagcagatgcagaagctgctcttagagtataaagccaggctggaagattctgaagagcggctcagacgtcagcaggaggaaaaagatagtcagatgaagtcgatcatttccagactcatggcagtagaggaggagctgaagaaggaccacgcggagatgcaggctgtaattgacgccaagcagaagataatcgacgctcaggagaaacgcatagtaagcctggactcagctaacactcggcttatgagcgcgttgacccaggttaaggaacggtatagcatgcaggtacgaaatggcatctccccgacaaatccaacaaagctgtccattactgagaacggcgaattcaagaattcctcatgctag

SEQ ID NO: 53429 - DNA, 3036 bp, Artificial Sequence
  Description of Artificial Sequence: Synthetic coding sequence
atggaccccccaagtccttctcgtactagccaaacccaacctacagctacatcccccttgacttcttatagatggcacaccgggggtgggggtgaaaaagctgccggagggtttaggtggggcagatttgccggttggggcagagccctttcccaccaggaacctatggtgtcgacacagcccgctcctagatcgatcttccggagggtcctgagtgccccaccaaaagagagccgaacatcccggctgaggctgagcaaagcactctggggaaggcacaaaaaccctccgcctgagcccgaccctgaacccgagcaggaggccccagaattagagcccgaacccgagcttgaacccccaacgcctcaaattccggaagcaccaacccccaacgtgccggtttgggatatcgggggattcacattattggacgggaagttagttctgcttggaggtgaggaagaaggacctaggcggccacgtgtgggatccgcttcatcagagggcagcatacacgtggcgatgggaaacttccgtgatcctgaccgcatgcctggtaagaccgagcctgaaacagccggtccaaatcaggtccacaacgttcgtggactgctgaagagacttaaggagaagaaaaaggctcgactggagccccgagatgggccacccagtgcactggggagccgcgaatcactggctacgctttcagagctcgatctcggcgctgagagagatgttagaatctggcccctccatccctctctgctgggcgaaccccattgttttcaggtcacttggaccggcggatcccgctgtttttcctgcaggtcggccgctgagcgggatcgctggatcgaagacctgcgccgacagttccaaccaacacaagataatgttgaacgagaggagacctggctcagcgtgtgggttcatgaagcaaagggcttgcccagggccgctgcaggggctccgggagtgcgcgctgaactttggctcgatggtgccctcctagcgagaacagcccctcgagcgggtcccggtcaattgttttgggccgagaggttccacttcgaggctctaccaccagccaggaggctttctcttcggttgcggggtctgggcccaggtagtgccgtgctgggacgggttgccctcgcccttgaggaattagacgcccctagggctccagccgcagggcttgagcggtggttccctttgctgggggcacccgctggcgcagctctgcgagctaggatccgcgctcgcagactacgtgtgttgccatccgaaagatacaaggagctcgctgagttcctcactttccattacgcaagactgtgcggggctttggagcccgcattacccgctcaggctaaagaggaactggcagcagccatggtccgggtgttaagagcaaccggccgagcccaggcactagttacagacctaggcacagctgagctagcgcgatgcgggggaagagaggctctgctgtttcgtgaaaacacactggccaccaaagcaattgacgagtacatgaaattagtggcccaggactatttacaggaaactctgggacaggtagtcagaaggctgtgcgctagtacggaagattgcgaggtggatccttcaaagtgccctgcttcggaactgccagagcaccaggctcggctcaggaactcatgtgaggaagtgtttgagactataatacatagctatgattggttcccagcagagctagggatcgtcttcagttcttggcgggaggcttgtaaggagcggggatctgaggtcctgggtccaagacttgtgtgcgcctccctgttcctgagattactttgccccgcaatccttgccccatccctgttcgggctcgctcccgaccaccctgcccctgggcctgccaggaccttgacactgatcgccaaagtgatccagaaccttgctaacagagctcccttcggagagaaggaagcctatatgggattcatgaactcctttctcgaggagcacggacccgcaatgcagtgctttctggatcaggtggctatggttgacgtggacgccgctccctccggttatcagggctcaggggatctggcacttcagcttgcagtgctccacgcccaactgtgtactatctttgctgagctcgatcaaaccacccgcgataccctcgaacccctccctacaattctacgggctattgaggaaggtcagcccgttctcgtgagcgtccctatgcgactcccgctcccccctgcacaggtgcatagcagtttgtctgccggagaaaagcccggatttttagcccctagggacctgcccaaacataccccattgatttccaagagccagagtctgcgctctgtgaggcgctcagaatcttgggccaggcccagacctgatgaagaacgccctctcagacgtcccaggcctgttcaacgaacgcagtcagtgcccgtgcgccgtcctgcaaggcgaaggcagagcgctggcccttggcccaggcccaaaggaagcctctccatgggaccagcaccaagggcccgaccatggacccgagactccgcttctttaccacgaaagcccagcgtgccgtggcagagacagatggaccagccgcaggatagaaaccaagctcttggtactcaccggccagtaaacaagctcgccgaattgcagtgcgaggtcgctgcgttacgtgaagagcagaaagtcttgtctcgactcgttgagtcccttagtacacaaatccgcgcactgaccgagcagcaggaacagcttcggggacaacttcaagacctggattcccggcttcgcgcagggtccagtgagttcgatagtgagcataacctgacttcgaatgaagggcatagtctcaagaacctggagcatcgcctaaatgagatggagcgcacacaggctcaactcagagacgcagtacagtccctccagttgtcccccaggaccagaggctcctggagtcaacctcagcccctaaaagccccatgcctgaacggagacacgacctag

SEQ ID NO: 53430 - DNA, 711 bp, Artificial Sequence
  Description of Artificial Sequence: Synthetic coding sequence
atggagcgctggctgttcctgggcgctacagaagagggtcctaagcggacaatggactctgggacgagacccgtgggaagttgctgttcctctcccgcaggactgtctcgggaatataagctggtgatgctgggtgccggtggggtgggaaagagtgccatgactatgcaatttatttctcatcggttccctgaggatcatgacccaacaatcgaggacgcctataagatcaggatcaggatcgatgacgagcccgctaacctggatatcctggacacggcaggccaggccgaattcacggccatgcgcgatcagtacatgagggcaggagagggattcatcatttgttacagtatcacggatcgtagaagcttccacgaggtgagagaattcaagcaattaatctacagggtgcgccgaactgacgacacacccgtggtgctggtcggcaacaagtcggacctgaagcagttacggcaagtgaccaaagaggaaggactggccctggcgcgagagttcagctgccccttctttgaaacatctgccgcttatcgttattatattgacgacgtgtttcatgccctggtacgggagattagaaggaaagagaaagaggctgtgctggcaatggaaaaaaagtctaaaccaaagaattcagtgtggaaacggctcaaaagcccttttcggaagaagaaagacagcgtgacctag

SEQ ID NO: 53431 - DNA, 660 bp, Artificial Sequence
  Description of Artificial Sequence: Synthetic coding sequence
atggactccggtacccgccctgtcggatcttgctgctcatccccagccggattgtctagggaatataaattagtgatgcttggcgctggcggagtggggaagtctgccatgactatgcagttcattagccatcgattccccgaagaccatgatcctacgatcgaggacgcatataaaatccggattaggatcgatgacgaacccgctaatctggacatcttggacaccgccggacaggccgagttcacggcaatgcgggaccagtacatgcgtgctggcgaaggctttattatctgctatagtataacagatcggagaagctttcacgaagtgcgcgaatttaagcagctgatttaccgcgtgagacgcaccgatgacaccccagtggtcctggtgggaaataaaagtgatctcaaacaattgcgtcaagtgaccaaggaagaaggattggcgttagctcgtgaattctcttgcccgtttttcgaaacttcggccgcataccgttattatatcgatgatgtgttccatgccttagtgagagaaatccgcaggaaggaaaaagaggctgtgctggccatggagaaaaaatctaaacctaaaaattctgtgtggaaacgcttaaaatcaccttttagaaaaaaaaaggactccgtgacttag

SEQ ID NO: 53432 - DNA, 552 bp, Artificial Sequence
  Description of Artificial Sequence: Synthetic coding sequence
atgacaatgcagttcatcagccacagattccccgaggatcatgacccaactatcgaggacgcttacaagattagaatccgcatcgacgacgagcccgcaaatcttgatatcctcgatactgctggtcaggctgaattcacagctatgagggatcagtacatgagagccggtgaaggtttcatcatctgctattcaatcactgaccggaggtcattccatgaagtcagggaattcaagcaactgatttaccgagttcgccgaacagacgacacccctgtggtccttgtcgggaataagagtgatcttaagcagctacgtcaggtcaccaaagaggaagggctcgccctggcacgcgagtttagctgcccgttctttgaaactagcgcagcctaccggtactacatcgatgatgtctttcacgcactggttcgtgaaataaggcgtaaggagaaggaagcagtgcttgctatggagaaaaagagcaagccgaaaaatagcgtttggaagaggttaaaatcgccattcagaaaaaaaaaggacagcgtgacctag

SEQ ID NO: 53433 - DNA, 462 bp, Artificial Sequence
  Description of Artificial Sequence: Synthetic coding sequence
atggaggtcgagaacgaggcgagctgcagtcccggatcagcctcaggagggtccagggagtataaggtggtcatgctgggagccggtggagtcgggaagtccgctatgactatgcagttcattagccatcagttccctgactaccacgatcccacaatagaagacgcctataaaacccaggtgcgtattgacaacgaacccgcttacctagatatcctggataccgccggacaagcagagttcacagccatgcgagagcagtatatgagaggaggcgaagggttcattatttgttattctgtaacagacagacagagtttccaggaggccgcaaaattcaaagaattaatttttcaagtaaggcatacttatgaaatcccactggtgctcgtcgggaacaaaattgacctggagcagttccggcagccaacactgaaagagtttggtagggaagaattctag

SEQ ID NO: 53434 - DNA, 654 bp, Artificial Sequence
  Description of Artificial Sequence: Synthetic coding sequence
atggaagtggagaacgaggcatcgtgttctcccggatcagcttctggcggatctcgcgaatataaagtggtgatgttaggcgcagggggagtgggcaagtctgcaatgacgatgcagtttattagccaccagtttccagattatcacgacccaaccatcgaggatgcgtacaagactcaagttcgcatcgataacgagcccgcttacttggatattctagacaccgctgggcaggccgaattcacagctatgcgggagcagtacatgaggggaggggagggcttcatcatctgttacagcgtcactgaccgccaatccttccaggaggcagccaaatttaaggagctaatcttccaagtgcgccacacatacgaaatcccgctagtcctcgtaggcaataaaatcgaccttgaacagtttagacaggtttcgaccgaggagggactgtcattggcccaggaatacaactgtggattcttcgagacctctgccgcactgcgcttctgtattgatgacgcctttcacggcctggtcagggagattagaaagaaggaatcaatgccttctctgatggagaagaagctgaagagaaaggactcactgtggaaaaagttaaagggcagcttaaagaaaaaacgggagaacatgacatag

SEQ ID NO: 53435 - DNA, 240 bp, Artificial Sequence
  Description of Artificial Sequence: Synthetic coding sequence
atgcccgtggccgttggcccatacggtcagagccagccctcctgttttgacagggtgaagatgggcttcgtaatgggttgtgccgtaggcatggctgccggagctctcttcggtacgttttcctgtctgaggatcggaatgcgaggaagagagctaatggggggaattggcaagacgatgatgcaaagcggcggtacttttggaacattcatggccatcggtatggggatccgctgttag

SEQ ID NO: 53436 - DNA, 240 bp, Artificial Sequence
  Description of Artificial Sequence: Synthetic coding sequence
atgccagtcgcagtgggcccttacggccagtcccaaccgtcttgttttgacagagtcaagatgggttttgtgatgggttgtgcagtcgggatggccgctggcgctttgttcggaacattcagttgcctgagaattggcatgcgaggaagagaacttatgggcggtattggtaagacaatgatgcagagcgggggaacattcggcacgttcatggccatcggtatggggatccgctgttag

SEQ ID NO: 53437 - DNA, 240 bp, Artificial Sequence
  Description of Artificial Sequence: Synthetic coding sequence
atgcccgtggccgtgggtccgtacggccagtctcagcccagctgcttcgatcgcgtgaaaatgggatttgtgatgggttgtgctgtcgggatggccgcaggcgcactctttggcacattttcctgtttaagaatcggcatgcgcggacgcgaactgatggggggtataggtaaaactatgatgcaatccggcggtacttttggtaccttcatggcaattgggatgggaattagatgttag

SEQ ID NO: 53438 - DNA, 240 bp, Artificial Sequence
  Description of Artificial Sequence: Synthetic coding sequence
atgcctgtggctgtgggtccatatggccaaagtcagccttcctgttttgacagagtgaaaatgggttttgtgatgggctgtgccgtcggcatggctgccggtgccctgtttggtactttctcttgtttgcgcattgggatgcgtggcagggagctgatggggggtataggtaagaccatgatgcaatccggcggtactttcggtaccttcatggcaatcgggatgggaatccgatgttag

SEQ ID NO: 53439 - DNA, 792 bp, Artificial Sequence
  Description of Artificial Sequence: Synthetic coding sequence
atgagaattttccgcccttggcgtctgcggtgtcccgctctgcatctcccgtctctaagcgtgttcagcctccgctggaaactgccttctctcacgacagatgaaacaatgtgtaaatctgttaccacagacgagtggaaaaaagtgttctacgagaaaatggaagaagccaaaccagcagactcttgggacctgatcatagatccaaaccttaagcacaatgttctctctccgggttggaaacagtaccttgagttacatgcgtccggcagattccattgtagctggtgttggcatacatggcagtctccctacgtggttatcctgtttcatatgttcctagatcgggcacagcgggctggatcggttcgcatgagggtttttaagcagctctgctatgaatgtgggacagccaggctcgacgagtcctctatgctggaggagaatattgagggcttggtcgataacttaattacgtccctgcgcgaacagtgttacggcgaaaggggagggcagtaccgtattcatgtggcatcacgccaggataatcggcgtcaccgcggagagttttgtgaagcatgccaagaggggatagttcactggaagccatccgaaaagctccttgaagaagaggctactacttacacatttagtcgagctccctctccaaccaagagccaagaccagacaggaagcggttggaatttctgcagcattccctggtgtttgttttgggcaaccgtcctactcctaattatataccttcaattctcttttcgttcatctgtgtag

SEQ ID NO: 53440 - DNA, 678 bp, Artificial Sequence
  Description of Artificial Sequence: Synthetic coding sequence
atgtgtacatcgctcactacctgtgagtggaagaaagttttttatgaaaaaatggaagtagccaaaccagcagactcctgggagctgatcatcgacccgaatctgaaaccgtcagaactcgctcccggatggaagcaatacctcgaacaacacgcatcaggacgtttccattgttcctggtgctggcacacctggcagagtgcacacgtggtgattctgttccatatgtttctggatcgggctcaacgggcagggagcgtgcgaatgcgcgtttttaaacaactgtgctacgaatgtggtaccgctcggctggacgagtcttccatgctcgaagaaaacatagaaggcctggtggataatctgatcacaagcctgcgcgagcagtgttatgaagaggacggcggacagtacaggattcacgtggctagccggcctgactccggaccccacagagcggaattttgtgaagcatgccaggagggcattgtacactggaagccttcggaaaaacttttggaggaggaggtgaccacatatactagtgaagcttctaaaccgagggcgcaggccggttcaggatataatttcctgtcacttcgctggtgtcttttttgggcaagcctttgcctcctagtggtgtatttgcaattttctttcctgtcacctgcatttttttag

SEQ ID NO: 53441 - DNA, 2016 bp, Artificial Sequence
  Description of Artificial Sequence: Synthetic coding sequence
atgcagcccgacatgagcctgaatgtgattaagatgaaatcctctgattttcttgagtctgcagagctcgacagcggcggttttggcaaggtgagtctttgtttccatcgtacacagggcctgatgatcatgaagactgtatacaagggcccaaattgcattgaacataacgaggcattacttgaggaggctaaaatgatgaatcggcttaggcacagccgtgttgtcaagctgctgggggttattatcgaagaaggaaaatactcactggttatggagtacatggaaaaagggaatcttatgcacgtgctaaaggcggagatgagtaccccccttagtgtgaaggggcgaataatcctggaaatcatcgagggaatgtgttatctgcacgggaaaggcgtgattcacaaagacctaaagcccgaaaacatcctagtggataacgatttccacattaagatcgccgatctggggctcgcatcatttaaaatgtggtctaaattaaacaatgaggagcacaacgaattgcgcgaagttgatggcacagccaagaagaacggagggaccctctattatatggcaccagagcacttgaatgacgtgaatgctaaacctactgaaaagagcgacgtatacagcttcgctgtcgtgctgtgggccatcttcgccaacaaggagccatatgaaaatgcgatctgcgaacagcagctcatcatgtgcattaagtcagggaacaggcctgacgtggatgatattacagagtattgtccaagggagattattagtctgatgaagttatgttgggaggcaaacccagaggcaaggccaactttccccggtattgaggaaaaattcaggcccttctatctaagccagctggaagaatctgtcgaggaagacgtgaaatcactgaagaaagagtattctaacgagaacgcagtggttaagaggatgcagtcactccagctcgactgcgtagccgtaccatcctccaggtccaatagtgccacggaacagccgggatctctccatagcagccagggcctggggatggggcctgtcgaagagtcctggttcgccccttctttagaacatcctcaggaggaaaacgagccgtcacttcagagtaagctgcaagatgaagctaactaccatctatacggatccaggatggacagacagacaaaacaacaaccccgacagaatgtcgcctacaatcgcgaggaagaaagaagaaggcgagtaagtcacgacccatttgctcaacaaaggccctacgagaacttccaaaacaccgagggcaagggtacagcatacagctctgcagctagccacggaaacgcagtccaccagccctctggactgacctctcaaccacaagtcctgtaccagaacaatggcctctattcttcgcacggctttggcacacggccactggatccaggcacagccggaccccgagtttggtacaggcccatccctagccacatgcccagcctacacaatattcccgtgcctgaaactaactaccttggcaatactcctactatgccattcagtagcctgccaccgaccgacgaaagcatcaagtacacaatctataactcaacaggcattcagatcggagcctacaattatatggagattgggggtacaagctcttctctgttggattctaccaacactaacttcaaggaggaacccgcagctaagtaccaggccatctttgacaatactaccagcctcacggacaagcatcttgatcctattagggagaatctgggcaaacattggaagaattgtgcccgaaaactggggttcacccagtcgcagatcgatgagatcgaccacgactacgaaagggacggattaaaggagaaggtgtaccagatgcttcagaaatgggtcatgagagagggcatcaagggagccaccgtcggcaagctggcgcaggctctgcatcagtgttcccgtattgacctgctgtccagcttgatctacgtcagccaaaattag

SEQ ID NO: 53442 - DNA, 2016 bp, Artificial Sequence
  Description of Artificial Sequence: Synthetic coding sequence
atgcaaccagacatgtctctgaatgtgatcaaaatgaagtcatcagatttcttggagtctgccgagcttgatagtggcggtttcggaaaggtatcactgtgcttccaccgaacccagggactcatgatcatgaaaacagtctataagggccctaactgcattgaacacaatgaggccctcctggaggaagcgaagatgatgaacaggctgcgccacagccgcgtggtgaagttgctgggagtgataatcgaggaaggaaaatatagtctggttatggaatatatggaaaaagggaacctgatgcacgtcctgaaggctgagatgagtactcctctgtctgtgaagggccgaattattcttgagataatcgaaggtatgtgttatcttcatggcaagggggtgatacataaggatttaaagcccgagaacatcctggtggataatgacttccacattaaaatcgccgacctcggattagcttctttcaagatgtggagcaagctgaacaacgaggagcacaacgaactgcgggaggtggacggtactgccaagaaaaatggcggaacactctactacatggccccagagcatctaaacgatgtcaatgcgaaaccaacggagaaatcagatgtgtacagcttcgcagtggtgctgtgggctatctttgcgaacaaagagccttatgaaaacgctatatgcgagcagcaactgatcatgtgcattaagtctggcaatcgccctgacgttgatgacataactgagtattgtcctcgggaaattatctcacttatgaaactgtgctgggaagcgaatccagaggctcggccaactttccccggaatcgaggaaaagtttcgacctttttatctctcccaattagaggaaagcgtcgaggaggacgtcaaaagcctcaagaaggagtatagtaacgaaaatgctgtggtaaagagaatgcagagcttgcaattggattgcgtcgccgtcccgtctagccgaagtaattccgccaccgagcagccaggcagtctccactcgtctcaaggcctaggaatgggtccagtggaggaatcctggttcgcaccatctctggaacatccacaggaggaaaatgaaccatccctgcaaagcaaactacaggacgaagccaattaccatctctatggctctagaatggatagacaaactaagcaacaaccacggcagaatgttgcctacaatcgggaggaagagagaagacggcgtgttagtcacgacccgtttgcccagcagaggccttacgaaaatttccagaataccgaaggaaaaggcactgcttactctagcgccgcatcccatggcaacgcggtccaccaaccctcagggctgacttcacagcctcaggtattatatcaaaataatgggctgtatagcagccacggcttcgggacccggcctctagaccccggaactgccggtcccagggtctggtatcggccaattccttcacacatgccctccctgcacaacattccagtgcccgagaccaattacctcggaaatacacctaccatgccattttcctctttaccacctacggacgagtcgattaaatacacgatctataattcaaccggaattcaaattggcgcttacaactacatggagatcgggggtacaagtagcagcctgctggatagcaccaatacaaattttaaagaggagccggctgccaaatatcaggccatctttgacaacaccaccagcctcaccgataagcacctggatccaattcgcgagaatcttggaaagcattggaagaactgtgctcgcaagctgggatttacacaatctcagatcgacgaaatcgatcatgactatgagcgcgacgggctgaaggagaaggtctaccagatgttacagaaatgggttatgagggagggtatcaagggggctacagtagggaagctcgcccaggcccttcaccagtgttcgagaattgacttactatcgtccttgatctatgtgtcgcagaactag

SEQ ID NO: 53443 - DNA, 822 bp, Artificial Sequence
  Description of Artificial Sequence: Synthetic coding sequence
atgtctcctgcatgccgggtcaatagtaaaactaaaccaaccaccatatttatggctgccgcttggacaggccgtcggaactcgagcccagatagaatgtggttgactacggaacgcaggaaaggggatgcaggatctcccatgacgctactccaccgcccttctggcctgactagccagccccaagtcttgtatcaaaataacgggctgtattcctcccatggatttggcacccggccactggatccaggtacagccggtcctagggtctggtataggccgatccccagtcatatgccgtctttgcacaatatacccgtcccagagacaaattaccttggaaacactcctaccatgccattctctagtttgcctcctacagacgagtccattaaatacacgatttataatagcacaggtatccaaattggcgcttacaattacatggaaatcgggggaactagtagctctctgctggattcaaccaacacaaactttaaagaggagcccgcagccaaataccaggcaatattcgacaacaccaccagccttacggataaacacctcgacccaataagggaaaatttaggaaagcattggaaaaactgtgccaggaaactgggctttactcaatcccagattgatgagattgaccacgactatgagagggacgggctgaaggaaaaagtttaccagatgcttcagaaatgggtgatgagagaagggataaagggcgctaccgtgggaaaattggcccaggccctgcatcaatgttcaaggattgatctgctgagctccttgatttacgtgtcgcagaattag

SEQ ID NO: 53444 - DNA, 1878 bp, Artificial Sequence
  Description of Artificial Sequence: Synthetic coding sequence
atgcagccagacatgtccttgaacgtgattaaaatgaagagcagcgactttctagagagtgccgaactcgacagtgggggattcgggaaagtgtccctgtgctttcaccgcactcaggggctgatgatcatgaagacagtctacaaggggcctaactgtatcgagcataatgaggcgctcttagaagaagcaaaaatgatgaaccggctcaggcactcgagggtggtaaagctgttaggcgtaattatcgaggaagggaaatattctcttgtaatggagtatatggagaaggggaatctaatgcacgtattaaaagcagaaatcgccgatctgggccttgcgagcttcaaaatgtggagtaagctgaataacgaagagcataatgagctgcgggaggtggacggaactgcaaaaaagaacggcggtacactgtattacatggctcctgaacacctgaatgatgtgaatgctaaacccacagaaaagtccgacgtgtactcctttgccgtggtcctgtgggccatttttgccaacaaggaaccctacgagaacgccatatgcgaacagcaactgattatgtgtattaaatccggcaatcgaccggacgtggacgacatcaccgagtactgcccacgtgagatcatcagcctgatgaaattatgctgggaggcgaacccagaggcgaggcctactttccccggtatcgaggaaaagttccgcccattttatctgagtcaattggaggagtctgtcgaggaggacgtgaagtcactgaagaaagaatactcgaacgagaatgcagttgtgaaacgaatgcagagcttgcagctggactgcgtggcagtccccagcagcagatccaacagcgctacagaacagcccggatctctacactcctcacaagggttggggatgggcccagtcgaggaaagttggtttgcccctagcctggagcacccgcaggaggagaacgagccatctctccagagcaagttgcaagacgaggccaactatcacctctacggcagtcgaatggacagacagacaaagcagcagcctcgccagaatgtggcctataacagggaagaagaaaggcggcgaagggttagccacgatcccttcgcccagcaacgaccgtacgaaaacttccagaacacagagggaaagggcacggcatactcttcagctgcaagtcacggcaatgcagtgcaccagccctccgggcttacttcccagcctcaggtgctgtatcagaacaatgggctttatagcagtcatggtttcggcacaaggccattagatcccggaaccgctggacccagagtgtggtacagaccaattccatctcatatgccctcgctccacaatatacccgttccggagacgaattacctaggcaatactccaaccatgccttttagctcacttccccctaccgatgagagtattaagtacaccatctacaacagtactggcatccagatcggggcatataactacatggagattggtggcacctcttccagcttactcgacagcaccaatactaattttaaggaggaacctgcagccaagtaccaagcgatcttcgacaacacaactagcctaaccgataaacatctggaccccatacgtgagaacctgggaaagcactggaaaaattgtgctcggaaattaggtttcacacagtctcagattgatgagattgatcacgactacgaaagggacggattgaaagagaaggtctaccaaatgcttcaaaaatgggtcatgagagagggaattaagggtgccacagtcgggaaactcgcacaggccttgcaccagtgcagcagaatcgatttactttcaagcctgatctatgtgtctcagaactag

SEQ ID NO: 53445 - DNA, 522 bp, Artificial Sequence
  Description of Artificial Sequence: Synthetic coding sequence
atgcagtcagagttgtgtttcgcggacatacacgatagcgacggcagcagttcctctagtcaccagtccttaaaaagcaccgcaaaatgggctgccagtctcgaaaatttactagaggatcccgaaggtgtcaagaggtttcgagaattcttgaaaaaagagttcagtgaagagaacgtccttttctggttggcttgtgaggacttcaaaaagatgcaggacaaaacccaaatgcaagaaaaagccaaagagatttacatgacgttcctgagttcgaaagcttctagtcaggttaacgtggagggccagtcacggcttaatgagaagattctggaagaacctcatccccttatgttccagaaattacaggatcaaatcttcaacctcatgaagtatgactcgtacagccggttccttaagagcgacctgttcctcaagcacaagcgcactgaagaggaagaagaagacctgcccgatgcccagacagccgcaaagcgtgcttcccgtatatacaacacctag

SEQ ID NO: 53446 - DNA, 546 bp, Artificial Sequence
  Description of Artificial Sequence: Synthetic coding sequence
atgtttaatcgtgcggtgtcccgactcagtcgcaaacgtcccccatctgatatccacgactctgatggtagttcctcgtccagccaccagagcctgaaatcaaccgctaaatgggcagccagtctggagaacttattagaggatcctgaaggcgtcaagcgctttagggagttcctgaagaaggagttttccgaagaaaacgttctcttttggctagcctgtgaagatttcaaaaaaatgcaggataagacacagatgcaagagaaagccaaggagatctatatgaccttcctgtcaagcaaggctagttctcaggtgaatgtagaaggccagtctaggctgaacgaaaagattctggaggagccacatccgctcatgtttcagaagcttcaggatcaaatttttaatctcatgaaatatgattcctacagcaggtttctgaaaagcgatctttttttgaaacataaacgtaccgaggaggaagaggaggacctccccgacgctcagacagcagccaaacgagcttctcggatctacaatacctag

SEQ ID NO: 53447 - DNA, 504 bp, Artificial Sequence
  Description of Artificial Sequence: Synthetic coding sequence
atggagcacattcatgactcagatgggagcagctctagtagccatcagagcctcaaatccacagctaaatgggccgcttcacttgaaaatctgctggaagatcccgagggggtgaaacgcttcagggaattcttgaagaaggagttttccgaggagaatgtcctgttttggcttgcctgcgaggatttcaagaagatgcaagacaaaactcagatgcaggagaaagccaaagaaatatatatgaccttcctgagctctaaagcctctagccaggtgaacgttgaaggccagtcccgattaaacgaaaagattctcgaggaaccacatccacttatgtttcagaagctgcaagatcagatctttaatctgatgaagtatgatagctatagcagattcctcaagtccgacctgttcttgaaacacaagagaacagaagaagaggaagaagacttgcccgatgcgcagaccgcagctaagcgagcatcaaggatttacaacacctag

SEQ ID NO: 53448 - DNA, 1341 bp, Artificial Sequence
  Description of Artificial Sequence: Synthetic coding sequence
atggagagggtcgtagtctcaatgcaggatccagaccaaggagtgaagatgcgcagccagcgcctgctggtaacagttattcctcacgcggttaccggcagtgatgtggtgcagtggctcgcccagaaattctgcgtatccgaggaggaagctctgcaccttggagcggtgctggtgcagcacggatacatctatcccctgcgcgatccaaggtccttaatgctgcggcctgacgaaacaccgtatcggtttcagactccctatttttggacatcgaccctcaggcctgcggcagaactagattacgccatctacctggccaagaagaacattcgcaaacggggaactctggtggactacgaaaaggactgctacgatcgtctgcacaaaaaaataaatcacgcttgggatctggtgcttatgcaggcgagagagcaactgcgggcagccaagcaaaggtcaaagggagacaggctggtcattgcctgtcaggagcaaacttactggctggtcaatagaccacctcccggagctcccgatgtcctcgaacagggacctggcaggggatcttgtgctgcgtcaagggtgctgatgactaagagcgctgattttcataagagagaaatcgagtacttccgaaaagccctcggacggacccgggtgaagtcctcagtgtgcctcgaggcatatttgagcttctgtggccaacgcggaccccacgacccactggttagtggctgtttgccgtctaacccctggattagcgacaacgatgcttattgggtaatgaatgcacccacagttgccgcacccaccaagctcagagttgaaagatgggggttctcctttagggagctgctggaagaccccgtgggtagggctcattttatggacttcctgggaaaggaattcagcggagagaatctgtcattctgggaagcctgcgaggaacttcgctacggggctcaggcacaggtccccacgctggtagacgccgtttacgagcagtttctggccccaggcgcagctcattgggtgaacattgattcccgcaccatggaacagacgctggagggactgaggcagccacatagatacgtgctggatgacgcccagcttcacatctacatgctaatgaagaaggattcgtatcccaggtttctgaagtctgacatgtacaaagccctgttagctgaggccggaattccactcgagatgaaacgcagggtttttcctttcacctggagacctaggcatagtagtcccagcccagcgcttctccccacacctgtggagcccaccgcagcttgcggccctggtgggggagacggtgtcgcttag

SEQ ID NO: 53449 - DNA, 786 bp, Artificial Sequence
  Description of Artificial Sequence: Synthetic coding sequence
atggcagcaggacccgctcccccacctggaaggcctcgggcacaaatgcctcacttgcgcaaaatggaacgtgtggtcgtctctatgcaggaccctgaccagggcgtgaagatgcgctcccagcggctactggtgactgtgattccacacgccgtgactggaagtgatgtcgttcagtggctggctcaaaagttctgcgtttcagaggaggaggcattacacctaggcgcagtattggtgcaacatggctatatctaccctctgcgggaccccagatctctcatgttgaggcccgacgaaaccccttacagattccagaccccctacttctggacaagcactctccgccctgcagctgaactggactacgccatatatctcgcaaagaaaaatatcaggaagcggggaacacttgtggattacgaaaaggactgttatgaccgcctacataagaaaatcaatcacgcctgggacctggtgctgatgcaggctagggagcagctgagagccgctaagcagagatctaagggcgaccggcttgtgattgcttgccaggaacagacctattggctggtcaacaggccaccgcctggtgctcccgatgtcctggaacagggcccaggccgtgggagttgcgctgcctcgcgggtgctgatggtagaggcctccaggacgagaggaacacggccagaaggagcatcagagcccagaagcagtaagaccctctgttctaatcaatcccatccggaccccacctcaggaaagatgcaccttgaaccccattag

SEQ ID NO: 53450 - DNA, 1404 bp, Artificial Sequence
  Description of Artificial Sequence: Synthetic coding sequence
atggcagcaggacctgctccccctcccggtaggcctagggcacagatgccccatctacggaagatggaacgggtggtcgtctctatgcaagatccagatcagggggttaaaatgcgatcccagagactgctggtcacagtaattcctcacgccgtgacaggaagtgatgtcgttcagtggttagcccagaagttttgtgtgagtgaggaggaggctctgcacttgggagcagttctcgtgcaacacgggtatatatacccgctgcgagatcccagaagtctgatgcttcggcctgatgagacaccctatcggttccaaaccccatatttttggacatcaacacttcggccagccgcagaacttgactacgccatctacctggctaagaaaaacatccgcaagagaggaactctggtcgattacgagaaagactgctacgatagactccataaaaaaataaatcatgcctgggatcttgtgctgatgcaggctagagagcagctgagagccgcaaaacagcggtccaagggagatcgcctggtaatcgcctgccaggagcaaacttattggctcgtgaaccgaccaccacccggtgcccctgatgtcctcgagcaaggaccaggacgcggatcctgcgcggctagccgggtgctgatgacaaaatcggcagattttcacaaacgcgaaatcgaatatttccggaaagcgctggggaggacacgcgttaagtcaagcgtgtgcctcgaggcttaccttagtttttgcggtcagaggggacctcatgacccactggtgagcggatgcttgccctcaaatccctggattagcgacaacgatgcatactgggtcatgaacgcaccgacggtggccgctcctactaaactccgggtggaaaggtggggtttctcattccgggagctcctcgaggacccagtcggtcgggctcatttcatggatttcttgggaaaggaattttccggggagaatctgagcttctgggaggcatgtgaagagctgagatacggagctcaggcccaggtgccaacactggtcgatgctgtctacgaacagtttctggctcccggagccgctcactgggtaaatatcgactccaggacaatggaacagacacttgagggccttagacagccacatcgttacgttctcgacgacgcccagctgcacatatacatgttgatgaagaaagactcgtaccctcgctttctgaagagtgatatgtataaggctctgctggccgaggccggaattcccctagagatgaagcggcgtgtatttccttttacctggagacctagacactcgtctccctcccctgccttgctacctacccccgtggagccaactgcggcatgcggaccaggcggtggagacggagtagcatag

SEQ ID NO: 53451 - DNA, 405 bp, Artificial Sequence
  Description of Artificial Sequence: Synthetic coding sequence
atggccacaagcactcgctgtgcgacgcctgtggcctcatgctccgggcaaacacgtcggcctactggttcccgctcagggagtggagtgcaggtcggggctggtggaactccaaccccaacccacccagcttatcagctgggtgaaaccggaggcgctccttctttgttaggtttagaatgggactcagctatgtctccctgggcaggtggcccttcaccgcctcctcagaaatcatggactgcctctacagacgttgttcgcaggacaagactgcgagacggagccagtgtgtttcttggaaccaccgccggaccacacaaggggtcctatgtccaacggattctgcctagttcatggggttcccttgggccaggacccgagggaggcgctgtaaaggcctag

SEQ ID NO: 53452 - DNA, 480 bp, Artificial Sequence
  Description of Artificial Sequence: Synthetic coding sequence
atgtctcggaggaattgttggatctgcaagatgtgtcgggatgaatccaagaggcctccctccaacctaaccctggaggaagtgctgcagtgggcccaaagcttcgagaatcttatggccaccaagtacggcccagtagtgtatgcagcctacctcaaaatggaacattcagacgagaacatccagttttggatggcatgtgaaacctataagaaaatcgcttccagatggtcacggatttctcgcgcaaagaaactatataaaatctacatccagcctcagtctccgagggagatcaatattgatagcagcacacgggagaccatcatcaggaacatccaggagcccacggagacatgcttcgaagaggcccaaaagatagtttacatgcacatggaacgagattcttacccaagattcctcaagtctgagatgtatcagaagctgttaaagacaatgcagtcaaataactccttttag

SEQ ID NO: 53453 - DNA, 480 bp, Artificial Sequence
  Description of Artificial Sequence: Synthetic coding sequence
atgtcccgacggaactgctggatctgcaaaatgtgtcgcgacgaatcaaagcgccctccatcaaatctaacactggaagaggtgttacagtgggcccagtctttcgaaaatctgatggcaaccaagtacggcccagtggtttatgcagcatatttaaagatggaacactcagatgaaaatatccagttctggatggcttgtgagacctataaaaaaatagcatcaaggtggtctcgaatcagtcgggcaaagaaactttacaaaatctatattcagccccagtctcccagagaaattaatatcgattcctctacgcgtgaaaccattattaggaacatacaagaacccaccgaaacgtgttttgaggaagcacagaagatcgtctacatgcatatggaaagagatagttatccgcgattcctaaagtccgaaatgtaccaaaaattgctgaagacaatgcagtccaacaactctttctag

SEQ ID NO: 53454 - DNA, 1788 bp, Artificial Sequence
  Description of Artificial Sequence: Synthetic coding sequence
atgacgatgacgcttcatactaaggcgagcggcatggccttactgcaccagatacaggggaatgagttggaacccctgaaccgccctcaactgaagattcctctcgagcgcccattaggcgaggtctacctcgacagttccaaaccggcagtctataattaccccgagggagctgcctacgagttcaacgcggctgccgctgccaatgcccaagtttacggacagacggggctgccttacgggccaggctcggaggcagccgcttttggaagtaatggattaggtggctttcccccattaaactccgtgtctcccagccctcttatgctactgcacccacctcctcaactgtccccgtttctgcagcctcatggccagcaggtcccttactatttggaaaatgagccctccggttataccgtgcgagaagcgggaccgcctgcattctacagacccaactctgataaccggagacagggcggtcgggaaagacttgcgtcaactaacgacaaaggtagcatggcaatggagagcgctaaagagacccgctattgcgcagtgtgtaacgactacgccagcggctaccattatggcgtgtggtcttgtgagggctgcaaagccttcttcaagcgatccattcagggtcacaacgactatatgtgtcctgcgactaaccaatgcaccattgacaagaatcgcagaaagagttgtcaggcctgcagattgagaaagtgctatgaggtcggcatgatgaaagggggtatacgaaaagaccgaaggggcggtcgaatgctaaagcacaaacgccaaagagacgacggggagggtagaggagaggtaggttctgccggtgacatgcgcgcagcaaacctgtggccttcgcctctgatgataaagcgctctaaaaaaaattcgttggctctaagcctgacagccgaccagatggtgtccgcactgctggacgccgaaccccctatcctgtacagcgagtatgatcccacaaggcctttctcagaagcatccatgatgggacttttaactaatctcgctgaccgggaattggttcacatgataaattgggcaaaacgcgtgccaggatttgtagaccttaccctgcacgatcaggtgcacctgctcgagtgcgcgtggctggagatcctgatgattgggctggtctggcgtagcatggaacaccccggaaagctgctttttgccccaaacctcttgctggataggaatcagggcaagtgtgtagaagggatggtcgagattttcgacatgctcctggctacctctagtcggtttaggatgatgaacctgcagggggaagagtttgtctgcctcaaatccatcattctactgaattccggcgtctacacctttctgagctctactcttaaatccttggaagaaaaagaccacatacaccgcgtgctggacaaaattacagacacactgattcatctcatggctaaagccggacttacactccaacaacagcatcaacgtctggcccagctgctgctgatcctctcacatatccggcacatgtccaacaagggaatggaacacctgtacagcatgaagtgtaagaatgtcgtcccactatatgaccttctcttagagatgctcgacgcacatcggctccatgcgcctaccagccgtgggggtgcgagcgtggaggagactgaccagtcacatctcgccacagctggcagtacttcgagccacagcttgcagaagtactacattactggtgaagccgaaggatttccggctaccgtatag

SEQ ID NO: 53455 - DNA, 633 bp, Artificial Sequence
  Description of Artificial Sequence: Synthetic coding sequence
atgagaaagcggcagcaatctcaaaatgagggtaccccagccgtgtcccaagctcccggaaaccagcggccaaataatacttgttgcttctgttggtgctgctgctgcagctgttcttgcctaaccgtccgcaatgaggagcgcggagagaatgccggaagacctacacacaccaccaaaatggagtctatccaggtccttgaggagtgtcaaaacccaacagcagaggaggtactgtcttggtcccagaatttcgacaagatgatgaaggcaccagccggtagaaatctgtttcgagagtttctccggactgagtattctgaagaaaacctgttgttctggctagcatgcgaggacttaaagaaagaacagaataaaaaggttatcgaagaaaaggcaagaatgatttatgaggattatatctcaatcctgtctcctaaagaagtgagtttggactctcgggtccgagaagtcattaacaggaacttactggacccaaacccacacatgtacgaagatgcgcaactgcaaatttatacgctcatgcatagggactcgtttccgagatttcttaactctcaaatatataaatcgtttgttgaaagcaccgctggtagcagctccgaatcatag

SEQ ID NO: 53456 - DNA, 708 bp, Artificial Sequence
  Description of Artificial Sequence: Synthetic coding sequence
atggagaccacactcctattcttcagccagatcaacatgtgtgagtccaaggaaaaaacattcttcaagttaattcacggaagcggtaaggaagagacaagtaaggaagccaaaatcagggctaaagagaagcgcaaccgtctgtctctgttagttcaaaagcccgaatttcacgaagatacccggagcagtcggtcgggtcacctggcaaaggaaaccagagtgagccctgaggaagccgtcaagtggggcgagtcctttgataagctactgtcccacagagacggattagaagccttcacacgattcctgaagaccgaattctctgaagagaacatcgagttttggattgcttgcgaagacttcaaaaagagtaaagggccacagcagatccacctgaaggctaaggcaatctatgagaagttcattcagacagacgccccaaaggaggtgaaccttgatttccacaccaaggaagtcattaccaacagtatcacacaacccacactgcactctttcgacgcagcccaaagcagggtttaccagttgatggagcaggatagctacacccggttcttgaaatctgacatttatctggacttgatggagggtagaccacaaaggcccacgaacctgaggaggcgctcccgctcgttcacctgtaacgaatttcaggatgtgcagagcgacgtggccatatggctctag

SEQ ID NO: 53457 - DNA, 654 bp, Artificial Sequence
  Description of Artificial Sequence: Synthetic coding sequence
atgccgacgccccacgaagccgagaaacagatcaccggacctgaagaagccgatcgtcccccaagcatgagttcacatgacacagcgtccccagcggctcccagtcggaatccctgttgcctatgttggtgctgttgttgctcctgtagctggaaccaggagagacgccgtgcctggcaggcatctagagaaagtaagctccaacctctgccaagttgtgaagtgtgtgctacaccaagtccagaggaggttcagagttgggcccagtcttttgataagttaatgcatagtcctgccggacggtcagtgtttcgcgcttttttgagaacggagtatagcgaggagaacatgttgttttggctggcttgtgaggagttaaaagccgaagcaaatcagcacgtggtggacgagaaggccagactgatttatgaggactacgtttctatcttgtctcctaaggaagtgtccctggacagcagagtgcgagaaggcatcaataaaaaaatgcaagagccttccgcccatacgtttgatgacgctcagcttcaaatctacacgctcatgcaccgcgactcatacccacggtttctgtctagccccacatatcgggcacttttgttgcagggaccatcccaaagctcgagcgaggcatag

SEQ ID NO: 53458 - DNA, 654 bp, Artificial Sequence
  Description of Artificial Sequence: Synthetic coding sequence
atgcccacaccacacgaggctgagaaacagataacaggaccagaagaggcagatcgtcccccatcaatgtctagccatgataccgcatcacctgcagctccatctcggaacccttgttgcttgtgttggtgctgttgttgtagctgctcctggaaccaggagcgtagacgggcatggcaagcctccagagaatccaaactccagcctttgccctcttgtgaagtttgtgccacaccaagcccggaggaggtgcagtcctgggctcagagcttcgacaaactgatgcattcccccgctggtcggagcgtgtttcgcgcttttctgagaacagaatatagcgaagagaatatgctgttctggctggcctgcgaggaactgaaagctgaggctaaccagcacgtagtggacgaaaaggccaggctcatctacgaagactacgtcagcatcctctctccaaaggaagttagccttgactccagagttagggagggaatcaataagaagatgcaggagccctctgcacacactttcgatgacgctcagctacagatttatacactcatgcatagggactcataccccaggtttctgagctctcctacctaccgtgcactcctgttacagggtccgtctcaatcctcatctgaggcatag

SEQ ID NO: 53459 - DNA, 726 bp, Artificial Sequence
  Description of Artificial Sequence: Synthetic coding sequence
atgcgaactgctgatggaggagagccagctggcgcttcttcccccgcaggtcgcgtggatggaggcctacagatggggtctgaacgcatggagatgcggaagaggcagatgcccgcagcgcaggatacacctggggcagcccctggccaaccaggggcaggctctaggggaagcaacgcatgttgcttctgttggtgctgttgctgctcctgctcatgcttgaccgtcagaaaccaggaagaccaacgtcctaccattgcatcccacgagcttcgcgcagatctgcctacctgggaggagtcccccgctcctacgttggaagaggtgaatgcttgggcccagtccttcgacaaacttatggtcacccccgctggaaggaacgcctttagggaattcttgcggaccgagttttccgaggaaaatatgcttttttggatggcttgtgaggagctgaagaaggaagcaaataagaatatcatagaggagaaggctcgcataatctacgaggactatatctccatcttaagtcccaaagaggtttccctggatagccgcgtccgagaagtgataaataggaacatggtcgagccatcccagcacattttcgacgacgcacaacttcagatctacacgctgatgcatagggactcctacccaagatttatgaattccgccgtgtacaaggatctgctacagagcctgagcgaaaagagtatcgaggcctag

SEQ ID NO: 53460 - DNA, 1167 bp, Artificial Sequence
  Description of Artificial Sequence: Synthetic coding sequence
atgccccagttgagtcaggataatcaggaatgtttgcagaagcacttctccaggccttcaatctggacccagttcctgccgctgttcagagcgcaacgctataataccgacattcaccagatcacggagaatgaaggagacctgagagcagtgcccgacattaaaagtttcccaccggctcagttgcccgatagtccagcggctcccaaactgtttggtctcctctccagtcctttatctagccttgctcgttttttcagtcacctgctgcgccgaccccctcccgaggcaccaagacgccgacttgattttagtcccctactccctgcacttccagctgctcgcctgtccagaggccacgaagaactgccaggacgcctgagtctattgttaggggcagcgttggccctacccggtagacccagtgggggtagacctttacgcccacctcaccccgtagccaagccaagggaagaggacgccaccgcgggacaatcaagccctatgccgcagatgggctccgaaagaatggagatgcgaaagcggcaaatgccggcagcccaggacacacctggagcagccccaggccaaccaggggcaggaagccgtgggagcaacgcttgctgtttttgctggtgctgctgttgttcttgtagctgtctaaccgtaaggaaccaggaggatcagaggcccacgatcgcaagtcacgaacttcgagccgacttgcctacctgggaagaatcccccgcacctacactggaggaggtgaatgcctgggcacaaagctttgacaagctaatggtaaccccggctgggagaaacgcattccgcgagtttctccgaacagagttcagcgaggaaaatatgctgttttggatggcctgcgaggagctgaaaaaggaggccaacaaaaacatcatcgaggagaaggcccgaataatatacgaagattacatatcaattctctctccaaaggaggtgtcactggactcaagggtccgcgaggtgattaaccgaaatatggtggaaccctcacagcatatattcgacgacgctcaactgcagatatacacactaatgcacagggactcatacccccgatttatgaattccgctgtgtacaaggatcttctgcagtcactttccgagaagagcatcgaggcgtag

SEQ ID NO: 53461 - DNA, 3795 bp, Artificial Sequence
  Description of Artificial Sequence: Synthetic coding sequence
atgcccgagaaacgcttaaccgcagaacccccaacaatcaccgaggaagaattcgaggactctctggctactgatgattttctagtggactacttcaatgaattcttatccctacctacattttcagaagccattaggtttaatgcagactatggggtcttcgaggtggccaacgatgcgcctcagttcctagaaaagcagttgaaaaaaatacttcaaaatcagcagccaagaaaccctatctatgatgtggtcagaaagggaaaaaacgaggtcaagcctgtgcaaatgaatgctcctgacgaggacgaaacaattaacgtaaactataatatcatgtgtctgagcagggaagagggcataaagtggattaaaaaagaaagactaccagccttcctggagagtgattgctacttcgagtatcgactggccaagctcgtgtctcaagtgcgttggagtaagtctggcatgaactttactgtgggtagcaatttcagtccttggattgtgaagaagccaccttctctcccacccccagccaccgaggaggataacctggtgatcatgaaaaagttctacgtgagcttgggagaggccagctacactcagaccaaggattggtttgccctcgcgaaacagtcacaacagacagtcagcacattcagtttaccctgttgtgtgccgtacaacaagctcaagagccctgctataagctccgtgagcgaaaattttattttcgatgacggtgtccaccccagaacaaagaaagatccgtctaagaccaacaaactcatttcggagtttgaggaggaggagggcgaggaagaggaggtatccgtgtccctgcaggacactccctctcaggcacttttgcgggtgtatttagagaaaaagcaggacgtcgatgaatccctcacgatgcactttagcacgtgcgaagagttcctttctagctatatctactttatattgaggggcgctatccagcagattgttgggaaacccgttggagagactccagactacatcaactttaacaatattacgaaggtgtccttcgatgattgtttcgagagtatccacggcaagaacttcctctctgaacttgtccagactaccaaggagcggtcagaagaaatcgagcagacaagcctgtcctccaaaaatgagtccgctggacctgagagccgtgccgactggtgcattagccacagaacatacgacatcgggaataggaaggagttcgaaaggttcaagaagtttatcaagggaaccctgggcgagcggtactggtggctgtggatggatattgaacggctgaaggtactcaaggacccgggtagacatcagcggcatctggaaaagatgaaaaagtgttacctggtgtccaacggggattattatctcagtgcagagatactgtccaagttcaaactgctcgacggcagccagtggaacgaggagcacctgaggaacattcagtcggaagtgctgaagccgctcctcctctactgggctcccagattttgtgtgacacattcagcatctaccaagtatgcctccgccgagctcaagttctggcatctgcgccaggcgaaaccacgaaaggacatcgatccatttccccagatggcaacgttactgcctctgcggccaaagagttgtatccctcagatccctgagattcagaaggaagagttctccttgagtcagccgcctaagtcacccaacaaatccccagaggtgaaaaccgccacacagaagccctggaagcgtgagctgctgtatcctggctcatcaaaggatgacgtgatcgagaaaggctccaagtacatgagtgaatcatcgaaagtcattcatctcacgtctttcactgatatctccgagtgcctgaagccccagctggataggcggtacgcctacacagaggagccgagagtcaaaaccgttagcgatgtcggtgccctgggcggatcagatatggaaaacctcctgcagagcctatatgtggaaaacagagcgggattctttttcacgaaattctgtgaacatagcggcaataaattgtggaagaactctgtctacttctggtttgacctgcaagcatatcatcaacttttctatcaagagactttacagccatttaaggtctgcaagcaagcacagtacctgttcgctacttacgtggccccttctgccaccttagatatcggcctgcagcaggagaaaaagaaagagatttacatgaaaattcaaccccctttcgaagatttattcgatactgcggaggaatatatactccttctcctgctggagccctggacgaaaatggtgaagtcagaccaaattgcctataagaaagtcgagctggtggaggagaccaggcagctagactctacctatttcagaaaattacaagccctccacaaggagaccttttcgaaaaaggcggaggatactacctgtgaaataggcaccggcattttgtctctttccaatgtgagcaagaggacggagtactgggacaatgtcccggctgagtataaacatttcaagtttagtgatctcctgaacaataaattagagttcgaacactttcgtcagttcttggaaacccacagctcttcaatggacttgatgtgctggacggacattgaacagttccgtcggatcacttacagagaccggaatcagcgcaaggcaaaatccatatatataaagaataagtaccttaacaaaaagtacttttttggccctaacagcccagcatctctctatcagcagaaccaggtgatgcatctgtccgggggatggggtaaaatacttcacgaacagctggacgctcccgtgctcgtggaaattcagaaacacgtccaaaatcgcttggaaaatgtgtggctccccctcttcctggcctccgagcaatttgctgctaggcaaaaaataaaggtccagatgaaagatatcgccgaggagctcctactgcagaaagccgagaagaagatcggagtatggaagcccgtcgaatctaagtggatcagttcaagttgtaagataatcgctttccggaaagcactgttgaaccctgttacaagtaggcagtttcagcgtttcgtggccttgaagggcgatctcctggaaaatggattacttttttggcaggaggttcagaagtataaggatttgtgccattcccattgtgacgagtcagttatacagaagaagattacaacaattatcaactgcttcatcaactctagtattcctccagccctacagatcgacatccccgttgagcaggcacaaaagatcattgaacacagaaaggagctaggcccatacgtgtttcgcgaagctcaaatgacaatattcggcgtcctgtttaagttctggccacagttttgtgagttccgaaaaaatctgaccgacgagaacataatgtcagtgctggaacgtcgccaagagtacaataagcaaaagaagaaacttgccgtcttggaagatgagaagagcggcaaagatggcattaagcagtacgccaatacttctgtgccagcgataaaaaccgccctgttatcggatagcttcctcggtttgcagccctatggtaggcagcccacctggtgctatagtaagtatatcgaagctttggagcaagaacggattcttttgaagattcaggaagaattagagaagaagctctttgctggattacagcctttaacgaacttcaaagcgagcagttccacaatgagcctgaagaagaacatgtccgcacactcgtcccagaaatag

SEQ ID NO: 53462 - DNA, 3756 bp, Artificial Sequence
  Description of Artificial Sequence: Synthetic coding sequence
atgcccgaaaagcgcctgaccgccgaaccccctaccattacagaggaggagttcgaggactcactggcaacagatgactttcttgtggactattttaatgagttccttagcctccctactttcagcgaggctatacgattcaacgcggattacggcgtatttgaggttgccaacgacgctccccagtttctggaaaagcagttaaagaaaattcttcagaaccagcagcctagaaatcccatctacgacgtggttcgcaagggcaaaaatgaggtgaagccggttcaaatgaacgcgccagacgaggacgagacaatcaacgtcaactacaatataatgtgcctaagtagggaggagggcatcaagtggatcaagaaagagcggttgcctgctttcctcgaatccgactgctattttgaatatcgactggctaagctcgtaagccaggtgcggtggtccaagtctggcatgaacttcacagttggcagtaatttctctccctggatcgttaaaaaaccgccttccttacctcctcctgcaaccgaagaggataaccttgctagctatacacagaccaaggactggttcgccctggctaagcagtcacagcagaccgtcagcactttttcgctcccatgttgtgttccctacaataaattgaagagtccagctatctcatctgtcagcgaaaactttattttcgatgacggagttcaccctaggaccaagaaggatcccagcaagactaacaagttaatctcggagttcgaggaagaggagggggaagaggaagaagtgtctgtttcgttgcaggacacaccttcgcaggctctactcagggtttacttggagaaaaagcaggacgtggatgagtctttgactatgcacttttctacatgcgaggaattcctgagttcatatatatacttcatcttgagaggtgcgatccaacagattgtgggcaaacccgtgggggagacgcctgactatattaatttcaacaatataactaaagtctcttttgacgattgttttgaatccatccacggaaagaattttctctccgagcttgtgcaaacaacaaaagaaagaagcgaggagattgagcagacctcactgagcagcaagaacgaaagtgctggccctgagtcccgcgctgactggtgtatatctcaccgcacctacgacatcggaaatcgtaaagagtttgaacggtttaagaagttcatcaagggaacgctgggggaaaggtactggtggttgtggatggacatcgagaggctgaaggtcctcaaagaccctggaaggcaccagaggcacctcgagaaaatgaaaaaatgttatttggtgtctaacggggactactacctgtctgccgagatcctgtctaagttcaagttgctcgatgggtcccaatggaatgaagagcaccttcggaacatacagtctgaggtgcttaaacctctcctgctatactgggccccacggttctgcgtcacccattctgcctcaactaagtacgcctctgccgagcttaagttttggcacctcagacaagcaaagccccgaaaggatattgacccattcccacagatggctacgctgctgccactgaggccgaagtcttgtattccacaaatccccgaaatccagaaggaggaattctccctcagccagcccccaaaatcccctaacaaaagtcctgaagtgaagactgctactcaaaaaccctggaaaagagaactgctgtatcctggttcctctaaggacgacgtcatcgagaagggcagcaagtatatgagcgagtccagcaaagtaattcacctgacttcttttacagacatttcagaatgtctcaagccgcagctggaccgcagatacgcctataccgaggagcctcgagtgaaaacagtttccgatgtgggggcacttggcggaagtgatatggaaaacctgctgcagtccctttatgttgagaatcgagcaggattcttctttacaaagttttgtgagcatagcggcaacaaactatggaagaatagcgtgtacttctggttcgacctccaggcttaccatcagttattttaccaggagaccctccagcccttcaaggtttgtaaacaagctcagtacctgttcgcaacttatgttgccccttcagctacactggacattggccttcagcaagaaaagaagaaagaaatttacatgaaaatacagccccctttcgaggacttgttcgatacggcggaagagtacatcctcttactgctcctggaaccttggaccaagatggtaaagagcgatcagatagcgtataagaaggtggaacttgtggaggaaactcgccaattagattctacatacttcaggaagcttcaggccctgcataaagagacgttttctaagaaggcggaagataccacttgcgagataggcaccggcatcctgtcgttgtctaacgtcagcaagagaaccgagtattgggacaacgtgccagctgaatacaagcacttcaaattctccgacctcctgaataataagctggaattcgaacactttaggcagttccttgaaacacattctagtcggtggattctttgtgcgggacagacgctgagctctagcggggaaacttatcgcgataggaaccagcgtaaggccaaaagcatttatataaagaacaaatatttgaacaagaaatattttttcggcccaaacagccctgcatcgctctaccagcaaaatcaggttatgcatttgtcggggggttggggaaagatattgcatgaacagctggacgctccggtgttggtagagatacagaagcacgtacagaaccgtctggaaaacgtctggcttcctctctttctagcgagcgagcaattcgccgctcgacagaaaattaaggtgcaaatgaaggatatcgctgaggaactgctgttacaaaaagccgagaagaagatcggggtgtggaaacctgtggaaagtaaatggatctcaagttcatgcaaaatcatcgcattccggaaggctttgctcaatcccgtgacatcaagacagtttcagcgctttgtggccttgaagggggatctattggagaacggactacttttctggcaggaggttcagaagtataaagatctgtgccattctcactgtgacgaaagtgttattcagaagaagatcaccactattataaattgctttatcaatagctccattcccccagcgctgcaaattgatattccagtggagcaggcccaaaagatcattgaacatagaaaagagctgggaccgtatgtgtttcgggaggcccagatgaccattttcggggttcttttcaagttctggcctcagttctgtgaatttaggaaaaacctgaccgacgagaatatcatgagcgtactggaacggcgacaggagtacaataagcagaaaaagaaactggctgtgctggaggatgagaagagtggtaaagacggaatcaagcagtacgccaatacatccgtgcccgcaattaagaccgcactcctgtctgattctttcctgggtctgcagccatacggaagacagccaacatggtgctactcaaagtatatagaggcccttgaacaggagaggatcttactaaagatacaggaggaactggaaaagaaattgttcgcagggttgcaacctcttacaaactttaaggctagctcttcaacaatgtctcttaagaaaaatatgtctgcccattctagccagaaatag

SEQ ID NO: 53463 - DNA, 597 bp, Artificial Sequence
  Description of Artificial Sequence: Synthetic coding sequence
atgtggaacacactgactcggtcactcagcgaccacccagttggaaaggacccgcaggcgatgaggactgggcaaaggcaaaacaagggaatgcgcacacgactgggctgcctgagtcataagtcggattcttgctcggattttactgctatactgcctgacaagccaaaccgcgcactcaagcggttatccactgaggaggcaacacggtgggcagactctttcgatgtcttgctcagtcataagtatggcgtggccgcattcagagctttcttaaaaactgaattctcagaagagaaccttgaattttggctggcatgtgaagaattcaaaaaaactcggtctacggccaaactggtcagcaaagctcatcgcatctttgaagagttcgtagatgtgcaggcgcctcgcgaagtgaacatcgattttcagacacgggaagctacaaggaagaatctccaagagccaagtctgacctgttttgatcaggcacagggcaaagtacactccctgatggagaaggatagctaccctagattcctgcgtagcaagatgtatctagacctgctctctcagagtcagcggcgtctgtcgtag

SEQ ID NO: 53464 - DNA, 543 bp, Artificial Sequence
  Description of Artificial Sequence: Synthetic coding sequence
atggctgctctgctgatgcccagaagaaacaaaggtatgcggacccggcttggctgtctcagtcataaaagtgactcttgttctgatttcacagcgatattgcccgacaagcccaatcgtgctctgaaaaggttgtccacagaagaggccactaggtgggccgacagcttcgacgtgttgctgagtcacaaatacggcgtggctgcgttccgggcattccttaagaccgaatttagtgaagagaatctggagttctggctggcttgcgaagagttcaagaaaacgcgtagcaccgcaaagcttgtctcaaaagcacaccgtattttcgaggagtttgtggacgtgcaggctccaagagaggtgaacattgacttccagactagagaggccacccgcaagaacctgcaagagccgtccttgacatgcttcgaccaggcccaggggaaagtgcacagcctcatggagaaggactcctacccccgattcttacgaagcaaaatgtacctggacctcctcagtcagagccaacgcaggctctcctag

SEQ ID NO: 53465 - DNA, 543 bp, Artificial Sequence
  Description of Artificial Sequence: Synthetic coding sequence
atggctgccctattaatgcctcggagaaacaaaggcatgaggacacgtcttgggtgtctgtcccataaaagtgacagctgcagtgacttcacagccattttaccggacaagccaaatagggccctgaagcggctgtccacagaggaagccactagatgggccgatagctttgacgtgcttttgagtcacaaatacggcgttgccgcattcagggcctttctcaagacggagtttagcgaagaaaaccttgagttttggttggcctgcgaagagttcaagaagacccggagcaccgccaaactggttagcaaagcacataggattttcgaagagtttgtggatgtgcaggccccacgtgaggtgaacatcgatttccagaccagggaggcaacaagaaagaacctgcaggagcccagtttgacatgtttcgatcaggctcaaggcaaagtgcattcactgatggagaaagattcatatccacgttttcttcgctccaagatgtatcttgatctcctgtcgcagtcccagcgaaggctcagctag

SEQ ID NO: 53466 - DNA, 543 bp, Artificial Sequence
  Description of Artificial Sequence: Synthetic coding sequence
atggcagctctgctgatgccccgtcggaataaaggcatgcggactagactcgggtgcctatcccacaaaagcgattcctgcagcgatttcacggcaatattgcccgacaagccaaaccgcgcacttaaaagactgagtacagaggaagctacacgatgggccgattctttcgatgtattgctgagtcacaagtacggggttgctgcgttcagggcttttttgaagaccgagttctctgaagagaacctcgaattttggctcgcctgcgaggagttcaaaaaaaccagaagcacggcaaaactggtcagtaaagcccatagaatctttgaggagttcgtggacgtgcaggcgccacgtgaagttaatatcgattttcagaccagagaagccacacggaaaaacttacaggaaccctctctcacgtgttttgaccaggcacagggcaaggttcattcccttatggaaaaggattcctatcccagattcctcagatctaaaatgtacctggacttgctgagccagagccaaaggcgcctatcatag

SEQ ID NO: 53467 - DNA, 174 bp, Artificial Sequence
  Description of Artificial Sequence: Synthetic coding sequence
atggctgcactgttgatgccccgaagaaataaggggatgaggactcggttaggatgtctatcccacaagtcggacagctgttctgacttcactgcaattctgccagacaaaccaaatcgggctttaaagaggcttagcacagaagaagctactcgctgggcagactccttttag

SEQ ID NO: 53468 - DNA, 2274 bp, Artificial Sequence
  Description of Artificial Sequence: Synthetic coding sequence
atgactagcggaagtgtgtttttctacatcctgatatttggcaagtacttcagccacgggggaggacaggatgtcaaatgctcactcggttactttccctgcggcaatattaccaagtgtctgcctcaactgctgcactgcaacggcgtcgacgactgcggtaaccaggccgatgaggacaattgcggggacaataatgggtggagtttgcagtttgataagtatttcgccagttattacaagatgacctctcagtacccttttgaggcggagacgccggagtgtctcgtcggttccgtgcctgttcaatgcctctgccaggggctagagttagattgtgacgaaacaaatctgagggctgtgccttctgtcagctctaacgtgactgccatgtccctgcaatggaacttgattaggaagctgccccctgactgctttaagaattatcacgacttgcagaagctgtacttgcaaaataataagatcacctctatcagtatatatgcttttagggggttgaactctctgaccaaactgtatctgtcccacaatagaatcactttcctcaagccaggcgtctttgaggatctccatcgcctggaatggctcataattgaggacaaccatctgtcaaggatatcacctcctactttctacggcttgaattcacttattttgctagtgttaatgaataacgttcttaccaggctgccagataaacccctctgccaacatatgcccaggctgcactggctagatctggagggcaatcacatacataatttacggaatctgacttttatttcatgctccaatcttacagttctggtgatgaggaaaaataagatcaatcacctgaacgaaaatacctttgcccctcttcagaagctcgatgaactggaccttgggtccaataaaatcgaaaacctgccacctttaattttcaaggacttgaaagaactgtctcaactgaatttgagttacaatcctattcaaaaaatccaggctaatcagttcgattatttagtgaaattgaagtccttgtctttagaagggatcgagattagcaatatccagcagcgaatgtttaggcctctgatgaatctgtcccatatctatttcaagaagtttcagtattgcggttatgctccccatgtgcggtcatgtaagccaaacacagatgggatcagctccctagagaatttactggcctcaattatacagagggtgttcgtatgggtggtatccgcagtgacatgttttggaaatatttttgtaatctgcatgagaccatatattaggtctgagaacaaactctacgccatgtccattatttctctgtgctgcgccgactgccttatgggcatatatctattcgttattggcggatttgatttgaaatttcgcggagaatacaataagcacgctcaactgtggatggagagtactcattgccaactcgttggctctttagccattctcagcaccgaggtctccgtactgctgctgacgttcctcaccctggagaagtacatttgtatcgtttacccttttcgctgtgttagacctggaaagtgcaggacaatcaccgttctaatactaatttggataacaggattcattgtggccttcattcctctttctaacaaggagttctttaagaactactatggaactaatggagtgtgtttccccctgcattcagaagataccgagagcatcggagctcagatatactctgttgctatcttcctggggatcaacctggcggcttttataattatagtcttcagctatggttccatgttctactctgttcaccagtctgccattaccgccactgaaattcgaaaccaagtgaagaaggaaatgattctcgccaagcggttcttctttattgtttttaccgatgctctctgctggatccctatatttgtagtaaaattcttatctctgttgcaagtggaaattccagggactatcaccagctgggtcgttatctttatactcccaatcaatagtgccctgaaccccatcctatacactctgaccactcgcccattcaaggaaatgatacacagattttggtataactatcgacagagaaaatccatggattctaagggccagaagacatacgctccatcttttatatgggtcgaaatgtggccgctacaggagatgcctccagaactcatgaagccggatcttttcacctatccctgcgaaatgtccttaatctctcagtctactcgcctgaactcatacagctag

SEQ ID NO: 53469 - DNA, 570 bp, Artificial Sequence
  Description of Artificial Sequence: Synthetic coding sequence
atgactagcgggtcagtgtttttctatatcctgatctttggtaaatacttctctcacggcggtggtcaggacgtgaaatgctctctgggctattttccctgtggaaacatcacaaaatgtctccctcagctgttacattgcaacggggtggatgattgcgggaaccaggccgatgaggataactgcggggataacaacgggtggagcttgcagttcgacaagtatttcgccagctattacaagatgacatcacaataccccttcgaggctgaaactcccgagtgcctggtgggaagcgtcccagtgcaatgtctgtgtcagggactggaactagactgcgatgagactaatctgcgggctgtacctagcgtgagcagcaatgtaaccgcaatgtccttacagtggaacctgatcagaaagttaccacccgactgctttaagaactatcacgacttgcagaagctctatctgcagaataataagatcacctccattagcatctatgcatttagaggcctgaacagcctgacaaaactgtcccgcgcagtcaaggatggatccgagaagtag

SEQ ID NO: 53470 - DNA, 1884 bp, Artificial Sequence
  Description of Artificial Sequence: Synthetic coding sequence
agaactatggtaacctgcacacagaacatgaaggccgctttgaaatctttgctctaccacagcagaaacctcggctatcttcagaacaataaaatcacatctattagcatctacgcctttcgtgggctgaattctcttactaaattgtacttaagccataatagaattacctttctaaagcctggcgtgtttgaggatctgcatcgtctcgagtggctgatcattgaagacaaccacctgtctaggatcagtcctccaaccttctacggcctcaattctctaatcctactcgttctgatgaataacgtgcttacaagactccccgacaaacccttatgccaacacatgcctcggttgcattggctggatctcgagggcaatcatatacataatctgaggaatctgacatttataagctgttcaaacctcacggtgctggtgatgcgaaagaacaagataaatcaccttaacgagaatacctttgcgccactgcagaagctagacgaactggacttggggagcaataagatcgagaatctgccccctctcatttttaaggatctgaaagaactgagccaactgaacttatcctacaaccctatccagaagatccaggcaaatcagtttgattacctggtgaaactcaagtccctgagcttggaaggaatcgagatttctaatatccagcagcgaatgtttcgacccctcatgaatttgtcccacatatatttcaaaaagttccagtattgtggatacgccccacacgtgcgctcctgtaaacccaatactgacgggatctcttctttggagaacttgctagcttccataatacagcgggtctttgtctgggtggtctccgccgtgacatgcttcggcaacattttcgtgatctgcatgcgcccatatatacgctccgaaaataagttatacgctatgagcatcatctctttgtgttgtgctgactgtctaatgggaatttacttattcgtcatcggcggattcgaccttaagttccgcggtgagtacaataagcacgcgcagctgtggatggagagcacccactgtcagttggtcgggtcactggctatcttatccaccgaggtcagcgtgctcctactgaccttccttacactcgagaagtacatttgtattgtgtacccttttaggtgtgtcagaccaggaaaatgtagaaccataacagtgctgatcctcatctggatcactggctttattgtggccttcattccactcagtaacaaggaattttttaagaattactatgggacgaatggcgtgtgctttcctttacattctgaggatactgagagcatcggagctcagatttactcagtcgctatctttctaggtatcaatcttgccgcattcattattatcgtcttctcctatggctccatgttttactctgttcaccagtccgccatcactgccacggaaatacgcaatcaggtaaagaaggagatgatccttgcaaagaggtttttctttatagtgttcaccgatgctttgtgctggattccaatattcgtggtcaaatttctgtcccttctgcaggttgaaattcctggaactattacttcatgggttgttatctttatactccctatcaattctgcactcaatccgatcctgtacaccctgacaacgcgacccttcaaagagatgatacacagattctggtataattataggcagcgaaagagcatggacagtaaaggccagaaaacctacgccccttcatttatttgggtcgagatgtggcctctccaagagatgccccctgagttgatgaagcctgatctgtttacctatccttgcgagatgtcattaatcagccagtccacacggctgaactcctacagctag

SEQ ID NO: 53471 - DNA, 1959 bp, Artificial Sequence
  Description of Artificial Sequence: Synthetic coding sequence
atgacaagccagtatccgttcgaggcagaaacccccgaatgccttgtgggctctgtgccagtgcagtgcctgtgtcagggcttggagcttgattgtgatgagaccaatctgagagccgtaccctccgtgagctcaaacgtgaccgctatgagtctgcaatggaatctgatcaggaagttaccccctgactgctttaagaattaccacgacctgcagaagctgtacttgcagaacaataaaattacctcgatctccatttatgccttccgcggtctgaatagcttaaccaaactgtacttatcccataatagaattacctttctcaagccaggtgtatttgaggacctgcatcgacttgagtggttgataatcgaggacaaccacctttcccggatttctccgccaactttttacggcttgaattcgctcattctgctggtgctcatgaataacgtcctgactaggctgccagacaagcccctttgccaacacatgccacgtttacattggttagtgatgcgtaaaaataaaatcaatcatttgaacgagaatacctttgcccctttgcagaagctggacgaattagatctgggaagcaacaagatcgagaacctgccacctctgatcttcaaagacctgaaagagttatcccagttgaatctgagttacaaccctattcaaaagattcaagccaatcagttcgattaccttgtcaagctgaaatcgctgagtctcgagggcatcgaaatatctaatatccaacagaggatgtttaggcctcttatgaaccttagccatatctatttcaagaagttccagtactgcgggtacgcacctcatgttagatcttgcaaaccaaacactgacggtatatcttctctcgagaacctgttagcttctataatacagagagtgttcgtgtgggtggtgtccgcagtaacatgcttcgggaatatcttcgtaatatgcatgcgcccttacatccgaagcgagaataagctgtatgccatgtcaataatatccttgtgttgcgccgactgcttaatgggaatctacctgttcgtgatcggtggctttgacctgaagtttagaggcgaatataataaacatgcccagctatggatggagagtactcattgtcaactggtcggtagccttgctatcttgtcaaccgaggtttccgttctgctgctgactttcctgaccctggagaaatacatttgtattgtttatccatttagatgcgtgcgtcccggtaagtgtagaactatcaccgtgctaatcctgatctggattaccggctttattgtggcattcattcccctcagcaacaaggaattcttcaaaaattattatggcacgaacggagtgtgctttcctctgcattccgaagatactgaatcaatcggcgctcagatctactcagttgctatctttttgggcattaacctagccgctttcatcataatcgtgtttagctacggctccatgttttactccgtccatcagtccgcaattactgccaccgagattcgaaatcaagtgaaaaaggaaatgattctcgcaaaacggttctttttcattgtttttaccgacgctctctgctggatacccatctttgttgtgaaatttttgtcccttctgcaggtggaaatccccggaactatcacgtcctgggtcgtgatctttatcctccctatcaattctgcgcttaaccccatcctgtatacattgacaacacgcccatttaaagagatgattcataggttctggtacaattatcggcagcgaaaatccatggactctaaggggcagaaaacgtacgccccatcctttatttgggtagagatgtggcctctccaggaaatgcctcccgagctgatgaagccagacctgtttacctacccttgtgagatgtcactgatttcacagtctacgagactgaactcctattcatag

SEQ ID NO: 53472 - DNA, 474 bp, Artificial Sequence
  Description of Artificial Sequence: Synthetic coding sequence
atgacttccgggagtgtcttcttctacatcctcatctttgggaaatattttagccatggaggtggccaggacgtgaagtgtagcctgggatacttcccgtgcggcaatatcacaaaatgtctcccccaacttctgcattgcaacggagtagacgattgcgggaatcaagctgacgaagacaattgcggtgacaacaatggatggagcttacagttcgataagtatttcgcgtcatactacaagatgacatcccagtacccttttgaagcagagacacccgagtgcttggtgggctctgtcccagtccaatgcttatgccagggtcttgagttggactgtgacgaaactaacctgcgcgctgtgcccagtgtgtccagcaacgtgactgccatgagtctgcagtggaacctgatccgcaaacttcctccggattgttttaagaactatcatgatctgcagaagctcactttgtag

SEQ ID NO: 53473 - DNA, 2265 bp, Artificial Sequence
  Description of Artificial Sequence: Synthetic coding sequence
atgattgtatttctcgtgtttaagcatcttttttccctccgcctgatcaccatgtttttcctgctgcattttatcgtgctgatcaatgttaaggactttgcattgacacagggaagtatgattacaccgtcttgccaaaaggggtacttcccatgtggaaaccttacaaaatgtcttccccgagcctttcattgtgacggcaaggatgactgtggcaacggggctgatgaggaaaattgtggtgacactagcggttgggctactatctttgggactgtgcacggtaatgcaaactcagtggccttaactcaggaatgcttcctcaaacaatatccacagtgctgtgattgcaaagagaccgagttagagtgcgtgaatggtgatttgaaatccgttcctatgatttcgaacaacgtaacgctgctgagcctgaaaaagaataagatccacagtttacctgacaaagtgtttattaagtatacaaaactaaagaagatctttctccagcacaactgtattaggcacattagtagaaaagcatttttcggcttgtgcaacctccagatactttacctcaaccataactgtattaccaccctgaggccagggatatttaaagacctacatcagttgacctggttgattttagacgataaccctatcacccgtatctcacagcgcctgtttaccggcctgaatagcctgtttttcctctccatggtgaataattatctagaggctttaccaaaacaaatgtgtgcccagatgccacagctgaattgggtagaccttgaaggaaatcgcattaagtatctgacaaatagcacgttcctgagctgcgattctttgaccgtacttttccttcctcggaaccagattggatttgtgccagaaaaaaccttcagctccctgaagaacctgggcgaactggatctgagtagtaacacaatcacggagctctcaccccatttgttcaaagacctgaagctgctccagaagctgaacctttcctctaaccctctgatgtatttgcacaagaatcagtttgaatcactcaagcagctacagtctctggatctggagcgtattgaaatacctaacatcaatacaagaatgtttcagccaatgaagaatctgagccatatctattttaagaatttcaggtactgttcctacgcccctcacgtgagaatttgcatgcccctgaccgatggcattagttcgtttgaagatctcctggctaacaatatcctccggattttcgtgtgggtaatcgctttcattacatgcttcggcaacctgttcgtgatcggaatgaggagtttcattaaagctgagaacactacacatgctatgagtattaaaatcctgtgttgtgccgactgtctcatgggagtatacctgttttttgtgggtatctttgatataaagtatcgaggtcaatatcaaaaatatgcgttgctttggatggagtctgtgcagtgcaggctgatgggctttctcgctatgttaagcacagaagtctcggtcctgctgctgacttacttaactctcgagaagttcctagtgattgtgttcccgttcagtaacattagaccaggcaagagacagacctccgtgatccttatctgcatatggatggcaggatttcttatagccgttattcccttttggaacaaggactacttcggcaatttctatgggaagaacggtgtatgtttcccactatattacgatcagacagaggacatcggcagtaagggatattcattgggaatcttccttggcgtgaaccttctggcctttctcatcatcgtctttagttacattacaatgttttgctcgattcagaaaaccgctttgcagactacagaagtacggaactgcttcggacgcgaggtggcagtggccaacagattttttttcatagttttttcagatgccatttgctggatcccggtgtttgtggtgaaaattctcagtcttttccgggtagaaatcccggacacaatgacctcttggatcgtgattttttttttgcctgtgaatagcgctctgaatccgattctgtacaccctgaccacaaatttcttcaaagacaagctaaaacagctgctccacaagcatcagagaaaatccatcttcaaaataaagaagaaaagtttgtcaaccagtattgtttggatagaagacagcagcagcctgaagctcggcgtgctaaataagatcactctcggagactcaataatgaaacccgtctcctag

SEQ ID NO: 53474 - DNA, 2193 bp, Artificial Sequence
  Description of Artificial Sequence: Synthetic coding sequence
atgattgtattcttagtgttcaagcatctgttttcactgaggttgattacgatgttcttcctacttcactttattgtcctaatcaacgtcaaagatttcgccctgacgcagggatctatgattaccccttcgtgccagaaaggttattttccttgcggtaatcttaccaagtgcctacctcgggctttccattgtgatgggaaggatgactgtgggaacggcgctgacgaggaaaactgcggagacacaagcgggtgggccacaatctttgggactgtccacggcaacgctaactcagtggcactcactcaggaatgttttctgaagcagtatcctcagtgctgcgattgtaaggaaactgaattagagtgcgtgaacggtgatctgaaatcagtccccatgatcagcaacaacgtaacactgctaagtctcaagaaaaataaaatccactctctgcccgataaggtgttcattaaatataccaagcttaaaaaaatttttctccaacataattgcatcagacatattagtaggaaggccttttttggactgtgcaatctccaaattctctatctgaaccataattgtattacaacactacggccaggtattttcaaagacttgcatcagttaacctggctcattctggatgacaatcctattactaggatatctcaaagattgtttactgggcttaactccctcttttttctgtcgatggtgaataactacctggaggccctgcccaagcagatgtgcgcccagatgccacagttaaattgggtcgacctcgagggcaacagaattaagtacttgactaactctaccttcctgagctgtgattccctaaccgtgctggacctctcaagcaataccataaccgagctctcccctcaccttttcaaagatctgaagctcctgcagaaacttaatttatctagcaacccactgatgtacctacacaaaaaccagtttgagtctttgaaacaactgcagagcctggacctggagagaatcgagatacccaacatcaacactcgcatgttccaacccatgaagaacctttctcacatctatttcaagaattttagatattgttcatacgccccacacgtgaggatctgcatgccactcacagatggcatttcttctttcgaggacctattagcaaacaacattctgaggatttttgtgtgggtgatcgccttcattacctgttttggcaatctgtttgttataggcatgagaagttttattaaggcagagaacacaacgcacgcaatgagcataaaaatcctctgttgtgccgactgcctcatgggggtttatttgttcttcgtcggcatctttgacattaagtaccgaggtcagtaccagaagtatgctttactttggatggaatccgtgcagtgccgcctgatgggattcttagccatgctgtcaacagaggtcagtgtactgctcttgacttatctgaccttagaaaaatttttggtaatagtgtttccctttagtaatatcagaccgggaaagaggcagacatctgtcatactaatctgcatttggatggcgggattccttatcgccgtgattcccttctggaacaaggactactttggtaatttctacggaaagaacggcgtgtgctttcctctgtattatgatcaaacggaagacatcggctccaaaggatatagcctgggaatctttctgggtgtgaacctactggccttcctcattatcgtcttttcctatatcacaatgttttgctctattcagaagacggctctgcagacaacagaagtgcggaactgcttcggtcgcgaagtagctgtcgccaaccggttttttttcattgtcttctctgacgccatctgctggatccccgtctttgtcgtcaaaatcctctcacttttcagggtggagatccccgacactatgactagctggatcgtcatcttcttcttgcctgttaactcggccctgaatccaattctgtacactctgactaccaatttcttcaaagataaactgaagcagttacttcataagcatcagaggaagagtatctttaaaattaagaagaagagcctcagtacctctattgtctggatcgaagattccagcagtctaaaattgggcgttctcaataaaatcactttaggcgacagcatcatgaagcctgtttcatag

SEQ ID NO: 53475 - DNA, 1410 bp, Artificial Sequence
  Description of Artificial Sequence: Synthetic coding sequence
atgcagatggcagacgctgcaaccattgccacaatgaataaagctgcaggaggcgataagctggctgaactgtttagtctcgtgcctgatctgcttgaggcggcaaatacatccggaaatgcttccttgcagctgcccgacttgtggtgggaattaggcctcgagcttcctgacggtgccccacccggacaccctccgggaagcggaggagccgagtccgcggacactgaggctcgtgtccgtatcctcatcagtgttgtatattgggtggtctgtgccttaggactcgccggaaaccttctggttttatacttaatgaagtctatgcaggggtggcgtaagtccagtatcaatctctttgtaaccaaccttgctcttaccgacttccagttcgtgctcacacttcccttctgggccgtagaaaacgcgctcgattttaagtggcctttcgggaaggcaatgtgtaagattgtgtctatggtgaccagcatgaatatgtatgccagcgtcttctttctgacagccatgtccgtaacaaggtaccatagcgtggcgagtgcgctgaaatcccacaggacaagaggccacgggagaggcgattgttgtggcaggtcccttggggacagctgctgcttctccgccaaggccctatgcgtgtggatatgggccctggccgcactggcgtcattacctagtgccatcttcagtaccaccgtaaaggtcatgggcgaggagctctgcctcgtgcgtttccccgacaagctgcttggtcgagaccgtcagttctggcttggactgtatcatagccagaaggtgctgctcggctttgtcctcccactggggattatcattctctgttacctactgctggtgcgattcatcgcagatcgcagggcagccggaacgaagggcggagctgccgtggccggaggacggcctactggtgcgagcgcgaggcggctgagcaaagttaccaaatcagttacaattgtagtgctgagtttttttctgtgttggctgcccaatcaggcgctcacgacgtggtcgattcttatcaagttcaacgccgtaccctttagtcaggaatacttcctgtgccaggtatacgcctttccggtttcagtgtgcttagcacacagtaacagctgccttaatccagtactctattgcctggtgcggagggagtttagaaaggcacttaaatctctgctttggagaatcgcctcgccatcaataacttctatgcggccattcacagcaaccacaaagcctgagcatgaagaccagggtttgcaggcaccggctccacctcatgcagccgcagagcccgatctgctctactatccacccggagtggttgtatattccgggggacgctatgatttacttccttccagcagcgcttactag

SEQ ID NO: 53476 - DNA, 1125 bp, Artificial Sequence
  Description of Artificial Sequence: Synthetic coding sequence
atgccgactctgaacacaagcgcctcaccccctacattcttttgggccaacgcaagcggtggtagcgtgcttagtgccgacgatgccccaatgccagtcaaatttcttgccttgcgtctgatggtcgccctggcatacgggcttgttggcgctataggactacttggcaatttggccgtgctctgggtcctttctaactgcgcaagacgggcacccggacctccctcagacacttttgtcttcaatctggccctcgccgatttgggtttagccttgacccttccgttctgggctgccgagagtgccctggacttccactggccttttgggggagccctttgtaaaatggttctgactgcaacagtattaaacgtgtacgcctccatatttctaatcactgcactgtccgttgcccgatattgggtggtcgcaatggcagctggtcctggcacgcatttgtcattgttttgggctcggatcgccacgctggcagtatgggccgcagcagctctggtgactgtcccaaccgctgtgttcggtgtggaaggcgaggtttgcggagtgagattatgtctgcttcgctttccaagtaggtactggcttggcgcataccaactgcagcgagtcgtcctggcttttatggtgcctttgggcgttattactaccagctatttattactgctagctttcctgcagcggagacagcgcaggaggcaggactctcgtgttgtggcaagatcggttagaattttagtggccagttttttcctgtgttggtttccaaaccacgtcgttaccttgtggggagtcctcgtaaagttcgatcttgttccatggaactcaacattttatacgatacagacatacgtcttcccagttaccacatgcctcgcacattcaaattcatgcttgaaccctgtgctgtattgtctcctgaggcgggaacccagacaggcactggctggcactttcagagatctgcggcttcgactctggccacagggcggaggttgggtgcagcaggtggccctcaaacaggtggggcgtcgctgggtggccagtaacccacgagaatcacgcccttccacactgcttacgaacttagataggggcaccccgggatag

SEQ ID NO: 53477 - DNA, 816 bp, Artificial Sequence
  Description of Artificial Sequence: Synthetic coding sequence
atggctccccgagctctacccggatctgccgtacttgccgcagcagtcttcgtcggaggtgctgtgtccagcccattagttgcaccagacaacggaagcagccggacactgcactctcggaccgaaaccacgccatcaccttctaatgataccggcaatgggcacccagagtacattgcatatgccctggtgcctgtgttttttataatgggtttatttggcgtcctaatttgccatctcctgaaaaaaaaagggtacagatgcacaactgaggccgagcaggatatcgaggaggaaaaggtggaaaaaatcgaactgaacgatagcgttaatgaaaactctgataccgttgggcagatagttcactatatcatgaaaaatgaagccaatgcagatgtgctgaaggcaatggtcgccgacaactctctgtacgatcctgaatcccccgtaacaccttcaacacctggttctccaccagtttcacccggaccgctgagcccagggggaactcccggtaaacatgtgtgtggacaccacctgcacactgtgggaggcgtagtggaaagagacgtgtgccacagatgccgacataaacggtggcacttcatcaagccaacaaacaagtcacgagagtcacgaccacgaaggcaaggtgaggtgacagttctcagcgttggacgcttccgcgtgactaaagtggagcataaatccaaccagaaagagcggagatctttaatgtcagtctccggagccgagacagtcaatggggaggtgcccgctactcccgtcaaacgcgaacgctctgggacggagtag

SEQ ID NO: 53478 - DNA, 816 bp, Artificial Sequence
  Description of Artificial Sequence: Synthetic coding sequence
atggctcccagagcactgcccggatcagccgtgctggccgcagctgtattcgtgggaggagccgtctcttctcctttggtagctccggacaatgggtcatctaggacccttcacagcagaaccgagacaacccccagccctagtaatgacacagggaatggtcaccccgagtacattgcctacgctctggttcccgtgtttttcatcatgggactgttcggcgtgctgatttgtcacctgctgaagaaaaagggctaccgatgtacaaccgaggcagaacaagatatcgaggaagagaaggtggaaaaaatcgagctcaacgactctgttaacgagaactctgataccgtcggacagatcgtccattatattatgaaaaatgaggcaaatgcggacgtcttgaaagccatggttgctgataactcgttgtacgatcctgaaagccctgttacaccttccaccccgggtagtcctcccgtgagtcctgggcctttgagccctggcggtactccaggcaagcatgtctgcggccaccacttgcacacagtcgggggagtcgtagaacgggatgtgtgtcatcgatgccgccataaaagatggcactttatcaagcctacgaacaaatcgagagaaagccggcctcgacgccaaggcgaagttacagtgttatccgtgggcaggtttcgtgtgacaaaggttgagcataaatcaaaccagaaagagaggaggagcttaatgtccgtgtcgggagctgagactgtcaatggtgaagttcccgctacccctgtgaagagggaaaggagtgggacagaatag

SEQ ID NO: 53479 - DNA, 363 bp, Artificial Sequence
  Description of Artificial Sequence: Synthetic coding sequence
atgaacgctaccttcttaaatcatagtgggttggaggaagtggacggcgtaggaggtggcgctggagccgctcttggaaatcgcactcacggcctaggcacgtggcttggctgttgcccgggtggcgctcccctggctgcatctgatggcgtaccggcaggcctggctcccgatgagagatctctgtgggtaagcagggtcgcacagattgcagttttgtgtgtgctgtcccttacggttgtgtttggcgtgttctttctcggctgcaatctacttatcaaaagtgagtcgatgatcaattttttggtgcaggaacggaggccaagcaaagatgtcggcgctgcaatcctcggcctctattag

SEQ ID NO: 53480 - DNA, 717 bp, Artificial Sequence
  Description of Artificial Sequence: Synthetic coding sequence
atgggtgtggagaactccgcgaaagaaggagaccccggtacaatcttcttctttagggagggagcagcagtgttttggaatgttaaggacaaaaccatgaaacacgttatgaaagtgcttgaaaaacacgagattcaaccttacgagatcgccctggtccattgggaaaacgaagagctaaactatatcaagattgaaggccagtctaaactccacagaggtgaaatcaagcttaactcggagctcgatctagacgacgccatcctggagaagtttgctttctccaatgccctgtgtctctccgtgaagctagccatttgggaagcctccctggataagtttatcgaatccattcagagcatcccggaggcccttaaggctggcaaaaaggtgaaactcagccacgaggaagttatgcagaagatcggggagctgtttgcactccgccaccggattaatctctcctcggatttccttattactccagatttttactgggaccgagaaaatcttgaaggtttatacgacaaaacttgccagttcctgagcataggccgaagagtaaaggtgatgaacgaaaaactgcagcactgcatggaactgacagatctgatgagaaaccacctaaacgagaagcgggctcttcgcttggaatggatgatagtgatcctcattactatcgaagtgatgttcgagctcggaagggtttttttctag

SEQ ID NO: 53481 - DNA, 423 bp, Artificial Sequence
  Description of Artificial Sequence: Synthetic coding sequence
atgcctttctgcaagacaggaaacctgggaagcatcctggataaatttatcgaatctatccagtcaatcccggaggcgcttaaagcgggaaagaaggtcaagctatcacacgaagaagtgatgcagaagattggagaactgtttgccctgcgacacaggatcaatttgtcctccgattttctaatcacacccgatttttactgggatagagaaaatctcgaaggactgtatgacaaaacttgtcagtttctgagcatcggacgcagagtgaaggtgatgaatgagaagctgcaacactgtatggaactgactgatctgatgaggaatcatctcaatgaaaaacgggctctgcgactcgaatggatgatcgttatcttgattacgatcgaggttatgtttgaactgggtagagtctttttctag

SEQ ID NO: 53482 - DNA, 1350 bp, Artificial Sequence
  Description of Artificial Sequence: Synthetic coding sequence
atgccggctaccctgctccgcgctgtagccaggagccaccacatcttgagtaaggcccatcaatgtagaagaattggacacctgatgctgaaacctttgaaggaatttgagaatactacctgctctacactgaccatccggcagtccctggacctgtttctcccagataagacagcctctggactaaacaaaagccagatactggagatgaatcagaaaaaatctgacacaagtatgctctcccccctgaacgccgctaggtgccaggatgaaaaagctcacctccctaccatgaagtccttcggcactcatcgtagggtgacgcacaagccaaacctcctgggctctaaatggtttattaaaatcttaaaacgtcatttttcgagcgtcagcacagagacctttgtgcccaaacaggacttcccccaggtgaagcgccctttgaaagccagtcgtaccagacagccatcacgcaccaacttgccagtgctcagtgtgaatgaggacctgatgcactgtacggcctttgctacagcagacgaataccatcttggcaacctaagccaggatctggcctctcacgggtacgtcgaggttacgtcactgcccagggacgctgctaacatcttggtaatgggcgttgagaacagtgccaaagaaggtgaccccggtaccatcttcttctttcgggagggcgctgctgtcttctggaacgtgaaggataagacaatgaagcatgtcatgaaagtcctggagaagcacgaaatccagccatatgaaatcgcattggtgcactgggagaacgaagaattaaattacatcaaaattgaaggacaatctaagctgcaccgcggagaaatcaaattaaattctgagctggacctggatgacgccattttggagaagtttgcattttccaacgccctgtgtctgtctgtcaaactggcaatttgggaagcctctttggataaatttatcgagagcatacaatccatccccgaagccctcaaagctggcaagaaagttaagctttcccacgaggaagtgatgcagaaaattggtgaattgttcgcgttgagacatcggataaatctgtcttcagactttctcataacccctgatttttactgggacagggagaacttggagggtctgtacgataaaacatgccagttcctgtccattgggaggcgggtcaaagttatgaatgaaaaattgcagcactgcatggagctcacggatctgatgagaaaccatctaaatgaaaaaagggcactcaggctagaatggatgattgtgattttgatcaccatcgaagtcatgtttgaattggggcgagtgttcttctag

SEQ ID NO: 53483 - DNA, 636 bp, Artificial Sequence
  Description of Artificial Sequence: Synthetic coding sequence
atgcattgtacagcattcgccacagctgacgagtaccaccttggtaatctttcccaagacctagccagccacggttatgttgaggtgacctcgctgccacgcgacgcggcaaacatacttgtaatgggtgtggagaatagtgccaaagagggtgaccccggaaccatattctttttccgtgagggggcagccgtcttctggaacgtcaaggataagacaatgaaacatgtgatgaaagtcttggaaaagcacgagatacagccctacgaaatcgctttagtgcattgggagaacgaagaactaaattacatcaagatcgagggacagtcaaagcttcatagaggtgaaataaagctcaatagcgagctggatctggatgatgccattctggagaaattcgctttctccaacgctctgtgcctttcagtgaagctggcgatttgggaggctagtctggataaattcatcgaatcaattcagtctatcccagaggcactgaaagccggaaaaaaggtcaagctgtctcacgaggaagtaatgcaaaagatcggcgagttattcgccttgcgacaccgcattaatcttagttccgatttcctgatcacacccgatttctactgggaccgggaaaattag

SEQ ID NO: 53484 - DNA, 591 bp, Artificial Sequence
  Description of Artificial Sequence: Synthetic coding sequence
atgagcgaaggagactcggtgggcgaatccgtgcacggcaagccttctgtggtgtatcggttcttcactaggcttggccagatctaccaaagctggctcgacaagagtacaccctacactgctgtgcgttgggtcgttaccttgggattgagtttcgtgtacatgatccgggtctatctgttgcaagggtggtatattgtgacttacgcgcttgggatttaccacctgaacttattcatcgcttttttgtcacccaaagtggatccatctcttatggaggattcagacgacgggccaagtctgccaactaagcaaaacgaggagttccgccctttcattcgccgactacctgaattcaagttttggcatgccgctacgaaaggcatcctcgtagccatggtgtgcacattcttcgacgcttttaatgtacccgttttttggcctatattagtaatgtactttatcatgctcttctgcatcaccatgaaacgacagatcaagcacatgattaagtatcggtacataccgtttacacatgggaagagacgataccggggaaaggaagacgccggaaaagctttcgcatcatag

SEQ ID NO: 53485 - DNA, 564 bp, Artificial Sequence
  Description of Artificial Sequence: Synthetic coding sequence
atgagcgaaggcgatagtgtgggcgaaagtgtccacggaaagccctcggtcgtttaccgcttttttacccggctggggcagatctatcagagttggctcgacaagtcaactccgtataccgctgtgcgctgggtggtgactttaggccttagcttcgtgtatatgatcagggtgtacctgctgcagggttggtatatagttacctatgctctcggaatctaccatctgaatctgttcatcgccttcctctccccgaaggttgaccctagtcttatggaagacagtgacgacggtccaagcttgccaacaaagcagaatgaggagttccggccattcatccggcgactgccagaatttaaattctgggacgcaagcgtatgcggcgatggaaggtgctcttgcaaagccggaggcggtcgacaggttcctggcgcaggatgcaggtgcggcgctaacttactatctccactggagggtatgagactcccaagagccagcctgtggctgtggagcgtgttgtcgtctacgctgtccactagcagatgtagtgggagattttggtag

SEQ ID NO: 53486 - DNA, 354 bp, Artificial Sequence
  Description of Artificial Sequence: Synthetic coding sequence
atgagcgagggggactccgtaggcgagagtgtgcatggtaaacccagtgtcgtgtacaggttctttacaagactgggccagatttaccaaagctggctggacaaatccactccttacacagccgtcagatgggtcgtcacactggggttgtccttcgtgtatatgatacgagtttatttactgcagatgacagtactgaggtacccacccaataggacaagaaacagcgccccatcgttcgagggatcccagtcccttaactttggcatgcgcctgccaagagcttcgctgtggctgtggtctgtgctgtcctcaacgctgtcaaccagtagatgcagcggcaggttttggtag

SEQ ID NO: 53487 - DNA, 354 bp, Artificial Sequence
  Description of Artificial Sequence: Synthetic coding sequence
atgtcagaaggggactccgtcggggagtccgtgcacgggaaacccagcgtagtgtatcgtttcttcacaaggctagggcagatatatcagtcctggctcgataaaagcacaccctatacggccgtgcgatgggttgtaactttagggctctcattcgtgtatatgatacgcgtctacctgctacagatgacggtgctgcgctaccctccgaatcggaccagaaacagtgcgccttcattcgagggtagccagtctttgaatttcggcatgcgtctgcctcgagcctccctctggttatggagcgttttaagttccactctgagcacctcacggtgcagcggacgcttctggtag

SEQ ID NO: 53488 - DNA, 645 bp, Artificial Sequence
  Description of Artificial Sequence: Synthetic coding sequence
atgtctgagggggatagcgtgggcgagtccgtacacggaaagcctagcgtggtgtacaggtttttcacaagactgggacaaatataccagagctggctagacaagtcgacaccatacacggccgtgcggtgggtggtgacactgggactgtcatttgtttatatgatcagagtgtatctgctgcagggctggtatatcgttacctacgctctaggaatctatcacctgaacctatttattgcgtttcttagtccaaaagtggatcccagcctgatggaagacagcgatgacggcccatccttaccaactaaacaaaatgaggagttccgcccattcattcgaagactgcccgaattcaaattttggcacgccgcaaccaaaggcatcctggtggcaatggtgtgcactttctttgacgcttttaacgtccccgtcttctggcctattctcgtcatgtattttatcatgctgttttgcattaccatgaaacgccagatcaaacatatgatcaagtatcgctacattccctttacacatgggaagcggaggtaccgcggaaaagaagatgcagggaaaccgtcccccgctaggagcgggacagaggctgcatcccgcgtagctcggaccgtattatcccactgctag

SEQ ID NO: 53489 - DNA, 477 bp, Artificial Sequence
  Description of Artificial Sequence: Synthetic coding sequence
atgagcgaaggggactccgtgggtgagtccgtacatggcaagccttccgtagtgtaccgcttcttcacacggctgggacaaatctaccagtcttggttagataaatcaacaccctacaccgccgtacggtgggtggtcaccttgggactatcgtttgtgtacatgatcagagtctacctcctccaggggtggtacatcgtcacttatgccctgggaatttaccacctgaacctgttcattgccttcttgtcccccaaggtggacccaagcctcatggaggactcagatgacggcccaagtctgcccacaaagcagaacgaggaattcaggccattcatcaggaggctccctgagttcaagttttggcatgccgctacgaaaggcattctggttgcgatggtatgtaccttcttcgacgccttcaacgtgcccgtcttctggcctatacttgtgatgtatttcattatgctgttctag

SEQ ID NO: 53490 - DNA, 1110 bp, Artificial Sequence
  Description of Artificial Sequence: Synthetic coding sequence
atggcttacagtaccgtccagcgggtggctttggcttcgggtctcgtgcttgccctcagccttctcctaccaaaggcttttctgtcaaggggcaaacggcaggagccccctccaacccccgaggggaagctaggcaggtttcctcccatgatgcaccatcatcaagcacccagcgacggccagacaccaggtgcccgattccagcgttcacatttagcagaagcgttcgccaaagccaaagggagcgggggtggagctggaggtggtggctctgggcgaggactaatggggcagattataccaatatacggattcggtatttttttgtatattttgtacatactgtttaagctaagcaaggggaaaaccactgccgaggacggcaaatgctatacggcaatgccaggaaacacacaccgaaaaattacgtcctttgagctggcacaactgcaggagaagctgaaggagaccgaggccgcaatggagaagctgatcaatcgcgttgggcctaatggcgagagcagggcacagacagtcacgagcgaccaggagaaacggctcctccatcagttgagggaaatcacaagggtcatgaaagaaggcaaatttattgataggttttcaccggaaaaggaggcggaagaagcaccatacatggaagactgggaggggtaccctgaggagacttaccccatctacgatctttcagactgtatcaagcgcagacaagagactattctggtggactaccccgatcccaaagaactatctgctgaagagatcgcagaacggatgggtatgattgaagaagaggagagcgatcacctgggttgggaatcactaccaacggacccacgcgctcaggaagacaactcagttacaagttgcgatcccaagcccgagacatgtagctgctgctttcacgaggatgaggatccggcagttcttgctgagaatgcaggattctcagcagatagttatccagaacaggaggagacaaccaaggaagagtggtcccaggattttaaggatgaagggttaggtatttcaaccgacaaagcatatacagggagcatgctgaggaagagaaacccacagggtctggagtag

SEQ ID NO: 53491 - DNA, 564 bp, Artificial Sequence
  Description of Artificial Sequence: Synthetic coding sequence
atggcctactctacagtgcaacgagttgccctggcctccgggctggtcctggctttgagccttctgcttcctaaagctttcctaagtcggggaaaacgtcaagagccccctcctactcccgagggctatccagaggagacatatcctatatatgacttatctgattgtataaagaggcggcaggaaaccattcttgtcgattaccccgatccgaaggagctgagtgccgaagagatagccgaacggatgggaatgatcgaagaagaagagtcagaccacctcgggtgggaaagtctgcctaccgatcctcgcgcacaggaggataactcggtcacctcttgcgaccccaagcccgagacatgctcttgttgctttcatgaggatgaggatcctgccgtgctagccgagaatgccggtttctccgctgacagctatccagagcaggaagagactacaaaagaagaatggtcccaggatttcaaggatgagggcctgggcatttccaccgataaagcctacacgggctccatgcttagaaagcgcaacccgcaggggctcgagtag

SEQ ID NO: 53492 - DNA, 1107 bp, Artificial Sequence
  Description of Artificial Sequence: Synthetic coding sequence
atggcctacagtaccgttcaacgcgtggctctggcgtcaggtttagtcctcgccttgagcctgcttttgcccaaggcctttttgtctcgaggcaaaagacaggaacctccccctacacccgagggcaagctcggccgttttcctcccatgatgcaccatcatcaggccccttccgatggtcagactccaggtgcaaggtttcagagaagtcatctggcggaggcattcgccaaggccaaagggagcggcggtggagctggcggaggtgggagtgggcgtgggttgatgggccagattatcccaatctatggctttggaatcttcctctacatcttatacatcctgttcaagttatcaaaagggaagaccactgccgaggatggaaaatgctacacagctatgcccggaaacactcaccgcaagattacctctttcgagttggcccagctacaggagaagctgaaagagaccgaggctgcaatggaaaagctcattaatcgcgtgggaccaaacggggaacgggctcagacggtgaccagcgatcaagagaagcgcctcctacatcaactccgggaaattactcgagtgatgaaagagggcaagttcatagaccgcttctcaccagaaaaggaagccgaagaagccccttacatggaggattgggagggctatcctgaggagacgtaccctatttacgatctgtctgactgcattaagcgacgacaggagaccatactggtcgactatccagacccaaaggagctaagcgccgaggagattgcagaacggatgggcatgatcgaggaggaggagtctgaccatctgggatgggagagcctgccgactgacccccgtgctcaggaagataactctgttaccagctgcgacccaaaacctgagacatgctcatgctgttttcacgaagatgaagacccagctgtcttggcagagaatgctgggttcagcgccgactcttatcctgagcaggaggagactacgaaggaagagtggtctcaggactttaaggatgaggggctgggtatttcaaccgataaggcatacacgggttcaatgctccggaagcgcaacccccaaggactggagtag

SEQ ID NO: 53493 - DNA, 624 bp, Artificial Sequence
  Description of Artificial Sequence: Synthetic coding sequence
atgtgtaggctgaaacgccaggagtttgtgatttcaagagcccagaccgtcacatcggaccaggaaaagcgactgttgcaccagcttcgggagatcacccgcgtcatgaaagaaggcaaatttatcgataggttctctcctgaaaaagaggctgaggaagcgccatatatggaggactgggaaggctaccccgaagaaacctaccctatctatgacctgtccgactgcatcaaacgcagacaagagactatcctggtcgattatcccgatcctaaggagctgtccgctgaggagatcgccgagaggatgggaatgattgaggaggaagagagcgaccaccttggttgggagagtctgcccaccgacccacgcgctcaggaagacaactccgtcacatcgtgcgatcctaaacccgaaacatgcagttgctgttttcatgaagatgaggatccggctgtacttgccgaaaacgctgggtttagcgccgattcatatcctgagcaggaggaaaccaccaaagaggagtggtcgcaggattttaaagatgaaggactgggcatttcaacggataaggcttacactggctctatgctccgcaagagaaacccgcagggccttgagtag

SEQ ID NO: 53494 - DNA, 387 bp, Artificial Sequence
  Description of Artificial Sequence: Synthetic coding sequence
atggcatactccaccgtccagcgggtggcactggcatccggcctggtactggctctctccctgttactgccgaaagcattcttaagccgtggcaaacgccaggaaccgccacccacaccggagggcaagctcgggagattcccgcctatgatgcatcatcaccaggcaccctctgatggtcagaccccaggtgcgcgatttcaacgcagccatctggccgaggcctttgccaaggccaaggggagcggagggggagctggtggcggagggtctggtagagggttaatggggcaaatcattcctatctatggtttcggcatatttctctatattctgtatattcttttcaaggtcagccgcataattctgattatcctacatcagtag

SEQ ID NO: 53495 - DNA, 963 bp, Artificial Sequence
  Description of Artificial Sequence: Synthetic coding sequence
atgatgcaccaccaccaggccccttcagatggccagaccccaggggcaagattccagcgatctcacttagcggaagcctttgctaaagcaaagggctccgggggaggggctggtggtgggggttcaggcagggggctgatgggacagatcatccccatttatggctttgggatctttctctatattttgtatatcctcttcaagctatcaaaaggcaaaaccactgccgaagatggaaaatgctacacagcaatgcctggaaacacccaccggaagataacatcgttcgaattagcccaacttcaggagaagttaaaagaaaccgaggccgctatggaaaaacttataaacagggtcgggccaaacggagaatcccgagcgcagactgtgaccagcgaccaggagaagcggctcctacaccagcttcgtgagattacaagggttatgaaagagggcaaattcattgatcgcttttcacctgaaaaggaggctgaagaagccccatacatggaggactgggaggggtatcccgaagaaacttacccgatctatgacttatcagactgcatcaaacggaggcaggagactatcttggtagactatcccgaccctaaggagctgagcgctgaggaaattgcggagcgcatgggtatgattgaagaggaagagtcagatcatctgggatgggaatccctgcccaccgatccaagggcgcaggaggataatagcgttacaagctgcgacccaaagcccgaaacatgctcctgttgttttcatgaagatgaggatccggcagtattagctgaaaatgccggtttctcagcggattcctatcccgaacaggaggaaaccacaaaggaagagtggagccaggacttcaaggacgaaggcctggggatctctactgacaaggcatacacaggcagcatgctgaggaagaggaaccctcagggcctggagtag

SEQ ID NO: 53496 - DNA, 990 bp, Artificial Sequence
  Description of Artificial Sequence: Synthetic coding sequence
atggcttactccactgtacaaagagtggccctggctagtgggctcgtgttagccttaagcctgctgctgcctaaagctttcttgtcccgaggtaaacggcaagaacctccaccaaccccggagggaaagctcggccgatttccccctatgatgcatcatcatcaggccccatcggacgggcagactccgggagcgagattccagcggtcgcacctggctgaagcctttgcgaaagcaaagggatcaggagggggtgccggaggaggaggatctggtagggggctcatggggcagatcatccctatctatggatttggaatttttctttatatcctctacattctctttaagctgagcaaaggtaagacaacagcagaggacggtaagtgctacaccgccatgcccggaaatacccatagaaaaatcactagctttgagctggcccaactgcaagaaaaacttaaggagaccgaagccgcaatggagaagctgattaatagagtgggtcccaacggtgagagtactcagactgatcactcggacgtgtacgtacattgtctgggagtgtttactactaaatggctcgattgcttgatctttttatcaagggcccagaccgtaacctctgaccaagaaaagcgtctcctacatcagctccgcgagataactagagtgatgaaggagggaaagttcatcgaccggttttcgcctgagaaagaggccgaggaagctccttacatggaagactgggagggttaccccgaagagacctatccgatctatgacctcagtgattgcatcaagagacggcaggaaacaattttggtggactatcccgacccaaaggagctctctgcagaagaaatagccgagcgcatggggatgattgaagaggaagagagcgaccacctgggctgggagtccttgcctactgatccacgagcacaggaggataatagcgtgacctcttgtgatccgaaaccagtgtag

SEQ ID NO: 53497 - DNA, 867 bp, Artificial Sequence
  Description of Artificial Sequence: Synthetic coding sequence
atggcctatagcacagtgcagcgggtagcccttgccagtggcctggtcctggcactgtcgttattactgcctaaagcctttcttagccgcggaaaacgtcaagaaccacccccaactccagaaggcaaactagggcgatttccccctatgatgcatcaccaccaagctccctcggatggacagaccccaggcgctaggtttcagagatcgcacctggccgaagcgtttgcaaaagcaaagggctctggaggcggagctggcggagggggatctgggaggggcctcatgggacagatcatcccgatatacggatttgggatctttctgtacattctctatatactgttcaaactgagcaagggcaagactacagctgaggacggtaagtgttacaccgcaatgccaggaaatacacatcgaaagatttcctatcccgaggaaacttacccaatctatgatctttctgactgtattaaacgcaggcaggagacaatcctcgtggactacccagatcctaaggagctgtccgcagaagagattgctgaaaggatgggcatgattgaagaagaagagagtgaccatcttggttgggaatctcttccaacagacccccgtgcgcaagaggataattcagtcacaagctgtgatccaaaacccgagacctgtagctgttgttttcacgaggatgaggaccccgcagtgttggccgaaaacgccggattttccgcggacagctaccccgagcaggaggagacaacgaaggaagagtggagtcaggatttcaaagacgagggcctgggcatctctactgataaagcctacaccggatctatgctcagaaagaggaacccacaagggttggagtag

SEQ ID NO: 53498 - DNA, 1614 bp, Artificial Sequence
  Description of Artificial Sequence: Synthetic coding sequence
atggaacctcgcgcagtggccgaagccgtggaaacgggagaagaggacgttataatggaagccctcagatcttacaatcaagagcattctcaatcattcacgtttgacgacgcacaacaggaagaccggaaaagacttgcagagctgctggtgtctgtactggagcaggggctgcccccatcacatagggtcatatggctgcagagcgtgagaattctttcgcgagatagaaactgtctggacccatttacaagtcggcagtctctgcaagccctggcttgttacgctgacatttcagtgtccgagggaagcgtaccagagtccgctgatatggacgtcgtgctggagtcgctgaaatgcctgtgcaacctggtcttgtccagccccgtggcccagatgctagccgctgaggccagactggtggtgaagctgacagaaagggtggggctgtaccgtgaacgctcctttcctcatgatgttcagttctttgatttgcgactgctgttcttgctgactgctcttaggaccgacgtacgacagcagttgtttcaggagctgaagggggttcggctgttaactgacacactggagctgactctcggtgtcactcccgaggggaatcccccacccacactcctcccatctcaagaaactgagcgggctatggagattctgaaggtcttgtttaatattactttggatagcatcaagggggaggtcgatgaggaggacgcggctttataccggcacctcgggaccctcctgcgtcattgcgtcatgatcgccaccgcaggcgaccgcacagaagagtttcacggccacgccgtgaatcttctgggcaatctgcccctgaaatgtcttgatgtgctgcttactctcgagccccacggagactccacagagtttatgggggtaaatatggacgtgatccgggctcttttgattttcctggagaagaggctgcacaagacacacagactgaaagaatcggtggccccagtacttagcgtgctgaccgagtgcgcaagaatgcatcggccagcaaggaagtttctgaaggcacagggatggccaccgcctcaagtcctgccacccctcagggacgttaggacgagaccagaagttggtgagatgcttcgaaataagcttgtacgtttgatgactcatctggacaccgacgtgaagagggtggcggctgaatttttgtttgtcctgtgctctgagtcagtgccaaggtttattaaatatactgggtacgggaacgctgcgggactcctcgcagcgcgagggctgatggcaggcggtcgccctgagggacagtattctgaggatgaagacactgataccgatgaatataaggaggcgaaagcctctatcaatcccgtaacgggcagggttgaagagaagcccccaaacccaatggagggaatgaccgaggagcagaaggagcacgaagcaatgaagctggttactatgtttgacaagctttcgcgtaaccgtgtgattcagccaatgggaatgagtcccaggggacacttgacctccctccaggatgcaatgtgtgagaccatggaacaacagctgtcttcggaccccgatagtgaccctgattag

SEQ ID NO: 53499 - DNA, 1596 bp, Artificial Sequence
  Description of Artificial Sequence: Synthetic coding sequence
atggagcccagggcagttgctgaggctgtggagacaggtgaggaagacgtgatcatggaggccttaaggtcatataatcaggaacactcccagtcatttacattcgacgatgcccagcaggaagacaggaaacgtctggccgagcttcttgtttctgtactcgagcagggactgcccccaagtcatcgggtcatatggctgcaaagtgttcgcatcctctcacgagaccgaaactgtctggatccttttacatcccgacagtctcttcaggccctggcttgttatgcggacatttcggtctctgaaggaagtgttcccgaatccgccgatatggatgttgtgttagagtcgctgaagtgtctttgcaacctcgtgctatcctctcccgttgcccagatgttagcagccgaagcacgactggtcgttaagcttacggaaagagttggcttgtatcgagagagatcattcccccacgatgtgcaattctttgatctgcggctactcttcctcctcaccgcattgcgtactgacgtcagacagcagctcttccaggaactgaaaggcgtcagactgcttaccgatacgctggagctgaccctgggggtgacgccagagggaaatcctccccctacgttgttaccctcccaagaaacagagagggccatggagattctcaaagtcctgttcaacatcacactggactccattaagggagaagtcgatgaggaggatgctgccctgtacagacacctaggcaccttgctacgccattgcgtcatgatcgcgaccgccggagataggacagaagaatttcatgggcatgctgtgaacctgctggggaatctgccgctgaagtgtttagacgtcctgttaacactcgaaccgcacggcgattcgacagagttcatgggcgtgaacatggacgttatccgagctctccttatcttcctggagaagcggcttcacaagactcacaggctgaaggagagtgtcgctccagtgctttcagtgctgacggagtgtgcaaggatgcataggccagccaggaaattcctcaaggctcaggtgcttccaccattacgcgatgttcgaacaaggccagaagtgggagagatgcttagaaataagctggtgagactgatgacccacctggacacagacgttaagcgcgtagctgctgagttcttgttcgtgctgtgctcagaaagcgtgcctcgcttcattaaatacaccggatatggtaacgctgccggacttctggccgcacgtgggctgatggccggaggcaggcccgagggccagtattctgaagatgaggatacagacactgacgaatataaggaagcaaaggcatctattaatcccgtgacaggacgcgtggaggaaaagcccccaaatcccatggaagggatgacagaagaacagaaagaacatgaggcgatgaagctcgttactatgttcgacaaactctccaggaatcgcgtcattcaaccaatgggtatgagcccaagaggccacttgacatcccttcaggatgccatgtgcgagacgatggagcagcagctaagtagtgatcctgactctgatcctgattag

SEQ ID NO: 53500 - DNA, 1491 bp, Artificial Sequence
  Description of Artificial Sequence: Synthetic coding sequence
atgctggcttcgaaactgtgcgagggaatcttcaaagtgctgatcaaagacattcctacgacttgtcaggtgtcctgcctggaggtgctgagaatcctgagccgcgacaaaaaagtgctggtgcctgtgacgacaaaggaaaatatgcagatcctgctgcgcctggccaaactgaacgagctggatgactcccttgaaaaggtgtctgaattccctgtcattgtggagagcctcaagtgtctatgcaacatcgtattcaatagtcagatggctcaacagttatccctcgagctgaacctagccgcaaaactgtgtaacttgcttcggaaatgcaaagatcgaaaattcatcaatgacatcaagtgctttgatctgaggctgctgtttcttctctccctcttgcacacagatatccgatcccagttgcgctatgagctgcagggactgccacttctgacccagattctggaatcagccttctcaataaagtggactgacgagtacgagtcagccatcgatcataacgggcctccactcagtcctcaggagactgattgtgcaatcgaggcgctgaaggccctcttcaatgtgactgttgacagctggaaggtgcataaggagagtgattctcatcaatttcgagtgatggctgccgttttacggcactgtcttcttattgtcggtccaaccgaagacaaaacggaagagcttcattcgaatgccgtcaatctgctttccaacgttccggttagttgcttagacgtccttatttgcccccttacccacgaggaaacagcgcaagaagccacaactctcgacgagctgccctcgaacaagactgccgaaaaggagactgtgttaaaaaataataccatggtctacaacggcatgaatatggaggcaattcatgtactgctaaattttatggaaaaaagaatcgataagggttccagctaccgggaaggtttaacaccagtcctgtctctgctgacagaatgctcccgggctcaccggaacattaggaaattcctcaaagaccaggtgttgccacccttacgagacgtcacaaacaggccggaagtggggtcgacggtacgcaataaactcgttcgactgatgacacatgtggatctgggcgtgaagcagattgcagccgagttcctcttcgtgctttgtaaggagcgcgttgatagtctgctcaaatatacaggctatggcaacgcagccggactgcttgcggcacggggactgttggccggaggaagaggagacaactggtactctgaggacgaagacaccgacactgaggaatataaaaatgcaaaacccaacatcaatttaattacagggcatttggaagagcctatgccaaatccaatcgacgaaatgaccgaggagcagaaggaatacgaagcaatgaagctggtgaatatgcttgataagctgtcaaggcgagctgacgtgaaagacctccatcaggatggtggctag

SEQ ID NO: 53501 - DNA, 1683 bp, Artificial Sequence
  Description of Artificial Sequence: Synthetic coding sequence
atggatgaggagcgcgctctgtacatcgtcagggcgggagaagccggagcaattgaaagagtactccgcgattactcggacaaacacagggccacatttaaatttgaatccacggatgaggataaacgtaagaagctgtgcgaagggatctttaaggtcttgatcaaggacatccctaccacgtgtcaggtgtcatgcctcgaggtgcttaggatcctgagtagagacaaaaaagtcctggtcccagttactactaaagaaaacatgcagatcctgctccgtctagctaagctgaatgaactggacgattcattggagaaggtgagcgagttccctgtgatcgtcgaatcactgaagtgcttgtgtaatatcgtcttcaattcgcagatggctcagcagttgtcactggagctcaatcttgccgcaaaactgtgcaatctgttacggaaatgcaaggatagaaagttcattaacgatattaagtgttttgacttgagattgctgttcctgctctccctcttgcatacagatattcgatcccagctgcggtatgagctccaaggtcttccgctgctgacacagatattggagagcgcttttagcatcaaatggacagacgaatatgagtctgctattgaccacaacggcccaccactgtcgccacaagaaactgactgcgccatcgaggctctgaaagccctctttaacgtgactgtagactcttggaaggtacataaggagtccgatagtcaccagtttcgcgtaatggctgcggttctccgacattgcctgctcattgtgggtccaaccgaagacaagactgaggagctgcactctaacgctgttaatctcctttccaatgtgccggtcagctgcctggatgttctgatttgcccacttacgcatgaagaaacggcccaggaggcaacgacactcgacgagttgccgagcaacaagacagcagaaaaagagaccgttctgaaaaataatacgatggtctataacggtatgaatatggaggctattcacgtgttgctaaatttcatggagaaacgcatcgataaagggagcagctacagagaaggcttaactcccgtactgtctttactcactgagtgcagtcgtgcccaccgcaatatccgcaagtttctcaaggatcaagtgctccccccactgcgagacgtcacaaaccggccagaagtgggatcaaccgtacggaataagctcgtgaggttgatgacgcatgtggatttaggggtgaagcagatcgcagccgagtttttgttcgtgctctgcaaagagcgggtggatagtcttctcaagtacaccgggtacggcaatgccgcaggtctgctcgcggctaggggactgcttgcaggtggaaggggagacaattggtacagcgaagacgaggatactgacactgaagagtacaagaacgccaagccaaacataaatttaataacagggcacctggaggagccaatgccaaaccctattgacgagatgaccgaagaacagaaggagtatgaagctatgaaactcgtaaatatgctagataaactgagtagggaagaactccttaagccgatgggtcttaagcccgatggcacgatcacacctctcgaggaggccttaaatcagtactcagttatcgaggagacctcttccgataccgattag

SEQ ID NO: 53502 - DNA, 1563 bp, Artificial Sequence
  Description of Artificial Sequence: Synthetic coding sequence
atggatgaagagcgggcattgtacatagtgcgggctggtgaggctggtgccatagaacgggtgcttagggattactctgataagcatcgggcaacctttaagtttgagagcacagatgaggacaagcgcaaaaagctgtgcgaagggatctttaaggtgctaattaaagatatcccaactacttgtcaagtttcatgcctggaagtgctccgaatcttgagcagagataaaaaggtgcttgtacccgtgacaacaaaagagaacatgcagatcctgctccgcttggcaaaactcaacgaattagatgattcactggagaaggtcagcgagtttccagtgatcgttgaatcactgaagtgtctgtgcaatattgtgtttaatagccagatggcccagcagctctcactggaactgaacctcgccgcaaaactgtgtaatctgctgcgcaaatgtaaggaccgcaagtttatcaacgacattaagtgtttcgacctgaggctcctattccttctgtccctgctgcacactgatattagatctcaactgagatacgaactgcaagggttgcctttgctgacccagattctggagagtgccttcagcatcaagtggacggatgagtatgaatctgctatcgaccataacggtccacctcttagcccccaagagacagactgcgccatcgaagctcttaaagccctgtttaacgtgaccgtagactcctggaaagttcacaaggaaagcgatagtcaccaattcagggttatggctgcagtccttcgccactgcttgctgatcgtcggtcccacggaggacaaaaccgaggagctgcactcaaacgctgtcaatctgctttctaacgtgcctgtgtcgtgtcttgatgtgctaatatgtccactaacccacgaagagacagcccaagaggctaccaccttagacgaattaccctcgaataagaccgccgagaaggaaacagttctgaaaaacaacactatggtgtacaatggcatgaatatggaggcaatccacgtgctgttaaacttcatggaaaagcggattgataagggctcttcctacagggaggggttaacccccgtcttgagcctcttgactgagtgctcgagagcccacaggaacattaggaagttcctgaaggatcaggtgttaccccctctcagggatgtgacaaatagacctgaagtgggcagtacagttcgcaacaagttggtgagactgatgacacacgtggatctcggcgtcaaacagatcgcggctgaattcctcttcgtgctgtgcaaagagagggtagattccctcctgaagtacacgggatacggcaatgccgcaggcctgctagccgcacgtggcctgttggcagggggacgaggagacaattggtacagcgaggatgaggatactgatactgaagagtacaaaaatgctaagccaaaagaagagctgttgaaacctatgggcctgaaaccagatggcactattacccccctggaggaggccttaaaccagtatagcgtgatcgaggaaaccagctccgataccgactag

SEQ ID NO: 53503 - DNA, 987 bp, Artificial Sequence
  Description of Artificial Sequence: Synthetic coding sequence
atgatgtggcgacccagtgtgcttctgctgttactgctcctgaggcacggagctcagggaaagccgtctcctgatgccggtccacacggccagggccgagtccatcaggcagcccctctgagcgatgctccccatgatgacgcccatggaaactttcagtacgaccatgaggcatttctcggacgcgaggtagccaaggaatttgaccagctaacccctgaggaatctcaggctcggctgggtcgcattgttgatcggatggatagagccggtgacggcgacgggtgggtgtctctggctgagttgcgagcatggatcgcacatacccagcaacgacacatccgggactctgtgagcgccgcttgggatacatatgataccgacagagacggcagagttggctgggaagaactgcgcaacgccacatatggacactatgcccctggagaagagtttcatgacgtcgaggatgcggagacctacaaaaaaatgctcgcaagagacgagcgacggttcagggtcgcagaccaggatggggattctatggccactagagaagaactcactgctttcttacaccctgaggaatttccacacatgcgggatatcgtgatcgcagagaccctcgaggacctagacagaaacaaagacggctatgtgcaggtcgaggaatacattgcggacctatatagtgccgagcctggcgaggaggagcctgcctgggtccagaccgaacgccagcaatttcgggacttcagggacctgaataaggatggtcatctcgacggatctgaagtgggtcattgggtgctgcccccagctcaggatcagcccctggttgaagctaaccatcttcttcatgagagtgacacagacaaagacgggcgtctgagtaaagcagagatcctgggcaattggaacatgtttgttggaagccaggctactaactatggagaagacttgacaagacaccatgatgaactgtag

SEQ ID NO: 53504 - DNA, 1326 bp, Artificial Sequence
  Description of Artificial Sequence: Synthetic coding sequence
atgctgagaaaaggttgttgtgtggagctcctgctgctgctcgtggccgcagagttgccacttggcggtggctgtccacgcgattgcgtctgctacccggcaccaatgactgtctcctgtcaggcccacaattttgccgcaattcctgagggcatcccggtggattccgaacgcgtattcctccagaacaatcggatcggccttctgcagccgggacacttctcgcctgctatggtcacgctgtggatatacagcaacaatatcacctacattcatccctcgacattcgaagggttcgtccacctggaagagttagatctgggcgataatcgccagcttaggaccctagctccagaaacattccagggtctagtcaaattgcacgccctgtacctttacaagtgcggactgtctgccctccccgcaggcgtcttcggcggtctccattccctgcaatacctatacctgcaagacaaccacatcgagtatctgcaggacgatattttcgtcgatctggtgaatctgagccacctgtttctgcacggaaataagctatggagtctggggccaggcacatttagggggttggtaaatctcgaccggctgctcctgcacgagaaccagctccagtgggtccaccataaggcttttcatgaccttaggagacttactaccttattcctctttaataacagtctctctgaattgcagggggagtgtctggcccctctgggagctctggaatttttgagattgaacggaaacccgtgggactgcggctgtcgcgctagatcactgtgggagtggcttcaacgcttcagaggctcctcctccgcagttccgtgtgtaagcccaggtctgagacatggccaggacctcaaactcctgagagcggaggacttcagaaactgtaccggacccgcaagtccccatcaaattaagagtcatactcttaccacaaccgaccgagcagccagaaaagagcaccacagcccccatggaccgacccgcagtaaaggccacccccacggccctcggcctgggcatagaaaaccgggtaagaattgtacaaaccctaggaacaggaaccagattagcaaagccggagcagggaagcaggcgcctgagctgcccgactatgctcccgactatcagcacaagtttagtttcgatataatgcctactgccaggcctaagaggaaaggtaagtgtgcaagacgcactccaatccgagccccttctggagttcagcaagcgagctcagcttctagtctgggggcttccctgcttgcctggacactcgggttagccgttaccctgcggtag

SEQ ID NO: 53505 - DNA, 1263 bp, Artificial Sequence
  Description of Artificial Sequence: Synthetic coding sequence
atgctgccgggtctcagaagattgctgcaggcccctgctagcgcctgcctcctcctgatgctgctcgccttacccctcgcggcaccatcatgcccaatgttgtgtacatgctactccagtcctcccaccgtgtcctgccaggcgaataacttctcgagtgtgcccctaagcttaccaccttctacacaacgactgtttctccagaataatctcatcaggaccctgagacccggaaccttcggaagcaacctgctgacgctgtggttattctccaataacctcagtactatctaccctggtacctttagacaccttcaggcactcgaagaactggatcttggcgacaacagacaccttcgttcccttgagcctgatacattccagggactggagcggctgcagtctctccacctttaccggtgccagctgagttcattaccgggaaacattttcagaggcctggtctccctccagtatctgtacctccaggaaaattccctgttgcatttacaggatgacctctttgctgatctggcaaatctgtcgcacctcttcttgcatggcaatagactgcggctgctgactgaacacgtctttcgcggacttggaagcctggatagattgctattgcatggcaaccgccttcagggagtgcacagagctgcatttcggggattgtctagacttaccattctgtacctgtttaataacagcctggcatctctccccggtgaggctcttgcagatctaccctcgcttgaatttctcaggctgaacgcaaatccttgggcgtgcgattgcagagctcgtccactgtgggcctggttccagagagcacgcgttagtagttcagacgtaacctgcgcaactccgcctgaacgtcaaggaagagatctgcgcgcactgcgcgaagccgactttcaagcctgtcctcccgcagcacccactcggccaggatccagggctcgcggaaatagctcctcaaaccacctttatggcgtggctgaggccggtgccccacctgccgacccatcgacactctatagggaccttcctgccgaggattctagaggcagacaggggggagacgcccctaccgaggatgactactgggggggttatggtggggaggaccagcgcggtgagcagatgtgtcccggagccgcttgccaggctccccctgattcacggggtcccgctctcagcgcaggtctaccctctcccctactctgcctgcttctcttggtgccacatcacttgtag

SEQ ID NO: 53506 - DNA, 1014 bp, Artificial Sequence
  Description of Artificial Sequence: Synthetic coding sequence
atgcttcgtaacaatctgggtaactcgtccgactcaaaaaacgaggatggtagcgtgttctcgcagaccgagcacaacatcgtcgccacatatctgatcatggccggaatgatctcaatcatttcaaatataattgtgctcggcatatttattaaatacaaggagctgcgcacccctacaaacgctatcatcataaatcttgccgtcactgatattggagtatccagcattggttacccaatgagtgccgcttctgatctgtatgggtcctggaagttcggttacgctggttgtcaagtgtacgctggtctgaatatcttctttggtatggcctctataggcctcctgacagtcgtggctgtagatcgctatctcactatctgtctgccagacgtcggtcgaaggatgaccaccaatacgtacatcggcctgatcctgggggcatggataaacggcctgttttgggccctgatgcctatcatagggtgggctagctacgcccctgaccctacgggcgcaacatgcacaattaattggcgcaagaacgatcggtctttcgtgtcatataccatgaccgttatcgctatcaactttattgtgcctcttacagtcatgttttactgctactaccatgtcaccctgtccatcaagcaccatacgacatcagattgtactgagagcctgaaccgggactggtctgaccagatagacgtcaccaagatgagcgtcatcatgatatgcatgtttcttgtggcgtggagcccgtactcaattgtatgcttatgggcttcctttggggatcccaagaaaatccctcctccaatggctatcatcgcccctcttttcgcaaagagctccactttttacaacccatgtatctacgtagtcgcaaataagaagtttcgccgtgctatgcttgctatgttcaaatgccaaactcaccagactatgccagtgacatccatcttacctatggacgtaagccagaacccactggcttccggtagaatctag

SEQ ID NO: 53507 - DNA, 792 bp, Artificial Sequence
  Description of Artificial Sequence: Synthetic coding sequence
atgcgacgaatctcattgacttctagtccggtgcgcctgctcctttttctgctactcctactaatagccctggaaatcatggttgggggacactccttgtgttttaactttacgatcaaaagcctctctcgcccaggtcaaccttggtgtgaagctcaggtctttctgaacaagaacctctttttgcagtacaactctgataataatatggtgaagcctttagggctgctaggtaagaaggtatatgcaacatcaacttggggggagctgacccagaccctgggcgaggttggcagagacttaaggatgttactgtgtgacataaagccccagatcaaaacatccgatccatccactttacaagttgaaatgttttgccagcgagaagccgaaaggtgtaccggcgcttcatggcaattcgcaactaatggtgaaaagagtttgttgtttgacgccatgaacatgacctggacagtcattaatcacgaagcatctaaaatcaaggaaacctggaagaaggataggggtctcgagaagtattttcggaagctgtccaagggcgactgcgaccattggctgcgagagttccttggacattgggaggcaatgcccgaaccaactgtgagccctgtcaatgctagcgatattcactggtcgagctcatctctccccgatcggtggatcatccttggagcttttatcctgctcgttctaatggggattgtactgatttgcgtttggtggcagaacggggagtggcaggcaggcctttggcctctgcgaaccagctag

SEQ ID NO: 53508 - DNA, 684 bp, Artificial Sequence
  Description of Artificial Sequence: Synthetic coding sequence
atgagacggatttccttgacatcttccccagtgcgattactgctctttttgctcctgctgctgattgctctggagattatgtacaacagtgataacaatatggttaaaccgctgggcctgctgggcaaaaaagtgtacgccacttcaacctggggtgaattaacacagactctgggtgaggtgggtagagatctgaggatgttactctgtgatattaagccacagataaagacaagtgacccatctacgctccaggtagagatgttctgccagcgggaggcagagcgctgtacgggagcaagctggcagtttgcaaccaatggcgaaaaatctctgctctttgatgccatgaatatgacttggacagtgattaatcacgaagcctcaaaaatcaaagaaacatggaagaaggatagaggactcgagaagtattttagaaagctgagcaaaggagattgtgaccattggctgagggaattccttggccattgggaagccatgcccgagcctacagttagtccagtgaatgcttctgacatccattggagctcctcctccctgcctgataggtggatcatcttgggagcttttattctgctcgtgctgatgggtattgtgctcatctgtgtgtggtggcagaacggcgagtggcaggcaggcctgtggcctttgaggacttcctag

SEQ ID NO: 53509 - DNA, 354 bp, Artificial Sequence
  Description of Artificial Sequence: Synthetic coding sequence
atgaggcgaataagtcttacgtcctcccctgtgcgactgttattatttttactgcttttgcttatcgcacttgagattatggtggggggacatagtctgtgtttcaactttaccattaagtcgcttagtcggccagggcagccctggtgcgaagcacaggtgttccttaacaagaacctgttcctccagtataactccgataataacatggtgaaacctttaggcctgctcgggaagaagatcctgcccttgtgtaagtcacgttgttttgtaaacgtgaaacaaaatggggcattagtgcatccaggatcgtctcctcctatggagcgcaaccccagcagcttaacccagtag

SEQ ID NO: 53510 - DNA, 630 bp, Artificial Sequence
  Description of Artificial Sequence: Synthetic coding sequence
atgcggaggatttctctgacatcgagccctgtcaggttactgctcttcctgctcctccttttaatagcactggagattatggtaggcggtcactctttgtgcttcaactttacaattaaatccctttccagacctgggcagccctggtgcgaggcacaggtgtttctcaataaaaacctgttcctccagtataatagtgacaacaatatggtgaaacctctgggcctccttggcaaaaaggtctacgctacttccacttggggcgagttgacccagactctgggcgaggttgggcgagatctgcgcatgcttctgtgcgacatcaaaccccagataaagacatcagacccttctactctccaggttgagatgttctgtcagcgggaggcggagcggtgtaccggcgctagctggcagttcgcaactaatggggagaagtcgctgttgtttgatgccatgaatatgacttggacggttattaaccatgaggcaagcaaaatcaaggagacgtggaaaaaagatcggggactcgagaagtacttccgaaagctgagtaagggagactgcgatcattggctgagagaattcttggggcattgggaggctatgcccgagcccacagggaattag

SEQ ID NO: 53511 - DNA, 243 bp, Artificial Sequence
  Description of Artificial Sequence: Synthetic coding sequence
atgcgtcgtatctctcttacaagttctcccgtcaggttgttactatttcttctcctgttactcatcgctctggagatcatggttgggggtcattctctgtgtttcaactttaccatcaagagcctttctagaccgggtcagccttggtgcgaagctcaagtcttcttgaacaaaaacctgttcctccagtataatagcgataataatatggtgaaaccgctgggtctcctgggaaaaaagtag

SEQ ID NO: 53512 - DNA, 639 bp, Artificial Sequence
  Description of Artificial Sequence: Synthetic coding sequence
atgaggaggatatctttaacatccagcccagtacggttactcttgtttctattgctcctgctgattgctctggagattatggtgggtggacactccctctgcttcaatttcacaatcaagtctctgagtagaccaggccagccttggtgtgaggcgcaggtatttttaaacaagaatctctttctgcagtataattccgataataatatggtaaagcccctggggctccttgggaaaaaagtatacgctacaagcacgtggggggaattaacccagactttaggtgaggtgggacgggatctgaggatgttgctgtgtgacattaaaccccagattaagacatcagatccatccacgcttcaggtggaaatgttctgtcaacgagaggcagagcgttgcacaggcgctagctggcagttcgcgaccaacggtgagaagagcctgttattcgacgccatgaatatgacatggactgtgattaaccacgaggccagcaagattaaggagacgtggaaaaaagatcgcggattagaaaagtatttcaggaaactcagcaagggagattgcgaccactggcttcgcgagtttttggggcactgggaagctatgcctgaacccaccggaagacgtagtacatag

SEQ ID NO: 53513 - DNA, 1005 bp, Artificial Sequence
  Description of Artificial Sequence: Synthetic coding sequence
atggccgctgccgcatcaccagcgttcctgcttcggttacctttgctgctgctgctgtcttcctggtgtcggacaggcctggctgaccctcattccctctgctatgatatcacagtaataccaaaatttcgtccgggacccaggtggtgcgccgtgcagggtcaggtggacgaaaaaacttttctccactatgattgtggctcgaaaactgttacacccgtgtcacctttgggaaagaaactgaatgtgactactgcctggaaagctcaaaatcccgtgcttagagaggtcgtcgatatactcactgagcagttgctcgatatacagctggaaaactacatccctaaggaaccgctgaccctacaagcgaggatgagctgcgaacagaaagctgagggtcacggttctggctcttggcaactgtccttcgacggacagattttcctgttgttcgactccgaaaatcgaatgtggacgacggtccacccgggtgcgagaaaaatgaaggaaaagtgggagaatgacaaagatatgacaatgtctttccactacatttctatgggtgattgcacgggttggctggaagattttctgatggggatggatagcactctggagccttccgctggagcgccacctacaatgtcttctggaaccgctcagccgagggccactgccacaacactcatcttgtgctgccttctaattatgtgccttctcatctgttcaaggcactccctgacacaatctcacgggcaccacccccagagcctgcagccgccaccacacccaccactactccatccgacatggctgctccgacgcgtattgtggtctgactcctatcaaatagcaaaacggccattaagcggagggcacgttacacgggtcacattgcctataatcggtgacgattctcacagcctgccttgcccgctggccctgtataccatcaacaacggcgcagctagatattctgaaccgttgcaggtcagcatatcttag

SEQ ID NO: 53514 - DNA, 663 bp, Artificial Sequence
  Description of Artificial Sequence: Synthetic coding sequence
atgagccggtatctgctccctctctcagcactagggacagtagccggtgccgctgtgttgctcaaggactacgtgacgggaggcgcatgtcccagcaaggccacgattccaggaaagacagtgattgttactggcgcaaataccgggattggtaagcagactgctcttgaactcgcaaggcgaggtggaaatattattctcgcttgccgagacatggaaaaatgcgaggccgctgccaaggatattcgcggtgaaacccttaaccaccacgtaaatgcaagacacctggatctggcgagcttaaaaagtatcagggaatttgcagcaaagatcattgaggaagaggaacgagtcgacatcttaatcaacaatgctggggttatgcgttgtcctcactggacaacggaagacggattcgagatgcagtttggcgtcaaccacctcggacatttcctcctcaccaatctcctcctcgacaaacttaaagcttccgccccttctcgcatcatcaatttgagctctctggcgcacgtcgccggacacatcgacttcgacgatctgaattggcagaccaggaagtataacactaaagccgcatattgccagtccaaactggcaatagtgctgtttacaaaagagttgtctaggcgactgcagggctag

SEQ ID NO: 53515 - DNA, 783 bp, Artificial Sequence
  Description of Artificial Sequence: Synthetic coding sequence
atggagaaatgcgaagctgcggctaaggatatccgcggagaaacactgaatcatcatgtcaacgcacgtcatctcgacttagcctccctgaagtccatccgagaatttgctgctaagattatagaagaagaagagagagtggacatcctcattaacaatgcaggagtgatgcgatgcccacattggacaaccgaggacggatttgagatgcagttcggcgtgaaccatttgggccattttctgctgacaaacttactgctggataaactgaaggccagcgcgccaagcaggattattaacctgtcttccttggctcatgtggctgggcacattgacttcgacgatctaaactggcagaccagaaagtacaatacaaaggctgcgtattgccagagcaaactagctatagtgctgtttaccaaggaactgtctcggaggttgcagggcagcggtgtcaccgttaatgcactgcaccctggcgtggccagaacggaactgggacgtcacaccggaatccacgggtcaacattctcatcaacaacactcggccctatcttctggcttctggttaaatctcccgagctggcggctcagccctctacctacttagctgtggctgaggaactggccgatgtcagtggtaaatactttgatgggctcaagcagaaagcccctgctcccgaggcggaggacgaggaggttgccagacgattgtgggctgagtctgccaggctggtggggttggaagcgccttcagtccgagaacagccactacccagatag

SEQ ID NO: 53516 - DNA, 996 bp, Artificial Sequence
  Description of Artificial Sequence: Synthetic coding sequence
atgtcacgatatctgttgcccttatctgccctgggcaccgtggctggagccgcagtacttctgaaggactacgtgacgggaggcgcatgtccttctaaagctactatccccggtaagacagtgatcgtgaccggcgcaaacaccgggatcggaaagcagacagccctagaactggcgcgaaggggcggtaacattattctcgcctgccgcgatatggagaaatgcgaggcggctgctaaggatattcggggtgagaccctgaatcatcatgtcaatgcaaggcatctggatctagcttcgctgaagtccattcgtgagttcgctgccaaaataatcgaggaggaggagcgggtggatattctgataaataatgcaggcgtcatgcggtgtcctcattggacaactgaggatgggttcgagatgcagtttggcgtcaaccacctgggacattttctgcttaccaatctgctactcgacaaactcaaggcttcagctccttcccggatcattaatctttcatccctggcacatgtggccggtcacattgatttcgatgacctcaattggcaaacacgcaaatataataccaaggcggcatattgccaaagcaaactcgccatcgtcttgttcacaaaagagctttcaagacgcttgcaggggtccggggtaaccgtcaacgcactgcatcctggcgtggctcgcacagagctcggcaggcatacaggaatccatggcagtaccttctcatctaccacactgggcccaattttctggctgctggtaaaaagcccagagctggccgctcagccctctacctacctcgccgtggcagaggaacttgcagacgttagtgggaagtattttgacggcttgaaacagaaagcgcctgcacctgaggctgaggatgaggaggtggccagacggctgtgggccgagtcagcccgtttggtcggcctggaagccccttcggttagagaacagcccctgccccgttag

SEQ ID NO: 53517 - DNA, 1011 bp, Artificial Sequence
  Description of Artificial Sequence: Synthetic coding sequence
atggctgtcgctacagctgccgcagtgttggccgctctcggaggagctctctggctcgctgccagacgcttcgttggccctcgcgtccagcgactgcggcgtggtggcgaccctggactcatgcacggaaaaactgtgctgatcaccggcgcaaacagcggactgggtagagccacagcagcagagctgctacgtctcggagctagagtcataatgggttgtagagatcgcgcacgagctgaggaagccgcagggcagctgagacgagagttacgacaggcggcagagtgtggacccgagccaggggttagcggggtgggggaactgattgtcagagaactggacttagcttccctcagaagcgtgcgcgcattttgtcaggagatgctgcaagaggagccgaggctcgacgtgttaatcaataacgccggtattttccagtgcccctatatgaaaactgaggatggcttcgagatgcaattcggagtcaaccacttgggacacttcctactgacgaacttgctgctgggactactaaagagcagcgctccatccaggatcgtagtagttagctcgaaactgtataagtacggcgacattaattttgacgatctgaacagtgagcagtcttacaacaagagcttttgctactcgaggagcaaactggcaaacatcctgtttaccagggagctcgctcggagacttgagggaactaacgtcacagtcaacgtactgcatcccggaatcgtgcgcaccaatctgggaaggcatatccatatcccacttctggtaaagcccctcttcaacttagtgagttgggcatttttcaagacccccgtggagggggctcaaacctctatctatctggcatctagccccgaggtggaaggcgtgagcggcagatacttcggcgattgcaaggaagaagagctgctccccaaagccatggatgaatcagtggcgaggaagctttgggatatcagtgaggttatggtcggactgctgaagtag

SEQ ID NO: 53518 - DNA, 954 bp, Artificial Sequence
  Description of Artificial Sequence: Synthetic coding sequence
atgtggctttacctggcggtgtttgttgggttgtactacctgctgcattggtaccgggagcggcaggtcctatcccacctgagggataaatacgtttttatcactggttgcgactccggctttggtaaactgctcgccaggcagctggacgccagaggtttgagagtgttggctgcttgtttgacagaaaagggggctgaacaattgcgcggacagacaagcgatcgcttggagacggtgactctggacgttaccaagactgagagtgtcgctgccgcagcccagtgggtaaaggagtgtgtgcgcgacaagggcctgtggggcttagtaaataacgccggtatctccctgcccactgcccctaacgaacttctcactaagcaggactttgtgacaatattggacgttaacttgctcggagtgatcgacgtgaccctgtcgctgttgcccctagtgaggcgcgcacggggtcgcgtggtgaacgtatcgtccgtaatggggagagtgtcattattcggtggcggatattgtatcagcaaatacggtgtggaggccttttcagatagcctcaggagggagctgagttacttcggagtcaaggttgcaatgattgagccgggttattttaagaccgccgtaacgtcaaaggagagattcctcaagtcctttctcgaaatttgggatcgcagctctcccgaggtgaaagaagcttacggggaaaagtttgtcgccgactacaaaaagagtgccgaacagatggagcagaaatgcacccaggacctctctctggtcaccaattgtatggaacacgcactgatcgcttgtcaccccagaacaagatatagcgctggctgggatgctaaactcctctatctccctatgtcctatatgcctaccttcctcgtggacgctattatgtattgggtgtccccgagtcccgctaaagcactgtag

SEQ ID NO: 53519 - DNA, 1446 bp, Artificial Sequence
  Description of Artificial Sequence: Synthetic coding sequence
atgtggttaccattggtgcttctgttggccgtcttgcttctggccgtgctctgtaaagtgtatctgggcctgttcagtggctcttctccaaacccttttagcgaggatgtcaagcgcccacccgctcccctggtgaccgacaaggaagcacggaagaaggtgctgaagcaagcattctcagcaaatcaggttcccgagaagcttgatgtggtggtgatcggatccgggtttggaggcttggcagctgcggcaatactcgctaaggccggtaaacgcgtgcttgttctggaacagcatactaaggcagggggttgctgccacacgtttggaaagaacggtctcgagtttgacaccggcattcactatattggcagaatggaggagggctccatcggtcggttcatccttgaccagatcaccgaaggccaacttgattgggcacctttgtccagtccttttgacatcatggtgcttgagggcccaaacggaagaaaggagtatcctatgtattctggtgaaaaagcctacattcagggtctgaaagaaaagtttcctcaggaagaagctattatcgataagtacataaagctggtgaaagtggtgtcatccggagcgcctcacgccatcctcctgaaatttcttcctttgccggtagtacagctgctggatagatgtggactgctcaccagatttagcccatttcttcaggcgagtactcagagcctggccgaagttctgcagcagttaggagcttcgagcgaactgcaagcagttctgtcatatattttccccacatatggagttaccccgaatcacagcgccttttctatgcacgcgctgctggtgaatcattacatgaaaggaggtttctatcccaggggtgggtcaagcgagatcgctttccataccatccccgtgattcaacgcgcaggcggagcggtgctgaccaaagcgacagtccagtccgtcctgttagactcagctggaaaagcttgcggtgtgtccgtcaagaagggacatgaactggtcaacatctattgtccaatagtggtatcaaatgctggcctgtttaatacatacgagcatttgctgccaggcaacgctcggtgcttaccaggcgttaaacagcagctcggtaccgtgaggcctggcttaggcatgacgtctgttttcatctgcttacggggaactaaggaagacctgcacctcccctccaccaattattatgtgtattacgataccgacatggaccaagccatggagcgctacgtgagtatgccaagagaggaagcagccgaacatatacccctcctgttcttcgcctttccatcggctaaggacccaacatgggaagacaggttccccggaggggaatgcgactgtcgtatccctacccaccagcccgtcctctcgggttgcagcccacggtgccttttaagagggtag

SEQ ID NO: 53520 - DNA, 1833 bp, Artificial Sequence
  Description of Artificial Sequence: Synthetic coding sequence
atgtggctgcctctggtactgctactggcggtgctgttgttggctgtcttgtgtaaggtctacttgggtctgtttagtgggagcagccccaacccctttagtgaggatgtcaagcgccctcctgcccctctagtgaccgacaaagaagctcgtaagaaggtgctcaagcaagcctttagcgccaatcaggtgcctgaaaagctggatgtagtggtgatcggatcaggcttcggcggtctggcagctgccgctatactcgctaaagctggaaaaagggttttggtgctggaacagcatactaaggccggaggctgttgccacaccttcgggaagaatggcctggagtttgacaccggaatccactacatcgggcgtatggaggagggaagcattggtcgattcatcctggaccagattaccgaaggacaactggactgggccccactctcttctccttttgacatcatggtgctcgagggaccaaatgggcgaaaggaataccccatgtactcaggggagaaggcttatatccagggactgaaggagaagtttccgcaagaggaggcaattatcgataaatacatcaagctcgtcaaagtggtaagctccggggctcctcacgctatactcctaaagttcctgccactcccggtagttcagcttctcgatcgatgtgggctactgaccagattttcgccattcctacaagcttctacccaaagcctggccgaagtcctgcaacaattgggcgcatctagcgaacttcaggccgtcctgagttacattttccctacgtacggggtcaccccaaaccacagcgcattctctatgcatgcgctgcttgtgaaccattatatgaaagggggtttttatccgagggggggttcatccgaaatcgccttccatacaattcccgtgatccagcgagccggtggcgctgtcctcacaaaagccaccgtccagagtgtgctccttgactctgcaggaaaggcctgcggggtttcagtaaagaaggggcacgagctcgtgaacatatattgcccaatcgtcgtgtcaaacgctggtctgtttaacacctatgagcacctgcttccaggaaacgccaggtgtctgcctggagtcaaacagcagttaggcactgtgcgccctggactagggatgaccagcgtctttatctgcctgagaggaacaaaagaggacctgcaccttcctagcaccaattactacgtgtattatgataccgatatggaccaagcgatggagcgttacgtgtctatgcctagggaggaagccgctgagcacattccactccttttttttgcgtttccatccgctaaggatcctacatgggaggatcgctttccaggccgatcaacaatgattatgctgattcccaccgcatatgaatggttcgaggagtggcaggcagagttaaagggtaagcgaggatccgattacgaaacattcaaaaattcgttcgtagaagcttctatgtctgtggtactcaagttatttccacagctggaaggcaaagtcgaatccgtgacggctggctctcctctcaccaatcaattttatctggccgctcctcgcggagcatgctacggggcagaccacgatctggggaggctccatccctgcgttatggcaagcctccgcgctcagagtcctatccccaatctctatctcaccggtcaggatatcttcacctgtgggctcgtgggagctctgcagggcgcactcctgtgcagttctgcaatactcaaacggaatctctattccgatctgaagaatttggattcccgaatcagggctcagaagaagaagaattag

SEQ ID NO: 53521 - DNA, 1650 bp, Artificial Sequence
  Description of Artificial Sequence: Synthetic coding sequence
atgtggcttcccttagtcctgctgctcgccgtcctacttctggccgttctgtgtaaagtgtacctcggattgttttcagggtcttcccctaatccttttagcgaagacgttaaacggccaccggctcccctcgtcacagataaggaggccagaaagaaagtgcttaagcaaggtatccattacattggcagaatggaagaaggttcaataggacggtttattttagatcagatcacagaagggcaactagattgggcaccgctgagctccccctttgacataatggtgcttgagggtcccaatgggagaaaagagtacccgatgtactcaggagagaaagcctacatccagggactgaaagagaagtttccacaggaagaagctattatcgataagtacatcaaacttgtgaaagttgtgtcttcaggggctcctcacgctatcctgctgaaattcctcccattaccagttgtgcagctcctcgatagatgcggtcttttgaccagattctccccgttcctgcaggcatccacccagtccttggccgaagtgttgcaacagctcggtgcctcgtcagagcttcaggcggtgctgtcttacattttccccacttatggggttacacctaaccacagtgccttctctatgcatgctttgttggtcaatcactatatgaagggaggcttctatcctcgcggtggaagcagtgagatagccttccacacaatacccgtcatccagagagcaggcggtgccgtcttaaccaaagctaccgttcaaagcgtgttgcttgattctgcgggtaaggcatgtggggtgtcagtaaaaaagggccacgagctcgtgaacatttattgtccgatcgtggtgtccaatgctggcctgttcaacacctacgagcaccttctgcccggaaacgccagatgcctgcccggtgtcaagcagcagttgggcaccgtgaggccaggactgggcatgacatccgtgtttatttgtttgaggggcaccaaggaagatctgcatttgccaagcaccaactactacgtttactatgatactgacatggaccaggcaatggaacggtatgtgtccatgccccgagaggaggcggcagagcatataccacttctgttcttcgctttcccttccgcaaaggacccgacatgggaggaccgctttcctggacgctcaacaatgattatgcttatacctactgcgtatgaatggttcgaagaatggcaagccgaactgaaaggcaagagaggctccgactacgagacattcaagaactccttcgtagaagcctccatgagtgtggtgttgaagctgtttccgcagcttgagggcaaggtggaaagcgttaccgctggcagccccctcaccaaccagttctacctggccgcaccgaggggcgcttgttacggtgccgaccatgatctgggccgactgcatccctgcgtgatggccagcctgagagctcagagcccaatccctaacctgtacttaactgggcaggacatattcacctgcggcctggttggggctttgcagggggctctattgtgcagttcggccattctcaaacggaatctgtatagcgacctcaaaaacctggattcccgaatacgcgctcagaagaaaaaaaactag

SEQ ID NO: 53522 - DNA, 699 bp, Artificial Sequence
  Description of Artificial Sequence: Synthetic coding sequence
atgaaagaaaggagagctccccagcccgtggtggccagatgcaagctcgtccttgttggagatgttcagtgcggcaagacggccatgttgcaggttctggcaaaagattgctacccggaaacctatgtgcctaccgtctttgaaaactataccgcatgcctcgagactgaagagcagcgggtggaactcagcttatgggataccagcggctctccttattatgacaatgtgcgccctctttgttattcagacagtgatgctgtgttgctgtgcttcgatattagtcgacctgaaacagtggacagcgccttgaagaaatggagaacagaaattttggactactgcccgagcactagagtgctgctgatcggctgcaagaccgatctccgaacagatctgtccaccttgatggagctctcacaccagaaacaggccccaatctcctacgagcagggatgcgccatcgctaagcagctcggggctgagatctacctggaaggctctgcctttacttccgagaagtcaatccactcaatcttccggacggcttcaatgctgtgcctgaacaaaccaagccctctccctcagaaaagtcctgtgaggtccctcagcaaacgcctgctccatctgccgagcaggtcagagctgatctcgagtacctttaagaaggagaaggctaaatcctgtagcatcatgtag

SEQ ID NO: 53523 - DNA, 381 bp, Artificial Sequence
  Description of Artificial Sequence: Synthetic coding sequence
tggagaacggagattctagactactgcccttccactagggtgttgctgatcggatgtaaaaccgatcttcggactgatctgtccacccttatggagctgtcccaccagaagcaggctcccatttcctatgaacagggctgcgcgattgctaagcagctgggtgccgagatctacttggaaggttctgcattcacttctgagaagagtatacacagcatatttagaactgccagcatgttatgccttaataaaccgtcacctcttccacaaaagtcacccgtgcgctcattaagtaagcgcctgctgcacctcccgagccgatccgagctgatcagtagcaccttcaagaaggagaaagctaagagttgtagcatcatgtag

SEQ ID NO: 53524 - DNA, 924 bp, Artificial Sequence
  Description of Artificial Sequence: Synthetic coding sequence
atgacaaaagcaggatccaaaggcggaaacttgcgtgacaagctcgacggaaacgagttggatttgagcttgtccgatctaaatgaggtgccagtgaaagaactggcagcattgccaaaggccaccatactcgaccttagttgtaacaagttaactaccttgccttctgatttttgtggcttgactcacctcgttaagctcgacctgtccaaaaataaactacagcagctgcccgctgatttcgggaggctcgtcaacctacagcatctggatctgctgaacaataagctggtgaccttaccagtaagcttcgcccaattgaaaaatttgaagtggctagatctgaaagataaccctctggaccccgtgctagcaaaggtcgctggagattgcctcgacgagaaacaatgcaagcagtgcgcaaacaaggtcctccagcatatgaaagcagtccaggcagatcaagagagggagaggcaaaggagactggaagtcgaacgggaggccgagaagaaacgcgaggcaaaacagcgtgccaaagaggcacaagagagggaattaagaaagagagagaaggccgaggagaaagagcggagacggaaggagtatgatgcgctgaaagcagccaaacgagagcaggaaaagaaaccaaagaaggaggctaatcaggcacctaagagcaaatcagggagccggcctagaaaacctcccccacggaaacatacccggtcatgggccgtgttgaagcttcttttgctcctgcttctcttcggtgtcgcaggaggactggtggcatgccgggttaccgaactccagcaacagcccctgtgtacctcagtgaataccatttacgataacgctgtccaggggctcaggagacacgagatcttacaatgggtgctgcagacggacagccagcagtag

SEQ ID NO: 53525 - DNA, 687 bp, Artificial Sequence
  Description of Artificial Sequence: Synthetic coding sequence
atggaaggccagtccggaagatgtaaaattgtagtcgtgggcgatgccgagtgcggcaagaccgccctgctgcaggtctttgccaaagatgcctacccaggctcttatgtacctactgtgttcgaaaactacactgcatcattcgagatagacaaacggcgtatagagctgaacatgtgggacacaagcggcagcagctattatgacaatgtcaggccactagcctatcccgatagcgatgccgtgcttatctgcttcgacatctccagacctgagaccctcgacagtgtgctgaagaagtggcaaggggaaacacaagagttttgtccaaacgccaaggtcgtactcgtcgggtgcaagctcgacatgcgtacagacttggctaccttgagggaactgtccaaacagagactcatccctgtgacacatgaacaggttgggaccgtgctggccaaacaggtcggcgctgtttcctatgtggaatgttccagcagatctagtgaacgtagcgtacgagacgtttttcacgtagccactgtggcaagtctagggaggggccatcgccagctcagacgaactgactcccgtcggggtatgcagcgatccgctcagttgtctggcaggcctgaccgtggtaatgaaggcgaaattcacaaagatcgggctaaaagttgcaacctcatgtag

SEQ ID NO: 53526 - DNA, 684 bp, Artificial Sequence
  Description of Artificial Sequence: Synthetic coding sequence
atggagggacagagtgggcgttgcaagatagtcgtcgtcggcgacgcagaatgcggaaagacagctctcttgcaggtcttcgcaaaagacgcttaccccggaagctacgtgcctacagttttcgaaaattacacagcatccttcgaaatcgacaaaagaagaatagaattaaatatgtgggatacaagtggcagcagctactatgacaatgtccgcccattagcctatcccgacagtgatgccgtactcatttgcttcgacattagcaggcccgagactctcgattcggtcttaaagaagtggcagggtgaaacacaggaattctgccccaacgctaaagttgtattagtgggctgcaagctggatatgaggactgatctggccacccttagggaactcagtaagcagaggttaatccctgttacacacgagcaaggcaccgtgcttgccaagcaggtgggcgcagtctcttacgtggaatgctcaagtaggagctccgagcggtccgtccgagatgtcttccatgtcgcaacagtggcatccctcgggcgaggccatcgccagttacggagaactgacagtcgcagaggcatgcagcggtccgcacagctctccggccgtcctgacagaggaaacgagggtgagatacacaaagaccgggctaaaagctgtaacctgatgtag

SEQ ID NO: 53527 - DNA, 6264 bp, Artificial Sequence
  Description of Artificial Sequence: Synthetic coding sequence
atggagaccgagtccgagtcgagcaccctgggcgacgatagcgtattttggctggaatctgaagtgattatccaggtgaccgactgcgaggaagaagagagggaagaaaaattccgaaaaatgaagtcttctgtacatagcgaggaagatgattttgttccggaattgcacaggaacgtccaccctagggagaggcccgattgggaggagacactctctgccatggctaggggggctgacgtccccgagattccaggagatctgaccctcaagacttgtgggtccaccgcctccatgaaggtgaagcacgtaaagaagttgccattcaccaagggacactttccgaaaatggccgagtgtgcgcacttccactacgagaatgttgaattcggatcaatccagctctccctgagtgaagagcagaatgaagtgatgaagaacggttgcgaatctaaagaattggtatatctggtgcagatcgcttgtcaaggaaagtcctggattgtgaagagaagttacgaggattttcgcgtattggacaaacacctccacctctgtatttacgacagacggtttagccagctgtccgaactgccacggtcagataccctaaaagattcccccgaatcggtcactcaaatgctgatggcttatttatctcggttgtcagcaatcgccggaaacaaaatcaactgcggaccagcactgacatggatggaaattgataataaaggcaaccatcttctggtccacgaggagtcatccatcaatacaccagccgtgggggcagcccatgtgatcaagcggtacaccgcacgggcaccagacgagctgacacttgaggtgggcgacatcgtgtccgtcattgacatgcccccaaaggtgttgtcgacctggtggcgcggtaagcacgggtttcaggtgggactttttcccggtcactgcgtggagttgattaatcaaaaagtcccacagtcagtcaccaattctgtgcccaagccggtaagcaaaaagcacggaaagttgataaccttcctgcgcacttttatgaaaagccggcctacaaaacagaaactgaagcaacgaggaattttaaaagaaagggtgtttggctgcgacttaggagagcacctgttaaattccggtttcgaggtgcctcaggtgctgcagtcctgtaccgctttcatcgaacggtatggtatagtagacggaatctatcggctgtccggagtcgcgagcaacatccagcgactgaggcacgagtttgactccgaacacgtgccggacctgaccaaggagccatatgttcaggatatccattccgtgggttctctgtgcaaactgtatttccgcgagttaccaaatccactgctgacctatcaactctacgagaagtttagcgacgcagtgtctgcggcaactgacgaagagcggctgatcaaaattcatgacgtcatacagcagttgccccctccccactaccggaccctagagtttctgatgagacacctgagcttgctggccgactactgttccattacaaacatgcacgctaagaatctcgctatagtgtgggcccctaacttactgaggtctaaacaaattgagtctgcatgcttctctggaactgccgcatttatggaggtcaggatacagagcgtggttgtcgagttcatcctaaaccatgtggacgtgctattcagcgggagaattagcatggccatgcaggaaggggctgcaagcctaagtagaccaaagtctctcttggtttccagcccctccacaaagttgttgactctggaggaagcccaggccaggactcaggcccaggtgaactcccctatcgtgaccgaaaacaagtatatcgaagtcggagaaggaccagccgcactacaaggtaagttccatactatcatcgaattcccactggaacggaaaagaccccaaaacaaaatgaagaagagccccgtggggtcgtggagaagcttttttaatctaggtaagtcctcctcagtgtctaagcggaaactacagaggaatgagagcgagccatctgagatgaaagcgatggcgttaaaaggaggacgagcagaaggaactcttcgctctgcgaagtcagaggagtccttgactagcctgcacgcagtcgacggggactctaagttgtttcgcccacgccgacctagaagtagcagtgatgcccttagcgcgagctttaatggcgaaatgcttgggaaccggtgtaattcttatgacaatctgccccacgataacgaatccgaggaagaaggaggcctcctccacatccccgctctgatgtccccacacagcgccgaggacgtggacctttcaccgccagacatcggggtggcgtcactggatttcgatcctatgagctttcaatgttcacctcctaaggccgagtcggagtgcctggaatccggggcaagctttctggatagcccgggttacagcaaggacaagccgtccgccaacaaaaaggacgctgaaacggggagttcacagtgccagacacctggctccacagcaagttccgagcctgtaagtcccctgcaagagaaacttagtcccttctttaccctggatttgagtcctacggaagataaatcttctaaacctagcagcttcactgaaaaagtcgtatacgcattctctcccaagatcggtcgtaaacttagtaaatccccatcgatgagcattagcgaaccgatttctgtcacactgcctcccagagtgtctgaagttatcggcacggttagcaataccaccgcccagaacgcttctagtagtacgtgggataagtgcgtggaggaacgcgatgctaccaaccgtagtcctacccagattgtcaagatgaaaacgaacgaaactgttgcgcaagaggcctacgagtctgaagtgcagccattggaccaggtggctgccgaggaagttgaactgcccggaaaagaagatcagtctgtatcctctagtcagtccaaggctgtagcgagcggccaaacccagacgggcgcagtgacacatgaccctccacaggatagcgtgcctgtctcgtccgtaagtttgatcccaccaccaccgccaccaaagaacgtcgcccgaatgttggcgctggcactagccgaaagtgctcagcaggccagcactcaaagtctcaagcggccaggtacatcccaagccggatacaccaattatggggacatcgccgtcgctacgaccgaggacaacttaagctccagttacagtgcggtggcactcgacaaggcctattttcaaactgaccgccctgcggagcagtttcacttacaaaacaatgcacccggaaactgcgaccacccgcttcccgaaacaaccgccaccggcgaccccacgcatagcaacaccactgagtccggggagcaacaccatcaggtggacctcacagggaaccagccccaccaggcctaccttagcggggaccctgaaaaggcaaggattaccagcgtgcccctggatagcgagaagtcagatgatcatgtatcattcccagaagatcagtccggcaaaaattccatgcccacagtttcattcctggatcaggatcaaagcccaccccgattttactcaggggaccagcctccaagctacttgggcgcaagcgtcgacaaactccatcaccccctggagtttgccgacaagtcccctaccccaccaaatcttccaagcgacaagatttaccctccatccggctctccagaagaaaataccagtacagcaacaatgacttacatgacaaccacaccagccacagcccagatgtccacgaaagaagcttcctgggacgtggccgagcagcctaccactgcagactttgctgccgcaacacttcagcgtacccaccggaccaacagacctttgccgcctccgccttcccagagatccgctgaacaaccgccagtcgttgggcaggtacaggccgctaccaatatcggattgaataactcacataaagtgcagggtgttgtccccgttccagagcgacccccagaacccagggccatggatgaccctgccagcgcttttatttctgattccggagctgcagccgctcaatgccctatggctacggcggttcagccgggactgccggaaaaggtgagagacggagccagggtgcctctgctccacctccgggctgagagcgtccctgcccacccctgcggattccctgcccctctgcctccaactaggatgatggagagtaagatgatcgccgcaatacactcatcatccgccgacgccaccagctcttccaactaccacagctttgtaacagcctcatctactagcgtggacgatgccctgcctctcccccttccggtcccgcagcccaaacatgcaagtcaaaaaactgtttactctagcttcgccaggcctgacgtgacaacggagccattcggcccagacaactgcctccatttcaatatgacccccaattgccagtatcgcccacagagcgttccaccccaccataacaaactggagcagcaccaagtttacggggctcgcagtgagccccctgccagcatgggactccgttacaatacttatgtggcgcctggccgaaatgcctctggccaccattctaagccgtgttcacgagtggaatatgtatcgtcactgagttcctcagtgagaaatacctgctatcctgaagacattcccccttatccaaccattcgacgcgtgcagagtctgcatgctccaccctcctcaatgatacggagcgtcccaatttcacgcacagaagtgcctcccgatgacgagcctgcttactgcccacggccattgtatcagtataagccttatcagtctagtcaggcaaggtctgactatcacgtgacacagcttcagccttacttcgaaaacgggagggtccactaccgatacagcccgtactcgtcttcgtcctcttcatattattcgccagacggggctttatgcgacgtcgatgcgtacggaaccgttcagctccgacctttgcatcgcctgcccaatcgcgatttcgcgttctacaatcccaggctgcaggggaaaagcctttactcatacgccggtttggctcctcgcccacgcgctaacgtgaccggctacttctcgcctaacgatcacaatgtagtgagtatgcccccagcagcagacgtcaagcatacctatacgtcttgggacctggaagacatggagaagtaccgtatgcagtctatccgcagggagtcacgtgcaaggcagaaggttaaaggaccggtgatgagtcagtatgataatatgacacctgcagttcaggatgaccttgggggaatctatgttatccacttgagatctaaatctgatcctggcaaaactggcctactgagtgtcgcggaaggcaaggaaagcaggcatgcagctaaggcaatctccccagagggtgaggatcgtttttaccggaggcatccggaggccgagatggatagggcccaccatcacggcggacacggatctacacaaccagagaaaccaagcttacctcagaaacagagttcgctgcggtcacggaagttgccagatatggggtgttctctccccgagcatagggcccaccaagaagcctcccaccgccagttctgtgaaagtaaaaatggacctccatacccacaaggagctggccagttggattacggcagtaaaggaataccggacacgtcagagcccgtgagctaccataacagtggagtgaagtacgctgctagcggccaagagtctctgcgcctgaatcataaggaggtaaggctgtctaaagagatggagcggccttgggtgcgacagccatccgccccagagaagcattcacgcgattgctataaagaggaggagcatttgacacagtctattgtgcctccccctaagccggagcgaagccacagcctgaaactacaccacacgcagaatgttgaacgagatccgagcgtactgtatcaataccaacctcacggcaagcgtcagtctagtgtgaccgtggtgtcccagtacgacaacttggaagactatcacagtctgccccagcatcagaggggcgtttttggagggggagggatggggacatatgtccccccaggcttccctcatccacaatctaggacttacgctacagcattaggccagggggctttcctgccggcagaactcagtctccagcatcccgagacacaaattcacgctgagtat

SEQ ID NO: 53528 - DNA, 969 bp, Artificial Sequence
  Description of Artificial Sequence: Synthetic coding sequence
atgcctccaaaagttctttccacctggtggcgaggaaagcacggcttccaagtcggcctgtttccaggacactgtgtggagctcatcaatcagaaagtgccacagtcggtgaccaatagcgtgccgaaaccagtcagcaaaaagcacggcaagttgattactttcttgcgcacattcatgaaatcccgcccaaccaagcaaaagctcaagcagcggggaattctgaaggaacgggtttttggatgcgacttaggagagcacctgttaaatagcggcttcgaggtgccacaagtgctccagagctgtaccgcattcattgagcgctacggaattgtggacgggatttaccggctgtccggagtggcttccaacatccagagactgaggcacgaattcgacagcgaacacgtgcctgatctgaccaaagaaccttatgtacaggacattcacagtgtgggtagtctatgtaagctgtatttccgggagctgccaaatccccttctgacataccaactatatgaaaagttcagcgacgctgtgtccgccgcaacagatgaagagcgactgattaagatccatgatgtgattcagcagttaccaccaccccattacaggacactcgagttcctcatgaggcacttgtctctcttggctgattactgcagtattacaaatatgcacgcaaagaatcttgcaattgtttgggcaccaaatttgctacggagcaaacagatcgaatcggcctgtttcagcgggactgccgctttcatggaggttaggatccaatcagtggtggtcgaattcattcttaaccatgttgatgtcctcttgcctcacttcagcgccagaacagaacttatcgtgccctttcccttgcgattaccgagaaaacagttcacaccacccctgttaggacccatgtcccccctgaaccccttagtccagataaccgtgtgtatttctatctag

SEQ ID NO: 53529 - DNA, 2865 bp, Artificial Sequence
  Description of Artificial Sequence: Synthetic coding sequence
gattacgaggaaactagtaaaaaggaagcacgaggcgctgacgtgcctgagatccctggcgatctgaccctaaaaacgtgtggaagcacagctagtatgaaagtaaagcatgtcaagaaacttccttttaccaagggccactttccaaagatggccgagtgcgcacatttccactatgaaaacgtagagtttgggtcaattcagctgtccctttcagaggaacagaacgaggtaatgaagaatggctgtgagagcaaggaacttgtttacctagtccaaattgcctgtcaggggaagtcgtggatcgtaaagaggtcttacgaggactttcgcgtgctggataagcatttgcacttgtgcatttacgaccgcagattctctcagctgtcagaacttcctcgtagcgatacgctgaaagacagccctgagtctgtaacacagatgttaatggcatatctgagcagactgtcggccatcgctggaaataagatcaactgcggtccggcactgacttggatggagatcgacaacaaagggaaccaccttctcgtccacgaggaatcttctatcaatacccccgctgtgggtgctgcacatgtgattaagagatacacagcgagagcacccgatgagctgacgctagaggttggtgacatagtatcagtcatcgacatgccaccaaaggtgctttccacatggtggcgagggaagcatggattccaggtcggcctcttcccgggacactgtgtggagttgattaaccagaaagtgccccagtccgtgacaaactccgtgcccaagccagtatctaagaaacacggaaagctgattactttcctccggacctttatgaaaagcagaccaactaagcagaagctgaagcaaagagggatcctgaaggagcgcgtatttggatgtgaccttggggagcatttactgaacagcggctttgaggtaccgcaggtgttgcagtcctgcacagcgttcatagagagatatgggatcgttgatggcatatacagacttagcggggtggctagcaacattcagaggctcagacacgagtttgattccgagcacgtgccagacctcacaaaagaaccctatgtacaggatatccatagtgtaggctctctatgcaagctgtacttcagagagcttccgaacccgctccttacttatcagctgtatgagaagttttccgatgccgttagcgcagccaccgatgaggagaggctcataaagattcatgatgtcatccagcagttgccaccaccccactaccggactttagagttcctgatgagacacctgagcttactggcggattactgtagcatcaccaacatgcacgccaagaacctcgccatagtttgggcaccgaacttactgcggagcaagcagattgagtctgcctgcttctccggcactgcggcatttatggaagtgagaatccaatccgtggtcgtggagttcatacttaatcacgtcgatgttctgttctcggggaggatatcaatggccatgcaggaaggtgcagcaagtttaagcaggcctaaaagtctcttagtcagctctcccagcactaaattactgaccctcgaggaagcccaagccagaacacaggctcaagtcaattcaccaattgtgactgaaaataagtacatcgaagtaggtgaaggcccagcggcactccagggtaagtttcataccatcatcgagttccctttagagcggaaacgtcctcagaataaaatgaagaagagccctgtgggctcttggagatccttcttcaatctcgggaagagctccagcgtgtcaaagcggaaactgcagcgaaatgaatccgagccatctgagatgaaagccatggcgttgaaaggcggaagagccgagggcacactgcgctcagccaagtcagaagaaagcctcacttcccttcatgcagtggacggcgactcgaagctgtttcgaccgaggcggcctagatctagttccgacgccctgagcgccagctttaacggggagatgcttggcaatcgttgcaattcttacgacaatctgccccacgacaatgaaagcgaggaagagggcggactactgcacatccctgcattaatgtcacctcactcagcagaggatgtagatctgagtccgcctgatattggggtagcttcactcgattttgatcctatgagttttcagtgctcccctcccaaagcggaatccgagtgtctagagtccggcgcatcattcctggactctcctggatatagcaaagacaaaccttctgctaacaagaaagacgctgagactggatcttcacagtgtcagacccctggcagcacagcttcttctgaacctgttagtcccttacaggagaagctttcccccttcttcaccctcgacctgtcacctactgaggataagagttccaaaccatcctcatttacggaaaaggtcgtatatgccttttccccgaaaattggcagaaagctgagtaagtctccctccatgtccatttctgaaccaatcagcgtcactctgccccctcgagtgtctgaggtgattgggacggtgagcaataccaccgctcagaacgcctcttcctctacttgggacaaatgcgttgaagagagagacgccaccaaccgctccccgacacaaatcgtgaaaatgaaaacaaatgagacagtggcacaggaggcatacgaaagcgaagtacaaccccttgaccaggtggctgccgaagaggtggagttgccagggaaagaagatcaatctgttagttcctcacagagtaaggcagttgcgtcagggcaaactcagacagggacagtctgctttcctccattctttctctag

SEQ ID NO: 53530 - DNA, 5216 bp, Artificial Sequence
  Description of Artificial Sequence: Synthetic coding sequence
atgaagtccagacctacaaagcagaaattgaaacagcgcggtattttgaaggaaagagtattcgggtgcgatctcggtgagcatctgctgaactctggtttcgaggttccacaagtgctgcagtcatgtacagcctttatcgaacggtacgggatcgtcgacggcatttatcgactctccggcgtggcaagcaacattcagcgtctgcgccacgaattcgatagcgagcatgtgcccgatcttacaaaggagccatacgttcaagatatccacagtgtcgggtccctgtgtaaactctacttcagggaactcccaaatccgttgttgacctatcaactatatgagaagttcagcgatgcagtatcagctgcgaccgatgaagagaggcttatcaaaatccatgatgtgatccagcagctaccacctccccactacaggacgctggagttcctcatgcgtcacctgtcattactggctgactactgcagcattaccaatatgcacgccaaaaacctggccatcgtctgggcgcctaacctgctacggtctaaacagatcgagtccgcctgtttttctggcaccgccgcttttatggaggtgaggatacagtctgtcgtcgtggagttcatacttaatcacgttgatgtgttattctcaggccgaatatctatggccatgcaggagggtgccgcttcattgtcgcgtccaaaatccctgcttgtgagcagcccaagcacaaaacttttgaccctggaggaagcccaagctaggacacaggcgcaagtgaacagccccatcgtgacggagaataagtacattgaagttggggaaggccctgccgcactgcaggggaaattccatacaataattgaattcccactggagcgtaaacgcccacagaacaaaatgaaaaagtcacccgtgggttcttggagatccttttttaatctgggcaagtccagcagcgttagtaagcgaaaactccagcgcaacgagtccgaacctagtgaaatgaaggctatggccttgaaggggggacgggcagaggggaccctgaggagtgcaaaatccgaagagagcctcaccagcctgcatgcagtggatggagattcaaaactgtttcgcccacgcagaccccgtagctcttctgacgccctctcggcttctttcaatggagaaatgctggggaatcggtgcaattcctacgataacctaccacacgacaacgaaagcgaagaggagggcggactgttgcacatcccagcgctcatgtcaccccacagcgcagaagatgtcgacctctcccctccggatattggagtcgcaagcctcgatttcgacccgatgagtttccaatgctcacctccgaaagcggaaagtgaatgtcttgagtcaggggcttcctttcttgacagcccaggctactctaaggataaaccaagcgcaaataagaaggatgccgaaaccgggtcttcccagtgccaaaccccagggtcaacagcaagttccgagcccgtgagtccattacaggagaaactcagtccattcttcacactggatttgtcacctactgaagataaatcatcaaaaccttcttctttcactgagaaggtcgtatacgcattcagccctaagattggtcgtaagttgtccaaatctccatctatgagcattagcgaacctatctctgtgactctgccccctcgagtctctgaagtcatcggaactgtttcgaatactacagcccagaacgcaagctcctctacttgggataaatgcgtggaggaacgggacgcaaccaaccgatctccaactcagattgtgaagatgaagactaacgagaccgtagcacaggaggcctacgagagtgaggtccagccgttggatcaagttgccgctgaagaagtggagctaccaggcaaggaagatcagtcggtgtcttcttctcagtcgaaggcagtcgccagtgggcagacacagactggggcagttactcatgacccaccccaggactcagtgcctgttagctcggtgtcccttatccctccccctcctcctcccaaaaatgttgcacggatgctcgctctcgccctggcagagtcagcacagcaggcttcgacacagagcttgaaacgaccgggaacaagccaggcaggatacaccaattatggtgacatcgcagtcgctacaactgaagataacctgtcatcctcctactctgcagtcgctctggacaaagcctatttccagaccgatagacccgcagaacagtttcacctgcagaacaatgcacctggcaactgtgatcaccctctgcccgagaccaccgccacaggggacccgacccacagcaatacaaccgagagcggcgaacaacaccatcaggtagatctgaccggaaatcaaccgcaccaagcctacttatcgggcgaccccgaaaaggctagaatcacaagcgtgccgctcgatagtgagaagtccgacgaccacgtatcatttcccgaggatcagtccggcaagaacagcatgccgaccgtgtcattcctggaccaggatcagagtccccctaggttctattcgggggaccagcccccttcttatctcggcgcttccgtggacaaacttcatcacccactggaatttgccgacaagagccctacaccccctaacctgccatctgacaaaatctaccccccatcgggatccccggaggaaaatacatctacagcgacaatgacttatatgacaacgaccccagcaacggcgcagatgtcaaccaaggaggcttcttgggacgtagccgagcagccgacaactgccgatttcgccgctgctactctgcagaggacacatcggaccaacaggccactgccgcctcctccctctcagcgcagtgccgagcagcctcctgtggtaggacaggtacaggctgccaccaacataggactcaacaactcccataaagtgcagggagtggtgcccgtacccgagaggcctcctgagcccagggcaatggatgaccccgcatccgcgtttatttccgatagcggagcagctgctgcccagtgtcctatggcgacagctgtgcagcccggactcccagagaaagtgcgagacggagccagagttcccctgcttcatctgagagcagaaagcgtgccagctcacccctgcggattccctgcccctctccctcctacccgcatgatggaatccaagatgatcgccgctattcactcgtcttccgccgacgctacatcatcctccaactaccactcgtttgtgactgctagctcaacaagtgttgatgacgctctgcctttgccactacctgtcccccagcccaagcacgcatctcagaagactgtatatagtagcttcgcaagacctgatgtgaccaccgaaccctttggaccggataactgcttgcattttaatatgactcccaattgccaatatcgccctcaatccgtgccccctcaccataacaagcttgagcagcaccaagtatatggcgctaggtcagagccgcctgccagtatgggcctccggtacaatacctatgtggcacccggtaggaacgcatctgggcaccatagcaaaccttgttcacgtgtcgagtacgtgtctagcctgagtagctcggtgcgcaacacttgctatccagaggacatccccccttacccgaccattcgcagagtccaaagcctgcacgccccaccttcttctatgattagatcggtgcccatctccaggactgaggtgccccctgacgatgaacccgcatactgtcccagaccattataccagtataagccttatcagagtagccaggccagatccgactatcacgtgacccagctgcagccatactttgagaatggtcgggtgcactatagatactctccttattccagttcaagctcatcctactacagtcctgacggtgcgctttgcgacgtggacgcctatggaacagtgcaactccgtccattacatcgactgcccaaccgcgacttcgccttctacaacccaaggctgcaggggaaatctctgtacagctatgctggactagccccacgtccacgggctaatgttactggttacttttcacccaacgaccataatgtggtgtccatgcccccagccgcagacgtgaagcacacgtacacttcctgggatctggaggacatggagaaataccgaatgcagagcatccggagggagagccgcgctagacagaaggtgaagggcccagttatgtcccagtatgacaatatgacacccgcagtgcaagatgatctggggggtatatacgtcattcatctgcgttccaagtctgatcctgggaagactggcttgctcagcgtcgcagagggcaaagagagccgccacgccgctaaggcaatttcccccgagggagaggatcgcttttacagaaggcacccagaggccgagatggatagagcgcaccaccatggcggacatggcagtacccaacccgaaaagccgagcttgccgcaaaaacaatctagcctccgcagccggaaactgccagacatgggatgttctctgccagaacatagggcacaccaagaggccagccaccggcaattctgtgagagcaaaaatgggcctccttaccctcagggggcaggacagctggactatggatcaaaggggatccccgacacttctgagcccgtatcctatcataatagcggggtaaaatacgcagcctctggccaagagagcctcaggctgaatcacaaggaagtaaggctgtctaaagaaatggagagaccttgggtgaggcagccttccgctccggaaaaacattctcgcgactgttataaggaggaagaacacctgacgcagtccatcgtgccccctcccaaacccgagagatcacatagtctgaaacttcaccatactcaaaacgtggagcgggatcccagcgtcctctaccagtatcagccccatgggaagcggcagagctcagtcacagtggtatctcaatatgataatctggaagactaccattctctgccacaacaccaacggggtgtgttcgggggtgggggtatggggacctatgtcccacctggcttcccccatccccagagtcgaacttacgctactgcccttggtcagggcgctttccttccggcagaactgtcgcttcaacatcccgagacccagatccacgccgaata

SEQ ID NO: 53531 - DNA, 2841 bp, Artificial Sequence
  Description of Artificial Sequence: Synthetic coding sequence
atggcagcacacgggaagctacgccgagaaagggggctccaggctgagtacgagacacaggtcaaggaaatgagatggcagctgtcggaacagctccgctgcctggaactacagggcgagctgcggagagagctacttcaggagctcgctgaatttatgaggcggcgagcggaggtggaactggagtattctcggggactggaaaagctcgccgagcgttttagttctagagggggacgcctaggcagttcacgggagcaccaatcttttagaaaagagccaagcctgctttcgcctctccactgttgggcagttttattacaacatacccggcagcagagtagggaaagtgcggctttatccgaagttttggctgggccactcgctcagcgcttatcgcatatcgctgaagacgtcggtagactggtgaaaaaatcacgtgatctagagcagcagttgcaggatgaattattggaggtcgtgtctgagctccaaacagcgaaaaagacctatcaggcatatcatatggaatccgtcaatgccgaagccaaactgcgggaggcagagcgacaggaggagaagagggctggcaggtctgttccaacaactaccgcgggagctacggaggccggacctctccggaagtcatcactaaaaaagggcggtagactcgtggagaagagacaggcgaaatttatggagcataagctcaagtgcaccaaggcgcgaaacgaatacctgctgagcctggccagtgttaatgctgctgttagcaattattatctgcacgatgtgctcgatctgatggattgttgcgacacaggcttccacttagctcttggacaggtcctacgcagctatacagctgcagagagccggacgcaggcttctcaggtgcaaggtctgggctcactggaagaagctgtcgaagctctggacccacccggagataaagccaaggtcctggaagttcacgctacagtgttctgtcccccactccggttcgattaccatcctcacgatggcgatgaggtagctgagatttgcgtagaaatggagctgcgcgatgagattctacccagagctcaaaatattcaaagtaggcttgaccgtcagactattgagactgaggaggtgaataaaaccttaaaagcgactctccaggccctgctcgaagttgtcgcctccgacgacggggatgtcctcgactccttccagaccagtccctcaactgagagcctcaagtcaacctcttctgaccctggctctcgtcaagccggacgacgtagaggccagcagcaggagaccgaaaccttctatctaaccaagctgcaagagtacctctcgggtaggtcgatactggcaaaacttcaagccaagcacgagaagctgcaggaagccttacagcgcggagataaggaggaacaagaggtgtcgtggacccagtacactcaaagaaagttccaaaaatctcgccaacctcgaccgtcatcacagtacaaccagaggctgttcggcggagacatggaaaagttcatccagagctctggccagcccgtccctctggtagtggagtcgtgcattcgctttattaacctcaatgggctgcagcacgaaggaatattccgggtgtccggagcacagctgcgtgtgagcgaaattagagatgctttcgaacgcggagaagatccattagttgaaggctgcaccgcccacgacctagactccgttgccggagttctgaagctttactttcggagtcttgaaccccctctcttccctcctgatctgttcggggaactgctggcctcctccgagctggaggcgacagctgaaagggttgaacacgtttcgcggttgctttggaggctcccggcacctgtcctcgtcgtgctgcgttatttattcacatttttgaaccacctggctcagtactcagatgaaaatatgatggacccttacaatcttgctgtgtgttttggtcctacactattgccagtacccgcaggccaagatccagttgccctacaaggcagagtgaaccagctcgtgcagaccctcattgttcagcctgaccgcgtattcccccctctcacttctttacccggacccgtctacgagaaatgcatggcccctccatccgccagctgccttggggacgctcaactcgaatctctgggagcggataatgaacccgaacttgaagccgaaatgccggcacaagaggatgacttggagggagttgtcgaagctgtggcatgctttgcttatactgggagaacggcgcaggagctcagtttccggcgtggagacgtcctgcgattgcatgagcgagccagcagcgactggtggcgcggtgagcataacggaatgagggggcttattccccacaagtacattacgctgccagccggtacggagaagcaagtcgttggcgcaggccttcagacagccggagagtccggttcctctccggaaggactgttggccagcgaacttgtgcacagaccggagccctgtacctccccagaggcaatgggcccttcaggacatcgcagacgctgcctggtccctgctagtccagagcagcacgtcgaggtggataaggctgttgcccagaatatggatagtgtgttcaaagaactgctgggtaagacgagcgtgcgacaaggcctcggcccagcatctacaacttcacccagccctggacctcgctcgcccaaggctccaccatcgtctagattaggaaggaacaagggtttctcacgcggtccaggtgccccagcgtcgccttcagcatcccatccccagggtctggatactacccctaaaccgcactag

SEQ ID NO: 53532 - DNA, 2778 bp, Artificial Sequence
  Description of Artificial Sequence: Synthetic coding sequence
atggccgctcatggcaaactgagacgcgaacggggactgcaagccgagtacgagacacaagtgaaagagatgaggtggcagctgtcagaacagctcaggtgtcttgaactacagggggaattgagaagagagctgctgcaagagctcgccgaattcatgagacggagggcagaggtggaacttgagtatagtagaggcctggaaaagttggccgagcgattcagctctcgtggtggacgtctgggctccagccgtgaacatcagtcctttcgcaaggagcccagcctactgagccccctccattgctgggcggttcttctccagcacactcgccagcagtctcgtgaatccgccgcactgtctgaagtcctggccggacctctggcccagaggctgagtcatatcgccgaagacgtcggtcgcctggttaagaaagctaaaaaaacttatcaggcctatcacatggagagcgtgaatgccgaggccaaacttagagaagccgagcgtcaagaggagaagagagcaggcagaagcgtgcctaccaccaccgcgggagctaccgaagctgggccactccgcaagtctagcctgaagaagggaggacggctagtggagaaacgccaggctaaattcatggagcataagttaaagtgcaccaaggcgcgaaatgagtatctgttgtcattggcttccgtgaacgccgcagtctctaattattatttgcatgatgtactggaccttatggactgttgtgacacgggctttcacttagcgcttggacaagtgctgcgcagttatacagcagcagagagtcggacccaggcgagtcaagtgcagggactcgggtcactggaggaagccgtagaagcccttgacccacctggcgacaaagcgaaagtgctggaggttcacgccacggtgttctgcccgccactcaggttcgactatcaccctcatgatggcgatgaggtggctgaaatctgtgtcgagatggaattaagagacgaaatcttaccacgcgctcagaacatccagtccaggctggatcggcagactattgagacagaagaggtgaataaaaccttaaaggctaccctgcaggctctgctggaggtggttgccagcgatgacggggacgtgcttgatagctttcagacttccccttccactgagagtcttaagtccacctcctctgaccccggttcaagacaagcaggtagaaggagaggccagcaacaggagacagagaccttttatctcaccaagctgcaggaatatctgtctggtcggtcgatcctggctaaactacaagcaaagcatgagaaactacaggaagccttgcaacggggagataaggaagagcaggaggtttcctggacccaatatacgcagcggaagtttcaaaaatctcggcaacctcgcccttcatctcagtacaatcaacgcctcttcggcggtgacatggaaaaattcattcaatcttctgggcagcctgttcccctagtggttgagagttgtatccgattcattaacctgaatggcctgcagcacgagggtatcttccgcgtgtcaggggctcagctgcgtgtctcagaaatcagagatgcatttgagagaggagaagaccctctcgtcgaaggttgtaccgcacacgatctcgattccgtggcaggggtcttgaagttatatttcagatccctggagccaccactgtttcctccagacctgttcggggaactcctggcttcttcagaactcgaggccacagccgagagggtggaacacgtttctcggcttctgtggaggctgccggctccagtgttagtggtgctgcgatatctctttacttttcttaaccacctggcccagtattccgatgaaaacatgatggacccgtacaatctggccgtgtgcttcggtcctactctcctccccgtaccagccggtcaggacccagtggctctccagggacgggtgaaccagctggtgcagacccttattgtgcagcctgatagggttttccctcctttgacatctctcccaggaccagtgtacgaaaagtgcatggcgcctcctagcgccagctgtctcggagacgcacagctagaaagcctcggggctgataacgagcccgaattagaggcagagatgccagcccaggaggacgatctggaaggcgtagtggaggctgttgcatgttttgcatacactgggagaactgcccaggagcttagctttcgccgtggagacgtccttagacttcatgaaagggctagcagtgattggtggaggggtgagcataacggcatgagaggtctcattccccacaaatacattacactccctgccggaactgaaaagcaagtcgtcggcgctggcctgcagaccgctggtgagtccggcagctccccggagggtttgcttgcatctgaactggtgcaccggccagagccatgtacgagccccgaagccatgggcccatccggccataggcgacggtgtctagtgcctgcttcccccgagcagcatgtcgaagtggacaaagccgttgctcaaaatatggactctgttttcaaagagcttctggggaagacctcggtaaggcagggattagggcctgcttctacgacctcaccatctccgggacctagaagcccaaaagcgcctccctcctctaggcttggacggaacaaagggttttccagagggccaggagctcctgccagcccctcggcgtcccatcctcaggggctcgacaccactcctaaaccacattag

SEQ ID NO: 53533 - DNA, 2961 bp, Artificial Sequence
  Description of Artificial Sequence: Synthetic coding sequence
atggcagcccacgggaaactacggagggagcgaggccttcaagccgagtatgagactcaagttaaggagatgcggtggcagctaagcgagcaacttcgttgtctggaactccaaggggagctccgtcgggaactgctccaggagctggctgagtttatgcgcaggcgggctgaggtggaactggagtacagccgtggcctcgagaagctcgcggagcgcttctcatctagggggggacggctcggttccagtcgggagcaccaatccttccgtaaggagccctccctcttatcacccctgcattgctgggctgtcctgctccaacacacccgccagcagagtagggaaagtgccgctctgtcagaggtgctcgccggacctttggcccagcggctatcccatatcgccgaggatgtcggacgtcttgttaagaaatcccgggacctcgaacagcagcttcaggacgaattgcttgaggttgtgtcagaactccagaccgccaaaaaaacgtatcaagcgtaccacatggagagtgtgaacgctgaagctaaactgcgggaggcagaacggcaagaggaaaaacgggcaggcagatccgtgcctactacaaccgccggagcgacagaagccggacctctgagaaaatcctcgctgaaaaaagggggtagacttgtggaaaaattgtggcccccacagagacctgttgctgcttcttcatgtgcacctgtatgttggctgcaggccggtttcctggtgcacccgccttggtggggggctatgtgtgcacctagtactcaccagaggcaggccaagttcatggaacacaagctcaaatgtacaaaggcaagaaacgaatatctgctctcgctggcttctgttaacgcagccgtgagtaattactatctccacgacgtgttggatcttatggattgttgtgacacaggcttccacctggcgttagggcaggtccttcgctcctatactgccgctgagtctcggactcaagcaagccaagtccaaggactcggaagcctcgaagaggcagtggaggccctggatccccctggggacaaggccaaggttctggaggtgcacgcgacagtcttttgtcccccactccgctttgattaccatccccacgatggtgacgaggtggcggaaatatgcgtcgaaatggagctacgcgatgaaatactgcccagagcccagaatattcagtctagattagatcgccagacgatcgagaccgaggaggtgaataagaccctcaaagcaacactccaggccttgttggaggtggttgctagcgacgacggcgacgtgttggacagctttcaaacaagcccaagcacagagtccttaaagagcactagctcagatcctggcagccgtcaagctggacgcagaagggggcaacaacaggaaactgagaccttttatctgactaaactccaggagtatctgtccggaaggtccattctggctaaactgcaggctaagcacgagaaactgcaagaggccctccagagaggtgacaaggaggagcaggaagtgtcatggacacagtacacccaacgcaagttccagaaatctaggcagcccagaccgtcatcacagtacaaccagaggttgttcggcggagacatggagaagttcatccagagctctgggcagcccgtaccactggtggtcgagagctgtatccgatttatcaacttgaacggactgcagcacgaaggtatttttcgcgtgtccggcgcacaattacgggttagcgaaattagagacgcttttgagcgcggagaagacccactagtggagggttgcaccgcacatgacctcgactccgttgcaggcgtcctcaaactctattttaggagcttggagccaccactgtttcctcctgacctttttggtgaactcctggcttcgtctgagttggaagcaaccgctgagagagttgaacacgtgtctcgcctgctctggcgtttacctgccccagtcctggtagtgcttcgctatctattcaccttccttaatcatctagcgcagtattcagacgagaacatgatggacccttataatctggcagtgtgtttcggaccaactttactcccggtgcctgcaggtcaggaccctgtggctctgcagggccgtgtcaatcagctcgtccagaccctgattgtccaacccgatagagttttcccaccgctaacctctctgcctggcccagtttacgagaaatgcatggcccctccaagtgctagctgtctgggggacgcacagctggagtctctcggcgctgacaatgaaccggagctggaggccgagatgcctgcccaagaggatgatctcgagggcgtagtcgaggctgtcgcatgtttcgcttataccggaagaactgcgcaagaactgtcatttcgacggggtgacgtgcttagattacatgagcgtgcctcgtctgattggtggaggggcgagcacaacgggatgagggggctaattccccacaagtatatcaccctccctgctggaacggagaagcaggtggttggcgctggcctgcagactgccggagaaagcggttccagtcctgagggtctcctagcttctgagctggtacaccggccagagccttgtacttctcctgaggcgatgggaccgagcggacaccgaagacggtgcctggtccccgcttccccggaacagcatgtggaggtggacaaggctgtggcccagaacatggactcagtttttaaggagctcctcgggaagacatccgtgcgtcagggactgggaccagcgtccacaacaagtccaagtcctggacctcgctcccctaaagctcccccttcctctagactaggacgaaacaaggggttcagtagaggccctggcgctcccgctagccccagtgcttcccatccacagggactggacacaacaccaaaacctcactag

SEQ ID NO: 53534 - DNA, 2307 bp, Artificial Sequence
  Description of Artificial Sequence: Synthetic coding sequence
atggccgcacacggcaagttacgcagagaaaggggtctgcaagctgagtatgagacacaggtgaaggaaatgcgatggcagctttcggagcagcttcgctgtttggaactgcagggagagctgcgacgcgagcttcttcaagagctggctgaatttatgcgacggagagccgaggtagaactcgaatattcacgcggactcgagaagttggcggaaagattctctagccggggaggcaggcttggcagttccagagagcaccaaagctttcgaaaggagccaagtctgctcagccccctacactgttgggctgttttattacagcataccaggcaacaatcacgggagtcggccgcactgagtgaagtcctggccggaccactggcacaaagattgagccacatcgctgaagacgtcgggcgactggtcaaaaagtcacgggatctggaacagcagctgcaggacgagctgctagaggttgtatcagagctccagactgtggcggagatatgcgtggaaatggagttgagagatgaaatcctccccagggcccagaatatccagagcaggttagacagacagactatcgagactgaggaagttaacaaaacactgaaggctacactccaggcgctgctggaagtcgtggccagcgacgatggcgacgtcttagatagctttcagacttcaccatctacggagtcccttaagagtacatcatctgacccaggatcaagacaggcaggcaggcggcgtgggcagcagcaagagaccgaaactttttatctgactaagcttcaggaatacctaagcggaaggtccatcctcgccaaattgcaggcgaagcatgaaaagttgcaggaggcactgcagaggggcgacaaagaggagcaggaagtgagctggacccaatacacacagcgaaagtttcagaagtcacggcaacctcgcccatcttcccagtacaaccaaagactgttcggaggagatatggagaaattcatccagagctcaggccagccagtgccactcgtggttgaatcatgtattcgcttcataaatctgaatgggctgcagcacgagggcattttcagggtgagcggggcacagctcagagtaagcgagatcagagatgctttcgaacggggagaggatcctctcgtggaggggtgtaccgcacatgatttagactctgttgccggagtgctgaagctgtactttcggtctctcgagccacctctgttccctcctgatttgtttggggaacttttggcttcctctgagctcgaggctaccgccgagcgggtggaacacgtgtctcgccttctctggaggctccccgcacctgtgcttgtcgtgctccgctatctgttcactttccttaatcatctggcccagtattctgacgaaaacatgatggatccctacaacttggccgtttgcttcggaccgacgctgcttcccgttcccgctggacaggatcccgtggcgctccagggccgtgttaaccagctcgtgcagactttaattgtccagccagaccgggtgtttcctccgctcaccagtctgcctgggcctgtgtacgagaagtgcatggccccacccagcgccagctgtcttggggacgcacaactggagtcgctgggggcagataatgagccggagctggaagctgaaatgcctgctcaagaggacgacctcgagggcgtggtagaggccgttgcctgcttcgcctacactggaagaacagcccaagaactaagtttccgaagaggcgatgtactccgtctccatgaacgcgcttcaagtgactggtggcgcggagagcacaacggcatgagaggactgatcccccacaaatacattacactacccgcaggaacagaaaagcaggttgtcggggcaggactgcaaaccgcaggcgagagcggctcgagccccgagggattactcgcctccgaactggtacaccgtccagagccatgcacatccccagaggccatgggcccatccggccacagacggcgttgcctggtgcccgcaagccccgaacaacacgtagaagtggacaaggctgtggctcagaatatggactccgtcttcaaggagctgctgggcaagacctccgtacgccagggcttggggccagcatcaacaacttctcctagcccaggtcctcgctccccaaaggccccaccatcgtcacggttggggcgaaacaagggcttctctaggggcccaggcgcacccgcatcaccgagcgcatcgcatcctcaggggttggacacgaccccgaaaccgcattag

SEQ ID NO: 53535 - DNA, 2772 bp, Artificial Sequence
  Description of Artificial Sequence: Synthetic coding sequence
atgcggtggcaactgtcagagcagctccgctgtcttgagcttcagggagaactgcggagagagttgctgcaggagctagccgagttcatgagaagaagggccgaggtggagctggaatatagtaggggtctggagaagctggcagagcggtttagtagtcgtgggggacgattaggatcgtctcgcgaacaccagtcctttcgcaaagagccatcacttttgtcacctttgcattgttgggctgtattgctacagcatacaaggcagcagagtcgagaatcagcggctctgtcggaggtgctcgcgggacccctcgcgcagagactgagccacattgcagaagacgtgggacgcctcgtgaagaaatctcgcgacctcgagcagcagctgcaggacgagctcctggaggtggtgtccgagctgcaaacagccaaaaagacctaccaggcgtaccacatggaatcagttaatgcggaggctaaactacgggaagcagaacgccaggaagagaaaagggccggtcggtccgtgccaacaacgaccgcaggcgcaaccgaggctgggcctttgcggaaatcatcgctcaaaaaagggggacgccttgttgaaaagagacaagcgaagtttatggaacacaaattgaaatgtaccaaggctcgaaatgaatatttgctcagtctggcttccgtgaacgctgcagtatcaaattactacctacatgacgtactcgaccttatggattgctgcgatactggtttccacttggctttaggccaggtcctgcgaagctacaccgcagccgaatcccgcacacaagcatctcaggtccaagggcttgggtctttggaagaggctgtcgaagctttggatccccctggagacaaggcgaaagtgctcgaagtacacgccacagtgttttgccctcctctgaggtttgactaccacccccatgacggcgatgaggttgccgaaatatgcgtcgagatggagttgagagacgagattcttcctcgggcacaaaatattcaaagtagattagaccggcagacaatcgaaacagaggaggtgaataaaacgctgaaggccaccctgcaagccctgcttgaagttgtagcctccgacgatggagatgtgctggatagtttccagacctccccatccactgagtctctgaagtcaacatctagcgaccccggatcccgccaggcagggcgtagacggggacagcaacaggagactgaaaccttctacctgactaagctgcaggagtacttgtccggcaggtcaatcctggccaaacttcaggcaaagcatgagaagcttcaggaagcactgcagaggggcgataaagaggagcaggaggtttcatggacacagtacacgcagagaaagttccaaaagtctagacaaccacgcccttccagccagtataaccagagactgttcggaggcgatatggaaaaattcattcaaagctctgggcagcctgtcccactggtggtcgaatcttgcatccggtttattaacctcaatggcctgcagcatgaagggattttccgggtgagcggtgctcagcttcgggtatctgagattagggacgcattcgaacggggtgaagacccactggtcgagggatgtactgcacacgacctggattccgtcgcaggggtactcaaattatatttccggtcgctcgaacctccgctgtttccccctgacctctttggtgagctcctggccagttccgagcttgaggccaccgctgagagggtggagcatgtatccagactactctggcggctgccagccccagttctggtggtactgaggtatctgtttacttttctgaatcacttggcccagtactccgatgaaaatatgatggatccatacaacctcgccgtatgctttggcccaactcttttacccgtcccagctggtcaggatcccgtcgcactgcaggggagagtcaaccaactggttcaaaccctcattgtacagccagatcgagtgtttcctcccctcactagtttgcctgggcctgtgtacgagaaatgtatggcccctccaagtgctagttgcctgggtgacgcgcagctagagtccctgggtgcagataacgagcctgagctggaggctgaaatgcccgctcaggaagacgacctggaaggagtggtagaggctgtggcttgctttgcctacacagggcgtacggcgcaggaacttagcttccggcgaggggacgttcttcggttgcatgaaagagcaagttctgactggtggcgtggcgagcacaacggcatgcggggacttattcctcacaagtatattactcttcccgctggaaccgaaaaacaggtagtcggcgctggactacagacggccggagagtccgggagcagtccggaagggctcctcgcaagtgaattggtgcacagacccgagccatgcaccagccctgaggctatgggaccatcaggacatcggcgacggtgtctcgtgccagccagtcccgaacagcatgtcgaagtcgacaaggcagtggcacagaatatggacagtgtcttcaaggaactgctgggcaaaacttccgttcggcagggcctgggcccagcctccaccaccagcccgagcccaggccctaggtcacccaaagccccaccgagctctaggttgggccgtaacaaggggttttcaaggggccctggagcccctgcatcgccctcggccagccacccacaaggcttggacaccacacctaagccccactag

SEQ ID NO: 53536 - DNA, 2817 bp, Artificial Sequence
  Description of Artificial Sequence: Synthetic coding sequence
atgttccgcaggagaacatgtgggaccgaagcttccctgcggtggtcccatagttcccggtctgaaatccggctgggaagatctgaatccctcaagggacgggaggagatgaaacgctctcgaaaagccgagaacgtgccacggtcacgcagcgatgttgatatggacgcagcagctgaggcaactcgcctccaccagtcagcatcctcctcaacttcctccctgagcacaagatccctcgagaatccaactccacccttcacaccaaagatgggcaggagaagcatcgagtctccctctctggggttttgtactgatactctgcttccacacttgctcgaagatgatctgggccaattgtctgacctggagcccgagcccgatgcacaaaactggcaacataccgtgggtaaagatgtggtggccggactgacacagagggaaattgatcgccaagaggtgattaatgagttatttgttactgaagcatcacatctgcgcactctgcgcgtgctcgatctgatcttttaccagcggatgaagaaagagaatctgatgcccagggaagagctcgccaggctatttcccaatctgcctgagctgatcgagatacataattcctggtgcgaggccatgaaaaaactcagggaggaggggccaataataaaggagattagtgacctgatgctggcgcgttttgatggcccagccagggaggagctacagcaggtggccgctcaattttgttcctaccaaagcattgccctagaattgattaagaccaaacagcgtaaggaatcccgcttccaattgttcatgcaggaggctgaaagccacccccagtgcagaaggctccaattacgggacctcattatcagtgagatgcagcggctgactaaatatcccctcctgctagagtccataattaaacatactgagggaggcacgagcgaacatgagaagctgtgtagagcacgggaccaatgtcgtgagattctgaagtatgtgaatgaggcggtgaagcagaccgagaatcggcacagacttgaaggctaccagaagaggctggacgctaccgccctggaaagggccagcaatccattggccgctgagttcaagtcgctggatctaacaacgaggaaaatgatccatgagggtcctttgacatggagaatctcgaaggacaaaacactggacctacatgtgttgctgcttgaagaccttctggtcctactgcagaagcaggacgagaagctactgctaaagtgtcatagtaaaactgccgttggctcgagcgacagcaaacagacgttttccccagtgctcaaactgaacgccgtactgattcgaagcgtggcaacggataaaagggctttttttataatctgcaccagcaagctagggcctcctcagatttatgagcttgtggccctcaccagcagcgataaaaatacttggatggagctgcttgaggaggcagtcaggaacgctaccagacacccaggggctgcaccaatgccagtgcatcccccaccaccaggcccacgggagcctgcacagcagggccctaccccctctagggtcgagctggacgactcagatgtattccatggagaaccagaaccagaggagcttccaggcggtacgggaagccagcaaagggtacaagggaagcaccaggttttactcgaagaccccgaacaagaaggatctgcggaggaggaggaattaggtgtgctgccatgtcctagcacctcactcgatggggagaatcgcggaattaggaccaggaatcctatccatctggccttccctggaccactgttcatggaaggactcgccgacagcgctcttgaagatgtcgaaaatttaagacatctgatcctctggagcctgctccctggacatactatggaaacacaggccgctcaagagccagaggatgatctgacaccaaccccttcagtcatcagtgtcacttctcatccttgggatcccggtagccctggccaggcccctcccggaggagaaggagacaacacccaattagccggactggagggagagcgtccagagcaagaagatatgggattgtgcagtcttgagcatttgccaccccgaactcgcaactcagggatttgggaatccccagagctcgaccggaacttggcagaggacgcgagttccaccgaggccgcaggcggatacaaagtcgtcagaaaggcagaggtcgcaggttctaaagtggtgcctgcccttcctgaatctggacagagcgagcctgggcctccagaggtagaggggggtactaaagctactggcaattgtttctacgtatctatgcctagcgggcctcccgactcgagcactgatcactcagaggctccgatgtctcctccccaacctgattccctgcctgccggacagaccgagccccaaccccagctacagggtggaaacgacgacccgaggcggccttccagaagcccccctagtctggccttgagagacgttgggatgattttccatacaattgagcagctcacactgaagctgaaccgcctcaaagatatggagctcgcccaccgggaactattaaagtccctgggcggagagagttcggggggtacaactcctgttggcagctttcatactgaagcagctcggtggaccgacggttccctgtccccgccagccaaggagcctctggcgagtgatagtcgaaactcccacgaactggggccatgccccgaagacgggagcgacgcacctttggaagattccacagccgatgcggcagcttcaccaggcccatag

SEQ ID NO: 53537 - DNA, 4569 bp, Artificial Sequence
  Description of Artificial Sequence: Synthetic coding sequence
atgagcgtacgactgccgcaaagcatcgatcggctgtcctccctgtcttcattgggagacagtgctccagagcggaaaagcccatcacaccatcggcagcctagtgatgctagtgagactacaggattagtgcagagatgtgtgatcattcagaaggaccagcacgggtttggcttcaccgtgtccggtgatcgcatagtgctcgttcagagtgtacggccagggggagcggcaatgaaagctggtgtgaaagaaggcgatcggatcatcaaggtgaacggcactatggtcaccaatagcagccatctcgaagttgtgaagctaataaaatcgggtgcctacgtggcactgaccctgctggggagcagtccgagcagtatgggaatctccggcctgcagcaggaccctagccccgcaggagccccaaggataacatccgtgatcccgtcgccacctcctccaccaccactgccacctccccagaggatcaccggcccaaagccgctgcaggatcctgaagtccagaaacacgctacacagattttgcggaatatgttaagacaggaggagaaggaactgcaggatattctgcctctctatggggacacatctcagaggccctctgaagggcgtcttagcctggatagccaggaaggtgattcagggcttgactcagggactgaaagattccctagcctgagcgaaagcctgatgaaccgaaatagtgtgctgagcgatcctgggctcgactcacctcggacaagccccgtgatcatggccagagtggctcagcaccacaggaggcagggatccgatgctgctgttccttccaccggggaccagggggtggatcagagcccaaaacctctgatcataggccctgaagaagactacgatcccggatatttcaacaacgagtctgacatcattttccaggacctcgagaaactgaagagtcgaccggctcacctcggagtgttcctccggtacatctttagccaagcagatccatcacctctcctgttctacctttgcgcagaagtctaccaacaggcatcccccaaggatagccgcagcctgggcaaagacatctggaacatctttcttgaaaaaaacgcccctctccgtgtcaagattcctgaaatgctgcaggctgaaatcgatagcagactgaggaatagcgaggatgctcgaggggttctgtgcgaggcccaagaggctgcgatgccagaaattcaggagcagatccacgactatcgaaccaagagaacactcggcctgggttcgctttacggggagaatgatcttctggacctggacggggatcccctaagagagcgccaggtggcagagaagcagctggcggcactgggggacatcctttcaaagtatgaagaagaccgctctgccccaatggattttgccctcaacacttacatgagccacgcaggtatccgcctgagggaagcaagacccagtaacactgcagagaaggcccagtccgcgcctgacaaggacaagtggctgccattcttccccaaaaccaagaagtctagcaactcaaagaaagagaaagacgctctggaggacaaaaagcggaatcctattctaaagtatatcgggaagcccaagtcttcctcccagtccacctttcacattcccctcagcccagtggaggtgaaacccggaaatgttaggaatattatccaacacttcgagaataaccagcagtacgatgcaccagagccaggcacccagcgtctgagtactggcagtttcccagaagacctcctcgaatcggactcaagccggagcgagatccgactagggaggagtgagagcctgaaagggcgagaagaaatgaaaaggagcagaaaggcagagaatgtaccacgcagcaggagtgacgttgatatggacgcagcggcagaagcaacaagactgcaccaatctgcctccagttctactagtagtctgtcaacacgctctttggaaaaccccacaccacccttcaccccaaagatgggcaggcgatcgattgaaagcccatctcttggtttttgtaccgatactctgctgccgcatctgctggaggatgacctgggccagctctcagacctggagccagaacccgatgctcaaaactggcagcacaccgtcggcaaggatgtcgtcgctggactgacgcaacgcgaaattgacaggcaggaggtgatcaatgaactgttcgtcacggaagcctctcatttgcgtactctgagagtcctggatctcatattctaccagcggatgaaaaaagagaacctgatgcccagggaggagcttgctcggctattccctaatctgcccgaactgattgaaatccacaacagttggtgcgaggccatgaaaaagctgagagaagaagggccaatcattaaggagatcagcgacctaatgctggcacgttttgacggacccgctagagaggagcttcaacaggttgctgcccaattttgtagctaccaatccattgccttagagctgattaagacgaagcagagaaaagaatctaggttccagctgtttatgcaagaggctgaatcccatccacaatgtcgccgtctccagctcagagacctgataatctcggagatgcagcgactgactaagtaccccctcctactggagtcaatcataaaacataccgagggtggaacatccgaacacgagaagctttgtcgcgcaagggatcaatgtcgggaaatccttaagtacgttaacgaggcagtcaagcaaaccgaaaaccgccataggctggaaggctaccaaaagcggctcgacgccactgcactcgaaagggcttctaatccgctcgctgcagagtttaaaagcctcgacctcaccactagaaagatgatccacgagggcccactcacatggcggatttccaaggataaaactttggatttacacgtacttctgctagaagaccttttggtcttgttgcagaagcaagatgagaagctactcctgaagtgccattctaaaacagctgtgggcagtagtgactctaagcaaacatttagcccggtgctaaagctcaacgctgtcctcatccggagcgtggcaacagataaacgagcctttttcatcatctgtactagcaaactgggtccaccccagatctacgaactggtggctctgacctcaagcgataaaaatacctggatggaactgctagaggaggcagtgcggaacgcgactaggcatccaggtgcggcacctatgcctgtgcacccacctcctccaggcccacgggagccagcccaacaagggcctacaccttcccgggtggaactggacgatagcgacgtcttccacggggagcctgaacctgaagaactacccggaggaacgggtagtcagcagagagttcaaggcaaacatcaagtgctgctggaagatcccgagcaggagggttccgcagaggaggaagaactgggagttcttccctgcccgagtaccagcctggatggagaaaatcgaggaattcgtaccagaaaccctatccacctggcttttccaggcccactcttcatggaaggtctggccgatagcgccctggaggatgttgaaaatttacgccacctgattctgtggtcgcttcttccgggtcacactatggagacacaggccgcacaggagcctgaggatgatcttacgcctaccccttcagtgatctcagtgaccagtcacccttgggatccaggaagcccaggccaggcccctccaggtggtgagggcgacaacacacagctcgctggattggaaggcgaaagacctgagcaagaggacatgggcttgtgttcactcgaacatcttccaccaaggacccgcaatagtgggatctgggagagtcccgagctcgacaggaatctggctgaggacgcctccagcacagaggctgctggaggctacaaagtcgtcaggaaagctgaagtcgcaggtagcaaggtggtacctgctctacccgaaagcggtcaatctgaaccaggcccaccagaagttgaaggtggcactaaggccacgggcaactgtttctacgttagcatgccttcaggaccacccgactctagtacagatcatagcgaagcacctatgtctcccccacagcctgatagtctcccggctggacagactgagccccagccacagctacaaggaggcaacgatgatccccgacgtccctcccggtctcccccaagtctggcattaagagacgtggggatgattttccacacaatcgaacagcttactctgaagttgaaccgtttgaaagacatggaactggctcaccgagagctgcttaagtcactgggaggcgaatcttccggcggtaccactccggtgggttctttccatacggaggccgcaaggtggactgacggctcactttctcctccagcaaaggaacctctggccagcgattctagaaactctcacgagctcggcccttgtccagaagacgggagcgatgctcctctggaagatagtacggcagatgcggcagcgagccccggaccttag

SEQ ID NO: 53538 - DNA, 4689 bp, Artificial Sequence
  Description of Artificial Sequence: Synthetic coding sequence
atgagtgttagacttccccagtcgatcgaccggctgtcctcgctttccagcctcggcgattctgccccagagcgcaaatctccttcgcatcaccggcagccatccgatgcctctgaaactacgggcttggtgcaacgatgcgtcattatacagaaggatcagcacgggtttgggtttaccgttagcggggacaggattgtcctagtccagagcgtccgccctggcggtgccgcaatgaaggctggggtgaaggaaggtgaccggattattaaagttaatggcacaatggtgacaaacagcagtcatctggaggtcgtgaagctcataaaaagtggcgcttatgtcgctctgactctgctgggcagtagccccagcagcatgggcatttcagggctgcagcaggaccccagccccgctggtgcaccaaggatcacgtcagttattccttccccacctccgcctcctcctctcccaccccctcaacgtatcacaggtcccaagccccttcaggatccagaagtccaaaagcatgccacgcagattctcagaaatatgctgcggcaggaggaaaaagagcttcaaaggatatgtgaagtttacagcaggaacccggcttccctccttgaagaacaaatcgagggtgcaagaagaagggtgacgcagctgcagttaaaaattcaacaggagactgggggttccgtggacatattgcccctctacggcgatactagccaacggccttccgaaggcaggctctccctcgacagtcaggagggtgattccggactcgattcagggaccgagcgatttccctcactgagcgagtcactgatgaaccggaacagtgtgctctcagacccaggactggactcccccagaacctccccagttataatggccagagttgcccagcaccataggaggcagggctcagacgccgctgtgccaagcaccggggaccaaggcgtggaccagagtccaaaaccactgattattggccctgaggaagactatgaccctggatatttcaataacgagagcgatatcatcttccaagacctggagaaactgaagagtaggcccgcacacttaggcgttttcttgagatatattttctcccaagcagatccaagccctctgttattttatctgtgtgctgaggtgtaccagcaagcttctccaaaagacagtaggagcctcggtaaggacatctggaatatcttcctggagaaaaatgccccactgagggtgaagatccccgaaatgctacaggctgagatcgacagtcgactgaggaatagtgaagacgcccgaggggttctttgcgaggcccaggaggcagccatgcctgagatccaagagcagattcacgactatagaacgaagcgcactctaggactgggaagcctttacggtgagaatgacctcttggacttggatggcgatccgctacgtgagcgacaagtggctgagaaacagcttgcggctctgggggacatattatctaagtatgaggaggataggagcgcacctatggattttgctctaaatacttacatgagccatgccggaatccggctccgggaagctagaccctccaatactgccgagaaggcgcagagtgctcccgacaaggataagtggttaccattcttccctaaaaccaaaaaatcaagtaactccaagaaggaaaaagacgccctcgaagataaaaaacggaaccccattcttaagtacatcggcaagccaaaatctagctcccagtcaaccttccatattcccctctcccctgtggaggttaagcccggaaacgtgaggaatattatacaacactttgagaataaccagcagtacgatgctcccgagcctgggacacaaaggctgtctacggggtcctttcctgaagatctgctcgaatctgacagttccagatccgagattcggttgggacggtccgaatctctaaagggaagagaggagatgaaacgcagccggaaggcagagaacgtacccagatccaggagtgatgtggatatggatgccgctgccgaggccacccggctgcatcaatctgcctcgtccagcacaagctccttgagtacgagatcgcttgagaaccctactccgccttttacccctaagatgggtaggagaagcattgaaagcccctccctgggcttttgtacagatacactgttgcctcaccttttggaggacgatctggggcaactctccgatctggaacctgaacctgacgcacagaactggcagcataccgtggggaaggatgtggtcgcagggcttacgcagcgtgaaatcgacaggcaggaggtgattaacgagctctttgtgactgaggcatcccacctgagaacactcagagtgttggatcttatcttctatcaacggatgaagaaggagaacttaatgcccagagaggagcttgcacgactgttcccaaaccttccggagctgatcgaaatacataacagttggtgcgaggctatgaagaaacttcgcgaggaaggccctatcatcaaggaaatcagtgatctaatgctggccagattcgacgggccagcacgggaggaattacagcaggtggccgcacaattttgttcttatcagtctatcgcattggagctcataaagacaaaacagcgaaaggagtctaggttccagttattcatgcaggaagccgagtctcacccccaatgcaggcgtttgcaactcagggacttgataatcagcgagatgcagcggctgactaagtaccctcttctgctggagtccatcatcaagcataccgagggaggcaccagcgagcacgagaaattgtgtcgcgcacgggaccaatgccgtgagattctcaagtacgttaacgaggccgtgaagcagaccgaaaataggcacagactggagggctaccagaaacgcctggacgccactgctctagagcgcgcaagcaacccactcgcagccgagttcaagtctctggatctcacaacccgtaaaatgatccatgaggggccactgacctggcgaatatctaaggacaaaactttggatctccacgtgttactgctggaggatcttctcgtcctgctgcagaagcaggatgagaagctcctgctgaaatgccatagcaagaccgcagtgggctcgtcagactcaaaacaaacattcagtcccgtattgaaactaaacgcggtattgatcagaagcgtagctaccgataaacgcgcattctttatcatctgcactagcaaactgggcccacctcaaatctacgaacttgtggccctcaccagcagtgataagaacacctggatggagttacttgaggaggctgtaagaaacgcaaccagacatccgggagctgctccaatgcctgtccatccaccaccaccgggtcccagagaacctgcgcagcaagggccaaccccatcccgcgtagaattggacgatagcgatgttttccacggggagccagaacccgaggagctacccggaggcacgggatctcagcagcgagtgcaggggaaacaccaggtgctcctggaagatcccgaacaagaaggatccgccgaggaggaggagctcggggtccttccgtgtccatcaaccagccttgacggggagaatagagggatcagaacaagaaatccaattcacctcgccttccctggtccattgtttatggaaggactggccgacagtgcgctcgaggatgttgagaacctgcgacacctcattctatggagcctcctacctggacacacaatggaaacccaggctgcccaggagccagaggacgacctcacgccgaccccatcagtgatttccgtcacatcccatccgtgggaccctggcagccccggacaggcacccccagggggtgagggcgataacactcagctggctggtttggaaggcgagcgcccagagcaggaggacatggggctgtgcagcctggaacacctgccaccccgtacgagaaattctgggatttgggaatcccctgagttagataggaacctggccgaggatgcttcaagcacagaggcagcaggtggatataaggtcgtgcggaaggctgaggtggctggcagcaaggtggtgcccgctcttccagaaagtgggcaaagtgagcccggaccacccgaggtagaaggcggaaccaaggccacgggtaattgcttctacgtgtctatgccctcagggccacccgacagttcaactgaccattccgaggctcccatgtccccaccccagcccgattcattgcctgccggacagaccgagccccagccccagctgcaagggggtaacgatgatcctcgcagaccctccagaagtcctccctctctggccctccgtgatgttggtatgattttccatactatcgagcagctgaccctcaagctcaacagacttaaggatatggaactcgctcatcgcgaactccttaaatcactcggaggcgagagctcaggaggcacaactccggtcgggtcatttcatactgaggcagctcggtggacagacggatccctctctccacctgcgaaggaacccctcgcctccgatagtcggaattcccacgagctgggtccatgtcccgaggatggctcagatgcgccactggaggactctaccgcagacgccgctgcttctccaggaccctag

SEQ ID NO: 53539 - DNA, 1743 bp, Artificial Sequence
  Description of Artificial Sequence: Synthetic coding sequence
atgaggggaggacacaaggggggtagatgcgcctgtcccagggtcattcggaaggtgctggctaaatgtggctgctgttttgcacgaggcggtagggagagttatagtatcgcaggcagtgagggctccattagcgcttctgcagcatcaggcctggcggctccaagcgggcctagcagtggactgtcttctgggccatgttccccaggacctcccggacctgtcagcggcttaagacggtggctggaccatagcaaacactgcttgagtgttgaaaccgaggccgactctggacaggcgggaccttacgaaaactggatgctagagcctgcgctcgccaccggggaggaactgcctgagttgaccttgctgaccacactgctggaaggccctggcgataagacccagccaccggaggaggagactctgtcccaagcacccgagtccgaggaggaacagaagaaaaaggcactggaaagaagtatgtatgtgctgtcagagcttgttgagaccgagaagatgtatgttgacgaccttgggcagattgtcgagggctatatggcaactatggcagcgcagggagtccccgagagcctcagaggccgagacagaattgtgttcggaaatattcagcagatttatgaatggcatagagattatttcctacaggagctgcaaagatgtctaaaagaccctgactggctggcacagctgttcattaaacacgagagaagactgcacatgtacgtggtgtactgccagaacaaacctaaatcagaacatgttgtgtctgagtttggggactcatatttcgaggaattgagacaacaactcggccacagacttcagttaaacgacctgttgataaaacctgtgcaaagaataatgaagtaccagttgctgctcaaagactttcttaagtactataaccgagccggaatggatacagccgatttggaacaagccgtcgaagtgatgtgtttcgtccccaaacgatgtaacgacatgatgacactaggtcggctgaggggcttcgagggaaaactgaccgcgcagggaaaattactgggccaggatacattttgggtgactgaaccagaggctggtggcttattgagttcccggggacgtgagcggagggtgttcttgtttgaacagatcattatcttttccgaggctttaggcggtggagtgcggggagggactcagcccggatacgtgtacaagaactcaattaaagtctcctgcctgggcctggaaggtaatcttcagggagacccctgccgttttgccctgacctcccggggtcctgaaggcggaatccaaaggtacgtgctgcaagctgctgatccagcaattagccaggcctggattaaacatgttgcgcagatcctcgaaagtcagagagacttcctcaacgccctgcagtccccgatagaataccagcgtagagaaagccaaactaactctctgggacggccacggggaccgggagtggggagtcctggcagaatccagctcggggaccaggcacagggtagcacccacaccccgatcaacgggtccctgccgtcgttgctcctgtctcctaaaggcgaggttgcaagggcactactgcctcttgacaagcaggctctgggggatatcccgcaggccccacacgactctccccctgtgtccccaaccccaaaaaccccgccatgccaggccagactcgccaaactggacgaggacgagctctag

SEQ ID NO: 53540 - DNA, 921 bp, Artificial Sequence
  Description of Artificial Sequence: Synthetic coding sequence
atgcgatcatctcctggtctgtgcagccccccacccgaggaagaaactttgagccaggctccagagtccgaggaagagcagaagaagaaggccttggagcggtcgatgtacgttctttctgaactggtcgaaaccgagaagatgtacgtagacgatcttggacagatcgtggaaggatacatggccaccatggctgctcaaggagtacccgaatctctgcgcggtcgcgacaggatcgttttcggcaacatacaacagatctatgaatggcatagggactattttcttcaggagttgcaaagatgtctgaaagatcccgactggttggctcagctgttcatcaagcacgaaaggcgactacacatgtacgtagtgtactgccaaaacaaacctaagtctgaacacgttgtctccgagttcggtgatagctattttgaagagctgcggcagcagctggggcataggctacagttaaatgacctcctcataaagccagtccagcggataatgaagtaccagctgctgcttaaagatttcctaaagtattacaatcgggctggcatggacaccgcagacctcgagggtaagttgaccgctcaaggcaaactactgggtcaggataccttctgggtgacagagcccgaagccggaggtctcctgtctagtaggggaagagagagacgagtctttctgtttgagcagattatcatcttctccgaggcccttggcggaggggtcaggggcggaacacaaccagggtatgtatacaaaaatagcatgcgccaggtgttctgccagatgcaggaactgccccaactctggcacatctctcgggtcgatttcgtgagaaatgccataacacccaggctccccccactcattttgctcgcctctccagcttctgcgctaaaccaaacctag

SEQ ID NO: 53541 - DNA, 1860 bp, Artificial Sequence
  Description of Artificial Sequence: Synthetic coding sequence
atgaaacccccagacagaccggcaccagggaggaccgatcgcattctgggggttatggggggtatgctgagagcttgcgctcttcccggacaggaggggccaccaaggcgtagtccactcgggctcgtcggaaccgagccagagtctgagcgcacagaaggagatcaccggagggatagggagcatgaggtgctagccggagcattgcagcctgaaagctactctattgctggctctgagggctccattagcgcttccgcagcgtctggactggccgctccctctggacctagctcaggtttgtcctccggcccatgtagcccagggccacctggacctgtgtccggcctgcgccgttggcttgaccatagcaaacattgcttgtccgtcgagacagaggcagactcaggccaggcaggcccttacgagaattggatgcttgaacctgccctggccactggcgaagagcttccagagctgactttattgaccaccctcttggaaggcccaggcgacaagactcagccaccagaggaggaaacgctgtcacaggccccagaatccgaagaggagcagaagaaaaaggccctggagcggtcgatgtatgtgctgtccgagctggtcgagaccgaaaagatgtatgtggatgatttgggtcagatcgtagagggatacatggccacaatggccgctcaaggcgtacccgaaagccttcggggaagagatcgtatagtgttcggaaatatccaacagatctatgagtggcaccgcgattacttcttacaagaactacagagatgccttaaagaccccgactggcttgcgcaactgtttattaagcacgagcgaagattgcacatgtatgtggtctattgccagaataaacccaagagtgagcacgtggtttcagaattcggtgacagttattttgaagagctgagacaacaactgggccaccggcttcaattgaatgatctgctaataaagccagtgcaacggataatgaaatatcagctactgctcaaggatttcctgaagtattataatcgcgcagggatggacactgcggacctggaacaggcagtcgaagtgatgtgctttgttcccaagcgatgtaacgacatgatgaccctgggccgtttacggggattcgagggaaaactcacagcgcagggaaagctcctgggacaggatacattctgggtgaccgagcccgaagcgggtggtctgctgtcatccagggggagagaacggagagtgtttctgttcgagcagatcattatcttttccgaggccctggggggaggggtgagggggggtactcagccagggtacgtgtataagaatagcattaaggtctcttgccttgggttggagggcaatttgcagggggacccgtgtcggttcgccctgacatccagagggcctgagggtgggatccagcggtacgtgctccaggcggctgaccctgctatttcacaggcatggattaagcatgtggcgcagatcttagaaagccagagagacttcctgaatgctctgcagagcccaatcgagtaccagcgtagagagtctcagaccaattctctcggccgacccagaggtccaggggttggaagccccggtcgcatacaattgggggatcaggcccagggatccactcacacgcccattaacggaagcttaccctccttgttgctctcaccaaagggcgaggttgcgagagcacttctcccattagacaagcaggcgttgggcgacatccctcaggcccctcacgactcacccccagtatctcctacacctaagacccctccttgtcaggccagactggccaaattggacgaggatgaactctag

SEQ ID NO: 53542 - DNA, 5064 bp, Artificial Sequence
  Description of Artificial Sequence: Synthetic coding sequence
atggaattatcttgctctgaggcacctctatacgggcagatgatgatttacgcaaaattcgacaaaaatgtatatctgcctgaagacgcagaattttactttacttacgacggctcacatcagcgacatgtcatgatagcagaaaggattgaagataacgtcctgcagagctccgttccgggacacggactgcaagaaacagtcactgtctctgtgtgcctgtgtagtgaggggtactccccagttaccatggggtccggcagtgtgacatatgtcgataatatggcttgcaggctagctagactgcttgtgacccaggcaaataggctgactgcctgctcccatcagacacttttgacccctttcgctcttacggctggagccttgccagccctcgacgaggagctggtcctggcacttacccacctggaattgcctctggagtggaccgttttgggttcgagcagcctggaagtgtcatcccacagagaaagcttactgcatctcgccatgagatggggcttggccaagttatctcagttttttctttgtctgccgggtggggtccaggccttagctctaccgaacgaggagggggctacacccctggacctggctctgcgggaaggacactccaagctggtggaagacgtcaccaatttccagggcagatggtcaccatccttcagccgcgtgcagcttagcgaagaggcctccctgcactatattcacagcagtgaaacactgactcttactctcaatcacacggctgagcacctgctggaggccgacattaagttgttcagaaaatatttttgggatagggccttcctcgtcaaagcatttgaaccagaggctcgacccgaggaacgtactgcaatgccatcatccggcgcagaaactgaggaggagatcaaaaactcggtgagttctaggtccgctgcagagaaggaggacatcaaaagggtaaagtcactcgttgtgcaacacaacgagcacgaagaccaacactctcttgacctggataggagttttgatattctgaagaagtccaagcccccaagcaccctgttggctgcagggcgtctgtcagacatgctaaatggaggcgatgaggtatacgccaactgtatggttattgaccaggtgggagacctggatatctcatacatcaacattgagggaattacggccaccaccagccctgaatcacggggatgtacactatggcctcagtcctctaaacacaccctgcctacagagacttcgccctccgtgtaccccctgagcgaaaacgtcgagggaacagctcatacagaggcccagcagtcctttatgtctccctccagctcgtgcgcatctaacttgaatctcagttttgggtggcatgggtttgagaaagaacaatcccacctgaagaaacgttctagcagcctggatgccctggatgccgactctgaaggggagggccactctgagccctcccacatctgctatacacccggatctcagagctctagtcgtaccgggatccccagcggggacgaactggattccttcgagacgaatacggaaccagacttcaatatctctcgggcagaatctctgccgctctcctcaaatttgcagagcaaagaatctctcctctccggtgtccgatcaagatcctattcatgctcaagcccaaagataagccttggcaagacgcgactcgtgagggagcttaccgtctgtagttcttctgaggaacagcgtgcttatagtttatcagagccccctagagaaaaccgcattcaggaggaagagtgggacaagtacatcatacccgctaaaagcgaatctgagaagtacaaggtatcacgtactttttcctttctgatgaacagaatgaccagtcccaggaacaagtctaagacaaagagtaaggacgctaaagataaggaaaagctgaatagacatcagttcgccccaggtacatttagtggggttctgcagtgcttagtgtgtgacaagaccttgttgggaaaggagtccctacaatgttctaattgcaacgccaatgtgcacaaaggatgcaaggatgccgctccagcctgcacaaagaaattccaggaaaaatacaacaagaataaaccccagacaatcctggggaacagctcatttagggatatcccgcagcccggacttagcctgcaccctagcagctctgtgcctgtggggttgccaacggggaggagggagaccgtggggcaggtccatccgttatctaggagtgttccaggcacgacgctcgagagcttccgtcgtagcgccacctccttagaaagtgagtctgaccacaacagctgcagaagcagatcccatagcgatgagcttctgcagagcatgggcagcagcccctctaccgagtcatttattatggaggacgtggtggactcgtccctctggtccgacctgagtagtgacgcccaggagtttgaggcggaatcatggtcccttgtggtggatcctagcttctgcaacaggcaagagaaggacgttattaagaggcaggatgttatctttgagctgatgcagacggagatgcaccacatccagaccctcttcattatgtctgagatattcagaaaaggcatgaaagaagagctgcaactggatcacagcaccgtggacaaaatctttccttgcctggacgagctgctggagattcaccggcactttttctactcgatgaaggagagaaggcaggaatcatgtgcagggtctgatagaaatttcgtgatagacaggatcggtgatattctcgtgcagcagttctccgaagagaatgccagtaagatgaagaaaatctacggtgagttttgttgtcatcataaagaagcggtgaacctgtttaaggaacttcagcaaaacaagaaattccagaacttcatcaaacttcggaattccaacctattggccaggcggaggggaatccccgagtgtatcctgctagttacccagcgcatcacgaagtaccctgtgctcgtcgaaaggatccttcagtataccaaagaaaggacagaagaacacaaggacttgcgtaaggccctgtgcttaatcaaagacatgatcgcgactgtggatttaaaggttaacgagtacgagaagaaccagaaatggctggagatcctgaataaaatagagaataagacctacactaagttgaaaaatggtcatgtgtttcgaaaacaggccctgatgtctgaggaaagaacgctgctgtacgacggactcgtgtactggaagacggctaccggtagattcaaggatattctggccctcctgctgaccgacgtacttctgtttctgcaggaaaaagatcagaagtatattttcgctgccgtggatcagaagccctctgtcatcagtctacagaagctgatcgctcgtgaggtggctaatgaagaacgcggtatgtttttaattagtgcatcaagtgccggaccagagatgtatgagattcacactaatagtaaagaagaaagaaataattggatgagaaggatccagcaggccgtggaatcttgccctgaggaaaaaggcggtaggacctccgagtccgacgaagataaacgtaaggccgaagcgagagtggctaaaatacaacagtgccaggaaatactaaccaaccaagaccagcagatttgcgcttacctcgaggaaaagctgcacatttatgcagagctgggagagctgagcgggtttgaggatgtgcacctcgaacctcacctgttaataaagcccgaccctggcgagccccctcaagccgcttctcttttggcagccgctttgaaggaggctctggtgacggggggacgcgaggggagaggctgctccgatgttgatcctggaattcagggagtggtgacagatctggctgtgtctgatgcaggggagaaggtggagtgccgcaactttccaggctcaagccagagtgaaatcattcaggcgattcagaatctgacacgccttctctacagcctccaggcagctttgacaatccaggacagccacatagaaattcaccgactcgtgcttcagcagcaggagggcctcagcctcgggcatagcatcctgagaggcggaccgttacaagaccagaaaagccgggacgcagataggcaacatgaagagctggcgaacgtgcaccaattacaacaccagctgcagcaggagcaaagacggtggctgaggcgctgtgagcagcagcaacgggctcaggcaacacgtgagagttggcttcaggagcgtgagagagagtgtcagtcccaggaggagctactgctgagaagccgaggcgaactggacttgcaactccaggagtaccaacacagtctcgaaaggttgcgcgagggacagaggttagtcgaacgagagcaagccaggatgcgggcacaacagtccctgctcggccattggaagcacgggagacagcgttcccttccagctgtcctgctgcctggcggtcccgaagtgatggaactcaaccgcagtgaatctctgtgtcacgagaattctttttttatcaacgaagctttggttcagatgtcctttaacacctttaacaagctcaacccctctgtaatccaccaagatgccacttaccccaccacccagtctcactctgatctggtccggactagtgaacatcaagtggacctgaaggttgatccatcccagcccagcaacgtttcacataagctgtggacggctgccggaagcggacaccagattctgcccttccatgagagcagtaaagattcatgtaaaaatggaagttctatgacaaagtgttcttgcactttgacctccccacccggtctatggacggggactacttcaaccctgaaggatctcgatacctcacataccgagtcccctactccccacgatagcaatagccaccgtccacagctgcaagcattcattacagaagccaagctgaatctacctacacgcaccatgacaaggcaggatggcgaaacgggcgacggcgctaaagagaacatcgtctacttgtat

SEQ ID NO: 53543 - DNA, 4956 bp, Artificial Sequence
  Description of Artificial Sequence: Synthetic coding sequence
atggaactgtcttgcagtgaggcccctctgtacggccagatgatgatctacgcgaagttcgacaaaaacgtgtacttgcctgaagatgccgagttttacttcacttacgatggaagccatcagagacatgtcatgattgctgaaaggatagaggataacgtgttacaaagcagcgttcccggacacggactccaagaaaccgtgaccgtcagtgtgtgtctatgttccgaaggctattcgccagttaccatgggaagcgggtctgtgacctacgtggataacatggcatgccgcttggcgcgtctgttagttacccaggcaaatagattaaccgcatgcagtcaccagacactgctaactccctttgccctaacggcaggagcgcttccggcactagatgaagagctggttctggctctcactcacctcgagttaccgctggagtggacagttctgggctcgtctagtctggaagtgagtagccaccgtgaatcactgctgcacctggccatgaggtggggtttagctaagctcagtcagtttttcctgtgtctcccagggggagtccaggcccttgcgctccccaatgaggagggcgcaactccactggatctcgctctccgggagggacactcaaaacttgtggaggacgtgaccaattttcaaggcaggtggtctcccagcttttcaagggtgcagctgagtgaggaagccagtctgcactacattcatagctcagaaactttgactctcaccctaaatcacacagcggaacacttgctggaggcagatatcaagctgtttcgcaaatatttctgggacagggcatttctggtgaaagcgtttgaaccagaagcacgtccagaagaaaggaccgccatgccgtcaagtggggcagagactgaagaggagataaagaacagtgtgtcctcacgttctgccgcagagaaggaagatatcaaacgggttaagtctttggtcgtccaacataatgaacacgaagatcagcatagtcttgacttagaccggtctttcgatattctgaaaaagtcaaagcccccatccacattactggccgcagggagactttccgatatgcttaacggtggagatgaagtctatgctaattgtatggtcatagaccaggtgggcgatctggatatatcttacattaacatcgaaggaatcacagccactactagtcccgaatcccgaggctgcacactttggcctcagtcctccaaacatacacttccaactgagacgagccccagtgtctatccattgtccgagaatgtggaaggcaccgcccacaccgaggcccagcagagctttatgagtcctagttcctcatgcgcgagtaatctgaacctgagctttggctggcacggatttgaaaaggaacaaagccacttaaaaaaacgcagctccagcttggatgctctggatgcggacagtgaaggcgaaggccattcagaaccttcgcacatctgctatactccgggttctcagtcctcttctcgcacaggaatccctagtggtgacgagcttgatagctttgagactaacaccgaacctgactttaatatttcgagggcagaaagtttgccactcagcagtaacctacaaagcaaggaatcgctgctgagtggcgtgcggtcccggtcctactcctgctcctcccctaagatatcattgggtaagacccgacttgttagggaattgacagtgtgctcttcttctgaagagcagcgcgcttattccctgtctgaaccacctagagaaaaccgcattcaggaagaagaatgggataaatacatcatccctgctaaatcggaatccgagaagtataaagtgagcaggaccttctcattcctgatgaaccgcatgacaagcccaaggaataagagcaagacaaagagcaaagacgctaaagataaggaaaagctcaataggcaccaattcgcgccagggaccttcagcggggtactacagtgtctggtgtgcgataagacactgctgggaaaagaatctttgcagtgtagtaactgcaatgctaacgtccataaaggttgtaaagatgcagccccagcttgcacgaaaaaattccaggagaagtataataagaataaaccacaaaccatcctgggaaactcaagttttcgggacataccccagcctggcttgtccctgcatccctcctcaagcgtgccagtcgggcttcccactggcagacgagagacagtggggcaggtccaccccctctccaggtctgttccaggaactaccttagagtcgttcaggcgctccgcaacgagtttggagtctgaaagcgatcataactcctgccggtccagatctcacagtgatgagctgctgcagtccatgggcagcagtcctagcaccgagtctttcatcatggaagatgtcgttgactccagcctttggagtgatctatccagcgatgcgcaggagttcgaagccgagagttggtcactggtcgtggacccaagcttttgcaacagacaggagaaggacgtaatcaaacggcaagatgtcatcttcgaattgatgcagacagagatgcatcacattcagacactctttatcatgagcgagatattcagaaaggggatgaaagaagaactccagcttgatcactccaccgtggacaaaatatttccttgcctcgacgagctgttggaaatccaccgccactttttttactctatgaaagagagaagacaggagtcatgcgcaggtagtgaccggaactttgtgattgataggatcggggatatcctggtacaacagttcagtgaggaaaacgcttcaaaaatgaagaagatctatggcgagttctgctgtcaccacaaagaagccgtcaatctgtttaaagagctgcagcagaacaaaaagtttcagaactttatcaaactgcggaattccaatctgcttgctaggcggaggggaatccccgagtgcatcttgttggtcacacaacgcattacaaagtatccagtgcttgtggaaagaatcctacagtacactaaagaacggactgaagaacataaagacttaagaaaagcactgtgcctaattaaggacatgattgctacagtcgacctgaaagtgaatgaatatgaaaagaaccaaaagtggctggagattctgaacaagattgaaaacaaaacatacaccaagctgaagaatggccatgttttcaggaaacaagcgctcatgtccgaggaacggactttactgtacgatggcctggtgtactggaagaccgccaccggtcgttttaaggatatcctagcactgttgttgactgatgtgctcctattccttcaggagaaagaccagaaatacatttttgcggcagtggatcaaaagccaagtgtgatctcactgcagaaattgattgctagggaagtcgcaaatgaggaaaggggaatgttcttaatcagcgcttctagcgccggtcccgaaatgtatgaaatccacactaactctaaggaagagaggaataattggatgcgtaggattcaacaggcagtcgaatcctgccctgaagagaaaggtggacggacctctgagtcagacgaggataagcgcaaggctgaggccagagtggctaaaattcagcagtgtcaggagatcctcacaaaccaagatcagcaaatttgtgcctatcttgaggagaagctgcatatatatgccgaactgggggagctatctggctttgaggatgttcatctggagcctcatttgctcatcaagcccgatcccggtgaacccccacaagctgccagcctgctggctgccgctctcaaagaagctgagagcctccaggttgctgtgaaggcctcacagatgggggcagtcagtcagtcatgtgaggacagctgcggcgattccgtcctagccgacacgctgagtagccacgacgtgccgggaagccctactgcgagtttggtcactgggggacgggagggtcgcggatgctccgatgtggatcccggaattcagggggtggtgacagatctagcagtcagcgatgctggtgaaaaggtggagtgcagaaactttccaggtagcagtcagagcgagattatccaggccattcagaacctgacaaggctgctctattctcttcaggccgctctgaccatccaagacagtcacatcgagattcacagactggtgctccagcagcaggaaggacttagtcttggccactcaatccttaggggcggaccactgcaggaccagaagagccgtgacgcagaccgccagcacgaagagctggctaacgtgcatcagctgcagcaccagctccagcaagaacaaagacgatggctccgtaggtgtgagcagcaacagagagcccaggcgactcgcgaatcctggctgcaggaacgggagagagagtgccaatctcaagaggagctgctacttcgcagccgtggcgaattggacctccagctgcaggaataccaacacagcctcgagcgtctgcgtgaggggcagaggctggttgagcgggagcaggcgagaatgagagctcagcagagtctgctgggacattggaaacatggaaggcagcgatctttacccgctgtcttgctgccaggtggccctgaggtaatggagctgaacaggagtgagtccttgtgtcacgaaaactcattctttattaacgaagcactggtgcagatgagctttaacacgtttaacaaactgaatccctccgtgatccaccaggacgctacctatccaacaactcaatcccattcagaccttgtgcgaacatccgagcaccaggtggatctcaaggtggacccctcccagccaagtaatgtgtcccacaaactgtggacggccgcaggaagtgggcaccaaattctgccctttcacgaatccagcaaggacagttgtaagaacgggaattag

SEQ ID NO: 53544 - DNA, 5117 bp, Artificial Sequence
  Description of Artificial Sequence: Synthetic coding sequence
atggagctgagctgttccgaggcgcctctgtacggacagatgatgatatacgcaaaatttgacaagaacgtatatctccccgaggacgcagaattctactttacttatgatggctcgcatcagaggcacgttatgatcgcagagaggatcgaagacaacgtgttacagtcctctgtccccggtcacgggcttcaagagacagtgaccgtatcagtatgcttgtgttctgaaggctattcaccagtgaccatgggctccggctctgtgacatatgtggacaatatggcgtgccgattggctaggcttttagttacgcaggccaataggttaaccgcctgctctcatcagacgctcttgaccccgtttgctctgacagccggagcactgccggctctggatgaagaactggtcctggcgctaacacatctcgagctgccattagaatggaccgtcctgggcagcagctccttggaggtttcgtcacatcgggaatccctcctccatttagctatgagatggggactggctaagttgtcacagtttttcctgtgtctgccaggcggagtgcaggcactggctctgcctaatgaagagggcgctacgccactcgatctggccctcagagaaggccactctaaactcgtagaagacgtgaccaactttcagggcaggtggagtcctagtttttcgagagtacaattgagtgaggaagcctctttacattacattcatagctctgagacactgaccctgacgctcaatcacacagccgagcacctcttggaagccgacattaagttattccgcaaatatttttgggacagggccttcctggtcaaagcctttgagcctgaggcgcgaccggaggaaagaactgccatgccgagctcaggagcggaaacagaagaggagattaaaaattctgtaagctcacgaagtgccgcagagaaggaggatataaagcgggtaaagtcgctggttgtgcagcataacgaacacgaggaccaacacagcctcgatctggataggtctttcgatattctgaaaaaaagcaaacccccaagcacacttcttgcggcaggaagactaagtgacatgttgaacggcggtgacgaggtctatgccaactgtatggttatcgaccaggtgggcgatctggacattagctacattaacatagaaggtatcaccgccacgacaagccccgaaagccgcggttgcacactttggccgcagtcatcgaaacacacactaccaaccgagacctcaccctcagtgtatccattaagcgaaaacgtcgagggcaccgctcacaccgaggctcagcagagcttcatgagcccttcaagtagttgcgcatctaatcttaatctgtcgtttgggtggcacgggtttgagaaggaacaatcccatcttaagaaacgatccagttctctggatgctctggacgcagattcagagggcgaggggcactccgagccttcacatatttgctacacgcccggatctcagtcatcgtctcgaacaggcatcccctcgggagatgagctggacagctttgaaaccaacaccgaacccgatttcaatattagcagggccgaatctctaccactctctagtaacctgcaaagtaaagagtcacttctcagtggagtgcgctccagatcatactcatgtagttcccccaagatcagcctcggaaagacgagacttgtaagggagttaacggtgtgttcctcttctgaggagcaaagggcttacagcctgtccgagccccctagggaaaacaggatccaggaagaggagtgggataagtatatcatccccgctaaatccgagtctgaaaagtataaggtgtcccggacattttctttcctaatgaatcggatgacatctccccgtaataaatctaagaccaagtccaaggatgccaaagataaagagaagctaaatcgtcatcaatttgcccctggcaccttctcaggcgtgttacagtgccttgtttgcgacaaaacgttattgggcaaagagtctctgcaatgtagcaattgcaatgccaacgtgcataaagggtgcaaagacgccgcaccagcgtgtaccaagaagtttcaggaaaagtacaacaaaaacaagccacagacgatactgggtaatagcagctttcgggatatcccccaacccggattgagtttacatccctccagttcagttcctgttgggttacccaccgggaggagagagactgtgggtcaggtgcaccctctgtcccgttccgtgcctggaacaacactcgagtccttccggagaagcgctactagcctagaatccgaatcagaccataattcctgccgtagcagaagtcacagcgatgaactgcttcagtcaatgggttcctctccatctacagaatccttcattatggaggatgtggtggatagctccctgtggtctgacctgtcaagcgatgcccaggagtttgaggctgagagctggtctctcgtggtggacccgagcttttgtaacaggcaggaaaaggatgtgatcaaaaggcaagacgtgatttttgaattgatgcagacggagatgcatcatattcagaccctgttcattatgagcgaaatttttaggaaaggaatgaaggaggagttgcaattagaccattctaccgttgataagattttcccatgtctagatgagctgttggaaatccaccgtcattttttttacagcatgaaggaacgcagacaagagtcctgtgcaggttcggacagaaacttcgtgatcgaccgaatcggagacatactggtgcagcagttctccgaggagaatgcaagcaaaatgaagaaaatttacggcgaattttgctgtcaccacaaggaggcagtcaacctgttcaaagaattacagcagaataaaaagttccaaaattttatcaagttgagaaattctaacctgctcgccagacgaagagggataccagagtgtattctactcgtcacgcagagaataaccaaatacccagtgctcgtcgagcgaattcttcagtacactaaggaaaggactgaagagcacaaggatctgcgcaaagcactgtgcctgattaaggacatgattgcaactgtcgatttgaaagtcaatgaatacgaaaagaatcagaaatggctggagatactgaataagatcgaaaacaaaacctacacaaagctcaaaaacggacacgtcttccgtaaacaagctctgatgtccgaggagagaacactgctttatgacggccttgtgtactggaagacagctacgggccgtttcaaggatatcctagcgctcttactcactgacgtacttttatttctgcaggagaaagatcaaaagtacatttttgcagccgtagatcagaagccctctgtgatctcccttcagaagctcatcgccagggaggtcgccaacgaggaacggggaatgttcctgatcagtgctagttcagctgggcctgagatgtatgagattcatactaattcgaaggaggagaggaataattggatgcggaggattcagcaagcggtggagagctgcccggaggaaaaggggggaaggacgtctgagtctgatgaggataagaggaaggcagaggccagggtcgctaagatccagcagtgtcaagaaattctcacgaaccaggatcagcagatctgcgcctatcttgaggagaagctgcatatctatgccgagttgggggagctgtctggatttgaggacgttcatcttgagccccacctgcttatcaagccggacccgggtgaaccaccccaggctgcctccctcctcgccgctgcattaaaagaagcagaaagccttcaggttgccgtgaaggcttctcagatgggcgctgtgtcacaatcatgcgaagacagctgtggagactcagtgctggcggatacattatccagccacgacgttcccggatctcctactgcctcacttgtgactggaggacgggagggtcgcggatgcagcgacgtagaccctggcattcagggagtcgtaactgacctggccgtgtccgacgcaggcgaaaaagtggagtgcagaaactttcccggaagcagtcagagtgaaatcatccaggcaattcaaaatttgaccagactgttgtattctttgcaagccgctctgacaatccaggatagccatatcgagattcaccggttggtgctccagcagcaggagggcttgtcattaggccacagcatcctgagagggggtcctctccaagaccagaagtctagagatgctgatcggcagcatgaggaacttgcgaacgtacaccaactccagcaccagctccaacaggaacaacgtcggtggctgcgacgatgtgagcagcagcaacgagcacaggcaacaagagagagctggctacaggagagggagagagaatgccaatcccaggaggaactactgctgcgaagccgcggagagctcgatctgcaactccaagaatatcagcattcactcgaaaggctacgagaaggacagcgcctagtggagcgtgaacaggctcggatgcgcgctcagcagagtcttttgggccattggaagcatggcaggcaaagatcgctgcccgctgttctgcttccgggtggcccagaggtcatggaactgaacaggagcgaaagcctgtgccacgaaaactccttcttcatcaacgaagcacttgttcagatgagcttcaatacatttaacaaactcaatccatcagtaatccaccaagacgccacataccctacgacccagtcccactcagaccttgtaagaacaagcgagcaccaggtcgacctaaaggtagacccctcccagccttccaacgtgagccacaagctatggactgctgcaggaagtggccatcagatcctcccattccacgagtccagtaaggattcgtgcaaaaatgaccttgacaccagtcataccgaatctcccacgcctcatgactctaactcacaccgccctcagctccaagcctttatcacagaggcaaaattgaacctccccaccagaacaatgacgcgccaagatggagagaccggtgacggcgctaaggagaatatagtgtatctgta

SEQ ID NO: 53545 - DNA, 252 bp, Artificial Sequence
  Description of Artificial Sequence: Synthetic coding sequence
atggagctgtcttgctcagaagccccattgtacggtcagatgatgatatacgccaaattcgataagaacgtctatctgccagaagacgccgaattttatttcacatacgatgggtcccatcaacgacacgtgatgattgcagagcggatcgaagacaatgtacttcagtctagtgtccccggacacggcctgcaggagacagtgaccgtttctgtctgtctttgcagcgaagggtactcaccagttacctag

SEQ ID NO: 53546 - DNA, 5117 bp, Artificial Sequence
  Description of Artificial Sequence: Synthetic coding sequence
atggagctgagctgttccgaggcgcctctgtatgggcagatgatgatctacgcaaagtttgataaaaatgtataccttccggaggacgcagagttctatttcacttacgacgggtcccaccagcgtcatgtgatgattgcggagcggatagaagataacgtcctccagtcctcagtccccggacatggacttcaagagacggtcactgtgtccgtctgcctgtgttcagaaggttatagtcctgtaactatgggttccggatccgtcacctacgtggataacatggcctgtagactggccaggttgctagtgacccaagctaatagactcactgcatgtagccaccagacactcctgacccccttcgctctcaccgctggagccctgccggctctcgacgaagaactggtactagcccttacccatcttgagttgccgctggagtggaccgtccttggcagctctagccttgaggtgagtagccatagggagagtctgctgcacctagcgatgaggtggggcttggctaaactctcacagttttttctctgtctgcccggtggggtccaagcgctggctctacctaatgaggagggggctacccccctggatcttgcccttcgcgaaggccatagcaaactggtcgaagacgtgactaatttccaaggccgatggagtccttcttttagccgagtgcagctatcggaggaggcgtcattgcactatatacatagctccgagacattgactctgacactgaaccacactgccgaacacttattggaagccgacatcaagctgtttcgtaagtatttctgggaccgcgcatttcttgtcaaggccttcgaacctgaagcgagacccgaagaaaggaccgccatgcccagctctggtgcggaaaccgaggaagaaataaaaaactcagtgtcaagtcgctccgccgcagagaaggaagacattaagagggtgaagtccctggttgtccagcacaatgagcacgaggatcagcattcactcgacctcgataggagtttcgatattctgaaaaaatctaagccaccaagcacattactggccgcaggtaggctttctgatatgctaaacggcggagatgaagtatatgcgaactgcatggtgatcgatcaggttggtgatttagatatttcttatataaacatcgaaggtatcactgcaacaacatcacctgagtcaagggggtgtacactgtggccccaatcttccaagcacactctccctaccgaaacttcacctagtgtgtatcccctttccgagaatgtggaggggacagcgcataccgaagctcaacaatcattcatgtccccctcctcctcctgcgccagcaacttgaatctgtccttcggctggcacggcttcgagaaagagcagtcacatctgaagaagcgttcatcctcattggacgcgcttgacgccgatagtgagggggaggggcacagtgagccttcccacatttgctatactcctgggagtcagtccagtagccgaactggaattccctctggggacgaattggatagcttcgaaactaatactgagcccgattttaacatttcaagagccgagagcctgccgctgagcagcaacctccagtccaaagaatccttgctgagcggggtgagaagcaggagctacagttgttcaagtcctaaaatttcactcggcaaaactagacttgtgcgcgaactgactgtatgcagtagcagtgaagagcagagagcttattctctgagcgaaccacccagggaaaacaggatacaagaagaggaatgggataagtacattatacccgcaaaatctgaatcagaaaaatacaaggtgtcccggacgtttagcttcctcatgaatcgcatgacctctcctaggaataaaagcaagacaaaatccaaggatgctaaagacaaggagaagctaaacagacaccagttcgctcccggaactttctcgggagtcctgcagtgcctggtctgcgacaaaacccttctgggcaaggagtccctccagtgttcaaattgtaatgctaatgtgcacaagggttgcaaggacgctgccccagcatgcacgaaaaaattccaagaaaagtataacaagaataagccacagacaatcctggggaactcatcgtttcgtgacatcccacagcccggtctgagccttcatccctcttcaagcgttccagtgggacttcctaccggacggagagaaactgtgggccaggtgcacccactcagcagaagcgtgccaggcactacactggagagcttccgtcggagcgctaccagcctggaaagcgaaagcgatcataactcatgtcgtagtcgttcccactctgacgaactccttcaatcgatgggctcttccccttctaccgaatcctttatcatggaggacgtggttgactcctccctgtggtcagacttatcatcggacgctcaggagttcgaagcagagtcctggtctttagtagtcgatccttcattctgtaacaggcaagaaaaagacgtcatcaagaggcaggatgtgatattcgagttgatgcagaccgaaatgcaccatatacagaccctcttcatcatgtctgagatctttaggaagggaatgaaggaagagttacagctagaccacagcacagtggacaagatctttccctgtctcgatgaactgctagagattcaccgccatttcttctactccatgaaggagcgcagacaggagtcgtgtgctggatccgatcggaactttgtcattgacaggattggcgatatcctcgtgcagcagttcagcgaagaaaacgcttctaaaatgaagaagatttacggtgagttttgttgccatcacaaggaagccgtgaacctgttcaaagagctgcagcagaataagaaattccagaactttataaagctacgcaatagcaacctgcttgcccgtaggaggggaatccccgaatgcatcctgctcgtgacccaacggataacgaagtaccccgtgctcgttgaacgtatcctgcagtacacaaaagagcgcaccgaagaacataaagatttgcggaaagctctctgccttattaaagatatgattgccaccgtggatctcaaagtgaatgaatacgaaaagaatcagaagtggctggaaatcctgaacaagatcgagaataagacctatacaaagctcaaaaatggacatgtgtttcgaaagcaagcattaatgagtgaagagcgcactttgctctacgatgggctagtgtattggaaaaccgccacaggaaggtttaaagatatactggctttattactgacagatgtgctgttgtttctccaggaaaaggaccagaaatatatcttcgccgctgtcgaccagaagcctagcgttatttctctccagaagcttattgcgagagaagtggcaaacgaagaaagaggtatgtttttaatctccgcttcttctgccggacctgagatgtatgagatccacactaattcaaaggaggagcgaaacaactggatgagaagaatccagcaggccgttgaaagctgcccagaagagaagggcggaaggacaagcgagtcggacgaagataaaagaaaggccgaggcccgagtggccaaaatccaacagtgtcaggagattttgactaatcaggatcagcaaatctgtgcttatctggaggagaagctccatatctacgcggagctgggggagctgtcaggtttcgaggacgtacatctggagcctcatctgctcataaagccggatcccggagagcctccacaggcagccagcctactcgccgctgcattaaaggaggccgaatcattacaggtcgccgttaaggcctcgcagatgggtgctgtttcccagtcatgcgaggactcttgcggggactccgtgctcgctgacacattgagcagtcacgatgtacctggctcacccaccgcctccctggtgacagggggaagagaaggaagagggtgtagcgatgtcgacccaggcattcagggagtggtcactgacctggcagtctcagacgctggggaaaaagtcgaatgcaggaactttcccggatctagtcagtcagaaataattcaggcaatccagaatctgactcgcctgttatattcactgcaagcggcactgacaatccaggattcccacatcgaaatacaccgactggttctgcagcagcaggaagggctgtccctcggacatagtatcctgagaggcggtcctctgcaggatcagaagtccagagatgctgacagacaacatgaggaactggcaaatgtacaccaattacagcaccaactccaacaggaacagagacggtggctgagacgatgcgaacagcagcagagggcgcaggcaacacgagagtcgtggttacaagagcgcgaacgtgaatgccagagtcaggaggaacttctcctccgaagtcgcggagaactggacctacagctgcaagagtatcaacacagcctggagcggttaagagaagggcaacggctggtggagcgagagcaggccaggatgcgcgcacagcagtcccttctcggccattggaagcacggaagacagcgctccctccccgctgttctgctgcctggtgggcctgaggtcatggagctgaatcggtcagagtctctctgccacgaaaactctttctttattaatgaagccctggtccaaatgagcttcaacaccttcaataagctcaacccatcagtcatccatcaggacgcaacataccctacaacccagtcccactctgatttggtccgcactagtgagcatcaggtcgacctaaaggtggacccaagccagccatccaacgtctctcacaaactttggacggcagcaggttctggacaccaaatccttcccttccacgagtctagtaaagacagttgtaagaatgacctggacacgtcacacaccgaaagtcccaccccccatgattcaaatagtcatcgtccacagcttcaggcattcattactgaggccaaactcaacttgccaacgcgcaccatgacccggcaagatggggagactggcgatggggctaaggaaaatattgtttaccttta

SEQ ID NO: 53547 - DNA, 5195 bp, Artificial Sequence
  Description of Artificial Sequence: Synthetic coding sequence
atggagctgtcttgctctgaggcccctctctacggccagatgatgatttacgctaagttcgacaagaatgtgtacctgcccgaggacgccgaattctatttcacatacgacggatcgcaccagaggcacgtcatgatcgccgaacgtattgaggacaatgtacttcagtcctcagtacctggacacggtctgcaggaaactgtgaccgtaagcgtgtgcctctgttcagagggttattctcccgttactatgggtagtggatcggtgacatacgtcgataacatggcatgtcgccttgcacggcttctggttacgcaagcaaaccgtttgactgcctgctctcatcaaactctcttgaccccttttgcattgactgccggtgcgcttcctgcactcgatgaggagctcgttctagcactgacacacctagagctgccactcgagtggactgtgcttggcagttcctccctggaagtgagtagccatcgggagtcgctcttacacctggccatgcggtggggacttgccaaactctcccagttcttcctttgcctacccggtggggtgcaggctctggccttacccaacgaagagggggctactccactcgacctggcgttgagagaggggcactcgaagcttgtggaagacgtcactaacttccaaggacgttggagcccctcctttagtcgtgtacaactgtcggaagaggcatcactccattatatccattcatctgagacacttaccttaacattgaatcatacagccgaacatttgcttgaagccgatatcaaactatttaggaaatatttctgggatcgagctttcttagtgaaggccttcgaacctgaggctaggcccgaggaacgcacagcaatgccaagttcaggcgctgaaacagaggaagagataaaaaattcagtgtcatcccgctctgccgctgagaaagaagatatcaagagagtgaagtcccttgtcgtgcagcataatgagcacgaggaccagcattcactggacctcgacaggtcctttgatattctgaagaagagcaagcccccatccacactactggcggcagggcgtctgtccgatatgcttaacggaggggacgaagtttacgcgaattgcatggtgatcgatcaggtcggcgatctggacatctcatacattaatatagaggggattaccgctacaacaagtccagaatctagaggttgcacactatggccacagtccagtaagcatactctccctacagaaacttctcctagtgtatacccgctgtctgaaaacgtcgagggtaccgcccacacagaggcacagcagtccttcatgtccccctcgagttcctgcgcctctaatttaaacttaagctttgggtggcacggtttcgaaaaagaacaaagtcaccttaaaaaacggtcatcatccctcgacgccctcgacgctgatagtgaaggcgaagggcattcagagccaagccatatttgctacactccgggttctcagtcgagttctcggaccggtattcccagtggcgatgagctggactcctttgaaacaaataccgaacctgactttaatatatccagggccgagtctctgcccctgtctagtaatctccagagtaaagaatctctgctctctggtgtcagatcccggtcctactcatgtagtagtcccaaaatatccctggggaagactaggctggtgcgcgaattaaccgtctgctcctcctcagaagaacagagggcctactccttgagtgagccaccacgcgagaaccggatccaagaggaggaatgggacaaatatatcattcctgccaaatctgagagcgaaaagtacaaagtgagccgaacctttagcttcctaatgaaccgcatgacgtcccctaggaataagtccaagacgaaaagtaaagatgctaaggacaaggaaaagctgaatcgccaccagttcgcgccaggaacttttagcggtgtgctccaatgcttggtgtgcgataagaccctcttgggaaaagagtccctccagtgctccaactgcaacgcaaacgtgcacaagggatgcaaggatgctgcccctgcctgcaccaagaagttccaggaaaagtataacaagaataaaccacagacgattctcggtaatagcagcttccgtgatattccccaacccggactttcattgcatccgtccagctccgtgccggtgggcctcccaacaggccgtcgcgagacagtggggcaggttcaccctttaagtaggtctgtacccggtactacccttgaaagttttcggaggagcgcgacgtctctagaatccgagtcagaccacaatagctgtcgttcaaggtctcattcagatgaactgctgcagtccatgggcagttcacccagtacagaaagctttattatggaggacgtggtggacagttccttatggagcgatttgagcagcgacgctcaggaattcgaggccgaaagctggtcactcgtggtggacccgtccttctgcaaccggcaggaaaaagatgtgataaagaggcaggatgtgatttttgagctcatgcagactgaaatgcaccatatacagaccctgttcattatgtccgagatcttccggaaggggatgaaagaggagttgcagctcgaccacagtaccgtggataagattttcccatgtctcgacgagctattggagatacaccggcactttttctattccatgaaagaaaggcgccaagaaagttgcgcgggttccgacagaaactttgtcatagatcggatcggagatattctggtgcaacagttttctgaggagaacgcctccaagatgaagaagatctatggggagttctgttgccaccataaagaggcagtcaacttatttaaagaactgcagcagaacaagaagtttcagaattttatcaaactgaggaatagtaacttgctggctcgacgccgtggcattcccgagtgtattctattagttacccagcgcataacaaagtatccggttcttgtagaacggattctgcagtacaccaaggagcgaacggaggagcacaaagatctgcgcaaggctctgtgcctgattaaggatatgatcgcaactgtggatcttaaagtcaatgagtatgagaaaaatcagaaatggttagagattctgaacaagatagagaataagacttacacgaaattgaaaaatgggcatgtcttccgtaagcaagcccttatgagcgaagagcgtactctgctctatgacggtctcgtctattggaagactgccaccgggagattcaaagacatcctagccctgttgctgaccgacgtccttttgttccttcaggaaaaggatcagaaatacatatttgccgctgtggaccagaagccatctgtgatctccctgcaaaaactgattgccagggaggtagcaaatgaggagcgcggaatgtttttgatctcagcatcctccgctggaccggagatgtatgagatccacacaaattcaaaagaggagaggaacaactggatgcgcaggatacagcaggcagtggaaagctgccctgaggaaaagggcggacgcactagtgagtcagatgaggacaagcggaaagctgaggccagagtggccaaaatccagcaatgtcaggagatccttacgaaccaggatcagcagatttgcgcttatcttgaggaaaagctgcacatctacgccgaactgggggaactttccggatttgaagatgtgcaccttgagccccacctccttattaaaccagaccccggagaaccgcctcaggctgcatctttactggcagccgctctcaaggaggctgagtccctgcaggttgccgtgaaagcttcccaaatgggggctgttagccagtcgtgcgaggatagctgtggcgacagcgtgttggccgacacgctcagcagccatgatgtcccaggcagtcctaccgcctctctggtaaccggcggaagagaggggagaggctgttcagacgttgatcccggaatccaaggggttgtgaccgatttagctgtcagtgatgccggtgagaaggtagaatgcagaaactttccaggctccagccaaagcgaaattatacaggccattcagaacctgacacgcctcctatactcacttcaggccgcactgactatacaggactcccatatcgagattcatagactcgttttacagcagcaggagggcttaagcttaggacactctattctgagaggcggtccgcttcaggaccagaaaagcagggacgcagatcgccagcacgaagaactcgctaatgtccatcagttacagcaccagctacagcaggagcagaggcgctggctgagaagatgtgaacagcagcagcgcgctcaggccacacgggaaagttggctgcaggagcgtgaacgcgagtgccaatcccaggaagaactgctgctgcgctccaggggcgagttagatctccaattgcaagagtatcaacatagtttagagcgacttagggagggccagagactcgtcgagcgagagcaggcacgcatgcgcgctcagcagagtctgcttggacactggaagcacggcaggcagcgttctctgccagcggtgttacttcctggcggacccgaggtgatggagcttaatcgtagtgaaagcttatgccatgaaaattcatttttcattaacgaagcccttgtacaaatgtccttcaacacatttaacaagctcaatcccagcgttattcaccaagacgccacatatccgaccacccagtcacatagcgacctggtgcgaacatctgagcaccaggtggacttgaaagtcgatcccagccagcctagtaacgttagtcacaagctctggacagccgctgggagcggtcaccagattctgccttttcacgagtccagcaaagactcatgcaaaaatggatccagtatgactaaatgctcctgtacccttactagcccaccaggactgtggaccggtacaaccagtactcttaaggacctcgacaccagccacacagaatccccaactccacatgattcaaatagccatcgcccacagcttcaagcctttattactgaggccaagctcaacctgccaaccagaactatgactaggcaggatggagagacgggtgacggagccaaagagaacattgtgtacctgta

SEQ ID NO: 53548 - DNA, 948 bp, Artificial Sequence
  Description of Artificial Sequence: Synthetic coding sequence
atgcaaaggcggtctcgaggcatcaacacaggactaatcttgctgttgtctcagattttccatgttggcatcaataatataccccctgtgacccttgccaccctggccctgaacatttggtttttcctcaacccccagaaacctttgtacagcagctgtttatccgttgaaaaatgctaccagcaaaaagactggcagcgtttgcttctcagcccacttcatcacgcagacgattggcacctttattttaacatggcatctatgctgtggaagggcatcaacctagagcggaggctgggttcccggtggttcgcttatgtcatcacagcattctctgtactgactggagttgtgtacctgctgttacagttcgcagtcgcagaatttatggacgaacctgatttcaagaggagttgcgcagtcgggttctctggggtgctctttgccctgaaggttttgaataaccattattgtcccggaggttttgtgaacatactgggcttccctgttcccaatcgtttcgcctgctgggtagagctggtcgccattcatctgtttagcccaggtacttcgtttgcaggccatcttgccggaattcttgtcggtctgatgtatactcagggccctcttaagaagattatggaggcttgtgctgggggtttcagttcatccgtgggataccctggccgacaatactatttcaacagctccggaagctctggttatcaagactactatccacatggccgacctgatcattatgaggaggcgcctcggaactacgatacctataccgccggtctgtccgaagaggagcagctcgaaagggccctccaagcatccctgtgggacagagggaacactcggaatagcccgcctccctacggcttccacttatcacctgaggagatgcgacgccagcgcctccaccgcttcgattcacagtag

SEQ ID NO: 53549 - DNA, 948 bp, Artificial Sequence
  Description of Artificial Sequence: Synthetic coding sequence
atgcaacggagatcacgaggaattaatacaggcctgattcttctgctctctcagatcttccatgtgggtatcaataatattccaccggtaaccctggccaccctcgccctgaatatttggttctttcttaacccacagaagccactctacagttcttgtctgagtgtcgaaaagtgctaccagcagaaagattggcagcggctgctcttatctccactgcaccacgcagatgactggcacctgtacttcaacatggctagcatgctctggaagggcattaatctggagagacgactgggttcacgatggttcgcctacgtgattactgcattttcagtgctgaccggcgtggtctacctgctcttacagttcgccgtcgccgaatttatggacgaacccgatttcaagaggagctgtgccgtcggattctctggcgtgctctttgcactgaaggtgctcaacaaccactattgcccgggagggtttgtgaacatcctcggtttcccggtgccaaatagatttgcctgttgggtggaacttgtagctattcacttattcagccccggtaccagcttcgccggacacctagcaggaatcctggtcggcctgatgtatacacagggtccactgaagaaaatcatggaggcttgtgccggtggcttttcctctagcgtgggctacccagggaggcagtactattttaatagcagcggttcctctggttaccaggactattacccccacggaaggcctgaccactacgaggaggcccctcgtaactatgacacatatactgccggactctcagaagaggagcagctcgagagggccttgcaagccagcctctgggatagagggaatacacgcaactcccctccaccctacggattccacttgtcccccgaggagatgagaagacagagactgcaccgattcgatagtcaatag

SEQ ID NO: 53550 - DNA, 456 bp, Artificial Sequence
  Description of Artificial Sequence: Synthetic coding sequence
atgcagagacgatcccgcggaatcaatactggactgatattgctccttagccaaatctttcacgtgggcatcaataacatcccacctgtgacgttagctacgctggctctgaatatctggttctttcttaacccacagaagccgctatattccagctgtctaagcgtcgagaagtgctaccaacagaaagattggcaacggctcttattatctcccctgcatcacgccgatgattggcatttgtacttcaacatggcatcaatgctgtggaagggcattaatctggagcgcaggctaggttcccgttggtttgcctacgtgattacagcattcagtgtgctgaccggggtcgtgtacttgctattgcagtttgctgttgccgagttcatggacgagcctgatttcaaaaggtcttgcgcggtgggcttctccggcgtcttatttgccttgaagtag

SEQ ID NO: 53551 - DNA, 405 bp, Artificial Sequence
  Description of Artificial Sequence: Synthetic coding sequence
atgcagcgccgatcgaggggcatcaataccggattgatcctgcttctgagccagatattccacgtgggcatcaacaacatcccaccagtcacactcgccaccctggctctgaatatatggttcttcctcaaccctcagaaacccctctattcgtcttgtctgtctgtggagaaatgttatcaacagaaggactggcaacgattgctgctatccccgcttcatcatgcagacgattggcacctttactttaatatggcatctatgctgtggaaaggaattaacctcgaacgcagactcggtagccgatggttcgcgtacgtgataactgcattcagcgttctcacaggggtggtgtacctactcctgcagttcgccgttgcagagttcatggatgagccagattag

SEQ ID NO: 53552 - DNA, 165 bp, Artificial Sequence
  Description of Artificial Sequence: Synthetic coding sequence
atgcaacgcaggagccggggaataaataccgggttgatcttgctgctatctcagatattccatgtaggtatcaataatattcctccagtaaccctcgccacattggctctgaatatctggttcttcttgaatccacaaaagcccctgtactcttcctgcctttag

SEQ ID NO: 53553 - DNA, 153 bp, Artificial Sequence
  Description of Artificial Sequence: Synthetic coding sequence
atgcagcggcgttctcgcggtatcaatactggactcattctcctgctgtcccagatctttcacgtggggattaacaacatcccgccagtgacactggccacccttgcgctcaatatttggttcttcctgaaccctcagaaaccactgtattag

SEQ ID NO: 53554 - DNA, 21 bp, Artificial Sequence
  Description of Artificial Sequence: Synthetic coding sequence
atgcagaggaggtcccgttag

SEQ ID NO: 53555 - DNA, 375 bp, Artificial Sequence
  Description of Artificial Sequence: Synthetic coding sequence
atgcagcgaagaagcagaggaatcaacacaggtctgattctgctgcttagtcagatctttcatgtgggaatcaataacatcccacccgtaacgctggcaacactggcactcaacatctggttcttcttaaacccccagaagccactctattcatcctgcttatcagtagagaagtgttaccaacaaaaagattggcagcgccttttgctctcacccctgcatcacgccgacgactggcatctttatttcaacatggcgagcatgctctggaaagggatcaatttggagagaaggctgggtagtagatggttcgcatatgttattaccgcattctcagtgttgacaggagtggtgtatctcctgttacagttttag

SEQ ID NO: 53556 - DNA, 1095 bp, Artificial Sequence
  Description of Artificial Sequence: Synthetic coding sequence
atggctgcatccggtcccggatgccgttcatggtgcctctgccctgaggtgccatccgctacgttttttacagccttattgtcactccttgttagtgggcctagactctttctattgcaacagccgttagctccctctggcctgacgctcaaatccgaagcattacgcaactggcaggtttaccgactggtgacttatatttttgtctatgagaatcctataagtctgctgtgtggcgcaattataatttggcgatttgcaggtaactttgagaggaccgtgggaaccgtgaggcactgcttctttaccgtgatctttgcgattttcagcgccatcatatttctcagtttcgaggccgtgtcgtcactgtccaagcttggggaagttgaggatgcgcgtgggttcacacccgtggctttcgccatgttgggagtgaccaccgttagatcccgcatgaggcgcgcactggtgtttggcatggtagtcccttctgtgctggtgccctggctgcttctcggcgcatcttggctgatccctcaaacgagcttcctctcaaacgtttgtgggctctcaatcggactggcctacgggttgacctactgttatagcatcgatctgtctgagcgggttgctctcaaactggatcagactttcccgttctccctgatgcggaggatatccgtgtttaaatacgtgtcaggcagttctgccgaaagaagggctgcccaatctcggaaactgaacccagtgcctggaagttatccaacacagtcctgccacccacacctttccccatcccatccagtatcccagactcagcacgctagtggacagaaactggcatcatggccgtcctgtacacccggacacatgccgacactgccgccttatcagcccgcatcgggcttgtgttacgtgcagaaccactttggcccaaaccccactagcagttcagtgtaccccgcttccgcaggcacaagtctaggtatccaaccacctacaccagttaactcccccggaactgtttattcaggcgctctgggaacccctggtgcagccggttccaaggaatcgtcacgcgttccaatgccatag

SEQ ID NO: 53557 - DNA, 672 bp, Artificial Sequence
  Description of Artificial Sequence: Synthetic coding sequence
atgctcggagtcacaaccgtcagatcaagaatgcgacgggctcttgtcttcggcatggttgtacctagtgtgctcgtcccatggctcctgctcggtgccagctggctgatcccccagacaagctttctgagcaatgtatgtggcctgtccattggcctggcgtacggtctgacgtactgttattcaattgacctttcggaaagggtggccctaaagctggaccagacttttcccttctcgctcatgaggcggatcagcgtgttcaagtacgtttctggatcgtctgctgagcgacgggcagctcaatcccgtaaactgaacccggttccaggctcgtatcccacccaatcttgccaccctcaccttagcccaagccaccccgtgtcacagacccagcacgcaagcggccagaagttggcatcttggccctcctgtactcctggacacatgcccactcttcctccctaccagcccgcaagtggcctgtgttatgtgcaaaaccactttgggccaaaccctacatcaagctcagtctatcccgcatccgccggtacatccctcggtatccagccaccaacacccgtcaacagccccggtaccgtgtactccggtgctctgggcacccccggagcagccggatctaaggagtcaagtcgagtgccgatgccatag

SEQ ID NO: 53558 - DNA, 1305 bp, Artificial Sequence
  Description of Artificial Sequence: Synthetic coding sequence
atggggagaggattgtgggaggcctggcctccggcaggaagctccgctgtggcgaagggtaactgccgggaggaggccgagggcgctgaggatcgccagcccgcttcacggcgtggtgcagggactaccgcagcaatggctgcaagcggccctgggtgcagaagttggtgcctttgtcctgaagtaccaagcgcgacatttttcacagctctactaagcctgctagtgtccggcccacgcttattccttctgcagcagccgctggcgccatctggattaactctcaaatccgaggctcttcgcaattggcaggtatatcgcctggtgacatacatttttgtgtacgagaatcctatatcactattgtgcggggcaatcattatctggcgttttgctggaaacttcgagagaaccgtgggcacagtccggcactgcttcttcacagtcatctttgccattttttccgccattattttcctcagcttcgaggctgtctctagcctgtcgaagcttggcgaagtggaggatgctagaggttttactcccgtggcctttgccatgcttggcgtgaccacagtccggtcccgcatgcgcagagctctggtctttgggatggttgttccctccgtcctcgtgccatggctccttcttggcgcatcctggctcattccacagacaagctttctgagtaatgtgtgtggcctctcgatcgggctcgcttacccacatctcttgctgtttcatcggccactacgtgcatccgggactgaagccagatcagacctcccgctccaacccgatgaggaggacatcagggtacaggtccgcttacgcgttttttctagagaagagggcagcccagagcccgagaccgaacctggtgcctggctgctccctcacaccgaactgcctccaagtccagttcctaaaccaccatgtgtcccagacgcggctcggcagtggtccgaggccggattactcgcctcttgcacacccggtcacatgcctaccctccctccgtaccagccagcttcgggcctgtgttatgtgcagaatcacttcggtccaaaccccacctcttccagcgtgtatccggcatccgcagggacctccctgggcatccagccgcctaccccggtgaatagcccgggaacagtgtactcaggcgcactcggacaccaaggacttcaagctcctaggagcccaccgggatcaccttgccctgaacgcattagtagggaggtgatctcgctgggactcttgaaagtgctgcccaaatcattactcacaaaagttacctattag

SEQ ID NO: 53559 - DNA, 672 bp, Artificial Sequence
  Description of Artificial Sequence: Synthetic coding sequence
atgctgggcgtgaccacggtccgctctcggatgcggcgtgcccttgtctttggtatggtagtaccatccgtccttgtcccatggctgctgctgggcgctagctggctgatcccacagacttcttttctgagtaatgtctgcggactgtcaattggcctcgcatacggcttgacgtactgctactccatagatctttccgaacgcgttgctttaaagctggatcaaacttttccattttccctgatgaggcgcatatctgtgttcaagtatgtctcgggaagttcggctgagcggcgtgccgctcagtcacgcaagttgaatcccgtgcctgggagctacccaacccagtcctgtcatccccacctcagcccttcacatcctgtgagccagacacaacacgcatcagggcaaaagcttgcctcttggccctcctgtacccctgggcatatgccaacactgcccccatatcagcctgcatctgggctctgctacgtccagaatcatttcggcccaaacccgaccagttcgtctgtatatccggcttccgcaggcaccagcttgggaattcagccaccaacaccagtcaactcccccggaacagtgtattctggcgctctgggaaccccaggcgcagcgggatccaaagagagctcacgcgtgcccatgccctag

SEQ ID NO: 53560 - DNA, 1185 bp, Artificial Sequence
  Description of Artificial Sequence: Synthetic coding sequence
atggaactctcagccgtgggggaacgggtctttgccgcagagagcattattaaacgaagaatacggaaaggtcggatcgaatacctggtgaagtggaagggatgggctattaaatattcaacttgggaacccgaagaaaacatcttggattcccggctgatcgccgctttcgaacagaaggaacgcgaaagggagctctacgggccaaagaagcggggtccaaaacccaagacattcttgctcaagcctagcgcttcagcctcctcgcccaagttacatagctcagctgcagtgcatagactaaagaaggacatccgtaggtgccataggatgtcccgacgccctcttcctagacctgatccacagggaggttcacctgggttacgtccaccaatttctccattttcagaaaccgtgcgcattattaataggaaagtcaaaccgagagagccaaagaggaaccggattattctgaacttaaaggtaattgataaaggcgcaggaggaggtggagcaggacagggcgctggagctctggcacgtcctaaagtccccagccggaatcgggtgatcggaaaaagtaagaaattttctgagagtgtgctgcgcacccagataagacacatgaagtttggggcattcgccctatacaagcctcccccagctcctctcgtggccccaagccctgggaaagcggaagcaagcgcccctgggccaggtcttctcttggctgcccctgcagccccatacgatgctcggtcaagcggatctagcggatgtccgtcccccacccctcagtcatccgacccggacgatactccaccaaaactgcttcctgaaactgtgagcccatcagcgccatcttggcgcgagcccgaggtgctcgacctctcactaccaccagagtcagctgccacatctaagcgagcccctcctgaggtgacagctgccgctggccctgcaccgccaaccgcccctgagcccgcaggtgccagcagcgaacccgaggccggtgattggaggcctgaaatgagcccctgctctaacgtcgtggtgacagacgtgacatctaacctacttacagtaaccatcaaagagttctgtaatcccgaagactttgaaaaggtggcagccggagtagccggagccgcaggtgggggaggaagcatcggagcgtcaaagtag

SEQ ID NO: 53561 - DNA, 411 bp, Artificial Sequence
  Description of Artificial Sequence: Synthetic coding sequence
atgcacgcaaggggacctcacggccagctgtcgccggctcttccactggccagtagtgtgttgatgttgctcatgagtacactctggcttgtgggtgctggtccagggctcgtgctggccccagagttgctgctcgacccttggcaggtgcacaggctcctaacgcacgccctgggccacaccgctctgccagggctgctcttgtccctgttattgctgccaacggtgggttggcagcaggagtgtcatcttggcaccttaagattcctccatgcctccgctctgttggcgctggcctccgggttgctcgccgtgctcctggctggactggggctttcctccgcagctggttcatgtgggtatatgcctgtgcacctggccatgctggctggagaaggccaccgcccttag

SEQ ID NO: 53562 - DNA, 588 bp, Artificial Sequence
  Description of Artificial Sequence: Synthetic coding sequence
atgcacgctcgtgggccacatgggcaactttcccccgcacttcccctggcatcgagtgtccttatgctactcatgagcaccctttggctagttggcgcaggtccaggcctggttctggcccctgagcttctattggatccttggcaggtgcaccgtctgctgacccacgccttgggacataccgcgttaccaggcctgctgttgtcacttctcttgctgcccacagtgggttggcagcaggagtgtcatctcggtaccctgcggtttctgcatgcatccgctctgttggctctcgcgagcggactgttggcggtactgctggcagggctggggctgtctagtgctgccggatcctgtggctacatgcctgtacaccttgctatgcttgccggagaggggcaccggccacgccgaccaagaggcgctctgccaccgtggctgtctccctggttgcttttggctctgacgcccctcctgagtagcgagccaccatttctgcagctgctttgtggtctcttggccggtcttgcatatgccgctggggcattcaggtggttagagccgtccgaaagaaggcttcaggtctag

SEQ ID NO: 53563 - DNA, 912 bp, Artificial Sequence
  Description of Artificial Sequence: Synthetic coding sequence
atgaagggcaaagaggagaaggagggaggcgctcgcctcggagcaggaggaggcagccctgagaaaagcccctccgcccaggagctgaaggagcaggggaatcgcctgtttgtcggcagaaagtacccagaggctgctgcttgttatggaagggctattactcggaatcctctggtcgcggtgtactacacaaacagggccctttgctacttaaagatgcagcagcatgaacaggcattagcggattgccgaagagctctagagctcgatggtcagagtgtaaaagcccacttttttttggggcagtgtcaactagagatggaatcctatgacgaggcaatcgcgaacttgcagcgcgcttactccctggcgaaagaacagcggctgaattttggagatgacatacctagcgcattaaggatcgcgaaaaagaagcgctggaactccatagaggagcgtcggatccaccaggagagcgaactacactcctacctatcacgacttatcgctgccgaacgcgaacgcgaactcgaggaatgtcagcgtaaccacgaaggcgatgaagacgactcacatgtcagagcccaacaggcttgcattgaagccaagcacgacaagtacatggcagatatggacgagcttttctcccaggtggacgagaagaggaaaaaacgcgacattcctgattacttgtgcggcaagatcagtttcgaactcatgcgggaaccatgcatcacgccttccgggattacttacgaccggaaagacatcgaagaacacctgcagcgggtgggtcatttcgaccctgtgacacggagcccgctcacccaagaacagttaatcccgaacctggccatgaaggaggtgatcgacgctttcatctcggaaaacgggtgggtagaggactattag

SEQ ID NO: 53564 - DNA, 1122 bp, Artificial Sequence
  Description of Artificial Sequence: Synthetic coding sequence
atggatagatcaagtttactccagttaattcaagagcagcagctggatccggagaacacgggcttcatcggcgcagatacctttacaggcctggtgcattcccatgaactgcctctggatcctgcgaagttggacatgctcgtggctctggcacaaagcaatgaacagggtcaggtttgttaccaggaactggtagatctcataagcagtaagagatcctcgagctttaaacgggctatcgccaacggacagcgggctctccctcgggacggacctctggacgagccaggactcggcgtgtataagcgattcgtacgatatgtggcatatgagatccttccctgtgaggttgacaggcgctggtacttttatcgacaccgaagctgtcctccacccgtctttatggctagtgtgactctcgcccagataatagtattcctgtgctatggggcacgattgaataaatgggtactgcagacctatcaccccgagtacatgaaaagcccactcgtctatcaccccggtcatcgtgctagggcttggcggttcctgacatatatgtttatgcacgtgggtctggagcagctcggtttcaacgctctcctccaactcatgatcggcgtgcccttggaaatggttcatggactcctgcgcatttcattactatacctagccggtgtgctggcagggtccctaacagtgtctattaccgacatgcgggctcccgtggttgggggttcgggtggggtgtacgccctgtgcagtgctcatctggctaacgttgtgatgaactgggcaggtatgagatgcccctacaagctgctccgtatggttcttgccttggtgtgtatgtcatccgaagtggggagagcagtgtggcttcggtttagtccacctttacccgcaagtggtccccaacccagtttcatggcccatttggctggtgcggtcgtgggcgtgagcatggggttgactatcctaagatcctacgaagaaaggctgcgggatcagtgtggttggtgggttgtgcttctcgcctatggaacctttctgctgtttgccgtgttttggaatgtctttgcttacgatcttctcggagcccacatcccgcctcctccatag

SEQ ID NO: 53565 - DNA, 933 bp, Artificial Sequence
  Description of Artificial Sequence: Synthetic coding sequence
atggatcgtagctccctcttgcaattaatacaggaacagcagctggatcctgaaaacacggggttcatcggcgctgataccttcactggcttggtgcatagtcacgaattgcctctcgaccccgcaaagctcgatatgctggtcgccttggcccagagcaacgagcagggacaggtctgctatcaggagctggtggacctcatttctagtaaacggtcatcgagttttaaacgcgcaatcgcaaatggacagagagccttgccacgagatggccctctggatgaaccagggttgggcgtatacaaacgattcgtgcggtacgttgcatacgaaatactgccttgcgaggtggatcggagatggtatttttataggcatagatcctgcccgcctcccgtattcatggccagcgttaccctcgcacagatcattgtgttcctgtgctatggtgccagactgaacaagtgggtactgcagacatatcaccccgaatatatgaaatctcccctggtttaccatccaggacaccgcgcacgagcatggagattcctgacttacatgtttatgcacgtcggcctggaacaactgggctttaacgctttattgcagctcatgatcggagtgccactggagatggttcacggtctgctgcggattagcctgctgtatttggctggagtcctggccggaagcctcaccgtgtccattaccgacatgcgggctcccgtggtgggcggttcgggtggagtgtatgcgctctgttccgcccacctagcgaacgtcgtgatggtgaccgggctgcctggcggtggcagaggggaagggccacaagtgagcttgaccactagtagattgcacacacccatagagctgggatgggacgaaatgagcctccaggtcgccgaggacggggcagggctgggcgttcagtag

SEQ ID NO: 53566 - DNA, 912 bp, Artificial Sequence
  Description of Artificial Sequence: Synthetic coding sequence
atggccgctgtgcatgacctggagatggaatctatgaacctaaacatgggcagggaaatgaaggaagagctggaagaggaagaaaaaatgagggaggacggaggagggaaagatcgagctaagtccaagaaggtgcacaggattgtgagtaagtggatgctcccagaaaagagtcgtgggacctacctcgagcgggctaattgctttccaccgcctgtattcataataagtatttcattagccgagctggccgtctttatttattacgctgtgtggaaaccccagaaacagtggattactctggataccggcattctcgagtctccgttcatttactctccggagaaacgtgaggaggcatggcgtttcatatcttatatgctggtgcacgccggtgtgcaacacatcctgggtaacctgtgcatgcagctcgtactgggcataccactcgagatggtacacaagggcctgcgggtcggactggtgtatctcgcaggagtgatcgctggttcattggctagttctatcttcgacccactgaggtatctggtaggggcaagtgggggtgtatacgctttaatggggggttattttatgaacgtcttagtgaatttccaggagatgattcctgccttcgggatttttcgcctgctgattatcatcttgattatcgttctggatatgggattcgccctatatcggcgattcttcgtaccagaagatggaagccctgtctcctttgcagcccacattgccggaggcttcgcgggtatgagcatcgggtacactgtctttagttgctttgataaagccctgctaaaggacccccgattctggatcgccatcgcggcttatctcgcttgtgtcctttttgccgtgttcttcaacatttttctgagcccagcaaattag

SEQ ID NO: 53567 - DNA, 1152 bp, Artificial Sequence
  Description of Artificial Sequence: Synthetic coding sequence
atgcagctcggcaagcggcataaactgaccacaaagtctgtgtgtcacggaaaaggcgtggttatccgcgtgctcgccctgccaggcccaagttgggtgagacgcagacgagagggcaaggccctggagtcaagcaggtgcgctcgacagcccagagaggagagacagccagaggacctgggaccgccagctgtgccatgggatagttgcccgtcaggtgaagaaggcggaccacggacaatggctgccgtgcacgacttggagatggagtctatgaatctgaatatgggacgggagatgaaagaagagttggaagaagaggaaaagatgcgagaggatggcggtggtaaagatcgggcaaagagcaagaaggtacatcgaatcgtcagcaaatggatgctgcccgagaaatcacgaggcacatatctggagcgcgcaaattgctttcctccacctgtgttcatcatcagtatttctctggcagaactggcagtctttatttattatgctgtttggaagccgcagaagcagtggataaccctagacactgggattcttgagtccccctttatttacagcccagaaaaacgcgaagaggcttggagatttatttcctatatgttagtccacgccggagtgcagcatatcctgggaaatttatgcatgcaactggttctgggaattccactcgagatggtacacaagggtctccgcgtcggcctggtgtacctcgccggagttatcgccggatccctcgcatcgtcaattttcgacccgctacgttatctcgtgggcgcaagcgggggagtgtacgctctcatgggcggatacttcatgaatgtacttgtgaactttcaggaaatgattccagcttttgggattttccggctgttaatcattatcctaattatcgtgctggatatggggtttgccctgtacagacgctttttcgtgcccgaagatggctccccagtatcttttgcagcccatatcgccggagggtttgcaggtatgtctattggctataccgttttctcctgtttcgataaggcgttacttaaagatccacgcttctggatagcaatcgcagcctatctcgcctgcgtcctcttcgcagtattctttaatatttttctgtctcctgcaaattag

SEQ ID NO: 53568 - DNA, 912 bp, Artificial Sequence
  Description of Artificial Sequence: Synthetic coding sequence
atggcagctgtgcacgaccttgagatggaatccatgaaccttaatatggggagagagatgaaggaggagctcgaggaagaggagaagatgcgggaggatggtgggggtaaagatcgggcaaagagtaaaaaggtgcaccggattgtgtccaagtggatgcttccagaaaaatctcgtggaacctacctagagcgtgccaactgctttccgccacccgtatttattatttctatctcgctggccgaactggcagtcttcatctattatgcagtgtggaagccgcagaagcaatggatcacgctggacactggtatcctggaatccccattcatatattccccggaaaagagagaagaggcctggcgcttcattagctacatgctcgtccatgccggagtgcaacatatactaggtaacctctgtatgcagctagttctcggaatccccctggaaatggtgcataaggggctgagagtcggactggtgtacctagccggagtcatcgctggtagcctggcaagtagcatctttgatcccttgagatatctggtcggtgccagcggcggagtctacgcgctcatgggcggatatttcatgaatgtcctggtgaatttccaagagatgatccccgcatttggcatctttcgtctattaataattatcctgatcatagtgttggacatgggattcgccctgtaccgacgatttttcgttcctgaagacggaagccccgtgagcttcgctgcccatattgctggaggatttgccggtatgtccattgggtatacagtgttctcttgcttcgacaaagctctcctgaaggatcctcgcttctggattgccatcgctgcatacctggcatgcgtgctgtttgctgtgttctttaatattttccttagtcctgcaaattag

SEQ ID NO: 53569 - DNA, 1113 bp, Artificial Sequence
  Description of Artificial Sequence: Synthetic coding sequence
atgaccactacatatatgttatctaaaaatcccctcgaagtctttgatatttgtcggtttaacacttgcaattttggaaaggccctggaaagcagcaggtgtgctaggcaaccacgtgaagagcgtcagcctgaagacctcggcccaccagccgtgccctgggattcttgtccatctggagaggaaggaggccctaggacaatggctgccgtgcatgaccttgagatggagagtatgaatctgaacatgggaagagaaatgaaagaagagctcgaggaggaagaaaagatgcgcgaagacgggggaggtaaggatcgcgctaagtccaagaaggtccaccgaatagtgagcaaatggatgttgcctgagaaatcaagaggaacataccttgagcgagccaattgcttcccacctcccgtctttataatctcgatttcccttgctgagttggcagtctttatttactacgctgtatggaaacctcagaagcagtggatcacacttgatacagggattttggagagtccctttatttacagtccagagaagcgagaagaggcgtggaggtttatctcatatatgctggtgcacgccggagtgcagcacatcctgggtaatctgtgcatgcagctggtgttaggtatacccttggaaatggtccacaagggcttgcgcgtcgggctagtgtacctagccggtgtgattgctgggtctttagctagctcaatcttcgaccccctgagatacttagtgggcgcatcaggtggggtgtatgcactcatggggggatattttatgaacgttttagtcaatttccaagagatgattcccgcattcggtattttccgactactgataatcattctcatcattgtgctggacatgggtttcgcactgtatcgtcgattttttgtgcccgaagatggtagcccagtgtccttcgctgcccatattgccggaggttttgcaggtatgtccatcggctacacagttttctcctgtttcgacaaagccctgctgaaggatccccgtttttggatcgctatcgccgcatacttggcgtgtgtactttttgcggtgttctttaacatcttcctctctcccgctaattag

SEQ ID NO: 53570 - DNA, 1215 bp, Artificial Sequence
  Description of Artificial Sequence: Synthetic coding sequence
atgggtgaacacccctcacccggacccgctgtcgcagcttgtgctgaggcagagcggatcgaggagcttgagccggaggccgaggaacgccttcccgcagcgcctgaggatcactggaaggtccttttcgatcagtttgacccgggtaataccggctacatcagtactggaaagtttagatcgcttcttgaatcccacagttccaaacttgatcctcataagagggaggtgctgctggctcttgctgactctcacgccgacgggcagattggataccaggactttgtaagcctgatgagtaataaaagatccaatagtttccgccaagccatactgcagggaaacaggcgcctgtctagcaaagcactgctggaggagaagggcctctctctgagtcagcgactcattcggcatgtggcgtatgagacgctacctagggagatcgatagaaagtggtactatgactcctatacgtgttgtcccccaccctggttcatgattacagtgacactcttggaggtggcttttttcctgtataatggcgtgtccctgggacagtttgttctacaggtgacccatcccagatacttgaagaatagccttgtttaccatccccagctgcgtgcgcaagtatggcggtatctgacatatatatttatgcatgcgggaatcgaacacctggggttgaatgtagtgctgcagttactggttggggtgcccctggaaatggtgcacggcgctacacgcatcgggctcgtttatgtggctggggtagtcgccggaagccttgcagtgtcagtcgcagacatgactgcaccagtcgtgggaagctcaggcggtgtgtacgcactggtgtccgcccacctcgccaatattgtaatgaactggtctgggatgaagtgccagttcaagctgctgaggatggctgtcgcactcatttgtatgtctatggagtttggtagggctgtgtggctgaggtttcacccctcagcttatcccccatgcccccacccctccttcgtggcccacttgggcggtgttgctgtgggaataactcttggcgtcgtagttctgcgcaactacgaacaacgcctgcaggatcagagcctgtggtggatatttgtggcaatgtacacagtgtttgtgctttttgctgtattttggaatatttttgcctatacacttctcgatctgaagctgccacccccaccatag

SEQ ID NO: 53571 - DNA, 1287 bp, Artificial Sequence
  Description of Artificial Sequence: Synthetic coding sequence
atgggagagcacccttccccaggacccgcagtcgctgcatgtgcggaagccgagaggattgaagaactggagccggaggcagaagagcggttgcctgccgcaccagaggatcactggaaagtgttattcgatcagttcgaccctggtaatactggctatatctcaacaggcaagtttcgatccttactcgagagtcactcaagtaagctagacccacacaagagagaggtgctcctggctcttgcagatagccatgccgatggacagatagggtaccaagatttcgtatccctgatgtccaacaaacggtcaaattccttccgacaggccatacttcaggggaatagaagattgtccagtaaagcactcttggaggagaaaggcctcagcttgtcccaacggctcatccggcacgtggcttacgaaaccttgccacgcgagattgaccgaaaatggtactatgactcttatacgtgttgtccacccccatggttcatgataaccgttaccctcctggaggtcgcgttcttcctctataacggcgtgagcttggggcagttcgtgctgcaggttacccatccacgctacctcaaaaattcacttgtgtaccaccctcaactcagggcccaagtgtggcgatatcttacctacatcttcatgcacgccggaatcgagcacttgggtctaaacgtggtgctacagctgctcgtgggagtgccgctcgaaatggtccatggagcaactcgcatcggactagtgtacgtggctggcgtcgttgcagagcttgtgcggcacgaggtgcctgtgcaagccgcagcagacggatgcgggccttacctctacgaacacggagtgtgggcagggagggtagcacccctaccgcctgtggggctgagccctgtgccatcacctaagctttgcggagccctgggctggcggggaagaggccaccatcctggaagaggaggtcccgaagaattgagagctgaagccccaggccctgtgacagtggttgacttctgcgggcatgtgcatagattgcgtgcagtgcggtgtctgctggagcatttgtgtctgcatccagccggactgaaagcagctgcatccccgctgagagccggaggcccaagatcaggtcgtggcggtaaaagcagcacacaccgggagaggctgcgcggattctttagtagtcctgcccaactaggccgagccgataaggaccggaggctgtgggcaacggtaatgtttgtttttcggttcgggcacaccgtggagactttattttag

SEQ ID NO: 53572 - DNA, 921 bp, Artificial Sequence
  Description of Artificial Sequence: Synthetic coding sequence
atgtccaacaaaaggagcaacagtttccgccaggcgattctgcaggggaatcgcagactgagctccaaagcattgctcgaagagaaagggctctctctctcacagcggctgatccgccatgtcgcctacgaaaccctccccagagaaatcgacagaaaatggtactacgactcgtacacctgctgtcccccaccctggtttatgatcaccgtcactttactcgaagtggcgttcttcttatataatggggtgtctcttggccagttcgtattacaggttacccaccctcgatatctgaagaatagtctagtctaccacccacagctgagagctcaggtgtggaggtatctgacttacatttttatgcatgctggcatcgaacacctcggtttaaatgtggtcttgcagctactcgttggagtccctttggagatggtgcatggcgctactcgaattggactcgtgtatgttgccggagtcgttgccggatcactggccgtgagcgtcgccgatatgaccgctccagttgtaggctcctctggcggagtgtacgcactggtgtcggcgcatcttgcaaacattgtgatgaactggtctggcatgaaatgccagttcaagttgcttagaatggcggtcgcattgatctgcatgtctatggaatttgggagggccgtctggctgcgatttcaccctagcgcctacccgccatgtccccacccttctttcgtggctcacctgggtggcgttgctgtggggattacactaggcgtggtcgtattgcggaattatgaacagagactgcaggaccaatcactttggtggattttcgtggccatgtacactgtttttgtgctgttcgccgtgttctggaacatctttgcttacaccctgctagatctgaagctgccaccgcctccatag

SEQ ID NO: 53573 - DNA, 1191 bp, Artificial Sequence
  Description of Artificial Sequence: Synthetic coding sequence
atgggcgagcacccaagcccagggcctgccgtcgccgcttgtgctgaggctgaacgcatcgaggaactggagcccgaggctgaggaacggctccccgcagctcccgaagacttcgaccctggaaataccgggtacatatccacagggaaatttaggagcctccttgaaagccactcaagcaaactcgatccacacaagagagaggtgctcctggccctcgccgactcccatgccgacggccaaatcggctaccaggatttcgtgagtctgatgtccaataagcgatccaatagtttccggcaggctatcctccagggaaacaggagactgagttccaaggctctgcttgaggaaaaaggcttatcgctgagccagcgcctcatccggcacgtggcctacgagaccctgccacgggaaattgatcggaagtggtactatgacagctatacgtgttgtccaccaccctggttcatgatcaccgtcaccttactggaagtggcgtttttcctgtacaacggcgttagcctggggcaatttgtcctgcaggtgacccaccctagatacttgaaaaatagtttagtgtatcacccccagctacgagctcaagtttggcgataccttacttacatcttcatgcacgctgggatagaacatctcgggctgaatgttgtcctgcagctgctggtcggcgttcccctggagatggtacacggggctactagaatcgggctagtctacgtagccggagtggttgctggaagtctcgccgtgagcgtggctgatatgactgcccctgtggtggggtcgagcggtggagtgtacgctctcgtaagcgcccatttggccaacattgttatgaactggagcggtatgaagtgccagtttaagctcctacgaatggcagtggctttaatctgtatgtctatggaatttgggcgagctgtatggttgaggttccaccccagcgcatacccaccctgtccccacccctcgtttgttgcacatctaggaggtgtcgccgttggaattacgctgggagtggtggtgcttaggaactacgagcaacggttacaggatcagtccctgtggtggatcttcgtagccatgtacactgtatttgtgctgtttgctgtgttttggaacatctttgcatatacactcttggaccttaagttgccacctcctccctag

SEQ ID NO: 53574 - DNA, 927 bp, Artificial Sequence
  Description of Artificial Sequence: Synthetic coding sequence
atgtgtctgctgctgtcttctgcggttttcggtgtcaagtacaacttgctggctcacacaactctcactctcgaaagcgcagaggacagcttcaaaacacacaacttgagcatcaatggcaatgaggagagttctttttggttacctttgtatggaaacatgtgttgtcggctggtggctcagccagcatgcatggcggaggatgcatttgccggatttttgaatcaacagcagatggtcgaagggctcatttcttggcgaaggctctattgcgtgctccgtggcggaaagctgtattgcttttatagccccgaggagatcgaagcaaaggttgagccagccctcgtggtacctattaataagtctttagtgctgttcgaggacagccttgaggggattcagttagcaatcagccagagcttcaaggagaccaggatccgggctatggacaaagatgctaagaaaaggattcacaacttttctgtgattaaccccgtcccaggacaggccatcacacagatatttgctgtcgataacagagaggaccttcaaaagtggatggaggctttctggcagcacttcttcgatctgtcgcaatggaaacactgctgcgaagagctaatgaagatcgaaatcatgtcccctagaaaaccgcctctgttcctcaccaaagaagctacttccgtctaccacgatatgtcaatagactcaccaatgaaattggagagccttaccgatattatacaaaaaaagatcgaggaaaccaatggccaatttttaattggtcagcacgaggagtctcttccacccccatgggccactctgttcgacgggaaccaccagatggtcatccagaagaagaacaactctaaccaactccataatctccaaaagcttcctgccacctctaaattcttgttcacttag

SEQ ID NO: 53575 - DNA, 1830 bp, Artificial Sequence
  Description of Artificial Sequence: Synthetic coding sequence
atggagggcccttcattaagaggtccagcactcaggctggccggactcccaacccaacaggactgcaatattcaggagaagatcgacctagaaattcggatgcgggaaggcatatggaaactcctcagtctgtctacgcagaaggatcaagtcctgcatgcagtaaagaacctcatggtctgcaatgctcgcctgatggcctacacctccgagcttcagaagctggaagaacagattgcgaatcagaccggtagatgtgacgtgaaattcgagagtaaggagcgcactgcatgcaaagggaaaatcgccatcagcgatattagaatccctctcatgtggaaggatagcgatcacttttctaacaaggaacggagtagacgctacgcaatattctgcctgttcaagatgggcgctaacgtgttcgacaccgacgtggtaaatgtggataagacgattaccgacatatgtttcgagaatgtgaccatttttaacgaggcaggaccagatttccagatcaaggtggaagtttatagttgctgtactgaagaaagttctatcacaaatacacctaaaaaacttgccaagaagttaaaaacaagcatcagtaaggctacaggcaaaaagatctccagcgtactgcaagaagaagatgacgaaatgtgccttctactttcatcagctgtatttggcgtgaaatacaatttgctggcccacaccacactgacattagagtccgctgaagactcttttaagacacacaatctctccattaatggcaatgaggagtcgagcttctggctacctctttatgggaatatgtgttgtcgcctggtggctcagcctgcctgcatggcagaggacgcctttgcaggctttttgaatcagcagcagatggttgaggggttgatctcatggaggaggctgtactgcgtcctcaggggcggaaagttgtactgcttctacagccctgaagaaatcgaagcaaaggtggagccagccctcgtggtcccaatcaataaggagaccagaattcgcgctatggacaaggatgccaagaagcgcatccataatttcagtgtgatcaatcctgttcccggtcaggccattactcagatctttgctgtggacaatcgggaagacctccagaagtggatggaggcattctggcagcactttttcgatctttcacagtggaaacattgctgcgaagagcttatgaagatcgagattatgtccccacgcaagccccctctattccttacaaaggaggccacatctgtgtatcacgacatgagcatagacagtcctatgaaacttgagtccttgaccgatataatacagaaaaaaattgaggagaccaacgggcagttcctgataggccaacacgaagagtctctgccacctccctgggccactctgtttgacggcaaccatcagatggtgatccagaaaaaggttctttaccccgcaagtgaaccccttcacgatgaaaaaggcaaaaagaggcaggccccactcccaccttcagataaattgccattttctttaaaatcgcaatcgaacacggaccagctggtaaaggataactgggggaaaacaagtgtgtcacaaacctcctctctggatactaagctaagtactctgatgcaccacttgcaaaagccgatggcagcccctcgtaagttgttgccggcaagaaggaatagactcagcgacggagaacacacagacaccaagactaatttcgaggctaaaccagtgccagctcccaggcagaaatctatcaaggatatactggatcctcgctcttggctccaggcacaggtatag

SEQ ID NO: 53576 - DNA, 492 bp, Artificial Sequence
  Description of Artificial Sequence: Synthetic coding sequence
atggaaggcccttctcttagaggccctgcactccgcctggccggattgcctacacagcaggattgtaatatccaggagaagatcgacttagaaatccgcatgcgggagggaatttggaagctcctcagtctgtccacccagaaggatcaggtcctgcatgccgtcaaaaatctgatggtttgcaatgctcggctgatggcatacacctctgaattgcagaaactggaagaacagatcgctaaccagaccggccgatgcgacgtcaaattcgagagcaaggaaagaactgcttgtaagggaaagattgcgatcagtgacatcagaattcctttgatgtggaaggattcagatcacttttcgaataaagagcggagtcggagatacgcgatcttctgtctcttcaagatgggtgccaacgtttttgatactgacgtcgtcaatgtggacaagacaatcaccgacatctgcttcgaaaacgtgaccattctgtag

SEQ ID NO: 53577 - DNA, 1584 bp, Artificial Sequence
  Description of Artificial Sequence: Synthetic coding sequence
atggaaggtccatccctgcgaggtccagcactccgtctcgccggactccctacgcaacaggactgtaatatacaggaaaaaattgatctggaaattcgtatgcgggagggcatctggaagctacttagtctgagtactcaaaaggatcaggtgttacacgccgtgaagaacctgatggtttgtaacgcccgacttatggcctatacgagcgagctacagaagctggaagaacaaatagcaaatcagacgggcagatgcgacgtgaagttcgaaagtaaggaacgcacagcttgcaagggcaaaatagcaattagcgatatcaggataccactcatgtggaaggattcggaccatttctctaacaaagagaggtcccgcaggtacgccatcttctgtctgttcaagatgggcgcaaatgtgttcgacacagacgtagtgaatgtcgacaagacaatcaccgatatctgctttgaaaacgtgactatatttaatgaggctgggcctgactttcagattaaggtcgaagtgtactcctgttgcacagaagaaagcagtattactaacactccgaaaaaacttgccaagaaactgaagaccagtatttctaaggccacgggaaaaaaaatctccagcgtgctccaggaggaagacgatgagatgtgtttacttctctcgtcagcagttttcggagtgaaatacaatctcctggctcatacgaccctgactttagagtccgctgaagattcctttaagacccataatctaagcataaacggaaatgaggaaagttcattctggctcccactctacggaaatatgtgctgcaggttggtcgcccagcccgcttgcatggctgaggatgccttcgccggttttttaaaccagcaacagatggtcgaggggctgatatcctggcgccgactgtactgtgtactgcggggaggtaagctctattgcttttattcccctgaggaaatagaggccaaggtcgagccggctctggtggttcccatcaacaagtccctggtgctgtttgaagatagcttagagggaattcagctggccatcagccagtcgttcaaggagacacgaattcgggctatggataaggatgccaaaaagagaattcataatttctcggtaatcaatccagtgcctggtcaagcaatcactcagatctttgcggtcgataatagggaagaccttcagaagtggatggaggcattctggcaacatttcttcgacctgtctcaatggaagcactgttgtgaagaattgatgaaaattgaaattatgtcccctagaaagccaccgctcttcctaactaaagaggctacaagtgtctaccacgacatgagcatcgattcacccatgaaactggagtctctgaccgatatcatccaaaaaaagatcgaagagactaacggccagttcctgatcgggcagcacgaagagtccttacctcctccttgggctacgctgttcgatgggaaccatcagatggtcatccagaagaagaacaacagtaaccagttacataacctgcagaagttacctgctacaagcaaattcctgttcacttag

SEQ ID NO: 53578 - DNA, 297 bp, Artificial Sequence
  Description of Artificial Sequence: Synthetic coding sequence
atggctagtcttctttgctgcggacccaaactcgctgcttgcggaatcgtgctctccgcttggggagtgattatgctcattatgctcggaatctttttcaatgtgcactcggctgtgctgatcgaagacgttcctttcacagagaaagatttcgaaaatggtcctcagaacatttacaacttgtacgagcaggtgagctataactgcttcatcgcagctggactgtatttactgctcggcggattctccttttgtcaggtcagactcaataagcgtaaggaatacatggtgcgttag

SEQ ID NO: 53579 - DNA, 414 bp, Artificial Sequence
  Description of Artificial Sequence: Synthetic coding sequence
atgggttggctaaggcctggcccacgcccactttgtcccccagccagagcatcgtgggccttctcccaccggttcccctcacccctggcacccaggcgttctcccacccctttctttatggccagcctgctgtgctgcggcccaaagttagcagcatgtgggatcgttctctcagcatggggtgtcattatgctaattatgcttgggattttttttaacgtgcacagcgccgttctaattgaagacgtacctttcacagaaaaggattttgagaacggtccccagaatatttataacttgtacgaacaggtcagctataattgcttcattgctgctgggctctacctgctcttgggcggtttctccttctgtcaggttaggttgaacaaacgtaaagagtatatggtcagatag

SEQ ID NO: 53580 - DNA, 471 bp, Artificial Sequence
  Description of Artificial Sequence: Synthetic coding sequence
atgcagatctttgtgaagactctgaccggcaagaccatcaccctggaagttgagccatcagacacaatcgagaatgttaaagccaagatccaagacaaggagggtataccacccgaccaacaacggctaatctttgctggcaaacagctggaagatggcagaacacttagcgactacaacatacagaaggagtctactctgcacctggtgctgcggttgagaggaggggcaaagaagagaaaaaagaaatcgtatactacgcctaagaaaaacaagcacaagcggaagaaggtgaagctggctgtcttgaagtattataaggtggatgaaaatggtaaaatatccaggctgcggcgagagtgccccagtgatgaatgtggcgcaggggtgtttatggcaagtcacttcgaccgccactactgtggaaagtgttgtctcacatactgcttcaataaacccgaagacaagtag

SEQ ID NO: 53581 - DNA, 471 bp, Artificial Sequence
  Description of Artificial Sequence: Synthetic coding sequence
atgcagatttttgtcaagactttgacgggaaaaacaatcaccctggaggtggaaccctcggacacaattgaaaatgtcaaagcaaagatccaagacaaggaaggtatccctccagatcagcagcgcctgatcttcgctggtaagcaacttgaagacggacggacactgagcgactacaacatccagaaagagagtactcttcatctggttctgcggctgaggggaggcgctaaaaagagaaaaaagaagtcttatacaacgcctaaaaagaacaagcacaagaggaaaaaggtcaagcttgctgtattgaaatattataaagtcgatgagaacggcaagatttcccgtctgagacgagagtgcccatccgacgaatgcggcgcaggtgtgttcatggcaagccattttgatcggcattactgcggcaagtgctgtctcacatattgctttaacaagcccgaagataaatag

SEQ ID NO: 53582 - DNA, 471 bp, Artificial Sequence
  Description of Artificial Sequence: Synthetic coding sequence
atgcagatttttgtaaagacactcactgggaaaactattaccctggaagtcgaaccgagtgacactattgaaaacgtgaaagcgaaaatccaggacaaggaggggatccccccagatcagcagcgcctgatttttgctggcaaacagctcgaggacggtcgaaccctgtccgactacaatattcaaaaggaatccactctccacctggtgttgcggctgaggggcggagcaaagaaacggaaaaaaaagagttacaccacaccaaaaaagaataagcacaagaggaaaaaggtaaagctggccgtgctgaaatactataaggtcgacgaaaatggcaagattagtcggctgagacgcgagtgtccgtcagacgaatgtggggctggagtattcatggccagccattttgatagacattactgcggcaagtgttgtctgacgtactgcttcaataaacccgaggataaatag

SEQ ID NO: 53583 - DNA, 321 bp, Artificial Sequence
  Description of Artificial Sequence: Synthetic coding sequence
atgcaaatatttgtaaaaacgctgacaggaaagacgataacactggaagtggaaccttccgacactattgagaatgtgaaagctaaaattcaggataaggagggaatccctccagatcaacagcggcttatttttgccggaaagcaattggaagatggcaggactctgtctgattacaacatacagaaagaaagtacgctgcacctcgtactgagattgaggggcggtgccaagaagcggaagaaaaagagttacacgacaccaaaaaagaataaacacaaaagaaagaaagtgaaactagccgtcttgaaatactattag

SEQ ID NO: 53584 - DNA, 1428 bp, Artificial Sequence
  Description of Artificial Sequence: Synthetic coding sequence
atgcccggtatctcagctcgcggtctgtcacatgaagggcgaaaacaactggccgtaaatcttactagggtgctggccctttaccgatctattctagacgcctatataattgagttcttcactgataatctctgggacaccctgccctgctcttggcaagaggctctagacggtctgaagccaccacaactggcgacaatgctgttgggtatgcctggcgaaggagaagtcgttcgctaccgatctgtttggcctctcactctgttggcactgaaaagcacagcttgcgccctggccttcacaagaatgccaggattccagactccgtcggagttcctggagaatccttcacagtctagtcgcctcacagccccattccggaagcatgtgagaccaaaaaaacagcatgaaataagacgattgggagagctcgtgaagaaactctccgattttacaggatgcacacaggtggtcgatgtggggagtggccaggggcatctctcaaggttcatggcccttggacttgggttaatggtcaaatctatcgagggggaccagcgccttgtcgagcgcgcacagcgtctggaccaggaactattgcaggccctggagaaggaagagaaacgcaaccctcaggtagttcaaacctccccacggcacagtccccatcatgtggtgcggtgggtcgaccccaccgcgttgtgcgaagaactactcttgcctttagagaacccgtgccagggacgggcacggcttcttctcactggtctgcacgcctgcggtgatctttcagtcgccctcctccgccacttttcctgttgtcccgaggtggtcgctcttgcctctgttggctgttgctatatgaagctgagtgatcccggagggtatcctttgtctcagtgggttgctggattgcctggttatgagctgccttaccgtctgcgagaaggggcatgccacgccctggaggagtacgccgagcggctgcagaaggccggacctgggctccggacacactgttatcgagcggcactcgagacggttatcagacgtgctagaccagagcttcgacgcccaggggtccagggaatcccgagggttcacgagctgaagattgaggaatacgtgcagcggggactacagcgtgttggcttggatccacagctgccactaaacctggcggctctgcaggcccacgttgctcaggagaaccgcgttgtagccttttttagtctagccttgctacttgcgcctcttgtagagacactaattctgttggacagactgctgtacttgcaagaacaggggtttcatgcggagttgttaccaattttttcacccgagctttctccaaggaatctcgttcttgtggctacaaagatgccactgggccaagccctgtctgttctggagacagaagacagctag

SEQ ID NO: 53585 - DNA, 834 bp, Artificial Sequence
  Description of Artificial Sequence: Synthetic coding sequence
atgccgggtatctccgctcgtggtctgtcacacgaggggcgaaagcaactggcggtgaacctcacccgcgtgctggcgctgtaccgctctattttggacgcatacatcatcgagttctttacagataatctgtgggacaccctgccttgctcctggcaggaggcgctcgatggtttgaagccaccccaactggccacaatgctgctcgggatgcccggagagggtgaagtggtgaggtaccgcagcgtctggccactcacgcttcttgcactgaaaagcactgcatgtgctctggctttcactagaatgcccggattccagaccccatccgagttcctggagaacccctcacagagttcacgactgacggctccatttagaaagcacgttaggcccaagaaacagcatgagatccggagattaggagagttggtcaaaaaactctccgacttcacaggctgtacacaggtggtggacgtaggcagcggccagggtcatcttagtagattcatggcactgggattaggcctcatggttaagtccatcgaaggagatcagagactggtggaaagagctcagcgactcgaccaggagctgctgcaggctctcgaaaaggaagaaaaaagaaatcctcagatctgtgccgctggtgctaccgcttcgggcgctaggtctccagctgccaccgagtctggctgtccatctggcccacggggacccggtgagccatgtggaggtttattgcagcctggaagcaccgcctgtcccactggtggggatgcgtactcgacaggccctgccgcagttccatccggtacgggcttcccatgttag

SEQ ID NO: 53586 - DNA, 3594 bp, Artificial Sequence
  Description of Artificial Sequence: Synthetic coding sequence
atgggcaggtctggcaaacttccctctggtgttagtgccaagctgaagaggtggaaaaaaggccactccagcgatagcaaccctgcaatttgccgccacagacaggctgctcgctctcgctttttttctaggcccagtgggaggagcgatcttaccgtggatgctgtgaagctgcacaacgagctccagtccggttcccttaggctgggcaagtctgaggccccagaaaccccaatggaggaggaggccgagttagtgctgacggagaagtccagtggtacctttctgagcggtttaagtgactgcaccaatgtaactttcagtaaggtacagaggttttgggagagcaactcggccgcacataaggaaatctgtgcagtcttagccgctgttacagaggtcattcggtcacagggagggaaagaaacagagactgagtactttgcagctctgatccgcaaggccgctcagcacggagtatgctctgtcctgaaaggatcagaatttatgttcgagaaagcacctgcgcaccaccctgcagccatatcaactgcaaagttttgcatccaggaaatcgaaaagtccggcggtagcaaggaagctactactacgttgcacatgttaactctcctgaaagatcttctaccctgttttcccgagggtttggtgaaatcgtgctctgaaacactgttaagagtgatgacactgtctcatgttttagtcacggcctgtgccatgcaagccttccacagtctgtttcacgcgcgacccggtttgagcaccctgtctgcagaattaaacgcacagatcattactgctctgtacgactatgtcccgtcagagaacgatttacaacccctcctcgcatggttaaaggtgatggagaaagctcatattaacctggtgcgcctgcagtgggatctgggtctgggacatttacctagattcttcgggactgctgtaacctgcctcctctcccctcatagccaggtgttgaccgccgcaacccaatcactgaaagaaattctgaaggaatgcgtggctccacacatggccgacatcggctctgtgacctcctccgcttccggccctgcacagtcagtcgcaaagatgttcagagcagtcgaagaaggtctcacctacaaatttcacgctgcttggtctagcgtgctgcagttgctatgtgtgtttttcgaggcctgcgggagacaagcccatccggtgatgcgaaagtgcctccagtctctgtgtgatcttagactcagcccacatttcccccacacagccgctttggaccaggccgtgggagcggctgtaacgtctatgggccctgaggtggttctgcaggccgtgccattggagatagacggctctgaggaaaccctagacttccccagaagctggctcctccctgtgattagggaccacgtccaggagactcgcctggggttctttaccacctactttctccccctcgcaaataccctgaagtcaaaggctatggatctggcgcaagctggcagtacggtcgaatcgaagatttacgatacgctccagtggcaaatgtggaccctgctgcccggattttgtacacgtcctacagacgtagccatcagttttaaaggcctggctcggaccctgggtatggctataagcgaaagacctgaccttcgggtcacagtttgtcaggctctgcgcacgctgatcaccaagggctgccaggcagaagcagatcgcgctgaagtgagcaggttcgctaagaacttcttgcctatcctctttaacctttacggacagcccgttgccgcaggagacactcctgcccctcgtcgcgctgtactggaaacgattcgaacatatctgactataactgacactcagctcgtcaacagtcttctggagaaagcaagtgaaaaggtcctggaccccgcatcctccgactttactagacttagcgtcttggacttagtggttgctctcgccccttgcgctgatgaagctgcaatcagtaaattgtatagcaccatccggccttatttggagtccaaagcccatggggtgcagaaaaaggcctatcgcgtcctggaggaagtttgcgcgtccccccagggcccaggggcattgtttgtccagagccacctggaggatctgaaaaaaacgttgctcgacagtcttcgctcgaccagctcccctgcaaagaggccccgtttaaagtgcctactgcatattgtgcggaagctgagtgcagaacacaaggagttcatcaccgctctgatacccgaagtaattctctgcacgaaggaagtgtccgtgggggctcgaaaaaatgccttcgctctgttggtggagatgggtcacgcctttctgcgctttggcagtaatcaagaggaggccttacagtgctacttggtgctgatatatcccggtctggtaggcgcagtgacaatggtaagctgtagcatactggctttgacccacttacttttcgagttcaaaggcctgatggggacaagcacagttgagcagttgctggagaacgtgtgtctcctgctcgcaagcagaaccagagatgtcgttaaaagcgcactgggcttcatcaaggtggcggtcacggttatggacgtggcacacctagcaaagcacgtacagctggtgatggaagcgattggaaaactgagtgatgatatgcgcaggcattttcgtatgaagctccgcaatctgtttacaaagtttatcagaaagtttggatttgagcttgttaagcgactcctccccgaggagtaccaccgcgttttagtgaacatcagaaaagctgaagctcgggcaaagaggcatcgtgctctctcacaggctgccgtcgaagaagaagaagaagaagaggaagaagaggagccggctcagggaaagggcgatagcatagaggaaatactggccgactccgaagacgaggaggataacgaggaggaggagaggagtcgtgggaaggagcagcgcaaacttgcgagacaacggagccgcgcatggctcaaggagggaggtggcgacgagcctcttaattttttggatcccaaagttgcacagagggtcttggccacccagcccggaccaggaaggggcagaaagaaagatcatggttttaaggtgtccgctgatggccgtctaattattagagaggaagcggatggtaataagatggaggaagaggaaggtgctaagggggaggacgaggaaatggcagacccaatggaggacgtgatcatccgcaacaaaaaacatcaaaaactgaagcatcagaaggaggctgaggaggaagagctggaaatcccaccgcagtaccaagccggtggcagcggaatccatagaccagttgccaaaaaggccatgccaggtgccgaatacaaagcaaaaaaggccaagggggatgttaaaaagaaaggacggcctgacccatacgcctatatcccactcaaccgctctaagctgaacaggcgcaaaaagatgaagctgcagggccagtttaaggggctggtcaaagcagctagaagaggctctcaagtagggcataagaacaggcgcaaggatagacgcccatag

SEQ ID NO: 53587 - DNA, 3894 bp, Artificial Sequence
  Description of Artificial Sequence: Synthetic coding sequence
atggggcgatctggcaagctcccttcaggagtgagcgccaagctaaagcggtggaaaaagggccactcaagtgactctaaccctgccatctgcaggcaccgacaggccgctagatcccggttcttcagccggcctagtggcaggtccgacctgaccgttgacgccgtgaaattgcataatgagctgcagtccgggagcctgaggctgggcaaatcggaagcccctgagacaccgatggaagaggaggctgagcttgttctgacagaaaaatcctctgggaccttcctctccgggctgtctgactgcacaaatgttactttctctaaggtgcaacggttctgggaaagcaactctgccgctcacaaagagatttgtgctgtgcttgctgcagtaacagaagtcatccgctctcagggtggcaaagagaccgagaccgagtactttgccgcactcatgacaactatggaagccgtcgaatccccagagagcctcgctgctgtcgcctatctgctcaacctggttttgaaacgggtcccttcccccgtgttaatcaaaaagttttccgatacctctaaggcattcatggatattatgtctgcacaggcctcctccggcagcacttccgtgttgcggtgggttttgtcctgtttggctacacttttacgaaagcaagaccttgaagcgtggggttaccccgtgaccctgcaggtgtaccacggcctgctgtccttcaccgtgcatcccaaacccaagatcagaaaggcggctcagcatggcgtctgcagcgtcttgaaaggttcagagttcatgtttgaaaaggcccctgctcatcatcctgctgcgatttccaccgcaaaattctgtatacaagagatcgagaaatctggagggtccaaggaggcaacaactaccctccacatgctcacactgttaaaggatttgttaccatgttttccggagggactggttaaaagctgctccgaaacacttttgcgcgtcatgacactctctcacgtgctggtgaccgcttgtgcaatgcaggccttccactccctttttcatgcgcgtccagggctgagcacactctcggcagaacttaatgcacagataatcacagccctgtacgattatgttcccagtgagaacgatttgcagccgctcctggcctggctgaaagtgatggagaaggcgcacattaacctggtgcgtcttcagtgggaccttggcctaggacatctgccaagatttttcgggactgctgtcacgtgtctgctgagtccgcattcccaagttctcaccgccgcaacgcagagtctgaaggaaattctgaaggaatgtgtggccccacacatggcagatattggttcagttacttctagcgcctctggacctgcccagtccgtagctaaaatgttcagagctgttgaggagggcttgacctacaaattccatgccgcatggagttccgtgctgcagctcctgtgcgtcttcttcgaagcgtgcggccgtcaggctcatccagtcatgaggaaatgcttgcagtcactctgcgacctccggctctctccacatttccctcacacagctgcgcttgatcaggctgttggagctgccgtcacatctatgggcccagaagtggtcctgcaggcagtgcccctggagatagatgggtcggaagaaaccttggactttccaagatcctggcttctgcccgtcatccgagaccacgttcaggaaactcggctaggattcttcaccacatactttcttcctctagcaaacacgctcaagtcgaaggctatggatctcgcccaagctggctccactgttgagtccaagatctatgacaccttacagtggcagatgtggacacttcttcccggattttgtacccggcctacggacgtggcaataagcttcaaggggctcgctcgaacacttggtatggcaatttctgagcgaccggatttgcgggtaaccgtgtgccaagcgcttagaacattaattactaagggttgccaagccgaggccgaccgggctgaagtctcacggtttgccaagaactttctgcctatcctcttcaacctgtacggacaaccagtggcagctggcgacactccagcacctagaagagccgtgttagaaaccatccgaacttacttgactattacagatacacagttggtaaactctctcctagagaaagcctctgagaaggtgctggaccctgccagcagcgacttcacaaggctgtctgtgctagatttagttgtggctttggccccatgcgctgatgaggcggctatctcaaagctgtatagcacaattagaccttatctcgagtctaaagcccatggagtgcagaaaaaggcatatagggtccttgaggaggtgtgtgccagtccccaggggcctggggctctgttcgttcaaagtcacctcgaggacctcaagaagaccctcctggactctttgaggtcaacaagctccccagctaagcgacctcggctcaagtgtctgctccacattgtaaggaaactgagcgcagaacataaggagtttattaccgccctcatccctgaggttattctgtgcacgaaggaggtgagcgtgggagccagaaagaatgcatttgctttacttgtagaaatggggcacgcattcctccgttttggcagtaaccaggaggaggctctgcagtgttacctggtcttgatctaccctggactagtgggagccgttactatggtaagctgcagcattctggctctaactcacctactgttcgaattcaagggactgatggggacgagtacagtcgagcaattgttagagaatgtgtgcctactgttggctagcagaacccgggacgtggtcaaatccgctctaggattcataaaggtcgctgtgacagtgatggatgtggcacaccttgcaaaacacgtgcagctcgtcatggaggctatcggcaagctgtccgatgacatgaggagacactttaggatgaagctgcgcaatctgttcacaaagttcatccgtaaatttgggttcgaactcgtcaagaggctgcttcctgaggaatatcacagagttctggttaatattcggaaggctgaagcaagagctaagaggcatcgggcattgagccaggcagcagtggaggaggaggaggaggaagaagaggaggaagagccagcccagggcaaaggcgattctattgaggagatcctggctgatagcgaggatgaagaggacaacgaggaggaagaacgctctagggggaaagagcagcgaaagctggctagacaacggagtagagcctggctcaaggaagggggaggcgatgagcccctgaatttcctcgacccgaaggtagcacaaagggtgttggccacacagccgggaccgggacggggacgcaaaaaggaccatgggttcaaagtcagcgccgacggtaggctcataatccgggaagaagcagatggcaataagatggaggaagaggagggtgccaaaggagaggacgaagagatggctgatcccatggaggatgtgatcattaggaataaaaagcaccaaaaattgaaacaccagaaggaagcagaagaagaggaactggagattccccctcagtaccaggccggaggttcgggcatacaccggcctgttgccaaaaaggccatgcctggtgccgagtacaaagcaaagaaggctaagggagatgtgaagaagaagggcagacccgacccttacgcctacatccctctgaacaggtctaaattaaacagaaggaaaaaaatgaaactgcagggacagttcaagggtttagtcaaggcggctcggaggggttcccaggtcggtcacaaaaaccggcgaaaagataggcggccttag

SEQ ID NO: 53588 - DNA, 3711 bp, Artificial Sequence
  Description of Artificial Sequence: Synthetic coding sequence
atgggcaggtccggtaaactgccatctggagtatcagccaagctgaagcgctggaaaaaagggcactccagtgacagcaatcctgccatatgccggcaccgacaggctgcccgttcgaggtttttctcaagacctagcgggaggagcgacctgactgtggacgccgtgaagctccataacgaattacaatctgggtccctgcgcctgggaaagagcgaggccccagagactcctatggaggaagaggccgaactcgttctcaccgagaagtcatctggaacctttctatcaggcctctcagattgtactaacgtgacattctccaaggtccagcgattctgggagagcaattcagccgctcataaggagatttgtgcagtgctcgctgctgtgacagaggtcatccgttcacaaggagggaaggaaacagagacagaatactttgcggctctcgtcctctcctgcttggctactctgctccgcaaacaggaccttgaagcatggggatacccagtcacactgcaggtgtatcacggtctcctgagttttacagtccatccgaagccaaaaataagaaaggccgcacagcacggtgtgtgcagtgtgctcaaaggcagtgaatttatgtttgaaaaggcaccagctcatcaccccgctgctatcagcaccgccaaattctgcattcaggagatcgaaaagtccggtggctccaaagaggccaccactaccttgcatatgctgaccctgctgaaggatctattgccttgctttcccgaaggtctagtgaagagttgcagtgagaccttgctccgcgtgatgacgttgtcacatgtgttggtgactgcctgcgccatgcaggccttccacagcctttttcacgctagaccagggctctctaccttgtccgccgaactgaatgcacaaatcatcacggccctgtacgattacgtacccagcgagaacgacctccaaccactgctggcatggctcaaggtcatggagaaagcccatatcaatctggtgcgcctgcaatgggatcttggtctgggacacttgcccagattttttgggacagctgttacctgcctattatctccccattcccaggtgcttacggctgcaactcagagcctcaaagagattctgaaggagtgcgtggcaccccacatggctgatatcgggtccgtaacctcctcagcatcagggccagcccagagtgtggccaagatgtttagggccgtcgaggaggggttaacttacaagtttcacgctgcatggtcgtccgtgctccaattactctgcgtattctttgaggcctgtggccgtcaggcacacccagtcatgaggaagtgccttcagagtctgtgtgatctgcgactatcccctcacttccctcataccgccgcactggatcaagcagtgggagcagcagtcacttccatgggacctgaagtggtcttgcaggcggtgccactcgaaatcgacggaagcgaggaaacactcgacttcccacgatcttggctgttgccagtgatacgagatcacgtgcaggagacccggctgggttttttcacgacatactttctgccactggctaacaccctgaagagcaaggccatggacctcgcccaggctggcagcaccgttgagagtaagatttatgatacccttcagtggcagatgtggacactgctgcccggtttctgcacgcgccctacagacgtggcgataagcttcaaggggttggcacgcacgctcggtatggcaatatccgagaggcccgatctgagggtgacagtgtgtcaagccctgaggactcttattaccaagggatgccaagcagaggctgacagagcagaggtgtcacggtttgccaaaaacttcttgcctatactgtttaacctatatgggcagcctgtggctgcaggagacacccccgctcctcggcgagccgtcctggaaaccataaggacttatctcacaattacagatactcagttggtaaactccctgctcgaaaaggcctctgagaaagtgctggatcctgcgagttctgactttacgcgtctgagcgtgcttgatctggtggtcgctctcgcgccatgcgctgacgaggctgcaatttctaaactgtattcaacgatcaggccctatttggaatccaaagcccacggtgttcagaaaaaagcttatcgggtccttgaggaagtgtgtgccagcccacagggtccaggtgcgctgttcgtgcaatctcacctcgaagacctgaaaaaaacccttctggattccctccgttcaacctcctccccagccaagaggccccgtctgaaatgtttactccacattgtgagaaaactctcagcggagcataaggagttcatcaccgcactcatcccagaagtgatcctctgtactaaagaggtgtctgtaggagcacggaagaatgcattcgcgctcctggtagaaatggggcacgcatttctaaggtttggttccaaccaagaggaggctttgcagtgttacctggtgctcatttatccaggccttgttggcgctgtgacaatggtgtcatgcagtatcctggccctgacacatctgctttttgaattcaagggactgatgggcacatcaaccgtcgagcagttgctggagaatgtttgtctgctgttagccagcaggacaagagacgtggtaaagtccgccctgggcttcatcaaggttgctgttaccgtgatggacgtagcccatctcgctaaacacgtgcagctggtgatggaggcaattggtaaattgtctgatgacatgagaaggcactttaggatgaaattacggaacctgttcactaaattcatcagaaaattcggattcgagctggtcaaaagactcctcccggaagagtatcaccgggtgcttgtgaatatccgcaaggccgaggcgagagcaaagcggcatcgggctctctcccaggccgctgtggaggaggaagaggaggaggaggaggaagaggagcctgcccaaggcaaaggggactccattgaagaaatcttggcagattctgaggacgaggaagacaatgaagaagaggaacgcagcagggggaaagaacagagaaagttggctaggcaaagaagccgggcatggttgaaggagggtggaggggatgaacctctgaatttcctggatcctaaggtcgcgcagagggtattagcgacccaacctggaccgggacgaggacgcaagaaagaccacgggtttaaggtgtctgccgatggacgactcataatcagggaggaggctgacggaaataaaatggaggaggaggagggagctaaaggggaagatgaagagatggccgatcccatggaagatgttattattcgtaacaagaaacatcagaagttgaagcaccaaaaagaagctgaggaggaagaactggaaattccaccgcaatatcaggcgggaggcagcggtatccacaggcctgtggccaagaaggcaatgcctggggcagaatacaaggccaagaaggccaagggggatgtgaagaagaagggtcgaccagatccttacgcgtatattccgctgaaccgatcaaagctcaaccgcagaaaaaaaatgaagctgcagggccagtttaaagggctggtgaaagccgcaagacggggaagccaagttggccacaaaaatcgacggaaagaccgcaggccttag

SEQ ID NO: 53589 - DNA, 3048 bp, Artificial Sequence
  Description of Artificial Sequence: Synthetic coding sequence
atggacatcatgtccgctcaggccagtagcgggagtacctcggtccttagatgggtgctgtcatgcttagctacgttactgcgaaagcaggacctcgaggcctggggatatcccgtgacattacaggtgtatcacggcctgctctcatttacagttcaccctaaacctaaactggtcaccgcctgcgctatgcaggcgtttcactccttgttccatgcacgcccaggcttgtctaccctgtctgctgagcttaatgcccagatcatcaccgctctttatgattacgtcccctctgagaatgacctgcagcccctccttgcctggttgaaagtgatggagaaggcccatattaacctagtaaggttacagtgggatctgggacttggacatttgcctagatttttcgggactgcagtcacctgcctgctgagcccacactctcaggtgctaactgccgcaacccagagcctcaaggaaattctcaaagaatgcgtggcccctcatatggctgatatcggttcagtgacctcctcagccagcggacccgcacagtcagtggccaagatgtttagggccgtggaggaagggttgacatacaagtttcacgctgcttggagtagtgtgctgcagctcctgtgtgtgttttttgaggcttgcggtcgccaggcccatccggtgatgcgtaagtgtctgcagagcctgtgtgatctcaggctgagcccacatttcccacatactgctgcactagatcaggcagtgggagctgccgtcacatctatggggccagaagtggtattgcaagctgtgcccctcgagatcgacggcagcgaggagaccctcgacttcccccgatcttggctgctacctgtcatccgcgaccacgtccaggagactcggctgggatttttcacgacatactttttaccactggctaacaccctaaagagcaaggctatggatcttgctcaggccggttcaacggtagagagcaaaatttacgataccctccagtggcagatgtggacacttcttcctggtttctgcacaaggcctaccgatgttgccatcagtttcaagggtctggcacgcactctcgggatggccatcagcgaaagacccgatctcagggtgactgtgtgccaggcactgcgaaccctgataacgaaggggtgccaggccgaagccgatcgggctgaggtcagcaggtttgctaagaatttcctgcctattttatttaatttatatggccaaccagtggcggctggcgacaccccagcaccacggagggcagtgctggagacaatcaggacatatctgaccatcacagatacccagctggtgaacagcctgctcgagaaagcctctgagaaggttctggatcccgcatcatccgacttcaccagattaagtgtgctagacctggtggtggcactggctccctgcgcagatgaggcggctatctctaagctgtattccaccattagaccatacctggaaagcaaggctcatggcgtccagaaaaaggcttacagggtcctggaggaggtctgcgccagtccacagggcccaggagccctctttgtgcagtcccatttggaagacctgaaaaagaccctgttagacagcctgcgaagcacgtccagtcccgctaaacgtcccagactgaaatgtctgcttcatatcgtcaggaaactctccgcggagcataaagagtttataaccgccctgattccagaagtgattttgtgtaccaaggaggtatcagtgggggctagaaagaacgcgttcgcactattggtggagatgggtcatgcctttctccggtttggctcaaaccaggaagaagctctccagtgctacctggttttgatatacccaggcctcgtgggggctgtgaccatggtctcatgcagtatcctggcactcacgcacctccttttcgagtttaaggggctgatgggtacttcaacagtggagcagttgcttgagaatgtatgcctcttgctggccagccgtacccgggacgtcgtgaaatccgcccttggctttatcaaggttgcagtgaccgtaatggatgtggctcacttggcaaaacacgtacagctggtgatggaggcaattggtaagctctccgacgatatgaggcgccattttcggatgaagctcaggaacctctttacaaaattcatccggaagttcgggttcgaactggtaaagcgtctcctgcctgaggagtaccacagggtcttggtaaacatcagaaaggctgaagccagagccaagaggcatcgcgcactttctcaggcagccgtggaggaagaagaggaggaggaagaggaggaagaaccagcacaggggaaaggtgacagcatcgaagagatactcgctgattcagaggatgaggaagacaacgaagaagaagagagatcaagaggcaaagagcagcgaaaacttgcgaggcagcgtagtagggcgtggctgaaagaagggggaggcgatgagcccctgaactttctggacccaaaagtagcccagagagtgttggccacccagccaggaccaggcaggggccgtaaaaaggaccatggcttcaaggtgtcggcagacgggaggctcatcatcagggaagaggctgatggaaacaaaatggaagaggaggaaggagctaagggtgaggacgaagaaatggccgatccaatggaagatgtcattatccggaacaagaaacaccaaaagttaaagcaccaaaaggaggcagaggaggaagagctcgagataccaccacagtaccaggccggtggtagtggcattcaccgtcccgtggccaaaaaggcgatgcccggagctgagtacaaagctaagaaggccaaaggggatgtcaaaaaaaaaggacgtcccgacccatatgcctatattcctctaaatcggtcaaaattgaatcggaggaaaaagatgaaactgcagggacaattcaaaggactggtaaaagccgcacggcgaggatcccaggtgggccacaaaaatagacggaaggatagaaggccatag

SEQ ID NO: 53590 - DNA, 849 bp, Artificial Sequence
  Description of Artificial Sequence: Synthetic coding sequence
atggctgcggcagcgcctgactccagggtctctgaagaagagaacctgaaaaagacccccaagaaaaagatgaaaatggtcaccggcgcagtggcctcggtgcttgaggacgaagccacggatacgtccgactcggaaggttcttgcggttctgagaaagaccatttctatagtgatgatgatgctattgaggcagattctgagggggatgctgagccttgtgacaaagagaacgagaatgacggagagagttccgtgggaaccaatatgggatgggctgacgctatggctaaagtgctgaataaaaaaaccccagagagtaagccaacaatcctcgtgaaaaataagaagctcgagaaagagaaggaaaagctgaagcaagaacggttagaaaagatcaagcagagagacaaaagacttgagtgggaaatgatgtgtagggtcaagcctgatgtcgtacaagataaggagacggagcgcaatcttcagagaattgccactagaggcgtggtacagctcttcaatgccgtccaaaaacaccagaaaaacgtggacgaaaaggtgaaggaggccggatcttccatgaggaagagggctaagctaatctctacagtgtcaaagaaggattttatctcagtcttgcggggtatggacggctcgacaaacgagacagccagttccaggaagaagcccaaagcaaagcagactgaagttaaaagcgaagaagggccaggatggacaattctgcgcgacgactttatgatgggcgcttcgatgaaggactgggataaggagtccgacggaccggatgactcccggccagagtctgcaagcgactctgacacctag

SEQ ID NO: 53591 - DNA, 729 bp, Artificial Sequence
  Description of Artificial Sequence: Synthetic coding sequence
atgtgggccgctgccggaggtctttggcgatcacgtgccggtcttagagccttgttccggtctagggatgcagctctgttccccggttgcgaaagaggcttgcactgttctgctgtatcttgtaaaaactggcttaagaagttcgcctccaaaaccaagaagaaggtgtggtacgaaagcccctcactgggctcacatagcacctataaaccatcaaaactcgaatttttgatgcgatcaacatccaaaaagactaggaaagaagaccatgctaggctgagagccctgaatggtctgttatacaaggcactcacagaccttctctgtacaccagaggtgtctcaggagttgtatgatttaaacgttgagttatcaaaagtgtcattaacccccgacttttcagcatgccgggcttattggaagaccaccttatctgctgagcaaaacgcccacatggaggcagttctgcaaaggagcgccgcacatatgtctctcatctcatattggcagtcccaaaccctggaccccggtatgaaggagaccaccctgtacaaaatgatctccggaacactcatgcctcacaaccctgctgctccccaaagtcggccacaggctcccgtgtgtgtgggctccataatgagacgcagcacctctcgcttgtggtcaaccaaagggggaaaaattaagggaagcggtgcctggtgcgggaggggacggtggctcagctag

SEQ ID NO: 53592 - DNA, 1032 bp, Artificial Sequence
  Description of Artificial Sequence: Synthetic coding sequence
atgtgggccgctgcgggagggctttggcgatctcgcgcaggactgagagcactcttccggagcagagacgcagcacttttccccggatgtgagagaggtctgcactgttcagcagtgtcctgtaagaattggctaaagaagtttgcctccaagacgaagaaaaaagtctggtatgaatctccctcattgggttcacacagcacatacaagccatccaagctggaattcttaatgcggagcacttccaagaagacccgcaaggaggaccatgcgaggctcagagctttgaacggcctgctgtataaagctctgacagacctgctgtgcactcctgaagtcagtcaggagctgtacgatctaaatgtggagcttagcaaagtctcacttacaccggacttttccgcatgtagggcctattggaagaccaccctgagcgcagaacaaaatgcacacatggaggccgtgctgcaaagaagtgccgctcacatgaggcatttattaatgtcacaacaaacactacgcaacgtgcccccaatagttttcgtgcaggataaagggaatgcagccctcgctgaactggatcagctgctggccgtagccgattttgggccaagagacgagagggataactttgtgcaaaacgattttcgggaccctgatgcaccccaaccgtgcggtacaaccgaacctactacatccagcagcctctgcggaatcgaccatgaggcactgaacaaacagataatggagtataagcgacgaaaggacaagggactgggaggactcgtttggcaaggccaagtcgccgaattaaccacacagatgaaaaagggcaggaaacgggcaaaaccaaggttagaacaggacagcagtctgaaaagttacctgtccggcgaggaagtggaagacgatttagatctcgttggtgcgcctgagtacgagtgctacgcacctgacacagaagagctggaggccgagcggggaggtggcagaacggaagacggccatagctgcggggcttcgagggagtag

SEQ ID NO: 53593 - DNA, 2058 bp, Artificial Sequence
  Description of Artificial Sequence: Synthetic coding sequence
atgtggctgaaactgttttttttgctcctgtatttcctggtgctgttcgtgctcgctcggtttttcgaggccattgtatggtacgagaccggtatattcgccacccagcttgtggaccccgtcgcactatcattcaagaagctgaagaccatcctggagtgccgaggactgggatacagtgggctgcccgagaagaaagacgtgagggaattagtcgaaaaaagcggcgacctgatggaaggagagctgtattccgcgcttaaggaagaggaggcttcagagagcgtctcttccaccaatttctccggcgagatgcatttctacgagctcgtggaggacaccaaagatgggatttggcttgtgcaagtgattgcaaacgaccgcagtcctttggtgggtaagatccactgggagaagatggtgaagaaagtttctcggtttggcattcgcacggggacatttaattgctcatcagatcctcgctattgcaggcggaggggatgggtgagaagcaccctcattatgtctgtcccccagacttcaacctctaagggcaaggtcatgctgaaggaatattctggccgtaagatcgaagtggagcacatctttaagtggattactgcgcacgctgcctctcgcattaaaactatttacaatgcggaacatctcaaggaggagtggaataagagtgatcaatactggctcaagatctacctgtttgcaaaccttgaccaaccccctgcctttttttccgctttgtctatcaagttcaccggcagagtggaattcatctttgtcaacgtggaaaattgggataataaaagctacatgacagatatcggtatttacaacatgcctagttacattcttaggacgccggagggcatataccgttatggcaaccacaccggcgaatttatctcactgcaagctatggactcatttttgaggagcctccagcctgaggtgaacgatttgttcgtgctctcgctcgtgttggttaatctgatggcatggatggacctatttattacccaaggggctactattaagcgcttcgtcgttctgatttcaacacttggcacatataactccctcttgatcatcagctggttgcccgtgcttggttttctgcagctgccttatctggacagtttttacgaatacagcctgaaacttttgagatactctaatacaacaactttggctagttgggttcgggctgattggatgttctactcaagtcacccagccctcttcctgagcacctacctcgggcacgggctgttgattgactacttcgagaagaagcgacggagaaataataataatgatgaagtgaacgccaataacctagaatggctgagtagcctctgggactggtacacctcctatcttttccaccctatcgcatcgtttcagaactttcccgtcgaaagcgactgggatgaggatccggacctattcctggaaaggctagctttccctgacttgtggcttcaccccctgattcccacagactatatcaaaaatctgcctatgtggcgcttcaagtgtctcggtgtccagtctgaggaggagatgagtgaaggcagccaagatacggagaacgactctgagtccgaaaacaccgacactctctctagcgagaaggaggtgttcgaagataaacagagtgtgttgcacaattcccccggtaccgcctcccactgcgatgccgaagcttgttcatgcgctaacaaatactgtcagaccagtccatgtgagcgcaaaggacgctcatacgggtcctacaacaccaatgaagacatggaacccgattggctgacttggccggcagacatgttgcactgtactgaatgtgtagtgtgtcttgaaaactttgagaatggatgcctcctgatgggcctgccatgtggacacgtgtttcaccagaactgcatcgtgatgtggctcgcaggagggagacattgctgtcctgtctgccgctggccatcatacaagaaaaagcagccctacgcccagcatcagcccctcagcaatgatgttccctcatag

SEQ ID NO: 53594 - DNA, 984 bp, Artificial Sequence
  Description of Artificial Sequence: Synthetic coding sequence
atggctgctgttgtcgaggttgaggtgggcggaggcgcagccggtgagcgcgagctggatgaggtggatatgagcgatctttcgccggaggaacagtggcgtgtggaacacgcgaggatgcacgccaagcatagaggccacgaggccatgcacgcagaaatggtcctgatcctgatagccactctggttgtagctcagcttctcctagtgcaatggaagcagaggcaccctaggagctataacatggtgacactctttcagatgtgggtggtacccttgtacttcaccgtgaaactgcactggtggcggttcttagtgatctggattctgttctcggccgttaccgcgtttgtgacctttcgtgctaccagaaagcccctcgtgcaaacgacccctagactggtctataagtggtttctcctcatctacaaaatttcctatgctacaggcattgtgggttacatggctgtcatgtttacgctgtttgggctcaatcttcttttcaagataaaaccggaagacgccatggactttggcatttccctgctgttttatggcctctactacggcgtcctggagagggatttcgcagagatgtgtgccgattacatggcctcgaccataggtttttattcagaatcaggcatgcctactaagcacctttcagattccgtgtgtgccgtctgtggccaacagatattcgtggacgtgagcgaggaaggcataattgagaacacataccggctgagttgcaatcacgtgtttcatgagttctgcattcgtggctggtgtattgtcggtaagaaacaaacctgtccatactgcaaagagaaggtcgacctgaagagaatgtttagtaatccttgggagcgtccgcatgtcatgtacgggcagctgctcgactggctgcggtatctcgttgcatggcagcccgtaatcatcggcgtggtgcaaggaataaattatattctcggcctggagtag

SEQ ID NO: 53595 - DNA, 741 bp, Artificial Sequence
  Description of Artificial Sequence: Synthetic coding sequence
atggtgactctgttccaaatgtgggttgtccccctgtacttcacagtcaagctgcattggtggcgctttctagtgatttggatcctcttctctgctgttactgccttcgtcactttcagagcaacacgcaagcccttagtgcagaccactccacggctcgtatacaagtggttccttctgatctataagatcagctatgcgacgggaattgtagggtacatggccgtaatgttcaccctgtttggactgaatcttctgttcaaaattaagcctgaagatgccatggattttggaataagtctactcttctatggcctctactacggggttctggagcgagatttcgctgagatgtgcgctgactacatggctagtactattggattttatagcgagtcgggcatgcccacgaagcacctgtccgatagcgtgtgcgccgtttgtggccagcaaatttttgtggatgtcagcgaggagggaatcatcgaaaatacttaccgcctttcatgcaatcatgtctttcatgagttttgtatcagagggtggtgcattgtcgggaaaaagcagacctgcccatactgcaaggagaaagttgaccttaaacgcatgttctctaacccttgggagagaccacatgttatgtacggccagctccttgattggctgagatacctggtagcctggcaacctgtgatcatcggcgttgttcaggggattaattatattctgggcctggagtag

SEQ ID NO: 53596 - DNA, 468 bp, Artificial Sequence
  Description of Artificial Sequence: Synthetic coding sequence
atgcatccatttcagtggtgtaacggatgtttttgcggactgggtctggttagtacaaacaaatcgtgtagcatgcccccaatcagctttcaggatctgccgctgaatatctacatggtaatcttcggtacaggaatcttcgtgtttatgctttcgttaatcttctgctgctattttatttccaaattgaggaatcaggcccagagtgagaggtacggatataaagaggtcgtgctaaagggagacgcaaagaaactccaactatacggccagacatgtgctgtctgccttgaagactttaaaggaaaggatgagctgggcgttctgccttgccaacatgcctttcatcggaaatgtctcgtaaagtggctcgaagttagatgtgtgtgcccaatgtgcaataaacccattgcatctccatctgaagcgacgcagaatatagggattctcctcgacgagttggtgtag

SEQ ID NO: 53597 - DNA, 1146 bp, Artificial Sequence
  Description of Artificial Sequence: Synthetic coding sequence
atgcttctgagcatcggaatgctaatgttgtctgcaacacaggtgtatacaatcctgacggtgcagctcttcgcttttctgaatctgcttccagtggaagccgacatccttgcatacaattttgaaaatgcaagccagacattcgacgacctgccagcacgtttcggctaccggctccctgcagaaggcttaaagggattccttatcaactcaaaacccgaaaacgcatgtgagccaattgtcccgcctcctgtgaaagataatagctcgggaaccttcatcgtattgatccggcgactggactgcaattttgatatcaaagtgttgaacgcacaacgggctggctataaggccgctatcgtgcataacgtggattctgatgatcttatctcaatgggttcaaacgacatagaagtactaaaaaagatcgatattcccagtgtctttattggggagtctagtgcgaacagtctgaaagacgaattcacttacgagaaaggagggcatctgatccttgtccctgagtttagccttcccctcgaatattacctcatcccctttttgattattgtggggatatgcctaattctgatcgtgatcttcatgatcaccaagttcgtgcaagatcggcacagggctcgcagaaacaggctccgcaaggaccagcttaagaagctccctgtgcacaaatttaaaaaaggagacgaatatgacgtctgtgcgatttgcctggatgagtacgaggatggcgataagcttcgaatcctgccttgctcacatgcctaccattgcaagtgcgtcgacccttggctgacaaaaaccaagaagacctgtcctgtctgcaaacagaaggttgttccttctcagggcgattctgacagcgacactgatagcagccaggaagaaaacgaagtcaccgaacacacaccactccttcggccactcgcaagcgtgtccgcccagagcttcggagccctgagtgagtctagaagccatcaaaatatgacagagagctccgattatgaagaagacgataacgaggacaccgatagcagcgatgccgagaatgaaatcaatgaacatgatgtcgtggtgcagctgcagcccaatggcgagcgggattataacatcgccaacacagtctag

SEQ ID NO: 53598 - DNA, 1146 bp, Artificial Sequence
  Description of Artificial Sequence: Synthetic coding sequence
atgctcctgtccatcggaatgctgatgctctccgccactcaggtgtatacgatcttaacagtgcagttgttcgcattcctgaatctgttgcctgtcgaggcagacatcctggcgtataattttgaaaacgctagccaaacattcgatgatctgccagccaggtttggatatcgactcccagccgaggggctgaaaggcttcctgatcaacagcaaacccgaaaacgcatgcgaaccaatcgtgccgccacctgtgaaggataactcctccggaactttcatcgtcctgatcaggcgattggattgcaacttcgatattaaagtactcaacgctcagcgcgcagggtacaaggctgccatcgtccacaatgtcgactccgatgatctgatctctatggggtcaaacgacatagaggtgctgaagaagatcgacatcccctccgttttcataggcgaatcctccgccaacagtctgaaagacgaatttacgtacgagaaggggggacacctaatattggtgccggagtttagtttgccattggaatattacttaatcccattcctgattatcgtgggcatctgtctgattttgatcgtgatctttatgattaccaaattcgtccaggatcgccatcgtgcacggaggaacagactgaggaaggaccaactgaagaagcttcctgtgcataagttcaagaaaggcgacgagtatgatgtatgtgctatttgtctggacgagtatgaggacggcgataagctgagaatactgccctgctctcacgcctaccactgtaagtgtgtggatccttggctcactaagaccaaaaagacttgtccagtttgcaaacagaaggtcgtgccttcccagggcgatagcgatagtgatacagactcttcacaggaggaaaacgaagtcaccgaacacaccccgcttttgaggccactcgcttctgtgagtgcccagagtttcggtgcactctcggagtccaggtctcaccagaatatgaccgaaagtagcgactatgaagaagatgataatgaagataccgactcatctgacgcagaaaacgagattaacgaacacgacgtagttgtgcaattgcagccgaatggagagcgggactataatatagcaaacactgtctag

SEQ ID NO: 53599 - DNA, 498 bp, Artificial Sequence
  Description of Artificial Sequence: Synthetic coding sequence
atgttgctttccattggaatgctgatgctttccgccacacaagtctacacaattctcacggttcagctatttgcgtttctgaatctcctgcccgtcgaagctgacattctggcctacaatttcgaaaacgcctcacagacctttgacgatctgccagctaggttcggataccgccttccagcagaaggactgaagggcttcttgatcaactcaaagcctgaaaacgcatgcgaaccaatagtgccccctcctgtgaaagacaattctagtgggacatttatcgtgttgatacgaaggctagattgtaattttgacataaaggtgttgaatgcccaacgtgctggatacaaggctgccatcgtccacaacgtggactccgatgatttaattagtatgggtagcaacgacattgaagtgttgaaaaagattgacatcccttctgtattcatcggagagagtagcgctaacagtctgaaggatgagttcacctacgaatag

SEQ ID NO: 53600 - DNA, 219 bp, Artificial Sequence
  Description of Artificial Sequence: Synthetic coding sequence
atgctgctgtcaatcggcatgctaatgctttctgccacccaagtatacacaatactcactgttcagttatttgccttcctgaacttgctcccagtggaagcagacatcctcgcctataacttcgagaatgcctctcagacattcgacgatctcccggctcgtttcggctatagactgcccgcagaaggactgaaggggttcctcattaactccaaatag

SEQ ID NO: 53601 - DNA, 492 bp, Artificial Sequence
  Description of Artificial Sequence: Synthetic coding sequence
atgctgctgtccattggcatgctgatgctaagcgctacacaagtctataccatactgactgttcaactctttgcattcctgaacttgttgcccgtcgaggcggatattctggcttacaattttgagaatgcgagtcagacatttgatgatcttcctgcccgattcgggtatagactgccagcggaagggcttaaggggttcctgatcaacagtaaacccgaaaacgcatgtgaacccatcgttccgcctcctgtgaaggacaactccagtggaacctttattgtattgatcaggagactggattgtaattttgatataaaagtgttgaatgcccaacgggcaggttataaggctgctatcgttcacaacgtggactccgacgaccttatatccatgggaagtaacgatatcgaagtgctgaagaaaattgacataccttccgttttcattggggaaagttctgcgaacagcttgaaagatgaatttacctag

SEQ ID NO: 53602 - DNA, 348 bp, Artificial Sequence
  Description of Artificial Sequence: Synthetic coding sequence
atgctattgagcatcggaatgctaatgctgtctgctactcaggtttatacaatcttaactgtgcagttattcgcttttttgaatttgttgccagtggaggccgacatcttagcgtataactttgagaacgcaagtcaaacctttgacgatctgcccgcacgctttggttatcgattgcccgctgagggactgaaaggattcctgataaacagtaagccggaaaatgcttgcgaaccgatagtaccccctcccgtaaaggacaactcgagcggtaccttcatagtcctcataaggcgactggactgtaacttcgatatcaaggtcctgaatgctcagagagccggatag

SEQ ID NO: 53603 - DNA, 243 bp, Artificial Sequence
  Description of Artificial Sequence: Synthetic coding sequence
atgcttctgagcatcgggatgctcatgttatccgctacccaagtgtacacaattttgaccgtccagctgttcgcatttctcaacctactgcccgtggaagccgatatactcgcatacaacttcgaaaacgcttcccagacattcgacgacttgcccgctcgcttcgggtaccgactgcccgctgagggtctgaaaggctttctcatcaactcaaaacccgaaaacgcctgtgagccaatctag

SEQ ID NO: 53604 - DNA, 273 bp, Artificial Sequence
  Description of Artificial Sequence: Synthetic coding sequence
atgctcctcagcattggtatgctgatgttgagtgctactcaggtgtacacaatcctgacggtccagctgttcgcatttcttaacctcctgccagtggaggcagacatcctggcctataacttcgagaatgcatctcaaacctttgacgatctacctgcccgtttcggctatcggctgcctgccgaagggctgaaggggttcctgattaactccaaacccgagaatgcttgtgaacccatcgtgcctcccccagtcaaggataacagcagttag

SEQ ID NO: 53605 - DNA, 876 bp, Artificial Sequence
  Description of Artificial Sequence: Synthetic coding sequence
atgttgctgagtataggtatgttgatgttatcggccacacaggtgtatacaatcctgaccgtacaactctttgctttcctaaaccttctccctgtggaggcggacattctagcttataattttgaaaacgcctctcagacctttgatgatttgcctgctagattcgggtaccggctgcccgctgagggattaaagggatttctcattaattcaaagccggaaaacgcctgcgaaccaatcgtcccccctcctgtaaaggacaacagctcggggacctttattgtgctcatcaggcgactggactgtaatttcgatattaaagtactaaacgcacagcgcgctggctataaagccgctatcgtgcataacgttgatagtgacgatcttatttcaatgggttcaaacgacatcgaagttctgaaaaaaattgacataccgtccgtctttatcggcgaaagttcagctaattcactgaaggacgagttcacatacgaaaagggcggtcatcttattctcgtgcccgagttttcactcccactggaatattacctgattcctttcctcatcatagtgggtatttgcctcatcctaatcgtcattttcatgatcacaaaattcgtgcaggatcgtcaccgcgcaagacggaaccggcttaggaaggatcagttgaagaagcttcctgtgcataaatttaagaagggcgacgaatatgatgtctgtgctatttgcctggatgagtatgaggatggagacaaattgcgtatcctcccctgctcccatgcttaccattgtaagtgcgtggacccatggctgaccaaaactaagaaaacatgtccagtttgcaagcagaagcctaaacataagaagaagaaatag

SEQ ID NO: 53606 - DNA, 1260 bp, Artificial Sequence
  Description of Artificial Sequence: Synthetic coding sequence
atgtcatgtgccggaagggccggtcctgctagactggccgcactggccctactgacctgctcactctggccagctagagcagataacgcctcccaagagtattacaccgccttgattaatgtgactgtccaggagcccggaagaggcgcacccctgacgttccgcattgatcgtggcagatatggactcgattcccccaaggccgaagtgcggggacaggtcctagccccactgccactgcacggagtcgccgaccacctgggatgtgaccctcagacacgcttcttcgtgccccctaacatcaagcagtggatcgccctgctgcagcgcggaaactgtacttttaaggagaaaattagccgggcagcttttcacaacgcagtagccgttgtaatctacaacaacaaaagcaaagaggagccagtcaccatgactcatcctggaaccggtgacataatcgctgtgatgatcacagagttaagggggaaggatatactgtcataccttgagaaaaacatatccgtgcagatgaccattgcagttggtacacgaatgcctccaaaaaacttctctcggggaagcctggtgtttgttagcatttctttcatcgtgttaatgataatctccagtgcctggcttatattctacttcatacagaagatcagatacacaaatgctagggacaggaatcaacgtagactgggtgacgctgcaaagaaggccatttctaaacttaccaccagaacagttaagaaaggggataaggagaccgaccctgattttgaccattgcgccgtgtgcattgagagctacaagcagaatgatgtcgtgcgcattcttccctgcaagcacgtattccataagagctgtgtagatccatggttatccgagcattgcacttgccccatgtgtaagcttaacatactgaaagctctggggatcgtacccaatttgccttgcacggacaatgtggcctttgatatggaacgcctgacccggacacaggctgtcaacagaagatctgccctgggcgacctggcgggagataactccctagggcttgaacccctcagaacatctggtataagccccctgccgcaggacggtgagctcacccctcggacgggcgaaatcaacatcgccgttactaaagagtggttcattattgcttctttcggtctgttgagcgccctgaccttgtgttacatgataatacgggctacagcttccctgaacgcaaacgaggttgaatggttttag

SEQ ID NO: 53607 - DNA, 1131 bp, Artificial Sequence
  Description of Artificial Sequence: Synthetic coding sequence
atgcacctgttaaaagtggggacatggcggaataacaccgccagttcatggttaatgaaattcagtgtgctgtggctggtttctcaaaattgttgtcgtgccagcgtggtgtggatggcctacatgaatatctctttccacgtcgggaatcacgtgttatctgagcttggagagaccggcgttttcggcagaagcagtaccctgaaacgcgtggcgggtgtcatagtgccacccgaaggcaagatccagaatgcctgcaaccccaacaccatcttcagccgaagcaaatacagtgaaacctggcttgccctgatcgaaagggggggatgtacatttacccagaagataaaggtagctaccgagaaaggcgctagtggggtaatcatttacaatgtgccaggtactgggaaccaggtctttcccatgttccatcaggcatttgaggatgtggtggtggtgatgattggtaacctcaagggcactgagattttccacttgatcaagaaaggtgtcttgatcacagcggtcgtggaggtgggccgtaaacacatcatttggatgaaccattatctagtgagttttgtgatagtaacgactgccacgctggcctacttcatattttaccatatccaccgcctgtgcttagctcggatccaaaacaggagatggcagagactcactactgatcttcagaatacgttcggccagctccagctcagggttgtgaaggaaggggacgaagagataaacccgaacggagacagttgtgtgatttgtttcgagagatataaaccaaatgatatcgttagaatcttgacttgtaagcacttcttccacaaaaattgcattgacccctggatactcccacatggcacctgtccgatatgcaagtgcgacattcttaaagtgcttggcattcaagtcgtggtcgaaaacggaaccgaaccccttcaggtgttgatgagcaatgaactgccagagacgctttcaccctctgaggaggagactaacaatgaagtttctccagcaggcacctcggataaagtcattcacgtggaagagaatccgacttcacagaataacgacatccaacctcacagcgtggtggaggatgtccacccaagcccatag

SEQ ID NO: 53608 - DNA, 879 bp, Artificial Sequence
  Description of Artificial Sequence: Synthetic coding sequence
atgacaaccacccgttacaggcccacatgggatctggctctggacccacttgtttcatgtaaactttgcctcggggagtatcctgtcgaacagatgaccaccatcgctcagtgccagtgcattttttgtacactttgtctgaagcagtatgtggagctcctgataaaagaggggctcgaaaccgctatctcctgcccagatgctgcctgccccaagcaggggcacctgcaggagaacgaaatcgaatgtatggtggcagccgagatcatgcagagatacaaaaaacttcagttcgagagggaagtgctgttcgacccctgtcgaacctggtgccccgctagcacttgccaggctgtgtgtcagctgcaggacgtggggttgcaaactcctcagccagtccaatgcaaggcctgtcggatggagttttgcagcacttgtaaggccagttggcatcccggacagggctgccctgaaactatgcccattacatttctgccaggtgagacctctgccgctttcaagatggaggaggacgacgcacctattaaaaggtgccccaaatgcaaggtgtacatagaaagagatgaagggtgcgctcagatgatgtgcaagaattgcaagcatgcgttttgttggtattgcctcgagagtctggatgacgactttttacttatccactatgacaaaggcccttgcaggaataaactgggccactccagggctagcgtaatctggcaccgtactcaggtggtcgggatattcgcgggatttggcttactgcttctcgtcgctagcccttttttgctcttggctacccccttcgttctttgctgcaagtgtaaatgctccaagggagacgacgacccgttaccgacctag

SEQ ID NO: 53609 - DNA, 168 bp, Artificial Sequence
  Description of Artificial Sequence: Synthetic coding sequence
atgacaactacccgctaccgccctacctgggacttagcactggaccctctggtaagctgcaagctgtgtttgggcgaataccccgtagagcaaatgaccacaattgcccagtgccagtgtatcttctgtaccttatgtctaaagcaatacgtggaattacttatctag

SEQ ID NO: 53610 - DNA, 597 bp, Artificial Sequence
  Description of Artificial Sequence: Synthetic coding sequence
atgaccactacacgttatcgtccaacctgggacctggccctcgacccattggtgtcatgtaaactgtgcttgggcgagtatcctgtggagcaaatgacgaccatcgcgcagtgccagtgcatcttctgcactctatgtctaaagcaatacgtggagctgctaataaaagaaggcttggagacggcgatttcttgtccagacgctgcctgtccaaaacagggacaccttcaggagaacgagatcgaatgcatggtggccgcagaaataatgcaaaggtacaagaagctccaattcgagcgggaggttctgttcgatccatgccggacctggtgtcccgcaagcacctgccaggccgtgtgccagctgcaggacgtggggctccagactcctcagccagtgcagtgcaaagcttgtcgtatggagttttgctctacatgcaaagctagctggcaccctggtcaagggtgccccgagaccatgcctattacgttcttgccaggcgagacctccgcggctttcaagatggaagaagacgatgccccaattaaacgctgtcccaaatgctccaagggcgatgatgaccccctgcctacttag

SEQ ID NO: 53611 - DNA, 168 bp, Artificial Sequence
  Description of Artificial Sequence: Synthetic coding sequence
atgactacaacaaggtaccgcccaacatgggatctggctttagacccattagtttcctgcaagctctgcctgggagaataccctgtggaacagatgacaactatcgctcaatgtcaatgcatattttgtactctgtgtctgaagcagtacgtcgagctgcttatctag

SEQ ID NO: 53612 - DNA, 912 bp, Artificial Sequence
  Description of Artificial Sequence: Synthetic coding sequence
atgggctctgcaggcaggctgcactatttggccatgacagctgaaaaccccaccccaggagatttggctccagccccactcattacctgcaaactgtgtctctgtgaacagtcattggataaaatgaccactctacaggagtgccagtgcatattttgtaccgcctgcctgaagcaatacatgcaactggccatacgtgagggctgtggttcccctattacgtgccctgacatggtttgtttaaatcacggaacccttcaggaggctgaaatcgcttgcttagttcctgttgatcagtttcagctgtaccagcgcctgaagtttgaaagggaggtacatttggacccatatcggacctggtgcccggtggccgactgtcagacagtgtgcccagtggctagctcagaccctggccaacctgttttggtggaatgcccctcttgccacctgaagttctgctcctgttgtaaagacgcatggcacgccgaagtgagttgcagagacagccagcctatcgtcctgccgaccgaacatagagcactgttcggaacggacgctgaagcccctattaaacagtgccccgtctgtcgggtttatatcgaaagaaacgaggggtgtgcccaaatgatgtgtaagaattgcaagcataccttctgctggtactgtttacagaatttggataacgacatcttcctgagacattacgataaagggccttgcaggaacaagctgggacactcccgcgcatcagttatgtggaacaggacacaggtcgtcgggatcttggtgggacttggaatcatcgcattggtgaccagtcccctgcttctgctggcttcaccatgtattatctgctgtgtgtgcaagtcttgccgcggaaagaagaagaagcacgatccctccactacgtag

SEQ ID NO: 53613 - DNA, 645 bp, Artificial Sequence
  Description of Artificial Sequence: Synthetic coding sequence
atgctgtggatcaccatgcctcacccagcccatctcgggctgtttatagcagtgaccctctctgaagtccaccttgatccttaccggacatggtgtcccgtcgctgactgccagaccgtttgccctgttgccagctctgaccccggacagcccgttctggtggagtgcccctcttgccaccttaaattttgctcatgttgtaaggacgcttggcatgccgaggttagttgtagggattcgcagccaatcgtgctgcccactgagcacagggcccttttcggaactgatgccgaggcccctataaagcagtgcccagtttgccgtgtgtacattgagcgaaacgaagggtgcgcccaaatgatgtgtaagaattgtaagcacaccttctgttggtactgcctacaaaatttagataatgatatttttctgagacactacgacaaggggccatgcagaaataaattgggccattcccgggcatccgtgatgtggaacagaacgcaagttgttggcattctcgtggggctggggataattgctttggtgacttcccccctcctgctgttagctagtccgtgcataatctgctgcgtgtgtaagtcatgtcgtgggaagaagaagaagcacgatccctctaccacttag

SEQ ID NO: 53614 - DNA, 2076 bp, Artificial Sequence
  Description of Artificial Sequence: Synthetic coding sequence
atgatgcgcaatcaccgcatcgcgtcttctctatgcggcgatcaggtgttctctaagaagaagaaaaagaaaaaaaaaaataatatggccgcaaaagaaaagctagaggccgttctgaatgtggcccttcgcgtaccatctattatgcttttggacgtgctttaccgctgggatgtatccagctttttccagcaaatacaacggagttccctcagcaataatccattgtttcagtataaatatctggctcttaatatgcactatgtgggatacatactatctgttgtgcttctcacactaccacgtcaacatctggtacagttgtatctgtatttcctgacggcactgctcctgtatgctgggcaccagatatcccgcgactacgtacggagcgagctggagtttgcctacgaaggacctatgtaccttgaacccctgtccatgaaccggtttacaactgccttgattggtcagcttgttgtgtgtactctatgctcctgtgtgatgaagacaaaacaaatctggctgttttcagcacacatgttgcccctcctggcgaggctatgcttagtgcccctggagacaatcgtgataatcaataaatttgcaatgatatttacaggactcgaggtgttgtatttcctaggctccaatctgctcgtgccttataatttagcaaaatcagcctaccgcgaattggtccaggtggtggaagtctatggactgctggctctgggcatgtccctttggaaccagttagtggtccccgttctctttatggtcttttggcttgtactcttcgctctgcagatttactcctacttttccacaagggatcaacccgctagccgagagagattgctgttcttgttcctcacctccatcgcggaatgttgttccactccttacagcttactcggcctggttttcactgtctccttcgttgccctgggggtgttgactttatgtaagttctatctgcaggggtatcgcgctttcatgaatgatcccgctatgaacagaggcatgacagaaggtgtgactctgcttatcctcgccgtacagacgggcctcatagaactgcaggtggtgcaccgcgctttcctcctatctataatcttattcattgtcgtggcttccatcttacaaagcatgctggagatcgccgatcccatcgtgctggcgctcggagcatcccgtgacaagagtctgtggaagcattttcgagccgtctcattgtgtctattcctgttagtgttccccgcatatatggcctatatgatttgtcagtttttccacatggatttttggctgctcatcattatttcctcatccatactcacctccctccaggtcttgggaaccctctttatttacgttctattcatggtggaggagtttcgaaaggagcctgtcgaaaacatggacgatgtgatatattacgttaacggcacttatagactgctcgagttcctcgtggcgttgtgcgtcgtggcctacggcgtctcagagactatttttggggaatggaccgtgatggggtccatgataatcttcatccactcctactacaatgtctggctacgggctcagctaggatggaaatcgtttctcttacgtcgcgacgctgtgaacaagatcaagtctctgcctattgccaccaaggagcagctggaaaaacataacgacatttgtgcaatctgctaccaggatatgaaatcagccgtgattaccccctgctcccacttttttcatgccggttgcttgaaaaagtggttatacgtccaggagacttgcccgctgtgtcattgtcatctgaagaatagcagccagctgccgggtctagggacagagcccgtgttacagccacatgctggggcagagcagaacgtgatgttccaggaagggacagagcccccaggccaggagcacactcccggtactaggattcaggaaggatccagagataacaatgagtacattgcacgcaggcccgacaaccaagaaggagcatttgacccaaaggagtaccctcattccgccaaggacgaggctcatcccgttgagtcagcatag

SEQ ID NO: 53615 - DNA, 2043 bp, Artificial Sequence
  Description of Artificial Sequence: Synthetic coding sequence
atggctgaggtggtgtttagcaaaaagaagaaaaagaagaagaagaacaatatggctgctaaggagaagttagaggctgtgctgaatgtggcccttagggtgccaagtataatgctgcttgacgtactctacagatgggatgtaagcagtttctttcagcaaatccagcgctcctcactgagcaataacccactgtttcaatataaatacctggctttgaacatgcattatgtggggtacatacttagcgtggtcttgctgacattgccacggcagcatttggtgcagctttatctgtattttttaaccgccctccttttgtacgctgggcaccagatctctagggattacgtccgtagcgagctggaattcgcctatgagggtccaatgtatctcgaacccctgtcaatgaataggtttaccacagctctcatagggcaactcgttgtgtgtacactgtgctcttgcgtgatgaaaactaaacagatttggcttttcagcgcccacatgctcccactgctagcacgcctttgtctggtccctctggaaactatagtcattattaataaatttgccatgatatttaccggactggaggtcctctacttcctgggctcaaacctactcgtgccttacaatctagcaaaaagcgcatatagggaactggtccaggtcgtggaggtctacggattgctggcgctgggcatgtctctgtggaaccagttagttgtgccagtcctgttcatggtgttctggctcgttttatttgctcttcagatttattcatacttctccacgcgagaccagcccgcaagccgagagcggctgctctttctattccttacaagcattgcagagtgttgcagcaccccgtattccctgctgggattggtctttactgtttctttcgtcgcccttggcgtgctgactctgtgcaaattttatttgcagggatacagagcattcatgaacgaccccgcaatgaaccggggaatgaccgagggcgtgaccctcttgatccttgcggtgcagacagggctgatagaattgcaggtggtgcatagagcattcctgctgtcgatcatcctcttcatcgtcgtggccagcattctgcagtccatgctcgaaattgctgaccctatcgtgctagcactgggcgctagtagggataagagtctttggaagcacttcagggctgtaagcctttgcctcttccttctcgtgtttcccgcttatatggcgtacatgatttgccagttcttccacatggatttttggctgctgatcattatctcttcttctatcttaactagcctgcaggtcctgggcaccttatttatatatgttctttttatggtggaagagtttaggaaagagcccgttgagaacatggacgacgttatctattatgtcaatggcacctaccggttgcttgagttcctcgttgcattgtgtgtggtagcctacggagtttccgagacaatcttcggggagtggaccgtgatgggcagtatgattatctttatccacagttattataacgtgtggctccgagcccagctggggtggaagagcttcctcctacgcagggacgccgtgaataaaataaagtcactccccatcgccactaaggaacagctggagaagcacaatgacatctgcgcaatctgctatcaggacatgaagagcgctgtaataaccccatgttcccatttttttcacgccggatgtctaaagaaatggctgtatgttcaagaaacgtgtcccctgtgccactgccatctgaagaattcttcacagctccccggtttagggaccgaaccagtactgcagccccacgccggagccgaacagaatgtgatgttccaggaaggaacagaaccacccggacaagagcataccccaggaacaaggattcaggagggcagtcgagacaataacgagtatatcgcccgaagacctgacaatcaagagggcgctttcgacccgaaagagtatccccacagtgccaaagatgaagcccacccagtggagtccgcctag

SEQ ID NO: 53616 - DNA, 1992 bp, Artificial Sequence
  Description of Artificial Sequence: Synthetic coding sequence
atggccgcaaaggaaaagttggaagccgtgctgaatgtcgctctaagggtcccttctatcatgttactcgatgtcctgtatcgttgggatgtgtcaagcttcttccaacagatccagcgaagctcattgagcaataaccctctttttcagtacaagtatctggcccttaacatgcattacgttggatacatcttgagcgtggtgcttctgactctgcctcggcaacacttagtgcagttgtacctctactttctcacagccctactgctctacgcaggccaccagatctcccgcgactacgtccggagtgagctagagtttgcctatgaggggcctatgtaccttgagccgctgagcatgaatagattcaccacagcccttatcggacagctggtggtgtgcaccctatgttcctgtgtcatgaagacgaaacagatctggctgttctccgctcacatgctcccactgctggcgaggctgtgcttggtgcccctagaaaccatagtcatcattaataagttcgccatgatatttaccggcctcgaagtgttatacttcctagggtctaatctgctggtgccttataatttagctaaaagcgcctatcgcgagctggttcaggtggtcgaggtgtatggactacttgcgctgggaatgtccttatggaatcagttggttgtgccggtgctatttatggtgttctggctcgtgctgtttgctctgcaaatctacagttacttctcgacccgtgaccagcccgcttctcgcgaacgtctgctcttcctttttctcacatcgattgccgaatgttgttccaccccatatagcctgctaggcttggtgttcaccgtatcctttgtggccctgggcgtgctaacactgtgtaaattttacctgcaggggtatcgagcatttatgaacgacccagctatgaacaggggaatgacagagggggtcaccttactgatcctggccgtgcagacaggtcttattgaattacaggttgttcatcgcgcattcctgttaagtatcattctgttcattgtggtggcaagcatattgcagagcatgctcgagatcgccgaccctatagtactggcgcttggcgcatctagagataaaagcttgtggaaacattttagggcagtcagcctgtgtcttttcctgctggtgtttcccgcatacatggcctatatgatttgtcagttcttccacatggatttttggctgctgatcattatcagttcgagcattctgactagcctacaagtgctgggaacgctctttatttacgtgcttttcatggtcgaagagttccggaaggaacccgtggaaaatatggatgacgttatctactacgttaacgggacataccgcctcttagaattccttgtggctctttgcgtggtcgcctacggggttagtgaaactatcttcggggagtggactgtgatggggtctatgatcatttttatacactcttattataatgtgtggctgcgcgcacagttgggatggaagtctttcttacttcgaagggacgccgttaacaaaatcaagtccctcccaattgcaaccaaagaacagctagagaagcacaacgatatttgcgcaatctgctaccaggacatgaaaagtgccgtgatcaccccttgttctcattttttccatgccggatgcctcaaaaagtggctgtacgttcaggaaacctgccccttgtgtcactgccatctaaaaaatagctcacagcttcctgggctcggcactgagccagtgcttcaaccccatgccggtgccgaacagaacgtgatgtttcaggaaggcactgagcctccaggccaggaacatactcccggaactagaatccaggaaggcagcagagataataacgagtacattgccagacgcccagacaatcaggagggggctttcgatcctaaggagtacccacattcagctaaagatgaggctcaccccgtggagtcagcttag

SEQ ID NO: 53617 - DNA, 2082 bp, Artificial Sequence
  Description of Artificial Sequence: Synthetic coding sequence
atgcatcgagatagaatctctccgtccaatagtcccacctggtctctgcaagtcttctcaaagaagaagaagaagaagaagaagaataacatggctgcaaaggagaaattagaggcggtattgaacgtggctctgcgggtccctagtattatgctactcgacgtcttgtataggtgggatgttagcagcttctttcaacagatccagcggagctcacttagcaataaccccctgttccaatacaaataccttgcgcttaacatgcattacgttggatacattctatctgtcgtcctactcaccctacccagacagcacctcgtgcagctatacctttatttcctcaccgcgttgttgctctacgccggacatcagattagtcgagattacgttcgtagcgagttggaattcgcatacgaaggccctatgtatttggagccactctccatgaaccgattcacaaccgcgctgatcgggcagctggtagtctgcacgctatgctcttgtgtcatgaagacaaagcagatctggttattttccgcccatatgctgcctctactcgccaggctttgcctagtgccactcgagacaatcgtgattatcaacaaattcgccatgatcttcaccggcctcgaggttctatactttctggggagcaacttgcttgtgccatataacctagcgaaatctgcataccgggagctcgtgcaggtggttgaagtttatggccttctggcacttggcatgagtctgtggaaccagctggtcgttcctgtgttatttatggttttttggctggtcctttttgcgctgcaaatctacagttacttctccactcgcgatcagccagcgagtcgggaacgtctgctgtttctgtttctgacatctatagcagagtgctgctctacaccatacagcctgctgggattggtgtttactgtgtcattcgtagcgctcggcgtgctgacactgtgcaaattttacttgcagggctatagagctttcatgaacgaccccgctatgaaccgcggaatgacagagggtgtgaccctgctgatcctcgccgtgcaaaccgggctgatagagctgcaagtcgtccaccgagcgttcttactgtcaataattctgttcatcgtggttgcctctatactgcaatctatgctggagatagccgatcccatcgtgctggcactcggggcatctcgcgataagtccctgtggaagcacttccgcgctgtgagtttgtgcctatttctgcttgtctttcccgcatacatggcctatatgatctgccagttcttccatatggatttctggctgctgattatcattagctcatccattctgacctcgcttcaggtgttaggcacgttgtttatctatgtcttattcatggtcgaggagttccggaaggagcctgtagaaaatatggatgatgtcatctactacgtgaacggcacctatagattgctggagttcctggtcgccctctgtgtggtggcttatggtgtttctgaaacaatcttcggtgaatggaccgtaatgggtagcatgatcatattcatccatagctattataatgtctggctgcgagcgcagctaggatggaagtcctttcttctgcggcgagacgcggtgaacaaaatcaaaagcctccccattgctacaaaggagcagcttgagaagcataatgacatctgcgctatttgttatcaagacatgaaaagcgctgtcatcactccttgcagccactttttccatgccggttgcctgaagaagtggttgtacgtccaggagacatgccccctctgtcactgccacctcaagaatagctcccaactaccaggtctgggcaccgaacctgtcctgcagcctcacgccggagcagagcagaacgtcatgtttcaggaaggtactgagcccccaggtcaggagcacacaccgggtactagaatccaggagggctcccgcgataacaatgagtacatcgctagacgaccagacaaccaagaaggagcgttcgatcccaaagagtaccctcactccgctaaggacgaggcccacccagttgagagcgcgtag

SEQ ID NO: 53618 - DNA, 1992 bp, Artificial Sequence
  Description of Artificial Sequence: Synthetic coding sequence
atggccgctaaggagaaacttgaggcggtgctgaatgtggccctgagggtgccttcgataatgctgctcgacgttctgtataggtgggatgtctctagcttttttcagcagatccaacggtcatctctctcaaacaatcccctgttccaatacaaatatttggccctgaacatgcattacgtgggttatatcctaagtgtagttcttttgaccctgcccaggcagcacctcgtacaactctacctgtactttctgacagctctgctcctatatgcagggcatcagatttcccgcgattacgtccgcagtgagctagagtttgcatacgagggcccaatgtatttggaaccactgagcatgaaccggtttaccactgcactgatcggacaactggttgtgtgtacactatgttcctgcgtaatgaagactaaacaaatctggttgttttctgcccacatgctccctctcttggctcggctgtgcttagtgcccctcgagacaattgtgatcattaataagttcgccatgattttcaccgggctagaggttctgtatttcttgggctcaaatctgctggttccatacaacctcgcaaaaagtgcctacagagagctggtccaggtggttgaagtgtatggcctactcgccctaggcatgagtctctggaatcagcttgtcgtgccggtcttgtttatggtgttttggctagtgctgtttgccctacagatctacagctattttagcacccgggatcagcccgcttcccgggagagacttctatttctatttctcacaagtatcgctgaatgctgcagcacaccatacagcttattgggcctcgtatttacagtgtcatttgtggccctgggggtgctgacactctgtaagttctacttgcagggatatcgggcttttatgaacgatccagctatgaacagaggcatgacagaaggggtcaccctcctgatactcgccgtgcaaaccgggttgatagagttacaggtcgtgcatcgggcatttctcctgagcatcatactgttcatcgttgtcgcctcaatcttgcagtctatgctggagatagccgatcccatagtgctggccctcggcgcatcccgagacaagtctctgtggaagcacttcagggcggtgagtctctgcctcttcttactagtttttcccgcttacatggcctacatgatttgccagttcttccacatggacttctggctgctcatcattatttccagcagtattttgacttctctccaagtgttgggcaccctgttcatctacgtgttgttcatggttgaggagttcagaaaagagcccgtcgaaaacatggacgacgttatttactatgttaatggcacctatcgcctcctcgagttcctggtggccctctgtgtcgtggcatacggtgtgtctgaaactatcttcggcgagtggaccgtaatgggcagtatgatcatctttatccacagttattataatgtttggttaagagctcaactgggatggaagtcgttcctcctgcgaagggacgctgtgaacaagataaaaagtctgcctatagccaccaaggagcagctggaaaaacataacgatatttgcgccatctgttatcaggatatgaagtcagctgtaatcacaccctgttcccacttcttccacgctggatgtctcaagaaatggttatacgtgcaagaaacctgccctttatgccactgtcatttgaagaactctagtcagctgcccggtctgggcacagagcctgtcctccagccacacgcgggtgccgagcaaaatgtgatgttccaggaaggaaccgaaccgccaggacaggaacacacccccggaacaaggatccaagagggatcgagggacaacaatgaatatatcgcccgaaggccagacaatcaggaaggggcattcgatccaaaagaatacccccactctgccaaggacgaagctcacccggtagagtctgcatag

SEQ ID NO: 53619 - DNA, 2034 bp, Artificial Sequence
  Description of Artificial Sequence: Synthetic coding sequence
atggtgttcagtaagaagaaaaagaagaaaaagaagaacaacatggctgctaaggagaagcttgaggctgttcttaacgtcgccttacgggtgccaagcattatgcttttagatgtgctgtatcgatgggatgtttcatctttctttcagcagattcagcggtcgagtcttagcaacaacccgctgttccagtataaatacctggccctcaatatgcattatgtcgggtatatcctgtccgtagtgctacttacgctaccacgccagcacttggtgcagctgtacctttacttcctgaccgccctgttgctctatgcaggccaccaaatctcccgcgattacgtgcgctctgagttggaattcgcctacgagggcccaatgtatttggagcccttgtcaatgaacaggttcaccaccgcactgatcggccaattagtggtgtgcacgttgtgctcctgcgtgatgaagacgaagcaaatctggctgttctcagctcacatgttgccattgctggcaagactgtgtctagtcccactcgagaccatcgtaatcatcaataaatttgctatgatcttcactggcttggaggtattgtattttttagggtcaaaccttcttgtgccatacaatttggccaaatcagcataccgcgagctggtgcaagttgtggaagtttacggactattagcccttggtatgtctctatggaatcaactcgtggttccagttctgtttatggtgttttggctggtcttgttcgcgctgcagatttacagttatttttcaacccgtgatcagcccgcaagccgggaacgtcttctattcctctttttgacctccatcgcagaatgttgttcaactccctattctctcttagggctggtctttaccgtgtcctttgttgcactgggcgttcttaccctttgcaaattttatctgcaaggataccgcgctttcatgaatgaccccgctatgaataggggtatgacagaaggtgtcaccctcctgatcctggccgtacagactggcttaattgagctgcaggttgtccatagggctttcctgctgagcatcattctttttatcgtcgttgccagtattctacagagtatgcttgaaatcgccgatccgatcgtgctggccttaggagcgagccgcgataaatccctctggaaacatttccgggcagtcagtctgtgtctgtttttgctcgtgttccctgcctacatggcctacatgatatgtcagttttttcacatggatttctggctgctaatcatcataagtagcagtatccttacttctctccaggtactgggaacattattcatctacgttctgttcatggtcgaagagttcagaaaggaaccagtggaaaacatggatgatgtgatctactacgtgaacggcacataccggctgctcgaatttcttgtcgccctgtgtgtcgtagcttacggagtgagtgagactatttttggcgaatggacagtgatggggagcatgatcatatttattcattcttactataatgtatggctgagagctcagctggggtggaaatcattcctgctgcgcagggatgctgttaacaaaatcaaatccttgccaatcgccactaaagaacagctcgaaaagcacaatgacatctgtgctatctgttaccaggatatgaagtccgccgtgatcaccccatgttcacacttcttccatgcaggctgtctgaaaaagtggctgtatgtgcaggagacatgcccattatgtcattgccatcttaagaactcttctcagctgccagggctgggcacagagcccgtgcttcagcctcatgccggagcggagcaaaatgttatgttccaggagggcaccgagccaccaggccaagaacatacacccggaaccagaatccaggagggatccagagataataatgagtatatcgcccgacgtcctgacaaccaagagggagcgttcgaccccaaggagtatccacattcagcaaaggacgaggctcaccccgtagaatcagcttag

SEQ ID NO: 53620 - DNA, 2040 bp, Artificial Sequence
  Description of Artificial Sequence: Synthetic coding sequence
atggcagaagttttctcgaagaaaaaaaaaaaaaaaaagaagaacaatatggctgctaaagaaaaacttgaggcggtgctgaacgtcgcactgcgtgtgccctccattatgctcctagatgtgctctataggtgggacgtgtcatcattcttccaacagatccaacgcagctcactcagcaacaatcctctcttccaatataagtatctggcccttaatatgcattacgtcggatacatcctctcagtggtgctcctgaccctgccacggcagcacctggtgcagctctacctctactttctgactgcactcctactgtacgctggtcatcagatctccagggactacgtgaggagtgaattagaatttgcatacgagggaccaatgtatctagaaccattgtccatgaaccgattcactactgcgctgatagggcagcttgtcgtttgcacattgtgttcctgcgtcatgaaaacaaaacagatctggctctttagcgcacacatgcttcccctcctggctaggctatgccttgtgcctctcgaaacaatcgtgatcataaacaagttcgctatgattttcactgggctagaggtgctgtattttctagggtcaaaccttttggttccctacaatttggcaaagagcgcctatagagaactggtccaggtggtcgaggtgtacggcctgctggccctgggcatgtccctttggaatcagctagttgtcccagttctcttcatggtcttctggctggtcttgtttgccctgcaaatctattcctacttcagcaccagagaccaaccggcatcccgggaaagactccttttcctctttctaaccagtatagcagaatgctgcagtactccatacagtttactgggcctggtatttacagtatcttttgtcgcgctaggagtgctgaccctgtgtaagttttacctgcagggttatcgcgcatttatgaacgaccccgctatgaacagggggatgaccgaaggcgttactcttctaattctggctgttcagaccggactcatagagttacaagttgtgcaccgcgcttttctgctctccataattctatttattgtggttgccagtatactacagtctatgcttgagatcgcagacccaatagttcttgccctaggggcaagccgggataaaagtctgtggaaacattttagggctgttagcctttgtttattcctgttggtgtttcctgcctacatggcatatatgatttgtcagtttttccacatggatttttggctcttaattataatttccagcagcatcttgacatcattgcaagtcctgggcaccctattcatctatgtgctgtttatggtggaggaattcagaaaagagcctgtcgagaacatggatgacgtgatttactacgtgaacggaacttacagactgctggaattcctggtggccctgtgcgtggtggcttacggtgtttcggagacgattttcggtgaatggaccgtgatggggagcatgataatctttatacactcttactataacgtgtggctacgtgcccaacttggatggaaatctttcctcctccgcagagacgccgtcaataagatcaaaagtctgcccatagccacgaaggaacagctcgaaaaacacaacgatatttgcgccatctgttaccaggatatgaaatctgctgtgattaccccgtgcagccactttttccatgctggatgcttgaagaagtggctgtatgttcaggaaacatgccccttgtgccactgccatttgaaaaacagttcacaacttccaggtctgggtaccgagcccgtattacagcctcacgccggtgctgaacagaacgttatgttccaggaaggcaccgaacctccagggcaggagcacactccaggcactagaattcaggagggatcgcgggacaacaacgagtatattgccaggcgccctgacaatcaggagggggctttcgaccctaaagagtatccgcattcagccaaggacgaggcccaccccgtggagtctgcctag

SEQ ID NO: 53621 - DNA, 1992 bp, Artificial Sequence
  Description of Artificial Sequence: Synthetic coding sequence
atggccgctaaagagaagcttgaagctgtcttgaacgtggccctgcgagtcccctctatcatgcttctggacgtcctctaccgctgggacgttagctccttcttccagcagatccagagatctagcctatctaataacccgctgttccaatataagtaccttgccttgaatatgcactacgtcggctatatcctctccgtggttctgctgactctgcctcggcaacacctggtgcagttatacttatactttctaaccgcactgctgttatatgcaggacatcaaatatctagggattacgtgaggagtgaactcgagttcgcttacgagggcccaatgtacttggagcctttgagcatgaatcgcttcaccaccgcacttatcggtcagctggtcgtgtgtaccttatgtagttgtgtaatgaaaactaaacagatctggctgttctccgcgcacatgctccccttactggctagactgtgtttggtgcctctggagacaattgtgatcattaataagtttgccatgatatttacgggccttgaggttctgtactttctgggctccaaccttctggtaccctataacctggctaaatccgcctaccgggagcttgtacaggtcgtagaggtctatgggctcttggctcttggcatgagtctgtggaaccagcttgtcgtgccggtgttattcatggtattttggctcgtccttttcgccctgcagatttatagctactttagtacaagggaccaacccgcttcacgcgaaagacttttgtttcttttcctgacgtctatcgccgaatgttgtagtaccccgtatagtttacttggcttggtgtttacagtgtcctttgtcgcactcggggtgcttaccctttgcaagttctacttgcaaggctatcgcgcttttatgaacgacccagccatgaacaggggtatgacagagggagtcaccctcctgatcctcgcggtccagactgggttgattgagttgcaagttgtccatagggcctttctcctcagcataattctatttatagttgtggcctctatacttcaaagcatgttggaaatcgcagacccaattgtcttggctctcggtgcgagccgcgacaagagtttgtggaagcatttcagggcggtatctctgtgcctgttcttgctggtcttccccgcttatatggcatacatgatttgtcagttctttcacatggacttctggctccttattataatctcaagctccattctcacctctttacaggtccttggcacgctctttatctatgtcctcttcatggtggaagagttccggaaggagcccgttgagaatatggacgatgtaatttattacgtgaacgggacctaccggctgctcgaatttctggtagcgctctgtgtcgtcgcctacggagtgtccgaaactatcttcggagaatggaccgttatgggctctatgattatcttcatccattcttactacaacgtttggcttcgcgctcaactgggatggaaatccttcttactcaggcgtgacgcagtgaacaaaataaagtctttgcctattgctacaaaagagcagcttgaaaaacacaacgatatctgcgccatttgctatcaggacatgaagtccgctgtgatcaccccgtgtagccactttttccacgctggctgtctcaagaagtggctctacgtccaagagacctgtccgctctgccactgtcatctcaagaacagcagtcagctgcctggcctcggcaccgaacccgtgttacagccccatgctggcgcagagcagaacgtgatgttccaggaagggacagaaccaccaggccaggagcatactcccggaacaagaattcaagagggctcccgagacaacaacgagtacatcgctagaaggcctgacaaccaggaaggtgctttcgaccctaaagaatatccgcactcagccaaagacgaagcacacccggtggagagtgcctag

SEQ ID NO: 53622 - DNA, 918 bp, Artificial Sequence
  Description of Artificial Sequence: Synthetic coding sequence
atgagctttctccgcatcacgccatccacccactccagcgtatcctccggcctcttaagacttagcattttcctgctcctcagttttcccgactccaatgggaaggcaatatggacagcacacttgaatattactttccaggttggcaatgaaattacttcagaactgggcgaatctggtgtgttcgggaaccatagcccactggagcgagtgagcggagtggtggcgctgccggaggggtggaaccagaacgcttgccacccactgacaaattttagcagaccaaagcaagctgattcatggcttgcactgattgaacggggaggctgcacatttacgcataagataaacgtagccgcagaaaagggagcaaatggggtgatcatatacaactaccaggggacagggtctaaagtctttcccatgtcacaccaggggaccgaaaacattgtggcagttatgatctccaatttaaagggcatggaaattttgcatagcattcaaaagggcgtatatgtcacagtgatcattgaggtaggtcgcatgcatatgcaatgggtctctcactacatcatgtacctcttcactttcctcgcggctactatcgcctacttctatctcgattgcgtatggcgcttaaccccccgagtccccaattcatttactagaaggaggtcacagattaagaccgacgtcaagaaggcaatcgaccagctccagctacgcgtactgaaggagggggatgaggaactggacctcaacgaggacaattgtgtcgtgtgtttcgatacatacaagccacaggacgttgtgagaattctgacttgtaaacatttcttccataaagcatgcatagacccctggttgcttgcgcaccggacatgccctatgtgtaaatgtgatatcttgaagacttag

SEQ ID NO: 53623 - DNA, 1203 bp, Artificial Sequence
  Description of Artificial Sequence: Synthetic coding sequence
atggcgtggcgcaggcgcgaagcatccgtgggcgctcgtggagttcttgccctggccctgctcgctctggcactgtgtgttcctggtgcaagaggcagagccctggaatggttttccgcagtcgtcaatattgagtacgtggatccacaaaccaacctgacggtgtggtccgtgtcagagtccggtaggtttggcgactccagccctaaagagggcgcacacggcctggtgggtgttccctgggcccctgggggtgacctggagggctgcgctcctgacacccggttttttgtgccggaacctggaggccgaggggctgccccatgggtggctctagtggctaggggcggttgcactttcaaggacaaggtgttggtcgctgccaggcgcaatgccagcgcagttgtgctctacaatgaggaaagatacggtaacatcactctgcccatgtctcatgccggtactggcaatatcgtggtgattatgatctcttatcctaaaggtcgcgagattctggagctcgtgcagaagggtatcccagtcacaatgacgatcggtgtaggtacacggcatgtgcaagaatttatctcgggtcaaagtgtggttttcgtggctatcgcctttattacaatgatgatcatcagccttgcctggctgattttttactatattcagcggtttctgtacaccggcagccaaatcggctcacagtctcaccgcaaagagaccaagaaagtaatcggccaactgttgctgcacactgtgaagcacggcgaaaagggaatcgatgttgacgccgagaactgtgccgtgtgcattgagaatttcaaggttaaggacatcattcgtatcttgccctgcaaacacatcttccaccgtatctgcatcgatccttggcttctcgatcaccgcacatgccccatgtgcaagcttgacgtcatcaaggcattaggctactggggagagcccggagacgtccaagaaatgccagccccagagtcaccacccggtcgggatccagctgcgaacctgagcctcgccctacctgatgatgacgggtctgatgattcctcgcccccaagtgccagtccagcagagtctgaaccccaatgtgacccttcctttaagggtgacgctggggagaacactgcactgctcgaggccggtcgctcggattcccgacatggaggcccaatctcttag

SEQ ID NO: 53624 - DNA, 1191 bp, Artificial Sequence
  Description of Artificial Sequence: Synthetic coding sequence
atggcaatgtctttgattcaggcatgctgtagcctggccctgagcacttggcttctaagcttctgttttgtccacttgctatgtttggattttacagtggccgaaaaggaagaatggtatacagcattcgtgaatatcacttacgccgaacccgctcctgacccaggtgccggagcagcaggtggcggaggggctgaactgcacactgagaagacggagtgcggtagatacggcgagcattctccaaaacaggacgctagaggcgaggtggtcatggcaagctcagcccatgacaggctggcttgtgatcctaatactaaattcgcagcacctacacgtggaaaaaactggatagctttgattcctaagggcaattgcacctatagggataaaatccggaatgcctttctccagaacgccagtgctgtggtgatttttaacgtgggaagcaacaccaatgagacgatcaccatgccacatgcgggtgtcgaagatatcgtggctataatgattccggaaccaaagggcaaggaaattgtgagcctgctggaaaggaacattactgtgacaatgtatattaccatcgggactcggaatctgcaaaagtaccgcagacttggagacgccgcaaaaaaggccatttctaagctacagatacgtacaataaaaaaaggggacaaggagactgagtcagattttgataactgtgcggtttgcattgagggctacaagccaaacgacgttgttcggatcctgccatgcaggcacctgttccataaaagctgtgtggacccctggctgctggaccatcggacatgccctatgtgtaagatgaatattctgaaggcgctggggatcccccctaacgcggactgtatggacgacctgccgactgacttcgagggctcactgggcggaccccctaccaaccagattacaggagcatctgacacgaccgtgaatgagtcgagtgtcacactcgaccccgctgtacgaaccgtgggcgcactgcaggtagtgcaggacactgacccgatcccccaggaaggagacgtcatttttactactaactctgagcaagagcccgcagtgtcctctgactccgacatcagcttgatcatggctatggaagtcggcctctctgatgtggaactgtccaccgatcaggattgtgaggaggtcaaaagctag

SEQ ID NO: 53625 - DNA, 894 bp, Artificial Sequence
  Description of Artificial Sequence: Synthetic coding sequence
atgtcttcccacgcacagcccctgaagctgatttctccctgcccctacagtctctcaagcggcgtcgaggatattgttgctatcatgattcccgagccaaaggggaaggagattgtgtcattgttggagagaaatataacagttaccatgtatatcacaatcggaacgcggaatcttcagaagtatgtatccaggacctccgtggtgttcgtatcaattagttttatagtgcttatgatcataagtctcgcttggctggtattctactatattcagcggtttagatatgctaatgctcgggaccggaaccagcgtagacttggcgatgcggctaagaaagcgatttcaaagttacagattagaacaatcaagaaaggcgacaaagagacagagtctgattttgataattgcgcggtgtgcattgaaggctacaagccaaatgacgttgttaggattttgccctgccgtcatctgttccataagtcatgtgtcgacccctggcttcttgaccatcggacctgccccatgtgtaagatgaatatcctgaaagccctgggcatcccgcctaatgctgactgcatggatgatctgccgacggacttcgagggatcactgggcggacctcccacaaatcagatcaccggcgcttccgatactaccgtaaatgagtccagtgttacattagatccggcagtgcggactgtgggcgctctgcaagtcgtccaggacacggacccaatcccccaggagggggacgttattttcaccaccaactctgagcaggaacctgcagtgagtagtgactctgatatatccttaattatggccatggaagtgggactgtcagacgttgaactctccactgaccaggactgcgaagaggttaaatcttag

SEQ ID NO: 53626 - DNA, 894 bp, Artificial Sequence
  Description of Artificial Sequence: Synthetic coding sequence
atgagtagccatgcacagcctctgaaactgattagcccctgtccatactcactttcctctggggtggaggatatcgtggctattatgatccccgaacctaaaggaaaagaaatcgtgtctctactcgaaagaaatatcacagtcacgatgtatatcactattggaactagaaaccttcagaagtacgtcagccggacttcagtcgtgttcgttagcatcagctttattgttctgatgatcatcagcctggcttggcttgtgttttactacatccagaggtttcggtatgcaaacgctcgtgaccgaaaccagcgcaggcttggggatgcggcaaaaaaagccatctctaagctgcagatccggacaatcaaaaaaggggataaggaaacagagtcagacttcgataattgtgcggtttgtattgagggctataagccaaacgacgtagtgcggatcctgccttgtcggcatctgtttcataaaagctgcgtggacccctggcttctggaccaccgcacctgcccaatgtgtaagatgaacatcctcaaggcattaggcattccgcctaatgcggactgtatggacgatctgcccaccgactttgaaggatccctcgggggaccccctaccaatcagattactggcgcttccgacacaacagtcaacgaatctagcgtgactctggatcctgccgtgcgtacagtgggagcgctccaagtcgtccaggatactgatccaatcccacaggaaggcgacgtaatcttcacaaccaattccgaacaggaacccgctgtctccagtgacagtgatattagtttaataatggcaatggaggtcggtctgtccgacgtagaactctccacagatcaagactgcgaggaggtgaagagttag

SEQ ID NO: 53627 - DNA, 1218 bp, Artificial Sequence
  Description of Artificial Sequence: Synthetic coding sequence
atggccatgagcttgattcaggcatgttgcagccttgcattgtcgacttggttacttagcttctgcttcgtgcatttgctgtgtctggactttacggtggccgaaaaggaggaatggtacaccgcatttgtgaatataacttatgccgagccagcgccagacccaggcgcaggcgctgcgggtggaggaggggctgaactccatacagagaagaccgaatgtgggagatacggagagcactctccgaagcaggacgctagaggcgaagtagtgatggcaagtagtgcgcacgaccgtttggcctgcgaccctaacacaaaattcgccgcacctactcgcggtaagaattggatagctctgatcccaaagggtaactgcacatatagggacaagatcagaaacgcatttctgcagaacgcttccgctgtagtcatcttcaatgtgggtagcaacaccaatgaaacaattacgatgccccacgccggagtggaagacattgtcgctattatgatccccgagccgaagggaaaagagatagtaagcctgctggagcgaaatattaccgtgacaatgtacattacaattggcactagaaacctgcagaagtatgtgtcgcgcactagtgtcgtctttgtatccatctccttcattgtacttatgattatcagtctggcatggctcgtgttctactatatacagagattccgctatgctaacgcccgagatcggaaccagagacgcctcggcgacgcggctaaaaaagccatctccaaactccaaatccgcactattaagaagggggacaaagaaacggaatcagactttgataactgcgcggtgtgtatcgaagggtataaacccaatgatgtggtccggatattaccctgcagacatttgttccacaagagttgtgttgacccttggctgctcgatcatcgaacatgtcctatgtgcaaaatgaatatcctaaaagccctcggtattccaccaaacgccgactgcatggatgatctcccaactgacttcgagggcagcctggggggacccccaaccaatcaaatcacgggcgctagcgacacgactgtgaatgagagctcagtgacccttgatccagccgtcaggactgtaggcgcactacaagtagtgcaagacacggatcctattccccaagagggcgatgtaatctttactacaaacagtgaattctgccacacctag

SEQ ID NO: 53628 - DNA, 1317 bp, Artificial Sequence
  Description of Artificial Sequence: Synthetic coding sequence
atggctatgagtctgatacaagcgtgctgttctttagccctgtccacctggctgctatccttctgcttcgtccacctgctctgcttagactttacagtggcggagaaggaagagtggtacactgccttcgtcaatatcacatacgccgaaccagcccctgatcctggtgcaggagcggcagggggaggtggggcagagctgcacactgagaaaaccgagtgtggcagatatggggagcattcccccaagcaggatgccaggggggaggtagtgatggcttcttctgcccacgaccggctggcctgcgatccaaatacaaagttcgctgcccctacacgcggtaagaattggatagccctgataccaaagggaaactgcacgtacagagacaaaatacggaatgcctttctgcagaacgctagcgcagtggttatttttaatgtgggctccaacacaaatgagaccataaccatgccacacgcaggggtcgaagacatcgttgccattatgatccccgagccgaagggcaaagaaatcgtctcccttctagagcggaacattaccgtgacgatgtatataacgatcgggactcgaaatcttcagaagtatgtatccagaacatcagtggtgttcgtgtcaatcagctttatcgtcctaatgattatctccctggcatggctggtattctattacatccagaggtttagatacgccaatgccagagacagaaaccagagaaggttaggtgatgcagccaagaaggcaatcagcaagctgcagatccggactatcaagaagggagacaaagagactgaatccgactttgacaactgcgcggtatgcatcgagggctacaagcccaatgacgtcgtgcgaatactgccctgtagacacctattccacaaatcctgcgtggatccttggctattagaccaccgaacctgccctatgtgcaagatgaacatccttaaggccctcggaattccaccaaatgccgactgtatggatgacctgcctacagatttcgaaggcagtctcggcggtcctccaacgaaccaaataactggtgcttcggacaccacggtcaacgagagttccgtgactcttgatccagctgttcgcacagtgggcgctctacaggtggtgcaagacacggatcccattccccaggagggtgatgttatctttacaactaatagtgaacaagagccggcagtgtcttccgattcggacatctctctaatcatggcgatggaagttggcctgtcagatgtggaacttagtaccgaccaggattgtgaggaggtgaaatcctag

SEQ ID NO: 53629 - DNA, 612 bp, Artificial Sequence
  Description of Artificial Sequence: Synthetic coding sequence
atggaaacactgtcccaggattcgctcctcgaatgccagatttgcttcaattattactcaccacggaggcgcccaaaacttctggattgtaaacacacatgctgctcagtttgtctgcagcagatgcgaacgtcgcagaaggacgtgcggtgcccatggtgtcgcggagtgaccaagctccctcccggatttagtgtaagtcagctgcccgatgaccccgaggtcttagccgtcattgccatccctcacacctccgaacacactccggtgttcatcaagctgccgagcaatggatgctatatgttaccgctgccaatatctaaggagagggccctgttaccgggagatatgggttgtcggctgttgcccggttcgcaacagaaaagtgtgacagtggtgacaatcccagcggaacagcaacctctccaaggcggtgcaccgcaagaggctgtggaagaggagcaagaccgtcggggagtggtgaagtcttctacatggtctggggtgtgtacagttattttggtcgcctgtgtactggtgttcttgttagggatcgtgctgcacaacatgagctgtatatcaaagagatttaccgttatttcatgcggatag

SEQ ID NO: 53630 - DNA, 1053 bp, Artificial Sequence
  Description of Artificial Sequence: Synthetic coding sequence
atgcaccccgctgctttcccgttgcctgtggtggtagccgcagtcctctggggggcagctcctaccagaggcctgatccgggcaacttctgaccacaacgcgtcaatggactttgccgacctgccggcattgtttggtgccacactatctcaagaagggttacagggtttcttggtcgaggcacatcccgacaatgcttgtagtccaattgccccaccaccgccagctcctgtcaacggatccgtcttcatcgcgttgctacggaggttcgactgtaatttcgacctgaaggtcttgaatgctcagaaggcaggctacggagctgctgtggtgcacaacgtgaacagcaacgagttgctcaacatggtgtggaactctgaagagatccagcagcagatttggattccttccgtctttatcggtgagcgatcttccgaatacctgcgcgcattattcgtgtatgagaagggagccagggttctgctggtccccgacaatacattccctctcggttattatctgatcccttttaccgggatcgtcggcctgctcgttcttgccatgggcgctgtcatgatagccagatgtatccagcatcgcaagcgccttcagcgcaacagactcacaaaggagcagctgaaacagattcctacacacgattaccagaagggcgaccagtatgacgtatgtgctatttgcctggacgagtatgaggatggcgataaattacgagtgctgccatgtgcccatgcataccacagccggtgcgttgacccatggctaacacagacacgaaaaacatgcccgatctgcaagcagcctgtgcataggggcccaggggacgaagaccaggaggaggaaacgcagggacaggaggaaggtgacgaaggcgagccaagggatcatcccgcatcagaacgcacaccgttgttaggcagctccccgactctgcccacctcctttggttccctcgcaccggctcctctcgtgttccccggaccttccaccgatccacccctgagtccgccttccagccctgtgatcctcgtatag

SEQ ID NO: 53631 - DNA, 489 bp, Artificial Sequence
  Description of Artificial Sequence: Synthetic coding sequence
atgcatctcctgcctcttgatagcagctctactttaacctgcacggtgcccagtgcttgcactaaacccccttcaaggtggcgtccaacagtggatattttttttgttgtgaccctgttgctgaccgtctttggagaagacgaccagtcacaagatgtcttacgtctgcaccaggatattaacgactacaataggcgtttcagtgggcaacctaggagcattatggagaggattatggatctgccgacattgcttaggcacgcattccgggagatgttcagtgtcgggggactcttttggatgtttcgaatccgaatcattctgtgcctaatgggcgcatttttctatcttatctcaccactcgacttcgtcccagaggccttattcggcatcctgggcttccttgacgatttctttgttatctttctgctgctcatatatatctccatcatgtaccgcgaggtaatcacccagagactgacgaggtag

SEQ ID NO: 53632 - DNA, 603 bp, Artificial Sequence
  Description of Artificial Sequence: Synthetic coding sequence
atggcgaaataccagggggaagtccagtcattgaagctcgacgatgatagtgtgatcgagggcgtttctgatcaggtcctagttgcggtcgtcgtgtcctttgcactgatcgccacacttgtgtatgccctgtttcgcaacgtccaccagaacattcaccccgaaaaccaggaactggtcagagtcttaagagagcagctgcagacagaacaagacgcacctgccgcaaccagacaacagttctacactgatatgtactgcccgatttgcttgcaccaggcaagcttccccgtggagactaattgcggacacttgttctgcggtgcttgcatcattgcttattggcgatacggctcatggctgggggctatctcttgtccaatatgccggcaaactggctctagtgaaaagtcctcccgtgcctctgaacagacacaccaggaagcagtggcatgtttagatacccagaatagcccagcttgcacagtggggtgtcgctccggcccacagcatatcccccacgatcgaatgctgccttccgcttcccctagactgtgtttcaccctcctggactgcgtgtcaattctttggttcagtggctag

SEQ ID NO: 53633 - DNA, 138 bp, Artificial Sequence
  Description of Artificial Sequence: Synthetic coding sequence
atggctaaataccagggcgaggtgcagagtttgaagctggatgacgactcagtcatcgaaggtgtttccgatcaggtgttggttgcagttgtcgtaagctttgcattgatagctacactggtgtatgctcttttctag

SEQ ID NO: 53634 - DNA, 777 bp, Artificial Sequence
  Description of Artificial Sequence: Synthetic coding sequence
atggcaaaataccagggcgaggtgcagagcctgaagctggatgacgatagcgtgattgaaggcgtgagcgaccaagtgctggtggctgtcgtggtttctttcgccttgattgcaactctagtctacgctctcttccgcaacgttcatcaaaacatccaccccgagaaccaggaactggttcgcgtgctgcgggaacagctacaaaccgagcaagatgcccctgctgccacacgccagcaattctatacagacatgtattgcccaatctgccttcatcaggcgagttttcccgtggagactaactgcgggcacctgttctgtggtgcttgtatcatagcatactggcggtatgggagttggctgggagcgatttcttgccctatctgtcggcagactgtcacacttctgttgaccgtatttggagaggacgaccagtcccaggacgtcctgcgacttcatcaggatattaatgactataaccgacggttctctgggcagccccgtagcattatggaaaggattatggatctcccgacccttctccgtcatgcatttcgagaaatgttcagtgtggggggactgttctggatgttccgtattcgtatcatcctgtgtcttatgggcgctttcttttatctgatctcacctctggactttgtaccagaggctctgttcggcattctcgggtttttggatgattttttcgtgatattcctgctcctgatttatatctcaattatgtatcgagaggtgatcacacagagactcacacgctag

SEQ ID NO: 53635 - DNA, 348 bp, Artificial Sequence
  Description of Artificial Sequence: Synthetic coding sequence
atggctaagtatcaaggagaagtgcagtccttgaagctggacgacgactctgtaatcgagggggtcagcgaccaagtccttgtcgccgtagtggtgtccttcgccctgatagccaccctggtgtacgccctattccgcaacgtccaccagaacatccatccagaaaaccaggagcttgtgcgggttctgagagagcagctgcagaccgaacaagatgccccagccgcaactcgtcaacagttttacactgatatgtattgccccatttgtctacaccaggcgagcttccctgtggagacaaattgcggtcacctgttctgcggagcatgcatcatcgcttactggtag

SEQ ID NO: 53636 - DNA, 777 bp, Artificial Sequence
  Description of Artificial Sequence: Synthetic coding sequence
atggcgaagtatcagggtgaggtgcaatcactcaagttagacgatgattctgtcatcgagggcgtgtctgatcaggtgcttgtcgcagtggttgtgagctttgccctcatcgctactctggtgtatgcgctgttccggaacgtgcaccaaaacatccacccagaaaatcaggagttagtgcgtgtgctgcgtgagcagctccagacagagcaggacgcgcctgctgccacacgtcagcagttctacacggatatgtactgccccatatgtttgcatcaggcctcttttcctgtcgagaccaattgtggacacctcttctgtggcgcatgtattattgcttactggcgatacggtagctggctgggtgccatctcatgccctatctgtaggcagacggtcactctgctgctgactgtattcggcgaagatgaccaatcacaagatgtgttgcgcttgcatcaggacattaacgactacaacagaagattcagtggtcaaccacgctctattatggaacgcatcatggatctcccgacgctgcttcggcacgccttccgggagatgtttagcgtgggcggtctattttggatgtttcgcatccggatcatactgtgtctgatgggcgctttcttctatctgatctccccattggatttcgtgcccgaagctctgtttggcattttaggctttctcgatgactttttcgttatcttcctcctgttgatctacattagcatcatgtatcgtgaagtcataacccagagattgaccaggtag

SEQ ID NO: 53637 - DNA, 525 bp, Artificial Sequence
  Description of Artificial Sequence: Synthetic coding sequence
atgtattgtcctatctgcttgcaccaagcatccttccccgtagagacaaattgtgggcacctcttttgtggtgcttgcattatcgcttattggaggtatggaagctggctgggcgcaattagctgtccaatctgccggcaaaccgtaactctgctcctcaccgtctttggggaggacgaccagtcccaagacgtacttagactgcaccaggacataaatgactataacaggcggttctcagggcagcctaggtcaattatggagcgtataatggatctaccaactctgctgagacatgcctttagggagatgttctcagtcggaggcctgttctggatgttccgaatacgcattatcctgtgtctaatgggcgcatttttttatctcatcagtccgttagactttgttcctgaggccctgttcggcatcttagggttcttggatgacttttttgtaatctttctgttgctgatttacatctcaatcatgtacagagaggtgattacacaacggctgacccgctag

SEQ ID NO: 53638 - DNA, 546 bp, Artificial Sequence
  Description of Artificial Sequence: Synthetic coding sequence
atggcagaccccaccatacttgtgtacaaatggttcctgctgatctataagctctcatacgcctttggcgtcgttggctatttagcaattatgttcaccatgtgcgggttcaacctatttttcaaaattaaggctcgcgacagcatggattttggcattgtgtcccttttctatggactctactacggagtcatgggtagagattttgctgaaatttgcagcgattatatggcaagcactatcggattttactcggtttctaggctgccaaccagaagcctgagtgataacatctgcgcagtttgtggacaaaagattattgtagaattggatgaggagggtctgatcgagaacacataccaactgtcatgtaaccatgtgtacccttttcagcgcaagctgttcggtctccaccaggccagcttcttcccaccttcgcctccgccaccacccgtgcctatcagttcaatcctcctcacctttcacgcgcagaccccagtactctatccacctgcgcaaagctccctcccagtatgtccatgttag

SEQ ID NO: 53639 - DNA, 987 bp, Artificial Sequence
  Description of Artificial Sequence: Synthetic coding sequence
atggccgctggaacagcggcacgtaaagctgcacctgtgctggaggccccacctcagcaggagcagctttcacacacaaaactgtccgctgaggacacctggaatctgcagcaggaacgaatgtataagatgcaccggggtcacgattctatgcacgttgagatgatcttgatctttctgtgtgttcttgtgatcgcacagatcgttctggtccagtggcgccagcgtcacggtaggagttataacttggtgacgctgctacagatgtgggtggtgcctttgtattttactatcaagctgtactggtggaggtttctctccatgtggggtatgtttagcgtgattacctcctatatcctcttcagggcaactaggaagcctctgagcgggagaacgccacggcttgtgtacaaatggttcctgctgatctacaaattatcctatgcctttggagtagtgggctatctggccataatgttcaccatgtgcggtttcaatctgttctttaaaatcaaagctagagactccatggattttgggattgtgtcattgttttacggcctgtattacggagttatgggccgtgacttcgcagagatttgtagcgattacatggcttcgactatcggattctacagtgtatcccggctgcccacccgctccttgagcgataatatctgcgccgtgtgcggccagaagattattgtggagctagatgaagaggggcttattgagaatacctaccaattgagttgtaatcatgtcttccatgagttttgcattcgtggctggtgtattgtgggaaagaagcagacctgtccatactgtaaggaaaaggttgacttgaaacggatgatttctaacccctgggaacgaactcatttcctgtacggccagattctagactggttgagatatcttgttgcttggcagccagtggtgatcgggattgtccaaggaataatttattccctaggactagaatag

SEQ ID NO: 53640 - DNA, 1251 bp, Artificial Sequence
  Description of Artificial Sequence: Synthetic coding sequence
atgaaaagatccaaggaattgattacgaagaatcactcacaggaggaaacgagcattctgcgatgttggaagtgtcgaaagtgcattgctagcagcggatgctttatggagtatctggagaatcaggtgattaaggataaggacgattccgtcgacgcccagaacatctgtcacgtttggcacatgaacgtggaagccttgccagagtggatctcatgcctcatccagaaggcacaatggaccgtgggcaagttgaactgtcccttctgcggcgctcggttaggcggattcaatttcgtgtccactcccaaatgctcatgtggtcagctcgcagctgtgcatctctctaaatcacgcaccgactatcagcccacccaggccggaaggttaatgagaccatctgttaagtacttgtcccaccctcgtgttcagtcagggtgcgataaagaagcactcttaacaggaggaggctcggagaatcggaatcaccgcttactgaacatggccagaaacaataatgatcctggcagactcactgaggctctgtgtctcgaggtgaggccaacctactttgagatgaagaacgaaaaactgctgtctaaggctagcgagcctaagtatcagttgttcgtgccacagcttgtgactggtcgctgtgctaccagagcctttcatcgtaagtctcatagtctggatctcaacatttctgaaaaactaacactgctaccaaccttgtacgagatccatagcaaaacaactgcttactctaggctgaacgagacgcagcccattgacctgagtggacttcctctgcaatcgtcaaagaattcctacagtttccagaaccccagctcgtttgacccaagcatgctgctacagcgcttctccgtcgcaccacatgagacacagacacagagggggggagaattccagtgtgggctggaggccgcttccgtatactcagatcacacaaacacaaacaatctgacgtttcttatggatctcccaagtgctggccgatccatgcctgaggcctctgaccaggaggagcacctgtctcccctggatttccttcactctgccaactttagtctcggctcgattaaccagcgtttgaacaagagagagcgaagcaagctaaaaaacttacgccgtaagcagagacggagagagaggtggttgcaaaaacaggggaaatattccggtgtgggcttgctggatcacatggtgagcatttacctgcttatttag

SEQ ID NO: 53641 - DNA, 291 bp, Artificial Sequence
  Description of Artificial Sequence: Synthetic coding sequence
atgaaacggtctaaggagctgatcacaaaaaaccatagccaagaagaaacgtcaatcttgagatgctggaaatgtcgtaaatgtatagcgtccagcggatgtttcatggagtacctagaaaatcaagttattaaagacaaagacgattctgtcgacgctcagaacatctgccacgtttggcacatgaatgtggaggcactcccagagtggatctcatgtctcatccagaagggtaaatactctggcgttggcctgctggaccacatggtgtccatatacttgcttatatag

SEQ ID NO: 53642 - DNA, 1779 bp, Artificial Sequence
  Description of Artificial Sequence: Synthetic coding sequence
atgaaacgtagcaaggagttaatcacgaagaaccactctcaagaggaaacgtccatattgcgatgctggaagtgccgaaaatgtattgcatctagtgggtgctttatggaatacctggagaaccaggtcattaaggataaggacgattcagtggacgcccaaaacatctgccatgtgtggcacatgaatgtggaagctctcccggagtggataagctgtctgatccagaaggcgcagtggaccgtgggaaaactgaattgtccgttctgcggcgcacgcctaggtggattcaactttgtatccactcctaaatgtagttgcggccagcttgctgccgtccatctcagcaagtcaagaaccgactatcagccgacacaggcaggccgattaatgcggcctagcgtgaagtacttgtctcaccctcgggttcagagcgggtgcgacaaagaggcgctgctcactggtggtggctccgaaaatcgaaaccatcggctcctgaacatggcccgtaataataacgaccctggtcgactcacggaggctctctgcctcgaagtgcgccctacctactttgaaatgaagaatgagaagcttctgagcaaggccagcgaacctaaataccagcttttcgtcccacagctcgtgaccggcagatgtgccacccgcgcattccaccgaaagtctcattcccttgacctgaatatcagcgagaaacttacccttttgcccactctgtatgagattcacagcaagaccactgcttactcaagactgaatgagacccaaccaattgatctcagcggtctacctcttcagagtagtaagaactcttactcttttcaaaatccatcatccttcgatccttcaatgttgctgcagagattctccgtcgctccacacgaaacacaaacccaacggggtggtgaattccagtgcggactggaggccgcttctgtctactccgaccatacaaacacaaacaacttaacctttttaatggacctgccatcagcgggtaggtcaatgcctgaggcaagcgaccaagaagaacacctgagtccgctagacttcctgcatagtgcaaatttttctctggggagtattaatcagcgcctaaacaagcgggaacgaagtaaattgaagaatctcaggaggaagcagagacgacgagaacgttggctgcagaagcagggcaagtacagcggcgtggggctactagaccacatgactctgaataacgaaatgagtacagacgaggacaacgagtatgctgaagagaaagattcctatatatgcgcagtttgcctagacgtttactttaacccgtacatgtgttatccttgccatcacatcttctgcgaaccctgtctccggaccctggccaaggataatccctcatcaactccctgtcctctctgtagaacaataatcagccgcgtcttttttcagacagagctcaacaatgcaacaaagacttttttcacgaaggagtacctgaagatcaagcagagctttcagaagtctaattctgcaaagtggccccttcctagctgtaggaaagccttccacctgttcgggggattccgtcgccacgcagctccagtcactagaagacagttcccccatggggctcacaggatggactacctccacttcgaagacgattctcgaggctggtggttcgacatggatatggtcattatctacatctattcggttaactgggtgatcggatttatcgtgttttgctttctgtgctattttttttttcctttttag

SEQ ID NO: 53643 - DNA, 324 bp, Artificial Sequence
  Description of Artificial Sequence: Synthetic coding sequence
atgaagcggtctaaagagctcattacaaagaaccattcgcaggaagagacatccatcctcaggtgttggaaatgccgcaaatgtatagcctcctctggctgcttcatggaatatcttgaaaatcaggtcataaaagacaaagatgattccgtggatgcacagaacatctgccacgtgtggcatatgaacgtcgaggcattgcccgagtggatttcatgtctgattcaaaaggcccagtggaccgtggggaaactcaattgccccttttgtggtgccagactgggtggattcaacttcgtgagcactccaaaatgttcatgctag

SEQ ID NO: 53644 - DNA, 489 bp, Artificial Sequence
  Description of Artificial Sequence: Synthetic coding sequence
atggcatcacagccgccagaagatacagccgaatcccaggccagcgacgaattggagtgtaaaatctgctacaatagatacaatctcaaacagagaaagccaaaggtgcttgaatgctgtcatcgcgtgtgtgctaagtgcttgtataaaataatcgactttggagatagcccccagggggtgattgtgtgccccttctgcagatttgagacatgcctgcctgatgatgaggtgagcagcctccccgatgataacaatatcttggtgaatctaacttgcggagggaaaggaaaaaagtgcctgcccgagaaccctaccgagctgttgctgacccctaagcgactcgcctctttggtctccccctctcacacttccagtaactgtctggttattaccatcatggaagtccagagagagagtagtccttccctatccagcacccccgtggttgagttctacaggccagcgagcttcgacagtgtcacttag

SEQ ID NO: 53645 - DNA, 249 bp, Artificial Sequence
  Description of Artificial Sequence: Synthetic coding sequence
atggctagtcagccacccgaggatacagccgagagtcaggcaagcgacgagcttgagtgcaaaatctgctacaaccgctacaatctcaagcagagaaagcccaaggtgttggaatgctgtcacagagtttgtgctaagtgtctgtacaagatcattgattttggcgattcgcctcagggagtgattgtatgtcctttctgcagattcgaaacttgcctacccgatgacgaggtgtcatctttgccctag

SEQ ID NO: 53646 - DNA, 42 bp, Artificial Sequence
  Description of Artificial Sequence: Synthetic coding sequence
atggcatcccagccgcctgaagacaccgccgaaagccagtag

SEQ ID NO: 53647 - DNA, 744 bp, Artificial Sequence
  Description of Artificial Sequence: Synthetic coding sequence
atggcctcccaacctccagaggatacagcagagagccaggcctccgacgagctggagtgcaagatatgttataataggtataaccttaagcagcggaagccaaaagtgctggaatgctgccacagagtctgcgctaagtgtttatataaaattattgactttggtgacagcccacaaggcgtgatagtatgtccattctgtaggttcgagacctgcctcccggacgatgaagtctcgagtctccctgacgacaataacatcctggtcaacctgacatgcggcggaaaggggaagaaatgcctaccggagaatccaactgagttgctgctcacgccaaaacgactggcatcactggtgagcccgtcacacaccagctccaattgtttagtcattacaatcatggaggtgcagagggaatcctctccatcccttagctcaactcccgtagtggagttttatcgccctgcttcctttgatagcgtaaccaccgtttcacacaactggactgtctggaactgcacgtcattgctattccagacttccattagggtactcgtctggctcctgggattattgtacttcagctctttgcctttgggtatctatctgctggttagcaagaaggttactctgggcgtggtgtttgtgagtttggtgccaagttcactcgtcatcctgatggtttacggcttttgccagtgtgtctgtcacgaatttctggactgcatggcaccaccttcctag

SEQ ID NO: 53648 - DNA, 156 bp, Artificial Sequence
  Description of Artificial Sequence: Synthetic coding sequence
atggcctctcagccccctgaggacacagccgagtctcaggcatccgatgagctcgaatgtaagatctgctacaatagatacaatttgaagcagaggaaacctaaggttctggagtgttgtcacagagtctgtgcaaagtgcctgtacaaaatatag

SEQ ID NO: 53649 - DNA, 744 bp, Artificial Sequence
  Description of Artificial Sequence: Synthetic coding sequence
atggcttcccagccacccgaagacacagccgaatcccaggcttcagacgaactcgaatgtaaaatttgttacaataggtataacctgaagcagcggaagccgaaagtgttagagtgctgtcaccgggtatgcgccaaatgtctttataagattattgattttggtgattcccctcagggggtcatagtgtgtcctttttgtcggttcgaaacatgcttgcccgatgacgaggtttcgtcactgccagatgacaataacattctggtgaaccttacctgtggcggtaaaggaaagaagtgcttacccgagaacccaaccgaacttcttttgactccaaagcggcttgcgtcactggtcagcccttcccacactagctccaactgcctggtcataacaatcatggaggttcaacgtgagtcgtcaccaagcctgagttcaacaccggtggtcgaattctatcggcctgctagcttcgacagcgtcacaaccgtttcacacaattggactgtctggaactgcacctcactcctgttccagaccagtatccgggtgctggtgtggctgctcggattactgtacttttctagcctgccactaggcatatatctgcttgtttccaagaaggtaacactcggtgtcgtcttcgtgtcacttgtgccctctagcctggtaatcctgatggtctatggcttctgccagtgtgtatgccacgagtttctggattgcatggccccaccatcctag

SEQ ID NO: 53650 - DNA, 744 bp, Artificial Sequence
  Description of Artificial Sequence: Synthetic coding sequence
atggccagtcagccccctgaggatacagctgaatcccaggccagcgacgaactcgagtgtaagatttgctacaaccgatacaatctgaagcagcgtaagcccaaggtgctcgaatgctgccaccgggtttgcgctaaatgcttatacaagattattgactttggagactctcctcagggagtgatcgtctgtccgttctgtcgattcgagacctgcttaccagacgacgaagtaagctcacttccagacgataacaatatcttggttaacctgacctgtggaggtaaaggaaagaagtgtctgcccgagaaccccaccgagttactgctaacccccaagagactcgcctcactcgtgagcccgtcacataccagttcaaattgcctcgtgatcacaattatggaggtgcagcgcgaatccagtccatctttgagttctactcccgtcgtcgagttttacagacccgcttcatttgactccgtcacgacggtgtcccacaattggactgtctggaattgtacctctctgttgttccagacatcaattcgagtgctggtgtggctccttggcctgctgtacttcagtagcctgccacttggtatctatctcctggtttcaaaaaaggtgactctaggggtagtgttcgtgagcctggtgccatccagcctcgtgatccttatggtgtacggcttttgtcagtgtgtctgccatgagttcctggattgtatggccccaccaagctag

SEQ ID NO: 53651 - DNA, 744 bp, Artificial Sequence
  Description of Artificial Sequence: Synthetic coding sequence
atggcttctcagcccccagaagatacggctgaatcccaagcctccgacgagttggagtgcaaaatatgttacaatagatacaatctcaagcagaggaaacccaaggtgttagaatgttgccacagagtctgcgccaagtgcctgtacaaaataatcgactttggggactcgccacagggggtgatagtctgccctttttgccgatttgagacatgtttgccggatgacgaggtcagctctcttcccgacgacaataacatactggtgaacctgacgtgtgggggaaaaggcaagaagtgtctgccagagaatcctaccgagctcctcctgactcctaaacgcctggcctctctggtctccccttcccacacctcctccaactgtctggtgattactattatggaagtacagagggaaagcagcccttccctcagttctactcccgttgttgaattttatcggcctgcatctttcgacagcgtgacaactgtgtcacacaattggacggtgtggaattgcactagccttctctttcagaccagcattagagtgctggtctggctccttggactcctctattttagcagcctgccactgggaatctatctactcgtgtctaagaaagtcacattgggggttgtgttcgtttctctcgtgccttcaagcctggtaattctgatggtctatgggttctgtcagtgcgtctgccatgagtttctggattgcatggcaccgccatcctag

SEQ ID NO: 53652 - DNA, 579 bp, Artificial Sequence
  Description of Artificial Sequence: Synthetic coding sequence
atggcatctaaagggccttccgcctctgcctcccccgaaaattcatcagcagggggaccttccggcagttcaaatggagccggtgagtccggagggcaggattccaccttcgaatgtaatatctgcctggataccgcgaaggacgccgtgatatctctatgtggccacctgttctgctggccgtgtctgcatcagtggctggaaacacggcctaacaggcaggtttgcccagtatgcaaggctggtattagcagggacaaagttattccactctacggaaggggttccacggggcaacaggatcctcgcgaaaaaacacccccacggccacagggccagaggcctgagccagaaaatcggggaggcttccagggcttcggctttggtgacggcggtttccagatgtcattcggtataggggcatttccttttgggatatttgcaactgccttcaacatcaatgatggaagaccacctcccgctgtacccggaacgccccaatacgtcgatgagcagtttctgtctcgactttttctgttcgtggcgctcgtgatcatgttctggctcctgatcgcttag

SEQ ID NO: 53653 - DNA, 393 bp, Artificial Sequence
  Description of Artificial Sequence: Synthetic coding sequence
atggcgctggcgcgtgctgaaggacggaccgccttatctagcgctactagcgcttggacacaacctcgcatgcccagcagcgcgtgtgttgctaccagttccgtgggtcgcgtctacatcagggaaaagacgccgccaagaccgcagggccagcgacccgagcctgagaatagaggcggtttccagggattcggctttggggacgggggatttcagatgagcttcggaatcggagctttcccctttggcatattcgctaccgctttcaatataaatgatggaagaccacctcccgcagtgccaggcacccctcagtacgtcgacgagcagtttctttcaagacttttcttgtttgttgcccttgtgattatgttttggttactaatcgcttag

SEQ ID NO: 53654 - DNA, 474 bp, Artificial Sequence
  Description of Artificial Sequence: Synthetic coding sequence
atggccagcaaggggcctagtgcatccgcatcccccgaaaactcctccgccggtggaccttcaggaagttccaacggggctggcgaaagtggtgggcaagatagcactttcgagtgcaatatttgcctggacaccgccaaagatgccgtcatctcattgtgcggacacctcttctgctggccctgcctccaccagtggctggagaccagaccaaataggcaagtgtgtcccgtttgcaaggctggcattagccgggataaggtgattcccctctatgggagaggctcaactggacagcaggatccaagagaaaagacgcctccccgtccacaggggcagaggcccgagcccgagaaccgcggagtgcgcaacatcctgggggaagcctccaccaacgagctcatggctctggaagtttctttcttggctcttcagtttttttctcttatcattaaggttaaggaaaacctctag

SEQ ID NO: 53655 - DNA, 579 bp, Artificial Sequence
  Description of Artificial Sequence: Synthetic coding sequence
atggcatccaagggacctagcgcttcagcatcccccgagaattcctcagccggagggccttcaggctcaagcaacggtgcgggtgaaagtggtggtcaagattccaccttcgaatgcaacatctgtctggatacagctaaagacgccgtcatatctttgtgcggacacctgttctgttggccctgtcttcatcagtggctggaaacgaggcctaatcgacaggtctgtcccgtgtgcaaggctggtatctcccgagacaaggtgattccattgtatggtcggggttcaaccggacaacaagatcctcgggaaaaaacgccaccgcgaccgcagggccagagacctgagcctgagaaccggggtggcttccaaggatttggcttcggggatggaggttttcagatgagtttcggcattggggcttttccgtttggcattttcgctacggcctttaacatcaatgacgggaggccccctcctgcggtgcccggaactcctcagtatgtcgacgaacagttcctgtccaggctgttcctttttgtggctctggtgataatgttctggctgctgatcgcatag

SEQ ID NO: 53656 - DNA, 411 bp, Artificial Sequence
  Description of Artificial Sequence: Synthetic coding sequence
atggcctccaagggtccgtcagcatcagcctcaccagaaaatagtagtgccggtggtccaagcggctcctctaacggtgcaggcgagagtggcggtcaagacagcactttcgagtgcaacatatgtcttgacaccgcaaaggatgccgtgataagcctttgcggccatttgttctgttggccctgtctccatcaaggattccagggcttcggattcggagacggtggtttccagatgtcattcggtatcggggctttcccatttggtatctttgccactgcattcaacatcaacgacggcaggccaccacctgctgtccctgggactccccagtacgtcgacgagcaatttcttagcaggctttttttgttcgttgctctcgtgatcatgttttggttactcattgcatag

SEQ ID NO: 53657 - DNA, 2517 bp, Artificial Sequence
  Description of Artificial Sequence: Synthetic coding sequence
atgcaggaacaagagatcggattcatctcaaaatataatgagggactctgtgtaaatacagaccccgtgagtatccttaccagcatattagacatgtctttacacaggcaaatgggttcagatcgagacctccagagtagtgcttcctccgtgtctttgccaagtgtgaagaaggctcctaagaagagacgcatttccattggcagtctgttccgtagaaagaaagataataaaagaaaatccagggagcttaacgggggagtggacggcatcgcatccatcgaatccatccactctgaaatgtgtactgataagaactcaatttttagtaccaacacctcatcagataatgggttaaccagcataagcaagcagatcggagattttatagagtgcccgctctgccttctgcggcatagtaaggaccggtttcctgacatcatgacatgtcaccaccggtcatgtgtagattgcctgagacagtaccttcggatcgagattagtgaaagcagggtaaacatctcgtgtccagaatgcacggagagattcaaccctcacgacattaggctgatccttagcgacgacgtcttgatggaaaaatacgaagagttcatgctcagacgctggctggtggccgaccccgactgccgatggtgtcctgcgccagattgcggatatgcagtgattgcattcgggtgcgcctcctgccccaaactgacttgcggacgggagggatgcggcacggagttttgctaccactgtaaacagatttggcaccctaaccagacatgtgacgccgctcgacaagagcgggcacagtctcttcggctacggaccatcagaagcagtagcatcagctattcccaggagtctggtgccgctgcggatgacattaagccatgtccccgatgcgcagcctacatcatcaaaatgaacgatgggtcttgtaatcacatgacctgcgcagtgtgtggatgtgagttttgctggttgtgtatgaaggagattagcgaccttcattatctgtccccaagtggttgcaccttctggggcaagaagccctggagcagaaagaaaaaaatactgtggcagctgggcactctggttggtgcccctgtgggaatagccctgatcgctggcatagccattccagctatgattattgggatcccggtgtatgtcggcaggaagatccacaatagatatgaaggcaaggatgtctctaagcacaagaggaaccttgcaattgccggaggcgtaacgttgtctgtgattgtgtcccccgtggtcgcagctgttactgtagggataggggtgcccatcatgctggcttatgtgtatggagtggtccctatatccctgtgcaggtcaggcggttgcggggtcagtgccggtaacgggaaaggcgtgcgaatcgaattcgacgatgaaaatgacattaacgtcggaggcacaaacaccgccgtcgataccacctctgtggccgaggcccgtcacaatcccagcatcggcgaggggagcgtcggcggattgacaggctccctcagtgcttcgggcagccacatggaccgcattggagctatccgtgataacttgtccgagaccgcctcgacaatggctctggctggagcttctatcaccgggagtctctctggctccgcaatggtaaattgcttcaacaggctcgaggtacaggctgatgtacagaaggagcgttacagcctgtctggtgagagtggaacagtgtccctcggaaccgtgagcgataacgcgtccactaaggccatggccggtagcatcttgaacagctacatcccactcgacaaagagggcaactccatggaggttcaggtggacatcgagtcaaagccctctaagttccggcacaactccggctccagttcggtagatgacggcagtgctacacgctcacacgccggtggctccagttcaggactccccgaaggcaaaagtagcgctactaagtggtctaaggaggctactgccggaaagaagtccaaaagtggaaaactgagaaagaagggtaacatgaaaatcaacgagacaagagaggacatggacgcgcagttgctcgagcagcagagtactaacagttccgagttcgaagcgccatcactgagcgatagcatgcccagtgtggctgactcccattctagccacttctccgagtttagttgctctgacttagaatctatgaagacctcctgttcacatggctcttctgactatcatacacgctttgctacagtaaatatactccccgaggttgagaacgacagactggagaactcaccacaccagtgcagtattagcgtcgtgactcaaaccgccagctgctccgaggtctctcagctcaatcacatcgctgaggagcatgggaacaatggaataaaacctaacgtcgacctctacttcggggatgccctgaaagaaacaaacaacaaccattcccaccagacaatggaactcaaagtggccatccagaccgagatatag

SEQ ID NO: 53658 - DNA, 270 bp, Artificial Sequence
  Description of Artificial Sequence: Synthetic coding sequence
atgcaggagcaggaaattgggtttatctctaaatacaacgaaggtctatgcgtgaatactgaccctgtgtccatccttacctccattctggacatgtcactgcacaggcagatgggatctgacagggacctgcagagcagtgcctcttctgtgtcacttccctctgtaaaaaaggctcctaaaaagcggcgaatttccatcggctcccttttcagacgcaagaaggacaataaacggaaatcccgcgaactcaatggaggagtcgattag

SEQ ID NO: 53659 - DNA, 2517 bp, Artificial Sequence
  Description of Artificial Sequence: Synthetic coding sequence
atgcaggaacaagaaataggattcatctctaaatataacgagggcctgtgcgtgaatacagaccccgtcagtatacttacatctatactagacatgtctctgcatcggcagatgggcagcgatagagatctccagtcttcggcgagcagcgtgagcctgccttccgtgaaaaaagctcctaaaaaacgccgtatcagcattggcagcctgtttagaagaaaaaaggataacaagcgtaaaagtagagaattgaatggaggcgtcgacggtatcgccagcattgaatctatccactctgagatgtgcacagataagaatagtatttttagtacgaatacctctagcgacaatggcctgaccagcataagtaagcagatcggggattttatcgaatgtccgctgtgtctattaagacattctaaggatcgatttccagatattatgacctgccaccacagatcttgcgtggactgtctgagacagtacctgaggattgagatttctgagtcccgcgttaacatttcctgtcccgaatgcaccgaaaggtttaatcctcacgatatcagactgattttatccgacgatgtgctgatggagaaatacgaggagttcatgctcaggaggtggctggttgccgatccagactgccgctggtgtccagccccagactgtggctacgcagtcatcgcgtttgggtgtgcctcttgccctaaattgacctgcggacgagaaggctgtggcaccgaattctgctaccactgtaaacagatttggcatccgaaccagacctgcgacgccgcacgccaggagagggcccagtctcttcggctccgtactattcgaagcagcagcattagctattcacaggaaagtggggcagcagcagatgatataaagccgtgtcctaggtgtgccgcatacataattaagatgaacgacggttcttgtaatcacatgacatgcgcagtctgcggttgcgaattctgctggctgtgtatgaaggagatttctgatctgcactacctgtccccttctggctgtacgttttggggcaagaagccctggtcccgcaaaaaaaagatcttgtggcagctgggcacactggtgggagccccagttggaatcgcactgattgcaggaatcgcaatccccgctatgatcattggcatccctgtgtatgtgggccgtaaaatccacaataggtacgagggtaaagacgtgagcaaacataaaagaaatctggccatcgccggaggcgtcaccctgtccgtcattgtgtcccctgtggtcgcggcagtgacagtcggaattggagtgccgatcatgctggcatatgtctacggagtggtccccatatccctctgcaggtccgggggttgtggggtaagcgctggtaacggaaaaggggtgcggattgaatttgacgatgaaaatgacatcaacgtggggggaactaacacagcagtcgataccacgtctgtggcagaagcgagacacaatccaagtattggggagggttcagtgggcggtctcaccggaagtctaagcgcttctggctctcacatggacaggataggcgcaattagggataacttgagtgagaccgcttccactatggcccttgcaggagcgtcaataacggggagtctaagcgggagtgctatggttaattgctttaataggcttgaagtgcaggccgatgttcagaaagaaaggtactccctctccggagaatctggcactgtgtcactaggaacagtttctgataatgcctccactaaggctatggctggttcaatactcaactcttatattccgctggacaaagaaggaaatagcatggaagtccaggtcgacattgaatctaagccctcgaaattcagacacaacagcggctcatccagtgtagatgatggcagtgcgactagatcacacgctggcggatcttcctctgggctcccggaaggcaaaagctccgcaaccaaatggagcaaagaagcaacagcaggaaaaaagagcaagagtgggaaactcagaaagaagggcaacatgaagatcaacgagacccgcgaagatatggatgcccagctcctggagcagcagagtacgaactcgtcagaatttgaagcaccatccctttccgacagcatgccaagtgtggctgatagtcacagctctcacttttctgagttctcatgctccgatctagaatctatgaaaacaagctgttcacacgggagtagcgattatcataccagatttgcaaccgtgaatatcctgcccgaggtcgaaaacgaccgacttgagaactcaccacaccagtgctctatatcagtggtcacacagaccgcaagttgcagcgaggtgtctcagttgaatcacatcgcagaagagcatgggaacaacggtatcaaacccaacgtggatctgtactttggggacgccttaaaggaaactaacaacaaccactctcaccaaactatggaactgaaagtggcgattcaaaccgagatctag

SEQ ID NO: 53660 - DNA, 498 bp, Artificial Sequence
  Description of Artificial Sequence: Synthetic coding sequence
atgcaggagcaagagataggattcatatccaagtataacgaaggcctttgcgtgaacacagatcccgtgtcaattctcaccagtattttggacatgagcctgcaccgacagatgggaagcgacagggacttacagagctcagccagcagtgtctccctaccttccgttaaaaaggcccctaaaaaaagacgcattagcattggcagccttttcagaagaaagaaagacaacaagcgaaagagtcgcgagttgaatggtggcgtcgatgggatagccagtatcgagagcatacacagtgagatgtgcaccgacaagaattctatcttctctactaacacctcttcagataacggtttgacctccattagcaaacagataggcgatttcatagaatgtccattgtgtctcctccgccactccaaggatcgctttccagatatcatgacatgccaccatcgctcatgtgtggattgtcttcgacagtatttacggatttag

SEQ ID NO: 53661 - DNA, 342 bp, Artificial Sequence
  Description of Artificial Sequence: Synthetic coding sequence
atgcaagagcaggaaatcggttttatcagtaagtataacgaaggcctgtgtgtcaatacggatcccgtgagtatcctcacctctattctggacatgtccctgcaccggcagatggggtccgatagagatctgcagagctctgccagcagtgtgtcattgcctagcgtaaaaaaagcgccaaagaagcggaggatatccatcggcagccttttccgaagaaagaaagacaacaagagaaaatctagagaactcaacggcggtgtggacggcatcgccagcatcgagtctatccacagcgagatgtgtaccgacaagaactccatcttctccactaacacctag

SEQ ID NO: 53662 - DNA, 471 bp, Artificial Sequence
  Description of Artificial Sequence: Synthetic coding sequence
atgcaggaacaggagataggctttatctccaagtacaatgagggcctgtgcgtgaataccgaccccgtgagcatcctcactagtatcctggacatgagcctccatcgccagatgggctctgacagggatctccagtccagcgctagttctgtctctctgcccagtgtgaagaaggcaccaaagaagcggcgaatcagtatcgggtctctgtttcggagaaagaaagacaataagcgtaaatctagggagttaaatgggggagtggacggcatagcaagcattgaatccatccacagtgagatgtgcacggataagaattcaattttttccaccaacaccagttctgataacggcctcacatccatctctaagcaaattggggattttatcgagtgtcccttatgtctacttaggcattcgaaagatcgtttccctgatataatgacatgtcaccaccggagttgcgtgtag

SEQ ID NO: 53663 - DNA, 48 bp, Artificial Sequence
  Description of Artificial Sequence: Synthetic coding sequence
atgcaggagcaagaaattggcttcataagcaaatacaacgaagggtag

SEQ ID NO: 53664 - DNA, 1029 bp, Artificial Sequence
  Description of Artificial Sequence: Synthetic coding sequence
atgagaaaggagactcctcctccgctagtcccacccgcagctcgagagtggaacctgcctccgaatgcccctgcctgtatggagcggcagctggaagccgcaaggtaccgttccgacggtgccctactgttgggtgcttcctctctgagcgggagatgctgggccggaagtctttggctgttcaaggatccctgcgcagcccctaacgaaggattttgctctgcaggcgtccagactgaggcaggagtcgcagatctgacctgggttggagaacgcggaatcctagtggcaagcgattctggtgctgtggagctttgggagctggatgagaatgaaaccctgatcgtcagcaaattctgtaagtacgagcacgatgatattgtgagcaccgtgtccgtgctctctagcgggactcaggccgtaagcggtagtaaagacatctgcatcaaagtgtgggatctggctcagcaggtagtcctgagctcctatcgggcacacgctgctcaagtaacctgcgtagctgcctccccccacaaagactccgtgtttctgagctgtagcgaagacaacaggattctgctgtgggacacaaggtgtcccaaacccgcaagccagatcgggtgtagtgcgccaggctatctacctacttccctcgcatggcacccacagcaaagcgaagttttcgtgttcggggacgagaacggcacagtatccttagtagacactaaaagcacaagttgcgtactgtcaagtgctgttcatagccagtgcgtcactggattggttttctcacctcacagtgtgccttttctcgcaagtctctccgaggattgttctctggccgtactggactctagcctgagtgaattgtttcggtcacaagctcacagggactttgtgagagacgctacatggtctccactgaaccatagtctgctgaccaccgtcggatgggaccatcaggttgtccatcatgtcgttcctaccgagcccctaccagcaccaggcccagctagcgttaccgagtag

SEQ ID NO: 53665 - DNA, 1764 bp, Artificial Sequence
  Description of Artificial Sequence: Synthetic coding sequence
atgggaagcgagaaagactccgaaagccctagatcaacctctctgcatgccgcagcccctgatcctaaatgtcggagcgggggacggaggcgtagattgactttgcactctgtattcagcgcttctgccaggggccgaagggccagggcgaagcctcaagccgaacccccaccacctgctgcacagccacctccagcccctgctccagcagctgcacagggcccaccccctgaggcactccccgcagagccagcggctgaggctgaggcagaagcagccgcagcagcagccgagccgggatttgatgatgaggaagccgctgaggggggaggcccaggtgctgaagaggtagagtgccctctgtgccttgtgagactacctccagagagggcgcctaggctgctctcctgccctcatcggtcatgccgtgactgcctgaggcactacctgcgactcgaaatctcagagtcccgtgtgcctatcagctgtccagaatgctcagagaggcttaacccacacgacattcgactcctattagctgaccctccactcatgcataagtatgaggagttcatgcttcgcagatacttggcctcggaccccgactgtcgatggtgcccggctcccgattgtggttatgccgtgatcgcctacggctgtgcctcttgcccaaagctcacctgcgaaagggagggctgccagacagagttttgttatcactgtaagcagatttggcaccccaaccagacctgcgacatggcgaggcaacagcgcgcacagaccttgcgtgtccgaacgaaacatacctccggtctatcctatgggcaggaatctggacctgacgacattaagccctgccccaggtgttccgcatacatcattaaaatgaacgatgggagctgcaatcacatgacttgtgcggtatgtggatgcgagttctgttggttgtgtatgaaggagatctcagacctgcattatctgtccccatctggctgtaccttctggggcaaaaaaccctggtcccgaaagaaaaagattctctggcagcttggaacacttatcggagctcccgtcggtatatcccttattgcaggtatcgctatccccgctatggtcataggaattcccgtctatgttggccgtaaaattcatagccgatacgaggggagaaaaaccagtaagcacaagcgtaatctggccatcacaggcggagtgactctttccgttatcgcttcacccgtaatcgcagccgtatccgtgggcatcggcgtgccaataatgctggcttatgtctatggagtggttcccatctctctatgtcgtggtggcggttgtggggtgagtacggcaaacgggaagggtgtgaagatcgagttcgacgaggacgatggacctatcaccgttgctgacgcatggagagccctcaaaaaccctagcattggggagtcgtccatcgaggggttgaccagcgtactgagcacctctggctcgccaaccgatggactgtccgtaatgcagggaccgtattctgaaaccgcctctttcgcagcccttagcggcggaaccctaagtggcggaatactgagctcaggaaaaggaaagtatagtcgactcgaggttcaagcagatgtgcagaaggagatttttccgaaggacaccgcctccctgggagcgatatccgataatgctagtacccgagccatggcaggctctatcatctcctcttacaaccctcaagataggttcagcatgatacatgcttag

SEQ ID NO: 53666 - DNA, 2199 bp, Artificial Sequence
  Description of Artificial Sequence: Synthetic coding sequence
atgggatctgagaaggattctgagtctcccaggagtacgagcctgcacgctgctgctcccgacccaaagtgtcggtccggcggtcggaggagaaggctcactctgcactctgtattctccgccagtgccagggggaggcgggcacgcgctaagccgcaggctgagcccccacctccggctgctcagccccctccagccccagcaccagcagccgcacagggccctccaccagaagcactgccagctgagccagctgcggaggccgaagcagaggctgcagcggcagctgccgaacctggctttgatgatgaagaggctgcggaggggggtggtcccggagccgaggaggtggaatgcccactgtgtctcgtgaggctcccaccagagagagcacctcgactgttatcatgcccacaccgaagctgtagggattgtctgagacactacttacggctggaaatctctgagagtcgagtgcccatctcctgtcccgagtgtagtgaaaggcttaatcctcacgacattaggctgctcctggctgacccacctcttatgcataagtatgaagagtttatgctgcgacggtatctcgcatcagatccggattgtagatggtgccctgcacccgattgtggatatgctgtgatcgcttacgggtgtgcgagttgccccaaattaacttgcgagcgggagggatgccaaactgaattttgctatcactgcaagcagatttggcatcctaatcaaacctgcgacatggcgagacagcagagagcacagacactgcgtgtacggacgaagcacaccagcggtctgagttacggacaggagagtggacctgccgacgacatcaaaccttgccccagatgttctgcctatataattaagatgaatgatggctcttgtaaccatatgacctgcgctgtctgcggatgtgagttctgttggctgtgtatgaaggagattagcgacctgcattacctgtcaccgtccggctgcacattctggggaaagaagccttggagccggaaaaagaaaatcctgtggcaactagggacccttatcggtgcgccagtaggcatttctctaattgccggtattgccatcccagcgatggtgattggtatcccagtgtatgtcgggagaaagatccactctagatatgagggtaggaagacgagtaaacacaagcgcaacctggcaattacaggaggagtgactctgagtgtgatcgcgtctcccgtgatcgcagctgtgtccgtgggtattggcgttcccattatgctcgcatacgtgtatggtgtcgtgccaatctctctgtgccgtggaggcggttgtggtgtaagcacagcaaacggaaagggagttaagattgagttcgatgaggatgacgggcctattacagtcgcagacgcatggcgagccctgaaaaacccttccataggtgagtctagcatcgagggccttaccagcgtgctgagcactagcggttctcccacagacgggctgtcagtgatgcagggcccatactccgagaccgcctctttcgctgctctgagtggcggaactctgtctgggggtatcctctcctctggcaagggcaagtattcaagattagaagtgcaggcggatgtgcagaaggaaatttttccgaaagatacggcaagtctgggtgccatctctgacaacgccagcacgcgagcgatggcaggcagtattatatcctcatacaatccacaggacagggagtgcaacaacatggaaatacaggtggacatagaggccaagcctagccactaccagctcgtcagtgggagttcaaccgaggactcacttcatgtacacgcccagatggcagaaaatgaagaggaaggaagtggcggaggaggatcagaagaggacccaccctgcagacatcagtcatgcgagcagaaggattgccttgcatcaaagccctgggatatctctctcgcccagccggaatctatccgctctgacttagagtcttcagatgctcaatcagacgatgtgccagatatcacgtcagacgagtgcggatctccacgttcccataccgcagcttgtcctagtactccacgcgcacagggcgcacctagcccttcggctcacatgaatctctcagcccttgccgagggacagaccgtgctgaaacctgagggcggtgaggcccgtgtttag

SEQ ID NO: 53667 - DNA, 1461 bp, Artificial Sequence
  Description of Artificial Sequence: Synthetic coding sequence
atgggaagcgagaaggattcggagtcccctcggagcacgagtctgcacgccgctgctccagatccaaaatgcagatctgggggacggaggagaaggctgttaagttgcccacaccgctcatgcagggactgcttgagacactacctgcgcttggagatcagcgagtcccgtgtgcccatcagctgccccgagtgctccgaacgactcaatcctcacgatattcgcttactgctggctgatccccctctcatgcacaaatacgaagaattcatgctgcgtaggtacctggcttccgatcctgactgcaggtggtgcccggcacctgactgcggctacgcggtgatagcgtatggatgtgcttcttgtccaaaacttacttgtgaacgggaggggtgccagactgagttttgttaccattgtaagcaaatttggcatccaaaccaaacttgcgatatggctagacaacagagggcgcagacgctccgggttcgaacaaaacatactagcggcctgtcttacggtcaagagtcgggaccagacgacatcaaaccttgtccgcgatgctcagcatatatcattaaaatgaacgatggttcctgtaaccatatgacatgcgctgtttgtggttgtgaattctgttggctgtgcatgaaggaaatttcagacctccactatctgtcgccaagcggatgtactttctggggaaagaaaccctggtctcgaaaaaagaaaatcctgtggcagctgggtacactgatcggggcacctgtcgggatctcactgatagccggtattgctatcccggcaatggttatcggaattccagtgtacgtgggaagaaagatacacagcagatacgagggtaggaaaacgtccaagcacaagcgaaacctggctattacaggcggtgttaccctgagcgttatcgcttcacctgtgatagctgctgtcagtgtcggcattggggtccccattatgttagcctacgtgtatggggttgtgccaatttccctctgccgcggaggagggtgtggagtgagtaccgctaatggaaagggcgtgaaaatcgaatttgatgaggatgacgggcctatcacagtggcagacgcgtggcgggctctcaaaaatccgtcaatcggggagagtagcattgaagggctgactagcgtactgagtacttccggctctcccacagacggactctccgtgatgcagggaccatactcagagacagccagcttcgcagctctgtcagggggaaccttgagcgggggaattctttcgtcaggaaaggggaagtacagtcgcttggaagtgcaggcagacgtgcagaaagagatttttcccaaggataccgcttctttaggagccattagcgacaacgctagcactagagccatggccggatccataatctcatcatacaatccccaggaccgaagctcaatgccacacgtctag

SEQ ID NO: 53668 - DNA, 1134 bp, Artificial Sequence
  Description of Artificial Sequence: Synthetic coding sequence
atgggtcccgctgcaaggccagctctgaggtctcctccgcctcccccaccgcctccgccatccccgctgctgctgcttctgccgctcctacctctgtggctgggcctcgctggacccggtgcagctgccgacggatcagaaccagcagccggagccggtcggggtggtgcccgagccgttagggtggacgtgagattgcccagacaggacgcactggtgttagagggcgtacgcattggatccgaggcagacccagcccctctgcttgggggaagactccttcttatggacatcgttgacgctgaacaggaagcccctgtcgagggatggatcgctgtggcctatgtcggaaaagaacaggctgcccagtttcaccaggagaacaaaggcagtggtccccaagcctaccccaaggctcttgttcagcagatgcgacgggctttatttttaggtgcttcagcactgctactgctaatcttaaaccataacgtggtgcgcgaactggacatctcacagctgctcctcaggcctgtgattgtgctgcactatagttccaatgttactaaactgctcgatgccctgttgcagcgcacccaggccaccgcagagatcacgtctggcgagtcactgtccgctaacattgagtggaagctgaccttatggacaacttgtggcttgtccaaggacggctatggtgggtggcaggatctagtttgtctgggcggatctcgcgcacaggaacagaaaccacttcaacagttatggaatgctattctgctggttgctatgctgctctgtaccggtttggtggtacaggctcaacgacaagccagcagacagagtcagagagagttaggcggacaagtcgacttgtttaaacgaagggttgtgagacgacttgcatcccttaagacccgcaggtgcaggctgtctcgggctgctcaggggctgcctgatccaggggcagagacttgtgctgtttgcctcgattacttttgcaataaacagtggttacgtgtgctcccttgcaaacatgaatttcacagggactgcgtggatccatggttgatgctccagcagacttgccccctttgcaagttcaacgttttgggcaatcggtactcggacgattag

SEQ ID NO: 53669 - DNA, 561 bp, Artificial Sequence
  Description of Artificial Sequence: Synthetic coding sequence
atggcaccatgcacagagacaaaaatctttgtgctgtgtgacgaacagatacagtgccctacatgtcagtttgtgtggtgttttaaatgccacagcccttggcatgagggcgttaattgtaaagagtacaagaaaggtgacaaacttttaagacactgggctagcgagatcgaacacgggcagcggaacgcccagaaatgccccaagtgcaaaatacatatacagagaacagaaggatgcgatcatatgacctgttcacagtgtaacacaaatttctgctacagatgtggagagagatatcggcagttacgtttttttggcgatcacacctctaacctcagcattttcggctgtaagtatcgctacttgccagagcgtcctcacctgagaaggctggtcaggggatccgtctgcgctggaaagctgttcattgcccctctcatcatggtgctgggtctggcgctgggcgcaattgcagtcgtcataggcctctttgtttttccgatttattgcctgtgcaaaaagcagcgtaaacgaagtcgcactgggatgcactggtag

SEQ ID NO: 53670 - DNA, 828 bp, Artificial Sequence
  Description of Artificial Sequence: Synthetic coding sequence
atgaaagttcaactgggacaggtggaaattaagtgtcccatcaccgagtgttttgagtttcttgaggagacaacagtggtgtacaatctgacccacgaagactcgattaaatacaagtacttcctggaactagggaggatcgactcatcaacaaagccctgtcctcaatgtaaacattttacaacttttaagaaaaagggacacatccccactccaagccggtccgaatccaagtacaaaattcaatgccccacatgccagttcgtgtggtgtttcaagtgccatagtccgtggcacgagggcgtgaactgcaaggaatataagaagggcgacaagctgcttcgccactgggcaagcgagattgagcatggacaaaggaacgcacagaagtgtcccaagtgcaagatacacatccagcggacagaaggttgcgatcacatgacgtgctcccagtgtaacaccaatttttgctaccgctgcggggagcggtatcggcagctccgcttctttggcgaccacaccagcaacctgagcatttttggctgcaagtatagatacctgcccgaaagaccacatctcaggcggttggtccgcggaagtgtttgcgctgggaaattgtttattgcccctctgattatggtgttgggattggcacttggcgctatcgccgtcgttatcgtcgaagaaatcaagacatactggaacttgatcagcggtagaacacgcaaccagacgcaacacctggccccacagcccgtgctgctgagcgacatgctctactgcttaaagcaggtcttcatctgtatttcctaccttctccctctttag

SEQ ID NO: 53671 - DNA, 9 bp, Artificial Sequence
  Description of Artificial Sequence: Synthetic coding sequence
atgaagtag

SEQ ID NO: 53672 - DNA, 924 bp, Artificial Sequence
  Description of Artificial Sequence: Synthetic coding sequence
atgccctctttactgggagcacctccatactcaggacttggcggtgtaggcgacccgtacgtgcctttgatggtactgatgtgtcgcgtctgtctcgaggataagcccataaagccattgccatgttgtaagaaggcagtgtgcgaagaatgtctaaaagtctatctcagcgcccaggtccagctgggtcaggtggaaataaaatgtcccataaccgaatgtttcgaatttctcgaggagacaacagtggtatataacctgacccatgaggactcaattaaatataagtactttttagagcttgggaggatcgatagtagcactaaaccgtgcccccaatgtaagcactttaccaccttcaaaaagaaaggccatatccccacgcctagccgctcagagagtaagtacaagatccagtgcccgacctgccaatttgtatggtgttttaaatgccactcaccttggcatgaaggggtgaactgcaaagagtacaaaaagggagataaactgttgcgccattgggccagcgaaattgaacacggacagcgaaacgcacagaaatgtcccaagtgcaaaatacatattcagcgaaccgagggctgcgatcacatgacctgttcccagtgcaacactaacttttgttacaggtgtggtgaaaggtacagacagctccgatttttcggggaccacacatcaaacttgagtatcttcgggtgtaagtatcggtatctgcccgagcgtcctcatcttcggagactcgtgagaggatctgtgtgtgccggaaagctattcatcgctcccctcatcatggtactgggcctggccctgggtgcgattgctgtcgtcatcggactgttcgtatttcctatttactgcttatgcaagaagcagcgcaagcgatctcggacaggaatgcattggtag

SEQ ID NO: 53673 - DNA, 750 bp, Artificial Sequence
  Description of Artificial Sequence: Synthetic coding sequence
atgtcttccgggcaacaggtttggcataccgccgtgcctcctcccaggcgatccagcagtatagcctcaatgcccaggtccccttcctctgccggtagcccgagatcacccggaactccaggatcagagcgagtcgcctcccccctggaatgttctatctgtttcagtggctacgacaacatcttcaagactcccaaagaactgagttgtacccacgttttctgcctggaatgcctagcacgcctcgctgctgcgcaaccagttggcaggccagggggagaggcagttccctgccctttttgtcgccagcctaccgctgtgcctccagctggcgctcccgctctctgcacatcaagacaattacaggccagaatgccagcccacctcaggcgtgaggaaccagtatggctggaaggtaccaagctctgctgccagcccctgcccactaccccagggcgagagccaggtttcgtgtgcgtcgacgtgggcttgtccaagcccgcagagcctcctgctccagcccgtgatcccgcacctcggagaggtagactagctagatgttgggccaggtgcagagactggagacgaatggctctggtcagcgccttgttgctgatgctcttctgtgtagcgctttggcctgtccagtgtgccttaaagactgggaacctgcggtgtcttccactcccacctagacccccagccacatccacggctgcctcccctctaggtccactgacagacaactag

SEQ ID NO: 53674 - DNA, 3006 bp, Artificial Sequence
  Description of Artificial Sequence: Synthetic coding sequence
atgtctggaccagggaacaaacgcgcagctggagacggtggttccggtccacccgagaaaaagttatctagagaagagaagacaacaacgactctcatcgagcccattcgtctcggaggcatctcctcaaccgaggaaatggatctgaaggtgctccagttcaagaacaaaaaattggccgagagactggagcagcgccaggcatgtgaagatgaactgcgggagaggattgagaaattggaaaagagacaggccaccgacgacgcaaccttactgattgttaaccggtactgggcccagctggacgagacggtggaagccctgctgcgttgccatgaatcccaaggagagctgtccagtgcacctgaggcacccggtacccaggaagggccaacctgtgacggtaccccgctccctgagccagggacctctgaactgagagaccctctgctcatgcagctaaggcctcctctttctgagcctgccctggccttcgtagtggccttaggtgcaagctcgagtgaggaagtggagttggaactgcagggcaggatggaattcagcaaggcagccgtaagccgcgtcgttgaggcatcagatcggctgcagcgcagggtagaagaactgtgccagcgggtgtacagcagaggcgattcagagccactcagcgaggcagcccaggcgcatactagggagctgggacgcgaaaataggaggctgcaggatctggccacacagctgcaagaaaagcaccaccggatctccttggaatactcagagctgcaagacaaagtaacatccgcagaaacaaaggtgttggagatggagaccactgttgaagatctccagtgggacatagaaaaattgagaaaaagagaacagaagctcaataagcacctggccgaggctctggagcaattgaactcaggctattacgtctccggatcctctagcggttttcagggtggtcagattactctctctatgcaaaaattcgagatgctcaacgccgaactcgaagaaaatcaagagcttgccaactcacggatggcagaactggagaagctccaagctgaattacaaggtgctgtaaggactaacgagaggctaaaggtggcccttcgctctctgccagaggaagtcgtacgggagactggagagtacaggatgctgcaggcacaattctccctcctctataacgagtccctgcaagtgaaaacacagttagatgaggcaagagggctgctactggccactaagaactcccatttgcgccatatcgaacacatggagtccgacgaactcggtctccagaagaagctccgaacagaggtgattcagctggaagacacactggcacaggtgcggaaggagtatgagatgttacggatagaattcgaacagaatctggcagctaatgaacaggcaggccctataaatagagagatgagacatctcatctcatcattgcagaatcacaaccaccagctgaagggcgacgcgcagcgctataagcgaaagctcagggaggtgcaggctgaaattgggaagctgcgcgctcaggcgtctggttctgcccacagtacaccaaacctgggccaccccgaagactctggggtgtccgctcctgcccctgggaaagaggagggcggtccaggtcccgtatctacacccgataacaggaaggaaatggccccagtacctggtaccacaacaacaacaacaagcgtcaagaaggaggagctggtgcccagcgaagaggatttccaggggatcaccccaggtgcacagggacctagctctcgcggtagggaacctgaggccagacccaaacgagaactacaggagcgagaaggcccttctctgggtccacctcccgtggccagtgccttgtccagagcagatcgggagaaagcaaaggttgaagagaccaaacggaaggaaagtgagcttctcaaaggattacgggcagaactgaaaaaagcccaagagtctcaaaaggaaatgaaactgcttctggacatgtacaagtctgctcctaaggaacaaagggacaaggtccagctaatggccgctgaaaggaaagctaaggcagaggtggacgaacttcggtcccgcatacgagaactggaagagagggatcgtagggaaagtaagaagattgccgatgaagacgcactcagacgcattcgccaagccgaagaacagatagaacacctgcagcgcaaactgggagctactaagcaggaagaagaagcactcctctcagagatggatgtgacaggacaggccttcgaagacatgcaggagcaaaacgggagacttctccagcagctgagggagaaggacgacgctaatttcaaactaatgtccgaaagaatcaaggccaaccaaattcataaactcttacgcgaggagaaagatgagctgggggaacaagtacttgggctcaagtcccaggtggacgcccagttgctgactgtgcagaagcttgaagaaaaggagcgggctctgcaaggcagtttaggaggcgtcgagaaagagctgacgctccgcagccaggcgttagagttgaacaagcgaaaggccgtcgaggccgctcagttggcagaggacttaaaagttcaactggagcacgttcaaactcggctacgggagattcagccgtgtttagcagagagccgagccgctagggagaaagaatctttcaatctaaaaagagcacaggaggacatctcacgtcttagacggaagttagagaaacaacgcaaggttgaggtgtatgcagacgcggatgagatcctgcaggaagagattaaggagtacaaagcaagattgacctgtccttgctgtaacacacgtaaaaaagacgcagtgttgactaagtgcttccacgttttttgtttcgaatgcgtccgcggaaggtatgaagccaggcagcggaagtgcccaaaatgtaatgccgcattcggcgcacatgacttccatcggatctacatctcttag

SEQ ID NO: 53675 - DNA, 2706 bp, Artificial Sequence
  Description of Artificial Sequence: Synthetic coding sequence
atgtctggcccaggaaacaagagggccgcaggggacgggggatccggcccacctgaaaagaagctgtcaagagaggaaaaaactactacaactctgatcgaacctattcgattgggcggaatctcctcaactgaggagatggatctgaaggtcctgcagtttaaaaataagaaactcgctgaacgcctggagcagaggcaggcatgcgaggacgaactcagggagagaatcgaaaagctggagaagcgccaagcgactgacgacgctactcttttgatcgtgaatagatactgggcgcagctggatgagacagtggaagccctgctgcgatgtcatgaatcgcagggcgaactgtcatccgctcctgaagctccgggtacccaggaaggtccaacctgtgacggaacacccctgcccgaacctgggactagcgaattgcgggaccccctgcttatgcagctccgccctcctttgtccgaacccgcactggcattcgtagtagcgttaggcgcttcttcctccgaggaagtggaactggagctgcaagggagaatggagtttagcaaggctgccgtctctagggtggtggaggcgtctgatcgactgcagcgcagagtcgaggagctctgccagcgcgtctacagcaggggggatagtgagccactgtccgaagcagctcaggcccatactcgcgaactaggcagagagaatcggaggttgcaggacttggctacacagcttcaagagaaacaccaccgaattagcctggagtattccgagctacaggacaaagtgacctcagcagagactaaggtccttgaaatggaaaccacggtagaggatttgcagtgggatatagaaaagcttcgtaagagggagcagaagcttaataagcacctggcagaagcactggagcagttgaatagcggttattatgtctccggctcctctagtggttttcaaggagggcagataacactctccatgcagaagtccgatgaactgggcctgcagaaaaagttgcgcacggaggttatccagctggaagacactctcgctcaagtcagaaaagagtatgagatgctacgcatagagtttgagcagaacctagccgcaaatgagcaggcaggacccattaatagagagatgcgccacttgatctcaagtctgcaaaaccataaccaccagctgaagggcgacgcccagcgatataagagaaagctcagggaggtacaggcggagatagggaagctccgggcacaggccagtggatcagcacacagtactcccaatctaggtcaccccgaggacagcggggtatctgcacctgcgcctggaaaggaggagggcggtccgggacccgtttccactcccgataatcgtaaagagatggcccctgttccaggcactaccaccacaacaacctctgtgaagaaagaagaacttgttccctctgaagaagacttccaggggattaccccaggcgcacaaggcccaagctctaggggaagggagcccgaggcaaggcctaagagagaactgcaagaaagggagggacccagtctaggcccaccaccagttgcctccgctctgagccgtgctgatcgcgagaaagcgaaggtagaagagactaagagaaaagagtctgaactgcttaaaggactgcgtgcagagcttaagaaagcccaggagagccagaaggaaatgaagctgctactggacatgtacaaatctgcccctaaagaacaaagggataaggtccagcttatggcagccgagcgtaaagccaaggctgaggttgatgagctgcggagccgaatacgtgaactcgaggagcgggatagaagggagtcaaaaaagattgccgatgaggatgctctgagaaggattcggcaggccgaagagcagattgaacacctgcaaagaaaactgggagctaccaagcaggaggaggaggcgttgctttctgagatggacgtgaccggacaagcattcgaagatatgcaagaacaaaatggtagactgctgcagcaactccgcgagaaggatgacgccaatttcaagctcatgtctgaacgcatcaaggccaaccagattcacaaactgctccgtgaggaaaaggatgagctgggcgaacaggtattgggcttaaagagtcaagttgatgcccagctccttacagtgcagaagctcgaggaaaaagagcgagctctgcagggtagtttgggcggagtggagaaagaacttacactgcgatcccaggcccttgaactcaataagcggaaggcagttgaggcagctcagcttgctgaggatctgaaggtacagctggagcatgtccagacccggcttagggagattcagccttgcctggccgagtcccgcgctgctcgggagaaggagtctttcaatctcaagcgggcacaggaggatatctctaggctgaggcggaagttggaaaagcaaagaaaggtggaggtgtatgccgatgcggatgagattcttcaggaagagataaaggagtacaaagccagactcacctgtccatgttgcaacacccgcaaaaaggatgcagtgctaacaaaatgcttccacgttttttgtttcgaatgcgtccggggaagatacgaagcccgacagcggaagtgccccaaatgcaacgccgctttcggcgcacacgactttcacagaatctacattagttag

SEQ ID NO: 53676 - DNA, 2082 bp, Artificial Sequence
  Description of Artificial Sequence: Synthetic coding sequence
atgagtggcccaggcaacaaaagggcggcaggggacggaggtagcgggcctcctgagaagaagctatcccgggaagaaaagactacaaccacgctcattgaacctataagattgggaggcataagctctacggaggagatggatctcaaggtgcttcagtttaagaataagaaactcgccgaacgacttgaacagcggcaagcctgcgaggacgagctgcgggaaaggatcgagaagttggaaaagaggcaggcccagttctccctcctatataatgaatctcttcaggtcaagacgcagttggatgaggccagggggttgctactcgcaacaaaaaactctcacctgagacacatcgagcatatggaatccgacgagttgggcctgcagaagaagctccgtaccgaggtgatccagctggaggatacactggcgcaggtcaggaaagaatacgagatgctgagaatcgagtttgagcagaacttggccgcaaatgaacaggctggtccaataaacagagagatgcggcatctcatcagcagtctccagaaccataaccatcagctgaagggagatgcgcagcgatacaagagaaaactgcgggaggtccaggctgaaatcggcaaactccgggctcaggccagcggtagcgcccacagcacgcctaacttaggtcaccccgaggactccggggtgtcagcacccgctccaggtaaggaggagggcggtcccggtcctgtctccacccctgataatcgtaaggaaatggccccagtccctggtacaactaccacgaccacctctgttaagaaggaggaactggtccccagtgaagaggacttccaggggatcacccccggagcccagggacctagctccagaggtcgggagcccgaagcacggccaaaacgtgaactgcaggagcgagagggaccctcactcgggccaccccctgtcgcttccgccctgtcccgcgctgatcgtgaaaaggcgaaagtagaggagaccaagagaaaggagtccgagcttctaaaaggactaagagcagagctgaagaaggcccaggagagtcagaaggagatgaaattgctgctcgatatgtacaagtccgctccgaaggaacagcgggataaagtccagctgatggcagcagagagaaaagctaaagccgaagtcgacgagctcaggagccgcatccgcgaactcgaagaacgggatcgcagggagtctaagaaaatcgctgatgaggacgcccttcggagaatccggcaggcagaagagcaaatagagcatctgcagcgcaaactgggggcaaccaagcaagaggaggaggctctgctcagcgagatggatgtgacaggacaggcgttcgaggatatgcaggaacaaaatggcagactactgcagcaactgcgggagaaggacgacgcaaacttcaagctcatgagtgagcggataaaggccaaccagattcacaagctactaagggaggaaaaggacgagttgggtgaacaggtgctcggtctcaaaagccaggtcgacgcgcaactgctgaccgtccagaaacttgaggagaaagaaagggcgttacaggggtctctgggcggtgtggaaaaggagcttacactgaggtcccaggcattagagctgaataaacgaaaagccgtcgaagctgctcagcttgcagaagatctgaaagtgcaacttgagcacgtgcagactcggctgcgagaaatccagccttgtctggcggaaagcagagcagctagggagaaggaaagcttcaatctgaagcgagcgcaagaagatatctccagattgcggagaaaattggaaaaacagcggaaggtggaggtatatgccgatgcagacgaaatcctccaggaggagatcaaagaatataaagcaagactgacatgtccgtgctgcaatacaaggaagaaagatgctgttctgacaaagtgctttcacgtattttgctttgaatgtgtccgaggacgatacgaggcacggcaacgcaagtgtcccaaatgtaacgccgcatttggggctcacgacttccatcgtatctatatcagctag

SEQ ID NO: 53677 - DNA, 693 bp, Artificial Sequence
  Description of Artificial Sequence: Synthetic coding sequence
atgcagctccgtccaccactgagtgaaccagccttggcctttgtcgtcgctttgggggcttcctcaagtgaggaagtcgaactcgagctccaaggacgcatggagtttagtaaagcagccgtttctcgggtcgtggaagctagcgacagacttcagaggcgtgtggaggagctttgccagcgggtctactcacggggagacagcgaaccactctcagaagccgctcaggcccacactcgagagctggggcgagagaatcggcgactgcaagacctcgcgacacagctgcaagagaagcaccataggatcagtttggaatactccgagttgcaggacaaggtgacgtctgccgaaactaaagttctggagatggagacaaccgtcgaggacttgcaatgggatatcgagaaactgcgtaaaagggaacagaaactcaataagcacctggctgaggcccttgagcagttgaacagcggatattacgtttcaggaagttcgtctggattccaggggggtcaaatcaccttgagcatgcagaagtttgagatgctcaatgccgaactcgaagaaaaccaagaattagccaacagtcgtatggctgagctagagaagcttcaagcagagctccagggggctgtacgcactaactttcagtcattccagttggaagagctgcctccagacacgctgtag

SEQ ID NO: 53678 - DNA, 924 bp, Artificial Sequence
  Description of Artificial Sequence: Synthetic coding sequence
atgaagctgctgttagatatgtacaaaagcgcccctaaagagcaaagggataaagttcaactgatggccgcagagcgtaaggctaaggcggaagtggatgaactgcggagtaggatcagagagctggaggagcgggaccgccgtgagagtaagaaaatcgccgatgaagatgccctgagacggatacgacaggccgaagagcagatagagcatctgcaaaggaagctaggcgcaacgaaacaggaagaggaggcccttttgtcagagatggatgtcaccggccaggccttcgaggacatgcaggagcagaacggtcgtttgctgcagcagcttagggaaaaagacgacgctaatttcaagctgatgagcgagcgaattaaggcaaatcaaattcacaaactgctgagagaggagaaggatgaactgggggaacaggttctggggctgaagtcacaggtcgatgctcaactgttgacagttcaaaaactcgaggagaaagaacgagctctccagggctctttggggggagtggagaaggaattaacgcttaggtctcaggcgcttgaactgaataagagaaaggctgtcgaagccgcacagcttgccgaagatcttaaggtgcaactggagcacgtgcagacacgtctgcgcgaaatccaaccctgtctggcagagtctagggctgccagggaaaaagagtcatttaacctgaagagagcacaggaagatatctcccgcctcagaaggaaattggagaaacaacggaaagtggaggtgtacgcggacgcagacgagattctgcaggaagaaatcaaagaatacaaagttggattgtgggcaaagctgtgccctatacacctgcggatcgtggacgctggtctgctgcgattggtggaatctttaggaacccttgaagtgatgtag

SEQ ID NO: 53679 - DNA, 1308 bp, Artificial Sequence
  Description of Artificial Sequence: Synthetic coding sequence
atgcccctgttcctgctgtctctaccaacaccgccttctgcctctggccacgagaggcgacagcggcctgaggccaagacatccggatcggaaaagaagtacctccgtgccatgcaagcaaacagatcccagcttcattctccaccaggtactggctctagcgaagatgcaagtacccctcaatgtgtgcacacacgtctgaccggcgaaggttcatgtccacatagtggtgatgtgcacatccaaataaactccattccaaaggagtgcgccgaaaacgcctcaagccgtaatatccggtccggtgtgcattcttgcgcacacgggtgcgttcatagtagacttagagggcacagtcatagcgaggctcgcttgactgatgacacagcagcggagtcgggcgaccacgggagttccagtttcagtgaattccgctatctgttcaagtggcttcagaagtccttaccttacattctcattctctcagttaagttagtgatgcagcatatcactggaatatccctggggattggcctcctgaccactttcatgtacgctaacaagtccatcgtcaaccaagtttttttacgtgaaaggagctccaaaatccaatgtgcctggctcttggtgtttctggctggttccagtgtcctcctctattatacttttcatagccaaagtttgtactactccttaattttcctgaatcccactttagaccatttgtctttttgggaggtattttggattgttggcatcaccgacttcattttaaaattcttctttatgggcctgaagtgtttgatccttctcgttccctccttcatcatgccatttaagtctaaggggtattggtatatgcttctggaagaactgtgccagtattataggacatttgtaccaatccccgtgtggttccgctatctgattagctatggcgaatttggcaatgtgacacggtggtctctggggatcctgctggccctgctttacctgattttaaagctccttgagttttttggtcacctgagaaccttccgtcaggtcctgaggatctttttcacgcagcctagctacggagtagcagcgtcaaagcggcagtgttctgacgtcgacgatatttgcagcatttgtcaagcagaatttcaaaaacctattctgctcatctgtcaacacatcttctgcgaggagtgcatgaccctctggtttaaccgcgagaaaacctgccccctgtgtcggaccgtcatcagtgaccacattaataagtggaaggatggagccacgtcatcccatctccaaatttactag

SEQ ID NO: 53680 - DNA, 408 bp, Artificial Sequence
  Description of Artificial Sequence: Synthetic coding sequence
atgcaggctaacaggtcacaactgcacagcccaccgggtacaggcagctctgaagacgcatccaccccacagtgtgtccacactaggctgacgggagagggctcttgcccacactcaggtgacgtccatatccagatcaattcaataccgaaggaatgtgcggaaaatgcttcctcaaggaacataagatccggcgtacattcctgcgcccacggctgcgtccatagtagactcagaggacattctcattccgaagccagacttacagacgatacggctgctgagtccggagatcacggatcaagcagtttctctgaattcagatacctgtttaagtggctgcagaaaagccttccgtatatcttgattcttagcgttaaactggtcatgcaacatattaccgcttag

SEQ ID NO: 53681 - DNA, 1335 bp, Artificial Sequence
  Description of Artificial Sequence: Synthetic coding sequence
atgtggctcttcactgtaaaccaggtcctccgcaaaatgcaaaggcgccactcttctaataccgataatatcccacccgagcggaatagaagccaggccctctcctccgaagcatctgtcgatgaagggggtgtgttcgagtccctgaaagctgaagctgcctcacccccagctctgtttagcggactgtcgggctctctccccacttcctccttcccatcctcactggtactggggtcatcagccggagggggagacgtttttattcagatgccagctagccgcgaagaaggaggcggaagaggcgagggcggagcctatcaccatagacagcctcatcatcacttccaccatggagggcaccgtgggggatctctgcttcagcatgtcgggggtgaccatagggggcattccgaagagggtggtgatgagcagcccggtacaccagcacctgcactttccgagctgaaggcagtgatctgttggcttcaaaagggcttgcctttcatcctcattttgctcgctaagttatgtttccagcataagcttggtatagcggtgtgtattgggatggcctctacgttcgcctacgctaactcgacactgagagagcaggtgagtttgaaggagaagcgctcggttcttgttattctctggatcctggctttcctggccggaaacacactgtatgtgctgtataccttttcttctcagcagctgtacaatagcctaatctttctcaaaccaaacctggagatgttggacttttttgacttgctgtggatagtggggatcgcagattttgtactcaagtatatcacaatcgcccttaaatgtctgattgtggctctgcctaaaataattctggccgtcaaatctaagggtaagttttacctggtgatcgaggaactctcgcagttattccgctccttagtccctattcaactgtggtacaaatatatcatgggtgatgacagctcgaattcttacttcctgggcggagtgctaatcgtcctgtattcactttgtaaatcgtttgatatctgtggacgcgttggcggagtgagaaaagccctgaagctgctgtgtacttcccagaattatggtgttcgagccacaggacagcagtgtacagaagccggagatatctgtgctatctgtcaggcggagtttcgtgaacccctgatccttctgtgtcagcatgtattctgtgaggaatgcctttgcctgtggctcgaccgagaacggacatgtccactgtgccgaagcgtagccgtggatacattgcgttgctggaaagacggggcaacgtcggcccatttccaagtttattag

SEQ ID NO: 53682 - DNA, 1335 bp, Artificial Sequence
  Description of Artificial Sequence: Synthetic coding sequence
atgtggctgttcacagttaatcaagtactgcgtaagatgcagcgaagacatagcagcaacacagataatatacctccagaaaggaaccgttcccaggcactgtcaagcgaggcatctgtggatgagggcggtgtcttcgagagtctgaaggctgaagcagcatcaccgcctgccttgtttagtggactgtctgggagcctgcctactagttcttttccaagctcactcgttcttggttcctccgccggaggaggcgacgtgtttatacagatgcctgcttctagggaggagggaggcggaagaggcgagggaggcgcttatcaccatcgccagcctcaccaccactttcaccatggtggccaccggggtggcagcctgcttcagcatgtcggcggagaccatagagggcactcagaggagggcggtgatgaacagcccggtacccctgcacctgcactctcggagttgaaagcggtcatctgctggctacaaaagggtctaccctttatcctgatactactggccaaactctgcttccaacacaagctgggcattgcggtttgcatagggatggcctccacattcgcctatgctaactccacactgagggagcaagtgtctcttaaggagaagcgtagtgtgttggttattctgtggatactggccttcttggccggtaacacgctgtatgtcctttacacattctcctctcagcagttatataattcccttattttcttaaagccaaacctggagatgctcgacttttttgatctcctttggatagtcggaattgctgattttgtacttaagtatatcaccattgcgctgaagtgtctaattgtggcactgcctaagatcatcctggccgttaagtcgaagggaaagttttacctggtcatagaggagctgtctcagctgttccgctcattggtgcctattcagctgtggtacaagtatatcatgggcgacgactcatctaattcctactttttagggggagtgttaattgtcctgtattccctctgcaagagtttcgacatttgtgggcgagtggggggagtaaggaaagccctcaaactcctgtgtaccagccagaattacggagttcgcgctacgggccagcagtgtaccgaagctggcgatatttgtgcgatttgccaggccgagtttcgggagccgctgattttactgtgtcaacacgtcttttgtgaggagtgtctgtgtttatggctcgatcgtgaacgtacttgtcctctgtgccgttcagtggcagtggatactctgcgctgctggaaggacggggctacgtcagcccactttcaagtctattag

SEQ ID NO: 53683 - DNA, 1263 bp, Artificial Sequence
  Description of Artificial Sequence: Synthetic coding sequence
atgtggttatttaccgtcaaccaggtgctgcgcaagatgcagagacgccatagttctaatacagacaacatacctcctgaaagaaaccgaagccaggcactgtctagcgaagctagcgtcgacgaagggggagtgtttgaaagtctgaaggccgaggccgcatctccccctgctttgttctccggattgagtgggagcctgcctacctctagttttccttcttcactcgtgctcggttcatctgcaggcggaggggatgtgttcattcagatgcctgctagtcgcgaggaaggcggaggcaggggcgagggcggagcctaccaccatagacaacctcatcatcactttcatcacgggggtcacagagggggttcattattacaacacgtgggcggagatcatcgcggacattctgaggagggcggagacgagcaacccggaacaccagcgccagctctgtctgagctgaaagcagttatctgttggcttcaaaagggcctgccttttattttgatattgctggccaaactgtgtttccaacacaagctgggcatcgctgtgtgtatcggtatggcctctacattcgcatatgccaattccacccttcgtgagcaggtctcactaaaagagaaaaggagtgtgcttgtaattctgtggatcctcgcttttctagcaggcaacaccctctacgttctttataccttctcgtctcaacaactgtacaattccctcatattcctcaagccgaatctggagatgctcgattttttcgatcttctgtggatagtcggcattgcggactttgtgctcaagtacatcactatcgccttgaagtgcctgattgtggctcttcccaagattatcctggccgtgaagtcaaaggggaaattttatctagttatcgaggagttatcacagctctttcggtccctcgtgccaattcagctatggtacaaatacattatgggcgatgatagttcaaactcatattttcttggcggagttctgattgtcttgtactctctgtgcaagtcttttgacatctgcggaagagtggggggtgtcagaaaagcccttaagctcctgtgcacctcacaaaactacggtgtgcgagccaccggccagcaatgcacagaggccggagatatatgcgcgatctgccaggccgagtttcgcgaacccttgatccttctgtgtcagatgcttctcaaagggcataagaaactcgaactggagaagatagacgaatcggcaggcgtatag

SEQ ID NO: 53684 - DNA, 1212 bp, Artificial Sequence
  Description of Artificial Sequence: Synthetic coding sequence
atggccgcatttttgaaaatgtctgtgagcgtcaatttctttcgaccctttacaagatttctggtgccgttcacactgcacagaaaacgtaataacctgaccattcttcaaagatatatgagcagtaaaatcccggctgttacatatcctaaaaacgaatctacgcccccatccgaggagttggaactggacaagtggaaaacaacaatgaaaagcagtgtgcaagaggagtgcgtatccaccatctcatctagtaaggacgaggaccctttggctgctactagggagttcattgagatgtggcgcctgctgggtagggaggtgcccgagcatataactgaggaagaacttaagaccttgatggaatgcgtcagtaacaccgccaagaaaaaatacctcaagtatctgtatacaaaagaaaaagtgaagaaagctcgtcaaatcaagaaggaaatgaaggctgccgctagggaggaagctaaaaatattaagctgcttgagacgactgaggaggataagcagaagaattttttattccttaggttatgggatcgtaatatggatatagcgatgggctggaaaggggcacaggcgatgcagttcggccagccgttggtattcgatatggcatatgagaattacatgaaacgcaaagaattgcagaacaccgtgtcgcagctgctggaatcagagggttggaataggaggaatgtcgatcccttccatatctatttctgcaatctgaagatagacggggcactgcaccgggagctagtcaaacggtatcaggagaagtgggacaaactgctgctcacatccacagaaaaaagccatgttgatttgttccctaaggattcaatcatttacctgactgccgactcaccaaacgttatgactactttccggcatgacaaagtttatgtcataggcagtttcgtggacaaatccatgcagcccggtacaagtctcgcaaaagctaaacgactcaacttggctaccgagtgtctgcctctggacaagtacctccaatgggaaatcgggaataaaaatcttactctggaccagatgataagaatacttctctgcctaaaaaacaacggaaactggcaagaggcactccaattcgtacctaagaggaagcacaccggctttttagagatctcacagcactcccaggagtttattaatcgattgaaaaaggcgaagacatag

SEQ ID NO: 53685 - DNA, 939 bp, Artificial Sequence
  Description of Artificial Sequence: Synthetic coding sequence
atggccgcatttctgaaaatgagcgttagtgttaatttctttaggccattcactcgctttttggttcctttcacactgcacagaaagcgcaataacctgacaatcctgcagaggtacatgtccagcaagatccccgcagtcacctatcccaagaatgaaagcacacccccatcagaggagctggaactggacaagtggaagactactatgaaatcaagcgtccaggaagaatgcgtatcaactatcagttccagcaaggacgaagaccccctcgccgcaacaagagagttcatcgaaatgtggcggctcctagggagggaggttcccgagcacattacagaggaggagcttaaaacactgatggagtgcgtttctaatactgcgaagaaaaagtatttaaagtacctctataccaaagagaaagtgaagaaagcccgacagattaaaaaggaaatgaaggccgctgcccgagaggaagccaagaatattaagcttcttgagactacggaggaggataaacagaagaacttcctttttttgagactctgggatcgtaacatggatattgccatggggtggaaaggagctcaggccatgcaatttgggcaaccccttgtgtttgacatggcctacgagaattatatgaagcggaaggaactgcaaaacaccgtttctcagttgctcgagtccgaggggtggaacaggagaaacgtggaccctttccatatctatttctgtaatctaaagatagacggagctcttcatcgtgagctggtcaagcggtatcaagaaaagtgggataagctcctactgacatctactgagaagtcccacgtcgatcttttccccaaagatagtatcatctacctgacagcggatagtcccaacgtgatgacaaccttccgacacgacaaggtgtacgtcatcggctcattttag

SEQ ID NO: 53686 - DNA, 1134 bp, Artificial Sequence
  Description of Artificial Sequence: Synthetic coding sequence
atggctgccccaaggtggtccgcctcaggaccatggataagaggaaatggccaagggtgcggatcgcttttcaccttagtgagcaagcccttctgtgccgcagctgctgcaagcacagcaatcaacgcgcaaaggctggccgagaaactcagagcgcagaagcgagagcaggacacgaagaaagaacctgtgtcaaccaacgctgtgcagaggcgcgtgcaggaaattgttagattcactcgccagctgcagagggtgcatcctaacgttctggcaaaggccctcacccggggtattctccatcaagacaagaatctagtcgttatcaacaaaccttacgggctcccagtgcatggcggacctggggtccagctgtgcattaccgacgtgctgcctatcctggccaagatgctgcacggtcataaggccgagccactccatttgtgccatagacttgataaagaaactactggtgttatggtcttggcctgggacaaagacatggctcatcaagtgcaggaacttttccggacccggcaggtcgtaaaaaagtactgggcgattacagttcatgtgccaatgcctagcgccggagtggtagatatacccatagtggaaaaagaggcccaggggcaacagcagcaccataagatgaccctgtccccatcttacagaatggatgatggaaagatggtgaaggtgagacgcagccgaaacgctcaagtcgccgtgacccagtaccaagtgctgtctagtaccctgtcttccgctttggtggagttgcagccaatcactgggataaaacaccaactccgcgtgcatttgagcttcggcttggactgcccaatccttggggatcacaagtactcggattggaacaggctagcaccacagaagctgtctgtaggtacccttaagaagctgggccttgaacaatccaaggctaggtatattccgcttcatctccacgcccgacagttgatccttcccgctctgggtagtggcaaggaagagctaaatttagtgtgcaaattgccacgcttttttgtgcattctcttcacaggttgagactggaaatgcctaatgaagatcaaaacgaaaataacgaggctaaatgcctgggtgctcagtag

SEQ ID NO: 53687 - DNA, 1041 bp, Artificial Sequence
  Description of Artificial Sequence: Synthetic coding sequence
atggctgcccctagatggagtgcctctggaccctggattcgcggaaacgggcagggctgtggctcattgttcacgctggtttcaaagcccttttgcgctgctgctgccgcatctaccgctatcaatgcccagaggttagccgagaaattgcgggcacagaagcgcgaacaggacaccaagaaggagcctgtaagtaccaacgctgttcagagacgcgtgcaggagatcgtacgatttacaaggcaattgcagcgggtgcaccccaatgtcctggctaaggccctgactcggggtattctgcaccaggacaagaatttggtagtgatcaataaaccctacggattgcctgttcacggaggccctggagtacaactttgcattacagacgtattacccatcctggctaagatgctccacgggcataaggccgaacctctgcatctctgccaccgcctggataaggagacaacgggagttatggttcttgcctgggacaaagatatggcacaccaggtacaggagctctttcggacacggcaagtggtcaaaaaatactgggccataactgtgcacgtccccatgcctagtgccggtgttgttgatatccccattgtggagaaggaggcgcaggtcgccgtgacgcaataccaagttctgtccagcaccctatcatcggcactggtggagctgcagccaattacaggcatcaaacaccaactaagagtgcatctgagttttggcttagactgtccaattctgggagatcataagtacagtgattggaacaggcttgcaccgcagaaactctctgtgggaaccctgaagaaattgggcttagaacagtcaaaagccaggtatattcccctgcacttgcacgctagacagctcatccttccagctctgggctccgggaaggaagagcttaatcttgtctgtaaactgccgaggttctttgtgcactctctccaccggcttagactggagatgcccaacgaggaccagaacgagaataacgaagccaagtgtctgggtgcacagtag

SEQ ID NO: 53688 - DNA, 1098 bp, Artificial Sequence
  Description of Artificial Sequence: Synthetic coding sequence
atggagggccaatccgtggaggagctgctggctaaggccgaacaggacgaggctgaaaagctgcagcgcattaccgttcacaaggagctggagctccagttcgatctgggcaacttgttagcaagtgacagaaaccccccaactggtcttcggtgtgccggtcccacacccgaagctgagttgcaggccctggcacgggacaacacgcagcttctcatcaatcagctctggcagcttcctacggaaagggtggaagaagccatcgtggctcggctcccggaaccaaccactcgccttccccgtgaaaaaccactcccacgcccacgtcctctgacacggtggcagcagtttgccagattgaaaggtatccgccctaaaaagaaaactaaccttgtatgggatgaggtatccggtcagtggaggcggcgatgggggtatcagagggcaagggatgacacgaaagaatggctcatcgaggtccctgggaacgctgatcctctggaagatcagttcgctaaaaggattcaagcaaagaaggaacgggtggcaaaaaatgaattgaaccgactgcgcaatttggctcgcgctcacaaaatgcagttaccctccgctgctgggttgcatcccactggacaccagtccaaggaagaactgggaagggctatgcaggtggcaaaggtgagtacagcgtccgtgggacggttccaggagagactaccgaaggagaaggtgccgaggggctcgggcaaaaagaggaagtttcaacccttgttcggagattttgctgcggagaagaagaaccagttagagctgctgagagtgatgaactccaagaagccgcagttagacgtgacacgggctacaaataagcagatgcgcgaggaggaccaggaagaggccgcaaagcggagaaaaatgtctcagaagggcaagagaaaagggggaaggcaggggcctggagggaagcgcaaaggcggaccccctagccagggtggaaaaaggaaaggaggattaggaggcaaaatgaatagcggacctcccggactgggcggaaaaagaaagggaggacagcgccctgggggaaaaaggagaaagtag

SEQ ID NO: 53689 - DNA, 2127 bp, Artificial Sequence
  Description of Artificial Sequence: Synthetic coding sequence
atggctgaccgggaggggggttgtgccgctggacgaggcagagaactcgaacctgagcttgagcctgggccaggccctggcagcgctctggagcccggagaggagttcgagatcgtggacaggagtcagcttccaggcccaggggacctgagatcagcgacaagaccacgggcagccgagggatggtctgcacctatccttaccctggcccgacgtgccacaggcaatctttccgcttcttgcgggtcggccttgcgagcggctgccggacttgggggaggagattccggggacggcactgccagagccgcatcaaaatgccagatgatggaagagagagccaacctgatgcacatgatgaaattgagtattaaggtgctgcttcaaagcgctctcagcttgggaaggtctctggacgcagaccatgcacctctgcagcagtttttcgtcgtgatggaacattgcctgaagcacggtctgaaggtaaaaaagtctttcatcggacagaacaagtcttttttcgggccactcgagttagtagagaagctctgtccagaggcatctgacatagccacctcagttagaaacctgccagaactaaagaccgcagtggggaggggcagagcgtggctgtatctggcgttaatgcagaaaaaactcgcagactatctgaaggttctcattgacaataagcacctactaagcgagttttacgagcctgaggcactcatgatggaagaggaagggatggtcatcgtcgggctgctcgtcggcctgaacgtgttggatgccaatctgtgtctgaagggcgaggacctggattcccaggtgggggttatcgatttctctctctacctgaaggacgtgcaagatctagatggcggaaaggaacacgaacggatcaccgacgtgttagaccagaaaaactacgtggaagagctgaacagacacctgagttgcacagtcggcgatctgcaaacgaagatagacggacttgaaaagacaaacagcaaattgcaggaggaactttccgccgctaccgaccgcatctgttctttacaggaagaacagcaacagcttagggaacagaatgagctgatccgggagcgaagcgagaagagcgttgaaatcacaaagcaagataccaaagttgaactggaaacatacaagcaaacaagacaggggctggacgagatgtacagtgacgtgtggaagcaactgaaagaagagaagaaagtgaggctcgagttggagaaggaactggaactccagatcggaatgaaaaccgaaatggaaattgctatgaagctgttggagaaggacactcacgagaaacaggacactttggtcgcactccgccagcaactagaagaggtgaaagctatcaacctccaaatgtttcacaaagcacagaatgcagagtcatctctccaacagaagaatgaagcaatcacctctttcgaaggaaagaccaatcaggtcatgtcctccatgaagcagatggaggaacgactccaacatagcgagagagccaggcagggtgcagaagagcggagccacaagctccagcaggagctgggcggtaggattggggctctccaactgcaactctcccagctacatgagcaatgttcgtcattggagaaggagctgaagtctgagaaggaacagcgccaagcgctgcagagagagctgcaacatgaaaaagatacttcgagtcttctgaggatggagctacagcaagttgaagggctcaaaaaggagctccgggaactacaagacgaaaaagcagagttgcagaagatttgcgaagagcaggaacaggccttgcaagaaatgggcctgcacttgtcacaaagtaagctgaagatggaggacatcaaggaggtcaaccaagctctcaaggggcacgcatggttgaaagacgatgaggccacccactgcagacagtgcgaaaaggaattttccatttcaagacgtaagcaccactgccggaactgtggacacatcttttgtaatacttgcagcagcaatgagttggccctgccgagctacccaaaacccgtgcgggtgtgcgattcatgccatacactccttctgcagagatgctcctcgactgctagttag

SEQ ID NO: 53690 - DNA, 933 bp, Artificial Sequence
  Description of Artificial Sequence: Synthetic coding sequence
atgtattctgacgtatggaagcagctcaaagaagaaaaaaaggtccgcctggaattagagaaggagctcgaactccagatcggaatgaaaaccgagatggaaatagccatgaaactgctcgagaaagatacccacgagaaacaggataccctggtggctctgagacagcagctcgaagaggtcaaggccatcaacctgcagatgtttcacaaagctcagaatgctgagagttctcttcagcagaaaaatgaggctattacaagcttcgaaggtaagacaaatcaggtcatgtccagtatgaaacagatggaagagcgactgcagcattccgagagagccaggcagggcgcagaagagcgatcacacaaactccagcaagaactcggaggcagaatcggcgcactccagctacaactgtcacagttacatgaacagtgctcgtcgttagagaaagaacttaagagcgaaaaagaacaaagacaggccttacaaagggagctgcagcatgaaaaagatacctcttcccttcttaggatggagctacagcaggtggagggcctcaagaaagaactccgcgagttgcaagacgaaaaggccgagctgcagaagatttgcgaggaacaagaacaggccctgcaagagatgggcctgcacctgtcccagtctaaactgaagatggaagacatcaaagaagtaaaccaggcactgaaaggccatgcctggttgaaagacgacgaggcgactcattgcaggcaatgcgaaaaagagttcagcatatcaaggagaaaacatcactgcaggaattgcggccacatcttctgcaatacctgcagctctaatgaactggccctgccctcgtacccgaaaccagtgcgtgtgtgtgatagctgccatacattgctgctccagcggtgctcgtctacagctagctag

SEQ ID NO: 53691 - DNA, 1239 bp, Artificial Sequence
  Description of Artificial Sequence: Synthetic coding sequence
atggcagacagggaaggagggtgtgcagccggtcgcggaagggagcttgagccagagctggagcccggaccagggccaggctcagcactggagcctggcgaggagtttgaaatagtagatcgatcgcagctgccaggacctggcgatctccgcagcgccactaggccacgcgcagccgagggatggtctgcccctattctgaccctcgcgaggagggcaaccggaaatctatctgcctcttgtgggagcgcccttcgtgccgctgccggattgggcggtggagatagtggggacggcactgcccgagcggcatccaagtgccagatgatggaagagcgcgctaacttgatgcatatgatgaagcttagtatcaaggtcctgttgcaatccgccctgtccttaggcagaagcctggacgcagaccacgcgcctctgcagcagttcttcgtggtgatggagcactgtctcaagcacgggttgaaggtgaagaaatcttttatcggacaaaataaatctttctttggacccttggagctagttgaaaaattatgcccagaagcttcagacattgcaacgagtgtccgcaacctgccagaactgaagaccgcagtgggccgtggacgagcctggctctatctagctctaatgcagaaaaagctcgccgactatctcaaggtcctgatagataacaaacatctgctctctgaattttacgagccagaggccctgatgatggaggaggagggcatggtgattgtgggattgctagtgggcctcaacgtactggacgctaatctgtgcctgaaaggtgaggacttggattcccaggttggggtgatcgatttcagcttgtacctgaaggacgtccaggatctggacgggggaaaggagcatgaaaggataacagatgtccttgatcagaaaaactatgtggaggagcttaaccgccatctttcctgtaccgtaggagacctgcagaccaaaatagatggcctggaaaagactaatagcaaactgcaagaggaggaggagaggatgaaggggcaggataaggggggtctgtcaagagggagagaactggccgcttcttgtccagcggttagcctgctggacacctcatgcctgctgctggcaggaggcggatgttcggctctgttaaggcttagtaccgcattctcctgcaacaggcctaacctgctcacctcccgcaggaccgccgctgttaaacgcaccaagtag

SEQ ID NO: 53692 - DNA, 1803 bp, Artificial Sequence
  Description of Artificial Sequence: Synthetic coding sequence
atgatggaagagcgggctaatctgatgcatatgatgaaactgtcaataaaagtgctgttgcagagtgccctcagtttgggccgaagcctggacgctgatcacgcccctttgcagcaattcttcgtggttatggagcactgcctaaagcacgggctgaaagtgaaaaagtcctttattggccagaacaaatccttctttggcccattagaattggtcgaaaagttatgcccagaggcatccgacatcgccacaagtgttcggaacctgccagaactgaagactgctgtgggccgagggagagcctggctgtacctagccttgatgcagaagaagctggccgattatttgaaagttctgatagacaataagcacctcctgtctgagttttacgaacccgaggcattgatgatggaggaggagggaatggtcatcgtcggtcttttggtcggattaaacgtactagatgctaacctttgcctgaaaggggaggacctggactcccaggtgggcgtgatcgacttcagcctgtatctgaaggacgtccaagacttggatggcggaaaggaacatgaaaggatcaccgacgtactagaccagaaaaactacgtagaagagttgaatcgccatctgtcctgtactgtgggagacctgcagacaaaaatagatgggctcgagaaaaccaactctaagttgcaagaggagctgagtgcggctaccgaccgaatctgtagtcttcaagaggagcagcagcaactgcgggaacagaatgagctcattcgggaacgtagcgagaaaagcgttgagatcactaagcaggacactaaagtggagctcgaaacgtataaacagaccaggcagggactagacgaaatgtatagcgacgtgtggaagcagcttaaagaagaaaaaaaggtaaggttagagctggagaaagagctggaactgcagattggtatgaagacagaaatggagatcgctatgaaactgctcgagaaggacacccacgagaaacaggacaccctggtcgctctcaggcagcagctggaagaggtcaaagccattaatctgcagatgtttcataaagctcagaacgctgaatcatccttgcagcagaaaaacgaggctatcacctcattcgagggcaagacaaatcaggtgatgtcatctatgaaacagatggaagaaaggcttcagcactcagagcgagccaggcagggtgccgaggaacggagtcataagttgcaacaggaactcggaggcagaatcggcgctttgcagctgcagcttagccagttgcacgagcagtgctcttctctcgaaaaagagctgaagtctgagaaggagcagagacaggccttacagagagaactgcagcacgagaaggatacatccagccttctgcgtatggagctgcagcaagtcgagggtttgaagaaggagctgagggagctccaagatgagaaggcagaactgcagaaaatatgcgaggaacaggaacaggcactccaggagatgggtttacatctgtcccagtccaagctgaagatggaggatataaaagaggttaaccaggctctgaaaggccatgcgtggctcaaagatgatgaagctacccattgtcgacagtgcgagaaggagttttctatttccagacggaagcatcattgcaggaactgcggtcatattttttgcaacacctgttcctcaaatgagttagcactgccatcttatccaaagcccgtgcgagtgtgcgatagttgtcacaccttgctactgcaaagatgctcaagcacagcaagttag

SEQ ID NO: 53693 - DNA, 1803 bp, Artificial Sequence
  Description of Artificial Sequence: Synthetic coding sequence
atgatggaggagcgagctaatctcatgcatatgatgaagctgtccattaaggtgcttctgcagagcgcactctcactgggccgttcactggatgccgaccacgccccactgcagcagttcttcgtggtcatggaacattgcctgaagcatgggctgaaggtcaagaagagtttcataggacagaacaaatcattctttggccctctcgaattggtggaaaagctgtgtcccgaggctagtgatatcgcaacatcggtaagaaacttgcccgaactaaagacagccgtaggaagaggcagggcttggctatacctggctctgatgcagaaaaaattggcggattacctgaaagtgctcattgacaacaaacacctactgagcgagttctacgagcccgaagcccttatgatggaagaggaggggatggtgattgtaggactgctggtgggtttaaacgtgctggacgctaacctctgcctcaagggggaggacctggactcgcaagtgggcgtcatagacttctctttgtacctgaaagatgtccaagacttggacggcggaaaggagcatgagcgaatcacggacgtcctggaccaaaaaaactatgtggaggaactgaacaggcacctgtcctgcactgtgggcgacttgcagacaaagatcgatgggctggagaagacaaactctaaacttcaggaggaactctccgctgctacagaccgtatttgctcacttcaagaagaacaacaacaactccgcgaacaaaacgagcttatccgcgaaagatccgaaaaaagtgtcgaaatcacaaagcaagataccaaagtggagttggaaacttataagcagactcgacagggcttggatgagatgtactcggacgtgtggaagcagctgaaagaagagaagaaagttcgccttgaacttgagaaagagctagaactgcaaattgggatgaagaccgagatggaaatagcaatgaaactcctggaaaaagatactcatgagaaacaggacaccttggtcgctttgcggcagcagttagaggaggtgaaagcaattaatctacagatgtttcataaggcccagaatgccgagagctccctgcaacagaaaaatgaggcaattacaagcttcgaagggaagactaatcaagtgatgtcctccatgaagcagatggaggaacgcctgcagcattcagaaagggcccgacagggggcagaagagaggtcacacaagttgcagcaggagctcggcggacggatcggcgctctgcagctgcagcttagtcagctgcacgagcagtgttcctccctggagaaggagctcaaatctgaaaaggaacaaaggcaggctttacagcgggagctgcagcatgagaaagacacctcaagcctcctacggatggagttgcaacaggtagagggcttgaagaaggagttacgagaactgcaggacgagaaggccgaattgcagaagatttgtgaggagcaagagcaagcattacaggaaatgggcctgcatctgagtcagtcaaaactaaaaatggaggacatcaaggaggtaaaccaggcgctgaaaggccacgcatggctgaaagacgacgaagctactcactgcaggcagtgtgagaaggagttttccattagtcggagaaagcaccactgccgcaactgcgggcatatcttttgtaatacatgcagctctaatgagttggcgctgccctcttaccccaagcctgtcagagtctgtgatagttgtcataccttactgctgcaaagatgctcctcaacagcttcttag

SEQ ID NO: 53694 - DNA, 1827 bp, Artificial Sequence
  Description of Artificial Sequence: Synthetic coding sequence
gcatgggcagctagactgggcagaccagggcgtagctgcctgccaggggcaagaggtagagctccaccccctccgcctttactgttgctcttagcccttctgccactgcttcccgcaccgggagccgcagccgcacctgctcccaggcctccagagctgcagagcgcgagtgctggaccctccgtcagtctgtatctttctgaggacgaggtccggaggcttatcgggttagacgctgagctttactacgtgcgcaacgatctcatctcacactacgccctgtcatttagtctcttagtgccaagtgaaaccaattttctacatttcacatggcacgccaaaagcaaagtcgaatataaactcggtttccaagtagataatgtgctggctatggatatgccccaggtgaacatctccgttcaaggagaagtccccaggacgctctcagtcttcagagttgaactgtcttgtacaggcaaggtggactccgaggtgatgatacttatgcaacttaacctgactgtgaattcctctaagaactttacagtcctaaattttaagagacgtaagatgtgttacaaaaagctggaggaggtgaaaacaagcgccctggataagaatacctctagaaccatatatgatcctgtccatgccgcacctaccaccagcaccagagttttctacatttccgtgggtgtttgttgtgcagtgatttttttggtagcaataatcctggctgtactgcatcttcacagtatgaagcgcatcgaactggatgattcaatcagcgcttcttcaagtagccagggactgagtcaaccatcaacccagaccacacagtacttgcgagccgacacacctaacaatgctacccctatcacgagttcactagggtacccaacactgcgcatcgagaagaatgacttgcgctcagtgacgttactagaggccaagggcaaagtgaaagacattgccatctccagggagagaataaccttgaaagatgtgcttcaggagggaacttttgggaggatatttcacggaatcttgatcgacgaaaaagatccaaacaaagaaaaacaggcttttgtaaagacagtcaaggaccaggcatctgaaattcaggtgaccatgatgcttaccgaatcttgcaaactgcgcggtctgcatcaccgcaatcttttgccgattactcatgtatgcatagaagaaggggaaaaacccatggtcatattaccttatatgaattggggcaacctaaagctgttccttcgccaatgtaaattggtagaagcaaataacccgcaggcgataagccagcaggaccttgtgcatatggccattcagatcgcttgcggaatgtcttatctggcccgtagggaagttattcacaaggatctggcggcacgtaactgtgtaatcgatgataccctacaagtaaagattaccgataacgccctcagcagggacctctttccaatggactatcactgcttgggggacaacgagaatcgaccagtcaggtggatggcacttgaaagcctcgttaacaatgagttcagttctgcatcagatgtgtgggcttttggggtgacgctgtgggagttgatgacactcggccagaccccatatgttgacatcgacccatttgaaatggccgcttatctgaaagatggatataggatagcccaacccatcaattgtcccgacgaactcttcgcagtaatggcttgttgctgggcattggacccagaggagcggcctaagttccagcagttggtgcaatgtttgacagaatttcatgccgcactgggagcctacgtctag

SEQ ID NO: 53695 - DNA, 1257 bp, Artificial Sequence
  Description of Artificial Sequence: Synthetic coding sequence
atgtgctacaaaaaattggaggaggtgaagacctcagccctggataagaatactagccggactatttacgatcctgttcatgccgcacccacaactagcacccgcgtcttctacatcagtgtcggcgtgtgttgcgccgtgatcttcctggtggcaatcatactggccgttctacacttgcattcaatgaagcgcatagagctggatgactctatctctgcatctagcagctcacagggcctcagccaaccaagtacccagaccactcagtaccttagagcggacactcctaacaatgccacacccataacgagctctctgggatatcctaccctaaggatagagaagaacgatctgaggtccgttacactcctggaggctaaggggaaagtaaaagatatagccatctcacgggagcggatcaccttaaaggacgttcttcaggagggcacatttggtcgtatttttcatggcattcttatcgacgagaaggacccaaacaaagaaaagcaggcattcgtaaagactgtgaaggatcaggcaagcgaaatacaggtcacaatgatgctgactgaatcttgcaaattgagaggacttcaccaccggaatttgctgcctatcacccatgtgtgcattgaagagggagaaaagccaatggtcatcctcccgtatatgaattggggcaacctgaagctgtttcttcggcagtgtaagctggtggaggcaaacaacccacaggcaatcagccaacaggatctcgttcacatggccatccaaatcgcctgtggtatgtcctacctggctcgccgagaagttatccataaggacttagctgctaggaattgcgtcattgatgacacccttcaggtcaagattactgataatgcgctgtctcgtgacctttttcctatggattatcactgcttgggggacaacgagaaccgccctgtaaggtggatggcgttggaaagccttgtcaacaacgagttttcctcagccagtgatgtgtgggcctttggggtgacactctgggagctcatgacgctcggacagacaccatatgtagacattgacccatttgaaatggccgcttacctaaaggacgggtatcgcatcgcccagcctattaattgtccagatgaactattcgctgtcatggcctgttgctgggccctggatcctgaagaaaggccaaagttccagcaactcgtccaatgcctcactgaatttcacgccgctctgggggcttacgtttag

SEQ ID NO: 53696 - DNA, 1764 bp, Artificial Sequence
  Description of Artificial Sequence: Synthetic coding sequence
tgacgggctccacccccaccccctctgctgttgctactagcacttctccctctactccccgcacccggagcagccgcagcccctgcacctcgccctcctgagctgcagtcagccagtgccggtccatccgtttctctttacctgtccgaggacgaagtacgaaggcttatcggcttagacgccgagctgtactacgtgcgcaacgaccttatctctcattacgccttaagttttagcctccttgtgccttcagagaccaactttcttcactttacatggcacgccaagtcaaaggtggaatataaactggggttccaagtagataatgtgctagctatggacatgcctcaagtgaatataagtgtgcagggtgaggtacctagaaccctgtctgtgttcagagttgagctgtcctgtactggcaaggtcgactctgaggtcatgattttgatgcaactcaacctgactgtaaactctagcaaaaactttacagtcctgaattttaaacgcagaaaaatgtgctacaaaaaactcgaggaggtaaaaaccagtgcgttggataaaaacacatctcgaactatctatgacccggtacatgccgcacctaccactagcaccagggtcttctacatttctgtaggggtctgttgcgccgtgatattcctcgtagctattattctcgctgttttgcatctccatagcatgaaacgtatcgagctggatgattcaatttcagcgagcagtagctcacaaggcctgtcccagccatccactcagacgacgcagtatctaagggccgacactcctaacaacgccacgcccattacatcttatccaacactcagaatcgaaaaaaacgacctgcggagtgtcacactccttgaagccaaaggtaaagtaaaagatatcgccattagtcgggaacggattactctgaaagatgttctgcaggaaggcacctttggtaggatatttcatggaattttgattgatgaaaaggatcctaacaaggagaagcaggcctttgtgaagactgtaaaggatcaggcatccgaaatccaggtcacgatgatgttgacagaatcatgcaaattacgtgggctgcatcataggaatctgttgcccatcacccatgtgtgcatagaggagggagaaaagcccatggtgattctcccgtacatgaattgggggaacctaaagcttttcttgcgccagtgtaagttagtggaagccaataatccacaagcaatttcacagcaggacctcgttcatatggccatacaaatcgcttgtggcatgtcttacctcgccaggcgtgaggtcatccataaggatttggcggctcgaaactgcgtaatcgacgacacactgcaggttaagatcaccgataacgcattgagtagagatctgtttccgatggattatcattgccttggagataacgaaaatcgtcccgtcagatggatggcactcgagtctctggtgaacaacgaattctctagcgcaagcgacgtgtgggccttcggagtgaccctgtgggagctgatgacgttaggacagaccccctatgtcgatattgatccgttcgaaatggccgcatatctcaaagatggttatcgcatcgcccagcctataaactgtcctgacgaactcttcgcagtcatggcctgctgctgggctctggatcccgaagagcgacccaagtttcagcagctggtgcagtgcctaactgaatttcacgccgctttgggcgcatacgtctag

SEQ ID NO: 53697 - DNA, 240 bp, Artificial Sequence
  Description of Artificial Sequence: Synthetic coding sequence
atgtccacaaagaaaagccccgaagaattgaaacggatcttcgagaaatatgccgcaaaggaaggggatccagaccagctgagtaaagacgagctaaagctgctaattcaggccgagttcccaagccttctgaaagggcctaacacactggacgacctgtttcaggagctcgataaaaacggcgatggggaagtgtcttttgaggagttccaggttctggttaaaaaaatttcacaatag

SEQ ID NO: 53698 - DNA, 726 bp, Artificial Sequence
  Description of Artificial Sequence: Synthetic coding sequence
atgaatggtacacttaccgctgttgagtcattcctcacaatccactcagggcctgagggcctctcaatacatgacggaacttggaaaagtgccatatacggattcggggatcagagtaatctgcggaagctgaggaatgtttcgaacctgaagcctgttcccttaattgggccaaagctgaagagacgatggcccatctcatattgtagagagctgaaaggatatagtatccctttcatgggaagcgacgtgagcgtggttcggcgaacacagaggtacctttatgaaaacctggaagagtcacctgttcaatacgctgcctatgtgacggtaggagggattacttccgtgatcaagctcatgttcgccggattattctttctgtttttcgtcaggtttggtatcggaagacagctgctgatcaagattgacgccgctagcttcactctgaccttctttgggcagggatacagccagggcactgggaccgacaaaaacaaacccaatatcaaaatctgcacacaggtgaaagggccagaggccggatatgtggcgactccaatcgcaatggtacaggccgctatgacattactgtcggacgcttcccaccttcccaaggctggtggggtgttcactcctggggcagccttttcaaagaccaagctaatagacagactgaacaaacatggtatcgaattttctgtgattagctcatccgaagtgtag

SEQ ID NO: 53699 - DNA, 1290 bp, Artificial Sequence
  Description of Artificial Sequence: Synthetic coding sequence
atggcaacagaacagcggcctttccatctggtggtgtttggtgcatctggatttacaggacaattcgtgactgaggaggttgccagagagcaggtggatcccgaaaggtcatcgcggttaccctgggccgttgcaggtaggtcgcgcgagaaattacagcgggttctggagaaagcagcacttaaactcggaagacccaccctgagcagtgaggtagggattattatctgcgacattgccaatcccgcaagtctcgatgagatggccaaacaggctactgtcgtgctcaactgtgttgggccatacaggttttatggtgagccagtcatcaaagcctgtatcgagaatggcgcttcttgtatcgatatatcaggagaaccacagttccttgaactaatgcagctgaaataccacgagaaggcggcagacaagggggtatacatcatcggcagtagtggatttgactctattccagccgatctgggggtcatatatacccgcaacaaaatgaatggcacactgactgcagtggagagttttctaacaatacactcaggaccagaggggctcagcattcatgatggcacatggaaaagcgcaatttacggattcggtgaccagtccaacctccgtaaactacgaaatgttagcaacttaaagcctgtgcctttgatcggcccaaaactcaagagacgctggcccatttcctactgtagggaactgaaaggatactccattccatttatggggtctgatgtttccgtcgtccggaggactcagcggtatctgtatgagaatctggaagaatcccctgtgcagtatgcagcctacgtcaccgtgggcggtatcacttctgtaataaagttgatgtttgctgggctgttttttttattctttgtcaggttcggaatcggacggcagctcctaattaaatttccttggttcttttccttcggttactttagcaaacagggccctacccagaaacagatcgatgccgcatccttcaccctgacattctttggacaaggttattcccaggggacaggcacggataagaacaaaccaaatattaagatctgtacccaggtaaagggtcccgaggcagggtacgtcgcgactcccatcgcaatggtgcaggccgctatgacattactgtcagacgcgagtcacctgcctaaagctggtggggtgtttacccccggagccgctttctctaagacaaaactcatcgaccgcctgaacaaacacggaattgagttttcagttatctcgagttccgaagtgtag

SEQ ID NO: 53700 - DNA, 1074 bp, Artificial Sequence
  Description of Artificial Sequence: Synthetic coding sequence
atgtccggtaaaactaaagctcgaagagccgcaatgttctttcgcaggtgcagcgaagatgccagtggctccgcatcaggcaacgccttgctgtctgaggacgaaaatcccgacgcgaacggggttaccaggagctggaagataatcctgagtactatgctaacccttacatttttgctcgtgggattattgaatcaccagtggcttaaagagaccgacgtccctcagaagtcccggcagctgtatgccatcatcgcggagtacggatcccggctgtataagtaccaagcccgattgcggatgcctaaagaacagcttgaacttctcaaaaaggaaagccagaacctggagaacaatttcagacagatattattccttatcgaacagattgatgtgctaaaagccctactaagagatatgaaagacggtatggacaacaatcacaactggaacacccatggcgaccctgtcgaagatcctgatcatacagaggaagtctccaacctggtgaattatgtgctcaagaaactccgggaggaccaggtggagatggcagactacgcacttaagtctgcaggcgcatctatcatcgaagctgggacatctgagtcatataagaacaataaagcaaagctctactggcacggcattggattcttgaaccatgaaatgccccctgacatcattttgcagcctgatgtttatcccggaaaatgctgggcattccctggctctcaagggcacacgctgattaagttggcgaccaagatcattcccactgccgtgacgatggaacacatctcggaaaaagtctcccccagcggcaacatcagcagtgcacctaaggagttctccgtatatggaatcaccaagaaatgtgaaggagaagaaatctttctgggccaatttatctacaacaaaacaggaacgactgtgcagacattcgagctccaacacgctgtgtccgaatatctcctgtgcgtgaaactgaatatcttttccaattggggccaccccaagtatacatgtttgtatcgattccgcgtacatggaacccctgggaaacatatttag

SEQ ID NO: 53701 - DNA, 1074 bp, Artificial Sequence
  Description of Artificial Sequence: Synthetic coding sequence
atgtccggcaaaaccaaagcgagaagagctgccatgttcttccggaggtgttctgaagatgctagcgggtcagccagtggcaacgccctcttatctgaggatgagaatcccgacgcaaatggcgtgacaaggtcatggaaaataatcctttcaacaatgctaaccttaacgtttctgctcgtgggcctgcttaaccaccagtggttaaaggagactgatgtccctcaaaagtctcgccagctttatgctattatcgctgaatatgggtctcgcttgtataagtaccaggccagactgcggatgccgaaggaacagttagaattactgaagaaggagtctcagaatctcgagaacaactttcgacaaattctttttctgatcgagcagattgatgttctgaaggcattgctaagagacatgaaggacgggatggacaataaccacaactggaatacacatggagatcccgtcgaagatccagatcatacggaagaggtttccaacctggtcaactacgtgttgaagaaactccgggaggaccaggtggagatggctgactacgcactgaaaagcgctggggcttctatcattgaggcgggaacctcagaaagctacaagaacaacaaagcaaaactctactggcacggcataggatttctcaaccacgaaatgcctccagacatcattcttcagccagatgtttatcctgggaagtgttgggccttccctggttcacagggacacacattgattaagttggctactaagattatcccgactgctgtgacgatggaacacatctcagaaaaggtatccccatctggaaatatttccagtgccccaaaagagtttagcgtatacggcattacaaaaaaatgtgaaggggaggagattttccttggacaatttatttacaacaaaaccggtaccacggtgcaaacattcgaactgcagcacgccgtctcagagtacctgttgtgcgtgaaacttaatatcttcagcaactgggggcacccaaaatacacatgtttatacaggtttcgagtccacggcacccccggaaagcatatctag

SEQ ID NO: 53702 - DNA, 810 bp, Artificial Sequence
  Description of Artificial Sequence: Synthetic coding sequence
atgccgaaggagcaattagaactgttaaaaaaagagtctcaaaacctcgagaacaatttcaggcagattctctttctcattgagcaaattgacgtgctcaaggctctgctgcgagacatgaaggatgggatggacaacaaccacaactggaatactcatggcgacccagtggaagatccagatcacactgaagaagtgtcgaatctcgtgaactacgtgctcaagaagctccgggaagaccaggtcgagatggccgactatgcactgaaaagtgctggcgctagcataatcgaagccggaacaagtgagtcgtacaagaacaataaagccaaactctactggcacggaatcggatttctgaatcacgaaatgccgcctgacataatcctgcagcccgatgtgtaccccggtaagtgttgggcttttccaggctcacagggccacacgcttataaaacttgccacaaaaattatccccaccgctgtgactatggaacacatcagcgagaaggttagtccttctggaaatatttcttctgcccctaaggaattctcagtctatgtccagcgctacatgtgcagattcgtcatccaggctggaatcacaaagaaatgcgagggcgaagagatttttctggggcagttcatctacaacaaaacaggtactacggttcaaaccttcgagctccaacacgctgtgtccgagtacctgctctgtgtcaagctgaatatcttctccaattgggggcatcccaagtacacgtgtctgtaccggttcagggtccacggcacacccggaaagcatatctag

SEQ ID NO: 53703 - DNA, 810 bp, Artificial Sequence
  Description of Artificial Sequence: Synthetic coding sequence
atgcccaaagaacaactagaactgctgaaaaaggaaagtcagaatcttgagaataattttcgccagatcctgttcctgatcgagcaaattgacgttctgaaggccttactccgcgatatgaaagatgggatggataacaatcacaattggaacacacacggagaccctgtggaggatcctgaccacaccgaggaagtgtctaatctggttaattacgtgcttaagaaactaagggaagaccaggtcgaaatggcagattatgcgctcaagtctgcaggcgcatccatcatcgaagcaggaacctctgaaagctacaaaaataataaggcaaaactctattggcacggcatcggcttcctgaaccatgagatgccccctgatatcattctccagcccgatgtctaccccggtaaatgttgggcttttccaggaagccaggggcataccctaatcaagttggccaccaaaataatccccaccgccgttacaatggagcacatttctgagaaggtttcaccctctggcaatattagctctgccccaaaggagtttagtgtatatgtgcagagatacatgtgccgttttgtgatccaggctgggatcaccaagaagtgtgaaggcgaggagatcttcctaggccagttcatctacaataagactggaacaacagtccagacatttgagcttcagcacgctgtctccgagtatttactgtgcgtcaagctcaacatcttttcaaattgggggcacccgaagtacacgtgcctctataggttcagagtccatggtacacccggtaaacatatctag

SEQ ID NO: 53704 - DNA, 846 bp, Artificial Sequence
  Description of Artificial Sequence: Synthetic coding sequence
taatacgcaattatcgcggagtatgggagccggctgtataagtatcaggccagactgagaatgcctaaggagcagctggaactgctgaaaaaggagtcccagaatcttgagaataactttagacaaatcctgttcctgatcgaacagatagatgtgctcaaggccctactccgcgatatgaaggatggcatggacaacaatcataactggaacacccacggcgatcccgtggaagatcccgaccatacagaggtgctggatgaggaggtgagcaatctggtgaattacgtcctgaagaagttacgcgaggatcaagtggagatggccgattacgctctgaaatccgctggcgctagcatcattgaagcagggacttcagagtcatataagaacaacaaggcaaaactgtactggcacgggatcggttttctgaatcatgagatgccaccggacatcattcttcaacccgatgtctaccccggaaaatgctgggcctttcctggctcccaggggcatacgctgataaaattagctaccaagataattcccacagctgtaaccatggagcacatctctgagaaagtgtccccgtcaggcaatatctctagcgccccaaaggagttttctgtgtatggtattacaaagaaatgcgagggggaggagatatttttgggccagttcatctacaataagacaggtaccacggtgcaaacatttgagctgcaacatgcagtgagcgaatatctcctttgtgtgaagttgaatatcttttccaactggggacaccccaagtacacgtgtttatacaggtttcgcgtgcacgggacccctggcaaacacatctag

SEQ ID NO: 53705 - DNA, 1038 bp, Artificial Sequence
  Description of Artificial Sequence: Synthetic coding sequence
atggaggactattccaaatataacgcttataccgatttctcttcctgtcggctggagtgctccggtgcgatcctggcacactgcaatctgcatctgctcggctcctcaatatctccagcatcagcttccagggttgctggaacaaccgggttattgaaccatcaatggctcaaggaaaccgacgttcctcaaaaatcaagacagctctatgctatcatcgccgaatacggttcgaggttgtacaaataccaggcaagattgcggatgccaaaggaacagctcgagctgctaaagaaagagtctcaaaatcttgagaacaactttcgtcagatattgtttctgattgaacaaatcgatgtgttaaaagctctcctgagggacatgaaagacggaatggacaacaatcataattggaacacccacggcgacccggtcgaagatccagatcacacagaggaggtgtcgaatttggttaattacgtactcaaaaagctgcgggaggatcaggtggaaatggcagactacgccctgaaatccgctggagcgtcaataatcgaagccggaaccagcgagagttataaaaacaacaaagccaagctttactggcatgggatcgggtttctgaatcatgaaatgcctccagatatcattctgcagcccgatgtataccccggaaagtgctgggccttcccagggtcccaggggcacaccctgattaaactggccaccaagattattcccacagccgtgacaatggagcatatttcagagaaggtgtcccctagtggtaacatctcctcagcacctaaagaattttctgtgtacggtatcacaaagaagtgcgaaggagaggaaatcttcttgggccagtttatatacaacaaaacaggtaccaccgtgcagactttcgagctccagcatgccgtgagcgagtacctgctgtgcgtcaagcttaacatcttttcaaactggggacacccaaaatatacttgcctatatcgcttcagggtccacggtacacctggcaagcacatatag

SEQ ID NO: 53706 - DNA, 939 bp, Artificial Sequence
  Description of Artificial Sequence: Synthetic coding sequence
atggatcgctccacgaatctggacattgaggagctcaagatgactcgagaacagtatatcctggcaactcagcagaataatttacccagaactgagaatgcgcagttatatccagtaggaatttacggatggcggaaaagatgtttatattttttcgtgctgcttcttcttgtcactatgattgtcaatttagctatgaccatctggattttaaaggttatgaatttcaccgtagatggcatgggaaaccttagggttactaagaaaggcatcaggcttgagggtatcagcgaatttctacttccgctctatgtaaaagaaatccacagcagaaaggattctcccttggtcctgcagagtgatcggaatgttactgtgaacgccagaaaccacatgggccagttaactgggcagctgaccatcggagcagatgccgtcgaggcccaatgcaagagattcgaagtccgggctagtgaggacgggagagtgctgttcagtgcagacgaggacgagatcacaatcggcgcagagaagctgaaagtcacgggtaccgaaggtgctgttttcggccacagcgtggagaccccacacattcgggcagagcccagccaggatctccggctggagtcaccgacacgctctctgatcatggaggccccaaggggagtccaggtgtcagctgctgctggcgattttaaggcaacctgccgtaaggagctgcatctgcagtctacggagggtgagatttttctgaatgctgagaccattaaactgggaaatctacccactggctcgttctcctcatcctctccctccagtagctctagccggcagaccgtctacgagctttgcgtgtgccctaatggaaagctgtaccttagtcctgcaggcgtgggtagcacttgtcagagcagttccaacatatgcctctggtcctag

SEQ ID NO: 53707 - DNA, 798 bp, Artificial Sequence
  Description of Artificial Sequence: Synthetic coding sequence
atgacccgtgaacaatatatcctggctacccaacagaacaacctcccccgaaccgaaaatgctcagctgtatcccgttggaatctacggatggaggaaacgatgtctgtacttcttcgtgctcttgctcttagtaactatgatcgttaacctggccatgacaatttggatcctgaaagtgatgaatttcacagtcgatagtcccttagtgctgcagagcgatcggaatgtgactgtgaatgcgaggaatcatatgggccaactcacgggccagctaaccatcggcgctgacgccgtagaggcccagtgcaagcggttcgaggtgagagcctccgaggatggcagggtcctgttcagcgcagacgaagatgagatcactataggagctgagaagctgaaggtgactgggactgaaggggctgtgttcggacattccgtcgagacccctcacatcagagctgaacctagtcaggatttgaggctcgagtctccaactcggagcctcattatggaggcacctcgaggcgttcaggttagcgctgccgcaggagactttaaggcgacttgccgcaaggaactgcatttacagagcacagaaggcgagatctttctgaacgccgagacaattaagttgggcaacctccccacaggttccttctcgtcatccagccccagcagctcctcttcccgccagaccgtctatgagctgtgcgtttgcccaaacggcaaactgtatctttcccccgcaggagtgggatccacttgtcagagcagcagcaatatctgtctgtggtcttag

SEQ ID NO: 53708 - DNA, 2436 bp, Artificial Sequence
  Description of Artificial Sequence: Synthetic coding sequence
atgccgtctgctttagccattttcacatgtcgccctaattcacaccctttccaggagcggcatgtatacttggatgaacctatcaagatcgggcgaagcgtcgcacgctgtcgcccagctcagaataatgctaccttcgattgcaaagtgctcagcaggaaccatgccctcgtgtggtttgatcacaaaactgggaagttctacctgcaggataccaagtcctcaaacggcacgttcattaactctcagcgactgtctcggggttcagaggagagtccaccctgtgagatactgagcggggacatcattcaatttggagtagacgtgactgagaatacaaggaaggtgacccacggctgtatcgtgagcactattaaactcttcctcccagatgggatggaggccagactgcggtccgacgtgatacatgcaccattgcctagcccagtcgataaggtcgcagcaaatacaccctccatgtactcacaagagctatttcagctgtcccaatacctccaggaggccttgcaccgcgaacagatgctggagcagaagttggccactcttcaacgactgttagccattacccaagaagcctcagacactagctggcaggcccttatcgatgaggatcgccttctgtctcgtctcgaagtcatgggcaatcagcttcaggcttgttctaagaatcagactgaagattccctcagaaaagaattgatcgcgctccaggaggacaaacataactacgagactacagcaaaggagagtctcagacgcgtactgcaggagaaaatagaggttgtgcgtaagttgtccgaggttgagcgcagcttatctaacacagaggacgaatgcacccatctgaaggagatgaatgagcgcacacaggaggaactgcgggagcttgccaataagtacaacggtgcagtgaacgagatcaaggatttaagcgataaacttaaagttgccgaaggcaagcaggaggaaatccaacagaaaggccaggcagaaaagaaagagttacagcataagatagacgaaatggaagaaaaggagcaggaactgcaggcaaaaatcgaggctctacaggctgacaatgacttcacaaatgagcggttaacagccttgcaggagcatctgctcagtaagagcggcggagactgtacctttatccaccaattcatagagtgccagaaaaagttgattgtggaggggcacttgaccaaggcagtagaggaaaccaagctgtcaaaggagaatcagaccagagccaaggagtccgacttctctgataccctctcgcctagtaaggagaagagctccgacgataccactgacgctcaaatggacgagcaggatctgaatgagccactggccaaggttagcctattgaaagatgatcttcagggagcacagagcgagattgaagccaagcaagagattcagcatctgagaaaggaactcatcgaggcgcaagaactagctcgaactagtaagcagaagtgttttgagctccaagcactcttggaggaggagcgtaaagcgtaccggaatcaggttgaggagtccaccaagcaaatccaggtcttacaggctcagctccaacgtctgcacatagatacagagaaccttcgggaagaaaaggactccgaaatcacaagcacgagggacgagctactatctgcacgtgacgagattctgctgctccaccaagctgcggctaaagtggcttctgagcgcgatacagatattgctagtctccaggaggagctgaaaaaagtacgcgcagagttagagaggtggcgaaaagctgctagcgagtacgagaaggagattacgtctctgcaaaattcatttcaactgaggtgccagcaatgcgaggatcagcagcgggaggaagctacccggcttcaaggcgaactggagaaactacgcaaggaatggaacgctttggaaacggagtgccattctttgaaaagggagaatgtgctcttgtcctctgagttacagcggcaggaaaaagaactgcataattctcagaaacagagcctggagctgacaagcgatcttagcatactacaaatgagtcggaaggaactcgagaaccaagtgggaagtcttaaggaacagcacctgagagactcggcagatctaaagactctcctttcaaaagcagagaatcaggcgaaggatgtgcagaaggagtacgagaaaacacagactgtcctgtctgagcttaagctcaaattcgagatgaccgagcaagagaagcagagcattactgacgagttaaagcaatgcaagaataatctgaagctactgagggaaaaaggcaataataagccctggccctggatgccgatgttagcagccctggtggctgtaacagccatagtgctttacgtacccggattggcgcgagcgagtccatag

SEQ ID NO: 53709 - DNA, 2436 bp, Artificial Sequence
  Description of Artificial Sequence: Synthetic coding sequence
atgcccagcgctctcgccatcttcacctgccgcccaaattcccatcccttccaggaacgccacgtctacctagacgagcccataaagatcggacgctctgtggccagatgcagacctgcgcagaataacgctacctttgattgtaaggttctatccaggaatcatgcattagtgtggttcgaccataagacagggaagttttacttgcaggatacaaaaagttccaatgggactttcattaatagtcagagattatcccggggaagcgaagaaagtcctccatgtgagattctctcaggcgatatcattcaattcggagtggacgtgaccgagaatacaagaaaggttacccacgggtgcatagtttccacaatcaagctatttctgccagatggcatggaagctcggcttcgatcagacgtgattcacgcccctctaccaagtccggttgataaggtggcggcaaacacaccttcaatgtattcacaagaactgtttcagttgtcccagtacctgcaggaagcactccacagagagcaaatgcttgagcaaaaactcgccacactgcaacggttactggccatcactcaggaggcatcagacacatcctggcaggcgttgatcgatgaagataggctgctaagcagactcgaggtgatggggaatcagcttcaggcttgctctaaaaaccagaccgaggattcccttcgcaaagaactgatcgccctccaggaggacaagcacaattatgaaacaaccgctaaggaaagcttaagaagggtattgcaggagaaaatcgaggtggtgagaaagctttccgaggtggaaaggtcgctaagtaacactgaggatgaatgcacccacctcaaggaaatgaatgaacggactcaggaagaactgcgcgagttagcaaataagtataatggggctgtcaatgagatcaaggacctaagtgataagctgaaagtggctgagggaaaacaggaagaaattcagcagaagggacaggccgagaaaaaggaactccagcataaaattgatgagatggaggagaaggagcaggaactccaagcgaagatagaggcactgcaggccgataacgatttcaccaacgaacgactcacagccctacaggaacatctgctgtctaagagcggtggagattgcactttcatacaccagttcatcgagtgccagaagaaactgatcgtggagggacatcttacaaaagccgtggaggaaaccaagttaagtaaggaaaaccaaactcgcgctaaggaaagtgacttttccgatactctcagcccttcaaaggaaaaatcctccgacgatactacagatgcccaaatggacgagcaagatctgaatgaaccactcgcaaaggtgtcactgcttaaggacgatctgcaaggagcccaatctgaaatcgaggcaaaacaggaaatacagcacctgagaaaggagcttattgaggcgcaggaactggcccgtacctccaagcaaaagtgtttcgaactgcaggcactcctggaagaagaacgcaaggcatatcgaaaccaggtggaagaaagcaccaaacagatacaggttctgcaagctcagcttcaacgtctccacattgatacagagaacctccgtgaggagaaggattccgagataacatccacacgcgatgaactgctctcagctcgggacgaaatcctactgctgcaccaggcagccgctaaggtggcctcagaaagggataccgacatcgctagccttcaagaggagctgaaaaaagtccgggcagagctcgagagatggaggaaggctgcgagcgaatacgaaaaggagatcacctcactgcagaattcctttcagctaaggtgtcagcagtgcgaggatcaacagagggaagaggcaacccgccttcaaggcgagctggaaaaactgcgaaaagagtggaatgcactcgaaactgaatgtcattccctgaaaagggagaacgtcttattgagcagtgagctccagcgccaggagaaggaactccataactcccaaaagcaatctctggagcttacttccgatctcagtatccttcagatgtcacgcaaagaattagagaatcaggtaggatcccttaaggaacaacatctgcgtgatagcgcagatctgaaaacactgctgtcaaaagcagaaaaccaagccaaggacgttcagaaagaatacgaaaagacccagactgtcctctctgagctcaaactgaagttcgagatgacagagcaggagaagcaaagcattactgacgagcttaaacagtgtaagaacaacctgaagttactcagagaaaaaggtaataataagccttggccatggatgccaatgttagccgcactggtcgctgtcacagcgatagttctctacgtgcctggcctcgctcgggctagcccttag

SEQ ID NO: 53710 - DNA, 1521 bp, Artificial Sequence
  Description of Artificial Sequence: Synthetic coding sequence
atgccctctgcattggccatctttacgtgccgcccaaattcgcacccattccaggaaagacacgtctatctggacgagccgattaagattgggcgatccgtcgccagatgcaggcccgcacaaaataacgctacgtttgattgtaaagtcttgtctcgcaaccacgccttagtgtggtttgaccacaagacaggaaaattctacttacaagatacaaagtcgtctaacggtactttcataaattcccagcgactcagtagggggagcgaagagtccccaccatgtgagatccttagtggagacatcatccagtttggcgttgacgtgactgaaaatacgcgaaaggtgacacacgggtgcattgtatcaaccataaagctgttcctgcctgacggtatggaggcccgactcaggagcgatgtcattcatgctcccctgccctctcccgtcgataaagtggccgctaacaccccaagcatgtacagccaggaacttttccagctcagccagtacctccaggaagccctccaccgggagcagatgcttgagcagaagctggctactctgcagagactgctggccattactcaggaggcatccgacactagttggcaggcgctcattgacgaagatagactgctaagccggctggaggtaatggggaatcagcttcaagcttgtagcaaaaatcagacagaggacagcttgagaaaggagcttatagctctccaagaggataagcacaattatgaaaccacggccaaggaaagtcttcgtcgtgtcctgcaagagaaaatcgaagtcgttcgcaagttgtccgaggtcgagagatccttatcaaacacagaggacgagtgcacacacctgaaggaaatgaatgaaaggactcaggaagaactgagggagttagcaaacaaatataatggcgctgtaaacgaaatcaaagacctgagcgataagctgaaggtcgctgagggtaagcaggaggagatccagcagaaagggcaggcagagaagaaggagctccagcataagatcgacgaaatggaagagaaagaacaggagctgcaggccaagatagaggccctgcaggcagataacgattttacaaacgagaggttgaccgcactgcaagtgcgactcgagcacctgcaggagaaaactttgaaggagtgttcctcactggggatccaggtcgacgatttccttcccaaaattaatggatccacggaaaaggagaagttaatcgtcgagggtcatctgaccaaggcagtggaagagacaaaattgtctaaggagaaccagaccagggcgaaggagtcagatttttccgacaccctgtcaccgtctaaagaaaagtcttcagacgatacaacggacgcacagatggacgagcaagacctgaatgagcccctggcaaaagtgtccctactcaagggtaccctgacatgcttctacgatattgttaatcaaggtatcaagtcaccttttgctatcaaatccgtgctcgacataatgtag

SEQ ID NO: 53711 - DNA, 816 bp, Artificial Sequence
  Description of Artificial Sequence: Synthetic coding sequence
atggatgagcaggatctgaacgagccactcgccaaggtgtcactacttaaagcacttttggaggaggagcggaaagcctatagaaaccaagtagaagagtcaactaagcagattcaagtgctccaagctcagctgcaacggctgcatattgataccgagaacctgagggaggagaaggatagtgagattacgagcactcgggatgagctcctaagcgctagggatgagatccttctattgcatcaggctgcggcaaaggtggccagcgagcgagataccgacatcgctagcctccaagaagagttgaagaaagtgcgggctgagttggagaggtggaggaaggcagccagcgaatatgagaaggaaatcacgagtctccagaattccttccagctgcgatgtcagcagtgtgaggaccagcagagagaagaggccacgagactgcagggggaactcgaaaagttgcgcaaggagtggaatgcactggaaaccgaatgccatagcttaaagagggagaatgtactgctgtcctccgagctgcagcgccaagagaaagaactacataacagccagaaacagagtctggagctgactagtgacctttcgattctgcagatgtccagaaaagaattagaaaaccaagtcggatctctaaaggaacagcaccttcgcgacagtgccgatcttaaaacgctgttgagtaaggcagagaaccaagccaaagatgtgcagaaggaagtcaagagaaaggatatcatgtcccctattatggtaggcctgaaagctaaatctaaatcagatatccacgcctcatag

SEQ ID NO: 53712 - DNA, 1230 bp, Artificial Sequence
  Description of Artificial Sequence: Synthetic coding sequence
tgaaaactcatcgtcgagggccatcttacgaaggcagtcgaggaaactaagctgagcaaagagaaccaaacgcgggctaaggagagtgacttctctgatactctgagtccgtctaaggaaaagtcttcagatgacactaccgacgctcagatggacgaacaggacttgaatgaaccactcgcaaaggtgtcgctcttgaaggatgatctccagggcgctcagtctgagattgaagccaaacaggagattcaacacctgcgaaaagagttaatagaggcgcaggagttggctcggacttccaagcagaaatgcttcgagcttcaagccctattagaggaagaacgaaaggcatataggaatcaggtggaggagagtaccaaacagatccaggtgctacaggcgcagcttcagcgtctgcatatcgataccgagaatctgcgggaggagaaggattccgagataaccagcactcgtgatgaactgttatccgctagagacgaaattctgctgctccaccaggcagccgctaaagttgcttccgaacgcgacacagatatagcaagtcttcaggaggagctgaaaaaggtacgagccgaacttgaaagatggaggaaagccgctagcgaatatgagaaggagatcacttctttacaaaatagcttccaactcagatgtcagcagtgtgaggaccagcagagggaggaggctacacggctgcagggagagttagagaagcttcgtaaggaatggaatgcgcttgagacagagtgtcactccctcaaacgggagaatgtgctgttgtcatccgaattacagcgccaggagaaagagctccacaactcgcagaaacagtcgctcgagctgacaagcgatctgtctattttgcaaatgtcgcgcaaggagttggagaaccaggtggggagccttaaagagcagcacttaagagacagcgccgacctcaagacacttctgtccaaggccgagaaccaggcgaaggacgtgcaaaaagaatatgagaaaacccagactgttttatctgaattgaagctaaagttcgagatgacggagcaggaaaagcagtctatcaccgacgagttaaagcagtgcaagaataatcttaaattgctcagggagaagggtaataacccatctattctacagcctgtgcccgctgtgtttatcgggctgtttctggccttcctgttctggtgtttcggccctctttggtag

SEQ ID NO: 53713 - DNA, 2487 bp, Artificial Sequence
  Description of Artificial Sequence: Synthetic coding sequence
atgccctctgctctcgcgatcttcacctgcagacctaatagccacccctttcaagagcgccacgtttacctggatgagccgataaagataggcagaagtgtcgcccgatgccgccctgctcaaaacaacgctaccttcgactgcaaggttcttagcaggaatcatgccttggtgtggtttgaccataagaccgggaagttttacctgcaggacaccaagtcttccaatggtacttttattaactcccaacggctgagccgcggatccgaggagtctccaccctgtgaaatccttagtggagatataattcagtttggtgtcgacgtcacagaaaatacccggaaggtgactcacggctgtatagtgtcaaccattaaactcttcctcccagatgggatggaagccagactgcgatccgacgtgatccacgctccactgcccagcccagtcgacaaagtggcagcaaacaccccttctatgtattctcaggaactattccagcttagccaatatttacaggaagccctccaccgcgaacaaatgctcgaacagaagttggcaactttacaaagactgctagcgattacccaggaagccagcgacacttcctggcaggcactcatagatgaggatcgactgctctctcgactcgaggtgatggggaatcagttgcaagcatgctccaagaaccaaactgaagacagccttagaaaagagctgattgcgttacaggaggataaacataattacgagaccacagcaaaagagtccctccgcagggtccttcaggaaaagattgaagtggtccggaagctatcagaggtagaaaggtccttgtcaaacacagaggatgagtgtacccatctgaaggaaatgaacgagcgaacccaggaagaactgcgggagcttgctaacaaatacaatggtgccgtgaatgagataaaggacttgagcgataaattaaaagtggccgagggcaagcaggaagaaatccaacagaaagggcaagccgaaaagaaagaactccagcacaagattgatgagatggaggagaaggagcaggagctgcaggcaaaaatcgaggcactgcaggcagacaatgattttacaaacgaaagactgacggctctgcaggttcgcttggagcacctccaggagaagactctcaaggagtgtagcagccttgaacacttgctttcaaagtcaggaggagactgtacttttatacatcaattcatagaatgtcagaaaaaactgatagtggagggacacctgacaaaggcagttgaggagaccaaactctccaaggaaaatcaaactcgagccaaggaatctgatttctcagataccttgtccccctctaaggaaaaaagctccgacgacaccaccgacgcacagatggatgaacaggatctgaacgagccattagccaaggtcagcttgctaaaggacgaccttcagggggctcaatccgaaatcgaagctaaacaggaaattcagcatttaagaaaagagctgattgaggcacaggaactcgccagaacatctaaacagaaatgttttgaattgcaggccctgctggaggaggagcggaaggcctacagaaaccaggttgaggagagcaccaagcagattcaggttttgcaggctcagttacagcggctccatatcgatactgagaatctgagagaggaaaaagattcagagatcacctcgacgcgggatgagctgctctcagccagggatgagattcttttacttcaccaggcggcagctaaagtggcctccgagcgggataccgacatcgcatctctgcaagaggagcttaagaaggttagggcggagctggagaggtggaggaaggcagcctcggagtatgaaaaagaaataacatctctgcaaaattccttccagttgaggtgccaacaatgcgaggatcagcagagggaggaagccacccgcctgcagggtgagctggaaaagctccgaaaggagtggaatgccctcgaaaccgagtgccactctctgaagagagagaatgttctcctgtcctccgagttgcagaggcaagagaaggagttgcataacagccaaaagcaaagtctggaactgacgtcagatctgagtatcctccagatgagtcggaaggaactagagaaccaggtcgggtccctgaaggaacagcacctgcgggactccgccgacctgaagactcttctgagcaaagctgaaaatcaggccaaagatgttcagaaggaatacgagaagacacaaactgtactgtccgagctgaagctgaaatttgaaatgacagagcaggaaaagcagtccataacagacgaactgaaacagtgtaaaaataatctgaagctgctgagggagaaaggcaacaataagccctggccatggatgcctatgctggccgctcttgttgctgtgaccgctatcgtgctttatgtgccaggcctcgctagagccagtccctag

SEQ ID NO: 53714 - DNA, 951 bp, Artificial Sequence
  Description of Artificial Sequence: Synthetic coding sequence
tagggccatttgacgaaggcggtagaggagactaaattatcaaaggagaaccaaacaagggcaaaggaaagcgatttctccgatacattaagcccctccaaagagaagtcctccgacgatactaccgacgcgcagatggatgagcaggatctcaatgagccgctagcaaaagtcagtctactgaaggcactgcttgaagaggagcggaaggcgtacagaaatcaagtggaggagtcaaccaaacagattcaggttctccaggctcagttgcagaggcttcatatcgatacggagaatctgcgggaggaaaaggactcagagataacatccactcgcgacgaacttctgtccgccagagatgagattttactccttcaccaggctgcggcaaaagtcgcatccgagcgagacacagatatagcttctctacaggaagaactgaaaaaagtgagagccgagctcgaacgttggcgcaaggctgcctcagagtacgaaaaggagatcacaagtttgcaaaattcatttcagctgcgctgtcaacaatgtgaggaccagcagcgcgaggaagccacacgcttacaaggcgagctcgagaagctgagaaaggaatggaatgctctggagactgagtgccattctctgaagagggaaaacgttctgctgtctagcgagctgcaaaggcaggagaaagagctgcataacagccagaagcaatcgctggagctgaccagcgacctgtctatcctgcagatgagcagaaaggaactagagaaccaggtggggtccctcaaagagcagcacttgcgcgatagcgctgacctgaagactctgctcagtaaggccgagaatcaggccaaggacgtgcagaaggaggtgaaacggaaggacattatgtcgcctatcatggtgggtctgaaagcaaaatctaaatctgacattcatgcgtcttag

SEQ ID NO: 53715 - DNA, 891 bp, Artificial Sequence
  Description of Artificial Sequence: Synthetic coding sequence
atggatgaacaagacttgaacgaaccgcttgctaaggtgagcctgctgaaagcccagttgcagaggctacatatagatactgaaaacctgagggaggagaaagacagcgaaataacctctacccgagatgagctgctctctgccagagatgagatccttctgctgcaccaggccgctgcaaaagttgctagcgagcgcgatactgatatcgcatctctccaagaagaactgaaaaaggtacgtgctgagctggaaagatggcggaaagccgcttccgaatacgagaaggaaataactagtctgcagaactccttccagcttcggtgccaacagtgcgaagatcagcagagggaagaagctacaagactgcagggcgagctagagaagttacgcaaggagtggaatgcccttgagaccgagtgtcatagtctgaagagagaaaacgtgctgttgtcgtccgaactccagaggcaagaaaaggagcttcataactcacagaagcagagccttgagcttacatctgacctcagtatccttcagatgtccaggaaagagctagagaaccaagtcggcagtctcaaagagcagcacctgcgggattctgcagatttaaaaaccttgttatctaaggctgaaaatcaagccaaagacgtgcaaaaagaatacgaaaagacgcagaccgtactcagcgagcttaaactgaaattcgagatgaccgagcaggaaaagcaaagtatcacagacgaactcaagcagtgcaaaaataacctgaagctgctgcgggagaagggcaataacaaaccttggccctggatgcctatgttggccgcactggtggctgtgactgctatagttctgtacgttccagggctcgctagagccagcccctag

SEQ ID NO: 53716 - DNA, 2373 bp, Artificial Sequence
  Description of Artificial Sequence: Synthetic coding sequence
atgccaagtgccctggccatatttacctgcaggcctaactcacacccgttccaggaacgacacgtttacttagatgaacctataaagattggaaggagcgtcgccaggtgccgcccagctcagaacaacgccacatttgattgcaaagtgctgtctagaaatcacgcattggtctggtttgaccacaagactgggaaattctatctccaagataccaagtcttccaatgggacattcattaattcccagcgcctgtcaagggggtctgaagaatcacccccttgtgagatcctcagcggtgatatcatccagtttggggttgatgtcaccgagaatactcggaaggtgacgcacgggtgcattgtgagcaccataaaattatttttaccagacgggatggaggctcgacttcgctccgacgtcattcatgccccacttccttcccccgtggataaagtggctgccaatacgccatcaatgtactcacaggagctgtttcaactttctcagtacttgcaggaggccctccatcgtgaacagatgcttgagcaaaagctggcaacgctgcagcgcctgctcgcaattacacaagaggcctccgatacctcctggcaagcgctaatagatgaggatcggctattgtcgcggctcgaggtcatggggaatcagctccaagcctgctccaagaatcagactgaggatagcttacggaaggagttgattgccctgcaggaggataaacataactacgaaaccaccgcgaaagaatccctccggagggtcttgcaggaaaagatcgaggtggtgcgaaaattatctgaggtggagagatcacttagcaacaccgaggatgagtgcactcacctgaaagaaatgaacgaaagaactcaagaggagctccgggaactggctaataagtataatggagcggtgaacgaaataaaggatctctcagacaagctgaaagttgcagaaggcaaacaagaagagattcagcaaaaagggcaagccgagaagaaggaacttcagcacaaaattgatgaaatggaagagaaagaacaagaactccaggccaagattgaggctctgcaggccgacaacgatttcacgaacgagcgcctgactgcactgcaggaaaaactgatcgtggagggccacctcaccaaagcagtagaggaaactaagctctcaaaggagaaccagacccgcgctaaagagtcggacttcagcgataccttatcaccctcaaaagagaaatccagtgacgatactactgacgctcagatggacgaacaggacttgaatgagcccctcgcaaaagtgtctctactaaaggacgacctgcaaggggctcagtccgagatcgaagcaaagcaggagattcagcatctgaggaaggagctgattgaggcacaagagctggctagaacatctaagcaaaaatgctttgaattacaggcccttctcgaagaagagcgaaaggcttacaggaaccaggtggaagagtctacgaagcagattcaagtcctccaggctcagttgcagaggctgcatattgataccgaaaatctccgggaggaaaaagacagtgagatcaccagcacacgcgacgagcttctgagtgctagagatgagattctcttacttcatcaggctgccgctaaggtcgcgtccgaacgagatacggacattgcctcattgcaggaggagttgaaaaaggtccgggcagagttggagcgatggcggaaagctgccagtgaatacgaaaaggagataacctccctgcagaatagcttccaactgcgatgtcagcagtgcgaagatcaacaacgcgaggaggcaacaaggcttcagggtgaactagagaagctcaggaaggagtggaatgctctggaaaccgaatgtcactcgctcaagagggagaacgttctgctgagcagtgagctgcagagacaggaaaaagagctgcacaacagccagaagcagagtctggagctgacatccgatctgagcatccttcagatgtctcggaaagagctggagaatcaagtggggtcgttaaaggaacagcacctccgcgactctgcggacctgaagacactgctgagcaaagcggagaatcaggcaaaagatgtgcagaaggaatacgaaaagacgcaaacagtgctgtctgaactaaagctcaagtttgagatgactgagcaagagaaacaaagcatcacagacgagctgaagcagtgcaagaataaccttaaactgctccgggaaaagggaaataacaaaccctggccatggatgccaatgctggcggcactggtagccgttaccgcaatcgtcctgtacgtgcccggactcgccagggccagtccctag

SEQ ID NO: 53717 - DNA, 957 bp, Artificial Sequence
  Description of Artificial Sequence: Synthetic coding sequence
atggacgaacaggacctaaacgagcctctagctaaggtatcactcctgaaagccctgcttgaagaagagaggaaggcataccgaaaccaggtggaggaatcaaccaaacagatccaggtgctgcaggctcagttgcagagattacacatagacaccgagaaccttagggaggaaaaagacagtgaaatcacctcaacccgtgatgagctgctctctgccagggacgagatcctcctcctgcaccaggcagccgcaaaggttgcttcagagcgtgacaccgatattgcttcccttcaggaggagctgaaaaaggtgcgggcagaactcgaacggtggaggaaagccgcaagcgaatacgagaaggaaattacctccctccagaacagctttcagctgagatgccagcagtgtgaggaccagcagcgtgaagaagcaactagactgcagggtgagctcgaaaagctccggaaggagtggaacgccctcgaaacagaatgtcactccctcaagcgagaaaacgttcttttgagttcagagttgcaacgacaggaaaaggaactgcataactcccagaagcagagtctagaattgacttctgatcttagcattctccaaatgtctagaaaagagcttgagaaccaagtaggatccctgaaagagcagcatctgagggactctgctgacctgaagactctgttgtcaaaagcagagaaccaggctaaggatgtacagaaggagtacgagaaaactcagacggtgctgtctgaattaaaactgaagttcgagatgactgagcaggaaaagcagtccatcaccgatgagctgaagcagtgcaagaataatctaaaacttctccgggagaagggcaacaacccttctatccttcagcctgtgccggctgtgtttattggcctgttccttgccttcctattttggtgtttcggcccactgtggtag

SEQ ID NO: 53718 - DNA, 1089 bp, Artificial Sequence
  Description of Artificial Sequence: Synthetic coding sequence
atggatgaacaggatctcaatgaacccttagccaaagtgagcttactgaaagacgacctccaaggcgcacagtcagaaatcgaggccaaacaagaaatacaacaccttcgcaaggaattgattgaggcccaggagctcgccagaacatctaagcagaaatgctttgagcttcaggctctgctcgaagaggagcggaaggcttaccgcaatcaggtggaagagtccacaaaacaaattcaggtactgcaggctcagcttcaaaggctgcacatcgataccgagaaccttcgggaggagaaggactccgaaatcaccagcactcgagacgaacttctgtccgccagagatgaaatcctgctgctccaccaagcggctgctaaggtggcatctgaaagagacactgatatcgcctccctgcaggaagagctaaaaaaggtcagagccgagctggagagatggcggaaggctgcgagcgagtatgaaaaggaaattacatcccttcaaaatagttttcaattgcgctgccagcagtgtgaggaccagcagcgcgaagaagcaacaaggctgcaaggcgagctggaaaaactcaggaaggaatggaacgctttagagacagagtgccactccttaaagcgtgagaacgtgctcctgtctagcgaactgcagcgccaggagaaagagctccataattctcagaaacagtcactcgagctaacctcagacctgtcaatcctccagatgtctcgcaaggagttagaaaaccaggttggcagcctgaaagagcagcatcttcgagatagtgccgacctgaagacacttttgtcaaaggctgaaaaccaggccaaagatgtccagaaagaatacgaaaaaacccagaccgtcctctccgagctgaagctcaaatttgagatgactgaacaggaaaagcaaagcatcaccgacgaattgaaacaatgcaaaaacaatctgaagctgctccgcgaaaaggggaacaacaagccgtggccctggatgccaatgttagctgcactggtggcagtgacagcaatagtactttacgtgccagggcttgccagagctagcccttag

SEQ ID NO: 53719 - DNA, 1356 bp, Artificial Sequence
  Description of Artificial Sequence: Synthetic coding sequence
atggaggagaaggaacaggagttgcaagctaaaattgaggctctgcaggccgataacgattttacgaacgagaggctcaccgccctgcaggaaaatcaaacccgagctaaggaatcggatttttcagacacactgagccccagcaaagagaagagctcagatgacactacggatgcacagatggacgaacaggaccttaacgagcccctggccaaagtgagcctgctaaaagacgacttgcagggggcacaaagtgagatagaggcgaagcaagagattcagcaccttcgcaaggagctgattgaagcacaggagctggcgcgaactagcaagcagaaatgcttcgagctccaggcattattggaagaggagcggaaagcgtaccgaaatcaggtcgaggagagcactaaacagatccaggtcttgcaagcccagctgcaaagacttcacatcgatactgagaacttgagagaggagaaggactcagagattaccagcaccagggatgagttgttgtctgctcgggatgagattctgctactccaccaggccgcagctaaagtggccagcgagcgcgacaccgacatcgcttctcttcaagaagaactgaaaaaggttagggcagagctggagaggtggaggaaggccgctagtgagtatgagaaggagatcacctctctccaaaactcgtttcaattgagatgtcaacaatgtgaagaccagcaacgtgaggaagctacacgcctgcagggtgaactggaaaaattgcgaaaagaatggaatgcgctggagaccgagtgccatagtctcaagagggagaatgtcctgctgagtagcgagcttcaaagacaggaaaaggaactacataacagtcaaaagcagtccttggagttgacttcggatctgtccattctacaaatgtcccgtaaggaactggagaaccaggttggaagcctaaaagaacagcacttaagggactcagccgacctgaagacactgctgagcaaggccgaaaatcaggcgaaggacgtacagaaggaatacgagaaaacacagaccgtgctctccgaactgaagctcaaattcgagatgacggaacaagagaagcagtctatcactgacgaacttaaacagtgtaagaacaatcttaagctcctccgggaaaaaggtaataaccctagtatcctccaacctgtgccacggatccatcgaccgatccccggatttcctgttttggtgtttcggtcaatcgtggtggagcagaaaccatggccttggatgcctatgctggccgcactcgttgctgtgaccgctattgtactttatgtgcctggcctggcccgagcttctccctag

SEQ ID NO: 53720 - DNA, 2427 bp, Artificial Sequence
  Description of Artificial Sequence: Synthetic coding sequence
atggccggaaccgttgtgctggatgacgttgagctgcgtgaggctcagagggactacctggatttcctagacgacgaagaagatcagggcatctatcagtcaaaggtacgcgagctcataagtgacaaccagtaccgcctaatcgtgaacgttaacgacttgcgacgtaaaaacgaaaagcgtgccaatcgcctcttgaacaacgcctttgaagagctcgttgctttccagcgtgcactgaaggactttgtcgctagtatagatgcgacttacgctaaacagtatgaggagttttacgtaggcctggaggggtcttttggctctaagcacgttagcccaagaaccctgactagctgttttctgtcttgtgtggtgtgtgtagagggaatagtcactaaatgttcattggtccggcctaaagtggtgcgctccgtccactattgcccagcgacaaaaaaaacaattgagaggcgctacagtgatctcactacactggtggcatttccttcaagctctgtatatccaacgaaggacgaagaaaataacccactggagaccgagtacggcctgtcagtttacaaggaccaccaaacaatcacgatccaagaaatgcccgaaaaggcccctgcgggtcagctccccagatctgtggatgtcatcctggatgacgacctggttgacaaagctaaaccaggagacagggtccaggttgttgggacttaccgatgcctgcctggtaaaaaagggggttatacttccggcacgttccggacggtcctaattgcctgtaatgtgaagcaaatgtccaaggacgcacagccctctttcagtgccgaagatatcgctaaaattaagaaattctcaaaaaccagatcaaaggatatcttcgatcaactggccaaaagtctagccccatcgatacacggacacgactacgtgaagaaggcaatcctttgtctcctcttgggaggggtagaaagggatctcgaaaatggtagtcacatccgcggagacatcaacattcttctcattggcgacccttctgtggctaaatcccagttgcttaggtacgtgctgtgcaccgcccctagagcaatccctacaaccggtcgcggatcttcgggggtgggattgaccgcagccgtgaccaccgaccaggagacaggggagcgccgactggaagctggggcaatggtgttggccgaccggggtgtggtatgcatcgatgaatttgacaaaatgtccgatatggacagaacagcgatccatgaggtgatggagcaaggcagagtcaccattgctaaagcaggcatccacgctcgtctgaatgcgcgatgctcagtactcgccgctgccaatcctgtgtacgggaggtacgatcagtacaaaactcctatggaaaatatagggttacaggatagcctgttatctagattcgatcttctcttcattatgctagatcagatggatccagaacaggaccgggaaatttccgatcacgttcttagaatgcatagatatcgcgctcccggagagcaggacggggacgctatgccattgggtagtgccgtggacatcctagccaccgacgaccccaactttagccaagaggaccagcaggatactcagatatacgaaaagcatgacaatctactccatggaaccaagaagaagaaagagaaaatggtctccgctgcctttatgaaaaagtacatccacgtggcaaaaattatcaaacctgtactcacacaggagagcgccacatacattgccgaagaatactccagattgcgaagtcaggactcaatgagctccgatactgccagaactagtccagtaaccgcaagaactctggagaccttgattagattggcgacagcccacgctaaggccagaatgtctaagacagtggacttgcaggacgccgaagaagctgtagaattggttcagtacgcatattttaagaaagtcctggaaaaggagaaaaaacgaaagaagaggtccgaggatgaaagtgagaccgaggacgaggaggagaagagccaagaggatcaggagcagaagcgtaagaggcggaagacccgccaacccgatgccaaggacggtgacagttacgacccttacgatttcagtgatacggaagaagagatgccccaagtgcacacacctaagacagcagattcccaggaaacgaaggagtcacaaaaagttgagcttagtgagtctaggttaaaagctttcaaagtagctctgctggatgtcttcagggaagcacatgctcaaagcatcggtatgaaccgcctgacagagtccatcaacagggactccgaggaaccgttctctagcgtcgaaattcaggcagcattgagcaaaatgcaggacgataatcaggtcatggtgtccgagggaattatcttcttaatttag

SEQ ID NO: 53721 - DNA, 351 bp, Artificial Sequence
  Description of Artificial Sequence: Synthetic coding sequence
atgcttgaagctgctcagccccaaggaagtacttcagaaactccctggaacacagcaattcccctcccatcttgctgggatcagagctttctcaccaacattacctttctcaaagtcctcctttggctcgtcctgctgggcctcttcgtggagctcgaattcggactcgcctacttcgtgctgtcacttttttattggatgtacgtgggaactaggggccctgaggagaaaaaagaaggagaaaagtcagcttactctgtgtttaatcccggttgcgaagcaatccagggtaccctgacagccgagcagctcgaacgagagcttcagctccgcccactggccggaagatag

SEQ ID NO: 53722 - DNA, 1074 bp, Artificial Sequence
  Description of Artificial Sequence: Synthetic coding sequence
atggagaacaaggcaatgtaccttcacaccgtcagcgattgtgacacttcatcaatttgcgaggacagcttcgacggacggtcactgtcaaagctgaatctctgcgaggatgtatccaggcccaggagctccccagatgacctgaaggcattgacacggaacgtgaacaggttgaatgagtcctttagagatctgcagctgaggctcctgcaggcacctcttcaggccgatctgacagagcaggtgtggaaagtgcaggacgctctgcaaaaccagagtgattctctgctggctttggccggtgcggttcagagactggagggtgctctgtggggactccaagcgcaggccgtgcagaccgaacaggccgtcgccctcctgcgggaccgaaccggtcaacaaagtgacacggctcaactcgagctgtatcagcttcaggtcgaatcgaattcatcccaactgcttctgcggagacacgctggcctacttgatggtcttgctagacgcgtggggatccttggggaagagttggccgacgttggcggagtcctgagggggctgaatcattcgctgtcttacgacgtcgcccttcatcgcacgcggctgcaggatctgagggttctggtgtcaaatgccagtgaggacacacgcagactacgactcgctcacgtgggaatggagctacagctgaagcaggagctggccatgctcaatgcagtgacagaagacctgaggctgaaggactgggaacatagcatagcgctgcggaacatttcactggccaaaggcccaccaggacccaaaggggatcagggggatgagggtaaggagggacgccctggtatccccggactgccagggcttcgcggactgcctggtgaaagaggcacgcctggcttacccggacctaaaggcgacgatggcaaactgggtgcgacagggccaatgggaatgcgcggatttaagggggataggggaccaaaaggtgaaaagggagaaaaaggcgacagagctggagatgccagcaaggacattcttctgggaccatgggacatggtgctggcacagggctag

SEQ ID NO: 53723 - DNA, 1488 bp, Artificial Sequence
  Description of Artificial Sequence: Synthetic coding sequence
atggaaaacaaggctatgtacctgcacactgttagcgactgcgatacgtcatccatctgcgaagatagcttcgacggacggtcgctctcaaagctgaacttatgcgaggatggcccatgccacaaaaggagagcctctatctgctgtacccaactcggaagtctcagcgcccttaagcatgcagtgctcggcctttacctgctggtatttctgatcctggtcggcattttcatcctggctgtgtcgcggcctcgttctagtcctgacgatctgaaagctctaactagaaatgttaaccgcctgaatgagagtttccgcgacctgcagctccgactgctgcaagcaccccttcaggccgacttgaccgaacaggtatggaaagtgcaagacgccttacagaaccagtcagattccctcctggccctggcaggcgctgttcaaaggctagagggggcactatggggacttcaagcacaggcagtgcagaccgaacaggccgtggcactgttgagagaccgtacagggcagcagtctgacaccgcacaactggaactgtatcagcttcaggtagagagcaattcatcacagctgcttctgaggaggcacgctggcctgctcgatggactcgctcgtcgcgtaggaatactgggagaagaactcgccgacgtggggggtgtgcttcgcggtctaaaccacagcctctcatatgatgtcgcactgcaccgaactagactccaagatcttagagttctggtctcaaacgcctccgaggacacacggaggctcaggttggcacatgtcgggatggagttacaattgaagcaggagctagcgatgctgaatgctgttaccgaagacctcaggctcaaagattgggaacattctattgcacttagaaacatctccctggctaaagggcctccagggcctaagggcgatcagggggacgaggggaaagagggcaggcccggtattcctggcctgcctgggctccggggactgcccggtgagcggggaactccgggactgcccggtccgaagggcgatgatggaaagttaggagcaaccgggccaatgggcatgcgcggttttaaaggggaccggggtccaaagggagagaaaggcgaaaagggagaccgcgctggtgatgccagcggtgtggaagccccaatgatgattagactcgttaacggttctggtccacacgagggaagagtggaggtttaccatgaccggagatggggaactgtctgtgacgacggatgggataagaaggacggggacgtggtgtgcaggatgctggggttccgaggcgtggaggaggtgtatcgcacagcacggttcggacagggaaccggcaggatctggatggacgatgtcgcttgtaaaggaaccgaagagactatcttccgttgcagtttctctaaatggggcgtcacaaactgtgggcacgccgaagacgccagcgttacctgtaacagacattag

SEQ ID NO: 53724 - DNA, 813 bp, Artificial Sequence
  Description of Artificial Sequence: Synthetic coding sequence
atggaaaataaagcaatgtatctgcacacagtgtccgactgcgatacatctagtatttgcgaagactcgtttgatgggaggtccctttcaaagctgaatctttgtgaagacggcccttgtcacaagaggcgcgcttccatctgttgcacccaacttggatctctgtctgccctgaaacatgccgtcttaggactatatctcttagtgttccttatacttgtggggatctttatcctcgccggtcctcctggtccgaagggagaccagggggatgagggaaaggaagggagacctggaattcctggtctacctgggctccgtggactaccaggtgagcgagggacccccggactgcctgggccaaagggagacgacggaaagctaggcgcaaccggccctatgggaatgcgcggttttaagggggaccgcggtcctaagggggaaaaaggcgagaagggcgaccgggcaggggatgcctctggggtggaagcccctatgatgattagactggttaatggaagtggccctcatgagggtagagtagaggtctatcacgatcgacgttggggaacggtttgcgatgatggctgggacaaaaaggatggggatgtagtttgtaggatgctcgggttcaggggagtcgaggaggtatatcgtactgctagatttgggcaaggcacaggcagaatttggatggatgacgtcgcctgtaagggaaccgaagagacaatcttcaggtgctcgttttccaagtggggagtaactaattgcgggcacgcagaggatgcgtccgtgacgtgcaatagacattag

SEQ ID NO: 53725 - DNA, 1074 bp, Artificial Sequence
  Description of Artificial Sequence: Synthetic coding sequence
atggaaaacaaggccatgtacctccacactgtgtctgattgcgacacgagcagtatctgtgaggacagttttgatgggagatctttaagcaaactgaatctgtgtgaggatgtctctcggccacgcagctcccccgacgatttgaaggcactgactcgcaacgtaaaccggctgaacgaatccttcagagacctacagctaagattgctgcaagctccactgcaagcggacttgaccgagcaagtgtggaaagtacaggacgccctgcagaaccagtccgattccctcctggctttggcaggcgctgtacagcgcctagaaggagccctgtggggtctgcaagctcaggccgtgcagaccgagcaggctgtcgctctcttaagagacagaactggtcagcagtctgacacagcccaactggaactgtaccagctccaggtggagtccaattcgtctcaactgcttttaaggcggcatgctgggctgctcgacggccttgctcgccgtgttggtatcctgggcgaagaattagccgacgtgggaggagtgcttaggggactgaatcattctttgtcctatgacgttgccctgcaccgcacacgcctccaggacttacgggtgctggtgtctaacgcatcggaggatactcgtaggctgagactggcccatgtcgggatggagctgcagcttaaacaagagctggccatgctaaatgcagtcacggaggatctacggttaaaggattgggaacactctatcgcactaaggaacatttctctcgccaagggcccacccggaccgaagggagatcagggggacgaaggaaaagaaggacgccctggtattccaggtctgcccggtctgcgaggacttcctggagagcggggtactcccggactacccggtcctaagggcgacgacgggaaactaggagcaactgggcctatgggaatgagagggttcaaaggagacaggggccctaagggtgagaaaggagaaaaaggtgatagagcaggtgacgccagcaaagacatcctactggggccatgggacatggtcttggctcaggggtag

SEQ ID NO: 53726 - DNA, 1203 bp, Artificial Sequence
  Description of Artificial Sequence: Synthetic coding sequence
atggagaacaaggcgatgtatctacatacggtgtcagattgcgacacttcctctatttgtgaggacagctttgacggccgaagcctgtctaagttgaacctttgtgaagacggaccatgccataaaaggcgggcatctatctgctgcacccagcttggctctctctctgctctgaagcacgcagtcctggggctctaccttctggtctttctgattctcgtgggtatattcattttggccgtgtctaggccccgaagcagtcccgatgaccttaaggctctcacccgcaacgtgaacaggctgaacgagtcgttcagggacctgcagttgcggttgctgcaggccccactgcaagcggatttgaccgagcaggtgtggaaagtgcaagatgctctgcagaaccagtccgattcccttctcgccttggccggagctgtgcagaggctggagggcgctctgtgggggcttcaggcgcaagccgtgcagaccgaacaggcagtcgccctactgcgagacagaaccggccagcaatctgacaccgctcagcttgagctgtaccaactgcaagttgaatcaaatagcagccagctgctgctgaggcgccacgcaggccttctggacggcctggccagacgtgtcggcattctgggggaagagttggcagacgtggggggagtgcttcgtgggctgaaccattcattgtcttatgatgtcgccctgcacagaacaagactgcaggatctgcgcgtgttggtctccaatgcctctgaggatactcgccgactgcgcctggctcacgttggcatggagctccagctgaaacaggagctggcaatgctgaacgccgtcacagaagacctgcggttgaaggactgggaacactccatcgcactaaggaatatttcattggccaaaggccctcccggtcctaagggagaccagggagacgagggaaaagaggggaggcccggaattcccggactccccggactgagaggactcccaggggaaaggggtacacccggtttgcctggcccaaagggcgatgatggcaaactcggcgcaacaggccctatgggtatgcggggtttcaagggggacagagggccaaagggcgaaaagggggaaaaaggggacagagccggagatgcctccaaggacatattgctgggaccatgggacatggtcctcgcgcagggctag

SEQ ID NO: 53727 - DNA, 1002 bp, Artificial Sequence
  Description of Artificial Sequence: Synthetic coding sequence
atggtccacgggaacattacccccgagaacataattcttaacaagagtggggcttggaagatcatgggatttgatttttgtgtttcttctaccaatccgagcgagcaggagcctaaatttccatgcaaagaatgggacccaaatcttccgtccctgtgtctgccaaacccagagtacctggccccagaatacatattgagtgtatcctgtgaaaccgccagtgatatgtactctctggggactgtgatgtacgctgtatttaataagggaaagccaatcttcgaggtgaacaaacaggacatttacaaaagcttctcccgacagctagaccagttatccaggctggggtcgtcctccttgactaatatacccgaagaggtgagagagcatgtgaaactgctgctgaatgtgacaccgaccgtacgccctgacgcagaccagatgactaagatccccttcttcgacgacgtcggagctgtgacactgcagtacttcgacactctgtttcagcgagataacctgcagaagtcacaattcttcaaagggctgcctaaggtgctccccaaacttcctaagcgggtgattgtccaacgcatactgccatgtctaacctccgagttcgtgaaccctgatatggtgccattcgtcctcccaaatgtgcttctaattgccgaagagtgtaccaaggaagaatatgtaaaattgatcctgcctgaactggggcctgtgttcaaacaacaggaacctatacagatcctactgattttcctgcagaaaatggacctgttactgaccaagactcctccagatgagattaagaatagcgtccttcccatggtctacagagcgctggaagcgcctagcatacagatccaagaactgtgtctgaacatcatccccactttcgcgaacttgattgattacccttccatgaaaaacgccctgatcccaaggatcaaaaatgcatgctacaagcacctccccctgcgcttccagcagtag

SEQ ID NO: 53728 - DNA, 2790 bp, Artificial Sequence
  Description of Artificial Sequence: Synthetic coding sequence
atggaatctatgcttaataaactgaagagcactgtgacaaaagtaacagccgacgtgacaagcgcagttatggggaacccagtgaccagggagttcgatgtgggaagacatattgccagtgggggaaacggactggcatggaaaattttcaatgggactaagaaatctacgaagcaggaggtcgccgtgttcgtgtttgacaaaaaactcatcgataagtatcagaaattcgagaaggaccagatcatagacagtctaaaaagaggtgtgcagcaactgacaaggcttagacacccacgattgctgacagtccagcacccccttgaagaaagcagggattgccttgccttttgtacggagcctgtgtttgccagtttggccaatgttttgggcaactgggaaaatttacctagccccatttcacccgacattaaagattacaaactctacgatgttgagacaaaatatgggctcctgcaagttagtgagggcctgtcatttcttcactcttcagtgaagatggtacacggcaacattacacccgaaaatattatccttaataagtccggcgcttggaagatcatgggattcgatttttgcgtctccagtacgaatcccagcgaacaggagcccaagttcccttgtaaggagtgggatcccaacttgccatcactgtgcctccctaaccccgagtacctggctcccgagtatatacttagtgtgagctgtgaaacggcttccgacatgtatagtctgggtacagtgatgtacgctgttttcaacaaagggaagcccatattcgaagtcaataagcaggacatctataaatcattctctcggcagctggatcagttgtcacggttaggatcctcttcacttacaaacatccccgaggaagtccgcgagcacgtgaagcttctgctgaacgttacccctaccgtacggccagacgctgaccaaatgaccaagattccctttttcgacgacgtcggagctgtgacacttcagtactttgacactcttttccaaagagataatcttcagaagagccaattcttcaaagggctccccaaagtcctgcctaaacttccaaaaagggtgatcgtgcaacgaattcttccatgcttgacaagtgagttcgttaaccctgatatggtccccttcgtgctcccaaacgttttgctgatcgctgaggagtgtacaaaggaagaatacgtgaaactaattctccctgagcttggccctgtcttcaaacaacaggagccaatacagatccttttaatctttctccagaaaatggacctccttcttacaaaaacccccccagatgaaatcaaaaactctgtcctgcctatggtctatagagccctcgaggctcccagcatccagattcaggaattgtgtttaaacatcattcctacatttgccaatctgatcgattatccatctatgaagaacgcgctgatcccaagaatcaagaacgcttgcttgcagacctcctctctggctgtccgggttaacagtctagtttgtctcggtaagattctggaatatctagacaagtggtttgttctcgatgatattctgccgttcctgcagcagatccctagcaaagagcccgctgtgttgatgggtattttaggtatctacaagtgcacctttactcacaaaaagctcggaattaccaaagaacagctggccggaaaggtgctaccccaccttatccctctctcaattgagaataacctgaacttgaatcagttcaacagcttcatcagcgtgatcaaagagatgctgaacaggcttgaaagtgaacacaaaactaagttagaacagctccacatcatgcaggaacagcaaaagagtctggacattggaaatcagatgaatgtgagtgaagaaatgaaggtcaccaacatcggcaatcaacaaattgacaaggtgttcaataacatcggagctgacttacttaccggttcggagagcgagaacaaagaggacggattgcagaataagcataaacgcgcttctttgaccctcgaggagaagcagaagttggctaaagagcaagaacaggcccagaaacttaagagccagcaacctctgaagccgcaggtccacacccctgttgctacagtgaaacagaccaaagacctgaccgatactctcatggacaacatgagctctttaacctcacttagcgttagtacacctaagagtagtgcctcctccacatttacttctgtgccaagtatggggatcggtatgatgttcagcacgcccacggataacactaaaagaaatcttaccaacggactgaatgcaaatatgggtttccagacaagtggattcaacatgcctgtgaatactaatcagaacttctactctagcccctctacagtgggtgtgaccaagatgacccttggcactcccccaacactgcccaactttaatgctctgtcagttccgccagccggagccaagcagactcagcaacgcccaacagatatgtccgccctcaacaatctgttcggtcctcagaaacccaaagtctcaatgaaccagttgtcccagcagaagccaaaccagtggctgaatcaattcgtgcccccacagggcagcccaaccatggggtccagcgtcatgggaactcagatgaacgtgatcggtcagagtgcttttgggatgcagggtaatccattctttaatccccagaatttcgcacaacccccaaccaccatgactaacagcagtagtgcctccaacgacctgaaggatctgttcgggtag

SEQ ID NO: 53729 - DNA, 2046 bp, Artificial Sequence
  Description of Artificial Sequence: Synthetic coding sequence
atggagtcgatgctgaataagctgaaatctacggtgaccaaagtcaccgcagatgtgacttcggccgttatgggcaatcctgtgacaagagaattcgatgtgggacggcacattgcttccgggggaaatgggcttgcctggaaaatcttcaatgggaccaagaaaagtactaaacaggaagtggcagttttcgtgttcgacaaaaagcttatcgacaaatatcaaaaatttgaaaaggatcagatcatcgacagtctgaaacggggtgtccagcagctaaccaggttacgccacccacggctcctgaccgtgcaacaccccttagaggaaagcagggactgtctggcattttgcaccgaacccgtgttcgctagcttggccaatgtgctgggtaattgggagaacctgccatcacctatcagtcctgacattaaggactacaaactatacgatgtggagacaaaatacgggttgctccaggtgtccgagggcctatcttttctacactctagcgtaaagatggtccatgggaacataaccccagagaacatcatcttgaacaagtccggagcttggaagatcatgggcttcgacttctgcgtgtcgtccaccaacccttcagagcaggagcccaaattcccatgcaaagagtgggaccctaatctgccgtccctgtgcttgccaaatcctgagtatctggcacccgaatatatactttccgtctcatgcgaaacagcttctgatatgtacagccttggcaccgtaatgtacgccgtgtttaataagggcaaaccgatctttgaggtgaacaagcaggatatctacaagtcattctcccgccaactggaccaattgtctaggctgggttcatcctctctgacaaacatccctgaagaggtgagagaacatgttaagctgttgctcaatgtgacccccaccgtgcgacctgacgccgatcagatgaccaagatcccgttctttgacgacgtcggcgctgtgacactgcaatacttcgacactctgttccaaagggacaacctgcagaaatctcagttctttaagggccttcccaaggtattgccaaaactgcccaagcgcgtgatcgtccaaaggatcctgccctgcctcacgagcgagttcgtcaatcccgatatggttccttttgtgctccctaatgtgctgttgattgccgaagagtgcaccaaggaagaatatgtgaagttgatcctgcctgagttaggcccagttttcaaacagcaagaacctattcagattttgcttatttttctgcagaagatggacttgcttttgaccaagacaccaccagacgagatcaagaatagtgtgcttcctatggtgtatcgggctctggaggcacccagcattcagatccaagagctgtgtcttaacatcatccccactttcgcaaacctcattgactatccatccatgaagaatgccttgatcccccgtattaagaacgcatgcttgcagacgtcgagcctcgccgtgagagtcaattcactcgtctgcctcgggaagattctcgaatatctggataaatggttcgttctcgatgatatcctgccttttcttcaacagatcccctcaaaggagcccgctgtcctcatggggatccttgggatttataagtgcacctttacacacaagaaactgggaattaccaaggagcagctagctggaaaagtcctgccacacctaattccactgagtattgagaacaatcttaacctaaaccaattcaatagcttcatctccgtcatcaaggagatgttgaatcgtctggagtcagagcacaaaaccaagctcgagcagctccatataatgcaggaacagcaaaagagcctggatatcggaaatcaaatgaatgtttcagaggagatgaaggtgacaaacatcgggaatcagcaaattgacaaggtgttcaataacatcggggctgatctcttaaccgggtccgagtctgaaaataaagaggacggactccagaataagcacaaaagagcatccctgaccctggaatag

SEQ ID NO: 53730 - DNA, 1653 bp, Artificial Sequence
  Description of Artificial Sequence: Synthetic coding sequence
atgccgacagaagagaatatcgatagaatgtgccaggatctgaggaaccagttgtatgagtcctattacctgaacttcatctcagccatttcgagaagcaaactcgaagatatcgccaacgccgctctggcagcctctgccgtgactcaagtggccaaagtcttcgaccagtatctcaatttcatcaccctggaggacgacatgttcgtgctatgcaaccaaaataaagagctggtctcatatcgggctataaatcgccctgacatcaccgacacagagatggaaactgtcatggacacgatcgtggacagcctattctgcttcttcgtcacactcggagccgtccctatcatcagatgctcaaggggcacagctgcagaaatggtggctgtgaagctcgacaaaaagctgcgggaaaatctgagagacgcacgcaactccctcttcacaggagacacgctgggcgctggacagtttagcttccaacgaccgttgttagttctggtagacagaaacatcgatctggctactcctctccaccatacctggacctaccaggccctcgtgcacgatgtcctggactttcatctgaatcgggtaaaccttgaggagtcgtccggcgttgaaaactctcctgccggtgctaggcccaagagaaagaacaaaaagagctacgatctgactcccgtggataaattctggcaaaagcataaaggttctccgtttccggaagtcgccgagagcgtacagcaggaactggagtcttatcgagcccaggaggacgaagtgaagagactcaaatctatcatggggctggagggcgaggacgaaggcgctatttcaatgctatccgacaacaccgcaaaactcactagcgccgtgtcctctcttcccgagctactggagaagaaaagactgattgatctgcacacaaatgtggctaccgctgtgctagaacacatcaaagctagaaagctcgacgtgtattttgagtacgaggagaagattatgagtaagaccaccctggacaagagcctgctggacatcatatctgatccagatgcgggaactcctgaggacaagatgagactttttctgatctactatattagtacacagcaagccccatctgaggccgacttggagcagtacaaaaaggccctgacagacgccggttgcaatcttaaccctctgcagtacatcaagcagtggaaagctttcactaagatggcctccgcccctgcctcctatgggtctacaaccactaaacccatgggccttttgagtcgagttatgaacactggaagccagttcgtgatggaaggcgtgaaaaatctggtcctcaagcagcaaaacctacctgtaacacgcatcctggataacttgatggagatgaaaagcaaccctgaaacagacgattacaggtactttgaccccaaaatgctgcgcggaaacgactccagtgtgccaagaaataagaaccccttccaggaagccattgtttttgttgtagggggtggcaattatatagagtatcaaaacctcgtggactacataaaaggaaagcagggcaagcatatactatatgggtgtagcgagctcttcaacgcaactcaattcattaaacagttatcccagttaggtcagaaatag

SEQ ID NO: 53731 - DNA, 1752 bp, Artificial Sequence
  Description of Artificial Sequence: Synthetic coding sequence
atgtgtctcatccttaagacggcgcaagagaatcagtacggcagactcctgcactcggacagagatcccataccagacgtgcctgccgtctacttcgtgatgcccaccgaagagaacattgataggatgtgtcaagatttaaggaatcagttatatgagtcttactacctgaatttcatctccgcgatttccagatcgaagcttgaagacatcgcaaatgcagctctggccgctagcgcagtcacacaggtagcgaaggttttcgaccagtacctgaattttattactcttgaagacgacatgttcgtactttgtaatcaaaataaagagctggtcagctacagggctatcaaccgcccagacatcactgacaccgagatggagaccgttatggatactatcgtggactccctgttttgcttttttgttacgcttggggcagtcccaataatccgctgctcccgcggaaccgcagccgagatggtggccgttaaattagacaagaaacttagagagaatctcagagacgcccgaaactccctgtttactggcgacacactaggcgctggacaattcagcttccaacggccactgctggtgctggtcgatcggaacatcgacctggcgactcccctgcaccacacttggacataccaagctttggtgcatgatgtgctggatttccatttgaaccgcgtgaaccttgaggaaagttccggcgttgaaaactctcctgctggggctagacccaagcggaagaataagaaatcttatgacctgacccctgtggataagttctggcagaagcataaggggtctccgttcccagaggtggccgaaagcgtacagcaggagctggagtcgtatcgggctcaggaggatgaggtcaagcgactaaagtctatcatgggactcgaaggtgaagatgagggcgcaatcagcatgctgtctgataataccgccaaactaacctccgccgtctcttcactaccagaattgctggaaaagaaacggctcatcgatctgcacacgaacgtggccacggctgtcctggagcacattaaagcgagaaagttggatgtatacttcgagtacgaggagaagattatgtcgaagacgaccctggataaaagtctgctcgacattatcagtgatcccgacgccggaaccccggaggacaagatgcggctttttctgatttattacatctcaacccagcaggcaccgagcgaagccgacctcgagcaatacaagaaagccttgacagacgcagggtgtaatctcaaccctcttcagtatataaagcagtggaaggcgtttacgaagatggcctcagcccctgcctcatacggctcgactaccacaaagcccatgggtctgctttctcgggtgatgaacacggggtcccagtttgtcatggaaggagtgaagaacctggtactgaaacagcaaaaccttccagtgactcgcattctggacaacttgatggaaatgaagtccaatccagagacagacgattacaggtattttgacccaaaaatgctccggggaaacgacagcagcgtgcccaggaacaaaaatccattccaggaggctattgtcttcgtggttgggggaggcaattacatcgaatatcaaaacttagtggactacattaagggaaaacagggaaagcacatcctgtatggctgttcggagctgttcaacgcgacgcagttcatcaagcagctctctcagctaggccaaaagtag

SEQ ID NO: 53732 - DNA, 1929 bp, Artificial Sequence
  Description of Artificial Sequence: Synthetic coding sequence
atggctgctgccgctgcagccactgccgcagcagcggcttccatcagggaacgacaaacggtggcgctgaaacggatgctaaattttaatgtgcctcatatcaagaactctacaggggaacccgtgtggaaggtgctgatttacgatcggtttggccaggacataatcagtcctctattgtccgtcaaggagcttagggacatggggattacccttcaccttctcctgcacagcgacagggaccccataccagacgtgcctgcagtctatttcgttatgccaaccgaggaaaacatagatcggatgtgtcaagatttaaggaaccagctgtacgagtcgtactacttgaactttatttctgccattagtcggtctaagcttgaagacattgctaacgctgccctggctgcttccgcagtgacgcaggttgcgaaggtgtttgatcaatacctaaacttcataacattggaggatgacatgttcgtgttatgtaaccagaataaagaactcgtgtcttaccgtgcaatcaacagaccagatataactgataccgaaatggaaaccgttatggacaccattgtggattccctcttctgttttttcgtgacgctgggtgctgttccaattattaggtgctcccgtgggaccgcagccgaaatggttgccgtcaagctggataagaagctgcgcgagaacctgagggacgccaggaactccctcttcacgggcgatacactcggggcaggacaatttagctttcagcgacccctgttggttctcgttgatagaaatattgatctcgctacgccactacatcacacctggacctatcaggctctcgtccatgatgtgttagacttccatctgaatcgggtgaacctcgaggaatccagcggtgtggaaaactcccctgccggagcgaggccaaaaagaaaaaataaaaagtcatatgacctgacccctgttgataaattttggcagaagcacaaaggatcaccctttccagaggtggctgagtcagtgcagcaggaattggagagttatagagcccaggaagacgaggtgaaaaggctcaagagcatcatgggccttgagggcgaggacgaaggggctattagtatgctgtctgacaacacagctaagcttactagcgcagtgagtagtctgccagagttgttggagaagaagcggctgatagatctgcacacaaatgtggcaactgctgtgctcgagcacatcaaagctcgtaagcttgatgtttacttcgagtacgaggaaaaaattatgagtaaaaccacccttgacaagagcctgttggatattatttctgacccggatgccggtaccccggaggataaaatgaggctattccttatttattacattagcacgcagcaagccccatctgaagcggacctggaacaatacaaaaaagcactgaccgacgctggatgtaatcttaacccactacagtatattaagcagtggaaagctttcaccaagatggcgagcgctcccgcaagctatggctccacaaccacaaaacccatgggtctcctttcccgcgtcatgaacacgggctcacaattcgtgatggagggggtgaaaaacctggtccttaagcaacagaacctcccagtgacacggatactcgataacctaatggaaatgaaatcaaatcccgagaccgacgactatcgctacttcgaccccaaaatgctgcgcggaaacgactcttctgtgccgagaaacaagaaccccttccaggaggccattgtatttgtggtcggcggaggtaactacatagagtatcagaatctcgtggattacattaaaggtaaacaggggaaacacatcttgtacggctgtagcgagttgttcaacgccacgcagtttataaagcaactcagtcagctcggacagaaatag

SEQ ID NO: 53733 - DNA, 1374 bp, Artificial Sequence
  Description of Artificial Sequence: Synthetic coding sequence
atggaaaccgtcatggacaccattgtggattcgctcttttgctttttcgttactctaggcgctgtgcccattatacgctgtagccgaggcaccgcagcagaaatggtcgcagtgaaattggataagaagcttcgcgagaacttacgcgatgccaggaactcactatttactggcgacactctcggggctggtcaattttcatttcagagacctcttctggtgttggtggaccgcaacatcgatctcgcaacccccctccaccacacttggacataccaggcattagttcacgatgttctcgactttcacttgaacagggtcaatctggaagagagttcaggggtggagaattcacccgcaggagctcggcctaaaagaaagaataaaaagagctacgacctcaccccagtcgataagttttggcagaaacataagggttcacctttccccgaagtcgcggagagcgtgcagcaggagttagagagctaccgggcacaggaggatgaagtaaaacgtctcaagtccattatgggcctcgaaggggaagacgaaggcgctatatccatgctcagcgacaacacagctaagctcaccagcgcggtcagtagcctgcctgaactgctggagaaaaagcgtctgattgacttgcataccaacgtggcaactgccgtcttagagcacattaaggctcggaaattggacgtgtactttgagtacgaagaaaaaattatgtccaagacgacactcgataagtctcttcttgatatcattagcgaccccgatgcaggaacccctgaagataagatgaggttattcctcatttactatataagcacccagcaggcacccagcgaagcagacctcgaacaatacaaaaaagccctaaccgatgcaggttgtaatctgaacccactgcaatacatcaaacagtggaaagcctttactaaaatggcatccgcacccgctagttatggctccacaaccacaaaacccatgggactgctgtctcgggtcatgaacactggcagccagttcgttatggagggcgttaaaaacctggtgctaaagcagcagaacctccctgtgacccgaatactggacaatctaatggagatgaaaagcaatcctgagacggatgactaccgttattttgaccctaagatgttgagaggcaacgattcctccgtgcccaggaacaagaacccctttcaggaggcaattgtgtttgtcgtcggcggtggcaattatatagagtaccagaatctggtcgattacataaagggcaaacagggaaagcatatcctctacggctgttcagaactgtttaatgcaactcagttcattaaacagttgtcccagctcggtcagaagtag

SEQ ID NO: 53734 - DNA, 1728 bp, Artificial Sequence
  Description of Artificial Sequence: Synthetic coding sequence
atggggatcaccttacacttgctcctacactcagatcgcgatccaataccagatgtgcccgctgtctatttcgtcatgcccacggaagaaaacattgacagaatgtgccaggatctgcgcaaccaattatacgagtcttattacctgaatttcatctccgctatctctcggagcaaactggaggacatagccaatgcagctctggctgccagcgccgtcacacaggtggctaaagtcttcgatcagtatctcaacttcattacattagaagatgacatgtttgtactttgcaaccagaataaagagctagtgtcataccgggcaattaaccgcccagatataaccgatacagagatggagacggtgatggataccatcgttgatagcctattttgttttttcgtgacacttggcgcagtgcctattattcgctgctctcgcggtacagccgctgaaatggtggctgtgaaattagataaaaaactacgcgagaatctcagggacgccaggaattccttgttcacgggcgatactctgggagcaggacagttctcttttcaacgacccctgttggtgttggtggacagaaacatcgacctggctacacccctccaccacacttggacgtaccaggcgctagttcacgatgttttagatttccatctcaatagagtcaacctcgaggaatcttcgggcgttgaaaattctccggcaggcgctagacctaagagaaaaaataaaaagagctatgatttgacaccagtagataagttctggcagaaacataagggaagtccatttcctgaagtcgccgaatcggtccagcaggaactcgaatcttaccgggctcaggaggatgaggtcaaaagactgaaatcgatcatggggttagaaggggaggatgagggcgcaatttccatgctgtctgacaatacagctaaactgacttcggctgtgagctccctgcctgaattactagagaagaaacgcctcatcgacctgcataccaacgtggctacagctgttttagaacacatcaaggcccgaaagctggacgtctacttcgaatatgaggagaagattatgtcgaagacgactctggataagagtctgctagacatcatatctgatcctgacgctggcacacctgaagacaagatgcgcctttttttgatctactatattagcacgcaacaagcaccatctgaagcggacctcgagcagtacaagaaggcgctcactgacgctgggtgcaaccttaatcctctgcagtacatcaaacagtggaaagcttttactaaaatggcctccgccccagcctcttacgggtccacaactacaaaacccatgggactattgtctagggtcatgaatacaggctcccagtttgtgatggaaggagttaagaacctggtactgaagcagcagaatctccctgtgacacgaatcttagacaacttgatggaaatgaaaagcaatccggaaaccgacgattataggtacttcgacccgaagatgctgagaggcaatgactcgagcgtgccaaggaacaaaaatccctttcaggaagctattgtcttcgtggtgggagggggtaattatatcgaatatcagaacctggtcgactatattaaaggcaagcagggtaaacacatactgtacggttgctctgagctgttcaatgccacccaatttatcaagcagctctcccagcttggtcaaaagtag

SEQ ID NO: 53735 - DNA, 540 bp, Artificial Sequence
  Description of Artificial Sequence: Synthetic coding sequence
atgctgagtctagacttcttagatgacgtccggaggatgaacaagagacagctatactatcaggtgcttaattttggtatgatagtaagtagcgccctcatgatttggaagggtctaatggttataacaggctctgaatccccaatagtcgtggtcctctccggtagtatggagccagcctttcataggggtgacttattattcctgaccaatcgggtggaggacccaatccgagttggcgagattgtcgtgttccgcatagagggcagggaaatccccatcgtccatcgtgtattgaaaatccatgaaaagcaaaacggacacatcaaatttcttaccaaaggcgataataacgccgtggatgaccgtggtctctataaacaggggcagcattggcttgaaaaaaaggatgtcgtaggacgcgcaagggggtttgtcccgtacattggcatcgtgacaatcttgatgaatgactatcccaagtttaaatacgcagtgcttttcctcctgggcctattcgtgttggtgcaccgggagtag

SEQ ID NO: 53736 - DNA, 462 bp, Artificial Sequence
  Description of Artificial Sequence: Synthetic coding sequence
atgattgtcagctcagcgctgatgatatggaagggactcatggttataaccggcagcgagagccctattgttgtcgtgttgtctgggtccatggagccggcttttcacagaggggacctcctgttcctaactaatagggtcgaggaccctatcagggtcggcgagatagttgtgtttagaatagaagggagggaaatcccaatcgtgcatagggttctgaaaattcacgaaaagcagaatggacacataaagttcctgacgaaaggcgacaacaacgccgtggacgatagaggtctttacaagcagggccaacattggctcgaaaaaaaggacgtggtcggtagagcgaggggattcgtgccatatattggcatcgttactatcctaatgaatgactatccaaaatttaagtacgccgtgctctttctgctgggcctctttgttctcgtacatcgagaatag

SEQ ID NO: 53737 - DNA, 579 bp, Artificial Sequence
  Description of Artificial Sequence: Synthetic coding sequence
atggtgagagctggggctgttggagctcacctacccgctagtggcctggatatttttggcgacctaaaaaagatgaacaagcggcaactatactatcaggtgcttaacttcgccatgatagtttccagtgcactgatgatctggaaggggctcattgtactgaccggcagtgagagcccaattgtggttgtcctaagtggaagcatggaaccggcattccaccgtggggacctcctcttccttactaattttagagaagacccaatcagggccggagaaattgtggtttttaaggttgagggtcgtgatatccctattgtgcaccgcgtcatcaaggtgcacgaaaaggataatggcgacattaaatttctcaccaagggcgacaataacgaggtagatgataggggtctctataaagaaggtcagaattggctggaaaagaaggatgtggtgggtcgggcaagaggattcctcccctacgtgggcatggtcactatcatcatgaatgattaccctaagttcaagtacgccctgcttgcggtgatgggggcatacgtcctactaaagcgggagtcatag

SEQ ID NO: 53738 - DNA, 471 bp, Artificial Sequence
  Description of Artificial Sequence: Synthetic coding sequence
atggtacgcgctggcgctgtgggagcacatctgccagcttcaggtctcgatatcttcggtgacctcaaaaaaatgaataaacgtcagctctattaccaggtactcaatttcgccatgatcgtttcatctgccctgatgatctggaaagggctgatcgttctgaccggtagcgaatcccccattgtcgtggtgctcagtggatccatggagcccgcatttcacagaggcgatttgttgtttttgacaaacttcagggaggatcctattcgcgcaggggagattgttgtttttaaagttgagggcagggatatccctatcgtgcatcgggtcatcaaggtccacgagaaagacaatggcgatatcaagttcttaaccaaaggagataataacgaagtcgacgaccgcggactatataaggagggtcagaattggctcgaaaagaaggacgtggtgggcagggccagggggtag

SEQ ID NO: 53739 - DNA, 579 bp, Artificial Sequence
  Description of Artificial Sequence: Synthetic coding sequence
atggtgcgggcaggcgcagtgggcgcacacttgccggcaagcggcctggatatcttcggagatctgaaaaaaatgaataaacgccagttgtactatcaggtcctcaatttcgccatgatcgtctccagcgccctgatgatatggaaaggcctcatcgtgctgaccgggagtgaatctccaattgtagtagtccttagcggaagcatggaaccggcttttcacaggggtgacttgcttttcttgaccaattttagggaggaccccattcgggctggagaaatagtggtgtttaaggtggaaggtcgcgacatccctatcgttcacagggtcattaaggtgcatgagaaggacaatggagacattaagtttctgaccaaaggtgataacaacgaggtggatgatcggggattgtacaaagaaggccaaaactggctcgagaaaaaagatgtggttggtcgagctcgcggattcctgccgtatgtgggtatggtcaccataattatgaacgattaccctaagttcaagtatgcactattagccgtgatgggagcatatgttctgcttaaaagggagtcttag

SEQ ID NO: 53740 - DNA, 2091 bp, Artificial Sequence
  Description of Artificial Sequence: Synthetic coding sequence
atggaagcctccgtgatcctgcctatactgaagaagaaactggccttcctgtccggcggaaaggacaggcgcagcggtttgatcctgaccatacctctgtgtctagaacaaacaaatatggatgaactcagcgtgaccctggattacttactgtccataccctccgaaaaatgcaaagccaggggctttaccgtgatcgtggacggcagaaagtcgcagtggaacgtggtgaagactgtagtggtcatgcttcaaaacgtggtgcctgcagaggtctccctggtgtgcgtggtcaaacctgacgaattttgggacaagaaagtgacacatttctgcttttggaaagaaaaagatagacttggattcgaagttattctagtgtctgcgaacaagctgacccgctacatcgaaccctgtcaattaacagaagacttcggtggctcgctcacctatgaccacatggactggttaaataaaaggctggtgttcgagaaattcaccaaggagagcacaagccttcttgatgaactggctctgatcaacaacggttcggacaaaggcaaccaacaggagaaagagcggtcagtcgacctcaatttcttgcctagcgtcgaccccgaaaccgtgctgcaaactgggcatgagctgcttagtgagctgcagcaaagacggtttaacggatcagatgggggagtgagctggtctccaatggacgatgagttactcgcacagccccaggtgatgaagcttctagactctctgagggaacagtatacacggtaccaggaagtatgtagacagcgttctaagaggacacagttagaagaaatccagcagaaggtgatgcaggttgtaaattggctggaggggcctggcagcgagcagctcagagcgcagtggggcattggagattccatcagggccagccaggctcttcagcaaaaacacgaggaaatagagagccagcattcagaatggttcgccgtgtatgtagagctgaatcagcagatcgcggctctccttaatgcgggtgatgaagaggaccttgtggaactgaagtccttgcagcagcagttgagcgacgtttgttaccggcaggcctcccagctggaattccgccagaatctattgcaggctgcattagaatttcatggcgttgctcaggatctgtcacagcagctagacgggcttctgggcatgctgtgcgtggacgtggcccctgcagacggggcttcaatccagcagaccttgaagttgctggaggagaagttgaagagtgttgatgtgggactccagggcctccgcgagaaaggccagggcctgctggaccagatatcaaaccaggctagttgggcgtacggaaaggacgtcaccattgaaaacaaggagaacgtcgaccacatccagggtgtgatggaggacatgcaattacggaagcagaggtgcgaagacatggtggacgtgaggcgcctcaagatgctgcagatggtgcagctgtttaagtgtgaggaggatgccgcacaggccgtggaatggctctcagagctcctggacgcattacttaagactcacatcagactgggtgatgatgctcaggagacaaaggttctcctggaaaaacaccgcaaattcgtggatgtggcacaaagtacatacgactacggacggcagctccttcaggcgaccgttgttctatgccagagcctacgttgtacatcaaggagtagcggggataccctgccacgcttgaaccgcgtgtggaaacagttcacaatcgcctcggaggagagagtccaccggctggaaatggctatagcgttccactccaacgccgagaaaatcctgcaagattgcccggaagaacctgaggccatcaatgacgaggagcagttcgatgagatcgaggctgtggggaaatccctgttggatcgtttaaccgtccccgtggtgtatccagatggaacagagcagtattttggctccccctctgatatggcttctacagctgaaaatattagggaccgcatgaaactggtcaatctgaaacggcagcagctgagacatcccgaaatggtgacgactgagtcttag

SEQ ID NO: 53741 - DNA, 432 bp, Artificial Sequence
  Description of Artificial Sequence: Synthetic coding sequence
atggaggcatcggtgatcctgccaattctgaagaaaaagctggcttttttgtctggcggtaaggatcgccgtagcggtctaattttgacgatcccactttgccttgagcaaaccaatatggatgagttgagcgttaccctagactatctcctcagcattcccagtgagaagtgcaaagccaggggcttcacagtgattgtggacggcaggaagagtcaatggaatgtagtaaaaacagttgtggtaatgcttcagaatgtcgtgcccgctgaagtgagtttagtgtgcgtggtgaaaccggacgagttttgggacaaaaaagttactcacttctgcttttggaaggagaaggacagactggggtttgaagtgatcttagtgtccgctaacaagctcacgagatatatcgagccatgtcagttgacggaatag

SEQ ID NO: 53742 - DNA, 441 bp, Artificial Sequence
  Description of Artificial Sequence: Synthetic coding sequence
atggaagcctccgtgattctgccgattctcaaaaagaaactggcatttctgtccggcggaaaagacaggcggtcaggactgatcctgacaatccccttgtgcctggagcaaacaaacatggatgagttgtccgtaactcttgattacctgctatccatcccctcagaaaagtgcaaagctcgaggcttcacagtgatcgtggacggtcgtaagtcccagtggaatgtggtcaagacagtggttgtcatgctccagaatgtggttccagctgaggtgtcactggtctgtgtcgtaaaaccagacgaattttgggataaaaaggtgacacacttctgtttttggaaggaaaaggatagattggggtttgaggtgatcctagtttccgccaataagcttacaagatatatagagccctgccagctcacggaagactttggatag

SEQ ID NO: 53743 - DNA, 2160 bp, Artificial Sequence
  Description of Artificial Sequence: Synthetic coding sequence
atggtgcagaagtatcaatctcccgtgagagtctacaagtacccctttgaattaatcatggccgcttatgagcgacgctttcccacttgtcctctgattccaatgttcgtcgggagcgatactgtaaacgaattcaagtccgaagacggtgcgattcatgtcatcgaacggagatgcaaactggacgtcgacgctccacgccttcttaaaaagatcgctggcgtggactatgtgtacttcgtgcaaaagaacagcctgaatagcagagaaaggacactgcatattgaagcatacaacgaaacatttagcaatcgtgtcatcattaacgagcactgttgctataccgttcaccccgaaaatgaggattggacctgcttcgagcagtcagcatcccttgacattaagagcttctttgggttcgagagcacggtggagaaaattgctatgaagcagtacacttctaatattaaaaaaggaaaggaaatcatcgagtactatcttagacagttggaggaggagggtatcacttttgtgccacggtggtcccctccctcaattacgacgtctagcgagacaagtagttcctccagcaagaagcaggccgcttcgatggctgtcgtcatccctgaggccgctcttaaggagggactctcaggcgatgccctgagctcccctagtgccccagagccggtggtgggtacacccgatgacaaactggacgccgactatatcaagcgatatctcggagatttaactcccttgcaggagtcttgtctgatcaggctccgacagtggttgcaggaaacccataagggcaaaattccaaaggatgagcacatcctccggttcctgcgggcaagagacttcaacatcgataaagccagagagattatgtgccaatcgctgacatggcgaaagcaacaccaggtcgactatatcctcgaaacttggacgccaccacaggttttacaggattactacgcaggcggttggcaccatcacgataaagacggacgcccactgtacgtactgcggttgggccagatggacactaagggtttggtgcgcgctcttggcgaggaggctctgctaagatatgttctgtcaatcaatgaagaagggcttagacgctgtgaggagaatacaaaagtgttcggcaggcccatctcgagctggacctgtttggtggacctggaaggcctgaatatgaggcacttatggcggcctggcgtgaaagctttacttcggattattgaggtcgttgaggctaactatccggagacactggggaggctgttgattttgcgcgcaccaagagtgttccctgtgctttggacgttggtgtcgcctttcattgacgacaacacccggcgtaagttcctcatttacgctggtaatgattatcaaggccctggagggttactcgactatatcgataaagaaatcatccctgatttcctgtcaggcgagtgtatgtgtgaagtgccggaagggggattggtgcctaaatctctctatcgtacagcagaagaattggaaaatgaggaccttaagctctggactgagactatttatcagtctgccagcgtgttcaaaggagctccacacgagatattgattcagatcgtggatgctagttctgtgataacctgggactttgacgtatgtaagggtgatatcgttttcaacatttatcattcaaagcgatcaccacagccgcctaagaaggacagcttgggcgctcattccataacctcccccggtggtaacaacgtccaactaattgataaggtatggcagctcggccgagactattccatggtggaaagcccactgatttgtaaagagggcgaaagcgtgcagggctcacacgttaccagatggccaggcttctatatccttcagtggaagttccactccatgcctgcttgtgcagcctcgtcactgcccagggtggacgacgtattagcttcattacaagtgtcaagccataagtgtaaagtgatgtactacaccgaagttatcggatcagaggacttccgaggatctatgactagcctagagagtagtcactccggcttctcccagttgtccgccgctacaacctctagttcccagtcccacagctcctctatgatctcacggtggaggttctgctag

SEQ ID NO: 53744 - DNA, 2148 bp, Artificial Sequence
  Description of Artificial Sequence: Synthetic coding sequence
atggtacaaaagtatcaaagcccagtacgagtgtataaatacccattcgagctcattatggccgcatacgaacgacggttccctacatgtccattgattccaatgtttgttgggagcgacaccgttaacgaattcaaatctgaggacggggctatccacgtcattgaacgcaggtgtaagctcgacgtcgatgcaccccgactacttaaaaaaatcgccggagtggattatgtttacttcgtgcagaaaaactcgctgaatagccgcgagcggacattgcacatcgaggcttataatgaaacattcagcaatagagtgataattaatgaacattgctgttatacggttcaccccgagaacgaagactggacctgctttgagcagtctgcatcactggacattaaaagttttttcggcttcgagtccacggtggaaaagatcgctatgaagcaatatacctctaacattaaaaagggcaaggaaatcatagagtactatctgcgccagttggaagaggagggcatcactttcgtgccacgatggtcaccaccttctattaccacatcatcagaaacaagctcatcatcaagtaagaagcaggcagcttcaatggcagtggtgattcctgaagccgctctcaaggaggggttgagtggggatgccctgagctccccatcagcgccagagcccgtggtaggaacccctgacgataagcttgatgcagattacattaagcgataccttggcgatctgacacctctacaggagagttgcctcattcgccttaggcaatggctccaggagacgcacaagggaaaaattcctaaggatgaacacatcctgaggttcctccgtgccagagatttcaatatcgacaaagccagagaaattatgtgtcagtcactaacatggcgcaagcagcaccaggttgactacattctggagacgtggacccctccgcaggtgcttcaagattattacgccggaggatggcaccaccacgacaaagacggtaggccactgtatgtgctccgtcttggtcaaatggataccaaaggcctggttcgtgcattgggcgaagaggccctcctcaggtacgtacttagtattaacgaagagggtctgcgcagatgtgaggagaataccaaggtatttggtcgacccatatcttcctggacctgcctggtcgatctcgagggcctcaacatgcggcatctctggcgccctggtgtgaaggccttactacgtatcatcgaggtcgtggaagctaattatcctgaaacattggggcgtctactgattctgcgtgcacctcgcgtttttccagtactctggaccctcgtctcacctttcattgacgacaacaccaggaggaaatttctgatatacgcaggcaatgattatcaggggccaggagggctgctagactatatcgacaaagagatcatccccgactttcttagcggtgagtgcatgtgcgaggtgccagaggggggtttggtgcccaagtctctctaccgtaccgcagaagagcttgagaatgaagaccttaaactttggacagaaacaatctaccagagtgcctctgttttcaaaggggcaccgcacgaaattctaatccagatcgtggacgcgtcgtccgtgataacctgggattttgacgtctgcaaaggagacattgtgttcaatatatatcattccaagagatctcctcaaccccctaaaaaggatagtttgggggctcattctatcactagtcccggaggcaacaacgtacaactgatagacaaagtgtggcagctggggagagattattcaatggtggagtctcctttgatctgtaaggaaggggaatcagtccagggttctcatgtgacccgatggcccggtttttatatactgcaatggaaattccattctatgcccgcttgcgccgctagcagccttcctcgggtggacgatgtgctcgcatccttacaagtgtcttctcataagtgcaaagttatgtattacacagaggtgattggcagcgaggacttccggggaagcatgactagcttggaaagttcacatagtggctttagtcagctttctgcggctaccacctcctcaagtcagtcccacagctccagcatgatcagtaggtag

SEQ ID NO: 53745 - DNA, 2148 bp, Artificial Sequence
  Description of Artificial Sequence: Synthetic coding sequence
atggtgcagaagtaccagagccccgttagggtttacaagtatccttttgagctcatcatggcggcttacgaaagacgttttcccacctgcccattgatcccaatgttcgtggggagcgacactgtaaacgagttcaagtcagaggacggagccatccatgttatcgagcggagatgcaagttggatgtagacgcgccacgactgctaaagaaaatcgccggagtggactatgtgtatttcgtgcagaaaaactctctgaatagccgggagcgaactctgcacatcgaggcgtacaacgaaacctttagcaatagggtgatcatcaacgaacattgttgttatacagtgcatccagaaaacgaggactggacatgcttcgaacagtcagccagtttggatataaaatcgtttttcggcttcgaatctacggtggaaaagattgctatgaagcagtacaccagcaacatcaagaagggaaaagagattatagaatattatttgaggcagctggaagaagaagggattacattcgtgcccagatggagtccaccatccattacaacctccagcgaaacatcttcaagctctagtaagaagcaagcagccagcatggcagtggtgatccctgaagcagctctcaaggagggactgtccggtgacgccctgagctctccctcggctcctgagccggtggtcggaactccggatgacaaactcgacgccgactacattaagaggtacctgggtgacctcactcccctgcaagagagctgtctgatcaggctgcgccagtggctgcaggagacacataagggcaagattccaaaagacgagcatatattacggtttttgcgtgctagagacttcaatatagataaagctcgagagatcatgtgtcagagcctaacatggcgcaagcagcaccaagttgactatatcctggaaacttggacgccccctcaagtcctgcaggattactacgccggaggatggcaccaccacgataaggacgggagaccactctacgtccttcgcctcggacagatggacactaaggggttggtgcgcgcactgggcgaagaagctctgctgcggtatgtgctgtccataaatgaagaggggttgaggaggtgcgaagagaacactaaagtgtttggtagacctatatcatcctggacttgcttggttgacctcgaaggtctcaatatgcgtcacctatggcggccaggagtgaaagctctcctcagaattattgaagtggtggaagctaactaccctgaaactctgggcaggctgcttattctgcgcgctcccagggtttttcctgtgctgtggacgctcgtgagcccttttatcgatgacaacacgcggaggaagtttctgatatacgccggaaacgactatcagggccctggtggactccttgactacatcgacaaggaaatcatccccgacttcctgtcgggagaatgtatgtgcgaggtccccgagggcggattggtcccgaaatcactctaccggacagctgaagaacttgaaaatgaagatctgaaactgtggaccgagacaatttaccaatcagcctctgtgttcaagggagctccccatgagattctgatccagatcgtcgacgcctcctcagtgattacctgggactttgatgtctgtaagggcgacatcgtttttaacatctatcacagtaagcggagtccacaaccccctaaaaaagattctctgggcgcacactccatcacatcccctggcggaaacaatgtgcagctgattgataaggtctggcaacttggtcgagactactctatggtggagtctcctctcatttgtaaagagggcgagtcagtgcagggctcccacgttacgcgatggcccggtttctacatcttgcagtggaaattccactctatgccggcttgtgctgctagctctctacctagggtcgacgatgtgctcgcaagcttgcaggtgagcagtcacaagtgtaaggttatgtactacaccgaagtgattgggagtgaggactttaggggatccatgactagcctcgagagtagtcacagcggcttttcccagctgtctgctgcaaccacgagctcttctcagtcacattcttcctcaatgataagtcgatag

SEQ ID NO: 53746 - DNA, 2046 bp, Artificial Sequence
  Description of Artificial Sequence: Synthetic coding sequence
atgtttgtagggagtgacacggtgaacgaattcaagtccgaagacggagcgattcatgtgatcgagcgcaggtgcaaactagatgttgatgcgccacgacttcttaagaagattgctggtgtcgactatgtttactttgtccagaagaacagcctcaatagtcgggagcgcacgttgcatatcgaagcatacaatgagactttctccaaccgtgtgattatcaacgaacactgttgttacacagtacaccctgagaacgaagattggacatgctttgaacagtcagctagcctggacattaagtcttttttcggctttgagtctactgtggaaaagatcgcaatgaagcagtacaccagtaatatcaaaaagggcaaggagatcatagagtattatctgcggcagttggaggaggaaggcatcacatttgtgcctcgttggtctcctccttccataaccacttctagtgagacgagctcgagctcctctaaaaagcaggcagcctccatggctgtcgttatcccggaagccgctctgaaggaaggtctgtcaggcgacgccctttctagcccttctgcccctgaaccggttgttgggacccctgacgataagctcgatgcggactatattaagaggtacctaggagatctgacacccctgcaggaatcatgcctgatccgcctccggcaatggctgcaggaaacacacaaaggcaaaatccccaaagacgagcacatcctgaggtttcttagggcccgtgattttaatatagataaagcgagagagataatgtgtcagagtctgacctggaggaaacagcaccaagtggactacattctggagacttggactcctccccaggtactgcaagattactacgctggagggtggcaccaccatgataaggacggacgtcccctttacgtgttgagactgggccagatggacacaaaaggactagtaagggccttaggtgaggaggcactgctccggtacgttctgagcattaatgaggaaggacttcgccgatgtgaagaaaacacaaaagtattcggcaggccaatttcttcatggacttgccttgtggacctggaaggccttaacatgcgccacctgtggagacctggagttaaagcattgcttcgcatcatcgaggtagtcgaagctaattacccagagacgttagggagattgctgatcctacgggctccacgcgtttttccagtgctgtggactctggtgagcccatttatcgacgacaacacccgcaggaaattcctgatttatgccggtaacgactaccagggacccggtggtcttctcgactacatagacaaggagataattcctgattttctgtcgggagagtgtatgtgcgaggttcccgagggcggactagtcccaaagtccttataccgtacggccgaggaactggagaacgaggatctgaagttgtggaccgagaccatttatcagtctgcgtcagtgttcaaaggagctccacacgaaatacttatacaaatagtcgacgcgtcaagcgtcataacatgggactttgatgtgtgcaagggggatattgtgttcaacatctaccatagcaagcggtcgccacaacctcccaaaaaagacagccttggagcgcactctatcacttcgccgggtggcaataacgtccagctgattgacaaggtctggcagctgggacgggactattcgatggtggaatcacctttgatatgcaaggagggggagagcgttcaggggtctcacgtcaccagatggcccggtttttatatcttgcagtggaaattccactctatgccggcttgcgctgcttccagtcttccccgtgtggatgacgttctcgctagcttacaggttagctcacacaagtgtaaagtaatgtattataccgaagtgataggatctgaagattttcgaggtagtatgacctcgctggaaagctctcattccggcttctctcaactgtcagccgcaaccacaagttcctctcagtctcactcttcatctatgatttctcgctag

SEQ ID NO: 53747 - DNA, 2148 bp, Artificial Sequence
  Description of Artificial Sequence: Synthetic coding sequence
atggtgcaaaagtatcagtcgcccgtgagggtctataaatacccattcgagctgataatggcagcatatgagagaaggttccccacctgccctctgatcccaatgttcgtgggaagtgacaccgtcaatgaatttaaaagcgaggatggagcaattcatgtcatcgaaaggcgttgcaagttggatgtggacgcgccaagactgctgaagaagattgccggtgtggactacgtgtactttgtacagaaaaattcactcaactcacgggagagaacactccacattgaagcgtataacgaaacttttagtaaccgcgtgataattaacgaacactgttgttatacggtgcaccctgagaatgaggactggacatgctttgagcagagcgccagcttggacataaaatcattttttgggtttgagtccacagtcgaaaaaatcgcaatgaaacagtacacctccaatatcaaaaaaggaaaagagatcatagagtactatctgagacagctggaggaagaagggattacgttcgtcccaaggtggtctcccccatccatcaccactagttccgagacatcttcgagctccagcaagaagcaggctgcttccatggccgtggtcatcccggaggccgctctgaaagagggcctcagcggcgacgccctttctagtccttccgcgcctgaacccgtagtcggcacccctgatgataaactcgatgcagattacatcaaaaggtacctgggcgatctaacacccctccaggagagttgcctgatccggcttcggcagtggctgcaagagacacacaagggtaagattcctaaagacgaacatatccttcggttcctgagagcacgcgacttcaatatcgacaaggcacgggagattatgtgccagtcactgacatggcggaaacagcaccaggtggattacatccttgaaacgtggactcccccacaggtgttacaggattactacgcaggaggctggcaccaccacgataaagatggccgaccgctgtacgtcctccgcttagggcagatggatacaaaggggctggtccgggctctgggcgaggaagcacttctgaggtacgtattatctatcaatgaggagggtctgcgacgctgcgaggagaatacgaaggtctttgggaggcccatatcttcttggacttgtctcgtcgatctggaggggttaaatatgcgccacctttggcggccaggtgtcaaggccttgcttaggatcatcgaagtggtcgaggccaattacccagaaacactggggagactgctgattttgagagctccgagagtgttcccagttctatggactctggtctccccctttattgatgataacacccggaggaagtttttaatctatgcaggaaatgactatcaaggcccaggaggcctgctcgactacatagacaaagaaatcattcccgatttcctgagtggagagtgcatgtgcgaagtgcccgagggcggtctggtcccgaagagtctgtaccgaaccgccgaagagctcgaaaacgaggatctgaagctatggaccgaaacgatctaccaaagcgcctccgttttcaagggagcgccacacgagattctgatacagatcgtggatgcctcgagcgtcatcacctgggactttgacgtctgcaagggtgacatagtgttcaatatttaccatagtaagcggagccctcaaccccctaaaaaggattccctgggcgcacacagcatcactagcccgggaggcaataacgtgcagctcatcgacaaggtgtggcaacttgggagagactactctatggttgagagccctctcatatgtaaggaaggcgagtcggtccaggggagtcatgtgacacgatggcctggcttttatattttgcagtggaaattccattcaatgcccgcatgtgcagccagtagcctgccgcgtgtagacgacgtgctcgcatccctgcaagtgagttcccacaagtgtaaagtaatgtactatacagaggtgataggatctgaagattttcgaggctccatgacatccctggaatccagtcattcgggattttcacagctctctgcagcgaccactagtagtagccaatctcacagcagcagtatgataagtaggtag

SEQ ID NO: 53748 - DNA, 2160 bp, Artificial Sequence
  Description of Artificial Sequence: Synthetic coding sequence
atggttcagaagtaccaatcacccgtcagggtgtataaatacccattcgagctgattatggccgcttacgaaaggagattccccacatgccccctgatacctatgttcgtaggatcggacactgttaacgagttcaagagcgaagatggcgctattcatgtgatagagagaagatgtaagttggatgttgacgcccctagactcctgaaaaaaatcgccggagttgattatgtctattttgtacagaagaattctctgaattctagagagcggacgttgcacatagaagcttacaatgaaactttcagcaatcgggtgataatcaacgagcactgctgttacaccgtgcaccctgagaacgaagattggacgtgtttcgaacaatcggccagtctggatattaagtcattcttcgggttcgaatcgaccgttgagaagatcgccatgaaacagtatacatcaaatatcaagaagggcaaagagatcatagagtactatcttcgacaactggaggaagagggcatcacgtttgttccgcgatggtcacctccttccattacaactagttccgagacaagctcctcatcatctaaaaagcaagcagcctctatggctgtggtgattccagaggccgcactgaaggaggggttgagcggcgacgcacttagctccccatctgctccagagccagtggtgggaactcctgatgataagctggatgccgactacataaagcggtacctcggcgaccttactcctttgcaggaatcatgtctcatccgactccgccagtggctgcaagaaactcacaagggcaagattccaaaggacgaacacatcctgcgttttctccgggcaagagacttcaacatcgataaggccagggaaatcatgtgtcagagcctcacttggcgaaaacagcaccaagtcgactatattttggagacttggacaccaccccaggtgctgcaagattattatgctggtggatggcaccaccacgataaagacggtcggcctctctacgtcctgcggctaggccaaatggatactaagggcctcgtacgggcactaggggaagaggcactcttgaggtacgtactgtcaattaatgaggaggggctgaggcgctgtgaggagaataccaaggttttcgggagaccaataagtagttggacttgtctcgtcgatctcgagggccttaatatgaggcacctgtggagacccggagtcaaagcccttcttagaataatcgaagtagtcgaggctaattatcccgagactctgggtcgcctgctaattttgagagcacccagggtcttcccagtgttgtggaccttggtcagtccatttatagatgataatacccgacgaaagtttctgatttatgctggcaatgattaccagggccctggcggactgttagattacatagacaaggagattatccctgatttcctgtccggcgaatgtatgtgcgaggtgcctgaaggtggattggtgcctaaatctctctacagaacagcagaggagctagagaacgaagacttgaaactttggacagaaactatctatcaatccgccagcgtgtttaaaggggcaccacacgagatccttattcagatagtcgatgcttccagcgtgatcacttgggatttcgacgtgtgtaagggtgatatcgtgtttaatatctatcacagcaagagatcaccacagcctcccaagaaggactctctcggcgcacattccattacctcaccagggggaaataacgtccagttgatcgataaagtgtggcaactcggcagggactacagcatggtggagtctccgttaatttgcaaagagggagaaagtgtccaggggtcccacgtcactcggtggccaggtttctacatcctacagtggaaattccatagcatgccggcatgtgccgcatctagccttcctcgggtggacgatgtcttagcaagtctccaggtgtcaagccacaagtgcaaggtgatgtactacacagaggtcataggctcagaggacttccgaggctctatgacgagtcttgagagttcccactcaggattcagccagctttcagccgctacgacgtccagctcccagagccactcttcctccatgattagcagatggaggttctgctag

SEQ ID NO: 53749 - DNA, 2091 bp, Artificial Sequence
  Description of Artificial Sequence: Synthetic coding sequence
atggtgcagaggtaccagtcccctgttcgcgtgtacaagtatcccttcgagctggtgatggcagcttatgaaaagcgcttcccaacctgcccacaaatacctgtcttcctgggcagtgaagtgcttagagagagcagaagccctgacggggctgtgcatgtcgtcgagcgatcgtgccgcctacgggtcgacgcccctaggctcttgcgcaagatagcgggtgttgagcacgtagtttttgtccagactaatatactgaattggaaagaacgcacccttctgatagaagctcataatgaaacctttgcgaatcgggtggtcgtcaacgagcactgtagctatactgtacatcccgaaaatgaggactggacgtgctttgagcagtccgccagcctggacatcagaagttttttcgggttcgagaacgcactagagaaaatagctatgaaacaatataccgcaaacgtcaaacgaggcaaggaagtgattgagcactacctgaatgagctcatctcccagggcaccagtcacattcctagatggacacccgctcctgtaagggaagaggatgccaggaatcaggccggtcccagggatcccagtagccttgaggctcacggccctcgctcaactctgggtcccgctttggaagctgtgagcatggacggagataaactcgatgcagattacatcgagcggtgtctcggccacttgacacctatgcaggaatcttgtctgatccaacttcgacactggctgcaggagacacacaaggggaagatcccaaaagatgaacatatcctgcgcttcctccgggctcatgatttccacctggataaggctcgcgagatgctgcgtcaatctctctcctggcggaagcagcatcaggttgatctgctcctgcagacttggcagcctccagccctgctggaagagttttatgcgggaggatggcattaccaggacattgatggacgaccactctacattctgaggcttggtcaaatggacactaagggactgatgaaggccgtcggggaagaggcgcttcttagacatgtccttagtgtgaatgaggagggacaaaaacgttgcgagggaagtaccagacagcttggaaggcccatttccagctggacttgcctactggacttggaaggcctgaacatgagacatctgtggcgacctggggtcaaggccttgttgaggatgattgaggtcgtagaggataattatcctgagactctcggcaggctgttaatcgtgcgggcaccgagagtgtttcctgtgctgtggacactgatttcaccatttataaatgagaacacacgaaggaagtttctgatttatagcggctctaactatcaaggtccgggtgggctcgtggattacctcgatagagaagtcatccctgacttcctaggcggagaatccgtgtgcaacgtgcctgaaggaggcttggtaccaaaaagcctctacatgacagaagaggagcaggagcataccgatcagttatggcaatggtcagaaacttaccacagtgcaagcgtactgcggggtgcacctcatgaagtggccgtagagatcctggagggggagtctgtgatcacctgggactttgacatcctcagaggagacgttgtgttctcgctctatcataccaaacaggcacctagattaggtgctagagagcctggcaccagagcgtcgggccagctaattgacaaggggtgggtgctgggcagagattattctcgtgtggaggcaccccttgtgtgccgcgaaggggaatccattcaggggtcacatgtgacaagatggcccggtgtgtatctcttacaatggcaaatgcattcccctccatcaagcgtggcttgttctttgcccggtgtggatgatgtgctgactgccctacattcccctggtcccaagtgtaaactgctctactactgcgaggtcctcgcaagtgaggattttagagggagcatgagctccctcgagtcatgtacatccgggttttctcaacttagcgctgcgacgtccagctctagttccggtcagagccactcgtcatctctcgtgagccggtag

SEQ ID NO: 53750 - DNA, 912 bp, Artificial Sequence
  Description of Artificial Sequence: Synthetic coding sequence
atgagcgtaatcttctttgcctgtgtagtgcgagttagagatggacttcctctatccgcatcaactgatttttatcacacgcaggactttcttgagtggagacgcagattgaagtctctggccctgagactcgcgcagtatcccggtaggggcagcgctgaggggtgtgacttttcgattcacttttcatcattcggggatgtcgcctgtatggccatttgttcttgccagtgtccggcagctatggcattctgttttctcgaaaccttatggtgggaattcacggcatcctacgatacaacgtgtatcgggcttgcaagtcggccatacgctttcctggaatttgacagcattattcagaaagtaaagtggcatttcaattatgtatcttccagccaaatggagtgttctctagagaagatccaagaggagctgaagctgcagcctcctgctgtgctcactctggaggatactgacgtggccaatggggtgatgaacggccacactcccatgcatctagagccagcaccaaattttcggatggagcctgtcaccgcactagggatcctgtctcttatccttaacatcatgtgtgcagcactcaacttgatccgtggggtgcatctggctgagcactccttacaggttgcccacgaagagatcgggaatatcctggccttcctggtgcctttcgtggcctgtatcttccagtgttatctgtacttgttttactccccagcccgtaccatgaaggtcgtcctgatgttattatttatctgcctgggaaacatgtaccttcatgggctacgaaacctctggcaaattctgtttcatatcggcgtggccttcttatctagctaccagattttgacacggcagctgcaggaaaagcagtctgattgcggcgtctag

SEQ ID NO: 53751 - DNA, 753 bp, Artificial Sequence
  Description of Artificial Sequence: Synthetic coding sequence
atgtcggtgattttttttgcatgtgtggtccgagttagggacggcctgccattgagcgcatcgactgacttttaccacacccaggactttctcgagtggcgacgaagactgaaaagtctcgcattaaggctagcccagtaccccggtcgcggtagcgcagaaggatgtgacttctctatacacttctcgtcctttggcgatgtggcttgcatggctatttgctcatgtcagtgcccagcggcaatggcgttctgcttcttggaaaccctatggtgggagtttaccgcctcttacgacacaacctgtatcggactggccagccgcccatacgcatttctggagtttgatagcattatacaaaaggtaaagtggcattttaattacgtgtcctcaagtcagatggaatgcagcttggaaaaaatccaggaggaattgaagctgcagcccccagctgttttaacattggaggacaccgatgttgccaatggggtcatgaacggccacaccccaatgcatctggagcccgcaccaaatttccggatggagccggtaactgctctgggtattttgtccctgatactcaacattatgtgcgccgcactcaacttaatacgaggggtccatttggcagagcatagcctccaagttgcccatgaggagattggcaatattctggcctttttggtgccctttgtggcttgcatcttccaagatcctcggtcctggttctgttggctcgaccagacttcttag

SEQ ID NO: 53752 - DNA, 753 bp, Artificial Sequence
  Description of Artificial Sequence: Synthetic coding sequence
atgtctgtcattttcttcgcctgcgtggtccgggtccgggatggcctccctctgtccgcctcaaccgacttttaccatactcaggattttttagagtggcgcagacgtctgaagagcctcgctttgaggctggcccagtatccgggaaggggatcagccgaaggatgcgatttctccatccacttctccagcttcggcgatgtcgcctgcatggccatctgtagctgccagtgcccagccgctatggccttttgcttcctggaaacgctgtggtgggagttcacggcaagctacgatacgacctgtatcggacttgcatcaagaccttacgctttcctagaatttgacagtattatccaaaaagtcaagtggcactttaactacgtttccagctcccagatggagtgtagtttggagaagatccaggaagaattgaaacttcagccgccagccgtactcaccttggaggacaccgacgttgccaatggggtcatgaacggccacactccaatgcacctcgagccggcacccaactttagaatggagcctgtgaccgcgctgggcattttgtcccttattttgaatatcatgtgcgccgctctgaacctgatccgtggggtgcacctcgccgagcactctctacaggtggctcatgaagagatcggaaatattctcgcattcctcgtcccgttcgtggcgtgcatctttcaggaccctcgctcatggttctgctggttggaccagactagctag

SEQ ID NO: 53753 - DNA, 687 bp, Artificial Sequence
  Description of Artificial Sequence: Synthetic coding sequence
atgtctgtgatattcttcgcctgcgtagtgcgagtaagagacgggctgcctctgtccgcctctaccgatttttaccacacccaggatttcctggagtggagaaggcggctcaagtctctagcactccgattagcccaataccccggacgaggcagcgccgagggctgcgacttctcaatacacttttcaagcttcggcgacgtcgcctgcatggctatttgttcgtgtcagtgcccagctgccatggccttctgttttctggaaactctgtggtgggagttcacagcctcctacgacactacctgcattggacttgccagcagaccatacgcgtttttagagtttgattctatcatccaaaaagttaaatggcacttcaactatgtgtcctcctcacagatggaatgctctctggagaagatacaggaggagctgaagttgcagccccctgctgttctgaccctcgaggacaccgatgttgccaacggggtaatgaacgggcacactcctatgcacctcgaacccgcacccaattttcgcatggaacctgtaaccgctttaggtatcctatctctgatattaaatattatgtgcgccgcactgaacctcattaggggtgtgcacctagcggaacactctttgcaagatccacgcagctggttttgttggctagaccagacctcttag

SEQ ID NO: 53754 - DNA, 543 bp, Artificial Sequence
  Description of Artificial Sequence: Synthetic coding sequence
atggcaatctgctcctgccagtgtcccgctgccatggctttctgtttcctagaaacgctatggtgggagttcacagcctcctacgataccacatgcatcgggcttgcatcaagaccttacgcctttctcgagtttgacagcatcatccaaaaggtgaagtggcattttaactatgtttccagcagccagatggagtgtagcctggaaaagatccaagaggagctcaagctgcagcccccagccgttctaaccctggaggatacagatgtggccaatggagtgatgaacggacatacaccaatgcatcttgagcctgccccaaattttcgcatggagccagtgacagcccttgggatcttaagcctgatccttaacattatgtgtgctgcacttaaccttatcaggggagtgcacttagccgaacacagtctgcaggttgctcacgaggagattgggaatattctggcatttctggtcccattcgtggcctgtatttttcaggatcctcgcagctggttttgctggttggatcagacgagttag

SEQ ID NO: 53755 - DNA, 1842 bp, Artificial Sequence
  Description of Artificial Sequence: Synthetic coding sequence
atgagccagcctggcatccctgcttccgggggagcccctgcgtctcttcaggctcagaacggtgccgctcttgccagcggatcaccctatactaacggcccagtccagaatgccctgctttcttctcaagagagcgtctctcagggctataattttcaactgcccggaagctaccctcaccccataccagccaaaaccctgaatcccgtcagtgggcagtcaaattacggagggagccagggcagcggccaaaccctgaatcgccctccagtggcatccaatcccgtgacaccgtcactgcactccggccctgcaccccgtatgcccctccccgcttcacaaaaccctgcaacgacccccatgcctagctcctcattcctgcccgaggccaacctgccaccacccttgaactggcaatataactatcctagcacggcatctcagacaaaccattgtcctcgcgcttcttcacagcccaccgtgagtggaaacacttcactgactactaatcaccagtacgtgtcatctggctacccttcacttcagaactcttttattaaatccgggccttccgtccctccactggtgaatcctcctttacccaccaccttccaacccggtgcgccacacggcccacctccggcaggtggcccaccgccagtccgggctctcactcccctaacctcaagttatagagacgtaccacagcctctgttcaactctgctgttaaccaagaaggaattacctccaatactaacaacggaagcatggtcgtgcactcttcctatgacgaaatcgaaggcggtgggcttcttgccactcctcagcttacaaacaaaaaccccaaaatgtctaggagtgtaggatacagctatccttccctgccgccaggctaccagaatacaaccccacctggcgctaccggcgtgcccccttcatctttgaactatcctagtggccctcaggccttcacccagacgcctctgggggctaatcacctcacaaccagtatgtctggtttgtccctccagcccgagggactgagagtggtgaacctgctccaggagagaaatatgttgccgtcgacccctctcaaaccaccagtgccaaatctacacgaggatatccagaaattgaactgcaacccggaactgttccggtgtactttgacctctatccctcaaacacaggccctgctaaataaggctaagctgccactggggctactgctgcacccatttaaggaccttgtccaattgcccgttgttacatcatcaaccatcgttcggtgccgcagttgcaggacgtatattaatccattcgtctcgtttcttgatcaacgaagatggaagtgcaatttatgctaccgtgtgaatgatgtgccagaagaatttttgtataaccccctgacgagagtctatggagagccacatagacgaccagaagtccagaatgccactatcgagttcatggctccgagcgagtatatgctccgcccaccccaacctcccgtgtatctatttgtctttgacgtgtcacataatgctgtggagacaggctacttaaattccgtgtgtcagtctctcctggacaatctcgatctcctccctggtaatacccggactaagattggctttatcacatttgactcaacaattcatttttacggattacaggagagcctgtcacaacctcagatgcttatagtcagtgacattgaggacgtgtttattcccatgccggagaacctgctggtgaacctcaatgagtctaaggaatccgtaatcggcgtgtccagcgaagagactttgatcacgtgcctggaaatagccatgcggtag

SEQ ID NO: 53756 - DNA, 3282 bp, Artificial Sequence
  Description of Artificial Sequence: Synthetic coding sequence
atgagccagcctggcattccagcctctggaggggctcccgcttccttgcaagcccagaacggagctgcactcgcctccgggtccccctatactaatggtccagttcagaacgctctgctcagctcacaggagtccgtctcccaaggctacaacttccagctccccggaagctaccctcaccctattccggctaagacccttaatcccgtatcagggcagagcaattacgggggttctcagggtagcggacagacactcaaccgcccacccgtcgcttccaacccggtcaccccatctttgcacagtgggccagcccctaggatgcccctcccggcttctcagaaccctgctactacaccaatgcccagtagttcattccttcctgaggcaaatctcccaccccctttaaattggcagtacaattaccctagcactgcgtcacagaccaatcattgtcccagagccagttcgcagccaactgtaagtggcaataccagtcttactacaaatcatcaatatgtctcgagcggctacccatccctgcagaacagtttcattaagagcgggccttccgtgccacccctggttaaccctcctttaccaacgacatttcagcccggagcccctcatgggcctcctcccgctggcggacctccacctgtgcgggctctaacacccctgacctcttcataccgggatgtgccgcagcctctgttcaattccgccgtcaatcaagagggcattaccagcaacaccaataacggcagcatggtcgtgcattctagttacgacgaaatagagggagggggactgcttgctacaccgcagctgacgaacaaaaatccaaaaatgagtagaagcgtgggatactcctacccttcattgccacctggttaccagaataccacgcccccaggcgcaactggagtaccccctagtagccttaattacccaagtggcccacaggcctttacccagacccctctaggtgcgaatcatctgacaactagcatgtccggtctcagcctgcagccggaggggctgcgggttgtaaatcttttgcaggagcggaacatgctgccgtcaactccactgaaaccacctgtccctaacttgcacgaggacatccagaagttgaactgcaacccagagctatttagatgcactcttacatccataccccaaacacaggcactgctgaataaagcaaaactgcccctggggctgctgttacatccattcaaagacctggttcagctgcctgttgttactagctctacaattgttcgctgtaggtcttgccgcacctatatcaatccttttgtgtcatttctagatcagaggaggtggaagtgtaacctttgctacagagtcaacgatgtcccagaagagtttctttacaatccactcactcgcgtgtatggtgagccacaccgcagaccagaggtgcagaatgccaccatcgagttcatggccccttccgagtatatgctgagaccacctcagcccccagtgtacctgtttgtgttcgacgtgagccataatgccgtggaaaccggctatctcaacagcgtgtgccaaagcttacttgataatctggacctccttcctggaaatacacggaccaaaataggatttataacattcgattccaccatacacttctacggcctccaggagtctctgtctcaaccacagatgcttatcgttagtgatatcgaggatgtctttattcctatgcccgagaatcttttggtgaacctcaacgagtccaaagaactggtccaggacttgctgaaaacgttgccacaaatgttcaccaagacattggaaacacagtctgccctcggcccagccctgcaagcagcattcaaactcatgagcccgaccggtggacgtatgtccgtgtttcagacacagctgcctactctgggcgtcggcgcacttaaacctcgggaagaacccaatcaccgctcttctgctaaagatatccatatgaccccttctacggatttttacaagaagctcgcactggactgcagcggccagcaggtagccgttgacctcttcctgctcagcggccagtacagcgacctggctagtctgggctgtatctcccggtattccgccggaagtgtatactattatccttcttaccaccatcagcacaaccccgtccaggtgcagaagctgcagaaagaactgcagcgttacctgactcgcaagatcggctttgaagctgtgatgagaattcgatgcactaaagggctaagtattcatacctttcacggaaacttctttgtgagaagcacagacctgctgagtctaccgaatgtgaaccccgatgccggatacgccgtccagatgtccgtggaggagagtctaacagatactcagctagtctcattccaatctgctctgttgtacaccagctccaaaggcgagcggagaattcgcgtgcacactctttgtttacctgtcgtcagcaccctgaatgatgtttttctgggagccgatgtccaggccatatccggacttcttgctaatatggctgtggatcgtagtatgacagcaagcctgtccgacgcgagagatgccctcgtaaacgccgtaatcgactctttgagcgcatataggagctcggtactatccaatcaacagccaggacttatggtaccctttagcctcaggctctttcccctcttcgtcctggccctgttaaagcaaaaaagtttccagacgggaacaaacgcccgtctcgacgagaggatcttcgcgatgtgccaggtgaaaaaccagcctctcgtgtacctgatgctgacgacacacccctctctttacagagtcgataacctttccgatgaaggcgcactgaacatttccgaccggaccatccctcagccccctattctgcagctcagcgtggagaaactgagtcgagacggcgcatttctgatggacgctggatccgttctcatgttatgggttggcaagaactgcactcagaatttccttagtcaagttctgggagtccaaaattacgcatcaatcccccagcccatgacagacctccctgagttggatacccctgagtcggccaggatcattgctttcatttcatggcttcgcgagcagcgtccttttttccctatcttatatgtcattcgcgacgagtcccctatgaaggccaatttcctgcagaatatgattgaggacagaactgaaagcgccctgtcctactacgagttcctgctgcatatccaacagcaggtaaacaagtag

SEQ ID NO: 53757 - DNA, 3807 bp, Artificial Sequence
  Description of Artificial Sequence: Synthetic coding sequence
atgtctgcgccagcgggaagcagtcaccctgctgcctctgccaggattccacccaaatttgggggtgccgctgtgtccggtgcagctgcaccagcaggccctggggcagggccagccccacatcagcagaacgggccagctcagaaccaaatgcaggtgccatcagggtacggcctgcaccatcagaactacatcgcaccaagtgggcactacagccagggccctggtaaaatgacttctctccctctcgatactcaatgtggagattactattcagcactgtacactgtccctacccagaacgtgactccaaatactgttaatcagcagccgggagcgcagcagttgtattcgcgcggaccgcctgctcctcacatcgttggcagcaccctgggaagtttccaaggcgcagcgtcttcagctagccacctgcacacatcagcgtctcagccttatagcagtttcgtcaaccactataattctcctgccatgtatagcgcatcatcttcggtagcttcacagggatttccttccacttgcggacattacgctatgtctacagtgtccaacgctgcctacccctccgtcagctacccctctctccctgcaggggatacgtacggacaaatgttcacatcgcagaatgctcccaccgtgcggcctgtcaaagacaattccttcagcggccagaacacggctatctcacatccctcccccctgcccccattgccatcacagcagcatcatcagcaacaaagtttatccggttactcaacgctgacttggagcagccccggtctgccaagcacacaagacaatctgattcggaaccatacaggcagtcttgcagttgccaacaataaccctaccataacggttgccgattcgttatcttgcccggtcatgcaaaatgtacagccgcctaaatcgagccctgtagtaagtactgtcttaagtggttcatcaggtagctcctccactaggacaccccctacggctaaccatcctgtggagccagtgacaagcgtgacccaaccgtccgaactgctacagcagaaaggggtccagtacggagagtatgtcaataatcaggcgagcagcgcacctactcccctttctagcacttcagacgatgaggaggaggaggaggaggacgaagaggcaggagtggactcatcgtcgactacttcctctgccagtcccatgcccaatagttacgatgcgctggaaggaggctcctatcctgacatgctcagctcatctgcctcgtccccagctccggatccagctccagagcctgaccctgccagtgctccagccccagcgagcgccccagcacctgtcgtccctcagccatctaaaatggccaagcccttcggttatggataccccacactccagcccggatatcagaatgcaactgccccactcatcagtggcgtccagccttcgaacccggtgtactccgggttccagcaatacccccaacaataccccggagtgaaccagctgagttccagcatcggcggtctgagcctccagtctagcccacagcccgagtcccttcgcccagttaacctcactcaggagcggaatatccttcccatgacaccagtctgggcccctgtgcctaacctaaatgctgacctaaagaagcttaactgcagcccagacagttttaggtgcaccctgaccaacatccctcagacgcaggcgctactcaacaaggctaagctgccactggggttgcttttgcacccatttagagacttgacccaactgcctgtgatcacgtctaataccattgtaagatgtcgttcgtgtcgcacgtacatcaatccctttgtctcatttattgaccagcggcgatggaaatgcaatttatgctatagagtaaacgatgtgcctgaagaattcatgtataatccactgacccgatcctatggcgagccgcacaagcggcctgaagtccaaaacagcaccgtggagttcattgcctcaagcgactacatgttacggcctccacagcccgctgtgtatttgtttgttttggacgtgtctcataacgccgttgaagcagggtacctcactatcctctgtcagtccctgttggaaaatctcgacaagctgcctggggacagtcgcacccgaatcggatttatgactttcgattcaaccatccacttctacaacctccaagagggcctgagtcagccacaaatgctcatcgtgagtgacattgacgatgtatttctacctactcctgactccctccttgtgaatctctacgagtccaaggagctgataaaggacttgctgaatgccctgcccaacatgtttaccaatactcgcgaaacccacagtgccctgggtcccgcactgcaggccgcttttaagttaatgagtccaactggagggcgagtgagtgtttttcagactcagctcccatctctgggggctggcttactacagagtagggaggaccccaaccagcgttcatccacaaaggtggttcaacacctagggccagcaaccgatttctacaaaaagttggccctggactgctctgggcaacagacagccgtggatctgtttctgctgtcctcacagtattctgacttggccagtctggcatgcatgtcaaaatattccgctggctgtatctactactaccccagcttccactatacacacaacccttctcaggccgagaaattacagaaagacctgaaaaggtacttgacaagaaaaatcggtttcgaggccgtgatgagaatcaggtgtaccaagggcctgtccatgcatacattccatggcaacttcttcgttcggtccacagacttactgtccttagctaatatcaatccagatgcagggtttgctgttcaattgtccattgaagaatcgctgaccgacacatccctcgtgtgttttcagacggctcttctatacacatcatccaaaggggaaaggcggatcagagtgcacactttgtgtcttcctgtcgtgagttcgctagcagatgtatatgcgggagtggatgtgcaggccgcaatttgcctgcttgccaatatggctgtggatcgttccgtgagtagcagtctgagcgatgctagagatgcattggttaatgcggtcgtggacagcctgagcgcctatggatccaccgtttcgaatttgcagcacagcgcgctcatggccccttcgtcactgaaacttttccccctgtacgtcttggctctgctgaaacagaaggcatttagaacaggaacctcaactaggctggacgaccgcgtgtatgcaatgtgccaaatcaagagccagcctcttgtgcacctgatgaagatgatccatcccaacttgtacagaatagatagactgacagacgaaggagccgtccacgtgaacgatcggattgtcccccaaccacccctccagaagttaagcgctgagaagctcacaagggagggggcatttctgatggattgtgggagcgtgttctatatctgggtaggaaaaggatgtgataacaattttatcgaggacgtactagggtatacgaacttcgccagcatacctcagaagatgacacacctccctgagctggacaccttaagttccgaacgggctagatcattcattacatggctgagggattcgaggccattatctccgattctccacatcgtgaaggatgagagccccgctaaggctgagttctttcagcaccttatcgaggatagaactgaagcggctttcagctactatgaattcctccttcacgtgcaacagcaaatttgcaagtag

SEQ ID NO: 53758 - DNA, 3702 bp, Artificial Sequence
  Description of Artificial Sequence: Synthetic coding sequence
atgagcgcccctgcaggatcttcccaccccgcagcgagtgcccgtatcccaccaaaattcggaggagccgcagtctcaggtgctgctgcgcctgcaggtcccggagcgggaccggcaccgcaccagcagaacggccctgctcagaatcagatgcaagtcccctccggttacgggctgcaccaccagaactatattgccccatctgggcactactctcagggaccaggcaagatgacctcacttcccttggatacacagtgtggggactactacagcgctttgtacacagtgcccacgcagaatgtcacaccgaacacagttaatcagcagcccggtgcccagcaactgtattccagggggcctcccgctcctcacattgttggctctactctcggatctttccagggcgctgcatctagtgcctcacatctacatacctccgcgtcccagccttatagctcttttgtgaaccattataattctcctgctatgtattccgcttcatctagcgtggctagtcagggattcccctcgacttgcggtcactacgcaatgagcacagtgtccaacgctgcttacccctccgtgtcatatccttcgcttccggctggggacacctacgggcagatgttcacatcacaaaacgccccaacagtcaggccagtcaaagacaatagcttcagcggccagaataccgcaatcagccacccaagcccactgccaccactccccagccagcaacaccatcaacaacaatcactgtccgggtatagtacactcacatggagctcccccggactgccatccacccaagataatctcatcagaaaccacacgggcagcctcgccgtagccaacaacaatcctacaatcacggtcgctgattctctctcatgccccgtcatgcagaacgtacagccccctaaatcatcacccgtggtatccaccgttctgtcaggttcttccgggtctagctccactaggacccctccaacggctaaccacccagtcgaacctgttacttctgtgactcagccttccgagctcttacagcagaaaggtgtggattccagctcaacaacctctagtgcttcaccaatgccgaactcttatgacgctctggaaggcggaagctacccggacatgctgagctcctccgccagttcccctgcccctgatccagccccagagcccgatccagcctcagctcccgctcctgccagtgcgcctgcaccggtagtcccccagccatccaagatggcaaaacccttcggttacggatacccaaccctgcaacccggatatcaaaatgctactgccccattaatcagcggagtgcaaccatccaaccctgtgtactccggattccagcagtatccgcaacagtatcctggcgttaatcagttatcttcctctatcggagggctttcgttgcagagctctccacaacctgaatcactgcgacccgtgaacctgacgcaggagagaaacattctgccgatgactcccgtctgggcaccggtgcccaacttgaatgcagacctgaaaaagctgaactgcagccctgattcattcaggtgcaccctaacgaatatcccacaaacccaggcactactgaacaaggctaaactaccccttggtctgcttctgcaccctttccgcgacctaacacagctgcccgtgatcacctccaataccattgtgaggtgtagatcatgcagaacgtatatcaatccatttgtgagcttcatcgaccagaggagatggaaatgcaatctgtgctatagggtgaacgacgtgcccgaagagttcatgtataaccccttgacacgttcatacggcgaacctcataagaggcccgaggttcagaattctacagtggagttcatcgcatcctctgactacatgctgcgccctccgcagcctgcagtctacctgtttgtgctagatgtttcccacaatgctgtggaggcaggctatctgaccatcctatgtcagtctctcctggagaacctggataaactacccggagactctagaacaagaattggattcatgacatttgattcgaccatccacttttataatcttcaggaggggctcagccagccacaaatgctcattgtgtcagatatcgatgatgtttttctgcctaccccggattccctgctggtgaatctgtacgagtctaaggagttaattaaagatctgctgaacgcacttccgaacatgttcacaaatactcgcgaaacgcactccgccttaggaccggctctgcaagccgctttcaagctgatgagtcctactggagggagggtcagcgtctttcagacacaactgccctctttaggtgcgggactgctccagagcagagaggatcccaaccagcgatccagcaccaaggtagtccagcacctagggcctgctacagatttttacaaaaaactggccctcgactgcagcggacagcaaactgccgttgatctttttctactcagcagccagtactccgacctggccagtctcgcgtgtatgtccaagtattccgccggatgtatctattattacccttcctttcattacacacacaatcccagccaggctgagaaactacagaaggatttgaaaaggtatctaacccgcaaaatagggtttgaggccgtcatgcggatccgctgcaccaaaggtctgtcaatgcacacattccatgggaacttctttgtgcgctctactgatttgttaagcctggcgaacattaatcctgatgctgggtttgcagttcagctaagtattgaggagtccctgacagatacctcccttgtgtgctttcaaactgctctgctttacacaagctccaagggagagcgacgcattcgcgtacacacgttatgccttcccgttgttagcagtcttgctgatgtctacgctggtgtggacgtgcaggcggctatctgccttctcgcaaacatggctgtagaccggagcgtctcaagctctctttctgatgcaagggacgctttggtgaacgccgtcgtcgacagcttgagcgcatacggctccaccgtgtccaatttgcagcactctgccctgatggccccttcctccctgaaactgtttcccctctatgtgctggcccttttgaagcagaaagcattcaggaccggtaccagcacaagactcgatgatagagtgtacgccatgtgtcagatcaagagtcagccccttgtgcacctgatgaaaatgatccacccaaatctctaccgaatcgatagactcaccgacgaaggtgccgtgcacgtcaatgatcgaattgttccacaacccccactgcaaaagctgtccgctgagaagctaactcgggaaggtgctttcctgatggactgcggaagcgtgttttacatttgggttggcaagggatgtgacaacaatttcatcgaggacgttctgggctacactaatttcgcctctattccccagaagatgacccacctgcccgagttggacaccctctctagtgagagggctagatccttcatcacttggttacgtgattccagacctctatccccaatcctccacattgtgaaggatgagagtccggctaaagccgagttctttcagcatctcattgaagaccgaacagaggctgccttctcctattatgaatttctgctccatgtccagcagcagatctgcaaatag

SEQ ID NO: 53759 - DNA, 3897 bp, Artificial Sequence
  Description of Artificial Sequence: Synthetic coding sequence
atgagcgcaccagcaggaagtagccatcctgccgcaagcgctagaattccacccaagtttggcggagctgcagtatccggcgctgcggctcccgctggcccaggggcagggccagcaccgcaccagcagaacgagaccggttttcaccacgtcgctcaagcctctctggagctcctggatccctcgaatttaccggcatctgctagccagatcgccggatcaaccgggcctgcccagaatcagatgcaggtgccaagcggatatgggctgcaccatcagaactatattgccccaagtggccactacagccaaggaccagggaaaatgacctccctcccactcgatacacaatgtggcgattattactcagctttatacaccgttcccacacagaatgtgactccaaataccgtcaaccaacagcccggagcacaacagctctactcgcggggacccccagccccacacatagttgggagcaccttgggcagcttccagggcgctgcttcaagcgccagtcacttgcatacctctgcctcacagccctattcttccttcgtgaaccactacaactcgcctgcaatgtacagcgccagtagctccgtggcctcccagggttttccgtccacttgcggccattacgccatgtctactgtctccaatgccgcttaccctagcgtctcttaccccagtttgcctgcaggtgatacctacgggcaaatgttcaccagccagaacgcacctacagtgcggccagttaaggataactcgttctcaggtcagaataccgccatttcccatccatccccacttcccccactcccatcacagcagcatcatcaacagcaaagcctatcaggctacagtacccttacctggagctctccgggactccccagcacccaggataacttaatcagaaatcacaccggctccctcgcggtagccaacaacaatccaacaatcaccgttgcagactctctttcttgtcctgtgatgcaaaacgtgcagccacccaagtctagtcctgtggttagcacggtgctgagtgggtctagcgggtcatcaagcacccggacaccacctactgccaatcacccagtggagcccgtgaccagcgtaacacagccaagtgagttactccagcagaaaggcgtacaatatggtgagtacgtgaacaatcaagccagcagcgccccaaccccactctcatccacttcggacgatgaggaggaggaggaggaggatgaggaggcgggagtcgattcatcctctacaaccagtagcgcctctccaatgccgaacagctacgatgctctggagggaggaagctatcccgatatgctgtcctcttcagcttcctctcccgcacccgaccctgcccctgagcccgacccagctagcgcacccgcaccggcaagtgccccagctcccgtcgtcccacagcccagcaagatggctaaaccgttcgggtatggatacccgacccttcagcccggataccagaacgcaaccgctccactgatctctggggtccagccttccaatcctgtttatagcgggtttcagcaatatcctcagtaccctggtgtcaaccagttaagctcatccataggtggattgagtttgcagtcctcccctcagcctgagagcctccgccctgttaaccttacacaggaacggaacatactgccaatgacacctgtgtgggctccagttcctaatcttaatgcggacctgaagaagcttaattgctcccctgactcctttcggtgtaccctcaccaatatcccgcaaactcaagccctcttgaataaagccaaactgcccttaggcctgctcctccatccatttcgggaccttacccagctgccggtgattactagtaataccatcgtgcggtgtaggtcgtgccggacatatattaacccatttgtaagcttcatcgatcagcgtcggtggaagtgcaacttgtgttacagggttaatgacgtgccagaggagttcatgtacaatcctctgactcgaagttacggcgaaccccataagcggccagaggtacagaattcaacggtcgagtttatcgcatcttctgattatatgctgcggccaccccaacctgcggtatacctgttcgtattggatgtctctcataatgccgtggaggcaggctaccttaccatcctttgccagtccctgcttgagaacctagacaagctaccgggagattcacgaactcggatcggtttcatgaccttcgatagtacaatccatttttataacctacaggaggggctgtcacagccacaaatgctgattgtgtcggatatcgacgatgtctttttgcccacaccagactccctgctagtgaacttgtacgagtccaaggagctgattaaagacctcttgaatgcactccccaatatgttcactaacacgcgtgagacacacagtgctctcggtcccgcactgcaggcagcattcaagctgatgagccccacggggggacgggtatcagtttttcagacccagttacctagcttaggcgctggcctcctgcagtcacgagaggacccaaatcagcggtcctcgacaaaagtggtgcagcacctcggcccagccaccgatttctacaaaaagctggcgttagattgctcaggccagcagactgctgtcgacctttttctgctgtcctcccagtattcggacctggcatctctggcctgcatgtctaaatactccgctggatgtatttactattatccatcatttcattacacccacaatccctcacaagctgagaaactgcagaaagacttgaagcggtatcttactcgcaagattggattcgaagccgtgatgagaatcagatgcaccaaaggacttagcatgcatacttttcacgggaatttcttcgtgcgctcgactgacctgctctctctggcaaacatcaaccctgatgcagggttcgccgtccagctgtccatcgaagaaagccttactgacacctccctagtgtgttttcagactgcccttctctacacctcttccaagggcgaaaggcggatcagggttcacaccctttgtcttccagtggtcagctcacttgctgacgtctacgcgggtgtcgatgtgcaggcagctatctgcctgctggctaatatggccgtcgacagaagcgtaagcagctcgctgagcgatgctagagacgcacttgttaacgcagtagtggattcattatcagcatatgggtcaacagtttctaatctccagcatagtgctctgatggcccctagtagcctgaaattgttccccctttacgtgctagctctcctcaaacaaaaagcattccgaaccggaacctccacccgactggacgatagagtttatgcgatgtgtcaaataaagtctcagcctttggtccatttgatgaagatgatacaccctaatctgtaccggattgatcgcttaacagacgagggtgcggtccatgtcaacgataggatagtaccccagcctccgctccagaagttgtccgcagagaagcttactcgggaaggggcattcctgatggattgtggttccgtgttttacatctgggtgggtaaggggtgcgataacaactttatcgaagatgtgctgggctatacaaatttcgccagcatcccacagaagatgacccatctacctgagctggacacactgtcttcagagagggctaggtcattcatcacatggctgagagattctcggccacttagcccaattttgcacatcgtgaaggatgaatctcctgctaaagctgaatttttccagcacctgattgaggacaggaccgaagccgctttttcatactacgagtttctgttacacgtgcagcaacagatatgtaagtag

SEQ ID NO: 53760 - DNA, 3285 bp, Artificial Sequence
  Description of Artificial Sequence: Synthetic coding sequence
atgaatgttaatcagtctgtgcccccagtacctcccttcggccagcctcagccaatctacccgggatatcaccagtcctcttacgggggtcagtccggcagcaccgctcctgctatcccttatggcgcatacaatggacccgtgcctggctaccagcagaccccaccccaaggcatgtcaagggccccacctagctccggtgctcccccagcttctaccgcccaagcgccttgcggccaggcagcttatggtcagttcgggcagggggacgttcagaatggacccagctcaacagtacagatgcaacgcctgccgggttcgcaaccctttggaagcccccttgcacccgtggggaaccaaccccctgttctgcagccatatggtcccccacccacgtcagcacaagttgctacgcagctgagcggcatgcagataagtggcgctgtggcccctgcacccccttctagcggactgggcttcggacccccaacctctctggccagtgccagcgggtcctttcccaatagcggcctctatggttcatatccccagggccaagctcctcctctgtctcaagcacagggccaccccggaatccagaccccccaacgctctgcaccatcccaggcaagctcgtttacccctccagcgtcaggcggacctagacttccttcaatgactgggcctttgctgcctggccaatcctttgggggaccaagcgtatcgcaaccaaatcatgtctcatcccctccccaagcgcttcctcccggaacccagatgactggtcccttaggtcccctgccacccatgcactcaccgcagcagcccggatatcaaccgcagcagaacgggtcatttgggcctgctcgagggccacagtctaattacgggggaccataccctgccgcacccactttcgggtcccagcccggaccgccacagcctcttcccccaaagcgcctggaccccgatgccatacccagtccaatccaggtgatcgaggacgacagaaataacagagggacggagccgttcgtcactggcgtgaggggtcaagtgccccctttggtgaccacaaacttcttggttaaggatcagggaaatgcatctcctcgctatatcaggtgcaccagctacaacatcccatgtacttcagacatggctaaacaggcccaggtccctctggctgcagttatcaagccactggcccgattaccccctgaggaggcttccccctacgtcgtggaccacggtgaatccggtcccctccgttgcaataggtgtaaagcgtacatgtgccctttcatgcagtttatagaggggggtcgaaggtttcaatgctgcttttgtagctgcattaatgacgtccccccacagtatttccagcacctcgatcacactggtaagcgtgtcgacgcttacgacagacccgagttgtctcttgggagttacgaattccttgctacagtggactattgcaagaacaacaaattcccctcacccccagcattcatttttatgattgatgtctcttacaatgctatccggacaggactcgtccggctgctgtgtgaagaactgaagagcctcctcgatttccttccgagagagggaggtgctgaagagtccgccatcagggtgggcttcgtgacttataacaaagtactccatttctacaacgtgaaatccagcctagcccagccacagatgatggttgtctcagatgtagccgacatgttcgtgccactgctcgacgggttcctggtgaatgtgaacgaatcacgtgccgtgatcacttctttgctggaccaaattcccgaaatgttcgcagacaccagagagaccgaaacagtctttgtcccagtaatccaggccggtatggaggccctgaaagccgctgaatgtgctggcaagctctttctcttccacaccagcctccctatcgcggaagcacccggtaaactcaagaatcgcgacgacaggaagctaataaatactgataaggaaaaaaccctgttccaaccgcagaccggagcatatcagactctggctaaagaatgcgtggcccaaggctgttgtgtcgatctttttctgtttcctaatcagtatgtggatgttgcaacgctgtccgttgttcctcagctgacgggtgggtccgtttacaaatacgccagcttccaggttgagaatgatcaggaacggttccttagcgacctcaggagagatgttcagaaagtcgtcggtttcgacgccgtgatgagagtgcggacctcaactggcattcgtgccgttgacttttttggcgctttctacatgtctaacaccaccgatgtggagcttgccggactcgacggggataaaacagtcactgtagagttcaagcacgacgatcgtctgaatgaggagtctggcgcactgctgcaatgtgcactgctgtacacgtcatgcgctggccagcggcgtttgcggattcataatctggcactgaattgttgcacacaactggctgacctctaccgaaactgtgaaacagatactcttatcaattacatggcaaaatttgcctatcgcggagttcttaacagtccagtaaaggccgtacgcgacactctgattacccagtgcgctcagattctggcctgttacagaaagaactgtgcatctccttcaagcgctgggcagctgatcctccccgagtgtatgaagctcctgccagtttacctgaattgcgtgctcaagtccgacgttctgcaacccggtgctgaagtgaccacagatgaccgcgcatatgtgcgccagttagtaacatccatggatgtgaccgaaacaaacgtatttttctaccctaggctgctgccccttacaaaatcccctgtggaatcaaccactgagccccctgccgttagggccagcgaggagaggctgtcaaacggcgacatctatctgctggaaaacggactgaatctattcctgtgggtcggagcatctgtccagcagggcgtggtgcagtctcttttctcagtgtcttccttttcacagattacctccggcctttcagtcttgccagtgctggacaatcccttaagcaagaaagttcgagggctcatcgacagtttgagggcgcagaggtcacgatacatgaagctcaccgtcgtcaagcaggaggacaagatggaaatgctgtttaagcattttctggtggaggataaatcactgagtgggggagcctcatacgtggatttcctgtgccatatgcacaaggagatccgtcagctcttatcctag

SEQ ID NO: 53761 - DNA, 3285 bp, Artificial Sequence
  Description of Artificial Sequence: Synthetic coding sequence
atgaatgtgaatcagtccgtccccccagtccctccatttggtcagccccagccaatctatccaggctaccaccaaagtagttatggaggccagagcggcagtacagctcccgctataccctacggggcatacaacgggccagtgcccggttatcagcaaactcctccccaaggcatgagccgggctcctcctagctctggagcccctccagcatcaacagcgcaggctccctgcggccaggctgcctatggacagtttggacaaggcgatgtccagaacgggccttcttctaccgttcagatgcaacgcctgccgggatctcagccatttggctcacccctcgctccagtaggcaatcagcctcccgtcctgcaaccttacggcccacctcctacgagcgcacaggtggccacccagctgagtggcatgcaaatatccggcgctgtggccccagcccctccctcaagcggattaggctttggccctccaacttctctcgctagtgccagtgggagctttccgaattccggcctgtacggctcgtaccctcaaggacaagccccaccattgagccaggcacaaggacaccccggtatccaaaccccgcagaggagtgcgccttcccaggccagttcttttacacccccagcatccgggggacctcgcctgccgtccatgaccggtccactgcttcccggacagagcttcggtggccctagtgtgtcccagcccaatcatgtgtcttcacctccccaagccctgccacccggaacccagatgactggccctttgggtccactgccccctatgcatagtccacagcagcccggttatcagccccagcaaaacggctccttcgggccagccagaggcccacagagcaactatggcggaccatatccagccgcacccaccttcggctcccaacctgggcctcctcaacccctcccgcctaagcggttggatcccgacgctataccatcacctatccaagttattgaagatgatcgtaataaccgcggtaccgaaccttttgtgactggcgtgcgtggccaagtgccccctctagtgactactaattttttggtgaaggatcagggtaacgctagcccacggtacattagatgtactagttataatattccctgtacttccgatatggcaaagcaagcccaagtcccactggctgccgtgattaaacctctggctagactccctcccgaggaggcatcaccttacgtagttgatcacggcgagtctgggccactacggtgtaatcgttgcaaagcttatatgtgcccttttatgcagttcattgaaggtgggaggcggttccaatgctgcttttgtagttgtatcaatgacgtcccaccacagtatttccagcacctggatcacaccggcaagcgggttgatgcctacgatcgccctgaactgtccctcggaagttacgagtttctggccacggtggactattgtaaaaacaacaaattcccatctccccctgccttcatctttatgatcgatgtgagctacaatgccatccgaaccggcttggtacggctcttgtgtgaagaacttaagagcctgctggactttctgcccagggaaggcggtgccgaggagtcagccatccgggtgggcttcgtcacgtataataaggtgctccatttttacaatgtcaaatccagcttagcacagccacaaatgatggtggtgtcagacgtggcggatatgttcgtgcctcttctcgacggcttcttggtgaatgttaacgagtctagagccgtgattacaagcctcctcgaccagatccccgagatgtttgccgatactcgagaaaccgagactgttttcgtgcccgtgatccaggcgggaatggaggccctcaaggcagcagagtgcgctgggaaacttttcctgttccatacgtccctcccaattgccgaggctccgggtaaactgaaaaaccgggacgatagaaagctcatcaacaccgacaaagagaagaccctgtttcaaccacaaacgggggcttaccagacactggccaaagaatgtgtcgcccaagggtgctgcgtggacttgttcttattcccaaaccagtatgtggatgtggctacactttcagtagtgcctcagctcacagggggatcagtatacaaatatgcttcattccaggttgagaatgaccaagaacggtttttaagtgacctccggagagacgtgcagaaggtggttgggtttgacgcggtcatgcgcgttcgcaccagtaccggaatcagggccgtggatttcttcggcgctttttatatgtctaatacaacagacgttgaacttgcagggttagacggcgacaagaccgtaacagtggaatttaagcacgatgataggctgaacgaggaatccggggcactacttcagtgcgcgctgctctacacctcttgcgcagggcaacggcgactccgcattcacaacctggcacttaactgttgcacccaactggctgacctttatcgcaactgtgagacagacaccctaatcaactacatggcgaaattcgcgtatagaggtgtcctcaatagcccagttaaggccgtgagggatacccttatcacccaatgcgcccagatcctggcctgttatagaaaaaattgcgcctcacctagctccgccggacagctgatcctgccagaatgtatgaaattgttacctgtgtacctgaattgtgtgctcaagagcgacgtactgcagcccggtgccgaggttaccacagacgacagggcctatgttaggcagctcgttaccagcatggatgttaccgagaccaatgtgttcttttatcccagactccttcctctgacgaaatcacctgtggagtcaactacagagcctccagctgtacgagcttctgaggaacggctcagcaatggggacatctacctgctggaaaatggactgaacctgttcttgtgggtcggggcttcagtccagcagggggtggtgcaatctctgttctctgtctcatcgttcagccagatcacttccggcctcagtgtcctgcccgtgcttgacaacccactttcaaagaaggtcagggggctgatagactccctccgggcacagcgctcacgctatatgaaactaactgtcgtgaagcaggaggacaaaatggagatgctgttcaagcattttttggtcgaagacaagtcactatctggaggagcctcatatgtggacttcctgtgtcacatgcataaagaaataaggcaactactgtcatag

SEQ ID NO: 53762 - DNA, 2928 bp, Artificial Sequence
  Description of Artificial Sequence: Synthetic coding sequence
atgcaaattagcggcgcagtagcccctgcacctcccagctccggcctggggtttggtccccctacttccctggcctcggctagtggtagttttccaaatagcggactctacggcagttatcctcagggccaggctcccccactgtctcaggcccagggccatcccggtattcagactccacagaggtctgcaccttctcaggcttcatcctttacacctccagcaagtgggggtccccgattaccgtctatgacgggaccccttctgccaggacaaagctttggcggtccatccgtgagtcagccaaatcacgtgtctagcccaccccaggccttgccccctgggactcagatgacgggccctttaggtcctctgccaccaatgcacagtcctcaacagcccggttaccagccacagcaaaatggaagctttggacccgcaagggggccacagtctaattacggaggcccttacccggctgctccaacgtttgggagtcaaccaggtccacctcagcctcttccacctaagcgcttggaccccgacgcaatcccctccccccagctatcagagctgcctccccaacaaaagacacggcatcgaattgatcccgatgccatcccttcgcctatccaggtgatcgaagacgatcgtaacaatcgcggtacagagccgtttgtgactggggtacgaggtcaggttcctccactggtgactacaaactttctagtgaaggatcagggcaatgcatctccacgctacataaggtgcaccagctataatattccatgcacttccgacatggctaagcaagcacaggtgccattggcagctgtcatcaagcccctggccagactgccacccgaggaagcctccccttacgtcgtggatcatggcgaatcaggccctctgcgttgcaatcggtgcaaggcctacatgtgtccgttcatgcaattcatcgagggtggaaggcggttccagtgctgtttctgcagctgcattaatgatgtgccgccacagtattttcagcacctggatcatactggcaagcgtgttgacgcctacgatcgtccagagctgtctctaggcagctacgagttcctggcgaccgtggattattgcaagaataataaattcccatcgccaccagcttttatcttcatgattgatgtttcctacaacgctatccggaccggattggtgaggctgctttgcgaagaactgaaatcactcttggacttcctgccacgcgagggcggtgccgaggagtctgccatccgggtaggatttgtgacctataacaaagtgttgcacttctacaacgttaagagctctctggcacagcctcagatgatggttgtttctgacgtggcggatatgtttgtgcctttactggacgggttccttgtgaacgtgaacgagtcccgcgcagtcattacttccctgttggatcagattccagaaatgtttgccgatacacgtgaaacggagacggtctttgttcccgttatacaggccggaatggaagcgttaaaagctgcagaatgtgctgggaagttattcctcttccacacctcactgccaatcgcggaagcaccaggcaagttaaagaacagggacgaccgcaaactgattaataccgataaagaaaagacactgttccagccccagactggagcctatcagactctggcaaaagaatgcgtagcacaggggtgctgtgtggacctcttcctgtttcccaatcagtatgtcgatgttgcaaccctctctgtggttccgcagctgactggtggcagtgtgtataaatacgccagctttcaggtggaaaacgatcaggagcgttttctttcggaccttcgtagggatgtgcagaaggttgtcgggttcgacgcagttatgagggttcggacatccaccggtatcagagcggtcgatttctttggggcattctacatgtccaacaccaccgacgtcgagttggctggcctggatggtgacaaaaccgtcacggtcgagtttaagcacgatgatcggctgaatgaggagtctggcgcactcttgcagtgcgctttgttatacacttcttgcgctggccagcggagattgcggatccacaacctcgcacttaattgctgtacccaacttgctgatctttataggaactgtgaaactgacaccctgattaattatatggcaaagtttgcgtacagaggtgtgctgaactctccagtgaaggctgtccgagatacactgatcacccaatgtgctcagattctggcttgctacaggaaaaattgcgcttccccatcctctgccggacagttgattctcccagaatgcatgaagttactcccagtgtatctgaattgtgtgcttaagtcagatgtacttcagccaggggctgaagtgaccaccgatgatagagcctatgtgcggcaactggtaacgtctatggatgtgaccgagactaacgtctttttctacccgaggctgcttcccctgactaaatccccagttgagtcaactactgagcctccagcagtgcgggctagcgaggaacgtctttctaacggagacatttatctactcgaaaacggtcttaatctgtttctgtgggtgggcgcaagcgtccaacagggtgtggtccagtctctcttctctgtgagctcattcagccaaattacgagcggtctgagcgtcctgcctgttcttgacaatcccttatcaaagaaggtcagggggctgattgatagtctaagagcccagcgctcccgttatatgaagctaactgtagtgaaacaggaggataagatggagatgttgttcaagcacttcttggtagaagacaaaagcctgtctggtggagcgtcatatgtcgattttctgtgccacatgcataaggaaataaggcaattgctgtcctag

SEQ ID NO: 53763 - DNA, 1029 bp, Artificial Sequence
  Description of Artificial Sequence: Synthetic coding sequence
atgcgggtgagaacctccaccggcatccgggcagtggatttcttcggtgcattctacatgtccaacacaactgatgtcgaactggcaggcctggatggcgataagaccgtgacggttgaattcaagcacgatgatagactgaacgaagagagcggagctttattgcaatgtgctctactttacacaagctgcgcgggtcagcgacgtctccgtattcataatctggcactcaactgctgtactcagcttgccgacttatatcgcaattgtgaaacagacacactaattaactacatggccaagttcgcctatcgcggtgtcctcaacagcccagtgaaagccgtaagggatacactgattactcagtgtgcacaaattctcgcatgctatagaaaaaattgtgcttcaccatcctctgcagggcagttaatcttgcccgagtgcatgaagctgctgccagtttaccttaactgtgtgcttaagtctgacgtgctccagcccggagccgaagtcaccacagacgaccgggcatacgtgaggcaactggttacgtctatggatgtcacagaaaccaacgttttcttttacccccgtctgctgcccctcactaaatcgccagtcgagtctaccacggagcctcccgcagtgcgtgccagcgaggaacgcctgtccaacggtgacatatacctgttagagaacggtttgaatttgttcctgtgggtgggggctagtgtacagcagggcgttgtgcagtccctgttttctgtgagctcttttagtcagatcacaagcggactgagcgtcttgccggtattggacaatcccctgtcaaaaaaggtccgtgggctaatcgactctctccgggctcagcgtagcaggtacatgaagctgacagtggttaagcaagaggacaaaatggagatgctgtttaagcatttcctggtcgaggacaagagcctgagcgggggagcaagttacgttgactttctatgccacatgcataaggaaatcaggcagttgctgagttag

SEQ ID NO: 53764 - DNA, 1029 bp, Artificial Sequence
  Description of Artificial Sequence: Synthetic coding sequence
atgagagtccgcacgagtaccggtattcgcgctgtggatttctttggggctttctatatgagtaatactaccgatgtggagctggccggactagacggggataagacggttaccgtggaatttaaacatgatgatagactcaatgaggagagcggcgcacttctgcagtgtgccctgctgtacacgtcctgcgccggtcaacgtcggctccggatccacaatctggcgctgaattgttgtacccagttggcggacttgtaccgcaattgcgagaccgatactctgatcaattacatggctaagttcgcctacagaggtgtcctcaacagtccagtcaaggccgtacgagatacactaattacgcaatgcgcccagatcctcgcgtgctatcggaaaaattgtgcttctccgagtagtgcaggccagctaatcctcccagaatgtatgaagctattgcctgtctatctcaattgcgttctcaagtcggatgtgttgcagcccggtgccgaagtgactaccgacgatcgggcatatgtgcggcagctggtgaccagcatggacgtgacagagactaacgtctttttctaccccaggttgctgccgctgaccaaatctcccgtggaatcgaccacagaaccccctgctgtgagggcttcagaggagagactctcaaatggcgacatctacctgttagaaaatggactcaatctcttcctgtgggttggcgcaagtgtgcaacaaggagtggtacagagcctgttcagcgtctcctccttttctcagatcacctccggcttgagcgttctacctgtgctcgacaatcctctgtcaaagaaggtaagaggtttgatcgattcactaagagcacagagatcacggtatatgaaattgacggtggttaaacaagaggacaagatggagatgctgttcaaacattttcttgtagaagataagtccctgagtgggggagcgagttacgtagacttcctttgtcatatgcataaggaaatcagacagctgctgagttag

SEQ ID NO: 53765 - DNA, 3099 bp, Artificial Sequence
  Description of Artificial Sequence: Synthetic coding sequence
atgagtcaacaagggtatgttgccaccccgccatactcgcagcctcagccgggtatcgggctatcaccacctcactatggacattatggagatccctcccacaccgcgtccccaaccggcatgatgaaacccgcaggccctttgggggctaccgccaccaggggaatgcttcctcctggacctccaccacccggacctcatcagtttgggcaaaatggcgctcatgccacaggacaccccccacagaggtttcctggaccaccccctgtgaacaatgttgcaagttcccacgctccatatcagccatccgcccaaagttcataccctgggccaatatccacatcttctgtcacgcaactgggaagtcagctctctgccatgcagattaatagttacggcagtgggatggcccctccctcacagggcccacccggacccttgagcgcaacctcactgcaaaccccccctcgccctccccaaccttcgatcttgcagccagggtctcaagtcttaccaccccctccgactacacttaacggaccgggagcaagtcctctgcctctgcctatgtatcgacctgacggtctttctggcccaccccctcccaacgctcaataccaaccaccccctctgccagggcagactttaggagctgggtatcctcctcaacaagccaattccggtccacaaatggcgggagcacagctgagctatccagggggttttcctggaggacctgcgcaaatggctggccctccacagccacagaagaaactcgatcctgacagcatcccctcgccaattcaagtcatcgaaaacgatagagccagcagaggagggcaggtgtatgcaacaaacacaagagggcaaatcccgccactggttacaactgactgcatgatccaagaccagggtaatgccagtccgagatttattagatgcacaacttattgtttcccatgcactagtgacatggctaagcaggcacagatcccgctagccgctgttataaagccattcgctactattcctagcaatgagagcccgttgtatttggtaaaccacggagagtctggccctgtgcgttgcaatagatgcaaggcctatatgtgcccctttatgcagttcatcgagggtggacggagatatcaatgcggattctgtaactgtgtgaatgacgtccctccattctactttcaacatctggaccacatcggcagaaggctagaccactacgagaagcccgagctctcccttggtagttatgaatatgtggcaactcttgattactgccgaaagagcaaaccgcctaacccccctgcatttatttttatgatcgatgtgtcctattcgaatattaagaatggtctggtgaagcttatctgcgaggagctgaaaacaatgctcgaaaaaatacctaaggaggagcaggaagaaactagcgcgataagggtcggattcattacgtataataaggtcctgcatttcttcaacgtaaaaagcaacctcgcccaacctcaaatgatggtcgttacagatgttggagaggttttcgtgccacttttggatggtttcctggttaattatcaggagtctcagagtgtgatccataaccttcttgaccaaatccctgacatgttcgccgactccaacgagaatgaaacagtgtttgcccctgtgatccaagcgggaatggaggccttaaaagctgccgactgtccagggaaactcttcattttccatagttctttgcccacagcagaggccccaggcaagctgaaaaatagagacgataaaaagctcgtcaataccgacaaggaaaaaatactgtttcagccccaaactaacgtgtatgactccctagccaaggactgcgttgcccacgggtgttcagtgacgctgtttctgttcccttctcagtacgtggacgtggcttccctgggcctggtgcctcagctaaccgggggaaccttgtataagtacaataacttccagatgcacctggatcgtcagcaatttcttaacgacctccggaatgacattgagaaaaagattggctttgatgctattatgcgagtgcggaccagcacaggattcagggcgaccgacttttttggcggaattctcatgaacaacacaaccgatgtcgagatggcagccatcgattgcgataaggcagttaccgtagagttcaagcatgatgacaaactgtccgaagattccggggcactcatacagtgcgcggttttgtacactaccataagcgggcagcggagattgagaatccacaacctgggcttaaattgtagctctcagttggccgatctgtataagtcttgcgagacggacgccttaattaacttctttgctaaaagcgcttttaaggcagtgttacatcaacccctgaaagtaattcgagaaatcctggtaaaccagactgcccacatgttggcttgttaccgcaaaaattgtgcctcccccagcgccgctagccagctgattttacccgatagcatgaaggtgctcccagtgtacatgaactgcctcctgaaaaattgcgtgctcttgtcgagacccgaaatatccaccgacgaacgcgcataccagcggcagttggttatgactatgggcgtggccgatagccaactatttttctatccacagttgttgcctatacacaccttagatgtgaagtcgactatgttgcccgcagcagtgcgctgctccgaatcgcgcctgagcgaagagggcatcttcctgttagcaaacggacttcatatgttcttgtggctgggggtatcctcccctccagagctcatccagggaatttttaacgtgccctccttcgcgcacatcaacacggatatgactctcttaccagaggtgggtaatccctactctcaacagctacggatgatcatgggcatcatccagcagaaacggccatactccatgaagcttactatcgtcaaacagcgtgagcaacctgagatggtattccggcaattcctcgtcgaggataagggactgtacggcggatcctcatatgtggacttcctgtgttgcgttcacaaggagatttgccagctgcttaactag

SEQ ID NO: 53766 - DNA, 3102 bp, Artificial Sequence
  Description of Artificial Sequence: Synthetic coding sequence
atgagccaacagggctacgtcgcgacgccaccgtactcccaacctcaacctggtatcgggctctcgccaccacactatggccattatggagacccttctcataccgcatcccccactggcatgatgaaacccgcaggcccactgggtgccactgccaccaggggcatgcttcctccagggccacccccacccggtccacatcagtttggccagaacggagcacatgcaacaggtcatccccctcagagatttccgggacctccgccagtcaataatgtagcttcaagccatgctccctatcagccatctgcccagagcagttacccagggcctattagtaccagtagtgtgacgcagctgggctctcagctatctgctatgcaaattaatagctacggatcaggcatggcccctccttcccaaggaccaccagggccattatctgcgacttcactccaaacgcctccccgacctcctcagcccagcatcctccagcccggatcccaagtcctgccaccccctccaaccacgctcaacgggccaggagctagccctctgcccctgcctatgtacagacccgacggcttaagtgggcctcctccacctaacgctcagtaccagccccctcctctgcccggacagacactcggtgctggctaccccccacagcaggcagccaattctgggcctcagatggcaggcgcacagctcagctaccctggtggattccctggtggcccagcacaaatggccggaccaccacaaccacaaaagaagttggacccagactctattcccagccctattcaggtgatcgaaaatgaccgggcatctcgtggagggcaggtgtatgcgaccaacaccagaggccagattcctccactcgtgacgactgattgtatgatccaggaccagggaaacgcgtcacccagatttattaggtgcactacttactgttttccctgtacctctgacatggcaaagcaggcacagatccccctggccgctgttatcaagccatttgcaacaattccgtccaacgagagccccctgtacctggtcaatcacggcgaaagtgggcctgtgcgctgcaaccggtgtaaggcttatatgtgtccattcatgcagtttattgaagggggaagaagataccagtgtggcttctgcaactgcgtgaatgacgttcccccattctattttcagcatctcgaccatatcggtaggagattagaccattacgagaagcccgagctcagtctcggctcttatgagtatgttgccaccctcgattactgtcgaaagtctaagcctcctaatccacctgccttcatatttatgatcgatgtcagctatagcaatatcaagaacgggctggttaaactcatatgcgaggaactgaagaccatgttggagaagattcctaaggaggagcaggaagaaacgtccgcaatcagagtgggattcattacctacaacaaggtcctgcatttcttcaatgtgaaatctaacttggcccagccccagatgatggtggtaaccgacgtgggagaggtgttcgtgcctctgttggatggctttctggtcaattaccaggaatcccagagcgtgattcataatctgctggaccagataccagacatgtttgcagatagcaacgaaaatgagactgtattcgctcctgtgattcaagcaggaatggaggctctgaaagccgctgactgtcccggaaaactgttcatctttcacagttccctgccgacagctgaggcacctggaaaactcaaaaatcgggacgacaaaaagcttgtgaacaccgacaaggaaaaaattctttttcaacctcagactaatgtctacgatagtctcgcaaaggattgtgtggctcatggttgttctgtgaccctgtttctctttcctagtcagtatgtggatgtcgctagcctgggcttggtgcctcagctcactggcggtacgctttataaatataataatttccaaatgcacctggataggcagcagtttcttaacgatctgaggaatgacatcgaaaagaagatcggattcgatgccataatgcgcgtccggacgtcaacgggtttcagggccaccgactttttcgggggtatccttatgaacaatacaacggatgtcgaaatggcagccatagattgtgacaaggctgtgaccgtggagtttaagcatgacgataaactgagcgaggatagtggcgctctcatccagtgtgcagtgctttataccacgatctccggacaaaggcgtttacgaattcataatctcgggctgaattgcagcagtcagctggcagacttgtataagagttgcgaaactgacgctcttatcaatttcttcgcgaaatctgcatttaaggcagtgctccaccagccccttaaggtcatcagagagatcctagtgaaccaaactgcacacatgctagcatgttacaggaagaattgtgcctctccatctgcagcctcccaactaatcctccctgattctatgaaagtactgccagtgtatatgaattgcctccttaaaaattgcgttctcctctcaagacccgagattagtacggatgagcgcgcataccagcgccagctggtgatgaccatgggggtggctgattctcagctgttcttctacccccagctcttacccatacacacacttgacgtgaaatccacaatgctgcccgcagccgtgcggtgctccgagtccaggcttagcgaagaaggaatctttctgttagcaaacggcctacacatgttcttatggttaggggtaagctctccaccagagctgattcaaggcatttttaacgtgcccagcttcgcccacattaatacggacatgactttgctgcccgaagtgggcaacccatacagccaacagctacgcatgattatgggcataatacagcagaaacgaccatacagcatgaagcttacaatcgtgaagcagagagagcagccagagatggtttttagacaattcctcgtggaggataagggtctgtatggcggaagttcctacgtcgactttctctgttgcgtgcacaaagaaatctgccagctgcttaattag

SEQ ID NO: 53767 - DNA, 1182 bp, Artificial Sequence
  Description of Artificial Sequence: Synthetic coding sequence
atgatagacgtgtcttacagcaatatcaaaaacgggctcgtaaagttgatttgtgaagaactcaagacgatgctggaaaagattcccaaagaggaacaagaggaaacctctgctatccgagtggggtttataacatataacaaggtgctgcatttcttcaatgtgaaaagtaacctggcgcagcctcaaatgatggttgtgaccgatgtgggggaagtcttcgtgcccctgctcgacgggttcttagttaactaccaggaatcgcaaagcgtgatccacaacctgctagatcagataccggacatgttcgcagattctaacgaaaatgagactgtgttcgctccagttattcaggcgggaatggaagctttgaaagccgcagactgtcccggaaagttgttcatcttccatagtagcctgcctactgcggaggcccctggcaagttgaagaacagggacgataagaaactcgttaatactgataaagagaagattctgttccagcctcagacaaatgtttatgatagtctcgccaaggactgcgtggcccatggatgctccgtcacactgtttctattcccctcacagtacgtggacgtcgcttcacttggactggttcctcagctgaccggcggaaccctctataaatacaacaactttcagatgcacctagataggcagcagttcctcaatgacttacggaacgatatcgagaagaaaattggcttcgacgcaatcatgcgcgtgagaacctccactggcttccgggcaacggatttttttgggggaatactcatgaataatacaaccgatgtagagatggctgctattgactgcgataaggctgtcactgtggagttcaagcatgatgacaagctctccgaagatagtggagctcttatccagtgtgccgtgttatatacgacaatttctggacagagacggttgcgtatacacaaccttgggctaaattgcagtagccagctggcggatctctataaatcatgcgagaccgacgctctgattaatttcttcgctaaatcagctttcaaggctgtgctgcaccagccgcttaaggtgatccgcgaaatacttgtgaaccagacagcccacatgctcgcctgctatcgaaaaaactgcgcctcaccatctgccgcatcccagttcacatgtgagaagtag

SEQ ID NO: 53768 - DNA, 1182 bp, Artificial Sequence
  Description of Artificial Sequence: Synthetic coding sequence
atgatagacgtatcttactctaacattaagaatggcctggtgaaactgatttgcgaggagcttaaaacaatgttagagaagattccgaaggaagaacaagaggagacatctgccatccgagttggcttcatcacatacaacaaagtccttcacttctttaacgttaaaagcaacctagctcagccgcaaatgatggtggtaaccgacgttggcgaagtctttgtgccgttgcttgatggatttctagtgaattaccaagagtcccagtccgtgattcataacctccttgatcaaatccctgacatgttcgccgacagtaacgagaacgagaccgtgttcgcacctgttatccaggccggtatggaggcccttaaagcggctgactgccctggcaagttgtttatattccatagctcgctgcctactgcagaggctcccggtaagctaaagaaccgcgatgacaaaaaactggttaacactgacaaagagaagatcttattccagccacaaacgaacgtctacgactcgttggccaaggactgtgttgctcacgggtgctccgtgaccctgttcctgttccctagccagtatgttgatgtggcttctttggggttggtgccccagctcacaggtgggaccctgtacaaatataacaacttccaaatgcatctggataggcaacaattcctgaacgacctccggaacgatattgagaagaagatcggatttgacgcaatcatgcgggtacgcacctcaaccggcttcagggccactgacttttttggaggaattcttatgaataacactacagatgtagagatggctgctattgattgcgacaaagctgttactgttgaattcaaacacgacgacaagttgagcgaggactctggcgctttaatccagtgcgcagttctgtacacaacaatctcaggacagagaagactgcggatccataatttaggcctgaattgctcatctcagctcgccgatctttataaaagttgtgagaccgacgcactgatcaattttttcgccaaaagcgcttttaaagccgtcctgcaccaaccacttaaggtgattagggagattcttgttaatcagaccgcccatatgcttgcttgctatagaaagaactgcgcatctccctctgcagcctcacagttcacctgcgagaaatag

SEQ ID NO: 53769 - DNA, 2910 bp, Artificial Sequence
  Description of Artificial Sequence: Synthetic coding sequence
atggtcaagctcgttcttctgtccatcgtcctgctcaaggtgacagttccaaaacttagcaatgacttactacagctcgactttatgcccattcacaggggcatattggccattgcctggagcatggctgaccccgagcttctcctgtcttgtggaaaggacgccaagatcctttgctctaaccccaacaccggcgaagttctgtacgagctgccaacaaatacccagtggtgttttgacatccagtggtgtccacggaacccagccgtgctatctgcggcaagctttgacgggagaatcagcgtatattccatcatgggaggctcgaccgacggactgagacagaagcaagtggataagttatcgtcgtccttcggcaacttggaccccttcggtactggacaacctctgccccctctgcagatccctcagcagaccgcacagcactccatcgtgttacctttaaagaagccaccaaaatggattagacggccagtgggggctagtttctcctttggcggaaagctcgtcaccttcgaaaacgtgcggatgccttctcaccaaggcgcagaacagcagcagcaacaacaccatgtctttatttcccaggtggtgacagagaaggagttcctgtcccggtccgatcagctgcagcaggccgttcagagccaaggattcatcaactactgccaaaagaaaatagatgctagccagaccgagttcgagaagaatgtgtggtcatttttgaaggtgaatttcgaagatgactctcggggaaagtacctcgagctcctagggtaccgaaaagaagatcttggcaagaaacacataaaggaagaaaaggaggaatccgagtttctcccaagctccggaggaacatttaatattagcgttagcggcgatatcgacggactgatcacccaggccctcctgaccggcaacttcgagtcagcagtggatttatgtcttcacgacaatagaatggctgacgctattatcctggctatcgcgggaggacaggaactactggcgaggacacagaaaaaatacttcgcaaagagtcagtctaagattacccgcctgatcactgctgtggttatgaaaaattggaaggaaatagtggaatcttgtgacctgaaaaattggagggaggctctggccgcagtgctcacatacgctaaaccagacgagttttctgccttatgtgatcttctggggacccgcttggagaacgagggtgactcactgctccagacccaagcctgcttatgttatatctgtgctgggaacgttgagaaactggtagcatgttggaccaaagctcaggatggaagccatccactgagtttgcaggatctgatcgaaaaagtggtgatcttgaggaaggccgtgcaactgactcaagctatggatacctctacagttggtgttctgctcgccgcaaaaatgagccagtatgccaatctgcttgcagcgcagggatctattgccgcagccctggcctttcttcccgataataccaatcagcctaatatcatgcaactcagagatcgcctgtgccgcgcacagggggagcccgtagcaggacatgagtccccaaaaatcccgtatgagaaacaacaactgcccaagggtcgccctgggccagtcgcagggcaccatcaaatgccccgtgtgcagacacagcagtactacccacatgtacgaatcgccccaactgttactacgtggagcaacaagactcccaccgctttgccaagccaccctcctgcagccagtccctcagacacccagggcgaaaaccctccgccaccaggattcatcatgcacggtaacgtgaatccaaatgctgcaggtcagctccccacaagccccggacacatgcacactcaagtacccccttacccccagccgcagccctaccagcccgctcaaccatacccatttggcaccggcggatccgctatgtacagacctcaacaaccagtcgctccgcctacgtctaacgcctatccgaacacgccgtacatcagtagcgcctccagctacactggacagtcacagctttacgccgctcagcaccaagcatcctcaccaacatccagtcccgcaacttcattccccccacctccgagcagtggcgcatcattccagcacggagggcctggggctccgccatcctcctctgcctatgctttgcccccaggtacaaccggccctcagaacggatggaatgacccccctgccttaaatcgagtgcctaagaagaagaagatgcctgagaacttcatgcctccagtgcctattacttctcctattatgaatccattgggggatccccagtcacagatgctgcagcagcagccttcagcacctgttcccctgagcagccagtcatcttttccgcagccccacctgcccggaggccaaccttttcacggtgtgcagcaacccctcgggcagaccggtatgccccctagcttctccaagcccaatatagagggagctcctggggcacctattggtaatacgttccagcatgtacagtctcttcccacaaaaaagataaccaagaagcctattccagacgaacatctgatcctcaagacaacttttgaggaccttatacagaggtgcctgtcatctgccacagacccacagaccaagaggaagcttgacgatgcaagcaaacgactcgaatttctatacgacaagttgcgcgagcagactttgtcaccaacaatcacctcaggcttgcacaatatcgcaagatccattgagacaaggaactacagtgaaggcttgaccatgcacacccacattgtttccacttctaacttttcagagacctccgcctttatgcccgtcttaaaagtggtcctcacacaagccaacaagctcggcgtttag

SEQ ID NO: 53770 - DNA, 3321 bp, Artificial Sequence
  Description of Artificial Sequence: Synthetic coding sequence
atgaaactaaaggaggtggacagaaccgctatgcaagcttggagcccggctcagaatcatcccatatacctggctacagggaccagcgcacagcagctcgacgcaactttttccactaatgcctccttggaaattttcgagctggatttgagcgacccatcacttgacatgaagtcttgcgccaccttctctagctcacatcgctatcacaagctcatttggggtccatataaaatggatagcaagggtgatgtatctggtgtgttgatcgctggaggggagaacgggaacattattctttatgatccttccaaaattatcgccggtgataaggaggttgtaatcgcccagaatgataaacatactggacccgtgcgcgctctcgatgtgaacatttttcaaaccaaccttgttgcatccggagccaacgagagcgaaatctatatttgggacctcaataacttcgcgacccccatgaccccaggagcaaagacacaaccccctgaagatatctcatgtatcgcctggaacagacaggttcagcacattctggcttcagcttcaccctccggcagagcaactgtgtgggatcttagaaagaatgagcctataatcaaggtgtccgatcatagtaacaggatgcactgttctggattagcttggcatcccgatgtggctactcagatggttctggcttcggaggacgatcgtctgcccgtgattcagatgtgggacttgagattcgccagtagccctctgcgtgtgcttgagaatcacgctcgtggcattctcgccattgcctggtctatggctgacccggagctccttctctcctgcggtaaagatgccaagatcctttgctctaaccctaataccggcgaggttctctacgagctcccaaccaacacccagtggtgctttgacatccagtggtgtccccgaaatcccgctgttctgtctgcggcttccttcgacgggaggatttctgtgtacagtattatgggtggaagcaccgatggactgaggcagaaacaggtcgacaagttgagctcatccttcggaaatctagacccattcggcacgggacaacccctgcctccactccagatccctcagcagactgcccaacacagtatcgtgcttcccctgaagaagcccccaaaatggatcagaaggccagtcggggcatcattcagcttcggcggtaaactcgtcacattcgagaacgtgaggatgccttcacaccagggggctgagcagcagcagcagcagcaccacgtattcatttcccaagtggttaccgagaaagagtttctgtcgaggagcgaccaactgcagcaggcagttcagtcgcaagggtttatcaattactgtcagaagaagatcgacgccagtcagactgagtttgagaaaaatgtctggagtttcttgaaggttaacttcgaggacgattccagaggtaaatatctggagcttcttggctatagaaaggaggatctcggaaagaagatagcattggccctgaataaggttgacggcgcaaacgtggccctgaaagattctgatcaggtggcacaatcagatggcgaggaatcgcctgcagccgaggagcagctgcttggtgagcacatcaaggaagagaaggaggagtccgaatttttaccgtcctcaggcggaaccttcaacatatctgtgtctggcgatatcgacggtcttatcacacaggctcttctcactggaaattttgaatcagctgtcgatctatgccttcatgacaacagaatggcagacgccatcattcttgccatcgctggcggacaagaactgttggcacgaacacagaagaaatattttgcaaaatcacagtctaaaatcacacgcctaatcacagctgtggtcatgaagaattggaaggaaatcgtcgagagttgcgatcttaagaattggcgtgaagcgctggcggcagtcctgacatatgctaaacccgatgagttctccgccctttgtgacctgctgggtactcgcctggagaatgaaggtgatagtctcctgcaaacacaggcttgcctgtgctacatatgcgcagggaacgttgaaaagcttgtggcttgttggaccaaagcgcaagacggttcccatcctctgagtctccaggacctgatcgagaaagtggtgattctgcgaaaggcggttcagctgacacaagcaatggataccagtacagtgggagtactgcttgccgcaaaaatgagccagtatgcgaacttgctggcggcacagggctccattgccgctgccctggcattcctgcccgacaacacaaaccagccgaacatcatgcagttgcgcgatagactgtgccgggcacaaggggaaccagttgcgggtcatgagagccccaagatcccttacgaaaaacagcagttgcccaaaggcagacctggtcccgtcgccggtcatcaccagatgccacgggtgcagacgcagcagtattacccgcacggggaaaatcctcctccaccgggtttcatcatgcatggcaatgtcaatcccaacgccgctggtcagctgccaacttcccccggtcacatgcatacccaggtccctccctatccccagccccagaggccccagaacggttggaacgatccgccagctctgaatagggtccctaaaaagaagaagatgcccgagaactttatgcctccagtgccaataacatcccctattatgaacccactgggagaccctcagtctcagatgctacagcaacagccaagtgcgcctgtaccactctcatcacaaagtagcttccctcagccccaccttcctggcggtcagcccttccatggtgtccagcagccattaggccagactgggatgccaccttctttctcaaagccaaatatcgagggcgctcccggagcacctataggaaacacattccagcacgtgcaaagtctgcctaccaagaagattactaagaagcctatccccgacgagcatctcatcctcaagaccactttcgaagacctgattcagcggtgcctgtccagtgccaccgaccctcagaccaagagaaaactcgacgacgcttccaagcgcctcgaattcctctacgacaagcttagagagcaaactctgagccccaccatcacaagtgggcttcacaacatagcgagaagcattgagacacgaaactattcagaaggcttgacaatgcacactcatattgtcagcacgagtaatttctccgagacctccgcttttatgccggtgctgaaggtagttcttacacaagcgaataaactgggagtgtag

SEQ ID NO: 53771 - DNA, 3546 bp, Artificial Sequence
  Description of Artificial Sequence: Synthetic coding sequence
atgaagctgaaggaggttgacaggacagcgatgcaggcctggtcgccggcacaaaaccacccaatctacttggcgaccggaacatccgcccaacagctcgatgctacctttagcaccaatgcctctctggagattttcgaactggatttgtctgatccttcattagacatgaaaagctgcgctaccttctcgtcttctcacagataccacaaacttatttgggggccttataagatggacagtaagggtgacgtttctggtgtgttgatcgcaggaggcgaaaatgggaatattattctttatgatccgtctaaaattattgctggcgacaaggaagtggtgatcgctcagaacgataagcatacgggcccagtgcgcgctttggacgttaatatctttcagactaatctcgttgccagtggagccaacgagagtgaaatttacatttgggacctgaacaattttgctacccccatgacgcccggagccaaaacccaacctccagaagacatttcgtgtattgcctggaacaggcaagtccagcatatactggcctctgcttccccgtccggcagagctaccgtgtgggatctgaggaagaatgaacctataataaaggtctcagaccacagcaaccggatgcactgtagcggtctggcctggcatcccgacgtggccacccagatggtgctggccagcgaggacgacaggctacccgtgatacagatgtgggacttacgcttcgcctcttccccattaagagtgctggagaaccacgcacgcggtatactggctatcgcatggagcatggccgatcccgaactactgctgtcgtgcggcaaagacgcaaaaatcctgtgctctaaccccaacaccggagaagtgctgtatgagttgccgaccaatacacaatggtgcttcgatattcagtggtgtcctagaaatccagcagttctttcggccgcaagcttcgatggacgtatttcagtgtatagcatcatggggggttccaccgatgggctgagacagaaacaggttgacaagctatcctcctccttcggcaatctggatccattcggaaccggccagccactgcctcccttgcagattcctcagcagactgcacagcatagtattgtgctccccctgaaaaaacccccaaaatggatcagaaggcccgtcggggcaagtttctctttcggaggaaagctggtgacgttcgaaaatgttagaatgccctctcatcagggagcagaacagcaacaacagcagcatcacgtttttatatcccaggttgttacagaaaaagagttcctttccaggtcagatcagcttcagcaggctgtgcagagtcaggggttcatcaactactgccagaagaagatcgacgcctcacaaaccgagtttgagaaaaatgtgtggagcttccttaaagtaaattttgaagatgacagtcgagggaaatatctggagcttctaggatatcggaaagaggacctgggcaaaaaacacattaaggaagaaaaggaagagtctgaatttctgccctccagtggaggcacttttaacatttcagtaagcggggacatcgacggtctgatcactcaggctctgctgaccggtaacttcgagagtgctgtcgacttgtgtttgcacgacaaccgaatggctgatgctattattctggccatcgcaggcggacaggagctcctggcccgaacccaaaagaaatactttgcaaaatcccaaagtaaaatcaccagactgataaccgctgttgtgatgaaaaattggaaagaaatcgttgaaagctgcgacctcaagaactggcgagaggcactggctgcggtacttacctatgctaaaccagatgaatttagcgccttatgtgatttgttgggaacccggttagagaacgagggggattccttattgcagacccaagcttgtctttgttatatatgcgccggtaacgtggaaaaactggtagcctgttggacaaaagcacaggatggctctcacccgttgtcactgcaagacttgattgaaaaggtggtgattttgagaaaggcagtccagctgactcaagcgatggacaccagtactgtcggcgttctactggctgccaaaatgagccaatacgccaaccttctggctgcccagggctctattgctgctgcattggcatttctgcccgacaataccaatcagccaaatatcatgcagttaagggaccggctgtgcagggcccaaggtgagccagtggctgggcacgagtcaccaaagataccctatgagaaacagcaactccccaaaggaaggcccggaccagtggctggacaccatcagatgcctcgcgtgcagacacagcaatactatccgcatggggagaatcctcctcccccaggatttatcatgcatggcaatgtgaaccccaatgctgccggtcagctgcccacctctcctggccacatgcacactcaggtgcctccatatcctcagcctcaaccctaccagcctgcacagccataccccttcgggacaggcggaagcgcaatgtacagaccacagcagcctgtggccccaccaacaagcaacgcataccctaatactccttacattagcagtgcctcttcatatacgggacaaagtcagctgtatgctgcacaacaccaggccagttcaccgacaagcagtcccgctactagctttccaccgccacccagttcaggagctagcttccagcatggagggccaggtgccccaccttctagcagcgcatacgcactaccacccggtacgaccggaactctgcccgctgcaagcgagctcccggctagccaacggactggacctcagaacggctggaacgacccacccgctctgaaccgcgtgcccaagaagaagaaaatgccagagaacttcatgccccctgttcctataacaagccctataatgaaccccttgggggatccccagtcccagatgctgcagcagcaaccgtccgctccagtgcctctgtctagccagtccagtttccctcaaccacatctccctgggggacagccctttcatggagtccaacaacccctaggtcagactggcatgccgccatctttctcaaagccaaatattgaaggagcccctggcgctccaattggcaacactttccagcacgtgcagtctctgccaactaagaaaattacaaaaaagccaattcccgacgaacatctgatactcaagactacatttgaggatttgattcagaggtgcctgagcagcgcaaccgacccccaaaccaagaggaagctggacgatgctagcaaacggttggagtttttatacgataaacttagagaacagactctgagtcccacaatcacctcagggttgcacaacattgcacgttctatcgaaacacgtaactacagcgaagggttgacaatgcacacccacatagtcagcacaagtaattttagcgaaaccagtgccttcatgcccgtacttaaggtggtactgacccaagcaaacaagcttggtgtatag

SEQ ID NO: 53772 - DNA, 3546 bp, Artificial Sequence
  Description of Artificial Sequence: Synthetic coding sequence
atgaaactgaaggaggtcgataggaccgccatgcaagcctggagccccgctcaaaaccaccctatttatctggcgacaggcacatccgcccagcagcttgacgcaacattttcgacgaacgcctctctggagatcttcgagctcgatctgtccgatcccagcttagatatgaaaagctgcgcgaccttttcctcgtcccaccgttatcacaaactgatatggggcccttataagatggacagcaaaggagacgtgtcaggagtgcttattgcagggggagaaaatggcaacattattttatacgatccctcaaagataatcgccggagacaaagaagtggtgattgcgcaaaacgacaaacacacgggccctgtgcgggctttagatgtgaatatctttcaaactaacctcgtggccagcggcgctaacgaatccgagatttacatttgggatttgaacaacttcgcgaccccaatgacaccaggggcaaagacgcagcccccagaggacatttcctgcatagcgtggaaccgacaggttcaacacatcctggcctccgcctccccttcagggagggccactgtttgggacctacggaagaatgagcccatcattaaggtctctgatcattctaaccgtatgcattgcagcggactggcctggcaccccgatgtggctacccagatggtcctcgctagcgaggacgacaggctccccgtcatccaaatgtgggacctccgattcgcctcatccccactgagagtgttggaaaatcatgcccgtgggatactggcaatagcctggtccatggcagacccggagctgctgttgtcatgcgggaaagatgccaagatcctgtgtagtaatcccaatacgggggaagttctttatgagctgccaacaaacactcaatggtgcttcgacatacagtggtgccctaggaatcctgccgtgctgagtgccgctagttttgacggacggatctctgtttattccattatggggggttcaacagatggcctccgacaaaagcaggtggacaagctatcctcatcctttggaaatctcgacccatttggaaccggccagcccctgccgccactgcagatccctcagcagaccgcccaacactccattgtgttgccactcaagaagcctccaaagtggattaggaggcccgtgggcgcatccttctcatttgggggaaagttagtgaccttcgaaaacgtccgcatgccctcccatcagggtgctgagcaacagcagcagcaacaccacgtgtttatctcacaggtggtcacagaaaaggaattcttgagtaggagcgatcagttgcaacaagccgtgcagtcccaaggcttcataaattattgtcagaaaaaaatcgatgcatcgcagacagagttcgaaaaaaacgtttggtcctttctgaaagttaactttgaggatgattctagaggaaaatacttagagctgctaggttacaggaaagaagatctagggaaaaaacatatcaaagaggagaaagaggagtccgagttcctgcctagttctggtggtaccttcaacatctccgtttccggggacattgacggcttgatcacacaggcacttctcaccggcaacttcgaatcggcagtagacttatgcttacacgataatcgcatggctgatgccattatcctcgcaatcgccggtggccaggaacttctggctcggactcagaaaaaatattttgccaagagccagtctaaaattacgcgtcttatcacagcggtggtcatgaagaattggaaggagattgtcgagtcatgcgacctgaagaactggagagaagcactggcagcagttcttacatatgccaagcctgatgaattcagtgcactctgtgatctcctcgggacccgcctcgagaacgagggtgactctcttctccagacacaggcctgcctttgctatatctgcgcaggcaacgtggaaaaactggtggcgtgttggaccaaagcccaggacgggtcccatccactctcgctccaagacctcattgagaaggtggtcatcttgagaaaggcagtgcagttaacacaggccatggatacctcgactgtgggtgtgctccttgctgccaaaatgagccagtacgctaacctcctggctgcacaaggttcaattgcagccgctctggccttcttgccagacaacaccaaccagccaaatattatgcaattgcgcgaccggctgtgtagagcccaaggagaacctgtggctggacatgagagccctaagattccttacgaaaagcagcagctcccaaaaggacgtcctgggcctgtggcgggtcaccaccaaatgccaagagtgcagactcagcaatattatccccatggtgaaaatccacctccacctggtttcataatgcacgggaatgtgaatccaaacgccgcaggacagcttcctacctcccccggtcacatgcacacacaggtgcctccctatccccagccacagccttatcagccagcccagccctacccattcgggaccgggggatcagccatgtaccggcctcagcagccggtcgccccacccaccagcaatgcctaccctaatacaccctatatttcaagcgcatcatcctacactggacaatctcagctatatgctgcgcaacaccaggccagcagcccaacctctagcccagcaacctcctttcctcctcctccttcatctggcgcatctttccaacacggcggtcctggcgcacctccctcgagcagtgcctatgcacttccgcctggtaccaccggcacccttccagccgcatctgaactcccggcatctcagcgcactggccctcaaaacggatggaatgatcctccagcgcttaatagggtaccaaaaaagaagaagatgcccgagaattttatgccacctgtgcctatcactagccctatcatgaatcctctgggcgatcctcaatcccagatgctgcagcaacagccttcagctccggtgcctctatctagccagtctagctttccacagccccacttgccaggcggacaaccgttccacggggtgcagcaaccattgggacaaacaggaatgcccccaagcttctcaaagcctaacatagagggggctcctggggcacctattgggaatacttttcaacatgtccaaagcctccccaccaagaaaatcacaaaaaagcctatccctgacgaacatcttattctcaagaccactttcgaggacctgattcaacgctgtctgagcagcgctaccgaccctcagaccaaaaggaagctggacgatgcttctaagcgtttggaattcctgtatgataaactcagagagcaaactctgagcccgaccataacatccggccttcataatatcgctcgctcaatagaaactaggaactatagcgaggggttgacgatgcatacacatatagtgtctacaagcaattttagcgaaacctccgcattcatgcctgtgttgaaagtagtgttgacacaagctaacaaactgggggtgtag

SEQ ID NO: 53773 - DNA, 3663 bp, Artificial Sequence
  Description of Artificial Sequence: Synthetic coding sequence
atgaaattgaaggaggtagacagaaccgctatgcaggcatggtcacctgctcaaaaccatcccatataccttgctaccggaaccagtgcacaacagttggatgctactttctcgaccaacgcatcgctggagatctttgaactcgatctctctgaccctagcctggacatgaagagctgtgccacatttagtagttcgcaccgctaccataaactgatttggggcccttataaaatggacagcaaaggggacgtatctggggtgctgatcgcaggaggagagaacggcaatataatcttatacgacccttctaagatcattgctggagataaagaggtcgttattgctcaaaatgacaaacacactggcccagtgagagcgctggacgtcaatatatttcagactaatttagtggcatctggggcaaacgagagcgagatttacatatgggacctcaataatttcgctactcctatgaccccaggagccaagactcagcccccagaagatatttcctgtatcgcatggaacagacaggtccagcacattctcgcaagtgcttccccaagtggcagggctaccgtttgggacctgagaaagaacgaaccaattatcaaggtttcggaccattctaacagaatgcattgtagtgggctagcctggcatccagacgttgccacccaaatggtgctcgcaagcgaagatgatcggctacctgtgattcaaatgtgggacctaaggttcgcatcttcacctctgagggtcttggaaaatcacgcgaggggaatcctcgctatcgcttggagcatggctgatcccgaactactgctgtcctgtggcaaggatgccaaaatactgtgttccaaccccaatactggcgaggtgctttacgaactgcccactaatactcaatggtgtttcgatattcaatggtgtccccgaaatcctgcagtcctgtctgcagcttctttcgacggccgaatcagtgtgtattcaataatggggggtagcactgacgggctgcggcagaaacaagtggacaaattgtcctcttccttcggcaatctcgacccattcgggaccggccagcccctacctcctctccaaattcctcagcagaccgctcagcacagtatcgtgttaccactgaagaagccacctaaatggatcaggcggccagtgggcgcaagctttagtttcggcggtaaactggtaacctttgagaacgttagaatgccaagccaccagggtgctgaacagcaacagcagcagcaccatgtcttcatcagccaagtcgtgacagagaaagagtttctgtccagaagcgaccagctgcagcaggcagtgcagtctcaaggcttcattaactattgccagaagaagatcgacgcttcccagacggaatttgagaagaacgtgtggagcttcttgaaagtaaactttgaagacgactcaaggggaaagtacttggaactcctgggatatcgtaaggaagacctcggcaagaagatcgccctggcgctgaacaaagtcgacggcgctaacgttgccctcaaggactccgatcaggtggcccagtccgacggcgaggaaagccccgctgcggaggaacagcttttgggagagcatattaaagaagagaaggaagagagcgagtttcttccatcatctggtgggacgtttaacatatccgtgtccggcgacatcgatgggctgattacacaagcactcctgactggcaacttcgaatccgccgtggacttgtgcctgcacgacaatcgcatggcagatgccatcatcctggccattgcgggaggccaggaactcctggcacgcacccagaagaagtattttgccaaatctcagtccaaaatcaccaggctgattactgcagttgttatgaaaaattggaaagagatcgtggaaagctgcgacctaaaaaattggagggaggccttagcagccgttctgacttatgctaaaccggacgaattctctgccttatgcgacttactaggcaccaggcttgagaacgaaggcgattccctgctgcaaacgcaggcttgtctctgctacatctgcgccggaaacgtggaaaaactggttgcttgctggactaaagctcaagacggttctcatcctctctccttgcaggacctgatcgaaaaggtagttatactgcgcaaagccgtgcagctgacgcaggccatggacacatctaccgtcggggttctgctcgcagctaagatgagtcagtatgcaaacttattggcagcccagggatcgatcgctgccgctttagccttcctccccgacaacacaaaccagcctaatatcatgcagctccgcgacagactctgtagggcccagggcgagccggttgcagggcatgaatcacccaaaataccttacgaaaagcagcagctccccaagggaagacctgggcctgtagctggacatcaccagatgcctagagtgcagactcaacagtactatccacacggtgagaacccgcctccaccaggtttcataatgcatggcaatgttaatccgaacgcagccggacagctgcccacctcaccaggccatatgcacacccaggtgccaccttaccctcagcctcaaccctaccagcccgcacaaccttacccatttggtactgggggatcagccatgtatcggccacagcagccagtcgctcctcccacgtcaaatgcttatccaaacacgccctacatctcttctgcctcctcttacacaggacagtcacagctctacgcggctcagcaccaggcaagctctccaaccagctcacccgctactagttttccaccgccacccagttcaggcgcaagcttccagcatggcggaccgggagccccacctagttcgagtgcttacgcattaccaccaggcactacgggaacccttcccgctgcatccgagctccctgcttcacaaaggacaggtccccaaaatgggtggaacgatccaccagctctcaaccgggtccccaaaaagaaaaagatgccagaaaattttatgccacccgtgccaattacttcccccataatgaatccacttggtgatccccagagtcagatgctccagcaacagccttccgctcctgtcccgttgagctcccagagcagcttcccccagccccacctgccagggggtcaacccttccatggagtgcagcaacccttgggacagaccggcatgcccccttccttctccaagccaaacatcgagggagcacccggagcgcctataggaaacacgttccagcacgttcaaagtttgccaactaaaaagataaccaaaaagcccatccccgacgagcatctaatactgaagacaacgttcgaggacctgatccagcgctgtctatcctcagctacggatccacaaaccaaacgcaaactagatgacgcatcaaagcgcctggaatttctatatgacaagctgcgggaacagacattgagtccgactatcacatccggcctgcataatattgccagaagcattgaaactcggaactactctgaaggtttgacaatgcatactcacattgtgagcacctctaacttttcagaaacttctgccttcatgcctgtgctcaaggtggttctgacacaggctaataaacttggggtgtag

SEQ ID NO: 53774 - DNA, 3663 bp, Artificial Sequence
  Description of Artificial Sequence: Synthetic coding sequence
atgaagctgaaagaggtggatcggacagccatgcaggcttggtccccagcccagaatcaccctatctacctggctactggcacttctgcgcagcagttagacgcaacatttagtaccaacgcctccttagaaatattcgaactggatctgagcgaccccagcttggacatgaagagttgcgccacattttcaagcagccacaggtatcataagttgatatggggcccatataaaatggactcaaaaggcgatgtctccggcgtgctgatcgcaggaggcgagaatggaaatatcatcctctatgatcccagcaaaataatcgcaggcgacaaggaggtggtgatagctcagaacgacaagcacactggacctgtgagagccctggatgtaaacatcttccagaccaacctggtcgcctccggagcgaacgagagcgagatctacatatgggatctgaataacttcgccactcctatgacccccggtgctaagacccagcctcctgaggacatttcatgcatcgcctggaatcggcaggttcaacacattctggcgagcgcctccccctctggaagagccaccgtgtgggacttgcggaagaacgagcctattatcaaggtgtccgaccacagcaataggatgcattgtagcgggctggcgtggcaccccgacgttgccacccagatggtactggcctctgaagatgataggctcccagttattcagatgtgggacctgcgcttcgcctctagccctctgagagtgctggagaatcatgccagagggattctggcaatcgcttggtcaatggctgaccctgagctgctactctcttgtggcaaggacgccaaaatcctctgctcaaatccaaataccggagaagttctgtacgaattacctactaacacgcagtggtgctttgacattcagtggtgccctagaaatcctgccgtgctgagcgccgcatcctttgacggcagaatatcagtctacagtatcatgggaggctctactgatggcctcaggcagaaacaagtcgataagttgtctagctcattcgggaacttggatcccttcggaacggggcagccgctgcctccactgcaaattccccagcagactgcccagcacagtattgttcttccactcaaaaagccacccaagtggattagacgtccagttggagcgtcattttcttttggcggtaagctggtaacatttgagaacgtgcggatgccatcacatcaaggcgctgagcagcagcaacagcaacaccacgtttttatctcccaggtggttactgagaaggagtttctatctagatccgaccagctgcagcaggccgttcagtcccaaggatttatcaactattgtcagaagaaaatcgacgccagccagaccgagttcgaaaagaatgtctggagtttcctgaaggtgaactttgaggacgattcacgaggaaagtatctggagctgctcggttatagaaaagaggaccttggcaagaaaatcgcactcgccctaaataaagtagatggcgctaacgtcgccttgaaggacagcgatcaagtagcccagtctgacggtgaagagagcccggcagcagaagagcaattgctcggtgagcacattaaggaggagaaagaagagagtgagtttctccccagctcaggcggtacctttaacatatcggtgtccggagacattgacggcctgataacgcaagcactgctaactggtaatttcgagagtgctgtggatctgtgcttacacgacaatcgcatggccgacgccattattctggcaattgccggtggtcaggagcttctagctcgcacgcagaaaaagtatttcgcaaaaagccagtccaaaataacacggcttatcactgcggtggtgatgaagaattggaaggaaatcgtggaatcttgcgatctgaagaattggcgagaagccctggccgcagtgctgacctacgcaaaaccggatgagttttccgcactgtgtgacttactcggcacacgactggagaacgaaggcgattctcttctccagacacaggcatgcctgtgttacatttgtgctggtaacgtggagaaactcgtggcatgctggacgaaagctcaagatggatctcaccctctgagcttacaagacctgatcgaaaaagttgtgatcttgagaaaagctgtgcagctgactcaggccatggacacctcgaccgtgggggtcttgttagcggctaaaatgagccagtacgccaatctcctcgcagcccagggcagtattgcagcagcactggcattcctgcctgataatactaatcagccgaatataatgcagctccgtgacagactctgtcgcgctcagggagagccagtcgctggccatgaatcgcccaaaatcccttatgagaaacaacaattacctaaagggagacctggacccgttgccggtcaccaccagatgcctagggtgcagacccaacagtactatcctcacggggagaatccgcctccacctgggttcatcatgcacgggaatgtcaacccaaacgcagccggtcagctaccgacttccccaggtcacatgcatacgcaggttccaccatacccacagccacagccataccagccagcgcagccctatccattcggcaccggaggctcagccatgtaccggcctcagcagccagtggctccacctaccagcaacgcttatcctaatacgccctacatttcttctgcatcttcttatactggacaaagccaactatatgccgctcaacaccaggcttcgagtccgacatccagtcctgctactagcttcccaccgcctccctccagtggagcctccttccagcacggtggcccaggagcaccaccgtcgtctagtgcctatgccctgccacctggaactaccggtacactccctgctgcaagcgagctacccgcttcccagcgcacagggccacagaatgggtggaacgacccacctgcactaaaccgggtgccaaagaaaaagaaaatgccagagaattttatgccacctgtccccatcacctctcctatcatgaatccactgggtgaccctcaatctcagatgctgcagcagcagccttcagcgcctgtgccattgtccagccagagctcctttcctcagccacatctgccaggagggcaacctttccacggggtgcagcagccactggggcagactggaatgcctccgtcgttcagcaaaccaaacattgagggagcacccggagctcctatcggtaatacattccagcatgtgcagagtctgcctactaagaaaataacaaaaaagccaataccagatgagcacttaatcttgaagaccaccttcgaagaccttattcaaagatgtcttagttctgcgactgacccccagaccaagcggaaactagacgacgccagtaagaggcttgagtttctctatgataagctgcgggagcagacactgagccccactataaccagcgggctgcacaacatcgctagaagtatcgaaacaaggaactacagtgaagggctcactatgcacacccacatcgtgtccacctccaacttttccgaaaccagtgcttttatgccagtacttaaagtcgtgcttacccaagctaacaagcttggcgtttag

SEQ ID NO: 53775 - DNA, 3702 bp, Artificial Sequence
  Description of Artificial Sequence: Synthetic coding sequence
atgaaactgaaggaggttgatcgaacagccatgcaggcatggagccctgcgcaaaaccaccccatctatcttgccacagggacgagtgcccaacagctcgatgccactttctcaactaacgcatcactagaaattttcgagctggacctatccgatccctccctggatatgaaaagctgcgcgacgttttccagctcccaccggtatcataagctcatttggggcccttacaagatggattcaaaaggagacgtttcaggcgtactcatcgctgggggtgaaaatgggaatatcatcctctacgacccaagcaagatcatagccggtgataaggaggtcgtcatcgcacagaatgacaagcataccgggcctgttagggctctggatgtgaacatctttcagaccaatctcgtggcaagcggggcaaacgaatcagaaatctacatttgggatctgaacaacttcgccactcctatgactcctggcgctaaaacccaacccccagaagacatcagttgtatagcatggaacagacaggttcagcatatcctggccagcgcctcgcccagtggacgggcaacggtttgggaccttcggaaaaacgaacccattatcaaagtgtctgatcatagcaatagaatgcattgctccggactcgcatggcatccagatgtggccacccaaatggtgctggcaagtgaagacgataggctccccgtgatacagatgtgggatttaaggttcgccagcagtccactgcgcgtgcttgaaaatcacgcacggggaatcctggcgattgcatggagtatggcagatccggaattgctcctttcttgtggaaaagacgcaaaaatcctgtgttcaaacccgaataccggagaggtgctgtatgagttgccaacaaatacgcagtggtgcttcgacatccagtggtgtccacgcaaccctgcagtgttgtcggctgctagtttcgacgggaggatcagcgtttattcgattatggggggatctacagacggccttaggcagaagcaagtcgacaagctttcatcgtcatttggaaatctcgacccttttggcactggtcagccactgccacctttacaaatcccccagcaaaccgcgcagcatagtatagttttaccactgaaaaagcctcctaaatggatccggaggcctgtcggggctagtttctcattcggcggtaaactggtcacttttgagaatgtcaggatgccctctcatcagggcgctgagcagcaacagcagcagcatcacgtgttcatcagccaggttgtcactgagaaggaatttctgagtcgctccgatcagctccagcaggcagtccagtctcaggggttcatcaattactgtcaaaaaaagatcgacgcatctcaaaccgagttcgagaagaacgtctggagttttttgaaagttaacttcgaggacgatagtcggggaaaatacctggagctgcttggctacaggaaagaagacttggggaagaaaattgccttggcactcaacaaagttgatggcgctaatgtcgcactgaaagactccgaccaagtggcacagagcgatggtgaagaaagccccgcagcggaggaacagctgctgggagaacatatcaaggaagaaaaagaggaatctgagtttttgcctagctcaggagggacgttcaacatcagcgtcagcggggatatcgatggccttattacccaagcgttgctgactggaaacttcgagtccgctgttgacctgtgcttgcacgacaaccgtatggccgacgctattattctcgctatcgctggcggtcaagaactgcttgcacggacgcaaaagaagtacttcgccaagtcccaatccaagatcacccgtttaataaccgccgtcgtcatgaaaaactggaaagagatagtggagtcttgcgacctgaaaaactggcgtgaagcactcgccgcagttctgacatacgctaagcctgatgagtttagcgccctatgcgacttactggggaccagactggagaacgaaggtgacagcctgctgcagacacaggcctgcctgtgctacatctgcgctggaaatgttgaaaagctcgttgcatgttggacaaaagcccaggacggaagccatccactgtccctgcaggatctcatagagaaagtagtcatactgaggaaggcagtgcagctgactcaagccatggatacatccacagtcggtgtgttgctcgcagctaagatgtcccagtatgctaacctgctggccgcacagggttctatcgccgctgctctcgcttttttgcctgacaacaccaatcaaccaaatattatgcaattgagggataggctctgtcgggcacagggtgagcctgttgccggacacgagtcccccaagatcccttatgagaaacaacaactcccaaaggggagaccaggcccagtagccggtcaccaccagatgcccagggttcagacccagcagtactatcctcacggagagaaccccccaccgccagggttcataatgcacggaaatgtcaacccaaacgccgctggccaactccccactagccctggtcacatgcacacacaagtgccaccctatccccagccgcaaccatatcagccggcacagccatatccctttggtaccgggggtagcgctatgtacagaccacaacagccagtggcgcctcctacaagcaatgcatatcccaataccccatacatttcatctgctagttcatacaccggacagtcgcagttatacgcggctcaacatcaggcatcaagccccacgagttctccggcaaccagcttccctccccctccgtcttctggagcaagttttcaacatggtggtcctggcgcacctccaagtagttctgcatacgctctgcctcctggcacaacaggcacccttccggctgccagtgagctccctgcctcccagcggacggagaatcagagcattcaggaccaggccccaatgctggaaggccctcagaacgggtggaatgatccgccagcactgaatcgagtgcctaagaagaagaaaatgcccgaaaacttcatgcccccagtcccgatcacgtctccaatcatgaaccctttgggagatccccagtcgcagatgctccagcaacagccctcggctcctgtgccattatccagccagtcttcattcccccagccgcaccttcccggtgggcagcccttccacggcgttcagcagcctctgggccaaaccggcatgcctccaagttttagcaaaccgaatattgagggagcacctggagctcctatcgggaataccttccagcacgtgcagtcacttcccacaaaaaagatcacaaaaaaacctataccggatgaacacctaatcctcaaaacgacctttgaagacctgatccagagatgcctttccagcgctacagaccctcagacaaagcgaaagctggacgacgccagtaagagactagaatttttatatgacaaattgagagaacagacactttctcctacgattaccagtgggttgcacaatatcgctagatctattgagactcgcaattactccgaaggactgacaatgcatacgcacattgtgtctacctctaacttctcagaaacgagcgcctttatgcctgtactaaaggtggtccttactcaggccaacaagctgggtgtgtag

SEQ ID NO: 53776 - DNA, 3663 bp, Artificial Sequence
  Description of Artificial Sequence: Synthetic coding sequence
atgaagctcaaagaagtggacaggactgccatgcaagcctggtcacccgctcagaaccatccgatttaccttgcgacgggaacctctgctcagcagctagacgcaacattttctactaatgcaagtctcgaaatatttgaactggacttgagcgatccatctctggatatgaagtcttgcgctactttttctagctcccataggtaccataaactgatttggggtccatataagatggactccaagggtgatgttagcggagttcttatcgctggaggagagaacggaaacatcattctgtacgacccttccaagatcatagctggtgataaagaggtagttattgcacagaacgacaagcataccggacctgtgagagctctggatgtcaatatctttcaaacgaacctggtcgcaagtggagcaaacgagtccgagatctatatctgggatctcaataatttcgccactccaatgacaccaggggcaaaaacacagcccccagaggacatcagttgtatagcctggaatcgtcaggtccagcacattttagcttctgcctcaccatcaggacgagcaaccgtctgggatctgaggaagaatgagccaatcatcaaggtttccgaccactctaatagaatgcactgtagcggcttggcctggcatccagatgtagccacccagatggtcctcgccagtgaagacgatcgcttgcccgtgattcaaatgtgggacctgagatttgcaagcagtcccctgagggtgctggagaaccatgccaggggaattctggcgatagcatggtctatggctgaccctgagctacttttgtcatgtggaaaagacgccaagatattgtgctccaacccgaacaccggcgaagtcctctacgagttgcccacaaacactcagtggtgctttgacatacaatggtgtcccagaaaccctgccgtgctctctgccgcttcctttgacggacggatatctgtctatagtattatggggggatccacagatggccttcgacagaaacaggtcgacaagctttcttcctcttttggcaatttggaccctttcggaacaggccagccactgcctcccctgcagatcccccaacaaactgcacaacacagtatcgtgctacctctgaaaaaacccccaaagtggatccgaaggccagtgggagcctccttttctttcgggggtaaactagtcacattcgagaacgtgcggatgccatcgcatcagggcgcagagcaacagcaacagcagcatcatgtgtttatcagccaggtggtgaccgaaaaggagttcctgtcccgttcagaccaattgcaacaagcagttcaaagtcaaggatttattaattattgccagaaaaagattgacgcctcccagacagaatttgagaagaacgtttggagcttcctgaaggttaattttgaggatgacagtcgcggtaaatatcttgagctcttaggatatcgaaaggaagacctcggcaagaaaatcgccctggcactgaataaggtcgatggcgctaatgttgcccttaaggactctgaccaagtggcacaaagtgacggagaggaatctcctgccgcagaggaacagctgctaggagagcacattaaggaagagaaggaggaatccgaatttctgcctagctcaggaggcacatttaatatttccgtgagtggagatattgacggacttataactcaggctcttctcacgggtaatttcgaaagcgccgtcgatttatgcctgcacgataacagaatggcggacgccattatcctcgctattgccggaggacaggaacttctggcaaggactcagaaaaaatactttgccaagtcccagagcaagatcacaagactaatcaccgctgtggtcatgaaaaactggaaggaaattgtggaaagttgcgatcttaaaaactggcgggaagccctcgccgctgtgcttacatacgccaaaccagacgagttcagcgccctgtgtgacctgctgggcaccagacttgagaacgagggagattcactgctgcaaactcaggcttgcctgtgttacatctgtgcgggtaatgtggaaaaactggtggcctgttggaccaaagcacaggacggctctcatccattatctctccaggatcttattgaaaaagttgtgatactccgtaaagcagtacaactgacccaggccatggatacaagcacagtgggcgtactcttggccgctaaaatgtcccagtacgccaacctcttggccgcacaggggtccattgccgcagcgctcgccttcctcccagacaacacaaaccaaccgaatataatgcagctgcgagaccggctttgccgcgcacagggggaaccagtggcgggtcatgagagtccaaaaatcccctatgaaaagcagcaactgcccaagggacgcccagggccagtggctggccaccatcagatgcccagggtacaaacccagcagtattaccctcatggggagaatccaccacctcctggctttatcatgcacggaaatgttaacccgaacgcagctggtcagctgccaaccagcccagggcatatgcatactcaggtaccaccatacccccagccgcagccctatcagccagcccaaccttacccctttggtaccgggggttcggcaatgtataggccacaacagcccgtcgcccctcctacgtctaacgcttacccaaatacaccttatataagttccgcctcgtcctataccggccagtctcaactgtacgccgctcagcatcaggcttccagtcccacaagcagccctgcaacttccttccctcccccaccctcctctggcgcatctttccagcacgggggtccaggcgcaccaccatcatctagcgcctacgccctcccacccggaaccacaggtacgttgcccgctgccagcgaactcccagcctcccagcggacaggcccacagaacggttggaacgacccacctgccctgaatcgcgtccccaaaaagaaaaagatgcctgagaactttatgccacctgtaccaatcacctcaccaatcatgaaccccttaggagacccacagtctcagatgttgcagcagcaaccttctgcgccagtcccactttcaagccagtcctcctttcctcagccccacttacccggaggccagccctttcatggggttcagcagccgctcggacagacaggcatgcctccatccttctccaagcccaacatcgaaggggcacccggagcccctatcggaaacactttccaacacgtgcagtccctgcctacaaagaagataacgaagaagccaattcctgacgagcacctcatactcaagactacatttgaggatctgatacagaggtgtctgtcatctgcaacggacccacagactaagaggaagctggatgacgctagtaagagactggagtttctctatgacaagttacgggagcagactctatcacccaccattacatcaggcctgcacaacatcgctcgctcaatcgaaaccaggaattacagcgaaggtctcacgatgcacacccatattgtctccacttcaaacttctcggaaaccagcgccttcatgccagtgctcaaagtcgttcttactcaggcaaacaagctgggtgtgtag

SEQ ID NO: 53777 - DNA, 3204 bp, Artificial Sequence
  Description of Artificial Sequence: Synthetic coding sequence
atgaaactgaaagaggtggaccgcactgctatgcaggcctggtcacccgctcagaaccaccctatttacttggccaccggaaccagtgctcagcagctcgacgcaactttcagcaccaacgcttccctggaaattttcgagctcgacctcagtgacccttcattagacatgaaatcctgcgcgactttctcaagttcccaccgctaccataaattgatttggggcccttataagatggattccaaaggtgatgtgtccggagttctaatcgccggaggtgaaaatggtaacatcatcctgtacgatccaagcaaaattatcgccggagacaaggaggtggtgatcgcgcaaaatgacaaacacacgggcccagtgcgggcactggacgtgaatattttccagacaaatctcgttgcgagcggggctaacgagtccgagatctacatctgggacctgaataactttgctactcctatgacccctggggcaaagacccaaccccctgaggatatctcttgcatcgcatggaataggcaggtacagcatattctggcaagcgcttccccaagtggaagagccactgtgtgggacctgaggaagaacgaacccataataaaggtgtcggatcattcaaacagaatgcactgctccggattagcttggcatccggacgttgccactcaaatggtcttggccagtgaagacgacagactcccggtgattcagatgtgggacttgaggttcgctagttctcccctgagggtcttggagaatcacgctcgagggattctggccatcgcctggagtatggctgacccagaactgctacttagctgcggcaaggacgcgaaaattctgtgtagtaaccccaatactggcgaggtgctgtacgaacttcctactaacacccagtggtgttttgatatccaatggtgccctcggaacccagccgtgctgagtgcggcaagcttcgacggacgcattagcgtctatagtataatgggtgggagcactgacggcttacgccaaaaacaagtggataagttgagctcctcatttgggaacctggaccccttcggaactggacagcccctgcctcccctgcaaatcccacagcagactgctcagcatagtatcgtgctccccttaaaaaaaccaccaaagtggatccgccgacctgtcggcgcatccttttcctttggaggcaaactggtaactttcgagaacgtgcggatgcctagtcatcaaggggctgaacagcagcaacagcagcaccacgtttttatttcacaggtagtgactgaaaaagaattcctcagccgatctgaccagctccagcaagccgtgcagtcacaggggttcatcaactactgtcagaaaaaaattgacgcctctcagactgagttcgaaaaaaatgtgtggagcttcttgaaggtgaacttcgaggacgactcccggggaaaatatcttgagctcttgggctacaggaaagaagacctggggaaaaaacatattaaagaagagaaggaagagtccgagttcctgcctagcagcggcggaacatttaacatctctgtcagtggcgatattgacggactgattactcaagctctgctgacagggaacttcgaatcggctgtggatttgtgtttgcatgacaacaggatggctgacgctatcattcttgccatcgcgggtggacaagaactcctggcacggactcagaaaaagtactttgccaaatcccaatccaaaatcacccgcctcatcactgctgtggtgatgaaaaactggaaagagattgttgaaagttgtgacctcaagaactggcgagaggcactggctgcggttttaacctacgctaaaccagatgagttcagtgcactttgtgacctgttgggcacacggctcgagaatgaaggcgacagcctgctccagactcaggcttgcctttgttatatctgcgccggtaacgtcgaaaagctggtcgcatgttggacaaaagcccaggatggctctcatccactcagtctccaggacctgatcgagaaggtggttatcctgaggaaggcagtacaactcacacaggccatggatacctcaaccgtcggtgtgttactcgccgctaaaatgagccaatacgccaacctgcttgccgctcagggctcgatcgctgcggcactggcgttcctcccagataacaccaaccagccaaacatcatgcagttgagagaccgactctgccgtgcccagggagaacctgtggcgggacatgaaagtcctaagataccatacgagaaacagcaattacctaagggcagaccaggcccagtggccggacatcatcaaatgcctcgagtccagacgcagcagtactatccccacggagagaatcccccaccgcctggattcatcatgcatggcaacgttaatcccaatgccgcaggtcagctgccgacatccccaggccatatgcacacgcaggtacctccctacccacagcctcagcgaccccagaacggatggaacgacccgccagccctcaacagggttcccaaaaaaaagaaaatgcctgagaacttcatgccccctgtgccaattactagtcctataatgaacccattgggggacccacagtcacagatgctgcagcagcagccctccgctcctgtcccacttagttcacaatcatctttcccccagccccaccttcctgggggtcagccatttcatggagtgcaacagccccttggccagacagggatgcctccaagtttctcaaaacctaacattgagggagcccctggggctccgatcggcaatacattccagcatgtccaatccttgcccactaagaagatcacaaagaagccaatcccagatgagcatcttatcctcaaaactacgtttgaggacttgatccagagatgtttgtctagtgcaaccgatcctcagacaaagcggaagctggacgatgcctctaaacgacttgagtttttgtacgacaagttaagggaacaaactctgtctcctactatcacatcaggcctgcataacattgcccgaagcatcgagacccgcaattattccgaaggcttaactatgcacacccacattgtatctacctctaatttctcggaaacctccgccttcatgcctgtgctgaaagtggtactgacccaagcaaataaattgggagtctag

SEQ ID NO: 53778 - DNA, 246 bp, Artificial Sequence
  Description of Artificial Sequence: Synthetic coding sequence
atgaaattgaaagaggtagataggacggccatgcaagcatggtctcctgctcagaaccaccctatatatttagcgacaggaacctccgcccagcagctggacgcgacattctcaacgaatgctagcctggaaatttttgagcttgacttgtctgaccctagcctggacatgaaatcctgcgccactttctcctccagccacagataccacaagctaatctggggaccctacaaaatggacagctag

SEQ ID NO: 53779 - DNA, 201 bp, Artificial Sequence
  Description of Artificial Sequence: Synthetic coding sequence
atgaagctgaaggaggtggacaggactgccatgcaggcatggagtccggcacagaatcatccgatctacctagcaacagggacttctgcccagcagctggacgctacgttctctacgaacgcttcattagaaattttcgagctggacttatccgacccaagccttgatatgaaaagttgcgcgactttcagcagttcatag

SEQ ID NO: 53780 - DNA, 3501 bp, Artificial Sequence
  Description of Artificial Sequence: Synthetic coding sequence
atgaagctgaaagaagtggaccggactgccatgcaggcatggagccccgcacaaaaccaccccatctacctcgccaccggcacaagcgctcagcagctggacgccaccttctcaaccaatgcctcacttgaaatcttcgaactggacttgtcagacccttctcttgatatgaagagctgcgcaactttcagtagcagtcaccgctatcacaaattaatctgggggccatacaaaatggactccaaaggagacgtgtccggggttttaatagctgggggagagaatggaaatattatactgtacgatccaagcaaaatcatagctggagataaggaggtagtgattgctcagaacgacaagcacacaggacccgtgcgcgcacttgatgtgaacatctttcagacaaacctggtggcttccggggctaatgaatcagaaatctatatttgggacctgaataacttcgcgacccccatgacgccaggagctaagactcaacctcctgaggatatttcctgtatagcgtggaatagacaggtgcagcatattctggcgtcagcctccccttcaggcagagctactgtttgggatctgaggaaaaatgagcccatcatcaaggtctcagaccactctaatcgaatgcattgcagcgggttggcttggcatcccgacgtagcaacccaaatggtcctagcatccgaggatgaccggctacctgtgatccagatgtgggaccttcgatttgctagcagcccactgagagtcctggagaaccatgcaagggggattctggcaatcgcttggtccatggccgaccctgagttattgctgtcatgtgggaaagacgcgaaaatcttgtgcagtaatcctaacactggggaagtgctgtacgagctgcccaccaatacacagtggtgcttcgacatacagtggtgcccacgcaacccagccgtgctgagcgcggcttctttcgacggacgcattagcgtgtatagcataatgggtggatctactgacgggttgcgccagaaacaggtggataaactatcgtcgtctttcggaaatttagacccatttgggaccgggcagcctttgcccccactccagattccgcagcagactgctcagcactccattgtacttcctctgaaaaagccaccaaagtggatccgacgccctgtcggagcctcctttagcttcggaggtaaactggtgacttttgaaaatgtgcgtatgccttctcatcaaggtgccgaacagcagcagcagcagcatcacgtgttcatctcccaagtagtgacggagaaagagtttctcagccgcagtgaccagcttcagcaggccgttcagagtcaaggcttcattaactactgtcagaagaaaattgacgccagccagacagaattcgagaaaaatgtgtggtctttcttaaaagtgaatttcgaagacgactcgagaggcaagtacctcgaattgctgggataccgtaaggaagatcttggaaagaaacatatcaaagaggaaaaggaagagtcagagtttctgccgtctagtggcggaacgtttaacatcagtgtatctggcgatatcgatgggctgatcacccaagctctcctgaccggaaacttcgaaagcgcagtagatctatgcctccacgacaatcgcatggcggatgcaataattctggctattgctgggggacaggagctcctggcaaggacgcagaagaaatacttcgccaagagtcagtctaaaatcacacggttaatcacggccgtggtgatgaagaattggaaggaaatagtggaaagttgcgacctgaaaaactggagagaggcccttgctgccgtcctcacatatgccaaacccgacgagttcagtgccctgtgcgacctactgggtacccgtcttgaaaatgaaggagactctctgctacagacccaggcttgcttgtgctatatctgtgctgggaacgtggagaagctcgtcgcatgctggaccaaagcacaggacgggagccacccactctccctccaggatctgatagagaaggtggttatcctgcgtaaggcagtccagctgacacaggctatggacacctcaaccgtaggggtgttacttgctgcgaagatgtcccagtatgccaatttgctagctgctcagggatctattgcagcagcacttgcatttctacccgacaacaccaaccagcctaacattatgcagctgcgggatcgcctctgccgtgcccaaggggagccggtcgcgggacacgagagtccaaagatcccctacgagaaacagcaattgcccaaggggcgaccaggcccagtggctgggcatcatcaaatgcccagggtgcagacccaacagtactacccccacggggagaatccacctcccccaggcttcatcatgcatggaaacgtgaaccccaacgccgctggccagctcccaacctcccctggacacatgcatacccaggtacccccatatccccagccccagccttaccagcccgctcaaccctatccatttggcacaggcggttctgcaatgtatagacctcaacaaccagtggccccacccactagcaacgcctacccaaacaccccctatatttcttccgcctcgagctacactggacaaagccaactgtatgcagctcagcaccaggccagttctccaacatcatcccctgccaccagcttcccgcctccaccatcttcaggcgcttctttccagcacggtgggcctggagccccaccatccagtagcgcctacgctctccccccaggtacgactggacctcaaaacggctggaacgacccccctgctctcaacagggtgcccaaaaagaagaagatgccagagaactttatgcctccagtccctattacatcacccatcatgaacccacttggagaccctcaatcccagatgctgcagcagcagccctcagctcccgtgccactgtcatctcagtcatcctttccacagccccatctgcctggtggacagccatttcacggcgtacagcagccactgggtcagactggcatgcccccatcattctccaagccaaacatcgagggagcacccggtgccccaatcggaaacacctttcagcatgttcaatctttgcctacaaagaaaataaccaagaagccaatccctgatgaacatctgattttgaaaaccaccttcgaagatctgatccagcgctgtctctccagtgccacagacccccagaccaagagaaaactggatgatgcttccaagcgactggagttcctgtacgacaaattgcgagagcagaccctctctcctaccatcacaagcgggttgcataatatcgcgagaagcatcgagaccagaaattactctgagggcctgacgatgcacacccacatagtgagcacaagcaatttttccgaaacctccgcttttatgccagtgctcaaagtggtcctgacacaggcaaataagctgggcgtttag

SEQ ID NO: 53781 - DNA, 84 bp, Artificial Sequence
  Description of Artificial Sequence: Synthetic coding sequence
atgaagcttaaggaggtggatcgtactgccatgcaagcttggtcccccgctcagaaccaccctatatacctcgcaaccggatag

SEQ ID NO: 53782 - DNA, 3618 bp, Artificial Sequence
  Description of Artificial Sequence: Synthetic coding sequence
atgaagctgaaggaggtggataggaccgccatgcaggcctggtcacccgctcagaatcatcccatatacttagcaacggggacctccgctcagcagctcgatgccacttttagcacaaacgcctcccttgagatcttcgagctagacctgtccgatcctagcctggacatgaagtcttgcgcgactttctcttcctctcaccgctatcataaactcatctggggtccttacaagatggactctaagggcgatgtgtcgggggtattgatcgcaggtggtgagaacgggaacattatcctatacgatcctagtaagatcatcgcaggagataaggaggtggtaatcgcccagaatgacaagcacaccggcccagtgcgtgccctggatgtaaatatattccagacaaatctcgtggcatcaggcgcaaacgaaagcgagatctacatctgggatctaaataactttgcaacgccgatgacacccggtgccaaaactcagcctccagaagatatatcatgcatcgcgtggaacagacaggtccaacacattctcgcctctgcatcacctagtggccgagccacagtctgggatctgcgcaaaaatgagcccatcatcaaagtttctgatcattctaatcgcatgcactgctcgggactggcgtggcatcctgatgtggcgactcaaatggtgctcgccagtgaagacgataggctgccggtgatacagatgtgggatttacggtttgcctcaagtcccctccgcgtgcttgaaaatcacgcccgtggaatcctggccatagcgtggagcatggccgatcccgagttacttctgagctgtggaaaagacgctaaaatcctgtgctccaacccgaatacaggtgaggtcctgtacgaactgcctaccaacacgcaatggtgtttcgacattcagtggtgcccacgtaatcctgcggtgctgagcgccgcatcctttgacggcaggatcagcgtatactcaattatgggtggctctacagacgggctacgtcagaagcaggtcgataagttgtcgagctccttcgggaatctcgatccgttcggcactggccagccactcccgcctctgcagatcccccagcagactgctcaacacagcatagtgcttccccttaagaagcctccaaagtggattagacggccagtgggggcatcctttagcttcggtgggaaactggttactttcgaaaacgtccggatgccaagtcatcagggtgctgaacaacagcagcagcagcaccatgttttcatctcccaggttgtaactgagaaagagtttctttcaagaagtgatcaacttcagcaggcggtgcagtctcagggattcattaattactgccagaagaagattgatgcatcccagacagaattcgagaaaaacgtgtggtcgtttctaaaggtgaactttgaagatgactcccgcggaaagtaccttgagctccttggataccgaaaggaagacttagggaagaaaattgcattggccctgaataaggtggacggagcgaacgtcgctttaaaggacagcgatcaggttgctcaatctgatggggaggagtcccccgctgctgaggagcagctactgggcgaacatattaaagaggagaaggaagaatctgagtttcttccaagtagcggcggaacgttcaacattagcgtatcaggggacatagacggactgattacccaggcactgctgactgggaacttcgaaagcgccgtggacctgtgcctgcatgataatcggatggctgacgccattattctcgcaattgcaggagggcaggagctgctcgctaggacacagaagaagtatttcgccaagtctcaatcgaaaatcacacgccttattaccgcagtagtgatgaagaactggaaggaaatcgtggagagttgcgacttgaaaaactggagagaagcactggcggcagtactgacctatgcaaagcccgacgagtttagtgcactgtgcgaccttctgggcactaggttggagaatgagggagacagcctcctccagacccaggcctgcctatgctacatatgtgctggcaatgtggaaaaactggttgcctgttggacaaaggcccaggatgggagtcacccgctctcactacaggacctgatagagaaggtagtcatcttgcgtaaagccgtgcagctgacacaggctatggacacgtccactgtgggggtgttattggccgctaagatgagccagtacgctaatttactagcggctcaagggtcgatcgccgctgcccttgctttcctcccggacaatactaatcagcctaatatcatgcagttaagagacagactctgccgggctcagggcgaacccgttgctggacatgagagtccgaaaatcccatatgagaagcaacagctgcctaagggtaggccgggaccagtggccggacaccatcagatgccaagggtacagactcaacagtactacccgcacggggagaatcctccgcctcccggttttattatgcacggaaatgtcaaccccaatgctgcaggtcagttacccacaagcccagggcacatgcacacacaggtcccaccttaccctcagccacagccttaccagcctgcccagccatacccctttggcacaggcggatcggcaatgtatcggcctcagcagcccgtggcccctccgacgagcaatgcataccctaacaccccttatatatcaagtgcgtcctcctatacaggacaatctcagctttatgctgcacagcatcaagcctcctctccgacttcttcccccgcaaccagctttcctcctccaccttcttcgggcgctagcttccagcacggcggacccggtgcccctccatcatcttctgcctacgccctcccccctggtacaaccggccctcaaaatggttggaatgatccgccagctttgaatcgggtgcctaaaaaaaagaaaatgccagagaacttcatgcccccagttcccatcacatcgcctatcatgaacccgctgggcgatccacagtcgcaaatgctacagcaacagccatctgcacctgttcccctgagttctcagtcaagtttccctcagcctcacttgcccggtggtcagccgttccatggtgtgcaacaacctttaggtcagacaggcatgccaccaagtttttcaaaacccaatatcgagggtgccccaggcgcacctattggaaatacattccagcatgtgcagtcactgcccaccaagaagattactaagaaacctatccccgatgaacacttaatactgaaaactacttttgaggacctgatccaaagatgcctgtcctcggccaccgaccctcagaccaagagaaaacttgacgacgcttcaaagaggctcgaatttctctatgacaagctgagggaacagactttgagccccaccatcacatcgggattgcacaatatcgccaggtcaatcgagaccaggaactacagtgaaggtctgacaatgcatacccatattgtctccacctcaaatttttctgagaccagcgcattcatgcctgtgctgaaggtcgtcttaacccaggcaaacaaactgggcgtatag

SEQ ID NO: 53783 - DNA, 3321 bp, Artificial Sequence
  Description of Artificial Sequence: Synthetic coding sequence
atgaagctgaaagaggttgatcggacagcgatgcaggcctggtcaccagctcagaaccatcctatctacttggcaaccgggacctcagcccaacagctggacgccacgttcagcacaaacgcttctctggaaatttttgagctcgacttatcagacccatccctcgatatgaagtcctgtgcaacgttctcaagttcccacagataccataagctgatttggggtccatacaagatggacagcaagggggatgtgtccggagttctgattgccggtggcgagaacggcaacatcatattatacgatccctctaagatcatcgcaggcgataaagaggtggtcattgcccagaacgacaagcataccggtcccgtgagggcgctggatgtcaacatattccagaccaacctggtggcaagcggtgccaatgagagtgagatctatatttgggatcttaataacttcgccacacccatgacaccaggcgcaaagacccagcccccagaagatatctcgtgcatagcttggaatcgtcaggtccagcacattctggcttctgcatccccctccggtagagccacggtgtgggacctccgcaagaacgaacccatcatcaaagtaagcgaccattccaacagaatgcattgcagtggcctcgcttggcatcccgacgtcgccacgcagatggtgctagcctctgaagacgatcgactgcccgtcatccagatgtgggacctacgcttcgctagttctccgctacgagtgctggaaaatcacgcaagaggaattttagcaatcgcctggagtatggctgaccctgagctcttgctgagctgcggcaaagacgcgaaaattctttgctccaatccaaacaccggcgaggtgttgtacgaactacccaccaatactcagtggtgtttcgacatccaatggtgcccacgtaatcccgcagtcctgagtgccgcatcattcgacggtcggatttctgtctactccattatggggggttccacagacggcctaagacagaagcaggtggataagctatcaagcagtttcggcaatctggatccattcgggactgggcagcccttacctcctctgcaaattccacagcagacagctcaacatagcatagtactacctttaaaaaaaccgccaaagtggattcggaggcccgttggagcaagtttttcattcgggggtaagctggtcactttcgaaaatgtaagaatgccgtcccatcagggagccgagcaacagcagcaacagcaccacgttttcatctctcaggtggttaccgagaaggagtttctgagtcgctccgaccaactgcagcaggcagtacagagccagggtttcatcaattactgccagaaaaaaatcgatgcatcccaaacggagttcgaaaagaatgtgtggtcttttcttaaggtgaatttcgaagacgatagccgcggtaagtaccttgagctgctcggctaccgcaaagaggatctaggaaaaaagatagccttggctttgaataaggtagacggtgctaacgttgcccttaaagattctgaccaggtggcccaatcagacggagaggaaagtcctgcagcagaagaacagctgctgggtgagcacattaaggaagaaaaggaagagtcagagttcctcccgtccagcggaggtacgttcaatatatccgtatctggggatatcgacggacttataacccaagcccttttaaccgggaacttcgagtctgccgtggatctgtgtctgcacgataaccggatggccgatgcaattatcctggctatcgcagggggacaagagctgctggccaggacacagaagaagtactttgctaagagccagtcaaagatcaccagactgatcacagctgtggtcatgaaaaattggaaagaaattgtggagtcttgtgatctgaagaattggagggaagctctggctgctgttcttacttacgccaagcctgatgaattttccgctctgtgcgacctgctcggcacccggctggaaaacgagggggacagcctactgcaaacccaggcatgcctctgctacatatgcgccggtaatgtggaaaagctggtggcttgttggacaaaggcccaggatggatcccaccccctgtctcttcaggacctgatcgaaaaggtggtgatcctcaggaaggctgtgcagctgactcaagctatggatacctctacagtgggtgttctgctggccgctaagatgtcccagtatgcaaacctgctggcagctcagggcagtatcgcggctgccctggctttcctcccagacaatactaatcagcccaacattatgcaactgcgcgaccgtctatgtagagcacaaggcgagcccgtagcgggacatgagtcacccaaaataccatacgagaagcaacagctccctaaaggcagacctggacctgtcgcaggacaccatcagatgcccagggttcagacacagcagtattaccctcatggcgagaacccccctcctcctggcttcatcatgcacggtaatgttaatcccaatgctgcaggccagctgcccacatctcctgggcacatgcatacccaggtccctccataccctcaaccccagaggccccagaatggatggaacgaccctcccgctctgaacagggtgccaaagaagaaaaagatgcccgaaaatttcatgccccctgtgccaataacctcgcctatcatgaatcctctgggcgaccctcaatctcagatgctgcagcaacaaccaagcgccccagttcccctgtcgtcccagtcctccttcccacagcctcacctcccgggtggacagccgttccacggcgttcagcagccccttggtcaaaccggcatgcctccaagcttctccaagccaaatattgagggggcacctggagcccctataggtaatacattccagcacgtgcaatctctgcccaccaaaaaaataactaagaaaccaattcccgatgagcacctgatactgaaaacaacttttgaggatctgatacagcggtgtctgagttcagcaaccgaccctcagaccaaacggaagctcgatgatgcaagcaagaggctggaattcttatacgataagttgcgggagcaaacgctcagtccaacaataacctcaggcctgcacaacatcgctaggtccatcgaaacaaggaattactccgagggcctgactatgcacacgcatattgtcagcacaagcaatttctctgagacctctgctttcatgccagtgttaaaggtggtactcactcaagccaacaaacttggcgtctag

SEQ ID NO: 53784 - DNA, 498 bp, Artificial Sequence
  Description of Artificial Sequence: Synthetic coding sequence
atgaaacttaaggaagtggaccgcaccgccatgcaggcttggagccccgctcagaatcatcccatttaccttgctaccgggacatcagcgcaacagctggatgccacattttcgacaaacgccagcctggagattttcgaattagacctgtccgatccctctttggacatgaaatcctgcgccacttttagctcttctcaccggtaccataaattaatttgggggccttacaaaatggactccaagggagatgtttccggggtgctgatcgccggaggtgagaacggaaacattatactatacgaccccagtaagattatagccggagacaaagaggtggtcatcgcccaaaacgataaacatactggcccagttcgcgctctggatgttaatattttccaaaccaacctggtagcgtctggtgctaacgaaagcgaaatctacatctgggacttgaacaacttcgctacacccatgacacctggcgcaaagacatag

SEQ ID NO: 53785 - DNA, 501 bp, Artificial Sequence
  Description of Artificial Sequence: Synthetic coding sequence
atgaagcttaaggaggtcgatagaacagctatgcaggcctggagtccagctcagaatcaccctatttatctcgccactgggacgtccgcgcagcagctggatgctaccttcagtacaaatgccagccttgaaatctttgagctggacctctcagatccctccctggacatgaagtcttgtgctaccttttctagtagccatagataccataagctgatttggggaccctataagatggattcaaaaggtgatgtgagcggcgtgctcatcgctggcggagagaacggcaacattatcttgtatgatccctccaagataatagccggtgataaggaagtggtgattgcgcaaaatgacaagcacactggacctgttcgtgcattagacgtgaacatttttcaaaccaacctcgtagcctccggagccaacgaatctgaaatctacatctgggatctcaataacttcgcgacgcccatgactcccggagccaagacacaatag

SEQ ID NO: 53786 - DNA, 3603 bp, Artificial Sequence
  Description of Artificial Sequence: Synthetic coding sequence
atgctcggggagtcagacgagcggtgcactaacgccggatctggttgtagacgttcttccccaggcacctctgctcaacagctcgatgccacttttagcacgaatgcctccctcgaaattttcgagctagacctgtcagacccctctcttgacatgaaatcatgtgcaaccttcagctcttcccaccggtaccacaaactgatctggggcccttacaagatggatagcaaaggggacgtatctggcgtgctgattgccggaggcgagaatgggaacatcatactctacgacccttctaaaatcattgcaggagataaggaggttgtgatcgcgcaaaatgataagcacacaggccctgtgcgggcactggacgtgaacatcttccagacaaacctcgtcgccagcggagctaacgaatccgaaatctatatctgggatttgaacaactttgcgacccccatgacgccaggagcaaagactcagccaccagaggatattagttgtattgcctggaatcggcaggtccaacatatccttgcctccgcttctcctagcggtcgcgcaacagtgtgggacctccgaaagaacgaaccaataattaaggtttccgatcattccaatagaatgcattgttctggactggcttggcatccagatgtggctacccaaatggtgctggcaagcgaggatgatcggcttccggtgatacaaatgtgggacctcagattcgcaagctccccactacgggtcctggaaaaccacgccaggggcattctggccatcgcatggagtatggccgacccagagctccttctgtcgtgcgggaaggacgctaagatactgtgctccaaccccaatacaggggaagtgctgtatgagctccctacgaacacccagtggtgctttgacatccagtggtgccccagaaacccagccgtgttgagcgctgcctcatttgatgggaggatcagcgtctacagtatcatgggagggtccaccgacgggttgcgtcagaagcaggtcgataagctgtcttctagcttcggcaacctcgatccctttggaaccgggcagcccttgccaccgttacagatacctcagcaaactgcccagcacagcattgtgttaccattgaaaaagcccccaaagtggattagacggccagttggcgcaagcttcagctttgggggtaagctggtgacctttgaaaatgtcagaatgcccagccaccagggcgcagaacagcaacagcagcagcaccacgtcttcatatctcaggtggtcacagagaaggaattcctgtcaagatccgatcagctccaacaggcagtccagtctcagggattcatcaactactgtcagaagaagatcgacgcatcgcagaccgaatttgagaagaacgtctggtcatttctcaaagtcaattttgaggatgacagccgcggaaagtatttggagctgctgggctatcggaaggaagacttgggaaagaaaatcgccctggccctgaacaaagtggacggcgcaaacgtggctctgaaagactcggatcaggtagcgcaaagcgacggcgaggagtcgccggcagccgaagagcaattattgggagaacatattaaagaggagaaggaagagtcagaatttttgccctctagcgggggaacattcaatatcagtgtgtccggcgacattgacggcttaatcacacaggccctcttgacagggaattttgagtcagcagtcgatctgtgcctccacgataaccggatggccgacgccatcatcttggcaatagctggcggtcaagagctgctagccagaacacagaagaagtacttcgccaaatcacagagtaaaattacgcggttaataactgccgtggtgatgaagaattggaaagagatagtcgaatcttgcgatctgaagaattggagggaagctctcgcagcagttctaacatatgcgaaacccgatgaatttagtgcactgtgtgatctactcggaacccggttggaaaatgagggcgacagcttactgcagactcaggcctgtctgtgctatatctgcgccggaaacgtcgaaaagctcgtcgcctgctggaccaaggctcaggacggttcacaccccctgagtctgcaggatcttatagaaaaagtggttatccttagaaaggctgtacaactgacccaggcaatggacactagtactgttggggtgctgcttgcggcaaagatgtcacagtatgctaacctactggcagctcaagggagcattgccgctgccttggcctttctacccgacaatacaaaccaacctaatattatgcagcttagagacagactatgtagggctcagggcgagcccgtagctggccacgagtctccaaagataccctatgagaagcagcagctccccaaaggccgacccggacccgtagcagggcaccatcagatgcctcgagtgcagacgcagcagtactacccccatggcgaaaaccccccaccccctggttttataatgcacggcaatgttaatcccaatgcagccggtcagttacccaccagcccaggccacatgcacacccaggtgcctccctatccccagccgcagccttaccaaccagcacaaccttaccctttcggcaccggcggttctgccatgtacagaccgcagcaacctgttgctccgccaacctctaatgcgtacccaaatacgccctacatctcttcagcctcttcttacacaggtcagagccagctttatgcagcgcaacaccaggcatcttctcccacctccagtccagcgacttcattcccccctcctccttctagcggtgcctcctttcagcacggcggtccgggagcccctccatcttcttccgcatatgccctgccccctggtacgaccgggcctcagaatggctggaatgatcctcctgccctgaatagagtgcccaaaaagaaaaagatgcccgagaacttcatgcctccggtcccgattacaagccccatcatgaatcctctgggagaccctcagagtcagatgctccagcagcagcctagcgcccctgtgccactgtcctcccagagttcgttcccccagccacaccttccgggaggacagccattccacggcgtgcagcagcctctcggtcagactgggatgcctccttcattttccaagccgaacattgaaggcgctcctggcgcacctatcggtaacaccttccagcacgtgcaatctctccctaccaagaaaattaccaaaaaacccatccccgacgagcatttgattctcaaaacaacgttcgaagacctgatccagcgatgcttaagctcagcgactgatccacagaccaagcggaaactcgatgacgcttcaaaacgccttgagtttctttatgacaagcttagagagcagaccctctcacctaccattaccagtgggcttcacaacatagcgagatctatagaaacacgaaactactctgaaggactgactatgcacacccacatagtctcaacctcaaatttcagcgagacaagtgcctttatgcccgtgctgaaggtggtgctcactcaggccaacaagctgggcgtgtag

SEQ ID NO: 53787 - DNA, 1431 bp, Artificial Sequence
  Description of Artificial Sequence: Synthetic coding sequence
atggcaataaagtttctggaagtgatcaagcccttttgcgtgatcctgccggagatacagaaaccagaacgaaagatacagtttaaagagaaggtgctgtggaccgctatcactttatttatttttcttgtatgctgtcagatccccctatttggaataatgagttccgactcagcagaccccttttactggatgcgagtgatcttggcctcaaaccggggaaccctaatggagctgggcatctctccgattgtcacgagtggcctgattatgcagttgctcgcgggtgctaagattatcgaggtcggcgacacaccgaaggacagggccttgttcaatggagcccaaaaactattcgggatgattatcaccatcggtcaaagcattgtctacgtgatgacaggcatgtatggggacccttccgagatgggcgctgggatttgtttgctaattactatccagctgtttgtggccggacttattgtgctccttctggacgaactgctgcagaagggctatggcttgggaagtggaatcagtctctttatcgcaactaatatatgtgaaaccatcgtctggaaggctttttcaccaacaactgtaaacaccggtcgcggaatggagtttgaaggagcaatcatcgcactgtttcatctactggctacccggaccgacaaggtgagggccctcagagaagcattttatagacaaaacttgcccaacctgatgaatctcatcgccaccatctttgtctttgccgttgtgatctactttcaaggatttagagtggacttgcccattaaaagcgcacgctaccgaggccaatacaatacgtatccgattaagcttttctacactagcaatatacctattatcttacagagcgcgctggtgtctaacttgtatgttatcagccagatgctgagcgctcgattctcaggaaacctcttggtgagccttctcggcacttggtctgacaccagttctggcggtcccgctcgtgcctatccggtgggcggactgtgttattacctttcaccacccgagtcatttgggtccgtcctggaggatcctgtgcacgctgtggtgtatatcgtgttcatgttaggaagctgcgcattcttctcgaaaacctggatagaagtgagcggtagcagcgctaaagacgtggcgaagcagttgaaggaacagcaaatggtgatgagaggacatcgcgagaccagcatggtacatgagctgaatcgatacattcctactgccgcagcttttggcggtctatgcataggtgccctctctgtgcttgcggacttcctcggcgctattggaagtggcaccggcatccttcttgccgtgacaatcatttatcagtatttcgaaatatttgtgaaggaacagagtgaggtgggctccatgggtgctctgctgttttag

SEQ ID NO: 53788 - DNA, 1071 bp, Artificial Sequence
  Description of Artificial Sequence: Synthetic coding sequence
atgattattaccattggacagagtatcgtgtatgtcatgacaggtatgtacggcgatccgtcagagatgggcgctggaatttgtctgttgattactatccagctgttcgtcgctggtttgattgtgcttctgttagacgaactgctccagaagggctatggacttggcagcggcattagcttgtttatcgcgactaacatctgtgagaccatcgtgtggaaagccttctcccctaccacagtaaacaccggccgaggcatggaattcgaaggtgccattatcgcattatttcatctgctggcgacacgcactgataaagtccgcgctctgagggaggccttctaccgacagaatcttcccaacttgatgaatctcatcgcgacaattttcgtgttcgctgtggtgatctatttccagggtttcagggtggacctgcccattaaatcggccaggtaccggggtcaatacaatacataccccatcaagctattttacacttccaacatccctattatcctccagagtgcattagtgagtaatctgtacgtaatctcccagatgctgtccgccaggttttccggcaatctgctagtgagcctgcttggcacttggtccgataccagtagcgggggacccgcaagggcttatcctgtcggagggttgtgttattacttatccccccctgagtcctttggaagcgtgctcgaggaccccgtccacgcagttgtgtacattgtattcatgctgggatcatgcgcatttttctccaagacatggatcgaagtctctggatcttccgcaaaggacgtggccaagcagctcaaagaacagcaaatggtgatgcgagggcatcgggagacgagtatggttcacgagctgaatagatacatcccaaccgccgcagcctttggaggcctgtgcatcggcgctctgtctgtgctggctgacttcctgggcgctatcgggtctggaacaggcatccttttagctgtcaccataatctatcagtactttgaaatcttcgtaaaagaacaatctgaagtcgggagcatgggagccctactattttag

SEQ ID NO: 53789 - DNA, 1449 bp, Artificial Sequence
  Description of Artificial Sequence: Synthetic coding sequence
atgacccagaccgccagggtgctcgtgaagttcctcgaggtaatcaaacccttctgtgtcatactgccagagatccaaaagcccgagcgcaaaatccagttcaaagaaaaggtactgtggacagcaatcactttgttcattttccttgtgtgttgccagattcctctgttcggcatcatgtctagtgactctgccgatcccttttattggatgagggtgatcctggcgtctaataggggtaccttaatggagctgggcatatcaccaatagtcacgtcgggcttaataatgcaactgctcgctggcgctaagattattgaggtgggggacactccgaaagatcgggcactttttaacggggcacagaagctgtttggcatgatcatcactatcggacaatcaattgtatatgtgatgacaggaatgtacggcgatccttccgaaatgggagctggaatctgcctgctgattaccatacagctatttgtagccggactcatcgtcctcctgctcgatgaacttctgcagaaagggtatggattgggatctggaatttcactctttatcgccaccaatatttgcgaaactattgtttggaaagccttcagtcccacaacagtaaatactggacggggaatggagtttgaaggcgctatcatcgcattgttccacctgctggcaacccgcaccgacaaagtccgcgcactgcgggaggcattctaccgacagaatctccctaacttgatgaacctgattgccacaattttcgtgtttgcagttgtcatatattttcaggggttcagagtggacctcccgatcaaaagtgccagataccgcggacaatataatacttacccaataaaactattctacactagtaatataccgattatcctgcagagcgcattggtatccaacctgtatgtcattagccaaatgctctctgccaggttttctgggaaccttctcgtgtcgcttctgggaacatggagcgacactagttctggaggccctgcgagggcttatccagtcggcggactgtgttactacctgtcaccaccggagtccttcgggagcgtgctcgaagatccagtgcacgccgtagtctatatcgtcttcatgttgggctcatgtgcctttttctccaaaacttggatcgaggtgtccggtagtagtgcaaaggacgtcgccaagcagttgaaagagcagcagatggtgatgagaggccatcgagaaacaagtatggtccatgagctgaaccgctatatcccaacggccgctgctttcggcggattgtgtataggcgctctgtctgtcctggcagatttcctgggcgcaattggcagtgggactggtattctccttgccgtgaccatcatctaccagtacttcgaaatattcgtcaaggagcagtctgaggtcggatcaatgggtgctttactgttctag

SEQ ID NO: 53790 - DNA, 1431 bp, Artificial Sequence
  Description of Artificial Sequence: Synthetic coding sequence
atgggaattaaattcctcgaagtcatcaaaccattttgtgctgtgcttccagaaatccaaaaaccggagcgtaagattcagttccgggagaaagtgctgtggacagcaattaccctcttcatctttctggtatgttgtcagatccccctgtttgggattatgagttccgactctgccgatccattttactggatgcgggtgattcttgcttctaatagaggaacactgatggagttaggaattagtcccatcgtcacctccggactgatcatgcagcttctggccggagccaagatcatagaggtaggggataccccgaaagaccgcgctctcttcaatggggctcagaagttgtttggtatgatcatcacaattggccaagctattgtatacgtgatgaccggaatgtacggagatccagctgagatgggggcaggcatatgcctcctcattattatccaactattcgtggctgggctgattgttctactgttggacgagctcttgcaaaaggggtacggactcgggtctggcatttccctttttatcgctactaacatctgtgagaccatcgtatggaaagccttctctcccaccacaataaatacaggacggggtacagaattcgagggcgctgtgatagccttgttccacttactggctacgcgtaccgacaaagtccgggcactcagggaggcattctatagacaaaatctgccgaacctgatgaacctcatagccaccgtcttcgtttttgctgtcgttatttattttcaggggttcagagtagaccttccaattaaatcagcacgctaccgcggacaatacagctcatacccaattaagctgttttacactagtaatatacctatcatcttgcaaagcgcactcgtctccaatctgtacgtgatttcccagatgctctccgtccggttttccggtaacttcctcgtgaatctgctcggccagtgggcagacgtgagcggtggtggccctgctaggtcttatcccgttggcggtctgtgctactatttgtctccccctgaaagtatgggcgcaatttttgaagacccagttcatgtggtggtatacattatcttcatgctcggctcatgcgctttcttctcaaaaacttggatcgaggtttccgggtcatccgctaaagatgtggctaaacagttgaaagagcaacagatggtgatgcgcggacacagggataccagcatggtgcacgagctcaaccggtatatcccaaccgccgctgcgttcggagggctgtgtattggggctctgtcagtcctggctgactttctcggggcaataggttcggggaccggaatcttattagcagtcaccattatctaccagtattttgagatttttgtgaaagagcaagcagaggtgggaggtatgggtgctctgttcttttag

SEQ ID NO: 53791 - DNA, 1314 bp, Artificial Sequence
  Description of Artificial Sequence: Synthetic coding sequence
atgggcataaagttcttggaggtgatcaagcccttttgtgccgtgctgcctgaaatccaaaagcctgagcgcaagattcagttcagggagaaggtcctgtggaccgcaatcactcttttcatatttttggtttgctgtcagatcccactgtttgggattatgagctcagacagtgccgacccattttattggatgcgggtaatcctcgcgtccaatcgcggtactctgatggaactcggtattagtcctatcgtgacatcgggtctgatcatgcagctgctggcaggcgctaaaatcattgaggtcggggatacacctaaggatcgcgcattgttcaatggtgctcagaaactgtttggcatgattatcacaatcggccaagccattgtctacgtgatgactggaatgtacggcgatcctgctgagatgggggctggtatctgtcttctaataataatccagctgttcgtggccggattgatagtgctcttgttagacgagctactgcagaagggctatggactcggctcggggatttccctcttcattgcaactaatatatgtgagaccatcgtgtggaaggcatttagccccactaccattaatactgggaggggaaccgaatttgaaggcgcagtcatcgcacttttccacttgcttgccacgaggaccgataaagttagagccctgcgcgaagcattttataggcagaacctcccaaatctcatgaacttgattgccacagtcttcgtgtttgcggtggtgatctatttccagggctttcgagtcgatcttcctattaagtcggcacgctatcgaggccagtatagctcttaccccatcaaactcttttatacgtcaaatattccgattattctgcagagcgccctcgtcagcaacctatacgttatctcgcagatgctttccgtgagattctctggcaacttcctggttaacctccttgggcagtgggcagatgtgtctgggggtggacccgcaagatcttacccggtcggcggactgtgctactacctctcaccccctgagtccatgggagcaattttcgaagatcctgtgcatgtggtcgtgtacataatattcatgctcggtagttgcgcgtttttttccaaaacatggattgaggttagtgggtcctccgccaaggatgtggctaagcaactgaaggagcaacaaatggtcatgcggggtcatagggatacgtcaatggtacacgagctgaacagacccaaagttaagctgcgtagatggaagggggagggtcggcacttcactaagcgcatattgttttattag

SEQ ID NO: 53792 - DNA, 507 bp, Artificial Sequence
  Description of Artificial Sequence: Synthetic coding sequence
atgggaatcaagtttcttgaagttattaagccgttctgcgccgtgctccctgaaatccagaaacctgaaagaaagattcagtttcgggagaaggttttatggaccgctatcacactgttcattttcttagtttgttgccaaataccgttgtttggaatcatgagctcagactccgctgacccgttttactggatgagggtgatcctagcttccaaccgcggaaccctaatggagctgggcataagtcccatcgtaaccagcggcctgatcatgcagctacttgcaggcgcaaaaatcatcgaggtgggggacacacccaaagaccgggctctcttcaatggagctcagaaactgttcggtatgatcatcactattggacaggcaatcgtttatgtcatgaccggtatgtacggtgacccggctgagatgggcgctgggatttgcctcctgattatcatccaggcccttttgaccctgaagatctgtggctatactgaagaactgtag

SEQ ID NO: 53793 - DNA, 1233 bp, Artificial Sequence
  Description of Artificial Sequence: Synthetic coding sequence
atggggattaaatttctggaggtaattaagcccttctgtgcagtgctacctgagatccagaagcctgagcgtaaaatccagttccgagaaaaggtcctgtggactgccataacactgttcatatttctggtgtgttgccagattccgctgtttgggattatgagttcagattcggctgacccgttttactggatgagggtcatcctcgcctcaaatcgtggaacactcatggaactgggcatctcacccatcgtgacatctggcttaatcatgcagttgctggccggagccaagataattgaagttggcgacactcccaaagaccgggctctgtttaacggtgctcaaaaattattcggaatgataatcacaatcggacaagctatcgtttacgtaatgaccggcatgtacggcgatcctgctgaaatgggggctggtatatgtcttttgattattatacagctcttcgtcgcgggactgattgtcttattattagacgagctgctccagaaaggctacggcctgggcagtggaatatccctatttatcgctaccaatatttgcgagacgattgtgtggaaagcctttagccccacaacaattaatacaggacggggaaccgagtttgagggggctgtgatcgcgctgttccatctgctagctacacggacggacaaggtaagagcgctccgagaagccttctataggcagaatttaccgaacctcatgaacctgattgctacagtatttgtcttcgccgtggtgatctacttccaggacgtgagtggcggaggaccagctagatcgtacccagtcgggggactgtgctactacctcagcccccctgagagcatgggggctatcttcgaggatcccgtccatgtagttgtgtacattatctttatgctaggatcctgtgccttcttttcaaagacctggattgaggtgagcggaagcagcgccaaagatgtcgcaaagcagctgaaggaacaacagatggttatgcgcggtcaccgggacaccagcatggtccatgagttaaaccgttacattcctacggctgcagctttcgggggattgtgcatcggcgcattgtcggtgctggccgacttcctgggggcaatcggctccgggaccggcattctgctggcagtgacgattatataccaatatttcgaaatttttgttaaggaacaagcggaggtaggaggcatgggagccctattcttttag

SEQ ID NO: 53794 - DNA, 1365 bp, Artificial Sequence
  Description of Artificial Sequence: Synthetic coding sequence
atgggaatcaagtttttagaggttatcaagcctttctgcgcagtcctcccggagatccagaagccagaaaggaaaatacccctgtttggaataatgtcaagcgactcggcagaccccttctattggatgcgggtgatccttgcctcaaaccgcggaaccttaatggaattgggcatctccccaatagtaacttctgggctgattatgcagcttcttgcgggagctaagatcatcgaggtgggtgacaccccaaaggatagggctttatttaacggggcacagaaactctttgggatgatcatcaccatcggacaggctattgtctacgtaatgacggggatgtacggagacccggctgagatgggggctggaatctgtttgctcattattatccagctcttcgtggcagggctaattgtgctgctgctggacgagttgctgcagaagggctacgggctgggttctggcatttctctgtttattgcgactaacatctgcgagactattgtatggaaagcatttagcccaacgaccataaatacaggaagaggaactgagtttgagggcgcagtgattgcgctcttccacttgttagcaacacggactgacaaggtaagggctctcagagaggccttttatagacaaaatttgcctaaccttatgaacttaatcgctaccgtgtttgtgtttgcagtcgtcatctattttcagggctttagggttgacttacccatcaaatccgcccgttatcggggtcagtatagctcttaccctatcaaactattctatacgagcaatattccaataattctgcaaagcgctctggtgtcaaacctctatgtcatttctcagatgctaagcgtacggttttctggcaacttcttagtcaacctgctgggccagtgggctgatgtgagcggcggaggtcctgctcgtagttaccccgtaggcggtctgtgttattacctgtccccacccgagagcatgggcgctattttcgaagacccggtgcatgtggtcgtctacattatttttatgctgggaagttgcgcctttttttccaaaacctggatcgaggtgtctggctcctctgcaaaggatgttgccaagcagctgaaggagcaacagatggtgatgcgaggccatagggacaccagcatggtccacgaactaaacaggtatatacccaccgctgctgcgtttgggggactctgtattggcgctctcagcgtgttggctgacttccttggagctatcggcagcggaaccggaatcctcctcgccgttaccataatctaccagtattttgagatcttcgtaaaagaacaggcagaggttggaggaatgggcgctctctttttctag

SEQ ID NO: 53795 - DNA, 480 bp, Artificial Sequence
  Description of Artificial Sequence: Synthetic coding sequence
atgggtatcaagttcctcgaagttattaagcccttctgtgccgtactacctgagatccagaaacctgaaaggaaaatacagttccgtgagaaagtgctctggaccgcaattaccctgtttatttttctggtgtgttgccaaattcccttattcggaataatgtccagcgactccgcggaccctttttattggatgagggtcatcctggcatccaataggggaacactgatggaacttggaatctctcctatcgtcacaagcggtctgattatgcaacttttggctggagctaagataatcgaggtcggtgatacacccaaggatcgggctctatttaacggtgcccagaagctgttcggcatgatcatcactataggacaagcgattgtatacgttatgacgggcatgtacggcgatccagcagagatgggagcgggaatttgtttgctaatcattatccaggatcagcacagcccctag

SEQ ID NO: 53796 - DNA, 438 bp, Artificial Sequence
  Description of Artificial Sequence: Synthetic coding sequence
taaagcgactccgcggatcccttttactggatgagagtgattttggcaagcaatcgcggtacattgatggaattgggaatttctccaattgtgacctccgggctgataatgcagctccttgccggtgctaagattatcgaggtgggagatactccgaaggacagagcacttttcaacggtgcccagaaactgttcggcatgattattaccattggacaagcgattgtctatgtaatgactggtatgtatggagatcctgccgagatgggggcagggatttgtctcctgatcataatccaggggtttcgcgtagatctcccgattaaatccgccaggtatcgcggtcaatattctagctatccaatcaagctgttttacacatctaacatccccatcattcttcagagcgcattggtcagcaatctctacgtcatttag

SEQ ID NO: 53797 - DNA, 687 bp, Artificial Sequence
  Description of Artificial Sequence: Synthetic coding sequence
tgaggcatgatcatcaccatcggccaagctattgtatacgtgatgaccggcatgtatggcgaccccgctgagatgggcgctggcatttgcctattgataatcattcagctctttgtcgcaggcctcatcgttctcctccttgatgagctcctgcaaaagggctacggacttggatctggaattagcctgtttatcgcaacgaatatttgtgaaaccattgtgtggaaggctttttcccccacaaccatcaataccggacgcggaaccgagttcgaaggcgcagtcatcgcactgttccacctcctggcaacgaggaccgataaggtccgcgctctccgggaggctttttaccggcaaaacctgcccaatctgatgaatttgatcgctactgtgtttgtcttcgcagtagtgatctatttccaggtagcgaagcagctaaaggagcaacagatggtcatgcggggacatcgcgacacatccatggtgcacgaactcaatcggtatatacctaccgcggctgcattcggaggcctatgcatcggagccctcagcgtgctcgcagacttccttggagctattggcagcgggacaggtattttgttagcggtgacaatcatctatcaatactttgagatatttgtaaaggaacaggcagaagtgggaggtatgggtgccctcttcttttag

SEQ ID NO: 53798 - DNA, 633 bp, Artificial Sequence
  Description of Artificial Sequence: Synthetic coding sequence
aagtacaatctctttacaaaagggttcagggttgaccttcctattaagagtgcccgttaccggggtcagtatagttcctaccccataaagttgttttacacatccaatattccaattatcttacagtctgcactcgtctctaatctgtacgtgattagccagatgctgtcagtgcgttttagcgggaacttcctcgtgaatctgttgggccagtgggcggacgtttctggtggcggtcccgctaggagctatccagttgggggactgtgttattatttgtcccctccagagtccatgggggctatattcgaggaccccgtgcatgttgtagtgtatatcatttttatgttaggtagttgcgcctttttttcgaaaacctggatcgaggtgtccggttcaagtgcaaaggacgtagccaagcagcttaaagagcagcagatggttatgcgcggacatcgcgacactagcatggtgcacgaactcaaccgttacatcccgaccgctgcggctttcggtggactgtgcatcggggctctaagcgtccttgccgattttctcggcgctataggatcaggaaccggcattctgttggcagtgacgatcatctaccagtattttgagatttttgtttag

SEQ ID NO: 53799 - DNA, 570 bp, Artificial Sequence
  Description of Artificial Sequence: Synthetic coding sequence
atgggcatcaaatttttggaagtgatcaagcccttctgcgctgtgctcccagaaatacagaagccggagcgaaagatccaatttagagagaaggtgctgtggacggccatcacccttttcattttcctagtttgttgtcagatacctttatttgggattatgagcagtgattcggcggatcccttctattggatgcgtgtgatcctggctagtaatcgcggaactctgatggagctcggaatatcccctatcgtaacttctggactcattatgcagctgctggccggagccaagattattgaggttggtgacacccctaaagaccgagcactcttcaacggcgctcagaagcgaactgaatttgagggggcagtcatcgctctgttccacctgttggccaccagaaccgataaagttagagctctgagggaggccttctatcggcaaaatcttcccaacctgatgaacctgatcgccaccgtgttcgtgtttgctgtggtgatttattttcagggatttcgagtcgacttgccaatcaagagcgctcgataccgcggacagtattcctag

SEQ ID NO: 53800 - DNA, 285 bp, Artificial Sequence
  Description of Artificial Sequence: Synthetic coding sequence
tagtttagagagaaggtcctgtggacagcaatcacgttgtttatcttcctggtctgttgccagattccgctgttcggtatcatgagttcagatagtgccgaccccttctactggatgagagtgatcctcgctagcaatcgcggtaccttgatggagttgggcatttctcccatcgtgacctcaggcctgataatgcaactgttggccggtgcaaaaatcattgaggtaggcgatacgccaaaagaccgggctttatttaacggtgctcagaaaagggagcactag

SEQ ID NO: 53801 - DNA, 1257 bp, Artificial Sequence
  Description of Artificial Sequence: Synthetic coding sequence
atggggattaagttccttgaggtcatcaaacccttctgcgccgtgctgccagagatccagaagcccgaacgcaagattcagttcagagagaaggttttgtggactgctattacgttatttatattcctggtgtgctgccagattccattgttcggcattatgagctccgactccgccgacccattttattggatgcgtgtcatcctggccagtaacagaggcaccctcatggaactcggcatctctcctatagtcacctcaggcctgatcatgcaattactggccggtgccaaaattatagaggtgggagacaccccgaaagatcgcgcacttttcaatggagcccaaaaattgtttgggatgatcatcaccattgggcaggctattgtatacgtaatgaccgggatgtatggggacccggcagaaatgggcgcagggatatgtctcctcattatcatccagctgtttgtggccggactaattgtgctgctgcttgatgagctgttgcagaaggggtacggtctgggaagtggtatctccctgtttatcgctactaacatttgcgagactatcgtgtggaaagcattttccccgaccacaattaatacaggccgaggcacagagtttgagggcgctgtaatcgcattattccatctgctggcaaccagaaccgataaggttcgggcacttagagaagcgttttaccgccagaatctccctaatttgatgaaccttatcgccaccgtcttcgtctttgcagtggtgatctatttccaggggttccgagtcgacctgccaattaaatcagctcgctaccggggacagtattcgtcgtacccaattaaattattttacaccagtaacattccgattatcctgcagagcgctctggtgagcaacctgtacgtcatttctcaaatgttgtccgtgcgcttctctggtaactttctggttaacctactgggccagtgggctgacgtatccggaggcggaccagccaggtcctacccagtcgggggactatgctattacttgagtcccccagagtcaatgggagccattttcgaggatcccgtgcacgtcgtagtttatatcatctttatgctgggcagttgcgctttttttagtaagacatggatagaagtgagtggctcaagtgcgaaggatgttgccaaacagcttaaggaacagcagatggtgatgcgcggtcatagagatacatcaatggtgcacgagctgaattcagcccgagcttag

SEQ ID NO: 53802 - DNA, 975 bp, Artificial Sequence
  Description of Artificial Sequence: Synthetic coding sequence
atgctgaagtcatgttcacgtgccagcttctccccatcggtccgcaagccaccgcttattctgaggcgcttgttgtcagaggatgtgggaatggatatcccttttgaagaaggggtgctaagccccagcgctgcagacatgcgcccagagccccctaattctctcgatctgaatgacacacaccctagacgaattaagctgacagcccctaacataaacctgtcccttgaccagagcgaaggatcaatcctgagcgacgacaacctcgattcccctgatgaaattgatattaatgtggacgagctggatacccccgatgaggccgattctttcgaatacaccggccacgaggatccaacggctaataaagacagcggccaggaatccgagtcgatcccagagtataccgctgaggaggagcgggaggataatcggctgtggcggacagtggtcataggcgagcaggagcagcgtatcgatatgaaggtgatcgaaccctatcgcagagtgattagtcacgggggatattatggcgacggcctgaacgccatcattgttttcgccgcttgttttctacccgactcatccagggctgattatcattacgtgatggagaatctatttctgtatgttatctcaacgctcgagcttatggtagccgaggactacatgattgtgtatctgaatggcgctacccccaggcgcagaatgccaggccttggttggatgaaaaagtgctaccagatgatcgacaggcggctccggaagaatctcaagtccttcattatcgtgcatccgtcctggttcattagaactattcttgctgtaacgcgtccattcatcagctctaagttctccagcaaaattaaatatgtgaattccctgtctgagctcagcgggctcatcccgatggactgtatacacattccagaatctatcatcaacatcgatcttaaactgaaagagaagccgtag

SEQ ID NO: 53803 - DNA, 207 bp, Artificial Sequence
  Description of Artificial Sequence: Synthetic coding sequence
atggaccaggtaatgcagtttgtcgagccttccagacaatttgtcaaagacagcatccgcctagttaagcggtgcactaagccagaccggaaggaatttcagaagatcgctatggccacagctatagggtttgcgatcatggggtttataggctttttcgtgaaactgatacatatccctattaacaacataatagtgggcggttag

SEQ ID NO: 53804 - DNA, 207 bp, Artificial Sequence
  Description of Artificial Sequence: Synthetic coding sequence
atggaccaggtgatgcaattcgtggaaccctctaggcaatttgtcaaggactcaatcaggctagtgaaaaggtgcacaaagcccgatcggaaagaatttcagaaaatcgcaatggcaaccgcaatcggattcgcaatcatggggttcatcggcttttttgtgaaactcattcacataccgatcaacaacatcatcgttggcggttag

SEQ ID NO: 53805 - DNA, 207 bp, Artificial Sequence
  Description of Artificial Sequence: Synthetic coding sequence
atggaccaagtgatgcagtttgtggagccatctaggcagtttgttaaggactcgatccgacttgtaaaacggtgtacaaagccggacaggaaagagtttcagaaaattgcgatggctacagccatcgggttcgccattatgggcttcatcggattctttgtgaagctaatccatatcccaatcaacaatataatcgtgggtggctag

SEQ ID NO: 53806 - DNA, 207 bp, Artificial Sequence
  Description of Artificial Sequence: Synthetic coding sequence
atggatcaggttatgcagttcgtggagcccagccgccagttcgtaaaggattcaatcagactggtgaaacgatgtacaaaacccgatagaaaagaattccagaagatagcgatggccactgctatcggctttgcaataatgggcttcattggttttttcgtgaagctgattcatatccccatcaataatattattgtgggaggatag

SEQ ID NO: 53807 - DNA, 2610 bp, Artificial Sequence
  Description of Artificial Sequence: Synthetic coding sequence
atggctgccgtgcccacacagcctcagtctaaggaaggaccttggtctccagagagcgaatcaccaatgctgcggatcaccgctccacttccccctggaccgagtatggccgtgccaactctcgggcctggcgagattgccagcactacccccccttcccgtgcgtggacacccacacaggagggcccaggggatatgggccgaccttgggtggccgaggtcgtgtcgcaaggagcagggatcgggatccaggggaccatcacctcttcgacagcctccggggacgacgaggagaccaccacaactactacaatcattacgactacaataacgaccgtgcaaacccctggcccttgtagttggaacttcagcgggcctgaggggtctctcgacagtccgacagatctgagtagccccaccgatgtgggcctggactgcttcttctacataagcgtgtatcccggatatggcgttgaaattaaagtgcagaacatttctttgcgagagggggagacagtaaccgtggaaggcctcggaggacccgatcccctgcccctagctaaccagagctttctgttgcggggtcaagtgatcaggagccccactcaccaagctgccctgagatttcagtccttaccccctccggctgggcctggaacgttccattttcactaccaggcatacctactgtcttgccacttccctcgcaggcccgcatacggcgatgtcacagtgactagtctgcaccccggagggtcggctcgattccactgcgccactgggtatcagctgaaaggcgcacggcaccttacatgtctgaacgccacccagcctttctgggatagcaaagaaccagtgtgtattgccgcttgcggcggtgtgatccgcaacgcaacaacaggcagaatcgtgtctccaggatttccgggaaactattctaacaatttgacatgccattggctccttgaagcccctgagggtcagaggctgcatctccactttgagaaagtgtctctcgccgaagatgatgatagacttattattaggaacggtgacaatgtggaagccccacccgtctatgattcttacgaggtggaatacctgcccatcgaaggtctactgagctctggaaagcacttctttgtagaactctccaccgatagtagcggtgccgctgctggaatggccctgaggtatgaagcttttcagcagggccattgttatgagccatttgtgaaatacgggaatttttcctccagcacacctacgtacccagtagggacaactgtcgagttttcgtgcgatccgggatacacacttgagcaaggaagcatcattattgagtgcgttgacccacacgacccgcaatggaacgagacagaaccagcctgccgggctgtctgtagcggcgagattacggacagcgccggtgtggttctgtcccctaattggcctgaaccatatggccgtggccaggactgtatttggggcgtccacgtggaggaggacaaaaggattatgctcgacatacgtgtcctgaggatcggacccggagacgtgctcacgttttacgatggcgatgatcttacggcgcgagtactggggcaatattctggtcctagatctcacttcaagctattcacaagcatggccgacgtgaccatccagttccaaagtgacccaggcactagcgttcttggatatcagcagggcttcgtcattcacttctttgaggttcctaggaacgacacatgccctgaattaccggagatccccaacggctggaagtctccttcacaaccagaactggtgcacggaaccgtggtcacttatcagtgctatccgggatatcaggtcgttggaagctcggtgctcatgtgccaatgggacttgacctggagtgaggaccttccttcctgtcagcgcgtgacgagttgtcatgatccgggagacgtggaacactcgaggcgcctgatctcttcgcccaagtttccagtaggcgctaccgtgcaatatatatgcgaccaggggttcgttctgatgggctcttcaatcctcacctgtcatgatcggcaggccggtagcccaaaatggagcgatagggccccaaagtgcctgctggagcagctgaaaccttgccatggtctgagtgctccggagaacggggcacgtagtccagagaaacaactgcatcccgcaggagccaccatacatttctcctgcgcccctggttacgtcctcaagggtcaggccagtatcaaatgcgtgcctggacatccgtcgcactggagcgatcccccaccgatctgcagggcagctagcctggacggattctacaatagcagaagtctggacgttgccaaagcaccagccgcaagcagcacattggatgccgctcatattgcagcagctatcttcctgcccctggtggctatggtattgttggttggaggagtgtatttctactttagcagactgcaaggcaaaagcagtttgcagctgccacgaccacggccacgaccgtataataggatcaccatagaatccgccttcgataatcccacatatgaaacagggtcgctgtcatttgccggagacgaaaggatatag

SEQ ID NO: 53808 - DNA, 1527 bp, Artificial Sequence
  Description of Artificial Sequence: Synthetic coding sequence
atgcggccagtggccttgctcctcctcccttcactgttggccttattggctcatggactttctcttgaggcacccacagttgggaaggggcaggccccaggtatagaggaaacagatggtgaattgaccgccgctcctactccagagcagccagaaaggggggtccatttcgttaccacggctcctacactgaagttgctgaaccaccaccctttattagaggagttcttgcaggagggactggaaaaaggtgatgaggagctcaggccagccttgccgtttcagccagatccacctgcacctttcacaccctctcctctccctcggttggcaaaccaggactcacgtcctgtgttcacctccccaactcctgcaatggcggcagtgccaactcaaccacagtccaaggaggggccatggtctccagagtccgaaagtccaatgctgagaatcaccgctccactgcccccagggcctagtatggctgtacccacccttggccctggcgagattgcatctaccactccaccatctagggcttggacaccaactcaagagggacctggggatatgggtcggccatgggtggctgaggttgttagccaaggcgcaggaatcggcatccagggcactattacaagtagtactgcctcaggggacgacgaagagaccactactactactaccatcataactaccaccatcactactgtccagactccaggcccatgcagttggaacttcagcggcccagaaggatcacttgacagccctactgacctctcatctcctaccgatgtaggccttgattgcttcttctacatatcagtgtatcctggctacggggttgagattaaggtgcagaacattagcctgagagaaggagagaccgtgacggtggaagggctcgggggacccgaccctctcccactagccaaccagagctttctcctgagaggccaggtgattaggtccccaacccaccaggccgctctgcgcttccaatctctgccccctccggcaggacccggtacctttcatttccactaccaggcctatcttctaagctgccatttcccgaggcgtcccgcttacggcgatgttactgtgacgtctctgcatcccggtggcagtgctcgtttccactgtgcgaccggctaccagctaaagggcgcaagacatctgacttgcttgaacgccacccagccgttctgggacagtaaagagcccgtgtgtattgcagcatgtgggggtgttatccggaacgcaactacgggtcgaatcgtgtctcccggattcccaggcaactatagcaataatctcacatgtcactggctgctggaggcaccagagggtcagagacttcacctacatttcgagaaggttagtttggctgaggatgatgaccgccttattatccgtaacggagataatgtagaagcccctcccgtgtatgattcctatgaagtaacggctccacctcccccacctccattgcaacctcactatcaccgtgtgagtgtgtag

SEQ ID NO: 53809 - DNA, 2985 bp, Artificial Sequence
  Description of Artificial Sequence: Synthetic coding sequence
atgcgcccagtggcattactgcttctgccttctcttttagcgttgctggctcacggactcagccttgaggccccaactgtggggaagggtcaagccccaggcattgaagagactgacggagaactgaccgctgcacctacccccgagcagcctgagaggggggtccacttcgttactacggcccctacacttaaactgctaaaccatcatccgttgcttgaggagttcctccaggagggcctggaaaaaggtgatgaagagctgaggcctgccctgccatttcagcccgatcctcccgcacccttcacaccctctcccctacccagactggccaaccaggactctcgacccgtgtttacatcacctactccggctatggcagccgtgccgacacaaccccagagcaaggagggaccctggagccccgagtccgagagccctatgctgaggattactgctcccctgccgccaggaccctctatggcagtgccaaccttgggacccggtgagattgcctctaccacccccccatctagagcatggaccccgactcaggaaggccctggcgatatgggtcggccatgggtagctgaggtggtgtcacagggtgccggaattggtatccagggaacaatcacctccagcaccgcctcgggagatgatgaggagactacaaccaccactacgattatcaccacaacaattacgactgtgcaaacacccggaccttgtagttggaacttctctggtcctgagggttcactcgactctcctacagatttgtcttctcccactgatgtaggattggactgctttttctacatcagcgtctatcccggatacggcgtggaaatcaaagtgcagaacatatctcttagagagggcgagactgtgactgttgagggcttgggaggccctgatccacttccattagccaatcagagtttcctcttgcgcggacaggtaataaggagcccaacgcaccaggccgcacttagatttcaatcacttcctccacccgcaggccctggcacttttcacttccactatcaggcctacctcctgagctgtcactttccaagaagacccgcttacggtgatgtgaccgtcacatctctccaccccggaggttcagctcgctttcattgtgctactggctatcagctaaagggcgctagacatctgacttgtctgaatgccacacaacccttttgggactctaaggaacccgtatgcatcgctgcctgcggcggagtgatccggaatgccaccactggtcggatcgtcagcccaggatttcccggtaattactctaataacctgacgtgtcactggttgctggaagccccagaaggacaacgcctccacctgcactttgagaaggtctcattggccgaggacgatgacagattgattatacgtaacggtgacaatgtggaggcccctcccgtgtacgactcttatgaagtggagtatctgcccatcgagggtctgctgtcatctggaaaacattttttcgttgagctgtcaacagacagcagcggggctgctgctgggatggctcttaggtacgaggcttttcagcagggacactgctacgagccatttgtgaagtacggcaactttagctcatccacgcccacctacccagtcgggacaacagttgaattttcctgcgatccagggtatactctcgagcaggggtcaattatcatcgagtgcgtggacccgcatgatccacagtggaacgagacggagcccgcttgcagagccgtttgttccggggaaatcactgactccgctggcgtcgtgttaagcccaaattggcctgaaccttacggcagaggccaggattgcatctggggagtacatgtggaagaagataaacgcatcatgctggacattcgggtgctccgaatcggacctggcgacgtactgacattttacgacggggatgatctgacagctcgggttctgggccagtacagcggcccaagatcacatttcaagcttttcacaagcatggctgacgtgacgattcagtttcagagcgatcccggtacaagcgtgctgggttaccagcagggctttgttatccattttttcgaagtaccccgaaatgacacttgtcccgagttacccgaaatccctaacgggtggaagtctccctcacaacctgagctggtacatggcactgtggtgacctaccagtgctatcctggatatcaagtagtgggaagcagtgttctgatgtgccaatgggatctcacgtggtcggaggacttgccatcctgtcaaagagtgacatcttgccacgatccgggagacgtggagcactccaggcgcttaatctcttcaccaaagttccccgtgggtgccaccgtgcagtacatatgtgaccagggattcgtgttaatgggtagcagcatcctgacttgccacgatcggcaggctggttcccccaaatggtcagaccgggctccaaagtgccttttagaacaactcaaaccttgccacgggctgagcgccccagaaaacggcgctcgttcaccagagaagcaattgcacccggcaggcgctaccatccatttctcttgtgccccaggatatgtcctgaaaggtcaggcgagtattaagtgcgtgccgggacatccaagccactggtcagaccccccacccatttgcagggcggcatcactggatggcttttacaactccaggtctctcgatgtagcgaaggccccagcggcttcgtccaccctcgatgctgcacacattgccgctgccatctttctgcctctggtggcgatggtgctgctcgtcggcggagtttacttttacttcagtcggctgcagggaaaatcttctctgcagctccctcggccaaggccacgcccttataataggatcaccattgagtccgcttttgataatccaacctacgagacagggtccttgtctttcgccggtgatgaaaggatctag

SEQ ID NO: 53810 - DNA, 2982 bp, Artificial Sequence
  Description of Artificial Sequence: Synthetic coding sequence
atgagaccagtggccttgttacttcttccttctcttctggctctgctggcccacggactgtcactcgaggccccaacagtgggcaaagggcaggccccaggcatcgaagagaccgatggagaactgacggcggctcccacacctgagcagcctgagcggggtgtccatttcgtcaccactgcgcctaccctaaaactcctgaaccaccatcccctcttagaggagttcctacaggagggcctggaaaagggtgatgaggagctgagacccgcattgccatttcaacccgaccctcctgccccatttacaccatcccctctgcctagattggccaatcaggactccaggccggtcttcacgtcccccactcccgcaatggccgctgtacccactcagccccaatccaaagaggggccttggtccccggaaagcgagtctcctatgctgcggataaccgcccctttgccaccgggaccaagcatggctgtcccgacgctcggccctggagagatcgccagcaccacaccgccatccagggcttggactccaacccaagagggccctggcgatatggggaggccctgggtcgccgaggtcgtcagccagggtgccggaattggcatccagggcactatcacttcctcaaccgcgagcggcgacgacgaggaaacaactactactaccaccatcatcaccaccaccatcactaccgtccaaacacccggaccatgcagttggaacttctccggccctgagggaagcctggattcccctacagacctgagctctccaaccgatgtgggcttagattgcttcttttacatttctgtgtacccgggatacggtgtggagataaaggtacagaacatcagtttgcgggagggagagacagtaactgtcgaaggtcttggagggccagatccactgccactagcgaatcaatctttccttctgagaggacaggtgattagatcacccacacaccaggcagccctacgttttcagtcactgcctccccctgctggaccaggaacatttcactttcattaccaggcgtacttactcagctgtcatttcccacggagaccagcctatggggatgttactgtaacctctctccaccctgggggatccgcccgattccattgtgccacaggctaccagctgaagggggctcggcacctgacatgcctgaacgcaactcagcccttctgggactcaaaggaacccgtctgcatcgctgcgtgcggaggcgtgataagaaatgcgaccactggacgaatagtgagcccgggattccccggaaactactcaaataatttgacctgccactggttgctggaggcccctgagggccaacgacttcacctccactttgaaaaagtatccttggccgaggatgatgaccgactcattattcgcaatggtgacaacgtggaggctccgccagtttacgattcatatgaagtggagtatcttcctattgagggtctgctgtctagcggcaaacatttctttgttgaattaagcacagatagctcaggtgccgcagccggaatggcactgcgatatgaagctttccagcagggccactgctacgagccgtttgtcaagtatgggaattttagttcgtccactccaacatatcctgtgggcacaacggttgagttcagctgcgatcccggttatacccttgagcagggtagcattataatcgaatgtgtggatccgcacgacccccagtggaacgaaacagaacctgcgtgtcgggctgtgtgtagcggagaaatcaccgattcggctggggtggtgctgagcccaaactggcctgagccttatggcagaggacaagactgcatctggggggttcacgttgaggaggacaaaagaattatgctagatatcagagttctgaggataggacccggtgatgtgttgacattctatgacggggacgatctgacagccagggtgctgggccagtacagcgggccacggtcccactttaagctgtttactagtatggctgacgttactattcaatttcaatctgaccctggaacctccgtcctcggctaccagcagggctttgtgatacattttttcgaggtgccgcgtaatgacacgtgtcccgagttacccgagataccgaacggttggaagtctccatcacagcctgaactggtgcatggcacagtggtaacatatcagtgttatcccggatatcaagtggtcggatcaagcgtcttaatgtgccagtgggacctgacctggagcgaagatcttcctagctgtcaacgggttacctcatgccacgacccaggagatgtggagcattcgaggcgactcatttcctcacctaagttcccagtgggggcaacagttcagtacatctgcgaccaggggtttgtgctgatgggaagcagtattctgacatgccatgaccgccaggccggaagccctaagtggtcagacagggcacccaagtgcctgctggagcagctgaaaccctgccatggcctgagcgcccctgagaatggggcacgcagccctgagaaacagctgcatcctgccggtgctaccattcatttctcatgcgctccgggatatgtgctgaagggccaggcatctattaaatgcgtccctgggcatccttctcactggtctgaccctccccctatctgcagagctgcctctctcgacgggttctataactcccgctcactcgatgtagccaaggcccctgccgcttcatccacactcgatgccgctcacatcgccgcagcaatattcctcccgttagttgcaatggtcttgcttgtaggcggagtctacttttatttctcccggctgcaaggaaaaagttccttacagctacctcgacctaggccaagaccttacaacagaatcacaatcgaaagcgccttcgacaatcctacatatgagactggggaaactcgcgaatacgaagtctctatttag

SEQ ID NO: 53811 - DNA, 2733 bp, Artificial Sequence
  Description of Artificial Sequence: Synthetic coding sequence
atgggaacaccacgtgctcaacacccccctcctccccaactgttatttctgattctgctgagctgcccatggatacaggggctgcctctgaaggaagaagagatcctgcccgagccagggtcagaaacacccactgttgcctccgaggcactggccgaactcctgcatggcgcactgctcaggcggggaccagagatggggtacctgcctggctccgatcgagaccccaccttggctacaccacctgccggtcagacactagcagtgcccagcctgcctcgggcaaccgaaccaggcaccggtcctctgactactgcagtcacccccaatggggtgcgaggggctggacccactgcccctgaactcttaactccaccccctgggacaacggctcccccacccccatcccccgcttccccagggcctccgctggggccagaagggggagaagaagagaccacaacaactatcatcaccactacaaccgtgaccaccactgtgaccagcccagttctgtgcaataataacatttccgagggagagggttacgttgagtcccctgacctgggcagtcctgtctctaggaccctcggactgttagattgtacatattctattcatgtatacccgggatacggcattgagatacaggtgcagacgctcaacttgtctcaagaagaggaactgctggtcttggctggcggagggagtccagggcttgccccacgcctcttggcaaactcaagcatgttaggggaaggccaggtgctgcgtagtcccacaaaccgactactgctccatttccagtctcccagagtcccgcgtgggggtggctttcggattcactaccaggcgtacttactgtcctgcggctttcccccacggccagcacatggcgacgtgagtgtaaccgatttgcatcctgggggaacagcgactttccactgcgactcaggctaccaactccagggagaagagacactcatctgtctgaatggaacccgtccatcttggaatggagaaacaccttcatgtatggcatcttgcggaggcaccatccataacgctactttaggacggattgtgtccccagagcccggaggtgcagttggtcctaatctgacctgtagatgggtcattgaggcagcggaaggccgaaggctccatctgcactttgagagggtttccctcgatgaagataatgatcgactcatggtgcggagcggcggtagtcccctgtctccagttatatacgacagcgatatggacgatgtccctgagaggggacttatctctgacgcgcagtcactttacgtagagctcctcagcgagacccccgctaacccactacttctctctctgcgctttgaagcctttgaggaagaccggtgttttgcacctttcctggcccatgggaatgtgaccaccacggaccctgagtacagaccaggcgcactcgctacattcagctgtcttcccggatacgcattggagccgccaggcccaccaaacgctatcgaatgcgtcgatccaaccgagccccactggaacgacacggagcccgcatgcaaggctatgtgcggaggagagctgagcgagccggcaggtgtcgtgctctcgccagattggcctcagtcgtatagtcccggacaggattgtgtatggggagtgcacgttcaggaagagaagcgcatcctgctgcaggtggagatcctgaatgtgcgggagggggacatgctgacactgttcgatggagacggtccctctgccagggtcctggctcagctgagaggccctcagcctagaagacgcctgctgtcctccggacctgacctgacattgcaatttcaggctccccctgggccacctaaccccggactgggacagggatttgtgctccactttaaagaggtccccagaaacgatacctgccccgagctccctccgccagagtggggctggcggaccgcatctcatggcgacttaatccggggaacagtgctcacttaccaatgtgagccaggctatgagttgctgggaagtgatatcctgacttgtcaatgggatctgtcgtggagcgcggcaccaccggcttgccagaagatcatgacctgtgctgaccccggagagatcgccaacggtcaccgcacagcctctgacgctggctttccagtgggatcacacgtccagtatcggtgccttccgggttacagcctggaaggggcagccatgctgacgtgttatagcagggacactggcacacctaaatggagtgaccgggtccctaagtgtgccctgaagtacgaaccatgcctgaacccaggtgtgcccgagaacggctaccagacgctctataagcaccactaccaagccggagaaagcctccgcttcttctgctacgaagggttcgagctgatcggcgaagtgactatcacctgtgtacctggacacccatcacaatggacctcgcaacccccactgtgcaaggttactcagacaaccgatccttcccgtcagctagaaggcggtaatctggcccttgcaattctattgccactcgggctcgtcattgttctcggcagcggggtgtacatctactacacaaagctgcaaggaaaatcactgtttggcttttccggttcacattcctactcccccataaccgttgaatcagacttttccaaccctctctatgaggctggagacacccgggaatacgaagtcagcatctag

SEQ ID NO: 53812 - DNA, 2430 bp, Artificial Sequence
  Description of Artificial Sequence: Synthetic coding sequence
atgggtacgcccagagcccagcacccccctccccctcaactgctgtttttgatactcttgagctgtccatggatccagggactgccactgaaggaagaagagatcttgcccgagcccggttcagaaacacctaccgtggcatccgaagctcttgccgagctgctacacggggcattgctgagacggggtcccgaaatggggtatctaccagggtctgatcgggatcctactcttgccacaccacccgctggacagaccctggctgtgccttctctgccaagagcgaccgagcctgggactgggccactcaccactgcagtgactcccaatggcgtgaggggggcaggacctacggcccctgaactgcttacgcctccccctggaacaacagcacccccaccacctagccccgcaagccccggacctccactggggccagagggcggagaggaggaaacgactacaacgataatcacaaccacgacggtcaccacaactgtaacttcccccgcataccttttaagctgcggattcccgccacgcccagctcacggcgacgtgagcgtgacagacctccatcccggagggactgctacttttcactgcgattctgggtaccagctgcagggcgaggaaaccctgatatgcctgaacggaactagaccgtcctggaatggcgagaccccatcctgtatggcctcctgtggaggaacaatacataatgctactctggggcgtatcgtctcgcccgagccagggggtgctgtggggccaaatctgacttgtcggtgggtaattgaggcagctgaaggtcgcaggttacacctgcattttgagcgcgtctcattggatgaggataatgataggcttatggttcgttccggaggatcccccctgtctccagtcatctatgattcagacatggacgatgtcccggagcggggactaatcagtgatgctcaaagcctgtacgttgagcttttatcagaaactccagcaaatcctctgctgttatccctgaggtttgaagcttttgaggaggaccgctgctttgctcccttcctagcccacggtaacgtcacgactaccgatccagaataccgacccggtgcactggctaccttcagttgccttcccggatacgcactggagcctccaggccctcctaacgctatcgaatgcgtcgatccgacagagccccattggaacgacacggaacctgcctgcaaagcaatgtgcggaggagagctcagtgaacccgctggagtagtattatcacctgattggcctcagagttattctccagggcaagactgtgtgtggggcgtacatgtgcaggaggagaagaggattctcctgcaggtagagatattgaatgtccgtgagggggacatgctgactctctttgatggtgatgggcctagtgcaagagtgctggcccagctccgcggacctcagccacgacgccgacttttgagcagtggcccagaccttaccctgcagttccaggcccctcccggtccgccaaacccaggcctgggtcagggctttgtccttcacttcaaagaggtgcctcgaaacgatacgtgtccagaactgccccctcctgagtgggggtggcggactgcaagccacggtgatctgatccgcggaaccgtcttgacctaccagtgtgagcccggatacgagttgttgggctccgatatcctgacatgccagtgggacctcagctggtctgccgctcctccagcgtgccaaaaaattatgacctgtgctgatccaggtgagatcgccaacggccacaggactgctagcgatgcagggtttcccgtgggcagtcatgtccagtatcgatgtttaccgggatactctttggaaggggcagccatgctgacctgttactcccgggacacaggcacccccaaatggagcgaccgggtccctaaatgtgcactgaagtatgagccctgcctgaacccaggtgtgccggagaacggctatcagacactctacaaacatcactaccaagcaggggaatccctaaggtttttttgctacgaaggctttgaactcatcggcgaagttactattacctgcgtgcctggccatccaagccaatggacctctcagcctcctctctgtaaagtcgcctacgaagagctgcttgataatcgtaagctggaggtgactcaaaccacagaccctagcagacagctggaggggggaaacctagctcttgccattctactaccccttggcctcgtgatcgtcctcggaagcggtgtgtatatttactatacaaagctccaaggaaaatctttgttcgggttttctgggtcacacagctactccccgatcactgttgaatccgactttagtaatcctctttatgaggctggcgatactcgcgagtatgaagtttccatatag

SEQ ID NO: 53813 - DNA, 2562 bp, Artificial Sequence
  Description of Artificial Sequence: Synthetic coding sequence
atgggtacaccacgggctcaacaccctccgcctccacagctactcttcttgattttactttcctgtccgtggatccagggtctaccactgaaagaagaggaaatcttacccgagcctggatctgagacacctacagtggctagcgaggctctcgccgagcttttacacggcgcattacttcggaggggacccgaaatgggctacctgcctggccctcctcttggaccggaaggcggagaggaggaaacgactacgaccattataacaacaaccacagtgacaaccactgttacatctcccgttctgtgcaataacaatatttctgagggggagggctacgtggagtcacccgacttaggctctccggtctcacgcacccttggcctgctggactgcacttattccattcacgtctatccagggtacggtatagaaatccaggtccaaaccctgaacctgtcgcaagaagaggagcttctggtcttggcgggtggaggaagtcctggcctggctccacgtttactggctaacagcagcatgctgggagaggggcaggttcttcgatcacctacaaacagactacttttgcacttccagtctcctagggtgcccagagggggaggttttcgcatccactaccaagcctatctgctctcgtgtgggttccccccacgccctgcacatggcgatgtgagcgttacggacctacatccaggcggtacagcaactttccattgtgatagcgggtatcagttacaaggggaagagactctcatatgcctaaacggcactcgccctagctggaatggagaaactccttcttgcatggctagctgcggtggtaccattcacaacgctacacttggtagaatcgtcagcccagaacctgggggagcggtcgggcctaatctgacttgtcgatgggtaattgaggccgctgaggggaggcgcctccaccttcattttgagagagtgtctctggacgaggataatgaccgactcatggtacgaagtggcggtagtcccctgagcccagtcatctatgattcagacatggacgatgtacctgagcgcggattaatttccgacgcccagtcactgtatgtggaactgctgtccgagactccggctaatccactgctgctgagcttaaggtttgaagcatttgaagaagaccgatgctttgcacctttcctggctcatgggaatgtgacaacaactgaccccgagtatcgtccaggagctctggcgaccttctcatgtcttcctggttacgcactggagccccctggacctcccaatgcaatagaatgcgtcgacccgacagagccccactggaatgatacggagccggcttgcaaggcaatgtgcggtggtgagctctcggagccggcaggtgtggttttgtccccagattggccacaatcctattcacctggacaggattgtgtttggggtgtgcatgtgcaagaagagaaacgaatcctgctccaggttgaaatcctgaatgtaagggagggagacatgttaactctgttcgacggggacggcccatcagcccgtgtgctggcccagctgcgaggccctcagcctagaaggagactactgtcttctggcccagacctgaccctacagtttcaggcgccacccggtccccctaaccccggtctgggacaaggattcgtacttcatttcaaagaagtccctagaaatgatacttgtcctgagctccccccaccggagtggggctggaggacagcgagccacggagacctgattcggggaaccgtcttgacgtaccagtgtgaacccggttacgaactgctcggatcagatattctgacctgccaatgggacctaagttggtccgccgctcccccagcatgtcagaaaatcatgacgtgtgctgacccaggtgagattgctaacgggcaccgcaccgcctctgacgcgggatttccagtagggagccacgttcagtaccgatgcctgccagggtactctctcgaaggagcagccatgctgacctgttactctcgggatacaggcacaccaaagtggagtgatcgcgttcccaaatgtgccctgaaatacgagccctgcttgaacccaggagtccccgaaaacgggtaccagactctctacaagcatcattatcaggcgggtgagagcctgcggttcttctgttacgagggttttgagctcatcggggaagttacgataacctgcgtgcccggacatccctcacagtggactagtcagcccccactttgcaaagttgcatacgaagagttactggacaaccggaagttggaagttactcaaacaacggatcctagccgccagctcgaaggagggaatttggcgttggccattctgctgcctttaggcctggtgatcgtattgggttctggcgtgtatatttattacacgaagctacaggggaaaagcctgttcggcttctccggctctcacagctacagtccgattacagttgagtccgatttctctaacccactgtacgaggccggagatactagggagtatgaggtctcgatatag

SEQ ID NO: 53814 - DNA, 2640 bp, Artificial Sequence
  Description of Artificial Sequence: Synthetic coding sequence
atgggtacccccagggctcagcatccacctcctccacagctgcttttcctgatcctcttaagttgtccctggatacaaggatccgacagggatccgactttggcaaccccacccgctggccagactctggccgtgccaagtctgccccgtgctacagaacctggcacgggtcccctcacgacagctgtcactccaaacggggtccgcggagctggcccaacagctcctgagctgcttactccccctcctggaactaccgcaccaccgccaccctcccctgcgtcacccggtcccccactgggacctgaaggcggtgaggaggaaacaacgaccacgatcattaccactacgaccgtaaccacaactgtcacaagccctgtgctatgtaacaataatatttctgagggagaagggtatgtggaaagcccagatctcgggagcccagttagtcggactctgggactcttggactgcacgtactccattcatgtgtaccctggctatggtattgagattcaagtccagacactgaatttatcccaagaagaagagctgcttgtgctggccggtggcggtagtcccggattggctcctaggctgttagccaatagcagcatgctgggtgaggggcaggtcttaagaagcccaactaatcgcctacttctccacttccagtccccacgtgtcccaagagggggtggttttaggatccactaccaggcttacctgctgagctgcggcttccccccaaggcctgcccacggagatgtcagcgttaccgatcttcaccccggtgggaccgccactttccactgcgactctggctatcaacttcagggggaagaaaccttaatctgtttaaacggcacccgtccttcctggaatggtgagacgccctcatgtatggcttcttgcggcggtaccattcataacgcaacattaggaaggatcgtgtcccctgagccaggcggtgccgtaggccctaacctcacttgccggtgggtaatagaggccgctgagggtcggagactccaccttcacttcgagcgggtctcactggacgaggacaacgaccgtcttatggtgcggtctggaggatctcctctttcccccgtgatctatgacagcgatatggatgatgtgccagaacgaggactcatctctgatgctcaaagtttatatgtggagctattatcggaaactcctgccaacccgctgctgctttctcttagatttgaggccttcgaagaagacagatgctttgcccctttcctggctcacggtaatgtgactacaaccgaccccgagtacaggcccggagcgctcgccactttttcatgcttgcccggatacgcactcgaaccccctggccctcccaatgctatcgagtgtgtagacccaacagagccccactggaatgacactgaaccggcttgcaaggcaatgtgtggcggagagctgagcgaaccagcaggcgtggtcttgtcgcctgactggccccaatcctattccccgggacaggactgcgtctggggcgtgcatgtgcaggaagaaaagcgcattctcttgcaagtggaaatactcaatgtgagggaaggagatatgctgacgctcttcgatggagacggaccgtccgccagagtcctggcccaactgaggggccctcagcctcgtaggcgcctgctgagcagcggccctgatcttacactgcagttccaggcacctcccggaccaccgaatcctgggctcgggcagggtttcgtgctgcattttaaggaggtcccaaggaacgacacatgcccagagttgccgccacccgaatggggctggcgcaccgcaagccatggagatctgatccgaggaactgtgttaacataccagtgcgagcctgggtacgaattgctgggctctgatatattgacctgtcagtgggacttgagctggtcggctgcccctcctgcgtgtcagaaaatcatgacttgcgcagacccaggagaaatcgccaatggacacagaacagcaagcgatgctgggtttccagtcggcagccacgtccagtaccgctgtctccccggatattccctggaaggggcagccatgcttacctgttattcacgcgacactggaaccccaaagtggtctgatcgcgttcctaagtgcgcactgaagtatgagccttgtctgaacccaggcgtccctgaaaacggctatcagacactgtacaaacaccactatcaggcaggagaaagcctacggttcttctgttacgagggctttgagttgattggtgaagttactattacttgtgtacccggacatccctcccagtggacctcacagccacccctttgtaaggtagcatacgaagaactgctagacaacaggaagcttgaggtgacccagactaccgacccctcccgtcagctggagggtgggaacttggcactggctattttgctgcccctgggtcttgtgattgtgctcggcagtggggtgtacatctattacaccaaattacagggaaaatctctgtttggctttagtggatctcatagttacagcccaatcactgtggagtccgacttcagcaatccactatatgaagctggtgacacgcgggagtacgaggtgtcgatatag

SEQ ID NO: 53815 - DNA, 3294 bp, Artificial Sequence
  Description of Artificial Sequence: Synthetic coding sequence
atggcaccgagaccaaaaaagcagcctgataagaatcctctccatggcagagaattaaacgtggtgccctctttgggcaggcagacttctttaacaacttctgtaatccccaaagcagagcaatccgtggcctataaggacttcatctactttacagtgtttgaaggaaatgtccgcaacgtctctgaggtgtcagtggagtatctgtgcagtcaaccctgcgtcgtgaatctcgaggccgttgtgtcttctgagttccgctcctccatcccagtgtacaagaaacgctggaagaacgagaaacacttacatacgtcacgcactcagattgtgcatgtgaagttcccatctattatggtgtaccgcgatgactacttcatacggcacagcatatccgtgagcgccgtgatcgtgcgcgcatggatcactcacaagtactctggcagggactggaatgtcaaatgggaggaaaacctgttacatgccgtggctaagaattacacactcttgcaaactatccccccatttgagcgccctttcaaggatcaccaagtttgtctggagtggaacatgggctacatatggaatctgagagcaaaccgtatcccccagtgtccacttgaaaacgatgtggtggccctgctgggcttcccctatgccagcagcggcgaaaacactggcatcgtcaagaagttccctcggttcaggaaccgggagctagaggccaccaggcgccagagaatggattacccagtctttaccgtgagcctctggctctacctactccattactgcaaagccaatctttgtgggatcctgtatttcgtggactcaaacgaaatgtatggaacaccgtccgtgtttcttacggaagagggctacctccatatccagatgcacctcgtaaagggagaggacctggcagtgaaaacgaagtttatcattccccttaaggagtggtttaggcttgacatctcattcaatggaggacagatcgttgttaccacgtcgatcggacaggacctaaagagctaccacaaccagaccattagctttagagaggacttccattacaatgacactgccggttatttcatcatcgggggaagccgatatgtagccggaatcgagggtttcttcgggcctctgaaatattaccggttaagaagcctccatccagcccagatctttaacccgctcctagagaaacagctcgcggagcagatcaagttgtactacgagagatgcgctgaagtccaggagatcgtgagtgtgtatgcctccgccgctaaacatggtggcgagagacaggaagcttgccacttacacaatagttatcttgatctacagcggagatacggcagaccctctatgtgcagagcctttccatgggagaaggagctcaaggacaaacatcccagtctcttccaggccctgttggagatggacctgctgactgtaccgcgaaatcagaatgaatccgtctctgaaataggcggtaaaatcttcgaaaaggctgttaaacgcctgtctagtatcgatggcctacatcagatctctagcattgtgcccttcctcaccgattcctcctgctgcggatatcataaagccagctattatctggctgtgttttatgagaccgggctgaacgttcccagggaccagttacaaggtatgctctacagtctcgtaggagggcagggttccgagcgactgtcctccatgaatctcggttataagcactaccaaggcattgacaactatcctctcgattgggagctgtcttatgcttactactcaaatattgcaacgaagacgccccttgatcagcacacgttgcaaggggaccaggcttatgtggaaacaattaggctcaaagacgatgagatcctgaaagtacaaaccaaggaggatggggacgttttcatgtggttgaaacacgaggccactcggggaaatgctgctgcccagcagagactcgcacaaatgctgttttggggccaacagggcgtggccaagaatcctgaggccgctattgaatggtacgcgaagggagccttagagacggaggaccccgcactcatttacgattatgcaatcgtcttatttaagggccaaggagtgaagaaaaaccggcgactagcactggagctgatgaagaaagccgctagcaaaggcttgcaccaggctgtgaacggcctgggctggtactaccacaaattcaagaagaattatgctaaagcagcaaagtactggctcaaggccgaggagatgggcaatccagacgcaagttacaatcttggagttctgcacctggatggcattttccctggcgtgccaggaagaaaccagacactcgccggtgaatatttccataaagccgctcagggaggacatatggaggggacactgtggtgttcattgtactatatcacgggtaaccttgaaacattcccaagggaccccgagaaggccgtcgtttgggcaaaacatgtcgccgagaagaacgggtacctggggcatgtgataaggaaggggcttaatgcctacttggagggatcctggcatgaggctcttctgtactacgttttggccgcagagaccggcatagaggtcagtcagactaaccttgctcatatctgtgaggaaagaccagacctggctcgcaggtacctcggcgtgaactgcgtgtggcgatactacaactttagcgtgttccagatagacgctccttccttcgcctatcttaagatgggcgacttgtattactacggtcaccagaatcagtctcaggatctggaactgtctgtgcagatgtacgcacaggccgctctagacggcgacagccaagggttcttcaatcttgctctgcttatcgaagaaggcaccatcatcccccaccatatcctcgacttcctggaaattgacagtacccttcactccaataacatttctattttacaggaactgtacgaaaggtgctggtctcactccaacgaggaatccttctctccgtgttccctggcctggctgtacctgcatttaaggctgctctggggagctattctacactccgcattgatatacttcctaggaacattcctgctctcaatcctgattgcctggacagttcagtatttccagtcagtttctgcaagtgatccacctcctaggccaagccaagcgtctccagatacggcaacctcgaccgcgtcccctgctgttactcccgctgccgatgcaagcgaccaagatcagcccacagtgacgaacaatcccgagccccgaggatag

SEQ ID NO: 53816 - DNA, 3399 bp, Artificial Sequence
  Description of Artificial Sequence: Synthetic coding sequence
atgcaacgcaggggcgctggacttggatggcctagacaacagcaacagcaacctcctcctcttgcagtgggccctagagcagctgccatggtgccctccggaggggtgccacagggactaggaggacgctcagcttgcgctttgcttttgctatgctaccttaacgtggtcccttccctgggccgacagactagccttactacatccgtaattccgaaagccgagcagtccgtagcctacaaagatttcatctatttcacagtattcgagggcaacgtgagaaacgtgtccgaagtgtcagtggagtacctctgcagccagccgtgcgtcgtgaatctggaggcagtggtgtcgtcagagtttaggtcttcgattcccgtctacaagaagcgatggaagaacgagaaacacctgcatacttcgcggactcaaatcgtgcacgtcaagttcccttccattatggtttaccgtgacgattatttcatcagacactctatcagtgtatcggcggttattgtaagggcctggattacccataagtacagcggacgcgattggaatgtgaaatgggaagagaatctgctgcatgccgtcgctaaaaactacactttgcttcaaacaattcctccctttgaaaggccatttaaagatcatcaagtttgcctcgagtggaacatgggctacatctggaatctgagagctaaccgcatcccccagtgtccattggagaacgacgttgtcgcacttttaggatttccctacgcttcttcaggcgaaaacactggtattgtgaagaaatttcctcgtttccgaaatcgagagctggaggctaccaggaggcagagaatggactacccggtgttcacagtgtccctttggctatacctcctccactattgtaaagccaacctgtgtgggatactgtactttgtggatagcaacgagatgtacggcactccctctgtgttcctcacggaagagggatacttgcacattcaaatgcacctggtaaaaggagaggacttggccgtcaaaacaaaattcataatacctctgaaagagtggttccgattggatatttcgttcaacggaggccagattgtggttacaaccagcatcggccaggatctcaagagttaccataaccagaccatcagcttcagggaggactttcattataacgatacagccggttacttcattatagggggatcaaggtacgtggcagggattgagggattcttcggcccactcaagtactataggctgagaagccttcatccagcccagatcttcaacccccttttggagaagcagttggctgagcagatcaagctatattacgagagatgtgccgaggtgcaggaaatcgtctcagtgtacgcaagcgccgctaaacatggaggggagagacaggaggcctgccacttgcataactcttatctcgaccttcagaggcgctacgggaggccttccatgtgcagagccttcccctgggagaaggaactaaaagataagcacccatcactcttccaggccttgctcgagatggatttactcactgtgccacggaaccagaacgagtctgtgtcggagataggcggtaaaatctttgaaaaggcggtgaagaggttgtctagcatcgatggccttcaccagatctcctcgatagtgccatttcttaccgactctagctgttgtggctatcacaaggcatcctactatctcgcagtcttttacgagacgggactcaacgttccacgggaccagctgcaggggatgctttactccctggtaggcggacaggggtccgagcggctatcatcgatgaacctcggatataagcactatcagggtatcgataactatccgctggactgggagctgtcttatgcttattattccaatatcgccaccaagacaccattagaccagcataccctacagggcgaccaggcatatgtagaaacaataagactgaaagatgacgagattctaaaggtgcagacgaaggaagacggagacgtttttatgtggctgaaacacgaagcgactaggggtaacgccgcagcgcagcagcgcctcgctcaaatgcttttctgggggcaacagggcgtagctaagaatcccgaagccgctattgagtggtatgccaagggggctctggaaaccgaagatccggctctgatatacgactacgcgatcgtactgttcaaagggcagggagtcaagaaaaacagaagactggctctcgagctgatgaagaaggcagcttccaaaggcctgcatcaggctgttaatggcctaggatggtactatcacaagttcaagaaaaactacgcaaaagccgctaagtattggctgaaggctgaggaaatggggaacccagatgccagttataacttgggcgtgctccacctagatggaatattccccggagtccccggacgcaatcagactctcgccggagaatattttcacaaagctgctcagggtgggcacatggagggaacgctatggtgcagcttgtactacatcaccggtaatttagagacgtttccaagagatcctgaaaaagcagtggtctgggcaaagcacgtcgcagaaaagaatggctaccttgggcacgtcattcggaagggactgaatgcatacttggaaggaagctggcacgaggccttgctctactatgtcttggcagctgagacaggcatcgaagtcagccaaaccaacctggcccacatctgcgaagaaagaccagacttggcccgtagatatctcggagtgaattgtgtgtggagatattacaacttcagcgtgttccagattgatgcaccttcctttgcatacctgaaaatgggagacctgtattactacggccaccaaaatcagagtcaagacctggaactgagtgtacagatgtacgcccaggccgcactggatggagatagccagggttttttcaatctggctctgctgattgaagagggcactatcattccacatcacattttggatttcctagagattgacagcactctgcatagtaataacatttccatcttacaggagttgtacgaacgctgttggtcacacagtaacgaggagtccttctcaccatgttccctggcttggctatacctccacttgcgtctgttatggggcgctattctgcactctgcactcatctatttcttggggaccttcctgctgtccatcttgatcgcttggaccgtgcagtactttcagtccgttagtgccagcgaccccccacctaggccgagtcaggcctctcctgatactgcaaccagtaccgccagccctgccgttacgcccgcagctgacgctagcgaccaggaccagcctaccgtaacaaacaatcccgagcccaggggttag

SEQ ID NO: 53817 - DNA, 2940 bp, Artificial Sequence
  Description of Artificial Sequence: Synthetic coding sequence
atggtgtatcgggacgattactttatcaggcactccatctcagtgtcagctgtgatcgtgcgcgcttggatcacacacaaatacagtggaagagactggaacgtcaagtgggaggagaacttactgcatgccgtggctaaaaattataccctcctccagacaatcccaccattcgagcggcctttcaaggatcaccaagtttgccttgagtggaatatgggttacatctggaacttaagggccaatcggattcctcagtgtcccctggagaatgatgtcgtcgcccttcttgggtttccctatgcttccagcggggagaacaccggcattgtaaagaaattcccaaggttcagaaatcgcgaactagaggctacgcgcaggcaacgcatggactaccccgtgttcacagtgagtctctggttgtatctgttgcactactgcaaagcaaacttgtgtggtattttgtacttcgtggacagtaatgaaatgtacggcacccctagtgtgtttttgaccgaggagggatacctgcacatccagatgcacctggtcaagggtgaggatctggccgtgaagacaaaattcatcattccactgaaagagtggtttaggctggacatctcattcaatggaggccagattgtggtcacgacctctatcggccaggatctgaaaagttaccacaaccaaactatctcgtttagggaggacttccactataatgataccgcgggatacttcatcattggcggttctcgatatgttgcaggcatcgaggggttcttcggaccattgaaatattaccgactgcggtccctgcatcccgcacagatatttaatcctctgctagagaaacagttagccgagcagattaagttgtattacgagcgatgcgcagaggtgcaggagatcgtgagcgtgtacgcttctgccgctaagcacggtggtgaaagacaggaagcctgtcatctccacaattcttacttggaccttcagcgacgctatggcaggccttcaatgtgccgggctttcccttgggaaaaggagttaaaggataaacacccttctctgtttcaggcccttctggaaatggatctcttgaccgtgccacgaaatcagaatgaatctgtgagtgaaattggcggtaaaatcttcgagaaggcggtcaaacggctctctagcattgatggccttcatcagatctcgagcatagtgcccttcctcactgactcctcctgttgtggctaccacaaagccagctactatcttgccgtgttttatgaaacagggcttaatgtccctcgcgaccagcttcagggaatgctgtatagcttggttgggggacaaggatccgagcgcctgtctagtatgaaccttggttacaagcactatcagggaatagataattatccattagactgggaattgtcttacgcatactacagtaatatagcaacaaagacacctttagatcagcacactctccaaggtgatcaggcatacgtggaaacaatcagactcaaggacgacgagatattgaaggtgcaaactaaggaggatggcgacgtttttatgtggttgaagcacgaggctacacgaggcaacgctgctgcccaacagcgcttggcccaaatgctcttctggggccagcagggcgtcgcgaagaatccagaggcggctatcgaatggtatgcgaagggagcattggaaactgaggatccggctctgatatacgattatgctatcgtgttgttcaaaggccagggagtgaagaagaatcggcgactggccctggaattgatgaaaaaggccgcatcgaaggggctccaccaagccgttaatggcctcggctggtactatcataagtttaaaaaaaattatgctaaggccgctaagtattggctaaaagcagaggaaatggggaaccccgacgcttcatacaacctgggtgtattacatcttgatgggatttttcccggtgtgcccggtagaaatcagacgctggctggcgagtattttcataaagccgctcagggaggccacatggaaggaaccctgtggtgttctctctattatatcacaggaaacctggagaccttcccgcgtgaccctgaaaaggccgtggtgtgggccaagcatgtggcagaaaagaacggctacttaggacacgtaatacgtaagggactcaacgcctacctggaaggatcctggcatgaagcacttttatattacgtgctggccgctgaaaccggaattgaggtctcacagactaatctggcccatatatgtgaggaaagacctgacctggctaggagatatttaggcgtgaattgtgtatggagatactacaatttctcagtgtttcagatcgatgcaccctcgtttgcatatcttaaaatgggcgatctgtactattacggccaccagaaccagagtcaggaccttgaactttctgtgcagatgtacgcccaggcagccctggatggcgacagccaaggcttcttcaacctggctcttttgatcgaggaaggcacaattattcctcatcatattctagatttcctcgaaattgattcgacattgcactcgaataatatctccattctgcaagaactgtacgaacgctgttggagccactccaacgaagagtccttttcaccctgcagcctagcttggctgtatctccacctgcgccttctgtggggcgcaattttgcattctgctctcatttattttctggggaccttccttttatccattttgattgcctggactgtccagtacttccagtctgtatcagccagcgatccgccacctaggccttcccaggctagccctgatacagcaacgagtaccgcatctcctgctgtgactcctgctgccgatgctagcgaccaggatcagcctaccgttacaaataaccctgagccccgaggctag

SEQ ID NO: 53818 - DNA, 228 bp, Artificial Sequence
  Description of Artificial Sequence: Synthetic coding sequence
atggtatatagggacgattattttattcgtcactccatcagcgtgtccgccgttatagtccgcgcttggattacccacaaatactctggccgtgactggaatgtaaaatgggaggaaaacctgttacacgccgtagcaaaaaattacactctgttgcagacaattcctccctttgaacggccatttaaagaccatcaagtctgcctggagtggaatatgggatattag

SEQ ID NO: 53819 - DNA, 189 bp, Artificial Sequence
  Description of Artificial Sequence: Synthetic coding sequence
atggtgtacagagatgattacttcattcggcattctatctctgtaagcgcagtgattgtccgggcatggattacacataagtacagcggtagagactggaacgtgaagtgggaagagaacctcctccatgccgttgctaaaaattacaccctgctgcagactatcccaccattcgagaggccgttctag

SEQ ID NO: 53820 - DNA, 108 bp, Artificial Sequence
  Description of Artificial Sequence: Synthetic coding sequence
atggtctacagggatgactacttcatcagacactctatctcggtgtctgcagtaatcgtgagagcatggataacacacaagtactcaggccgagactggaacgtgtag

SEQ ID NO: 53821 - DNA, 570 bp, Artificial Sequence
  Description of Artificial Sequence: Synthetic coding sequence
  Description of Combined DNA/RNA Molecule: Synthetic coding sequence
atggaacgccaggaggaatcgctttccgctcgacccgctctggagactgagggcctccgtttcctacatactacagtggggtcccttctggccacctatggatggtacatcgtgttcagctgtattctgctgtatgtggtgttccaaaagttgtcagcccgtctgcgagctctgcggcagaggcaactggaccgggcagcagcagccgtagaacccgatgtggtcgttaagcgtcaagaagcccttgccgcagccaggctcaagatgcaggaggaactcaatgcccaagtggaaaaacacaaggaaaagctgaagcagcttgaggaggaaaaacggagacagaagattgaaatgtgggattcaatgcaggaaggtaagtcttacaaaggcaatgcgaagaaaccgcaagaggaagattcaccgggtccctctacaagtagcgtgctgaaaaggaaaagtgatagaaaaccactgcggggaggaggatataacccactgagtggcgagggcggaggcgcttgctcttggcggcctggcaggcgagggcctagctccgggggaugaggctag

SEQ ID NO: 53822 - DNA, 570 bp, Artificial Sequence
  Description of Artificial Sequence: Synthetic coding sequence
  Description of Combined DNA/RNA Molecule: Synthetic coding sequence
atggaacgccaggaggagtccctgagtgctcgtcctgcccttgagaccgagggactgcggttcctgcatacaactgtggggagcctgttggccacatatgggtggtacattgtgttctcttgtattttgttgtacgtcgtcttccagaagctgtctgccagactcagagctctccgccagaggcagcttgatcgcgcagccgcagctgtagagccggacgtcgtagtgaaaagacaggaggctttggctgctgcgcgactgaaaatgcaggaggagctcaacgcacaagtggagaagcacaaggaaaaactgaaacaactggaggaggaaaagagaaggcagaagatcgaaatgtgggactccatgcaggaaggtaaaagttataaaggcaacgccaagaagccgcaggaggaggactcacctggccctagcacttcatccgtattaaaacggaagagcgatcgcaaacccctgcggggtgggggatacaatcctctcagcggggagggcggtggcgcttgctcttggcgcccaggcaggagaggaccctcatctggtggcugagggtag

SEQ ID NO: 53823 - DNA, 564 bp, Artificial Sequence
  Description of Artificial Sequence: Synthetic coding sequence
atggaacgtcaggaggagtcccttagcgctagaccggctttggagacagaaggtctgagattcttacataccacagtaggtagcctgctagccacgtacggttggtacatcgtattctcatgcatactcctttatgtggtcttccagaaactctcggccaggctgcgtgctctgagacagcggcaactcgacagggccgctgctgcagtagagccagatgtggttgtcaagcgccaggaggcactggccgctgccaggctcaagatgcaagaagagctcaacgcccaagtcgagaagcataaggagaaactgaagcagctagaggaggaaaagagacgccagaagattgagatgtgggacagcatgcaggaagggaagagttacaagggaaatgccaagaaaccccaggaggaagattccccgggtcccagcacgagcagtgttctcaagcgcaaaagtgacagaaagccacttaggggcggaggatacaacccactgagcggcgaaggcggtggagcttgcagttggcgtcccggacgcaggggtccaagcagcggcggttag

SEQ ID NO: 53824 - DNA, 2667 bp, Artificial Sequence
  Description of Artificial Sequence: Synthetic coding sequence
atgcaaactccccgtgctagccccccaagacctgccctcctgctgctcctccttctgctgggcggagcgcacggacttttccctgaagagccaccacctctgagcgtggctcctcgtgactatcttaaccattacccagtgtttgtaggatcaggacctggccgtttgacgccggctgaaggcgcagacgacctcaacatccaaagagtgctgagagtcaatcggaccttgtttatcggagacagggataatctgtatagagtcgagttggaacctccgacatcaacggaattaagataccagcggaagttgacctggcgcagcaaccccagcgacatcaatgtatgtcgaatgaaagggaagcaggagggagaatgcaggaattttgttaaagtcttgttactaagagacgagagcaccctgtttgtttgtgggtcaaatgcttttaaccctgtctgcgctaactacagcattgataccctgcagcccgtgggcgacaacatttcgggaatggcgaggtgcccctacgaccccaagcatgcgaacgttgcgctattttcagatggcatgttgttcactgctacagtgactgactttctggcaatcgatgctgtgatttaccgaagtcttggggacagacctacccttaggacggtgaagcatgacagcaaatggtttaaggaaccatactttgtccatgcagtggaatggggtagccatgtctatttcttcttccgggaaatagctatggaattcaactatctagagaaggttgtcgtgtctagggtggcacgggtctgcaaaaatgatgtaggaggttcccctcgggtgctcgaaaagcagtggactagtttcctgaaggcccgtttgaattgttctgttcccggagattcccacttttacttcaatgtgttgcaggcagtaacaggcgtggttagtctcgggggtagacctgtcgtgctggcagtcttcagtactcctagcaatagcattccaggaagtgccgtgtgtgcgttcgacctgacgcaggtagccgcagtattcgaagggagatttcgcgagcaaaaatcccctgagtcaatctggaccccagtgccagaggatcaagtgccgagaccacgcccagggtgttgtgcagccccaggcatgcagtacaatgcttcctctgcactcccggatgatattttaaacttcgtgaagacccaccctcttatggacgaggcggtgccaagcctgggacatgccccatggattctgcgcactctgatgcgacaccagctaactcgcgtcgccgtcgatgttggggcaggcccttggggaaatcagaccgtggtctttctgggttccgaggcaggaaccgtgctgaaattcctggttcggccaaatgcatctaccagcgggacatctggcctgagcgtctttcttgaagagttcgagacttataggccggatcgctgtggaagaccaggcggtggggagactggccaaagattgctgtccctggagctcgatgccgctagcggcggacttctagcggcattcccgaggtgtgtggtgcgggtgcctgtcgctaggtgccagcaatactctggctgcatgaagaactgcatcggaagccaagacccatattgcggctgggcccctgacgggtcctgtatcttcctcagccctgggacgagagccgcatttgaacaggacgttagcggtgcctccacaagtggcctaggggattgcactgggctgctgagagcttcgctgtccgaggaccgggcaggactggtgtccgtgaatcttttagtgacatcctctgtggctgcttttgtggtaggcgcagtcgtgtccggtttttccgtgggctggtttgtgggtctgcgagaaaggagggagcttgcgcgtcggaaagataaagaggcaatcctggcgcacggagccggtgaagccgtcctgtccgttagtcggctgggtgagcgcagggcacaggggcctgggggacggggtgggggtggaggcggtggggcaggtgtgccgcctgaggccctcttagccccactaatgcaaaacgggtgggcaaaagctacactgctacagggaggaccacatgacctggactcagggctacttccaactcccgaacagacacctctgccacagaagcgcttaccgactccccacccccacccgcacgcgttgggtccacgggcatgggaccacggccatcccctgctgcccgcaagcgccagtagttctttgctcctgctggcccctgcacgagccccagagcagcccccagcacctggggagcccacacccgatggacgcctgtacgcagctcggcctggtagagcaagccacggcgacttccccctgacacctcacgcctcccctgacagacgcagggtcgtgtcggcccctacaggcccactggatcctgcttcagctgctgacgggttgccacgaccgtggtctccacccccaaccggatctctacgaagacccttaggaccacacgcccctccagccgctactttaaggcgcactcacactttcaattctggagaagctcgtcctggcgaccgacacagggggtgccatgctaggcccggtactgacttagctcatctgctgccttacggcggagcagaccgcactgcccctccggttccatag

SEQ ID NO: 53825 - DNA, 2358 bp, Artificial Sequence
  Description of Artificial Sequence: Synthetic coding sequence
atgctggtcgctgggctgctcctctgggcgtctctgctcaccggtgcttggccatcattcccaacgcaggatcatcttcccgctaccccgcgagttagactcagcttcaaggaactaaaagccaccgggacagcacacttctttaactttctgctgaatactacggactacagaatactgcttaaggatgaagaccatgacagaatgtatgtgggctcaaaggactacgtgttgtccctcgatctgcatgacattaaccgggaaccactgataatacattgggccgcttcaccacagaggattgaggagtgcgttctgtccggaaaggatgttaatggagagtgcggcaacttcgtgaggctgatccagccatggaataggacccacttatacgtttgcggtaccggggcatataaccctatgtgcacttatgtcaatagaggcagacgagctcaggctactccatggactcagacacaggccgttcgagggagaggctctagggcaaccgatggcgctctcagaccgatgccgactgctcccaggcaggattatatcttctaccttgaacccgaaagattggagtcaggcaaagggaagtgcccttatgaccctaaactggacactgccagcgcactaattaacgaagagctttacgctggggtctacattgattttatgggtacagatgctgctatttttcgaactctggggaaacagactgctatgaggaccgaccaatataattccaggtggctgaacgatccatcgttcattcatgcagagttgattcctgactcagccgaaaggaacgacgataagctctacttcttttttagggaacggtcagctgaggcaccacaatcaccagccgtgtacgctcgtatcgggaggatctgtctcaatgatgacggtggccactgttgtctggtgaataagtggtccactttcttgaaagcgaggctggtgtgttctgtccccggagaggatggcatcgaaacccattttgacgaattgcaggatgtgttcgtgcaacaaactcaggacgttaggaatcctgtgatttatgccgttttcacatcctcaggcagcgtctttcggggatcggctgtctgcgtgtactctatggcagacattcgaatggtgtttaacggcccattcgctcacaaagaaggaccaaactatcaatggatgcccttttccggcaagatgccttaccctagacctggcacatgtcctggcggaactttcaccccatccatgaagtcaacgaaggattacccagacgaggtcatcaatttcatgaggagccatcctctcatgtaccaggctgtttacccacttcagcggaggccattggtggtgaggactggcgctccatatcggctaaccaccattgctgttgatcaggtggacgccgctgatgggagatatgaagtgctatttctaggaacagacagaggaactgtgcagaaggtgattgtgctacccaaggatgatcaggagctcgaggagctgatgcttgaagaggtagaagtgtttaaagatccggcacctgtcaagactatgactatcagtagtaagcggcaacagctgtacgtcgcatctgctgtcggcgtgacgcacctgagtctccaccgctgtcaggcttatggagcagcctgcgccgactgctgcctcgcccgagacccgtattgtgcctgggacggtcaagcttgctctaggtataccgcatcgagcaagaggcgctcgcgcaggcaagacgtgcgccacgggaaccctatccgccagtgtcgaggatttaactccaatgcaaataaaaacgctgttgagagtgtacagtacggagttgcgggatcagccgcttttctggagtgtcagcctcggagccctcaggctaccgttaagtggttgtttcaaagggaccctggtgatagacggagggaaataagagccgaagatcgctttctcaggactgagcagggcctgctgctccgagctcttcagctttcagatcgcggactctactcttgtactgctaccgagaacaatttcaaacacgtggtcacacgtgtgcagcttcacgtattaggaagagatgcagtgcacgccgcactctttcctccactctccatgtccgcgcctccacctccaggtgctggcccaccgacacctccttatcaggagctggctcagctattggctcagccagaagtgggattgatccatcaatactgtcaggggtactggagacacgtgccgccatcccctcgggaggcccctggggcacccaggagccccgaaccccaggatcagaagaagccccgaaatcgtcgtcatcacccaccagatacttag

SEQ ID NO: 53826 - DNA, 795 bp, Artificial Sequence
  Description of Artificial Sequence: Synthetic coding sequence
atgcttgttgccggtctgctcctatgggcatcccttctcacgggagcctggccaagcttccctacccaagatcaccttccagcaactccgagggttaggctttccttcaaagagctgaaggcaactggcacggcccactttttcaatttcctgttgaacaccacagactacagaatcctcctcaaagacgaggaccacgaccggatgtacgtgggttctaaggactacgtgttatccttagatctgcatgacattaaccgggagcccttgatcatccattgggccgcatcacctcaaagaattgaggagtgtgtgctctctggcaaggacgtgaacggcgaatgcggaaactttgtgagactgatccaaccgtggaaccggacacatctctacgtgtgcgggacaggagcctacaatccaatgtgcacctatgtgaaccgcggacgcagagctcaagactatattttctatctagaacccgagcggctggagtccggaaagggcaagtgtccatacgaccctaaactggataccgcgagcgcgctgattaacgaagaactgtacgctggcgtttacatcgattttatggggacagacgccgctattttcaggacactgggcaagcagacagcaatgaggacagaccagtacaattctcggtggctaaacgacccaagctttatccacgcagagcttattcccgattctgccgaaaggaatgacgataagctttattttttttttcgcgagagaagcgccgaagcccctcagtcccctgccgtttacgcaagatag

SEQ ID NO: 53827 - DNA, 279 bp, Artificial Sequence
  Description of Artificial Sequence: Synthetic coding sequence
atgctggtcgccggactcctgctgtgggccagcttgttaaccggtgcttggccttcatttcctacccaggaccatcttccagccactccacgggtgcgactgtcgttcaaagagttgaaggctaccggaaccgctcatttcttcaatttccttctcaacacgaccgactacaggattctgctgaaggacgaggaccacgaccgcatgtatgtggggtcaaaggattacgttttatcccttgatctccacgacattaacagagaaccgctgatcgtatag

SEQ ID NO: 53828 - DNA, 2265 bp, Artificial Sequence
  Description of Artificial Sequence: Synthetic coding sequence
atgctcgtggcgggtctgctactgtgggcgtctctgttaactggagcttggccatcttttccgacacaggaccatttaccagctacacctcgtgtgaggcttagctttaaggaactcaaagccaccggcaccgcccatttcttcaactttcttcttaacaccactgattatcgaatcttactcaaggacgaagatcacgatagaatgtacgtcggctcgaaggactacgtgctctccctcgatttgcacgatatcaacagagagcccctcattatccattgggccgctagcccacagagaattgaagagtgcgtcctgtctggaaaagacgttaacggggagtgtggaaactttgtcagactgatccagccctggaacagaacacacctttacgtgtgcggcacaggggcatataacccaatgtgtacatatgtgaatcggggacgccgagcccaggactatatcttttacctggagccggaaaggctggagtccggaaagggcaaatgtccttatgatccaaaactggacaccgctagtgctctcattaacgaagagctgtacgcaggcgtgtacattgattttatgggtactgatgcggcaatttttcgaacactcgggaagcaaacggctatgcgcacagatcaatataatagccggtggctcaacgatcctagctttatacatgcggagttgattcccgactccgctgaacgcaacgatgacaagctgtacttcttctttcgcgaacgttctgctgaggccccacagtctcctgctgtgtatgccagaatcgggagaatctgtctcaacgacgatgggggtcattgctgcctggtaaacaagtggagtacatttctgaaggcccgtcttgtttgtagtgtcccaggggaggatggaatcgagactcatttcgatgagctgcaggacgtatttgtccaacaaacccaggacgtccggaacccggtaatttatgctgttttcacaagttccggcagtgtgtttcggggatcggccgtttgtgtgtactcaatggccgatatcagaatggtttttaatgggccattcgcccacaaggagggtcccaactaccaatggatgcccttttccgggaagatgccttatcccagaccaggtacctgccccggtggaaccttcacaccctccatgaagagcacaaaggactatcctgatgaggtgatcaatttcatgcggtcccaccctcttatgtaccaagccgtgtacccacttcagcgacgacctctcgtggtgaggactggtgctccgtaccgcctgactacaattgctgtggatcaggtagatgccgcagacgggaggtatgaggtgttgttcctgggaacagataggggaacagtacaaaaggtgatcgtcttgccgaaagacgaccaggagctggaagagctaatgcttgaagaggtggaagtatttaaggaccccgctccagtgaagaccatgacgatctcctcaaagcgccagcagctttatgtcgcttcagccgtcggcgtcactcacctgagtctgcaccgctgtcaggcttacggagctgcatgcgccgactgttgcttggctagagacccgtattgcgcctgggacggacaagcctgctctcggtacaccgcaagctccaagcggaggtctcggaggcaggacgtgagacacggcaatcctatccgccaatgccgcggtttcaacagcaacgccaacaagaatgccgtcgagtcagtgcaatatggagtcgcgggaagtgctgcatttctggagtgtcaacctcgttctcctcaggcaacggtaaagtggttgttccaacgcgacccaggagatcgcagaagagaaattagggcagaggaccggtttctacgcacagagcagggactgttgctgcgagccttgcagctgtctgaccgtggtttgtactcctgcacagccaccgagaacaattttaagcatgttgtcacccgtgtgcagctgcatgtactggggcgagatgccgttcacgccgctttatttccccctcttagcatgagtgcacctccccctccaggagctggccctcctacacccccttaccaggaattggcccaactgcttgcccagccggaagtggggctcattcaccagtattgccaaggatactggcgacacgtcccaccaagtcctcgcgaagcacctggtgcgcctagatcacctgagccgcaggaccagaaaaagccccgtaacaggcgccatcacccacccgacacctag

SEQ ID NO: 53829 - DNA, 1143 bp, Artificial Sequence
  Description of Artificial Sequence: Synthetic coding sequence
atgctggttgcaggactgctcttgtgggcctctttgctcacaggtgcttggccaagcttcccaactcaggaccatctccccgctactcccagggtgcgcttatcctttaaggaactcaaggccacagggactgctcatttctttaactttttgctaaacaccacggactatcgcatcctcctgaaagatgaggatcacgatcgaatgtatgtgggcagcaaggattatgtcctatcccttgacctacatgacataaacagggagccacttatcatccactgggctgcctctcctcagcgaatagaggagtgtgttcttagtggtaaggatgtaaatggtgagtgtggcaactttgtcagactgatccagccttggaatcgaactcatttgtatgtgtgtgggactggggcatataacccaatgtgcacatatgtgaataggggacggagggcccaagattacatcttctatctggagccagagagactagagtccggcaaaggcaagtgcccctacgacccaaagttggacacggcatccgcactcattaacgaggaactgtatgcaggtgtatacatcgacttcatggggaccgacgccgctatattcagaactctgggaaaacagactgccatgaggactgaccagtacaattctcgctggctaaacgacccttcatttattcacgccgagttgattcctgatagcgctgagagaaacgacgacaaactgtacttctttttcagggagcggagtgccgaggccccacaatcaccagcagtctacgcgaggatcggcaggatttgtctcaatgacgacgggggtcactgctgcttagtgaacaaatggtccactttcctcaaggctcggctggtctgttcagtgccaggagaagatggcattgaaacacactttgatgagctgcaagatgtgtttgtccaacagactcaggatgtccggaacccggtcatctacgctgtgttcacatctagtggaagcgtattcaggggttctgcagtatgcgtttattctatggccgatatccgaatggtgttcaacggaccttttgcccataaggagggtcccaattatcaatggatgcctttttctggcaagatgccctatccacgccctggcacttag

SEQ ID NO: 53830 - DNA, 2514 bp, Artificial Sequence
  Description of Artificial Sequence: Synthetic coding sequence
atgctgcggactgccatggggctaagatcttggctggcagccccatggggtgccttgcccccaaggcctcctctgctgcttcttctgctgctgttattattactgcagccgcctccccctacttgggccctgagtccgaggatcagcctgccactggggagcgaggagaggcccttcctaagattcgaggctgagcatatctcaaattacactgcccttctcctatctcgggacggacgcaccctgtatgtgggagcccgagaggctttattcgccctaagcagtaatttgtctttcctgcctggaggggagtatcaggaactgctgtggggggctgatgcagagaaaaaacaacagtgcagcttcaagggcaaggacccccagagagattgtcagaactatattaagatactgctcccactgtcaggatctcacctgtttacgtgtggaaccgcagccttctcccctatgtgcacatatataaacatggaaaactttactctggcccgtgacgaaaaagggaacgtcttactggaggatgggaagggcaggtgcccattcgaccccaactttaaatccaccgctcttgtggttgacggcgaattgtacaccggtacagtgtcttccttccagggtaatgatcccgctatctcgcgcagtcagagtctccgcccaacaaaaacggaatcatccctgaattggcttcaagaccctgcgttcgtggcctccgcatatatcccagagagccttggttcgctgcaaggcgacgatgataaaatttacttcttcttttcggagactgggcaggaattcgaatttttcgagaacacaatcgttagtaggattgccaggatttgcaagggagacgagggaggtgagagggtcttgcaacagcggtggacaagcttcttgaaagctcagcttctgtgcagcagacccgacgacggctttccatttaacgtgctccaggacgtgttcacactctctccttcccctcaggattggcgggacacgctgttctatggtgtttttacaagccagtggcacagaggtacgaccgagggtagtgcggtatgcgtctttaccatgaaagacgttcagagagtattctcagggctctataaagaagtaaaccgcgaaactcagcagtggtataccgttactcatccggtcccaacaccgcgtcctggcgcttgcataaccaattctgcaagggaacgtaaaatcaactcctccctgcaattacccgaccgggttctgaattttctgaaggaccattttctcatggatggtcaagtgaggagcagaatgttgctgttacaacctcaagcgcgatatcagcgagttgccgtacatagagtcccgggattacaccacacctatgatgtgctgttcctcggtaccggcgacggtaggctgcataaggcggtcagcgtcggtcccagagttcacattattgaggagttacaaatcttcagcagtggccagccggtgcagaacctgctgctggatactcaccggggactgctgtacgcagccagccactctggagtggtccaggtacctatggcaaactgctctctgtaccgctcctgtggcgactgtcttctggcacgtgacccctactgcgcctggtctggctcctcttgcaaacacgtatctctttaccagccgcagctggccacccgtccttggattcaggatatcgagggcgctagtgcaaaagatttgtgttccgcaagctcagtcgttagcccttcattcgttcctacaggcgagaaaccctgcgagcaagtgcaattccagccaaacaccgttaacacgctggcctgtcctttgctgtcaaacctcgcaacacgcttgtggttaagaaatggggcacccgtcaatgcttcagcctcatgtcacgtgctccctacaggcgacctgcttttagtcggaacccaacaactaggagaatttcaatgctggtctttggaagaagggtttcaacagcttgtggcctcctattgtccagaggttgtggaagacggtgtggccgatcagacagatgagggtggcagcgtgcccgtgataattagcacgtcaagggtgtccgcccctgcgggtggaaaagccagttggggagccgatcgatcctactggaaagagtttttggtgatgtgtactctgtttgtgctggccgtgctcctgcccgtgctctttctcctgtatcgtcatcgaaactctatgaaagtcttccttaagcagggagagtgcgctagcgtccaccctaagacgtgtccagtggtgctaccgccagaaacaaggccactgaatggactgggcccaccatccacccctctagatcacaggggttatcaatctctgtcagactcacccccagggtcccgagttttcaccgagtctgagaagcgtccattatccatccaggactcgtttgtcgaagtaagccccgtgtgccccaggcccagggtcaggctcggctccgagatacgcgatagtgtggtttag

SEQ ID NO: 53831 - DNA, 2214 bp, Artificial Sequence
  Description of Artificial Sequence: Synthetic coding sequence
atgggtctgcgctcatggttagcggctccatggggagcattgccacccagacctcctctgttgttgctgctgctcttgctcctactgctgcaaccccctccgcctacctgggcattatccccaagaattagtcttccactcggctctgaggaaagacctttccttcgctttgaagctgaacatattagtaactataccgctctgttgctgtctagagacggacgtacactctacgtcggggctcgcgaagctctgtttgctttgtccagtaacctcagcttccttcccggaggtgagtaccaggaactcttatggggggcagacgctgagaagaagcaacagtgttcgttcaaagggaaggatccacagagggactgtcagaactatatcaagatccttctgcccctgtcaggttcccatttgtttacctgcggcaccgcagcatttagcccaatgtgcacatacataaacatggaaaatttcacgttggccagagacgaaaagggcaatgtattgctggaggatggtaagggtcggtgtccatttgatcccaacttcaagtcaactgcactggtggtggatggcgagctctacacggggacggtgtcttctttccagggtaacgaccccgcaatcagtcgctcacagtctcttcggcctaccaagacagagtccagcttgaattggttgcaagacccagcatttgttgcaagtgcctatatcccggagtccctgggaagtctgcagggggacgatgataagatttactttttcttcagtgaaacagggcaggagttcgagttttttgagaatacaatagtgagccgaattgccagaatttgtaagggggatgaggggggtgagcgggtcttgcagcaaagatggacttcttttctgaaggcccagttgttgtgttctagacccgatgatgggtttccttttaatgtcctacaggacgtgttcaccctgtcccccagtccacaagactggcgggatactttattctacggcgtttttacatcacagtggcatcgtggtactacggaaggttctgcagtatgtgtgttcaccatgaaggacgtgcaacgagtgttcagcggcctctataaagaggtgaatcgggagacacagcaatggtacacggttacgcaccctgtgcccacaccgcgtcccggtgcatgtataaccaattcggctcgcgaaaggaagatcaacagctccctacagttacccgacagggtgttgaacttcctaaaggatcacttcctcatggacgggcaggtgagaagcaggatgctgcttctccagccccaggcccgatatcagcgagtagcagtgcacagggtgcccggactgcaccacacatatgacgtgcttttcctcgggacaggggacggaagactccacaaggcagtttcagtgggcccacgcgtacatatcatcgaggaactccagattttcagctccgggcagcccgtccagaatttactcctggacactcaccgcggacttctctatgcagcatcacacagtggcgtcgtgcaagtccccatggcaaactgtagtctgtatcgcagctgtggagactgtctgctcgccagggacccatattgtgcctggtccggaagcagctgtaaacacgtgtctttataccaaccacagttggccactaggccttggatccaagacattgagggcgctagcgccaaggatctgtgtagtgcctcatcggtcgtttccccatcttttgttcccacaggcgaaaaaccatgcgaacaggttcaatttcagccaaatactgtgaacactctggcctgccctctcctatccaacctggccaccaggctttggctgcgcaacggcgctcccgttaatgcgtcagcctcctgtcatgttctgccaaccggcgatcttttactggtggggacccagcagctgggcgagtttcagtgttggtccctggaagaagggtttcagcaactagtggccagctattgtcccgaggtggtcgaggacggcgtagccgaccagaccgacgagggtggctcggtccccgtaatcatctccacatcccgagtgtctgctccggcaggtggtaaggcttcttggggggcagatcgctcctgggcacggactcaacttctggacctgtcaagcctctatcaagctgtcgccacacgagaggactcggcttccagtggtgagatctcatag

SEQ ID NO: 53832 - DNA, 2514 bp, Artificial Sequence
  Description of Artificial Sequence: Synthetic coding sequence
atgctgcggaccgccatggggctccgctcttggcttgctgccccatggggagcattgcccccaagaccccctctgctgttgctactgctgctgctgctgctcttgcagccccctccacccacctgggccctgtcaccgcgaatatctcttcctctaggaagcgaggaaaggcccttcctcagatttgaggctgaacatataagtaactacacagccctgctgctctctagggatggaagaacgctgtacgtgggtgcacgcgaggctctctttgccctcagtagtaacctttcattcctcccaggaggcgaatatcaagagctcctgtggggcgcagatgcggagaaaaaacagcagtgtagctttaaagggaaagaccctcagcgggattgtcagaattacatcaaaatcctgttgcctctcagcggaagtcatctgtttacctgtggtacagctgccttttctcctatgtgcacttatatcaacatggaaaactttaccctggccagggatgaaaaaggtaacgtcctcctggaagacggaaaaggacggtgccctttcgaccccaactttaagtccactgctttagtggtggacggggaactgtacactgggacagtcagcagtttccaggggaacgatcccgctatctcaaggagtcagtccctccgaccgaccaaaacagagtcttccctaaactggctccaggacccagcctttgtggcttctgcctacattcctgaatcgcttggaagccttcagggcgacgatgacaagatttactttttcttctccgagacaggccaggaatttgaattcttcgagaatacaatagtgtcccgtatcgccaggatttgtaaaggcgatgaaggcggtgagcgcgtcttacagcagcgttggacatcattcctcaaagcacaactgctctgttcccggcctgacgatgggttccccttcaacgtacttcaggacgtgtttacgttgtcgcccagtccacaggattggcgtgacacgctgttctatggcgtgtttacatctcaatggcaccgcggaactactgaggggagcgcggtgtgcgttttcaccatgaaggatgtgcaaagggtcttttccggactgtacaaagaagtcaatagagagactcaacagtggtatactgtcacgcatccagtaccgacaccgagacctggagcatgcatcacaaacagcgccagagagcgcaaaattaactcttccctccagctgcccgacagggtgctgaattttctcaaggaccatttcttgatggacggacaggtgagatctcgcatgctgctgcttcagcctcaagcgagatatcaacgtgttgcggtgcaccgtgttcccggtcttcatcacacatatgacgtcctgtttttaggcaccggagacgggaggctgcataaggccgtttcagtcggacctagggtgcacataattgaagaactacagatcttcagctcagggcagcctgtgcagaacctcctgcttgatactcatcgtggattgttatatgcagcttctcactccggggtcgtccaagtgcccatggctaactgctctctgtaccgatcgtgcggggactgcttgctcgcacgcgacccctactgtgcgtggtccgggagttcctgtaagcatgtcagtctgtatcagccgcagctcgctactcgcccttggattcaggacatcgaaggagcaagcgccaaagatctctgctctgcctccagcgttgtttctccctcttttgtgcctactggggagaaaccctgcgaacaggttcagtttcaacccaataccgtgaacacactagcctgcccactgttgagcaatctagcaactcgtctctggctccggaacggcgctcctgttaatgcctcggccagttgtcacgtcctgcccaccggagacctgctcctagtgggcacacagcaacttggcgaattccagtgttggagtctagaggaaggctttcaacagctcgtcgcttcctattgcccggaggtagtcgaggatggtgtggcagatcaaaccgacgaaggtggaagtgttcccgtgatcatctctacatcccgagtgtcagctccagctggcggtaaagcctcttggggcgcagataggtcctactggaaggaattccttgtgatgtgtactctgttcgttctggctgtgctgttacccgtgttatttctgttatatcgccaccgcaactcaatgaaagtgtttctgaaacagggcgagtgtgcttcggtgcaccctaaaacttgccctgtcgtgctgccacccgagactagacctttgaacggattaggcccacctagcactcccctggaccacagagggtaccaatccttaagcgactctccacctggcagtagggtgttcactgagtcggagaagcgcccactgtccatacaggattctttcgtcgaagtctcgccagtgtgtccccgtccacgcgttaggctaggatccgagattcgcgattctgtcgtctag

SEQ ID NO: 53833 - DNA, 276 bp, Artificial Sequence
  Description of Artificial Sequence: Synthetic coding sequence
atgctgcggactgccatgggtctgaggtcttggctggcagctccatggggggcactcccacctcgtccccctctgctgctgctcctgttgctcctgttacttctgcagcccccaccaccgacctgggctctgtcaccacgaatttccttgccactcggctctgaagaaaggccctttctacgattcgaggcggaacacatctcgaattacactgctttgctccttagccgggatggccgaaccctgtatgtaggtgcccgtgaggccctgttttag

SEQ ID NO: 53834 - DNA, 345 bp, Artificial Sequence
  Description of Artificial Sequence: Synthetic coding sequence
atgcttagaaccgctatggggttacggtcttggctggcggcaccgtggggcgctcttccaccgaggcccccactgctcttgcttcttctgttgctgctcttactgcaaccgccaccaccaacatgggccctgtctcctaggatctccctgccactgggttcagaggaaagaccattcttgagattcgaagctgagcacatatccaactatactgccctgttgttgtccagagacgggagaacactgtatgtgggcgctcgtgaggctctgtttgccctgagttctaatctgagctttctgccaggcggagagtaccaggagctactgtggggagcggatgcctag

SEQ ID NO: 53835 - DNA, 366 bp, Artificial Sequence
  Description of Artificial Sequence: Synthetic coding sequence
atgcttcggacagctatgggcctccgatcctggctagcagcgccatggggagctttaccccctaggccacccctgctgctgctgctcctgctgttgctactcctgcagccaccaccccctacctgggccttaagtcctcgaatcagtctgccactgggttctgaggaacggcctttcctgaggtttgaggcggaacatattagtaactacactgctcttctcctatccagggatggacggaccctgtatgtgggcgcacgagaagcactcttcgccctgtcttccaacctctccttcctcccaggaggtgagtaccaggagctgctgtggggagccgatgccgagaagaagcagcaatgttcctag

SEQ ID NO: 53836 - DNA, 2502 bp, Artificial Sequence
  Description of Artificial Sequence: Synthetic coding sequence
atggcacctcattgggcggtctggctcctggcagccaggctctggggtcttggaataggtgcagaggtgtggtggaacctggtcccaaggaagactgtgagcagtggagaactcgctaccgttgtaaggcgattttctcaaactggaatccaggatttcctgactctgacattgactgagcctactggtctgctctacgtgggagcccgagaggccctgttcgccttttccatggaggccttagaactgcaaggggctatatcttgggaggcgcctgtcgaaaaaaagacagagtgcatccagaaggggaaaaacaatcagacagagtgcttcaattttatccgctttctccagccgtataacgcgtcacacctatatgtctgtggaacatacgcctttcaacctaagtgcacctacgtgaatatgctcacgttcactctcgagcatggagaatttgaagacggcaaagggaaatgtccgtatgatccagccaaggggcacgcaggccttttagtggacggcgagctgtattctgctaccttgaataacttcttggggacagagcccattatactgcggaatatgggccctcaccactctatgaaaacagagtacctcgccttctggctgaacgagcctcactttgtgggcagcgcttacgttcccgagtccgtggggtcgtttacgggggatgatgacaaagtctacttctttttcagagagcgggcagtcgagtctgactgttacgccgagcaggtggtagcaagagtggcgagggtatgcaagggagatatgggtggggcaaggacccttcaacggaaatggacgaccttcctcaaagctcgcctcgcatgctcagctcctaattggcagctttactttaatcaactgcaagcaatgcatacgttgcaggatacgtcgtggcacaacaccacattcttcggggttttccaggcacaatggggggatatgtatctctcagcaatttgcgagtatcaattggaggaaattcagcgagtgtttgagggcccttacaaggagtatcatgaagaggcacaaaaatgggatcgatacacagatccggtgcccagcccccgacccggtagctgtatcaacaactggcacaggcgccacgggtacacgagtagtctcgaactccctgacaatatccttaactttgtgaagaaacaccccctgatggaagaacaggttgggccaagatggagccgaccccttctggttaagaaaggtaccaatttcacacatctggtcgctgaccgggtcaccggcctcgatggcgctacttacaccgttctgttcatcggtaccggcgacgggtggctcctcaaagcagtttcgctaggcccttgggtccaccttatcgaagaactgcaactgtttgatcaggaacccatgcgtagtctggtacttagtcagagcaagaaacttttgttcgcagggagtcggtctcaattggtccagctgccagttgctgactgcatgaaatacagaagctgcgccgattgcgtactcgccagggacccgtattgcgcttggagcgtgaatacctctcgctgtgtcgccgttggcggtcattccgggtccctgctcatacagcatgttatgaccagcgacacaagtggtatttgtaatctcaggggcagtaaaaaggtccgtcctacgcctaagaatataacggtggtggcagggactgatttagtgctcccctgtcacctatcctctaacttggcccacgcaagatggacgttcggaggcagggatcttcctgccgaacagcccggttcatttctctacgatgcccgactccaggccttggtggtgatggcagcacagccccgacacgctggtgcttaccactgcttcagtgaggagcagggcgcacggctggctgcggaaggttacctcgtggcggtggtggccggaccctcggtgactctggaggccagagcccctcttgagaatctcggactcgtatggctggccgtggtcgcgctcggagctgtatgtttagttctcctcctgctggtgctctcccttcgcaggcggcttcgcgaagagcttgaaaaaggagctaaggccaccgagaggaccctggtctatcccctggaactgcctaaggagccaacttccccgccatttcgcccttgtcccgagcccgatgagaaattatgggaccctgtgggctactactatagtgatggatccctaaaaatcgtgccgggtcacgcccgatgtcagcctgggggaggacccccaagccccccaccaggaatacccggacagcctctcccctccccaactagattgcatttaggcggtgggaggaactctaatgctaacggttacgtccgcctccagctgggaggcgaagaccggggaggtctaggacatccattgccagaactggctgacgagctccggagaaagctgcaacagagacagccccttccggattcaaaccctgaggagtccagtgtctag

SEQ ID NO: 53837 - DNA, 606 bp, Artificial Sequence
  Description of Artificial Sequence: Synthetic coding sequence
atggcgcctcattgggccgtgtggctactcgcagctcgcctatggggacttggcattggcgcagaagtatggtggaacctcgtgcctaggaagaccgtcagttcaggtgaactggcaacagtggttcggagatttagccaaactggcatccaagacttcctcacactcacactcaccgagccaacaggactgctctacgtgggcgcaagggaggccctttttgcctttagcatggaagccctggagctccagggagcgatttcttgggaggcacctgtcgaaaagaagacagaatgtatccagaaggggaagaacaatcagacagagtgctttaattttattcgtttccttcagccatataatgctagtcatctgtatgtctgtggaacatatgccttccagcctaaatgcacatatgtaaatatgttaacttttactttggagcacggggagttcgaggatggcaaggggaagtgcccatatgaccctgccaaaggccacgcgggtctcctagtcgatggcgagttgtacagcgctactctgaataattttcttgggacagaacccatcatcctccggaacatgggccctcaccactcaatgtag

SEQ ID NO: 53838 - DNA, 423 bp, Artificial Sequence
  Description of Artificial Sequence: Synthetic coding sequence
atggcccctcactgggccgtatggctcctagctgctagactatgggggctggggattggggctgaggtttggtggaatctggtccctagaaaaacggtgtcttccggagagttagcaacagtggttcgacggttttcacagacaggaattcaggatttcttaacccttaccttgaccgaaccgaccggtctgctgtatgtcggtgccagagaggccctttttgcgttctctatggaggcattggagcttcagggggctatttcatgggaggcccctgtcgaaaagaagaccgagtgtatccagaagggcaagaataatcagacagagtgtttcaacttcatccgcttcttacagccgtataatgcatcccatctttatgtttgtggcacctatgcctttcaacctaagtgtacctacgtgtag

SEQ ID NO: 53839 - DNA, 2217 bp, Artificial Sequence
  Description of Artificial Sequence: Synthetic coding sequence
atgcgcatgtgcacccctataagaggacttctcatggcgctggcagtaatgtttggtaccgcgatggcgttcgcccctatcccccgtatcacctgggagcatcgagaagttcacctggtccaatttcacgaacccgacatatacaattacagtgctctacttctcagtgaggataaagacacactttacataggggctagggaggcggtgtttgcagttaacgccctcaacatctcggaaaaacagcatgaggtctactggaaagtctctgaggataagaaggcaaaatgcgcagagaaaggaaagtcaaaacaaacggaatgtctgaactatataagagttctgcagccgctatcagccacctctctctacgtctgcggcactaatgcatttcaaccggcttgcgaccacctgaaccttaccagcttcaagttccttggaaagaacgaagacggtaagggtaggtgcccgtttgatcccgcacatagctatactagtgtaatggtcgatggcgaattatattctggcactagctataactttctcgggtccgagcctatcatcagccgcaattcctcccattctcctctaaggacagaatatgccatcccgtggctcaatgagccatcgttcgtgtttgctgatgtaattaggaagtccccagactcacccgatggcgaggacgatcgtgtctactttttctttacggaagtgagcgtggaatatgagttcgttttcagagtgctcattccaagaatcgccagagtctgtaaaggagaccagggcggactgagaacactgcagaagaagtggactagttttctgaaagccagattgatttgcagccggcctgatagcggcctcgtttttaacgtgttgagagatgtgttcgttttgcgatcacctggcctcaaagtgcctgttttttacgccctcttcacacctcagctgaataatgtgggactctctgctgtgtgcgcttataacctttccaccgcagaagaggtgttttctcacggcaagtatatgcagtctaccacggtggagcagagccacacgaagtgggtccggtataacggacctgtccctaagccgaggcctggtgcgtgcattgacagcgaggcccgtgccgcaaattacacaagcagtctcaatctgcccgataaaacactgcagtttgtgaaggaccatccgcttatggatgacagtgtgacaccaatcgataatagaccacggctcattaaaaaagacgtgaattacacccagattgtggttgataggacccaagccctagacgggaccgtgtatgacgtcatgttcgtgagtaccgatcgaggcgcactgcataaggctatatcccttgagcacgccgtgcacatcattgaggaaacacagttgttccaggacttcgagcccgtgcagacgttgttgcttagctcaaaaaaaggtaacagattcgtctacgctggatcaaactccggcgtcgttcaggcaccgcttgctttctgcggcaagcacggaacctgcgaggactgcgtgctagctcgtgacccctattgtgcctggtcccctcctacagctacttgtgtcgcactgcaccaaactgagtctccttccaggggcctcatacaggagatgagcggagacgcttctgtctgcccagcatcgtcccccaaacctctgcctcctcctgggagctcctccctgagctgtctaggtcatgtgggcgataggcgactctcctctccttggactccctggcctgcttcaggcgctggacctgactcttcatcccgcgtcagcttactgcctccattcctgtccgatcaggctcagcatgtccatgccctcggcaacttttatctgttttgccaggccacgggtcctgccgacattcgatttgtttgggaaaagaatggcagggctctggagacatgcgtgccggtccaaacccacgctttaccagacggacgggcacatgcacttagttggctgcaggatgcaattagagaatccgctgaatacaggtgttctgtgctcagtagcgctggcaataaaacaagtaaagtgcaagtggcagtgatgcgcccagaggtgacccatcaagaaagatggacccgcgaactatcggcctggagggctgtggcgggagagcacgaccggatgatgcagtcctggaggaaagcgtgggagtcttgctctaaggatactctgtag

SEQ ID NO: 53840 - DNA, 2589 bp, Artificial Sequence
  Description of Artificial Sequence: Synthetic coding sequence
atgaggatgtgcaccccaattcggggtctgctcatggcccttgctgtgatgtttgggactgcgatggcctttgctccgattccccgaatcacgtgggagcacagagaagtccatctggtgcagttccatgagcccgatatctacaattactctgccctgctactgagtgaggataaagatacattatatattggtgcccgagaggctgtattcgctgtcaatgccttaaacatctccgaaaagcagcatgaagtttattggaaagtatcggaggataagaaggcgaaatgcgcagaaaaggggaaaagcaaacaaacagagtgcctgaattacattagagttctccagcctctgtctgccacctctttgtatgtgtgtggaactaacgcatttcagcccgcatgcgaccacctgaatctaacatctttcaaattccttggaaaaaacgaagacgggaaaggccgatgcccgttcgaccccgctcattcttatacttccgtcatggtagatggtgaactctattcaggaacgtcctacaattttttgggatctgagcccatcatctcacgcaactcttcccattcccccctccgtaccgaatacgctataccctggctcaacgagcccagttttgtattcgcagacgtgattcgcaagagccccgattcgcctgatggagaagacgaccgcgtgtactttttcttcaccgaagtctctgtagagtacgaatttgtcttccgtgttctgattcctcggatagcccgagtctgtaaaggggaccagggcggtctgcggacactgcaaaaaaagtggacaagttttttgaaagccagactcatctgtagtcggcctgatagtggcctcgtctttaatgttctccgcgatgtatttgtcctacgttctcccggtcttaaagtgccagtgttttatgccctgttcacgcctcaactcaataatgtgggactgagcgccgtatgcgcctataacctctcaactgccgaggaagtgttcagccacggcaagtacatgcagagcacaaccgttgagcaaagccacacaaagtgggtgcggtacaacggccctgtgcccaagcctcgtcctggcgcttgcatcgactccgaggcaagggctgcaaattacacctcaagccttaacctgcctgataagactctgcagtttgttaaagaccacccacttatggacgactctgtgacgccaatcgacaataggccgaggctcatcaaaaaagacgtcaactacactcaaatcgtagtcgacaggacccaggccctggatggaactgtgtacgacgtgatgtttgtgagcacagatcgaggcgctctccataaggctatcagcttagagcacgcggtccacattatcgaagagacccagttatttcaggactttgagccagtgcagacgctattgctgtcgagcaagaagggtaaccgattcgtgtatgctgggagtaactccggggtggtgcaggcacccctcgctttttgtggcaaacatgggacctgcgaagactgtgtgttagctagagatccttactgcgcctggtcccctccaactgcaacgtgtgttgccctccatcagaccgagtcacccagcagaggcctaatccaggagatgagcggggatgctagcgtgtgtccggataagagcaaaggctcttacagacagcatttcttcaagcacggcggaacggctgagctgaaatgctcccagaaaagcaacctcgcacgagtgttttggaagttccagaatggcgtgctcaaggcagagagccccaagtatggactgatgggacgcaaaaacctcctgattttcaatttgtcggaaggggatagcggcgtttaccagtgtctttctgaggagagagtgaagaacaagaccgtcttccaggtagtcgctaaacacgtgcttgaggtgaaagtggtgccaaagcctgttgtggcccctacgctaagcgtggtccagactgagggctcccggattgccactaaagtcctggttgcctccactcagggttccagcccgcctacgcccgctgtgcaggccacgtccagtggcgcaatcactctgccacctaaaccagctcctacgggcacatcctgcgaacccaagattgtgatcaacaccgtgcctcagctgcattcggagaagaccatgtacctcaaaagtagcgataatcgcctgttgatgtcactctttctcttcttctttgtgctcttcctctgcctgttcttttataactgctataagggctacttgccacggcaatgcttgaagtttagaagcgccttgctgattggcaagaagaagcctaagtcggatttctgcgatagggagcagtccctcaaggagacactggtggagccgggttctttcagccaacagaatggagagcatccaaagcctgcgcttgatacaggctacgaaaccgaacaggacacaatcacctccaaggtccctaccgatcgagaggatagccaaaggattgatgacctgagtgccagggataagcccttcgacgtgaagtgtgagctcaaatttgctgactcagatgctgacggggactag

SEQ ID NO: 53841 - DNA, 180 bp, Artificial Sequence
  Description of Artificial Sequence: Synthetic coding sequence
atgcggatgtgtactcctattagaggtctgctcatggccctggccgtgatgttcggcacagcaatggcctttgccccaatcccaaggattacatgggaacaccgcgaggtacatctggttcagttccatgaacctgatatctacaactatagcgccctgctgttgtctgaggacaaatag

SEQ ID NO: 53842 - DNA, 372 bp, Artificial Sequence
  Description of Artificial Sequence: Synthetic coding sequence
atgtggacacagagatggaaaagaagtgtttctccaggcccagctgacatacgcttcgtgtgggagaagaatggaagggccctcgagacatgtgtgcctgtccagacacatgctttacctgatgggcgagcccacgccctgtcctggctgcaggacgcgatccgtgaaagtgccgaataccgctgcagcgtactgtcatctgctggaaacaagacttcaaaagtgcaggtggcggttatgcggcctgaggtcacccaccaggaacggtggacaagagagctttccgcctggcgggctgtcgccggagagcatgacaggatgatgcagtcctggcggaaagcgtgggaaagctgttccaaggacactttgtag

SEQ ID NO: 53843 - DNA, 6 bp, Artificial Sequence
  Description of Artificial Sequence: Synthetic coding sequence
atgtag

SEQ ID NO: 53844 - DNA, 441 bp, Artificial Sequence
  Description of Artificial Sequence: Synthetic coding sequence
atgcggatgtgcactcccatccgtggcctgttaatggcgctggcagtcatgtttggaacagctatggcctttgcccctattcccagaattacatgggagcatcgcgaagttcatctggtccagttccatgaaccagacatttacaactactcagccttgctactgtctgaagacaaagatactctttacattggtgccagggaagcagtgttcgcagtgaacgccctgaatatctcggagaagcaacacgaggtctactggaaagtatcagaagacaaaaaagcaaaatgcgctgagaagggaaagtccaagcagaccgagtgcttaaactatatccgcgtgctgcagccccttagtgccacctccctctatgtgtgcggtacaaacgcttttcagccggcttgcgaccacctgaacttgactagtttcaaattcctatag

SEQ ID NO: 53845 - DNA, 2217 bp, Artificial Sequence
  Description of Artificial Sequence: Synthetic coding sequence
atgaggatgtgcactcctatccggggtcttctgatggcactcgccgtcatgtttgggacagctatggccttcgcgcctatccccaggattacatgggaacacagagaggtacacctggtgcagttccatgagcccgatatctacaattactctgccctgttgctgagcgaagataaggatacattgtatattggggctagagaagctgtttttgccgttaacgcactaaacattagtgagaaacaacacgaagtgtactggaaagtgtctgaggacaaaaaagcaaaatgtgccgaaaaggggaaatccaaacaaactgagtgcctcaactacatccgagttttgcagccccttagcgccactagcctttacgtgtgcggtacaaacgcatttcaacccgcatgcgatcacctaaatttgacaagtttcaagtttctgggtaagaatgaggacggaaaagggagatgtccatttgaccctgctcatagctacacctcagtcatggtggacggggaactgtactccggcacgtcctacaacttcttgggttccgagcctattatctcccgcaattcgtctcacagccccctgaggaccgagtatgctattccttggttaaatgaacccagcttcgtgttcgccgacgtcatccgaaagtcaccagatagcccagatggggaagatgacagagtctatttcttcttcacggaagtctccgtcgagtacgagtttgtctttcgcgttctaatcccaaggattgcccgagtttgtaagggagaccagggcggtctgcgtacacttcagaagaaatggacaagctttttaaaggcacgtctgatttgcagcaggcctgatagcggcctggtgttcaatgtcctgagagatgtgttcgtgttgaggtcgcctgggctcaaggtgcccgtcttctatgcattatttacgccgcagttaaataacgtgggactgtctgcggtatgtgcctacaacctgtctacagctgaggaggtatttagccatggtaaatacatgcagtccactaccgtggaacagagccatactaagtgggtgcggtataatgggccagtgccaaagccaagacccggagcttgcattgactctgaagctagagcagctaattatacaagcagcctgaacttgcccgacaagaccctccagttcgtgaaagatcaccctcttatggatgacagtgtgacaccaatcgacaacaggcctaggcttattaagaaagacgtcaattacacacagatcgtcgtggaccgaacacaagcattggatggcacagtatacgatgtgatgtttgtgtctacagatcgaggagccctgcacaaagccattagccttgagcacgcggttcacattatcgaggagacacagctgttccaggactttgaaccagtgcagacccttctgctttcaagtaaaaaggggaacaggttcgtgtacgccggtagcaatagcggtgtggtccaggctcccctggctttctgcgggaagcacggcacctgtgaggactgcgtgctagccagagatccttattgcgcttggagccctcctacagccacgtgtgtcgctctccatcagacagagagcccctcgcgcggacttattcaggaaatgtccggagatgcaagtgtctgtccagcctccagccctaagcccctacctcctccaggcagtagttcattgtcctgcttggggcatgtcggagatagacggctgtcatctccctggaccccctggcctgcctctggagccggtcccgacagttctagtcgcgtaagtcttcttcctcccttcctgtctgaccaggcacagcatgtgcacgccctggggaatttttaccttttttgtcaggctaccggacccgcagatatccggtttgtctgggaaaagaatggcagggcgctggagacttgtgtccccgtgcaaactcatgcactacccgacggcagagcacacgcactgagttggctgcaggacgccatccgagagtcggccgagtaccgctgttccgtcctgtctagcgccggaaacaagacttcaaaagtgcaggtggccgtaatgaggcctgaggtcacgcatcaggagcgctggactcgcgaactttccgcatggcgtgccgtggcaggcgagcatgaccggatgatgcaaagctggcgcaaagcctgggaaagctgcagcaaagatactctctag

SEQ ID NO: 53846 - DNA, 2589 bp, Artificial Sequence
  Description of Artificial Sequence: Synthetic coding sequence
atgcgcatgtgtacccctatcagaggcctactgatggccctggccgtgatgttcggaacagctatggcattcgcgcctatcccacgcataacatgggaacaccgggaagtgcatctggtccagtttcacgaacctgacatatacaattactctgccctcctcctttcagaagataaagacaccctgtatattggagcgcgtgaggctgtcttcgcagtgaatgccttaaatatctccgaaaaacagcacgaggtctactggaaagtcagtgaggacaaaaaggcaaagtgcgcagaaaaaggtaaaagcaaacaaacagaatgcctgaattacattagagtcctacagcccctaagtgctacttctctgtacgtctgcggtactaacgcatttcagcctgcttgtgatcacctaaatctgacaagcttcaagtttctgggaaaaaatgaggatggaaaggggaggtgtcctttcgatcccgctcatagctataccagcgtcatggttgatggcgagctgtacagcggcaccagctacaacttcttgggcagtgagccaattattagtaggaattcttcccattctccgctgaggaccgaatatgccataccatggctcaacgagcctagtttcgtcttcgctgatgttatacggaagtcgccagatagtcccgacggtgaagatgacagggtttactttttcttcactgaggtgtccgtagagtatgagttcgtctttagggttttgattcccagaattgccagggtttgcaagggcgatcaggggggactgaggactctgcagaaaaaatggaccagcttcctaaaagcacgtctgatctgtagccggcctgatagcggattggtgttcaatgttctgcgggatgtcttcgtactgcgaagtccaggattgaaagttccagtgttctatgcgctatttacgcctcagcttaataacgtggggctgtctgcagtctgtgcttacaacttgtctaccgcggaggaggtattcagtcatggaaagtatatgcagagtacaacagtagagcagagtcacactaagtgggtacgatacaacggtcctgtgccaaaaccgaggccgggagcctgcattgactcagaggcccgagccgctaattacacctcctccctgaacttgccagacaagacactgcagttcgtgaaagatcaccccctgatggatgactccgtgaccccgatcgacaaccgaccgcgattaatcaaaaaggatgttaattacacccaaattgtggtggataggactcaggctttggacgggactgtctatgatgtgatgtttgtgtccacagacaggggggctctccacaaggctatatccctggagcatgccgtccacatcattgaagagacgcagctgttccaggatttcgagccggtgcagactcttttgctaagtagcaagaagggaaaccgcttcgtttatgccggatccaactccggagtggtgcaggcaccactagcattttgtggcaaacacggtacgtgcgaggattgcgtgcttgccagagatccctactgcgcttggtcccccccaacggctacatgcgtggccctccaccagacagaaagcccctctcgcggtctgatccaggagatgtccggagatgctagcgtatgtcccgacaagtcgaaaggctcctatagacagcacttttttaagcacggcggtaccgccgaactgaagtgctctcaaaagtctaatctggctcgggtgttttggaaattccagaacggtgttctgaaggcggaatcccccaaatacggtctgatgggcagaaagaacctgctgatcttcaatctatccgaaggcgatagcggagtataccagtgcctgtcagaagagagagtgaaaaacaagaccgtatttcaggtcgtcgcaaaacacgtgctggaggtgaaggtcgttccaaagcctgtagtggctccgaccctgagtgttgttcagacggagggctccaggatagccaccaaagtcctggtcgcctccactcaaggctcatctccacctacacccgcagtgcaggcgacctccagcggagccattacccttccaccaaaacccgctccgacgggcacctcttgtgaaccgaagatcgtcatcaataccgtgccacagctgcactcagaaaagacaatgtaccttaaatccagcgacaaccggctgctcatgtccctcttcctgttctttttcgtgctcttcctttgtctcttcttctacaattgttacaaagggtatttgccccgacagtgcctaaagtttcgaagcgccctcctgatcgggaagaagaaaccaaaaagcgacttctgtgacagagaacagagtctgaaagaaacactggtggagcctggtagcttctcccaacaaaacggggagcatcctaagcctgcccttgacacagggtatgagacagagcaggacaccattacaagcaaggtgcctactgaccgtgaagacagtcagcgaatcgacgatttgagcgctagagataagccattcgatgtgaagtgtgagctgaaattcgcagattcagacgcagatggggactag

SEQ ID NO: 53847 - DNA, 231 bp, Artificial Sequence
  Description of Artificial Sequence: Synthetic coding sequence
atgagaatgtgcacacccattcggggactacttatggcactggcagtgatgttcggcaccgcaatggcgtttgcccctatccccaggatcacctgggagcatcgtgaggtgcatcttgtccagttccacgagccagacatctataactacagcgctttgctcctgtctgaagataaggatactctctacattggggctagagaggccgtgttcgcggtgaacgccctgtag

SEQ ID NO: 53848 - DNA, 2589 bp, Artificial Sequence
  Description of Artificial Sequence: Synthetic coding sequence
atgaggatgtgcacacctatcaggggccttcttatggcacttgcagtgatgttcggcacagctatggcctttgccccaattcctaggatcacctgggaacaccgtgaggtccatctcgtccagtttcatgaaccggacatttacaactattctgcactccttctctccgaagacaaggacacactctacatcggggcacgcgaagctgtgttcgccgtcaatgcacttaatataagcgagaagcaacatgaggtatactggaaagtttcagaggataagaaggccaaatgtgcagagaaaggaaagagcaagcagaccgaatgcctgaactatatccgggtcttgcaaccacttagtgcgactagtttgtatgtgtgcgggaccaatgcatttcagccggcatgtgatcacctaaatctaacctccttcaagttcctcggaaaaaatgaggacggcaagggaagatgcccatttgacccagctcattcatatacctcagtcatggtcgacggagagttgtattctgggacttcctataacttcctagggtccgagccaataatttcacgaaattctagtcattccccattgcgcacagagtacgccattccctggctgaatgaaccatctttcgtgtttgcggacgtgattaggaagagccccgatagccctgatggcgaggatgacagggtgtactttttctttaccgaggtgtcggtggagtacgagttcgtttttagggtcctcatccctcgtatcgctagggtatgcaaaggggatcagggcggtctgaggacactgcagaagaaatggacttccttcctcaaagctcgtctgatttgttcacggccagactcaggcttggtgtttaacgtgctgagggacgtgtttgtgctgagatctcccggactgaaggtcccagtgttttacgccctgttcactccccagctgaacaacgtaggcctttccgccgtttgcgcctacaacctgtcaacggctgaggaggtgttcagtcacggcaaatacatgcagtctaccacggttgagcagtcccacacaaaatgggtcagatacaacgggcctgtccccaagcctagacccggagcatgcatcgatagtgaggctcgggcagctaattacacatcaagcctgaatttgcctgacaagacgttgcagttcgtcaaggatcaccctctcatggatgatagcgtcactccgatcgacaataggcctagattaattaaaaaagatgttaactatacacagatcgtcgttgataggactcaggccctggatggtacggtgtacgatgtgatgttcgtgtcaaccgatagaggtgcactgcataaggcaatctcactggagcatgccgtccacataattgaagagacccaactcttccaggatttcgagccagtacagacattgctactttctagtaagaagggcaatcgcttcgtttacgctggctcgaactctggcgtggttcaggcacccctagcattttgcggcaagcatggtacctgtgaggactgtgtgctggccagggacccttactgcgcatggtctccccctaccgctacttgcgtggctctgcaccaaaccgagtccccatcacgaggtttaatacaggagatgagtggcgacgccagcgtgtgtcccgataagagcaaaggttcatacagacagcatttctttaagcacggcggtactgctgagctaaaatgcagtcagaaatccaacctcgcgagagtgttttggaagtttcagaatggtgtgctgaaggccgagtcacccaagtatggcctcatgggccgtaaaaatcttcttatctttaatttgagcgagggagactcgggtgtataccagtgtctctccgaagaacgggtaaaaaataaaacagtgtttcaagtggttgccaagcatgtgctggaggtaaaggttgtgccaaagccagtggttgcccctaccctgtccgtggtgcaaaccgaggggtccagaattgctactaaagttctggtggcttcaacccaggggtcgtcgcctcccaccccggctgttcaggcaacgtcgagtggtgccatcacgctgccacccaaacccgctcccaccggcacaagctgtgagccgaaaatagtgattaataccgtaccgcagctccactcagaaaaaaccatgtatctcaagagttcggataatagactgttgatgtctttattcctttttttttttgtgctgttcctgtgtctgttcttctataactgttacaagggctacctaccacgacagtgcctcaagttcaggtcggcgttgctaatcggcaagaaaaaaccaaagagtgacttctgtgaccgggaacagagccttaaggagaccttggtagagcccggaagcttctctcagcagaatggcgagcacccaaagcccgctctggacacgggatatgaaaccgaacaggacacaatcacatccaaggtgccgacagaccgcgaggattcccagaggatagatgacttgtccgcgagagacaagccttttgatgttaaatgcgagctcaagttcgccgactccgacgccgatggggattag

SEQ ID NO: 53849 - DNA, 2589 bp, Artificial Sequence
  Description of Artificial Sequence: Synthetic coding sequence
atgaggatgtgcacgcctatccgaggcctgttgatggccctggcagtcatgttcggaaccgcgatggctttcgcccctatccctcgaattacctgggaacacagagaggtacacctggttcaatttcacgaacccgatatatataattattcagctctattgctgtcagaagacaaggacaccctgtacatcggagccagagaggcagtcttcgcagtgaacgccctgaacatctctgaaaaacagcacgaggtctactggaaggtgtcagaggacaagaaagccaaatgtgctgagaagggcaagtcgaagcagacagagtgtctgaactacatccgggttctccagccccttagcgccacctctctgtacgtctgtggtactaacgctttccagcccgcttgcgatcatctgaatttgactagcttcaaattcctcgggaaaaatgaggacggaaaaggtagatgtccattcgatcccgctcactcctatacgtccgtgatggtggacggggagctgtatagcggtacctcatacaactttctcggctctgagcctatcatctctaggaacagctcacattctccgctgagaaccgagtacgctataccctggctgaatgaaccttcattcgtgttcgcagatgttatccggaagtcccctgactcccccgacggagaggacgaccgcgtatatttctttttcacagaggtatcagtcgagtacgagtttgtgttcagggtccttatccccaggattgctcgggtctgcaagggggaccaggggggactccggactcttcagaagaaatggacgagctttctcaaagctcgattgatttgctcaaggccggactcagggctggtgttcaacgtgctgagggacgtgttcgtattgagatcgccgggtctgaaggtgcctgtcttctacgcactgtttactccacagttgaacaacgtgggattgtccgctgtttgcgcctataatctgtccaccgctgaagaagtttttagtcacggaaaatacatgcagtctaccaccgtcgagcagtcacacaccaaatgggttcgttataatgggccagtcccaaaacccaggcctggtgcttgtatcgactcggaagcccgtgcagctaactatacctccagccttaatttacccgataaaaccctccaattcgtaaaggatcaccctctgatggacgattcagtaactcctattgacaaccgacctcggctgataaagaaggacgttaattacactcagattgtcgtcgatagaacacaggctctggacggcacagtgtacgatgtcatgttcgtaagtaccgatcgcggagccttgcacaaggctatttcattagagcacgccgtgcacattatcgaggagacgcagctttttcaggatttcgaacctgtacagacactgctgctttcatcgaaaaaaggaaacaggttcgtgtatgccggtagtaattccggagtcgttcaagcgccattggccttctgcggcaagcatgggacatgcgaagactgcgtgctagcgagggacccttattgcgcctggagcccaccaactgccacatgtgtagcattgcaccagactgaaagtcccagcaggggcctgattcaggagatgagtggagatgcaagcgtgtgccctgataagagtaaaggcagttaccgacagcacttcttcaagcatgggggaactgctgagctgaaatgttcacaaaaaagtaatctggccagagtgttctggaaattccagaatggcgtgctgaaagcagaatctccgaaatacgggctaatggggaggaagaatctgttaatctttaatctgagcgagggcgactccggtgtgtaccaatgtctgagtgaggaacgagtcaaaaataagaccgtgtttcaggtggttgccaagcacgttcttgaggtgaaggttgtgccaaagccagtggtcgcccctaccctatccgtggtccagaccgagggttccagaattgccacaaaggttctcgtggccagcacccagggctcgtcaccaccgacccctgccgttcaggcaactagctccggtgcgattacactgccacctaagccggcacccacgggcacgagctgcgagcccaagatcgtcatcaacacagtaccgcagcttcactcagaaaagactatgtacctcaaatcctctgacaatagactgctgatgtccctgtttctgttcttcttcgtgctgttcctatgcctgtttttttataactgctataagggatacctgcccagacagtgcttgaaatttcgatcggctttgctgattggaaagaagaaaccgaagtctgacttttgcgatcgagagcaaagcctaaaggagaccttagtcgaaccgggaagcttctctcagcagaacggggagcacccgaagcctgccttggacaccggatacgaaacagaacaggacaccattacatctaaagtgccgaccgatcgagaggactctcagcgcatcgatgacctgagcgctcgggacaagcctttcgatgtaaagtgtgagctaaaattcgcagatagcgatgctgatggggactag

SEQ ID NO: 53850 - DNA, 201 bp, Artificial Sequence
  Description of Artificial Sequence: Synthetic coding sequence
atgcgaatgtgcaccccaattcgtggtctcttgatggctctggctgtgatgttcgggaccgccatggcttttgcccctattccgagaatcacctgggaacacagggaggttcatctggtacagttccatgagcctgatatctacaattattccgcgctgcttctgagtgaggacaaagacactttatacatcggcgcatag

SEQ ID NO: 53851 - DNA, 2313 bp, Artificial Sequence
  Description of Artificial Sequence: Synthetic coding sequence
atgcccgctagcgctgccagacccaggccagggccaggccagcccactgcttcccccttcccactcctcctgcttgcggttctttccggtcctgtgagcggacgcgtgccaagaagcgtcccacgtactagcctgcccatcagcgaagctgattcctgcctcacacgctttgctgttccacatacatacaattactccgtcctgctagtggacccagcttcccacacactgtatgtgggggctagggacaccatttttgctctctctctccccttctccggggaaagaccacggagaatcgattggatggtcccagaagcacaccgccagaattgccgcaagaagggtaaaaaggaggatgagtgccacaacttcgtgcagattttggccattgctaatgcttctcacctcctgacctgtggcactttcgcattcgatccaaagtgcggagtaattgacgttagccgctttcagcaggtggagaggctggagtctggccgagggaagtgccccttcgagccagcccaaaggagtgcggctgtcatggccggaggcgttctgtacgccgctacagtgaaaaactaccttgggactgagcccataatcactagagccgtcggccgtgcagaagactggataagaacagatacgctgccctcctggctgaacgctcctgcctttgtcgctgcagtcgccctctctccagcagagtggggggatgaggatggcgatgatgaaatctactttttcttcacggagacctcccgtgcctttgatagctatgagcgaattaaagtaccccgtgtggcacgggtttgcgctggagatctggggggtagaaagacgctccaacaaaggtggactacctttctgaaggctgatctcctctgcccaggtcccgagcatggccgagcctcgagcgtgctacaggatgtggccgtgttgcggccagagcttggcgcaggcacacctatattctacgggatattcagctcacagtgggagggtgctaccatctcagccgtgtgtgcttttcgccctcaggacatccgcaccgtgctgaacggtcccttccgggagctgaaacatgattgcaatcggggtctcccagttgtggacaacgatgtgccccagccacgtcctggggaatgcattacaaataacatgaagctgcgccactttggcagctccctgtcactccccgaccgagtgctgaccttcattcgtgaccatccactcatggacagaccagtttttccggctgatggccatcctctgctggtcaccaccgacaccgcctacttacgggtggtggcccatcgtgttacttcactcagtggcaaggaatatgatgtgctgtatctcggcaccgaagacggacatttgcatcgcgcagtgaggattggcgctcagctctctgtgctcgaagacttagcccttttcccagaacctcagccagtggagaatatgaagctctatcattcgtggcttttggtcggctcacgaactgaggtgacacaggtcaatactactaactgcggtagattgcagagctgttccgaatgtatcctggcccaggaccctgtctgcgcatggtcatttaggttggatgaatgcgtcgctcacgccggagagcatcggggattagtgcaggatattgaatctgctgacgtttcatccctgtgtcccaaggaacctggcgagcggcctgtggtgttcgaggtacccgtggcgaccgccgctcacgtagtgctgccctgttccccctcctctgcatgggccagctgcgtttggcaccagccttctggggtaactgcactgaccccaagacgcgatggacttgaggtcgtggtgaccccaggagccatgggcgcttatgcgtgtgagtgtcaggaaggcggagccgctcacgtcgtggctgcctattccctcgtctggggctcccagagagatgccccaagtagggcacacacagtcggcgctggactcgcagggttctttctgggaattttagcggcaagtttgactctcatccttatcggtaggaggcagcagaggcgacggcaacgggaattgttggctcgcgacaaggtcggactggatctcggcgctcccccttcaggaacaacaagctacagccaagacccaccgtcaccgagcccggaggacgagcgattgccattggctttggcaaaaaggggatctggcttcgggggattttcccctcctttcttacttgacccatgcccatcccccgcacatataagactcaccggtgcccctctagccacctgtgacgaaacttctatatag

SEQ ID NO: 53852 - DNA, 384 bp, Artificial Sequence
  Description of Artificial Sequence: Synthetic coding sequence
atgcccgcatctgctgctcggcctcgccctggtccaggccagcccaccgcctccccgtttccgctcctgttgctggcagttctgagtgggcctgtttccgggagggtgcccagatcggtgcctaggaccagcctgccaatcagtgaggccgattcttgtctaaccaggtttgcagtgccgcatacgtacaattactctgtactgctggtggaccctgcaagccataccctgtacgttggcgcacgggacacgatctttgcgctttcattgcccttttcgggagagcgccctcgccgaatcgactggatggtaccggaagcgcatcgccagaactgcagaaagaaagggaaaaaagaaggtgggagcagcatgctccctttgtag

SEQ ID NO: 53853 - DNA, 1080 bp, Artificial Sequence
  Description of Artificial Sequence: Synthetic coding sequence
atgccactggaacttgagctttgcccagggagatgggtcggaggacagcatccttgtttcatcattgcggagataggccagaatcatcaaggcgatctggacgtggcaaagagaatgattcgaatggcgaaggagtgtggagccgactgtgcaaaattccagaagagcgagctggaattcaaattcaatcgcaaggccctggaacgcccatacacctcaaagcattcttggggcaagacctacggggagcacaaacgacacctggaattctctcacgaccaataccgcgagctacaacgatacgccgaggaagtggggatttttttcacagcttccggcatggacgagatggccgtagagttcctccatgagctcaacgtgccgttcttcaaagtgggctccggagataccaataacttcccatacctggagaagactgcgaaaaagggacgcccaatggtgatcagttctggcatgcagagtatggatacaatgaagcaagtataccaaatcgtgaagccccttaatcctaacttctgtttcctgcagtgcacaagcgcatatcccctgcagcctgaagacgtgaatttgcgggttatttccgaatatcagaagctttttcccgatatacccatcggttattctggccatgagactggcattgcaatcagtgtggctgctgtcgccttgggggctaaggtgctcgaacggcacataaccctcgacaaaacatggaagggttcagaccatagcgctagtctggagccaggggaactggctgaactcgtaagaagcgtgaggctggtggagagagctctgggtagtcccactaagcagctgttgccctgcgaaatggcttgcaacgagaagctggggaagagtgtggtcgctaaggtgaagatcccagagggcactattctgaccatggacatgctgactgtgaaagtgggcgaacccaaaggatatccgcctgaggacatttttaaccttgtaggcaaaaaggtgctggtgaccgttgaggaggacgacaccataatggaagagctggtggacaatcacggtaaaaaaattaaatcttag

SEQ ID NO: 53854 - DNA, 2517 bp, Artificial Sequence
  Description of Artificial Sequence: Synthetic coding sequence
atgtgggggaggctgtggccacttctgttgagtatcctgactgctactgcagtgccgggacccagcctgcggagacccagccgcgaactggacgccacaccaaggatgactattccatacgaggagctttctgggacacgccacttcaagggacaggcacagaactatagcactctgttgctcgaggaagcctctgcccgtctactggtaggtgcacgcggagccctgttctcattgagcgcaaatgacattggagatggcgctcacaaggagatccattgggaagcctcccccgagatgcagagcaagtgccatcagaagggcaagaataatcaaaccgaatgtttcaatcatgtgcgctttctgcagaggcttaattctacccacctgtatgcctgcggtacgcacgcctttcagcccttatgtgcagccatcgacgcagaggcatttaccttgcctacctcctttgaggagggcaaagagaaatgtccgtatgatcctgcccgaggcttcacaggcttgattatagacggaggactgtatacggcaactagatatgaatttaggagcatcccagacatcaggcggagtcggcacccccatagcctgaggaccgaggaaaccccaatgcactggctaaacgatgcagagtttgtctttagtgtgttagtaagagagagcaaagcttccgctgtgggggacgacgataaagtgtattacttctttactgagagggcaacagaggagggctctggtagtttcacacagagcagatccagtcacagggtggccagagtagctcgggtttgtaagggagatctcggcggtaaaaagatactccaaaagaagtggacctctttcttaaaagcgcgtcttatatgccacatccctctctatgaaaccctccggggtgtgtgctcattggatgctgagacatcgagtagaacacacttttatgccgcttttactctgtctacccagtggaaaacgcttgaagcttctgccatctgtaggtatgacttagccgaaatccaggccgtgtttgcagggccatatatggaataccaggacggatcaagacgatggggacgttatgaaggtggcgtgccagaaccacgcccaggctcctgcatcaccgactccctgcggagtcaaggctataacagcagccaggacttgccgagccttgtgttggactttgtcaaactgcatccactcatggcgagacccgttgtaccaacccgagggaggcctttgctgcttaaaaggaatatacgatatacgcaccttacaggaacaccagttactacccccgcaggcccaacatatgacctgctatttctgggcacagccgatggttggatccataaggcggtggtcctaggctctgggatgcacattatagaagaaacccaggtgttccgagaatcacagagcgtggagaacctcgtgattagtctgctgcaacattcactctacgtgggcgcaccgtcaggggtgatccagctgcccttaagttcctgtagtcgctatcgttcttgctacgattgcattcttgctagggatccgtactgcggctgggaccccggaacacacgcatgtgccgctgcaacaaccatcgctaaccgcacagctctaatccaggatatcgagagggggaatcgcggttgtgagagttcaagggacaccgggccaccccctcccttgaaaaccagatccgttctgagaggcgacgatgtactgttgccatgcgaccaaccatccaatttggcaagggccctgtggctcttgaatggaagcatgggtttatcggacggccaaggcggataccgtgtcggcgtggacggactgcttgttaccgacgctcagcctgagcatagcgggaattatggctgctacgccgaggagaacgggctcaggactttgttggcttcatactcattaacagtgaggccggctaccccggctcctgcccctaaagcgcctgccacgccaggtgcacagctcgccccagatgtgcgcctcttatacgtcttggccatcgccgctctgggaggtctgtgcctcattctggcgtcatccttactatacgtcgcatgcttacgagaggggaggcggggacgtcggaggaaatactcattgggtagagcatccagggccggtggtagtgcagtgcaactacaaactgtctccggacagtgtcctggcgaagaagacgagggagatgacgagggcgctggaggcctggaggggagctgcctccagataattccaggggagggggcaccggctcctccgcctcctccacctcccccaccgcctgccgaactgaccaacggcctcgtggctttaccttctcgtctgaggagaatgaatggaaactcctatgtgctcctgcgccagagcaacaacggtgtgcccgcaggtccctgttcatttgccgaggaactgagcaggattttggagaaaagaaagcacactcagctcgtcgaacagctggatgaatcttcagtctag

SEQ ID NO: 53855 - DNA, 1659 bp, Artificial Sequence
  Description of Artificial Sequence: Synthetic coding sequence
atgtggggaagactatggcccctgctgcttagcatattaaccgccactgcagtgcctggcccttcactgagacggcctagtcgagagctggacgcaacccctcgtatgactattccttacgaagaactgtccggcacgcggcacttcaaaggccaggctcagaattatagtaccttgctgctggaggaagcttcagctagactgctggtcggagccagaggcgcactcttttcactgtctgcaaatgacattggagacggcgctcataaagagatccattgggaagcctctcctgaaatgcagtcaaaatgccaccaaaaaggcaagaataaccaaacggagtgttttaatcacgtaaggttcctgcagcgtctgaactccacgcatttatatgcttgtggcacacatgcgtttcaacctttatgtgccgcaattgatgcagaggcctttaccctcccaacctcgttcgaggagggtaaagagaagtgtccgtacgaccccgcaaggggtttcacaggcctgatcattgatgggggattatacacagccaccagatatgagttccggtcaattcccgacataagacggagccggcacccacacagtctacgcaccgaggaaacccctatgcactggctaaacgacgccgagtttgtctttagcgttttggtccgggaatcaaaggcaagtgcagtcggagatgacgacaaagtgtactacttttttacggaaagggctacagaggaagggagcggatcttttacccagtccaggtctagccaccgcgtggctcgggtggcgagggtgtgtaagggggacctcggcggaaaaaagattctgcagaaaaaatggacgtccttcctgaaagctagactgatctgccacatccccctgtatgaaactctgcggggagtgtgcagcctggacgctgagacctcttctagaacgcatttctatgctgccttcactctgagtacgcagtggaaaaccttggaagcaagcgccatctgccggtatgacctggcggagatccaggccgtgtttgccggaccttacatggagtaccaggacggctcaagaaggtggggtaggtacgaggggggtgtccctgaacctcggccagggagctgcattacagattcactccgaagccaggggtataactcatctcaggacttgccctcactggtgctagactttgttaagctacatccactcatggccagacccgtggtccctacgcggggtaggccccttctgctgaaaagaaatattcgctatacccatttgacgggcaccccagtcactacccccgctggccctacctatgacctgctgttcctgggaactgccgacggatggatccacaaagcagtcgttctgggaagcggtatgcacattattgaagaaacacaggtgttcagggaatcacaatctgtggagaatcttgtgatcagtctcctgcagcattcgctttacgtcggcgcaccctctggtgtgattcagttgcctctctcatcgtgcagtcggtacaggtcatgttacgactgtatcctcgcgcgagacccatattgccatatcttgtctgggcctctccctcaacctcacgtcgtgacctccctttcaagggcttgggaaagagcatctctgggacggtag

SEQ ID NO: 53856 - DNA, 2109 bp, Artificial Sequence
  Description of Artificial Sequence: Synthetic coding sequence
atgtggggcaggctctggccactgctcctgtctatcctaaccgcgaccgctgtaccaggaccctcactacggaggcccagtagagaattagatgccacaccgaggatgaccattccatatgaggaattgtcaggtactaggcatttcaagggccaggcccaaaattactccacgctactgcttgaggaagcatccgcacgccttctcgtgggggcaagaggtgcactcttctcgctctctgccaacgatatcggagacggagctcacaaggagattcattgggaagcttccccggaaatgcagagcaaatgccatcagaaagggaagaacaaccagaccgagtgctttaaccacgtgcgtttccttcagcggctgaattcaacccatttgtatgcctgcggcacacacgcgttccagcctttgtgtgccgctatcgatgctgaggcctttacactaccaaccagcttcgaggagggtaaggagaagtgcccatacgacccagctaggggatttacaggacttatcatcgacggaggtctatacacagccactaggtatgagtttcgttctatacccgatatcagacgatccaggcatccacactcactgcggacagaggaaacccccatgcattggctaaatgatgctgagtttgtgtttagcgtgctggtcagagagtctaaagccagcgcggtaggcgatgacgataaggtgtattacttttttaccgaacgagccaccgaggagggcagtgggtcattcacccagtctagatcatcccacagagttgctcgcgtggccagggtgtgcaaaggtgacctcggaggcaagaaaatactccaaaagaagtggacctcttttctgaaggctaggctaatttgtcatattccgctgtatgaaactctgcgaggcgtatgttctctggacgcagaaacaagcagtcggacccatttttacgccgcatttacattgtctacccagtggaagacgcttgaagcttccgcaatctgtagatacgacctcgccgaaatccaagctgtttttgctggtccctatatggagtatcaggatggcagccggcgttggggtaggtacgaggggggagtccccgaacccagaccaggcagttgtatcactgactcattaagatctcaggggtataattccagccaagatttaccaagtctagtcctcgactttgttaagctacatccattgatggccaggcctgtggtacctactcgtggtcgtcctttattgctgaaacgcaacattcggtacacacacctgactgggacgccagtgaccactcctgcagggcctacctacgacctcctgtttctgggaaccgcagatggctggatccacaaggccgtggtattaggcagcgggatgcacattatagaagagacccaagttttcagagaatcccagagcgtggagaacctcgtgattagtctgcttcagcattcgctctatgtgggggctccttctggcgtgatacaattaccacttagttcttgtagcaggtacagaagctgctacgactgcatcctggctcgagacccatactgtggatgggatcctggcacacacgcttgtgctgctgcaactaccatcgctaatcggtcccagggctccaggactgcattaatccaagatattgagagagggaacaggggttgcgagtctagccgggacacaggtcgcgcactgcaagtacatatgggatccatgagtcctccatcggcatggccctgcgtgctcgacggccctgagactcggcaggacttgtgccagcctccaaagccttgtgtgcatagccatgcgcacatggaagaatgcttaagtgcagggttacaatgcccgcaccctcatcttctgttggtgcattcctgcttcattccggcatccggcctcggagtgccctcacaacttccacacccaatctggtcttccagtcccgctccttgcggagacttgtttgtcaaaagtctgggcaccgggcaacccggagaggtgcgtttgcaccatagtcccccacttccgtcttgcgtcgctttagtgaatcaaccaccgcatagcccgtggagcttttccagggtctag

SEQ ID NO: 53857 - DNA, 513 bp, Artificial Sequence
  Description of Artificial Sequence: Synthetic coding sequence
atgtgggggagactctggccactgctgctttctattctgacggctactgccgtgcccggtccatcccttcggaggccaagccgcgagctggacgcgacgcccaggatgactattccctacgaggaattatctggcaccagacattttaaaggccaggctcaaaattattccactctgctgctcgaggaggcctctgcacgtcttctggtgggagctcggggtgccctgtttagtctgtcagctaacgacataggggacggtgcccataaggagattcattgggaggcatccccagaaatgcagtccaaatgtcatcagaaaggaaaaaacaaccagacggagtgctttaatcatgtgaggttcttgcaacggttgaactctacccatctgtacgcttgtgggacccacgcatttcagccactttgtgccgcaattgatgccgaggcttttacgttacccactagcttcgaggagggcaaggaaaaatgtccttatgatcccgctcgcggttag

SEQ ID NO: 53858 - DNA, 1569 bp, Artificial Sequence
  Description of Artificial Sequence: Synthetic coding sequence
atgtggggcagactctggcccctgctgctctcaatcctgactgccaccgcggttccaggaccatctttgaggaggccgtctcgggaactggatgccacacctaggatgactatcccttacgaagagctgtccggcacgcggcatttcaaaggccaagcacagaactattcaacactgctgctcgaagaagccagcgccagacttttagtgggagcaaggggtgctcttttctctctaagcgcaaacgacattggcgatggggctcataaagaaatacactgggaagcatccccggagatgcagtcaaagtgccaccagaagggcaagaacaatcaaaccgagtgctttaaccatgtgcggttcctgcagagactgaactcaacgcatctctatgcttgtgggacccatgcctttcagccactgtgcgctgccattgacgccgaagcctttaccctgcctacctccttcgaggagggtaaagaaaagtgcccatacgatcctgccaggggattcacaggacttattatcgacggcggactctacaccgctacacgctatgaattcaggtctatccctgacattcggagaagtagacatccgcattccttacgaacagaggagactcctatgcattggctgaatgatgcagagtttgttttttctgtgctagtccgcgaatcaaaagccagtgctgtgggggatgacgacaaggtctactatttcttcactgaaagagcaaccgaagagggctcaggtagtttcacacaatccagatccagccatcgggtggccagggtggcacgcgtctgcaaaggcgatctgggcggaaagaagatactgcagaagaagtggacatcattcttgaaagcccgtctcatttgtcacatcccactgtatgagaccttgcggggagtctgttctctggacgccgagacatccagcaggacccatttctatgccgctttcaccctttcaacccagtggaagactctggaagcttccgccatttgccggtatgatctcgctgagatccaggccgttttcgctggtccttacatggagtatcaggacggctctagacgttggggtcgctacgaaggcggagtgccagaaccccgtcctggcagttgtataacggatagtctcagatctcagggctataactcttcccaggacctgccgtcactggtgctggacttcgtgaaattgcatccgctgatggcacggcctgtcgtgcctacccgtggacggcctctgctgctgaagaggaatattagatatacacacctgacaggtactcccgtgaccacacccgcaggcccaacgtacgacctgctcttcctgggcactgctgatgggtggatccacaaggcagtggttcttggaagcggcatgcacattattgaagaaacccaggtgttccgtgagagccagtctgtcgaaaatctcgtcatttctctcctccagcactccctgtacgtgggggcaccctccggagtgatccagctgccactgtcctcatgtagtcggtatcggagctgttatgactgcattttagccagggactag

SEQ ID NO: 53859 - DNA, 2517 bp, Artificial Sequence
  Description of Artificial Sequence: Synthetic coding sequence
atgtggggtcgactttggccactcttactcagcatcctgactgcaacggccgtcccgggacctagcctaaggagaccaagtagggagcttgatgcaactccgagaatgaccattccctacgaggagttgtcaggaactagacattttaaaggccaggcacagaactactcaactctgttactcgaagaggcttcagcccgacttttggtgggcgctcgaggggctttgtttagcctgtcagccaatgatattggtgacggggctcacaaggagattcactgggaggccagtcccgagatgcaatctaagtgtcatcagaagggaaaaaataatcagacagagtgtttcaatcatgtgagatttcttcagcggcttaactctacacatctctacgcatgcgggacacacgcttttcaacctttgtgtgctgccatcgacgcggaagcctttactctgccaacatcttttgaagagggcaaggaaaaatgtccgtacgacccagcgaggggctttaccggattgatcatagatgggggtctgtacacagcaacacgctacgagttcagatcaatcccggatatcagacgcagtcgacacccccattcactgagaactgaagaaacacctatgcattggctgaacgacgccgagttcgtattctctgtgctggttagggagagtaaggcctccgctgtgggggatgacgataaagtgtactacttctttaccgaaagagcgacagaggagggctctgggagtttcactcagagcaggtccagtcatagggtcgccagagtagccagggtatgcaagggcgatttgggcggaaagaagatcctgcaaaagaagtggacctcttttttgaaagctcggctgatttgccatataccactgtacgagacactccgaggcgtgtgcagtctcgatgccgaaacgagctcgagaactcacttctacgcagcattcaccctttccactcagtggaaaactcttgaggcctctgccatttgcagatatgatctggctgagatccaggctgtgtttgctggtccctatatggaatatcaggatggcagcagacgctgggggaggtacgaaggaggagtacctgaacctagacccggatcgtgtatcactgattccctacgctcccagggctataattccagccaggatctgccatctttagtcttagattttgtcaaacttcatccactaatggctcggcctgttgtgccaacaagaggccgacccctgttgttgaagcgaaatatccggtacacccatttgacagggacccccgttactacacctgccggtccaacatacgatctgcttttcctggggacagcagacgggtggatccataaagccgttgtcctggggagcgggatgcacattatagaggagacacaggtgtttcgggagtctcaatccgtcgaaaacctggtgatcagcctattacagcactcattatacgttggcgctccttcgggggtcatccaactacccctgtccagctgttctaggtaccgaagttgctatgattgtatcctcgccagggacccttactgtgggtgggacccagggacacacgcctgcgcagcagctaccacaatcgcaaatagaaccgctttgattcaggacatagagagagggaatcggggatgtgagagctcacgggacacaggaccaccccctccacttaagactagatccgttctcagaggtgacgatgttctgctgccgtgtgatcagcctagtaatcttgcgcgagccctatggctgttaaacggcagcatgggactctctgatggacagggaggatacagagtgggcgtggacgggcttcttgtgaccgacgctcagcctgagcacagtggcaattacggatgctacgcagaggaaaatgggctgcgcaccctgctggcctcttacagcctgactgtccggccagcaacacccgctcctgccccaaaggcacctgccacacctggggctcaactggctcctgacgtccgactgttgtacgtgctcgccatcgctgcccttgggggattatgcctgattctggcatcctcactcctctacgtcgcttgtctcagagaaggcagacgcggtagaaggcgcaagtactccctggggagagcctctagggctggcggatctgccgtgcagcttcagaccgtttccggtcagtgtccaggggaggaggacgagggtgacgatgaaggtgctggcggtctggaggggagctgcctacagatcatccctggggagggcgcacccgctcccccacctcctccccctcctcctccacccgcagaactgaccaacggcttagttgcccttccaagtcggctgcggaggatgaacggcaattcctatgtgcttctgaggcagtccaacaacggcgtgcctgccggaccctgctcctttgctgaggagctctctcgaattctcgaaaagcggaaacatacacagctggtggaacagctcgatgaaagcagtgtgtag

SEQ ID NO: 53860 - DNA, 3279 bp, Artificial Sequence
  Description of Artificial Sequence: Synthetic coding sequence
atgccttgtggcttctctccaagtccagtcgcccatcatctggtgccagggccaccggataccccagctcaacaacttcggtgtggttggaccgttggtggatggctcttgagcctcgtgcgcggactgctgccatgtctgcctccaggcgcaaggaccgccgagggccctattatggttttggccggacccttagctgtatcgctgctgctgccctcactgacattgcttgtgtcgcacctctctagtagccaggatgtgtcctcagaacccagcagcgagcaacagctctgtgcactgtctaaacacccgacagttgctttcgaggacctccaaccctgggtgagcaacttcacgtatcccggagcccgtgacttctcccaactcgctttggatccatccggcaatcagctcattgtgggcgcacgaaactatttgttcaggttgtctctagctaacgtgtctctcctgcaagccacagagtgggcttctagcgaagatacacgtaggagctgtcagtccaagggcaagacggaagaagagtgccagaattatgtcagagtccttatcgtggccggtaggaaggtgttcatgtgtggaacgaatgcattcagccctatgtgcaccagtcggcaggtggggaatctgagcagaactatcgagaagatcaacggagtggctcgctgcccatatgatcccaggcacaactccactgcagtcattagtagtcaaggcgagctttacgctgccacagtgatcgacttctccgggcgagaccctgcgatttatcggtcactcggctccggtccacctctacggaccgcgcaatacaattccaaatggttaaacgagccaaatttcgtagcggcatacgacattggcctttttgcctacttcttcctcagagaaaatgctgtcgaacatgactgtggcagaactgtttacagtagagttgccagagtgtgtaagaatgatgtgggtgggcgattcctgctggaggatacctggaccacctttatgaaagcgcgactcaattgcagtaggcctggcgaggtgccattctattataacgagctgcagtccgcatttcacctcccggaacaagacttgatttacggtgtctttacgaccaatgtcaattcaatcgcggcttcagcagtgtgcgcctttaatctgtcggccattagccaggcttttaatgggcctttccgctaccaggaaaatcccagagccgcttggctgccaatagcaaaccccatccccaactttcagtgtggtacgctgccagagacaggacctaacgaaaacttgaccgaacgctcacttcaagacgcacagcgactctttctgatgtcagaagcggtccagccggtcactccagagccatgcgtgacccaggactctgtacgcttttctcatctggtggtcgacctagtgcaggcaaaagacaccctctatcatgtgttgtatataggtacagagagcggcactatactgaaggcgctgtccactgcctcccgatccctgcatggttgttacttggaggagctgcacgtgcttcctccaggcaggcgggagcccctgcgcagccttcgcattttgcacagcgccagggccctctttgtggggctacgcgacggtgtcttgcgtgttccactggaacgctgcgctgcttacagaagccagggtgcctgcttaggagccagggatccttattgtggatgggacggaaagcagcagcgatgttccacccttgaggattcctcaaatatgtcactgtggacccagaacatcaccgcatgtccagtccgtaacgtcaccagagatgggggtttcggtccgtggagcccatggcaaccatgtgagcacctagatggcgacaactcggggtcctgcctctgtcgggcacgaagctgtgattcccctagacccagatgcggtgggcttgattgcctcggcccagccatccatatcgccaattgctcgcgaaatggcgcttggacaccatggtcatcttgggccttgtgttcgacaagctgtgggattggatttcaagttcgacagcgctcttgtagcaatcccgctcctagacacggaggcagaatctgtgtgggcaaatctagagaagagcgcttctgtaatgagaataccccttgtcccgtcccaatcttttgggccagctggggctcctggtctaaatgttcgagtaactgcggaggcggaatgcagtctagacgcagggcttgtgagaacgggaattcgtgccttggatgtggagaattcaagacatgtaatccagaggggtgccccgaagtgcgaagaaataccccgtggacaccctggctaccggtaaacgtgacacaggggggagcacgccaggagcagagattccggtttacgtgccgtgccccactggcggatcctcacggacttcagtttggacgcaggcgtacggagactcgcacatgcccggcagacggatctggtagctgtgatactgacgctctggtcgaggtcttgttgaggtcaggctctactagcccccacaccgtatcaggcggatgggctgcgtggggaccttggtcatcctgcagtagggattgcgagctaggttttagggtcagaaagcgcacctgtaccaaccccgaacccagaaatggtgggctcccttgcgtgggagacgccgctgagtatcaggactgcaatccccaggcttgcccagtgagaggggcttggagctgttggacttcttggtccccctgcagtgcaagctgtgggggtgggcattaccagagaacccggtcctgtacctcacctgcacctagtccaggcgaagatatctgcctaggtctgcacaccgaagaagccctttgcgctacccaagcctgccctggatggtccccatggagtgagtggtctaagtgtaccgatgatggcgcacagagcaggtcaagacactgcgaggaactcctgccgggtagttccgcatgtgccggaaatagctctcagagtcgcccatgcccgtacagtgaaattccggtgatactgcccgctagttcgatggaggaggccacagactgtgcgggaaaacgaaacagaacttatctaatgctgcgaagctcgcagccttcagggacccctctgcagtcactggactccttccatatccttctccagacagccaagctctgctgggggccacactgttttgaaatgggcagtatcagctcaacttggtggcctagggctagcccagcatcatgggcactcgggtcatag

SEQ ID NO: 53861 - DNA, 3456 bp, Artificial Sequence
  Description of Artificial Sequence: Synthetic coding sequence
atgccctgcgggttttcacctagcccagttgcccaccatttagttccaggccctcctgacacaccagcccagcagctgcgctgcggctggacagtcggtgggtggctcctctccctggtgcgcggactcttgccatgtctccccccaggagctaggacggcggaagggcctattatggtgctggctggcccactcgccgttagtctgctcctgccatctctgacactgctggttagccacctgtcatctagccaggatgtcagttccgagccttcgtcagagcagcaactttgtgccctaagtaaacatcccactgtggcctttgaggacctacagccatgggtgagcaattttacctacccaggggctcgagacttttcacagctggccttggatcccagcgggaaccagctgattgtgggggcaaggaactatctgtttcggttgtccctggcaaacgtgtcgctgctgcaagctaccgaatgggcaagcagcgaagacactagacggtcttgccagtccaagggcaagactgaggaggaatgccagaactacgttagagtccttatcgtcgctggacgaaaggttttcatgtgtggtaccaatgccttttctccaatgtgcacgtctaggcaggtagggaacctgagcagaaccatcgaaaagattaacggcgtggcacgctgtccttacgacccaaggcacaactcaaccgctgtgatttcttctcagggagagttatacgctgccactgtgatcgatttctccggccgtgatccagcaatctacagaagtctgggttctgggcctcccctgaggactgctcagtacaacagtaagtggctgaatgaacctaattttgtggccgcatatgatatcgggttgtttgcctattttttcctgcgggagaacgcggtggaacatgactgtgggaggacagtctatagccgcgtagcaagagtgtgtaagaacgacgtggggggacgatttctgctcgaggatacatggaccaccttcatgaaggctcgtcttaactgcagcagacccggagaagtgcctttttattacaacgagctgcaaagtgcttttcacctcccagagcaggacctcatttacggtgtttttaccacgaacgttaattcaattgccgcaagcgcagtgtgtgcctttaacctaagtgccatatcacaggcttttaacggtccatttcgatatcaagaaaatccaagggcggcatggctgcctatagctaatcccattccaaattttcagtgcggaacccttccggagactggtcctaacgagaacctcaccgaaagaagcctacaagacgcccaacggttattcttgatgagtgaagcagtgcaacctgtgacaccagaaccgtgtgtcacacaggactctgttcgcttttctcacctggtggtagatttagttcaggccaaagataccctttatcacgtcttgtacattgggaccgagtccggcaccattcttaaggctcttagcaccgcttcacgctccttacatgggtgctacctcgaggagcttcacgtgctgccacccggaaggcgagagccgttgaggagcctgagaatcctccactccgctcgggctctgtttgtcggactgcgggacggtgtactgcgagtgccccttgagcggtgcgctgcctaccggtcccaaggcgcttgtctgggagcaagagatccatactgcggctgggatgggaagcagcaaaggtgttccacattggaagactcttccaacatgagcctgtggacacagaacatcactgcatgccccgtcaggaatgtcaccagggacggcggatttgggccttggtcaccttggcaaccatgtgaacacctcgatggagataatagcggttcttgtttatgccgcgcacggtcgtgtgactctcccaggccgcgatgcgggggactggattgcctaggtccggctatccacatagccaactgctcgcgtaacggcgcatggactccatggtcctcatgggctttatgttccacatcctgtggaatcggtttccaggtaagacagaggtcctgttcaaatcctgcacctcgacatggagggcgaatttgcgtcgggaagtctagagaggagagattttgtaacgagaacacaccttgtcccgtccccatcttttgggcaagctggggctcctggtccaaatgttcaagtaattgcggagggggtatgcagagtcgacgcagggcctgtgagaacggtaattcttgcctcgggtgcggggtggagtttaaaacatgtaatcctgaaggatgccccgaggttaggaggaacactccgtggactccatggctgccggtaaatgtgacccaggggggagctagacaggaacagcggttccgatttacgtgcagagctccgctcgccgatccgcatgggctccagtttgggagaaggcgtaccgaaacccgcacatgccccgcagacggcagcggctcttgtgatactgatgcactcgttgaggttcttctgaggtccggatcaacatctcctcacaccgtttcgggtggctgggccgcatgggggccttggagtagttgcagccgagattgcgagctgggctttagagtgcggaaacggacatgcactaaccccgagcctagaaacgggggtctgccctgcgtcggagacgccgcagagtatcaagactgcaacccacaggcatgtccagtccggggagcatggagttgctggaccagctggtctccctgttcagcctcttgtgggggtggacattaccagcggaccaggagctgcaccagtccagctccctccccaggtgaagacatctgtctcggcctccatactgaagaagctctatgtgcaactcaggcctgtcccgaagggtggagtccttggtccgaatggtcaaagtgtacggacgacggagcccagagccggtctaggcactgtgaggaactcctgcccggaagtagtgcatgcgctgggaatagttcacagtcgagaccttgtccgtactccgagattcctgttatactacctgcctcctcaatggaagaggcaacggactgcgccggattcaacctaattcacctcgttgccaccggcatctcctgttttctgggatccggacttctgaccttggctgtgtatctgtcttgtcagcattgccagaggcagtcccaggagtcaacactggtgcatcctgctacccccaatcatctgcattataagggcggtggaacacccaaaaatgaaaagtatacccccatggagttcaagaccctaaacaaaaacaacttgattcccgatgacagagcgaacttttaccccctacagcagaccaatgtgtacacgaccacatattacccctccccactcaacaaacacagctttcggccagaagcaagccccggacaaaggtgtttcccaaactcttag

SEQ ID NO: 53862 - DNA, 3267 bp, Artificial Sequence
  Description of Artificial Sequence: Synthetic coding sequence
atgccttgcggcttttccccgagtccagtggcccaccatctcgtccccggtcccccagatactccagcccagcagttgagatgcggatggacggtggggggatggctgctgtccctggtcagaggactgcttccctgtcttcctccgggtgccagaactgccgaaggaccaatcatggttctggcgggtccgctcgccgttagcctgctgctgcctagcctgacactcttagtgagtcacctgtcatcttcccaagatgtgtcatcagagccaagttcggagcaacagctgtgtgctctgagcaagcaccctactgtagcctttgaggatctgcagccttgggtgtccaacttcacctatcccggagcacgcgactttagccagctggccctcgatccaagcgggaaccaactgatcgtcggggctaggaattatctctttcgcctctcattggcgaacgtctcccttctccaggctactgaatgggcaagctccgaggatacccggaggagctgtcagtcaaaagggaagactgaggaggagtgtcagaattatgtacgcgtcttgatcgttgcaggccgtaaggtgtttatgtgcgggaccaacgcattcagtccaatgtgtacttcccgtcaggtgggcaatctgagtagaacaatcgagaaaataaacggagtggccagatgcccctacgatccacgccacaatagtacagccgttatctcgagccaaggcgagctgtatgctgctaccgtaatagatttctcgggcagggacccggcaatctatcgctcactaggatctggcccacctctgagaacggctcagtacaactcgaaatggctgaacgagcctaactttgtcgccgcttacgacatcggacttttcgcatacttcttcctgcgggaaaatgctgtggagcacgactgcggccgtactgtgtattcgcgagttgccagagtttgcaaaaatgatgtcggtggtaggttcttgttagaggacacatggaccacatttatgaaagctcggctgaattgctctagacccggtgaagtgcctttttactataatgaattacagtctgccttccatctgccagagcaggatttgatttatggggtgttcaccaccaatgtgaactccatcgctgcctctgccgtgtgcgcgttcaatctgagcgctatctcccaggcctttaacgggccatttaggtatcaggaaaatccacgcgcagcttggctgcctatcgcaaaccctattccgaatttccagtgtgggacccttccggagacgggccctaatgaaaacctgacagagcgttctttgcaggacgcccagaggctgttcctgatgtctgaggccgtccaacccgtcacgcccgagccgtgcgttacccaagactcagtccgatttagccatctcgttgtagatttggtccaagcaaaggataccctgtaccatgtcctgtacatcggaacggagagtggtaccatcctgaaagctctctccaccgcctcgaggagcctccacggctgctacctagaagaactgcatgttctaccgcctggccgacgtgagccactgagatcattacgtattcttcattcagcaagggccctcttcgttgggctgcgggacggagtcctaagagtacctctggaaagatgcgccgcttaccgatcccagggggcatgtcttggagccagggatccttactgcggctgggacggcaaacagcagagatgctccactctggaagattcatcaaatatgtcgctttggacgcagaatataacagcctgtcctgtacggaatgtgactagggatggcggattcggtccctggtccccatggcagccgtgcgagcacctggacggtgataattctggctcttgcctgtgtcgggctaggagctgtgactctcctaggcctcggtgcggaggcctcgactgtctgggaccagccatccacattgccaactgttcccggaatggggcttggacaccgtggagctcctgggccctctgcagtacatcttgtgggatagggtttcaggtgcggcagcggtcctgtagtaatccagctcccaggcatgggggtcgaatttgtgtgggcaagtctcgtgaggagcggttctgtaatgagaacaccccatgtccagtgcctatattttgggcttcctgggggagctggtctaagtgttcttccaactgcggcggaggcatgcagtcgcgcaggcgcgcttgtgaaaacgggaacagttgcttaggttgtggcgtcgaatttaaaacctgcaatcccgaaggctgtcctgaagtgcgtcggaatactccctggactccgtggctcccggttaatgttacccaggggggagcaagacaggagcaacggttcagatttacatgtcgtgccccacttgcagacccacacggcttacagtttgggaggagacggacggagacccgtacatgcccagcagacggctccggatcctgcgacacagatgcactggtggaagtactcctgagatctgggagtacgagcccacatactgtgtcaggaggttgggcggcttgggggccatggtcctcctgtagcagggattgtgagctgggtttcagggttaggaaacgtacttgcactaaccccgagcctagaaacggcggtctcccctgtgttggagatgccgctgagtatcaggactgcaatccgcaagcgtgtcccgttaggggggcttggtcatgctggactagttggagcccttgttctgcaagctgcgggggagggcattaccagcgaacacggagctgcacgtcacctgccccaagcccgggagaggacatctgcttggggctgcacacagaggaagcactgtgcgctacccaggcatgccctgagggctggtccccttggtccgaatggtcaaaatgcacggatgatggcgctcagtctcggtctcgtcactgcgaggaactgctaccgggtagcagcgcatgtgccggaaacagttcccagtccaggccttgtccctactctgagatcccagtgatcttgcccgcatcaagcatggaagaagcaaccgactgtgccggatttaacctgattcatttggtggcgacgggaattagctgttttctggggagcggccttctgactctcgccgtgtacctatcttgccagcattgccagagacagagtcaggaatcaaccctagtccatcccgcaacgcccaaccacctgcactataaaggaggagggaccccttag

SEQ ID NO: 53863 - DNA, 3174 bp, Artificial Sequence
  Description of Artificial Sequence: Synthetic coding sequence
atggtgcttgccggacctttggctgtgagtcttctgctgccctctcttacgcttctcgtctcccatctcagctcctcccaagatgtttcgtctgagccgtcctctgaacaacagctctgcgcgcttagcaaacatccaactgtagctttcgaagatctgcagccatgggtcagcaacttcacatacccaggtgcgcgtgacttttcccagctggctttggatccgtcaggaaaccagttaatcgtaggggctcgtaactatctgtttagactttcactagccaacgtgtccctactccaggccactgaatgggccagcagcgaggatacccggaggtcatgccagtcaaagggaaagacagaggaggagtgtcagaactatgttcgggtgttaattgtagccggtcggaaggtgtttatgtgtggaacgaacgccttcagtccaatgtgtacttctagacaggttggaaacctttcaagaactatcgaaaagattaatggtgtggctaggtgcccttatgatccccgacataactcaaccgccgtcatttcctcacagggtgaactttatgcggctacagtgatagatttcagcggcagagacccagccatttatcggtctcttggatccgggccacctctacgaacggcacagtataactctaagtggttgaacgagcccaattttgtggcagcttatgatattggactattcgcctatttctttctacgggagaacgccgtagaacatgactgtggcaggacagtctacagtagagtggcgagagtatgtaagaacgacgtcggcggacggttcttactagaagatacgtggaccacatttatgaaggcgagacttaactgctcccgacccggagaggttcccttttactacaacgagcttcaaagtgcttttcacctgcctgagcaggaccttatatacggagtttttacaactaacgttaactccatagccgcatcagcggtatgtgccttcaatttgtctgccatcagccaggcgttcaatgggccttttcgctaccaggagaatccccgtgctgcatggcttcctatcgccaatcctattcccaatttccaatgcggcacgctccccgaaaccggacccaacgaaaacctgactgaacggtccttgcaggatgcacagagattgttccttatgtccgaagcggtccagccggtgacccccgaaccatgtgtgacccaggatagtgtcaggttctcacacctggttgtggacctcgtgcaggcgaaggacactctttatcatgttctttacattggcaccgagtctgggactatcctgaaggccctgtccacagcgagcagatcactgcacgggtgttacctagaggaactccacgttctgccccctgggagaagagagcctctccgcagcctccgcattctgcattccgcccgtgctctattcgttggcctgagggatggggtgctgcgggtaccattggaaagatgcgcagcataccgctcccagggtgcatgtctaggtgcgagggacccttactgcgggtgggatggcaagcagcagaggtgctccaccctggaggacagttctaatatgtcgctgtggacacagaacatcaccgcgtgtcctgtccgaaatgtcactagggacgggggattcgggccatggagcccttggcagccatgcgagcatctggatggggacaacagcggctcctgtttgtgtcgagctcgaagttgtgacagtccaagaccgaggtgtggcggactcgattgtctgggtcctgccatccatattgctaactgctccagaaatggcgcttggacaccatggtcttcatgggctctatgcagtacatcctgtggtattggattccaggttcggcagcggtcctgctcaaatcccgctccacggcacggcggtagaatttgtgtgggaaagagtcgtgaagagcgattttgcaacgagaataccccctgcccggttcccattttttgggcgagttggggcagctggtcaaaatgcagctccaattgtgggggaggcatgcagtctcggaggcgcgcttgtgagaatggcaactcttgcctcgggtgtggagtcgaattcaaaacttgcaacccagaaggctgtccagaagtgagaaggaacaccccgtggactccatggcttcccgtgaatgtgacacaaggaggggcacgacaggagcaacggtttcgctttacatgtagggcccctcttgccgacccccatggcctgcagttcggacgacggagaacagaaactagaacctgccccgcagacggatcaggttcctgcgacactgatgctctagtggaggtgcttcttcgaagcggatccactagcccccacactgtgtccgggggttgggctgcatgggggccatggagctcttgctcgagggactgcgagctgggattccgagtgaggaaacgcacctgcactaaccccgaaccccgaaacggtgggctcccatgcgtgggcgacgcagcagaatatcaagactgtaacccacaggcctgtcccggagaagacatatgtctgggtcttcacactgaagaggcgttgtgcgcgacgcaggcatgccctgaaggttggagcccatggtccgagtggtccaagtgtacggatgacggggctcagagccggtctcgacattgcgaggagctgctgcccggatctagcgcttgcgcaggcaactcttcacaaagccgaccctgcccttactccgagatccccgtgatcctccctgctagctcaatggaagaagccaccgattgcgcaggatttaatctgatccatctagttgcaacaggcatttcgtgctttttagggagcgggctgctcactcttgcagtgtacctgtcttgtcaacattgccagaggcagagtcaagaatccactctggtccacccagccactcctaaccatctgcattacaaggggggaggcacacctaagaacgagaagtatacgcctatggaatttaagacactgaacaaaaataacctgatacctgacgatcgagctaatttttacccactccagcaaactaatgtttacacgacgacctactaccctagtccactgaacaagcactctttccggcctgaggccagtcccggtcagaggtgttttccaaattcttag

SEQ ID NO: 53864 - DNA, 429 bp, Artificial Sequence
  Description of Artificial Sequence: Synthetic coding sequence
atgccctgcggcttctcacccagtcccgtagcccaccaccttgtgccgggtcccccagatacccccgctcagcaacttaggtgcggctggacagtggggggttggctgctctccctcgtacggggtttactgccgtgtctccctccaggcgcaagaaccgccgagggcccaatcatggttttggcaggtcctcttgcagttagtctgttgcttcctagtttgacactcttagtgtcccacctgagtagctcccaggacgtgtcatccgaacctagcagtgagcagcagttatgtgccttgtcaaagcacccaactgtagcctttgaggatctgcaaccctgggtctccaatttcacataccccggtgctcgtgacttcagccagttggcccttgacccatccggcaatcaactgattgtaggcgcttag

SEQ ID NO: 53865 - DNA, 255 bp, Artificial Sequence
  Description of Artificial Sequence: Synthetic coding sequence
atgccttgcggattcagccccagtccagttgcccatcatctcgtgcctggtcccccagatacacctgctcaacagctgcggtgcggttggactgtgggtggatggctgctatcgctagtcagaggcttactgccctgtctaccgccaggtgcgagaaccgctgaaggtcccattatggtccttgctggacccttggctgtaagtctgctgctgcccagcttgactctgcttgtcagtcatctgtctagcagctag

SEQ ID NO: 53866 - DNA, 3618 bp, Artificial Sequence
  Description of Artificial Sequence: Synthetic coding sequence
atgctgcacctgtctgccgaagaggcgattggatgtgtgagagttagacggagcttcatcgatgagcttgcgtttggacgaggtcacagcactggtactggaaagcaaaaacggagagacagagtctccggatcatcctggtgtctggcttgcgtctcttggatgccatgcggtttttcaccttcccctgtcgcacaccatctggtacccggtccaccggacactcccgctcagcaactccggtgtggctggaccgtcggcggttggctgttatcactagtcagaggcctgttgccctgtctgccgcctggcgcaaggaccgccgagggccctatcatggttctggcaggaccactggctgtgagtttgttgttgccgtccctcacactccttgtctctcatctgagctcaagtcaggacgtaagctctgaaccctccagcgagcagcagctatgcgcattaagtaaacatccaacggtggcctttgaagaccttcagccgtgggtctctaacttcacctatccaggtgctcgagatttctctcagttggcacttgacccatcaggaaaccagctaatcgtgggagcgagaaactacctgttccgattatctctggccaatgtctccttgctccaagctacggagtgggccagtagtgaggacactcgccgatcctgccagagcaaaggcaagaccgaggaagagtgtcagaattacgtgagggtactcatcgtcgctggcaggaaagtttttatgtgtggaacaaacgccttctcgcctatgtgcacaagcaggcaggtgggaaacctttctaggactattgagaagattaatggtgtggcccgttgtccctatgaccctagacacaactccactgcagtcatatcaagtcaaggtgagttatacgctgccacggttatcgacttctctgggagggaccccgcaatctatcgaagcctcggatctggaccacccttgcggactgcccagtataactcgaagtggttgaacgaacccaactttgtcgccgcatacgacattgggttgttcgcctacttctttctccgagagaatgcagtcgaacatgactgcggcaggactgtttacagccgcgtggccagggtttgtaagaatgacgtggggggtcggttcctgctcgaggacacctggacaacctttatgaaagctcgcctcaactgtagtcgtccaggggaggttcccttttactacaacgagctgcagtctgcgtttcacctcccagaacaggatctgatttatggggtcttcactaccaatgtgaactcaattgccgctagcgcagtgtgtgccttcaacctcagcgctatctctcaagcattcaatggaccttttaggtaccaggagaatcccagagccgcatggctgccgatagccaaccctatacccaattttcaatgtggcacactgcccgagaccgggcctaatgagaaccttactgagagatccctccaggacgcgcagcggctgtttttgatgtcagaagccgtgcagccagtgactcccgaaccctgtgtaacacaagacagtgtaagattctcacacctcgtcgttgacttagttcaagccaaagacaccctctaccacgtcctgtacatcggcacagaatccggtaccattttgaaagcattgtctactgcaagtagatccctacatggttgttacctggaagagctgcatgtgttacctccaggccgacgcgaaccactgaggagcctccgcatcttacatagcgcgcgagcgctttttgtaggtctgagggacggcgtgctgcgggtgcctctggagcgatgtgccgcttatcggagccaaggcgcttgcctaggggctcgtgacccatactgtgggtgggacggaaaacagcaacggtgctcaacactggaggatagtagcaacatgtccctgtggactcagaacatcacagcctgtccagttaggaatgtgacgcgggatggaggctttggtccctggagtccatggcagccatgcgagcacctggatggcgataacagcgggagctgcctgtgccgggctcgatcctgcgattcgccaaggcccagatgcggaggcctcgactgtctgggtcccgcaatccatattgccaactgtagtagaaacggggcatggaccccatggtcatcatgggcgttgtgctctactagttgcggcatcggcttccaagtccggcaaagaagctgttcaaaccccgctcccagacacggcggacgcatatgtgttggaaagtccagggaggagcgcttctgcaacgagaacacgccctgccccgtgcccattttctgggccagttgggggagttggtcaaaatgcagttctaattgtggcggaggaatgcagtcacgcagacgagcttgtgagaatggcaactcctgtttgggatgcggagtggagttcaaaacatgcaaccctgaaggatgcccagaagtccgacgcaatacaccctggaccccttggctgccagttaacgttacacagggaggggcaagacaagagcagagattcagatttacttgccgcgctcctttggctgacccacacggcttacagtttgggaggcgtcggacagaaacccggacctgtccagccgacgggtctggctcctgtgacacagatgctctggtggaggtgctccttagatctgggagcaccagtcctcataccgtaagtggagggtgggcagcgtggggaccatggagctcatgctcccgtgattgtgagctgggttttcgagtccggaaacgtacgtgtacaaacccagagccccgaaatggtggcctgccttgtgttggagatgctgccgagtaccaggactgcaatcctcaagcttgccccgtgcggggtgcctggtcttgttggacgtcatggtcaccgtgttcggccagctgtgggggaggccactaccaaagaacgcgttcatgcaccagccctgcgccttccccaggagaagacatttgcttgggcttgcataccgaggaagcgctctgcgctactcaggcttgtcccgagggctggagtccttggtccgagtggagcaaatgcacggacgacggtgctcagtctaggtcaaggcactgtgaagagcttctgcctggaagttccgcttgcgccggaaactcctcgcagtcccggccttgtccttactctgaaatacccgtgatactcccggcttcttccatggaggaggcaacggactgtgctggcttcaaccttatccacctagtggccactggaatttcttgtttcctcggatctggtctcctcacattggccgtgtacctatcttgccagcattgtcagaggcaatcacaggagtccaccctcgttcaccccgctaccccaaaccatttacattacaagggaggcggaaccccgaaaaacgagaagtatactccaatggagtttaagacactgaataagaataacctgatccctgacgatagggccaacttttacccactgcagcagaccaacgtgtacacaacaacatactacccttctccccttaacaaacactccttcaggcccgaagcctctccgggacaacggtgtttccctaactcttag

SEQ ID NO: 53867 - DNA, 3144 bp, Artificial Sequence
  Description of Artificial Sequence: Synthetic coding sequence
atgagaagcgaagctctgctcctgtatttcacactgctccactttgctggggctggcttccctgaagattctgaaccaatttctatctctcatggtaattacactaagcagtatcccgtgttcgtcggccataagcctgggagaaacacaactcagaggcacaggctagatatccagatgattatgatcatgaacggaactctatatatcgcggctcgcgaccacatttataccgtggatatcgacacctcccataccgaagagatatattgcagcaaaaagctgacttggaaatcacgccaggctgacgtagatacttgtcgcatgaaagggaagcataaggacgagtgccataactttatcaaagttcttctgaaaaagaatgacgacgcgttattcgtctgcggaactaatgcttttaatccctcctgccggaactataagatggacaccttggaaccattcggtgacgaatttagtgggatggccaggtgcccctacgacgcaaaacacgccaacgtggccctgtttgcggacgggaagctgtattcagctaccgttacagatttcctcgcaattgatgccgtgatctaccgaagcttaggagagtcacccacgctccgcacagtgaagcacgactccaagtggttaaaggaaccatacttcgtgcaggccgtcgactacggtgactatatatatttctttttccgcgagatcgcagtcgagtataatactatgggtaaagtggtattccctcgggttgcgcaggtttgcaaaaacgacatggggggatcccagcgtgtgcttgagaaacagtggacctcatttctaaaggctagactgaattgcagcgtgcccggtgactcacatttttatttcaacatcctgcaggcagtgaccgacgtaatccgtatcaacggccgagatgtggtcctcgccacgttctccaccccctataatagtatcccgggatccgcggtctgcgcctacgacatgctcgatatcgcatccgtgttcaccggtagattcaaggaacaaaagagtcccgatagtacatggacacctgttcctgacgagcgcgtccctaaacccagaccaggctgttgcgcaggaagctcgtctctggaacggtatgcaacatcgaacgaatttccagatgatactctgaatttcattaagactcacccactgatggacgaagccgttccatctatttttaaccggccttggtttttacgcaccatggtacgctatcgccttactaagatagcggtggacactgccgctggcccataccagaaccacacggtggtgttcctgggctctgagaaggggataatcctgaagtttctcgccaggatcggcaattccggcttccttaacgactccctgttcctggaggaaatgtctgtgtacaatagcgagaagtgttcctatgacggcgtggaggacaagcgcatcatgggtatgcaactggatcgggctagtagcagcttatatgttgctttctctacgtgcgtgataaaggttcctcttggccgatgtgaacgctacggtaagtgtaagaaaacatgcattgcatctagagacccatactgcgggtggatcaaagaggggggagcgtgtagtcatctgtctccgaattcccggctcacgtttgaacaagatattgaacgcggaaacactgacggcctcggagactgccataactcatttgttgctctcaatgatatttccacccctctgcccgataacgaaatgtcatacaacactgtttacggacatagtagcagtcttctcccatctacgaccactagcgatagcactgcccaggaaggctatgaaagtaggggcggtatgttggattggaaacatctgttggacagtccagactccactgaccccttgggcgctgtgtcctctcacaatcaccaagacaagaaaggcgtcatccgcgagagttacttaaaaggccacgatcagttggttccggtgacccttttggcaatcgccgtcatcctcgccttcgtgatgggcgcagtgttctcgggcataaccgtatattgcgtttgcgatcatcgtagaaaggatgttgctgtggtgcagcggaaagagaaggaacttacacattcaagacggggaagtatgagctccgtcactaagctttcagggctttttggcgatacccagtctaaagaccctaaaccagaggctattctgacaccactcatgcataacggcaaactggccacccctggcaataccgcaaagatgttgatcaaggctgaccagcaccatctggatctaaccgccctgcctactcctgagagcacccctaccctccaacagaaaaggaagccttcccgcggttctagagagtgggaacgtaatcagaacctgatcaacgcatgcaccaaggatatgcctcctatgggatctcctgtgattcctaccgatctgcccctccgggcaagcccctcgcacataccttccgtggtcgtgctgccaataacccagcaagggtaccaacacgaatacgtggatcagcccaagatgagcgaggtagctcaaatggcgctagaagaccaggcagctacactggaatacaaaaccattaaagaacacctctcttccaaaagtccaaatcatggagttaatctagtggaaaatttggacagcctgccccctaaggtgccacagagggaagcatccctgggccctccaggggcatcgctcagccagacaggcctatctaaacgccttgaaatgcaccactcctcatcatatggggtggactacaagcggtcctaccctaccaactcactgacacgaagccatcaggcaaccacgctcaagcgaaataacaccaacagcagtaatagctcccacctcagccgcaaccaatcattcggccgtggcgacaatccccctcctgctcctcaaagagtcgacagtattcaggtgcattctagtcagccaagcggacaggctgtcaccgtgtccaggcagccttcactgaatgcctataacagtctaacaaggagtgggcttaaaaggacaccctctcttaagcctgatgtgcctccaaagccctccttcgccccattaagtacatcgatgaagcctaatgatgcatgcacctag

SEQ ID NO: 53868 - DNA, 1524 bp, Artificial Sequence
  Description of Artificial Sequence: Synthetic coding sequence
atgagcgtgtataactcagagaaatgttcatatgacggagtggaggataaacgtatcatgggcatgcagctggaccgtgcaagctcttcgctgtacgtggcgtttagtacctgcgtgatcaaagtgccgttgggcaggtgtgaaagatatggcaagtgtaaaaagacatgtattgcttcccgggacccctactgtggatggattaaggaaggcggtgcttgttcccacctaagccccaacagccgtctcacattcgagcaggacatcgagaggggaaacaccgatggtctgggagactgtcacaactcattcgtggccttaaacggtgtgattcgggaatcctatctcaagggacatgaccaactcgtcccagtgaccctgctggcgatcgccgtgatccttgcctttgtaatgggtgccgtctttagcggaattacagtctattgtgtctgtgatcacagacgtaaggatgtcgcagtggtgcagcggaaggagaaggaactcacacactcgcgcagaggctcaatgagcagcgttacaaaactgtccggcctgtttggtgatactcagtcgaaggatcccaaaccagaagccattttaacccccctgatgcacaacggtaagctggcaactcccggtaacacggcgaaaatgctgataaaagccgatcaacaccacttggatctgacagccctgccgacccccgaaagcactccaacgctccaacaaaaaaggaaacccagtcgcggtagccgcgaatgggagaggaaccagaacttaattaacgcctgcactaaagatatgcctccgatggggtcacccgtaatcccaacggatctgccattgagggcatccccctcacatattccgagcgtggtggtcctacctatcacacagcaaggataccagcatgaatacgttgatcagcctaaaatgagcgaagtggcacagatggcactggaggatcaggccgcaacactagagtacaagacgatcaaagagcacctgagcagcaaatctcctaatcacggcgtgaacctggtggagaatcttgatagcctgccccctaaggtaccacagcgcgaggcttcgctgggaccacccggtgcctcactgtctcaaacgggtctttccaagaggctagagatgcaccatagttcttcctacggagtggattataagcgatcttaccctacaaactctctgacacggagtcaccaggcaacaacactcaagagaaataatactaactcctccaacagcagccatctgtctcgaaatcaatctttcggtcggggtgacaacccccctccggctccacagagagtggactcgatccaggtgcactcaagccaaccaagtgggcaggccgttacagtgagtcgccaacccagcctgaacgcctacaatagtctgactcggagtgggttgaagcggacaccctctctgaagcccgacgtgccacctaagcccagctttgctccactaagtacttccatgaagcctaatgatgcctgtacatag

SEQ ID NO: 53869 - DNA, 3093 bp, Artificial Sequence
  Description of Artificial Sequence: Synthetic coding sequence
atgcgcagtgaagctttattactttacttcaccttgctgcattttgccggagccggttttcccgaggactccgaaccaatctctatcagccacgggaactataccaagcagtatcccgtgtttgttggacacaaacccggacggaacacgactcaacgccaccgactagatatccagatgatcatgatcatgaacggtacactttacatagccgctagagatcatatctacacagttgacatcgatacatcacataccgaggaaatctattgcagtaaaaaactgacctggaagagtcgacaggctgacgttgacacctgcagaatgaaaggtaagcacaaggacgaatgccacaatttcattaaagtcctactgaagaagaacgacgacgctctctttgtgtgtggtaccaacgccttcaatccttcctgtaggaactataagatggatacgctggaacctttcggcgatgagttttcagggatggcccgatgtccatacgacgccaaacacgctaatgttgcgctgttcgctgacggaaaactgtactcagccaccgtcacggattttctcgctatcgatgctgttatctacagaagcctcggagagtccccgacgcttcggacagtcaaacatgattctaagtggcttaaggaaccttactttgtgcaagcggtagactatggcgattacatctacttcttctttcgcgaaattgcggtggagtacaatacaatgggtaaggtggtcttccccagggtggcccaggtttgcaagaatgatatgggcggatcacagagagtgctggagaaacagtggacaagcttccttaaagccagactaaattgtagtgtgcccggagattcccacttctacttcaacatactgcaggcagtgacggatgtgattaggatcaatggcagggatgttgtgctcgcaacattttctactccatacaacagtatccctggatccgcagtgtgtgcgtacgatatgctcgacatcgcttcggtgttcacaggacgatttaaggagcaaaaatcacccgactctacctggaccccagtcccagacgaacgtgtgcctaaacccagacccggttgttgtgccggtagctcaagcttagagcgatacgccacgtcaaatgagttccccgatgacacattgaatttcattaagacccatcccctcatggacgaggcagtgccatccatattcaacaggccatggttcctgagaacaatggtccggtaccgactgactaagattgcggtggacaccgctgccggaccataccagaatcacacagtagtgttcctggggtctgagaaggggataatcttaaagtttctcgccaggatcgggaattcaggattccttaacgattctttattcctcgaagagatgagtgtctacaacagcgagaagtgtagttatgacggggtggaagacaagagaattatgggtatgcaactggatagggcctcttcaagcctttacgtagccttcagcacctgcgtgatcaaggtgcctctgggccgttgcgagcgctacgggaaatgtaagaaaacttgtatcgccagccgcgatccgtattgtggttggatcaaagagggaggtgcttgtagtcacctgtctccaaactccaggcttacttttgaacaggatatcgaacggggtaatacggatgggctaggcgattgtcataatagcttcgtggccttgaatgggcatagcagctccctgctgcctagcactacgacgtctgactccaccgcgcaagagggatatgagtccagaggcggtatgctcgactggaagcaccttctcgatagccctgactcgacagatccactgggtgcagtgtctagccataatcatcaggacaaaaaaggcgtgatccgggaaagctacctgaaagggcacgatcagcttgtgccagttacattgctcgcaattgcagtgatccttgcctttgtcatgggcgctgtgttcagtggaattactgtctactgcgtgtgcgaccaccgaagaaaggacgttgccgttgtgcagcgtaaagagaaggagctaacccatagccggaggggatccatgtcaagtgttacaaagctcagcggactcttcggagatacccagagtaaggatcccaagcctgaagccatcttgacacctctgatgcacaacggtaaactggctaccccaggcaacaccgccaagatgctcatcaaggctgaccagcaccacctggacctgacagctctgccgacacctgagagcacccctaccctgcagcagaagaggaaaccaagccggggatcccgcgagtgggaacgaaaccagaatctgatcaacgcatgcactaaggatatgccacctatgggctccccggtgatcccaacagacctgcctctgcgggcatcgccgtcccacatcccaagcgttgtggtgttgcccattactcaacagggctaccagcacgagtatgttgaccagccaaagatgagcgaggtggcccagatggccctcgaagaccaggctgccactctcgaatacaaaactattaaagaacatctctcaagtaagtctccgaaccacggggttaatctagtggagaatctggatagcttgcctcctaaagttccccagagagaagccagcttgggaccaccaggagcaagtttgtcccaaactggactctctaaacgtctcgagatgcaccacagctcttcatatggcgtcgactacaaaaggtcttatcccacaaatagcctgacacgctcacatcaggccacaactctcaagagaaataatacaaactcctctaattccagccatctttcccgcaaccagagctttggaagaggcgataaccctccacccgctccgcaacgcgttgactccattcaagtccattccagtcaaccatccgggcaggccgtgacagtgtcccgccagccaagccttaacgcatacaattctttaacccgcagcggcctcaagagaacgcccagcctgaagcctgacgtgccccctaagcccagcttcgcacctctgtcgacaagcatgaaacctaatgatgcatgtacttag

SEQ ID NO: 53870 - DNA, 1230 bp, Artificial Sequence
  Description of Artificial Sequence: Synthetic coding sequence
atgaagaacgcgagcccagaaacgcgagaaggggttattagggagtcttacctgaagggtcatgatcagctcgtcccagtgaccttgctggccatcgctgttatcctcgccttcgtgatgggagccgtcttcagtggtattactgtgtattgcgtttgcgaccaccgtagaaaggatgttgccgtagtgcagcgaaaggagaaagaattgacgcactcaagaagaggctctatgtcctcagtgaccaaactcagtgggctgttcggcgacacacagtccaaggacccaaagcccgaagcgatcctcactcccctgatgcataatggcaagttggccacacctgggaatactgcaaagatgctaattaaggctgaccagcaccacctagatctgacagccctgcccacaccggaaagcactccaaccttgcagcagaaaaggaagccctcgcgtggatccagggagtgggagcgtaaccagaacctaatcaacgcctgtaccaaagacatgccccctatgggctcccctgtgatccctaccgatttaccgcttagagctagcccaagccacattccgtctgtcgtggtactgccaatcacacagcaagggtaccagcacgaatatgtcgatcagccgaagatgagcgaagttgcacagatggcacttgaagaccaagccgctaccctggaatacaagacaattaaagagcatctctcttccaagagccctaaccatggggtgaatctcgtggaaaatctggacagtctgcccccaaaagtccctcaacgggaagcctctcttggccctccaggtgcctctctgtctcagacagggctgagtaagaggcttgaaatgcaccattcctcttcctacggtgtggactacaaacgaagttacccaacaaattctctgaccagatctcaccaggccacaacactcaaaagaaacaatacaaatagctctaactcctcacatctttccagaaaccagagctttggaaggggtgacaatccaccacccgcaccacagagggtcgactctatccaagtgcatagtagccagccaagcggccaagcagtgactgtgtctagacagccttctctcaacgcgtacaacagtttgactaggagtgggttaaagagaactccttctttgaagcccgacgttccccctaagcctagcttcgcacccctgagcacaagtatgaaacccaatgatgcgtgcacatag

SEQ ID NO: 53871 - DNA, 345 bp, Artificial Sequence
  Description of Artificial Sequence: Synthetic coding sequence
atgagatccgaggctctcctcctgtacttcactctgctacactttgccggagccggttttcccgaagacagcgaaccaatttcaatctcacatggaaattataccaagcaatacccagttttcgtcggccacaaaccagggaggaacacgacccaacggcaccggctcgacatccagatgatcatgattatgaatggcacgctttatatcgccgcacgcgaccacatctacactgttgacatcgacacctcccacacggaggaaatctactgcagcaagaagctaacctggaaatcccgtcaggctgacgtggacacttgtaggatgaaaggaaaacacaaatag

SEQ ID NO: 53872 - DNA, 3093 bp, Artificial Sequence
  Description of Artificial Sequence: Synthetic coding sequence
atgcggtcagaggcattgcttctgtactttaccttattgcacttcgctggcgctggctttcccgaggattctgaacctatcagtatctctcacggaaattatacaaaacagtatcccgtgtttgtagggcacaagcctggcagaaacaccacccaaagacaccgcctcgacattcagatgattatgatcatgaacggcaccctgtatatcgctgcaagggatcacatttacaccgtggatattgacacctcacacactgaagaaatttactgttcaaagaagttgacatggaagtcccgacaggccgacgtcgacacttgtcgcatgaaggggaagcacaaggatgagtgccacaatttcattaaggtacttctgaagaagaacgatgatgccctgttcgtctgcggaaccaacgccttcaatccctcatgccgaaattataagatggatacacttgaaccttttggcgatgaattctccgggatggctcggtgtccgtatgacgccaagcacgccaatgtagcgttgttcgctgacgggaaactctattctgctactgttacggatttcttagccatcgatgcagtgatctaccggagcctcggagagtctcctactctgcgcaccgtgaaacatgatagcaagtggctgaaggaaccctacttcgtgcaggccgtagactatggcgactatatctatttcttttttagggaaattgcagtggagtataacacaatggggaaggtggtctttccccgtgtggcccaggtctgtaaaaatgacatgggcggtagtcaacgggttctcgagaagcagtggacatccttcctgaaggctcggttaaattgtagcgttcctggggattcccatttttatttcaacatccttcaggcagtcacggacgtcatccggattaacggacgggatgtggttctggcaacgttctccaccccatacaactcaattcccggatctgctgtgtgtgcatatgacatgctagatatcgcgtccgtctttaccggacgctttaaggaacagaagtcaccagacagcacatggaccccagttcccgatgaaagggtgccaaaaccaagacccggatgttgtgctgggagctctagcctggaaaggtacgccacaagtaacgaattccccgacgatactctcaatttcatcaaaacccaccccctgatggacgaagccgttcctagcatctttaatcgtccttggttccttcggacaatggtgcgatatagactcactaaaatcgctgtggacacagcggctggtccataccagaaccacaccgtggtattcctgggttcagagaaaggcattatattgaaatttctggccaggatcggcaattctggctttctcaacgactctctgttcctggaggagatgtctgtttataattcagagaagtgtagctacgatggggttgaggacaaacgtattatgggcatgcagctagaccgggctagtagctccctctatgtggccttttctacctgcgttataaaggttccgctggggagatgcgagagatatgggaaatgcaagaagacatgtatcgcatctcgcgacccttattgtggatggattaaggaggggggagcctgcagtcatctcagccctaactctcgcctgactttcgaacaggacatcgagcgaggcaatactgacgggctgggggactgccataatagctttgtcgctcttaacggacactcgagctcactgctcccgagtactactacatccgacagcaccgcacaagaaggctatgaaagtagagggggaatgctagactggaaacatctgctggacagtcccgatagcactgacccattgggcgcagtctctagccacaatcaccaggacaaaaaaggagtaattagggagagctacttgaaaggacacgatcaacttgtgcctgtaaccttgctggccattgctgtcatcctcgcattcgttatgggcgcagttttttccggtatcacagtgtactgcgtgtgtgatcataggcggaaggacgttgcagttgttcagaggaaagaaaaagaacttacccattcacggagaggcagcatgtcatcagtgaccaagctcagtggattatttggggatacgcagagcaaggatcctaagcctgaagctatcttgactccacttatgcataacggcaagctagcaacccctggtaatacagcgaagatgctcattaaagctgaccagcatcatctcgacctgaccgccctgcctacccctgagtccacccccacactacaacagaagcggaagccctctagaggtagtcgggaatgggaacgcaaccaaaacctgataaacgcctgcacaaaggatatgccaccaatgggatctccggtaataccaacggaccttcctctgagagcctctccctcccatataccatctgtggtggtgttacccatcacccagcagggttatcagcatgaatacgtggaccagccaaaaatgtccgaggtggcccagatggctctggaggaccaggctgccacgctggaatacaagaccattaaagaacatctctcctcaaaaagccccaaccacggcgttaacctcgtggagaacctggacagtctccccccaaaggtcccccaacgtgaggcatcattgggtcctccaggagcttccctttcccaaacgggactctcgaaacggttggaaatgcaccattcaagtagttatggagtggattacaaacgttcttaccctacaaacagcttaacaagatcccatcaggccacgacgctgaaaaggaataatacgaacagcagcaactctagccatctatcccgaaatcagtcttttgggcgaggagataatcctcccccagccccacagagggtggattctattcaggtccacagtagtcagccgagcggacaggccgtgactgtcagtcgccagcccagcctgaacgcctacaactccctcactcggagtggactgaagcgcacgccttcgctcaagccagacgttccgccaaagccctctttcgcaccgctgagtacatctatgaagccgaatgacgcatgcacctag

SEQ ID NO: 53873 - DNA, 1374 bp, Artificial Sequence
  Description of Artificial Sequence: Synthetic coding sequence
atgaagacaggtcactcttcctctcttttaccgagtacaactacctccgattccactgctcaggagggctacgagtcaagggggggaatgctggactggaagcacctgctggatagtccagactccacagaccccttgggagctgtgtcatctcataatcaccaggataagaagggggtgattcgggagtcttacttgaagggtcatgaccaactcgtcccggtcactctcctcgctatcgccgtgatcctggccttcgtcatgggtgccgttttcagcggtattactgtgtattgcgtgtgtgatcacaggcgtaaagacgtcgctgtggttcagagaaaggaaaaagagctgacccactctcggcgtgggagtatgagcagcgtgacgaaacttagtggcctgtttggcgacactcagtctaaggaccctaaaccggaagctattctaacccccctcatgcacaatggcaaactcgccaccccgggtaataccgcaaaaatgttgatcaaagctgatcaacaccatctggatctgacagcactgcccacacccgagagtactccaacccttcagcagaagagaaaaccgtctcggggtagtcgtgaatgggaaagaaaccagaacctgataaatgcgtgcacgaaagatatgccaccgatgggctcacctgtgattccaaccgacctgccactgcgtgcctcccccagccatataccctccgtggtagtacttcccattacacagcagggctatcaacacgaatacgtggatcagccaaagatgagcgaggtggcacaaatggccttagaggatcaagccgcaaccctagagtataagactatcaaggagcacctcagcagtaagagtccgaaccacggcgttaatctggtcgaaaatctggactcactgccacccaaggttccgcaaagagaggcaagcctaggtcctccgggagcttctcttagccagaccggactgagcaaacggttggaaatgcaccactcaagctcatacggcgtcgattacaagagatcctacccgacgaatagcctgacgaggagccaccaagccaccacactgaagcgtaataacacaaattcaagcaactccagccatcttagccgtaaccagagctttggacggggtgacaacccgcctcccgctcctcagcgcgtggattcaattcaggtccattctagccagccaagcggccaggccgtgaccgtgagtcggcagccgtcactgaacgcctacaactccctgacacggtccggtctgaagcggactccatctcttaagcctgacgttccccctaagccttcctttgctcccttgtcaacatcaatgaagcctaatgacgcctgcacgtag

SEQ ID NO: 53874 - DNA, 480 bp, Artificial Sequence
  Description of Artificial Sequence: Synthetic coding sequence
atgagatcagaagccctgcttctctatttcaccctactgcatttcgctggcgcaggttttccggaggacagcgaacctatttctattagtcacggtaattacaccaagcagtaccccgtctttgtcggccacaaaccgggacgaaataccactcaacggcaccgtctcgatatccagatgatcatgattatgaatggtactctctatattgcagccagagatcacatctatacggtggatattgatactagccataccgaggagatctattgtagcaagaagctcacctggaaatcacgtcaggctgacgtggatacatgcaggatgaagggaaaacacaaggatgaatgccacaacttcattaaggtgctgctgaaaaaaaatgatgacgcactctttgtgtgcgggacaaatgctttcaatccatcctgccggaattataagatggacactcttgaaccattcggagatgaattttag

SEQ ID NO: 53875 - DNA, 2049 bp, Artificial Sequence
  Description of Artificial Sequence: Synthetic coding sequence
atgcagaccccgagggcaagcccgcctcgtcctgcactactccttttgctgcttctattagggggtgcccatgggctctttcctgaggaacctccgccacttagtgttgcaccgagggactacctgaaccattacccggtatttgtgggcagcggcccaggtcggcttactcctgctgaaggtgccgacgacttgaatattcagagagtgctaagagtcaatcggacactgtttatcggcgaccgagacaacctttatcgggtagagttagagccacctaccagtaccgagttaagataccagagaaagctaacgtggcgaagtaatccgagtgacatcaatgtgtgtaggatgaagggcaagcaggaaggcgaatgtcgcaattttgttaaggtcttattgttacgagacgaatccacgcttttcgtgtgcgggtctaatgccttcaatccagtgtgtgcgaactatagcatcgatacactccagcccgtaggagacaatatctctgggatggccaggtgcccctacgatcccaaacatgcaaatgttgctctgtttagcgacggcatgctgttcacagcgaccgtgactgacttcctcgccatcgacgccgtgatctacaggagcttgggggatcgccctacactgaggactgttaaacacgattctaaatggtttaaagagccctatttcgtacacgccgtcgaatgggggtcacatgtgtacttcttcttccgagaaatcgcgatggaattcaattatctggaaaaagtggtagtatcacgggtagcccgtgtgtgcaaaaacgatgtcggaggaagcccacgagtgctggagaaacagtggaccagctttctcaaggcacgactaaattgctccgtaccaggcgatagccacttctattttaatgtgctgcaggcagtgaccggcgtggtatcactgggagggagacctgtggtcctggccgtcttcagcaccccttcaaatagcattccgggttccgctgtgtgtgcatttgatctcacccaggtggcagccgtttttgagggacgatttcgtgaacaaaagagccccgagagtatttggacgcctgtgccggaggatcaggtgcctagacctcgaccaggctgttgtgccgcaccaggaatgcagtataatgctagttctgctttgccagatgacatactaaatttcgtcaagacacatcctttgatggatgaagccgtcccttcactgggccacgctccctggatcctccgcactcttatgcgccatcagctgactcgggtagccgtagacgtcggcgctggaccttggggaaaccagaccgtggtctttttaggctctgaagctggcacagtgctcaaattccttgtgcgacctaacgcctctacatcgggtacatctggccttagtgttttcctcgaggagttcgagacttatcgccctgaccgctgtggcaggcctggcggaggagaaacaggacaacgcctgcttagtctggaactggatgccgcttccggcggtttgctggccgcatttccacgctgcgtggtgagagttccggtggccagatgccagcaatacagcggctgcatgaagaactgtattggaagtcaagacccttattgtggttgggctccagacgggtcttgtatctttttgtctccagggaccagggctgcattcgaacaggatgtatccggcgctagcacctcaggtctaggcgactgtacaggcctattgagggctagcctgtcggaagatcgggcaggcctggtgagtgtcaacctactggtcacatcatctgtggcggcatttgtcgtgggggcagtcgtgtctggtttctctgtaggatggtttgttggtcttagggagaggcgtgaactagctcgccgaaaggacaaagaagcaattttggcccacggcgctggagaggccgtgcttagtgtttctcgtctcggcgagaggcgagctcaggggcctgggtctcgtagatggggattccagaaggctaggggtagcccgaggtgccgactgggggtttag

SEQ ID NO: 53876 - DNA, 2667 bp, Artificial Sequence
  Description of Artificial Sequence: Synthetic coding sequence
atgcagacgcctagagctagccccccaagacccgcactgctgctcttgcttttgctgctcggaggtgcacatggcctgttcccggaagagccccctcccctgtccgtcgctccaagagactatctgaatcactatccggtctttgtcggttccggccctggtcgcttaacgccggcagagggcgcagatgacctgaatatacagcgggttttaagggtgaacagaacactgtttattggtgatagggacaatctgtacagggttgaattggagccaccgacctcgacagagttgagataccagcggaagctcacctggagaagcaacccaagcgatattaatgtatgccgcatgaaagggaagcaggagggagagtgccggaactttgtcaaggtgcttctgctccgcgacgagagtacactgtttgtgtgtgggagtaacgctttcaatcccgtgtgcgccaattattcaatcgacactttgcaaccggtgggagacaatatcagtggtatggccagatgcccatacgaccctaaacatgctaacgttgccctattcagcgatggcatgctgtttacagccaccgtaacagattttctcgcaatagatgccgttatttacaggtccttgggcgacaggccgacactgcggacagtcaagcacgactccaagtggtttaaagagccatactttgtgcatgcggtggaatgggggtcacatgtgtatttcttcttccgagaaatcgccatggaattcaattaccttgaaaaggtagtcgtcagcagagttgctcgggtgtgcaagaacgacgtgggcggttccccaagggtgctggagaaacagtggacaagtttcctcaaagctcggctaaactgttctgtgcctggtgactcccacttttattttaatgttctgcaggcagttacgggggtagtgtcacttggaggtcgccctgtggttctcgctgtattctcgacaccgtccaattctatcccaggaagcgccgtctgtgcctttgacttgacacaggtggccgcagtgttcgaaggaaggttccgagagcagaagagtccagaaagtatttggacaccagtcccggaagaccaggtccctcgccctagacctggatgttgcgccgctccaggtatgcagtataatgcttcaagcgccctgcccgacgatatcctgaatttcgtgaaaacacatcccctgatggacgaagccgttccatctctgggccatgctccatggatcctccgtactctgatgcggcatcagttaactagggttgccgtggacgtaggcgctggaccatggggcaaccaaaccgtcgtgttcctcggcagtgaagccggtacagtcctgaaattcctcgtgcgacccaacgctagcaccagcgggacttcaggattaagtgtatttttggaagagtttgaaacctatagaccagaccgatgcgggaggccgggtggcggagagacgggtcagaggttgttaagccttgagcttgacgctgcctctggcggattgctggctgcatttcctaggtgtgtggtgcgtgtgcctgtcgccaggtgtcagcaatattccggttgtatgaagaattgcattggatctcaagatccttactgtggctgggcccctgacggcagctgtatcttcttgagccccggtacgagagcagcttttgaacaggatgtctccggcgcatccacttcgggcctgggcgactgtaccggcttactgcgtgcctcattaagcgaagatagggccggactcgtgagtgtgaacttgctggttacatcctcggtcgccgcattcgtggtcggagcggtagtgtctgggttttccgttgggtggtttgttggtctgcgtgaaaggcgggaattagcgagacgaaaggacaaggaagccatactggcccacggggctggtgaggcggtcctgagcgtctcccgcctgggagagaggcgtgcacagggcccagggggaagaggcggtgggggagggggtggggctggcgttccgccagaggccctccttgccccacttatgcaaaacgggtgggcaaaggctaccctgctgcagggcggacctcatgacctggactctgggcttcttcctaccccagaacagaccccgctgccgcagaaaaggctgccgacacctcatccacacccccatgcactgggcccacgggcatgggaccatggccaccccctactccctgccagcgcaagcagttcactactgttgctggccccagctagggcccctgagcaaccgccagctccaggagagcctactccagacggcagactgtatgcggctcggccaggcagagcttcacatggggacttccccctgacgcctcatgcctcacctgacagacggcgtgtggtctccgctcccactggaccactggatcctgcctccgctgccgacggcttgccacggccatggagcccaccccctacaggatcgctaagacgccctctgggaccgcacgctcccccagctgctaccctgaggcgcacacacacctttaacagtggagaggctagacctggggaccgccacagaggttgtcacgctcgcccaggaaccgacctcgcccacctgctgccttacggtggcgctgataggacggcaccacctgtcccctag

SEQ ID NO: 53877 - DNA, 2793 bp, Artificial Sequence
  Description of Artificial Sequence: Synthetic coding sequence
atgcctagggcccctcacttcatgcctctactgttgctgctgttgttgttgagcctgcctcacacgcaggctgccttccctcaagacccgctgccactgctcatttccgacctccagggcacctctcccttgtcatggtttcgcggactagaggacgacgcggtcgctgcagagctgggcctggatttccagaggtttttgacactgaataggaccctcttagtggcagcgcgtgaccatgtgttcagctttgacctgcaagcggaggaggaaggcgaaggcctcgtgcctaacaaatatctcacttggagatcccaggatgtggagaactgcgctgttcgcggaaagcttaccgacgagtgttataattacattcgtgttctggttccctgggacagtcaaacactgctcgcctgcggtactaactcattctctcccgtatgtcgcagctacggcatcacaagtttgcagcaggagggcgaagagctgagtggccaggcaaggtgcccatttgacgcgactcagagcaatgtggccatcttcgcggaagggtccttatactctgctaccgccgctgatttccaggccagcgacgccgtggtctatagaagcttggggcctcagccccctctccgctccgctaaatacgacagtaagtggcttcgggagccacactttgtacaggccttagagcacggcgaccacgtgtatttcttttttcgggaggtaagcgtcgaggacgcaagactgggccgagttcagttttcacgggtggctagagtgtgcaagagagacatggggggttcaccccgtgcactggatcgccactggacatcctttttgaagttgaggctcaattgttctgtgccaggcgacagcactttttacttcgacgttcttcaggctttgaccggcccagtcaacttgcacggcaggtctgcccttttcggagtgttcaccactcagactaattccattcccggtagcgctgtatgtgctttttacctagatgagattgaacgcggatttgagggcaaatttaaggaacagagatcgcttgatggcgcttggacccctgtttccgaagatagagtacctagtcctagacccggaagttgcgcgggagttggtggcgctgcgctgtttagcagtagccgagacttgccagatgacgtgcttacctttataaaagcccatcccctgttagatcccgctgtcccgcctgtcacacaccagccgctgctcacgctaactagccgcgcactgctgacccaagttgctgtcgacggcatggccggaccacactctaacatcaccgttatgttcctgggaagcaatgacgggacagtcctgaaggtcttgacaccgggaggcaggagtggcggaccggagccaatcctgcttgaggagattgatgcttactctccagccaggtgtagtggtaaaagaacagcacagacggccagacggatcattggactggagttggatacagaagggcatcgtttattcgtggccttctcaggctgtatcgtctatttgcctttatcacgatgcgcccgtcacggtgcttgccagcgttcttgcctggcttcccaggatccatactgtggatggcactcatctagaggttgcgtagacatcagggggtcagggggtacagatgttgatcaggcaggaaaccaagagagtatggaacatggcgactgccaggacggggctacaggcagccagtctggcccaggagactccgcatacggagttaggcgagacctgcccccagcctcagctagccgctcggtcccaattcccttgctgctcgcttccgttgccgctgcgttcgcattaggcgctagcgtaagcggcttgctagttagctgtgcttgccggagagctcacaggcggaggggcaaggacatcgaaacaccgggattgccgcgacctctgagccttagatctctagcgaggctgcacggtggagggcctgagccccctccgccttccaaggacggcgacgccgtacagaccccccagctgtacacaaccttcttacctccaccagaaggcgtgccccctcccgaactcgcttgtctgcccacccctgagagtacgcctgagctgccggttaaacatttgcgcgctgcaggtgatccctgggagtggaaccagaatcgcaataacgcaaaagaagggccagggaggtctcgtggaggtcacgccgcaggaggacccgctcctcgcgtactcgtgcggccacctccccctggttgtccaggacaggcagtggaagtcaccactctggaggagctgctgcggtatctgcacggaccccaacctcctaggaaaggcgcagaaccgccagctcccctgactagtcgcgctctcccacctgagcccgctccagccctgctcgggggaccatcacctcgccctcacgagtgcgctagtccactccgcctggatgtgcctcctgagggcagatgcgccagtgctcccgctaggccagccctcagcgcgcctgcccctcggctcggagtggggggtgggaggagactgcctttcagcggacacagggctccgccagctcttctgacccgcgttccgtctggcggaccatctaggtatagtggtggccctggcaaacatttactctacctcggacgccctgaggggtacaggggccgtgccctgaagcgggtcgatgtggaaaagccacaactgagcctgaaacctccattagtgggaccgagcagtaggcaagctgttcccaatgggggacgatttaacttctag

SEQ ID NO: 53878 - DNA, 2769 bp, Artificial Sequence
  Description of Artificial Sequence: Synthetic coding sequence
atgccacgcgctccacacttcatgcctttgctgcttctcctgctgttactgtccttgcctcatactcaggccgcatttccccaagaccccttacctctgctgataagtgacctccagggcactagtccactctcctggtttagagggctggaggacgacgcagtcgcagctgagctcggcctggatttccaacggttcctgactctgaaccgcaccctgctggtcgctgctagggatcatgtattttcctttgatcttcaagcagaggaagagggtgagggcctcgtcccaaataaatacctaacctggcgttctcaggatgtggagaactgcgccgttagaggaaaactcaccgacgagtgttataactatatacgcgtcctggtgccttgggacagccagactctgctagcttgcggcaccaactccttcagccctgtatgccgatcttacggcatcacctcactacaacaggaaggggaggagctcagtggccaggccagatgtccatttgacgctacacagagtaatgtcgccatctttgccgaaccccatttcgtacaggccttggaacacggtgaccacgtgtactttttctttcgggaggtgagcgtggaggacgccaggctcgggagggtccagtttagccgcgtggcacgtgtgtgcaagcgcgacatgggcggatccccgagggctctggatagacattggacttctttcctaaaactgaggctcaattgttcagtaccgggagattctacattctactttgatgttctccaggccctgaccgggccagtgaacctgcacgggcgaagtgccctatttggggtcttcacaacccaaactaactccatccctggcagcgcagtctgcgccttctacctggacgagatcgagagggggtttgaggggaagttcaaagagcagcgctcgctggatggtgcctggacccctgtttcagaggaccgggtaccctcacccagaccagggagctgtgccggtgtcggcggagctgccctgtttagctcgagtagagatcttcccgatgatgtgcttacttttatcaaggcacaccccctcctcgaccctgctgtgccacctgtcacgcaccagcccttgctaactcttacttcacgggctttgctgactcaagttgccgtggacggcatggccggaccgcattccaacattactgtcatgtttttgggttctaatgacggcaccgtgcttaaggttttgacacccggtgggaggagtggtggacccgagccaatcctgctcgaagagatagatgcttactccccagctagatgctccggaaaacgcactgcacagactgcacgccgaatcattggccttgagttagataccgagggccatcgactgttcgtcgccttcagcggttgcatcgtctacctacccctgagcaggtgtgccagacatggcgcttgccagagatcttgcttggccagccaggacccctactgtggttggcattcctctagggggtgcgtggacatcaggggatcagggggtactgacgtggatcaggccggaaaccaggaaagcatggaacacggcgactgccaggacggtgcaaccggcagtcagtcagggccaggggattctgcctatgttctgccaggccctggaccatcccctgggaccccaagccctccgtctgacgcccatccaagaccacagagttctactctcggggttcacacacgaggcgtcagacgcgaccttcctcctgcatctgcgagcagatcagtgcccattccactcctcctcgctagcgttgccgctgcattcgccttgggagcaagtgtcagcggcctattagtctcttgtgcctgccggagagcccacaggcggcgaggaaaggatatagagactcccggactgcccagaccattgtctttgcggtctctggccagattgcacggcggtggcccagaacccccacctccctctaaagatggagacgccgtccagacgccccagctctataccacatttctgccacccccagagggcgttcccccacccgaattagcttgcctccccactcctgaatctacaccagagttgcctgtgaagcacctgcgcgctgccggtgacccctgggagtggaatcagaacagaaacaacgctaaggagggaccaggacggagtaggggagggcacgccgctgggggacctgcccctcgagtgctcgtcagacctccgcctcccggttgtcccggacaggctgtcgaggtaaccacactggaggagttgctgcgctacttgcacggccctcagccacccaggaaaggcgctgagccccctgcccctctaaccagcagggccttgccaccagaaccagcgccagcactcctagggggaccctccccacgacctcacgaatgcgcctctccgctccgcctggacgtccctcccgagggcaggtgtgctagcgctcccgcacggcctgcgctttctgccccagctccgcgtctgggggttgggggaggtcggagactccccttttcaggtcacagagcgcctcccgctctcctgacaagggtgcccagtggcggacccagccgctattcagggggaccgggaaagcatctcctctatctgggacgcccagagggctaccgtggcagagctctcaaacgtgtcgacgtggaaaaacctcaactctctctgaaaccccctttagtcggaccatctagtagacaggcagtaccaaacggcggacgatttaacttctag

SEQ ID NO: 53879 - DNA, 2889 bp, Artificial Sequence
  Description of Artificial Sequence: Synthetic coding sequence
atgccgagagcgcctcactttatgcctctgctccttcttcttcttctgttgagtctgccacacacacaagcagccttcccgcaggatcctctgcctctgctcatctccgacctccagggtacttcaccccttagctggtttcgcggtctggaagacgacgccgtcgctgccgaactggggcttgactttcagcgattcctcacgctaaatagaactcttcttgtggcggcaagagatcatgtcttttcgttcgacctccaggctgaggaagagggggaaggcctggtgcctaacaaatacttgacatggcgtagtcaggatgttgagaattgcgccgtccgaggcaagttgacagatgagtgctacaattacatccgggtgctggtgccttgggactcccaaaccctgctcgcatgcggtaccaatagcttctctcccgtatgcagaagttatggcattacaagccttcagcaagagggggaggagctttccgggcaggcgcgatgtccattcgacgccactcagtctaatgtggccatttttgcagagggttctctttactccgctactgctgcggatttccaagcctccgacgcagtagtctatcgtagcttaggcccacagcctcctctgcggtccgccaaatacgactccaagtggttacgggagccacactttgttcaagccctggagcatggagatcacgtgtacttcttttttcgcgaagtatcggtcgaagatgctagattaggacgagtgcaattttcacgggtggcgagagtttgtaaaagggatatgggtggctcccccagggcgcttgatagacactggacaagttttctgaagctgcgcctcaattgctccgttcctggtgactccacgttttacttcgacgtactccaggcactgaccgggcctgtcaaccttcacggcagatcggccctctttggagtatttacgactcagacgaactccattcctgggtccgctgtatgtgcattttacctggatgaaatcgaacggggttttgagggtaaattcaaggaacagaggagcctggacggggcttggacccctgtctctgaagatagggtaccatcacctcggcctggctcctgtgcaggggttgggggagctgctctgtttagctcaagcagggatctgccggatgacgtgctcacattcatcaaggctcaccccctgctggatccagcagtgccgcctgtcacacaccagccacttctgacgctgacatcacgtgcacttctcacacaagtggccgtagacggaatggcaggtcctcactcaaatatcacagtgatgttccttggttcaaacgatggaactgtactgaaagttcttactcctgggggtcgctccggtggaccagagccaattctattggaggaaatagacgcgtactccccagcccgttgctccggcaagcgtacagctcaaacagctaggcgcataataggtcttgaactggataccgaaggccacagactgtttgttgccttctccgggtgtatcgtgtacttgccactgtcacggtgcgctcgacacggtgcctgccagcgatcctgtctcgcttcccaagatccctattgcggttggcatagcagcagaggctgcgtagatattcgcggttccggaggcaccgacgtcgaccaagccggaaaccaggagtctatggagcacggggactgccaggacggcgctactggtagtcaatccggtcccggtgacagtgcctacgttctcccaggaccagggccatctcctggaaccccttctcccccaagtgacgcacacccccgtccacaaagttccaccctgggcgtgcacaccagaggcgttagacgggaccttccccctgcgtctgcctcgcgttctgtgcccattcctctgcttctggccagcgtcgcagcggcattcgccctaggagcatccgtcagtggactcttggtcagctgtgcctgccgccgagcccatagaagacgaggcaaggatattgagactcccggactgcctcggcctctgtcactcagaagcctggcaaggctgcatggtggtggcccagaacctccccctccatccaaggatggggacgccgtgcagaccccacagttatatacaacattccttccccctcctgaaggcgtcccccctcccgagttggcatgcctgccgacgcccgagtctacacctgagttgccagtgaaacacctcagggcagccggtgacccttgggaatggaaccagaatcggaataatgctaaagagggcccaggcagatctcggggaggtcatgccgctggcggtcccgctccgagggttctggtgagacccccaccacctggttgtccgggacaggccgtagaggttactactcttgaggagttactgcggtatctgcatggtccgcaacctccccgaaagggcgcagagcctccagccccactcacctcacgagcgctaccaccagagcctgcccctgccctgctgggcggaccttcccctcggcctcacgagtgcgccagcccactacggttagatgttcctcctgaaggacggtgcgcaagtgctccggcaaggccagctctgtcagcgcctgcccctcggctgggggttggcggagggagaaggttaccattttctggccatcgcgctccccctgcactgctgacgcgcgttcccagcggcggtcctagccgttattcaggcggtccaggtaagcacctactctatctgggtcgccctgaggggtatcgcggacgagctcttaagcgcgtggatgtcgagaagccccagctatccttgaagcccccattagtgggtccctccagccgacaggccgtaccaaacggcggacgcttcaacttctag

SEQ ID NO: 53880 - DNA, 2793 bp, Artificial Sequence
  Description of Artificial Sequence: Synthetic coding sequence
atgccgagggcccctcatttcatgccactgcttttgctgctgcttctcttatcacttccacacacgcaggcagccttcccacaggaccctctccccctgttaatctccgatctgcagggtacctctcccctgtcctggttccgcggactggaggatgacgctgttgcagccgaactgggactcgattttcagcgatttctgacacttaatcggacactgctcgtcgccgctagagatcatgtattttcgtttgatctccaggccgaggaagagggcgaggggcttgtgccaaacaaatacttgacctggagatcccaggatgtggaaaattgtgctgtgcgcggaaaactgactgacgaatgctataattatatccgtgttttggtgccctgggattcccagacgttgttagcgtgtgggactaacagcttttcgcctgtctgtcgctcttacgggattacttctctgcaacaggagggtgaagaactgagtggacaggccagatgtcctttcgatgctacacagtccaatgtggccatctttgccgaaggctcgctgtactccgcaacggcagcggactttcaggcaagcgatgccgttgtctaccgctctttagggccacagcccccattgcggagcgccaagtatgactccaaatggttacgcgagccccattttgttcaggcattagagcatggagaccacgtttatttcttcttccgcgaggtgagcgttgaggacgccagattaggtcgtgtgcagttctcaagggtagcgcgtgtttgcaagcgagacatgggagggagccccagagcgttggataggcactggactagcttcctcaagctcaggctgaattgtagcgttcccggtgatagcactttttatttcgacgttctgcaggctctgactgggcctgtgaacctgcatggtcgctctgccctattcggcgtgttcaccacacaaaccaactctattcctggttccgctgtctgcgccttttaccttgacgaaatcgaaagggggtttgaaggaaaattcaaggagcagagatccctggatggagcctggaccccagtctcggaagatcgcgtcccatctccaagaccgggttcctgtgcaggagtggggggtgcggcactgtttagcagtagtagggacttgcccgatgacgttctcacttttataaaagcacacccactcctggatccagccgtgccaccagtaacccaccagccgctcctcacattgacctcgagagctctgttgacccaggtagccgtggatggcatggctggtccccacagcaacattactgttatgtttctaggttctaatgatggaaccgtcctcaaagtcttgacgccaggcggaaggtccgggggtcccgagccgatattgctcgaagagatagacgcctatagcccagctagatgttctggaaaacggaccgctcaaacagcacgccgtataatcggcctggaactggatacagaggggcaccggctctttgtggctttctccggatgtatcgtttatttacccctttcccgctgtgccagacacggagcctgccagcggtcctgtttggccagtcaggatccttactgtggctggcatagcagccggggatgtgtcgatattcgcggaagcgggggtaccgatgtcgatcaggcgggtaaccaagagtctatggaacatggggattgccaggacggggctaccgggtctcagtcgggccctggagattccgcgtacggggtgagaagagacctgcctcctgcaagcgcgtcaagaagcgtgcctattccgttgctcttagctagcgtggcggcagcatttgccctgggggcttcagtctccgggttgttggtgagctgtgcctgtagacgggcacatcggagacgtgggaaagacattgaaacgccgggattaccgcgacccctcagtctgagaagcctggcgcgtctccacggaggtggacccgaaccacccccaccttctaaggacggggatgcagtccagacgcctcagctttacaccacttttttgccgcctcccgagggtgtgccaccacccgaactagcctgtctcccaactcctgagagcacacccgaactgccagtgaaacacctgcgggctgcgggtgacccatgggagtggaaccaaaatcgtaataatgccaaagaggggcctgggagaagccgaggcggtcatgcagccggaggtccagcccctagagtgctggtaaggcccccacctccagggtgcccgggacaagccgtggaagtgaccacactggaagagctcctcaggtatctgcatggacctcagccccctagaaagggcgcagagccgccagccccacttacgtcgagagcactcccgcctgagccagcccctgccctcctcgggggaccatcacctaggccccacgaatgtgcatctcctttgcggcttgatgtgccacccgaaggcaggtgtgccagtgcccctgcacgtcccgcattatccgccccagcaccccgtctgggagtgggagggggacggaggctgccttttagtggccatcgtgctccccctgctctgctcaccagggtgcccagcggtgggccttcacgttactctgggggaccgggaaaacacttgttatatctgggtcgccctgaaggctatcggggacgggcactgaaaagggtggacgtcgaaaaaccacagctgtccctaaaacccccactcgtaggcccatccagccggcaggcagtacccaatggcggacgatttaatttctag

SEQ ID NO: 53881 - DNA, 1614 bp, Artificial Sequence
  Description of Artificial Sequence: Synthetic coding sequence
atgccgagggctcctcacttcatgcctcttctgctactactgctgctgctgtcccttccacacacacaggccgcattccctcaggatccccttcccctgctgatttcggacctccaaggtacgagtcctctcagttggtttcgaggattggaggacgatgcagttgcagcagagctgggcttggattttcagcggttcctgaccttgaatagaacattactcgtggctgcacgcgaccatgtgttttcctttgatttgcaagccgaggaggaaggagaaggcctggtacctaataaatatttgacctggcgcagtcaagatgtggaaaactgcgctgtccggggaaaactgacggatgaatgctataactatatccgcgttctggtcccctgggatagtcagactctacttgcctgcggcacaaactccttctctcctgtctgcagatcatacggcattacctctctgcaacaggagggcgaggagctatctgggcaggcccgatgcccttttgacgctacacagagtaacgtagccatttttgccgaaggctccctttacagtgctaccgccgcagatttccaggcttctgatgccgtcgtctaccggtctctggggcctcaaccccctttgcggagtgcgaagtacgatagtaaatggctgagagagccccacttcgtccaggctttggagcatggtgaccatgtgtattttttcttccgggaggtcagtgtcgaggatgcccgactagggagagtgcagttctccagagtggcccgagtgtgtaaaagagacatgggaggtagtcccagagcactcgaccgacactggacatcatttctgaagctgagactcaactgttcagtgcccggagattctaccttctactttgatgtgcttcaggcactcacaggacctgtcaatctccacggtcgatcagcgctgtttggcgtcttcaccactcagacgaacagcatccctgggtcagctgtctgcgcgttttacttagacgagatcgagagggggttcgaaggcaaatttaaggaacagcgttccttggacggtgcatggacaccagtcagcgaggatagagttccaagtcctaggcctggctcctgcccagcccatagctcccctctgggacgctcactgcaggtgttgcgaggatcccgcgaggcgcctccggtacccggacctgctcgcggactgcctggtcccaggccagagaagggcggacggcgtgaggctcctgtggtgccagaggcttcccccagacgagctttgctcccacccggacgccctgagagaagaccatttcagctgctcaaaggagcggctcatggactgcagcgcggagagagacccagccctctcggacacgaacttgatgccctccaggacgtgagccctcctcccagacccgctccacctgcctttccgactcgcagggtatcgcgaggccctttttccccaagagtgtacttattgactgtgttccccccagtgcttgaccgcagggtcggaggcgagaaacccgtctcttcagtgagtcagcatttccgaggcagctggcgcactccgaccccacgttcgctgcctgcgaagctcccttag

SEQ ID NO: 53882 - DNA, 3222 bp, Artificial Sequence
  Description of Artificial Sequence: Synthetic coding sequence
atgcgggtgtttctcctgtgtgcctatatacttcttctaatggtgagtcagctccgcgctgtgagttttcccgaagacgacgaaccgctcaataccgtagactaccattactctagacagtaccctgtctttaggggtcggccttccggtaatgagtctcagcatcgcctcgacttccaactgatgctaaaaatccgcgataccttatacatcgcaggtagagaccaggtctatactgtgaacctgaacgagatgcccaaaaccgaagtcatccctaacaaaaagctcacttggagaagccgccagcaagacagggaaaactgcgccatgaagggtaagcacaaagatgagtgtcacaactttatcaaagtgttcgtgccaaggaacgatgagatggtattcgtttgcggaaccaatgcctttaaccccatgtgtcgctactatagactttccactctcgaatatgatggcgaagaaataagcggacttgcacggtgtccttttgatgccaggcagacaaacgtggcattgtttgctgatgggaaactctattctgccaccgtggcagattttttagcatctgacgccgtcatatatcgcagcatgggcgacggtagcgccctgcgcaccatcaaatatgactcaaagtggataaaggagccacatttcctgcacgccattgagtacgggaactacgtatacttcttctttagggaaatcgccgtcgaacacaataacctgggcaaggccgtgtactccagggtggccaggatatgcaagaacgatatggggggttcccaacgcgttttggaaaagcactggacatccttcttgaaagctagactaaattgttccgtgccaggcgactcattcttttacttcgatgtgctgcagtccatcactgacatcattcaaatcaacggcattcctaccgtcgtaggggtgttcactacacagctgaattccatccctggtagtgccgtttgtgctttctccatggatgacatcgagaaggtgtttaaggggcgattcaaagagcagaaaactccagactctgtctggacagcagtgccagaggataaagtgcccaaacccagaccgggatgctgtgccaaacatggcctagcagaggcgtataagaccagcattgatttcccagacgagaccctgtcgtttattaagtctcaccctctgatggactcagcggtgcccccaattgctgacgagccctggtttacaaaaacaagggtgaggtatcgcctcaccgccatatccgtcgaccactctgctggaccttaccagaattacaccgtcatctttgttggtagcgaagctggaatggtcctgaaggtcctagcaaagacctctcctttttcattaaacgactcagtgctgctcgaggagattgaagcctacaaccacgccaagtgctctgccgagaacgaggaagataagaaggttatcagtctgcagctagacaaagatcaccacgcactctatgtcgccttcagctcctgcattatcagaatcccactcagcaggtgcgaaagatacggttcatgtaaaaagagctgtatagcgtctcgagacccgtactgcggctggttaagccagggaagctgcggcagagtgacgcctgggatgcttgcagaggggtacgagcaggacacagaatttggtaacaccgcccacctgggtgactgccatgaaatactgccaaccagcaccacccccgactataaaattttcggagggccaactagcgatatggaagtatcctcaagcagtgtcactacaatggcaagtattcctgagatcactcctaaagttatcgacacttggaggccaaaactgacttcctctaggaagttcgtggtacaggacgaccccaacacaagcgacttcacagaccccctttccggaataccaaagggcgtccggtgggaagtacaaagtggtgagagtaaccagatggtgcatatgaatgtacttatcacatgtgtgttcgctgcctttgtcctaggtgcatttatagctggagtcgctgtctattgttatagagatatgtttgttcggaaaaaccgaaaaattcacaaggatgctgaatccgcccagtcttgtacagattcctcaggaagcttcgccaaactcaatgggttgttcgattctcccgttaaagaatatcagcagaacatcgatagccccaagctgtactccaacctgctgacgagcaggaaagagctccctcctaatggcgacactaaaagtatggtcatggaccaccggggacaaccccctgaacttgccgctttgcctacccctgaatccacccctgtcctccaccagaagacactccaggctatgaaatctcacagtgaaaaggcccacggacatggtgcttcacgcaaagagactccgcagttctttccctcctctcctccccctcattccccactttctcacggccatattccttcagccatcgttctccctaacgcgacgcatgattacaatacatcgttttcaaactctaacgcacacaaagccgagaaaaagctgcagaacattgaccaccccctgacaaaaagctcgtcaaagagggatcaccgcaggtccgtggacagccggaatacactgaacgatttgctgaagcaccttaatgatcctaattccaaccccaaagcaatcatgggggatattcaaatggcacatcagaatctgatgctggaccctatgggcagcatgtccgaggtcccaccaaaagttcccaacagagaggctagcctctattcacctcctagcactttaccgaggaattctccaacgaagcgggttgacgttcccacgacacccggtgtgccgatgacctccctagaacggcaacgagggtatcacaaaaacagcagccagcggcatagtatatcagctatgcccaaaaacctgaatagcccaaacggggtgctgttgtcccggcagccttctatgaacaggggcggatatatgcctactccgaccggggcaaaggtcgactatatccagggaaccccagtctctgtgcacctgcagcccagccttagtagacagagttcttatactagcaatggcactttgccaagaacgggcttgaaacgtaccccgagtctgaagcctgatgtgccccctaagccttcgtttgtgcctcagactcccagcgtgcggcctctcaacaaatacacgtactag

SEQ ID NO: 53883 - DNA, 3054 bp, Artificial Sequence
  Description of Artificial Sequence: Synthetic coding sequence
atgcgcgtcttcctgctctgcgcctatattcttctgctgatggtctcccaacttagggccgtgtcctttcccgaagatgacgagcccctgaatacggtcgattaccactactcacggcagtaccctgtttttaggggtaggccctccggtaacgagtcacaacaccggctggacttccaacttatgcttaaaattcgcgatacgctgtacattgctgggcgagaccaggtttacaccgttaacctgaacgaaatgcctaagacagaggtcatcccgaataaaaaactgacctggcgatctaggcaacaggacagagagaattgtgcaatgaaaggcaagcacaaggatgaatgccataattttattaaggtgttcgtacccaggaatgatgaaatggtgttcgtgtgcggcacaaacgcctttaaccctatgtgccgatactatcgcctgagcaccctagaatacgacggggaggagatttctggactcgccaggtgccccttcgatgcaaggcaaaccaatgtggccttgtttgccgatgggaagctttactccgcaaccgtggccgattttctcgcttccgacgccgtcatataccgttctatgggcgacggatctgccctccgaaccataaaatatgactctaagtggatcaaagagccccactttctgcacgccattgagtatggaaactatgtgtatttctttttcagggaaatagcggtagaacataacaacctgggcaaggctgtttacagtagggtcgctaggatatgcaaaaacgatatggggggatcacagcgcgtgcttgaaaagcactggacatcctttcttaaggccagactgaactgctctgtgccaggtgatagcttcttttacttcgatgtcctgcagagcataacagacatcattcagataaacgggatcccaaccgtcgttggagtatttactacccagctcaactccattcccggttctgcagtttgcgcattttccatggatgacatcgagaaagtctttaaggggcgattcaaggagcaaaaaacccctgactccgtttggacagctgtgcccgaggacaaggtgcccaaacccagacctggctgctgtgcaaaacacggtctggcagaggcgtataaaacatcgatagacttccccgacgaaaccctgtcatttataaaaagccaccctctgatggattcggccgtgccccctattgcggatgaaccttggtttaccaagacccgggtcagataccgccttacagctatttctgtcgatcacagcgccggaccgtatcagaattatactgtgatctttgtcggcagcgaggcgggaatggtgctgaaagtactagccaagactagcccgttctcgttgaacgattcagtgctcctcgaggagatcgaggcctacaaccacgctaagtgcagcgccgaaaacgaagaggacaagaaagttattagcttgcagctggacaaggatcaccacgctctttacgtagcgttctcgtcttgtattattaggattccactgagccgttgcgaacgttacggctcttgtaaaaaatcatgtattgcatctagggacccttactgtgggtggctgtctcagggctcttgtggcagggtgacaccgggtatgctggcggaggggtacgagcaagatacagagtttggaaatactgcgcatcttggagattgccatgagattctccctacgagtacaacaccagactataagatcttcggagggccaacatcgggagtgagatgggaagtccagtcaggcgagagtaaccagatggtgcatatgaatgtactgatcacctgtgtgtttgcggcatttgttctgggcgctttcatcgccggagtggctgtttactgttatagggacatgtttgtccgtaagaacagaaaaatacacaaggatgctgaatctgcccagagttgtactgacagctctggatcattcgcaaaactaaatggtctgttcgacagtccagtgaaagagtatcagcagaatatcgacagccccaaattgtatagcaacttactcacctcacgaaaagagcttccacccaacggggataccaaatcaatggtgatggatcatagaggccagccacccgagcttgccgctcttccaaccccagagtctacccctgtgctccaccagaagactctccaggctatgaaatcccatagcgaaaaggcgcacggccatggcgcaagccgcaaggaaacgccccaattctttccgtcgagtccacctccgcacagtccactaagccatggccacatcccctccgcaattgtcctccctaacgcaacccatgattacaatacttcgtttagcaacagcaatgcccacaaagcagagaagaagctacaaaacatagaccaccccctgaccaagtcatcttcaaagcgagaccatagacgtagtgtagattcccggaacacattgaacgatttactcaagcatctcaacgacccaaactccaatcctaaggcaatcatgggagacatccagatggcgcaccagaacctgatgttggacccaatgggtagcatgagcgaagtacccccaaaggtgcccaaccgcgaggcttctctgtacagtcccccttcaactctaccaagaaattctcccactaagcgggtggatgttccaaccacgcctggagtgccgatgacttcactggaacgacagagaggctatcataagaacagcagccagagacatagcatcagtgcaatgccaaagaatctgaacagtccgaatggcgtgctgctgtccaggcagccctccatgaaccgaggcggatatatgcccacccccactggagcaaaggtggactatatacaaggtacccctgttagcgtccacttgcagcccagtctctctagacagtcgtcctacacaagcaacgggacgctcccgcgtacgggtttaaaacgcacccccagcttaaagcctgatgtgccccctaaaccttcgttcgtcccccaaaccccttctgttcgcccactgaacaagtatacctattag

SEQ ID NO: 53884 - DNA, 1794 bp, Artificial Sequence
  Description of Artificial Sequence: Synthetic coding sequence
atgcgggttttcttgctgtgcgcctacatactcctcctgatggtcagtcagctgagagcagtctctttcccagaagacgatgagccactgaatacggtggactaccactacagccgtcaataccccgtcttccgcggaagaccatctggtaatgagtctcagcacagactggacttccagttaatgctcaaaatccgtgacacactgtatattgcaggcagggatcaggtgtacactgtcaacctgaacgagatgcctaaaactgaggtgattccaaacaagaaattaacctggcgatccaggcagcaggacagggaaaattgcgctatgaaggggaagcataaagatgaatgccacaatttcataaaagttttcgtacccagaaatgacgagatggtattcgtgtgtggcaccaacgcctttaacccgatgtgtaggtattaccgcctgtctacattggagtacgatggcgaagaaatttccggattagcacggtgcccatttgatgcaagacagactaatgtggcattattcgccgatggaaagctctattccgcaactgtggccgacttcctggcgtccgatgcggtgatctacaggagcatgggagatgggtcagcattaaggaccattaaatacgacagtaagtggatcaaggagcctcacttcttacacgcaatcgagtacgggaattacgtttatttcttctttcgtgaaatcgccgttgagcataataatctgggtaaagcagtgtactctcgcgtcgcacgaatctgcaaaaacgatatgggcggatcacaacgagtgcttgagaaacattggacctcttttcttaaggcacgtctgaactgctccgttccaggcgacagttttttctacttcgatgttctgcaaagcatcaccgatattatacagatcaatggcatcccgacagtggttggcgtatttacgactcagttgaacagcattcctggcagtgcagtttgtgccttctccatggatgacattgagaaggtgttcaaaggtaggttcaaggagcagaaaacacctgactctgtctggactgctgtgcccgaggataaggtgccaaaacctcggccagggtgctgtgcaaagcatggcttggccgaagcctacaagactagcattgactttcccgacgagaccctgagcttcatcaagtcccatcccttaatggactcagcagtccctcctatagccgacgagccatggttcactaagacacgagtgcgttatcgtctcacagctatcagcgtagaccattcagcaggcccttatcagaattacactgtcattttcgtgggctctgaggcaggaatggttctcaaggtacttgcgaaaacttcacccttctcactgaacgattcggtgctgctggaggaaatcgaagcatacaaccatgcgaagtgctccgccgagaacgaagaagataagaaggtgatttccctgcaactcgacaaagaccatcatgccctctacgtggctttcagttcatgcattattcggatccccctttctaggtgcgaacgctacgggagttgcaaaaaatcgtgtatagcctctagggacccttattgcgggtggctgtctcaaggaagttgcggtcgtgttacccctgggatgcttgctgagggttacgagcaagacaccgaatttggaaacactgcgcatcttggtgattgtcatgatatggaagtttcctcatccagcgtcaccacaatggtttacgatggaaaatcttctctggagtcgccaacaaggtggagtacatag

SEQ ID NO: 53885 - DNA, 3036 bp, Artificial Sequence
  Description of Artificial Sequence: Synthetic coding sequence
atgcgggtgttcctactgtgtgcctacatactgttgctaatggtctcacagctccgagctgtctctttcccagaggacgacgagccactgaacacagtggactatcattactcccggcaatacccggtgttcagaggaagacctagtggtaacgagtcccaacacagacttgatttccaattgatgctaaaaatcagagacactctgtatatcgctggtagagaccaagtatacacggtaaacctaaacgaaatgcccaaaactgaggtgattcctaataaaaagctcacttggagatctaggcagcaggatagggaaaattgcgctatgaaggggaaacataaagacgagtgtcacaattttatcaaggtgtttgtgccaaggaacgacgaaatggtatttgtctgcggaacaaatgcctttaaccccatgtgtaggtactatcgcctatccacattggaatacgatggcgaagagatctcaggattggctcgatgcccatttgatgccaggcagacaaacgtggcccttttcgccgacggaaaattgtactctgctaccgtggcagatttcctggcatccgatgccgtaatctatcggtcaatgggcgatgggagcgccctacgtacaattaaatatgactcaaagtggattaaggagcctcacttcttacacgcaattgaatacggcaactacgtttatttctttttccgggaaattgccgtcgagcacaacaatctgggcaaggccgtgtatagccgcgttgctcggatttgcaagaatgacatgggcggttcacagagggtgctggagaaacactggacatcttttctgaaggccagactcaactgtagcgtgccgggagactcctttttttacttcgacgtcctccagtcaataacagatatcattcagatcaatggcatcccgaccgtcgtgggcgtgtttacaactcagctaaattccattcctggcagcgcagtgtgcgccttttccatggatgatatcgagaaggtcttcaaaggaagattcaaggaacagaaaactcctgattcagtctggacagccgtgcctgaggacaaggtcccaaagcccaggcccggttgctgcgcgaaacacgggcttgctgaagcctacaagacatcgatagattttccagatgagaccctgtccttcattaagtcacaccccttgatggattctgccgtcccacccatcgccgacgagccatggttcactaagacccgcgttcgctatcgacttaccgccatttcggtagatcatagcgccggtccctaccaaaattacacagtaattttcgtgggatcagaggccggaatggtgttgaaggtgctggctaaaactagcccattctctctgaacgatagtgttctgctggaggagatcgaggcctacaaccatgccaagtgtagcgccgaaaacgaagaggacaagaaggtgattagtctgcaactcgataaggatcaccatgctctctatgtggcatttagctcttgtatcattcgaattcccttgagccgctgcgaaaggtacgggagttgcaaaaaatcttgtatcgcatcgagggatccttactgcggctggctgtctcaggggtcctgtgggcgtgttaccccagggatgctgctcctcaccgaagatttctttgccttccacaaccatagcgctgaagggtatgaacaggacacggagtttgggaacacagcccatctaggcgattgccacggggttagatgggaggtgcagtcgggagagtcgaatcaaatggttcatatgaatgtcctgatcacttgcgtgttcgcagcctttgtgctgggcgcatttattgctggtgtggccgtgtactgctaccgagatatgttcgtgagaaaaaataggaaaatccataaggatgccgagtctgcccagtcttgcaccgattctagcggcagctttgccaagctgaatgggctgttcgacagtcccgttaaggagtatcagcagaatatcgactcccccaaactatattctaacctcctgacctctagaaaggagctccccccaaatggcgacacaaaaagtatggttatggatcatcggggacaacctccagaattagccgcactgccaactcctgagagcactccagtgctccatcagaaaacactccaggctatgaaatcacatagtgaaaaagcccatggccacggggcatccagaaaggagaccccacaattcttcccaagttcacccccaccccactcacctctgagccacggtcacatcccctctgctatcgtgctccctaatgcaactcacgattataacacatctttttctaactccaatgcccacaaggctgaaaaaaaactgcagaatatcgatcacccactgactaaatcatcctccaagcgcgaccatcgtagaagcgtggacagccgaaatactttaaacgatctgctgaagcacttgaacgatccaaacagtaatccaaaggcaatcatgggagatattcaaatggcacaccaaaacctcatgctcgaccctatgggctctatgtctgaagtaccacctaaggtaccaaatagagaagcctctctgtacagccctccttccacgctgccccgaaattcacccacaaaacgcgtcgatgtgcctactactcccggagttcctatgacttcacttgaaagacagcgcggataccataaaaatagcagtcagcgccattcaataagcgccatgcccaagaatctcaactcccccaacggggttctcctgagtcgacagcccagcatgaacagaggcggatatatgcccactccaacgggcgcaaaggtggactatatccagggaacacctgtatctgtgcatttacagccatccttgtcgaggcagagcagctacaccagtaatgggactctgcctagaacgggtctaaagcggacaccttctctcaagccagacgttccgccaaagccatcttttgtgcctcagaccccctcggttcggcctttgaataagtacacgtattag

SEQ ID NO: 53886 - DNA, 1431 bp, Artificial Sequence
  Description of Artificial Sequence: Synthetic coding sequence
atgcgcgtcttcctcttgtgtgcctacatactccttttgatggtgagccagttgcgcgcagtttctttccccgaggatgacgagccgctgaacactgtagactatcattattcaagacagtatcccgtgttccgtgggcgaccaagcggcaacgagtcccaacaccgactcgattttcagctgatgctcaaaataagagacacactgtatatcgcaggaagagatcaagtgtacaccgtcaatctaaatgagatgcctaaaactgaagtgatccccaacaaaaagctcacctggcgctcacggcaacaggaccgcgaaaattgtgctatgaaaggcaagcataaggacgagtgccataatttcatcaaggtatttgtaccccgaaacgatgagatggttttcgtttgcggcactaatgccttcaatcctatgtgccgctattatcgcctgtcaacgttggagtatgacggcgaagaaatctccgggctggcaagatgcccgtttgacgctagacagacaaacgtggccctgttcgccgacggcaagctgtacagcgctaccgtcgcggattttctggcgtccgatgccgtcatttaccgaagcatgggagacggctctgcgctgcgaaccattaagtatgatagtaaatggataaaggagccacattttttacatgccattgagtacggaaactatgtgtactttttcttccgcgagattgccgtggagcacaacaatttgggcaaggccgtctacagcagggtagccagaatttgcaaaaatgacatgggagggagccaaagggttcttgagaagcattggacaagcttcctgaaggcccgtctgaactgttccgttccaggcgatagttttttctactttgatgtattgcagtccataaccgacattatccaaattaatgggatacctaccgttgtgggagtcttcaccactcagttgaatagtatccctggttccgcagtgtgtgctttctctatggatgatattgagaaagtcttcaaaggcaggttcaaggaacaaaaaactcctgacagcgtgtggacggccgtgcccgaagacaaggttcccaagcctaggccgggttgctgcgctaaacatggtttagccgaagcttacaaaacctctattgacttccccgacgagaccctctcatttatcaagtcacacccgctgatggattctgccgtaccccctatcgcggacgagccctggttcacaaaaactagggtcaggtatcggctcactgcgatttcagtggatcatagtgcagggccatatcaaaactatacagtaatttttgttggctcagaagcaggcatggtccttaaagtcctggccaagacctctccctttagtttgaatgactccgtcctcctggaagaaatagaggcgtacaatcacgctaagtag

SEQ ID NO: 53887 - DNA, 2997 bp, Artificial Sequence
  Description of Artificial Sequence: Synthetic coding sequence
atgcgagtgtttttgctctgtgcttatatcctgctgctcatggtgtcccaactccgggcagtttcgttcccagaagatgacgaacccctgaatactgtggattatcactactctcgtcaatatccagttttcagagggaggccttcgggaaacgagtctcagcaccgcctcgatttccagctgatgttaaaaatcagggacaccctctacattgccggtcgggatcaagtttacaccgtcaacttgaacgagatgcccaagacggaagtcatcccgaataaaaagctgacatggagatctagacagcaggacagagagaattgcgccatgaaaggcaagcataaggacgaatgccacaatttcatcaaagtcttcgtaccacgcaatgatgagatggtcttcgtttgcggcaccaacgcttttaatcccatgtgccggtactaccgtctgtccacattggagtatgatggggaggaaatcagcggactcgcgcgttgccctttcgacgcccgacagactaacgttgctctgttcgctgacggcaagctgtacagtgccactgtggccgactttctggcttccgatgccgttatataccgctcaatgggcgatggttctgcacttcggaccatcaaatacgatagtaaatggattaaagagccccactttttacacgccatcgagtatggaaattatgtgtactttttctttcgggagattgccgtggaacataacaatttgggcaaagcagtctattctcgagtcgcgaggatctgcaagaatgacatgggaggctcacagcgcgtcctggagaaacactggaccagttttcttaaagccaggctaaactgttccgtccccggtgactcatttttttattttgacgtgctccagtcaataactgacatcatccaaattaatggcattcccacggtagtgggtgtgttcacaacacagctgaactccatcccgggatctgccgtatgcgctttctctatggatgacatcgagaaggtattcaagggcaggttcaaggaacagaaaactcccgattccgtgtggaccgccgtgccagaagataaagtgcctaagcccaggccaggatgttgcgcaaagcatggactagccgaggcatacaagactagtattgatttccccgatgaaaccctcagcttcattaaaagccacccactgatggactccgccgtccctccaatcgcggacgaaccttggttcacaaaaacacgcgtgagataccgcctcacggctatatctgtggatcactccgctggcccataccagaactacaccgtgattttcgtgggcagcgaagccggaatggtactaaaagtgcttgccaaaactagcccattttcccttaatgactctgttctgctggaagaaattgaggcttacaaccacgctaagtgcagtgccgagaacgaggaggacaagaaagtgatctccctgcagctggacaaggaccaccatgccctgtacgtcgccttctcatcttgtattatcaggatcccactctctcgatgtgaacggtacgggtcatgtaagaagtcgtgcatcgcctctcgtgatccctactgcggatggctgagccaggggtcgtgcggcagggtgacacctggcatgctggccgagggctacgaacaagacacagagttcggaaacaccgcccaccttggcgattgtcatggtgtacggtgggaggttcaaagcggcgaatcaaatcagatggtgcacatgaacgtgctgataacatgcgtgttcgcagctttcgtgttgggagccttcatcgccggtgttgccgtttattgttaccgggatatgtttgtgcgaaaaaaccgaaagatccataaggacgctgaatctgctcagtcctgcactgactcaagcggaagtttcgccaagcttaacggcctttttgacagccccgtgaaggagtatcagcagaacatcgattcccctaagttgtactccaatctattaacaagtcgcaaggaactcccacctaacggagatacaaagagtatggtgatggatcaccgcggacaaccaccagaactggccgctctccctactcctgaatcgacccccgttttgcaccagaaaactctacaagccatgaagtcacactcagaaaaagcccacgggcacggggcatccagaaaggagactccccaattcttcccgtccagtccgcctccacattctcctctgtcccacgggcacatcccatcagcaatagtgctgccaaacgctactcacgattataacacatcattctcaaattccaacgcccacaaggccgaaaagaagctgcagaatattgaccacccactgactaagtctagctctaagcgcgatcatagaaggtccgtggatagtcgcaacacattgaatgatctgctgaaacacctgaacgaccccaatagcaatcccaaggccattatgggggacatacagatggcgcaccagaatcttatgctggatcctatgggatctatgagcgaagtcccccctaaggtccctaaccgagaggcatcgctgtactcacccccatcaacattacctagaaactcacctaccaaaagagtggacgtaccaactaccccaggagttccgatgacctctttggagagacaacggggatatcacaaaaactcttcgcaacgacatagcatttccgcgatgcctaagaaccttaacagtccgaacggagtcttactaagcagacagccttctatgaatcgtgggggatacatgcctacacctaccggtgccaaggtcgactatattcagggtacccctgtaagcgtgcacctccagcccagtctttcgagacagtcgagctacacctcgaacggcactctcccaagaactggcctgaaacgaaccccatcgctcaagcccgacgtccctccaaagcccagtttcgttcctcaaacccccagtgtaagacccctgaataagtatacatactag

SEQ ID NO: 53888 - DNA, 3093 bp, Artificial Sequence
  Description of Artificial Sequence: Synthetic coding sequence
atgagggtgttcctcctctgcgcttatatcctgttgctcatggtaagtcagctgcgagcggtgtccttccccgaagacgacgaaccactgaatacagtcgattaccactattcaagacaataccccgtctttagaggtaggccctcgggcaatgagtcccagcataggctcgactttcagctgatgctcaagatacgcgataccctctacatcgccggtcgggaccaggtgtatacagtaaacttaaatgaaatgcccaagacggaggtgataccaaataaaaagttgacttggagatcccggcaacaggaccgggaaaactgtgccatgaaggggaagcataaagacgagtgccacaacttcatcaaagtcttcgtccccaggaacgacgaaatggtgttcgtgtgcggtactaatgccttcaaccctatgtgtcgatactaccgtcttagcactctggagtatgatggtgaggagattagtgggctcgctagatgccccttcgacgcgcgacaaacaaatgttgcattgttcgctgatggcaagctgtactccgccaccgtcgctgattttctggcctcggacgctgtcatctaccgttccatgggggacggctcagctctgagaactatcaagtatgacagcaaatggatcaaggaaccccactttctgcatgcaattgagtacgggaattatgtttactttttttttagggaaattgctgtcgagcacaacaatcttgggaaagcagtgtactcacgggtagccagaatctgtaagaacgacatgggcggtagccaacgggttttggaaaagcattggacctccttcttgaaggctcgactgaactgtagcgtacctggcgacagctttttctactttgatgtcctgcagtcaattacggacattatccagattaatggaatacctacagtggtcggggtttttacgacacagctgaacagcattccaggatcagcagtatgcgcttttagcatggacgacatcgaaaaagtgttcaaagggcgtttcaaagagcagaaaacccccgattccgtttggacggcagtaccggaagacaaggtgcctaagcctcggccaggatgctgcgctaaacacgggctggccgaggcatacaaaacatctatagactttcccgatgaaacacttagctttattaagtctcatcccctcatggattccgctgtgccccctattgccgacgaaccatggttcacaaagacaagggtgcgctaccgtttaaccgccatttctgtggaccattctgcaggcccatatcagaattatacagtcatttttgtcggctcagaagctggcatggtcctcaaagtgctggcgaagacaagccccttctcattaaatgactcggtgcttctagaagaaattgaagcttataaccacgccaaatgttctgctgaaaacgaagaagataaaaaggtgattagccttcagctggataaggatcaccatgctctgtacgttgcctttagttcctgcattatccgaatccctctgagcaggtgcgagaggtacggttcttgtaagaagtcatgcattgcctctagggatccttattgcggctggctgagccagggctcctgtggacgcgtaacccctggaatgctgcttctgaccgaggacttctttgccttccataatcactccgccgaaggctatgagcaggatacagaatttggtaacacagctcatctgggagactgtcacgagatactaccaacatctactaccccagactacaaaatttttggaggcccaacctcaggcgttcgctgggaagttcagtctggggagagcaaccagatggtccacatgaacgtgctcatcacctgcgtctttgccgctttcgtgttgggagctttcattgcgggtgtcgcagtttattgttacagagacatgttcgtcagaaaaaaccgcaaaatacataaggacgctgagagtgcccagagctgtactgacagttccggaagcttcgccaagttgaatggactgttcgacagccccgtgaaagaataccagcagaatatagacagccccaaattgtacagcaacctgctgacaagcagaaaggagctgccaccaaatggagacacgaagagcatggtgatggatcatcggggacagccgccagagctcgcagccctcccgacacctgaaagtacccctgtgcttcaccagaagactctacaggccatgaaaagccattccgagaaagctcatgggcatggagcttctaggaaggagaccccacagttctttcctagctctccccctccccattcaccccttagccatgggcatatcccgtcggcgatcgttctccctaatgctacccatgattacaacaccagtttctcgaatagtaacgcacataaggccgagaaaaaactgcagaatatcgaccaccccttgaccaagtcgtcatctaaacgggatcatagaaggagcgtggactcgcgaaacacactgaacgatctgctgaaacatctaaacgacccaaattctaaccctaaggccattatgggcgatattcaaatggcgcaccagaatcttatgcttgatccgatgggctcaatgtccgaggtgcctccgaaagttcccaatagggaggcatctttatacagccccccttcaaccctaccaaggaattccccaacaaagagagtagacgtgcctaccacacccggagttcctatgacttccttagagaggcaaagaggttaccacaaaaactctagccagcgtcattctatttccgcaatgccaaagaacctgaactcacccaatggcgtgctgctgtctaggcagccgagtatgaatcgcggtggctatatgcccactcctaccggcgcaaaagtcgactacattcagggaacaccggtgagcgtccacttacagccctctctttcaaggcagagcagttacaccagcaatggcactcttccccgaaccgggctgaaaaggaccccctccctcaaacctgatgttccccctaagcctagcttcgtgcctcagacaccttcggttaggcccctgaacaaatacacctattag

SEQ ID NO: 53889 - DNA, 3165 bp, Artificial Sequence
  Description of Artificial Sequence: Synthetic coding sequence
atgagggtgttcctcctctgtgcctatattttactcctgatggtcagccagttgagagctgttagtttccctgaggacgacgaaccgctcaataccgtcgactaccactacagcaggcaataccccgtcttccggggaagaccatctggcaacgaaagtcaacaccggctcgactttcagctgatgctgaagattagggacacgctttacatcgccggtagagaccaggtctacacagtcaacctgaatgagatgccaaagaccgaggttattccaaacaagaagctcacatggcggagcagacaacaggatcgggaaaattgtgcaatgaaagggaaacacaaagacgagtgccacaatttcatcaaagtgtttgttccacgtaatgacgagatggtcttcgtatgtggcaccaacgcattcaacccaatgtgtcgctactaccgcttatccaccctcgagtacgatggggaggagatctctggactggctagatgcccgttcgatgcccgacagaccaacgtggccctgtttgcagacgggaagctatatagtgctaccgtcgccgattttctcgcctcggatgcggtgatctacagaagcatgggagacggctctgccttgcgcactatcaagtacgacagcaaatggatcaaagagccacactttttacatgccatcgaatacggaaattacgtgtacttcttctttcgtgaaatcgcagtcgaacacaacaaccttggaaaggcagtttattcaagggtggcccgtatttgcaaaaatgacatgggcggatcccaacgcgtccttgaaaagcactggacctccttcctgaaggcgaggctcaattgtagtgttcccggtgattcttttttttactttgacgtcttgcagtcaatcacggacattatacagattaatggcattccaaccgttgtgggcgtcttcacaacacagctgaacagcataccagggagcgctgtttgtgcattctccatggacgatatcgagaaggtgttcaaagggagattcaaagaacaaaaaaccccagactcagtttggactgccgtgcctgaggacaaggttcctaagcctagacctggatgctgcgcgaagcacggcctggcagaagcatacaagacctccattgactttccggatgagaccttgtcgttcataaagagtcatccattaatggattcggccgtcccacctatcgcggatgagccgtggttcacaaagactcgagtgaggtataggttgacagctatcagcgtcgaccactctgctgggccttaccagaactatacagtgatatttgtcggcagtgaggctggaatggtgttgaaagtgctggctaaaacctccccgttcagcctgaacgactccgttctgctggaggaaattgaagcctacaaccacgctaaatgctccgctgaaaacgaggaggacaaaaaggtgataagcttacaattggataaggaccaccacgccctttacgtagccttcagctcatgcatcattcggatacctctctcccggtgtgagagatatggatcctgcaagaaatcatgcattgcctctcgggacccgtactgcggttggttaagtcagggatcctgcgggagggtcacccctgggatgctcgcagaaggctatgaacaagataccgaattcggcaatactgcgcacctgggggattgtcacgacatggaggttagttcgagttccgtgacaaccatggcctccatccctgagattacgcccaaggtcatcgacacttggagaccaaagttaactagttcccgcaagttcgtggtgcaggacgatcctaacactagcgacttcactgatcccctttccggcatacccaagggagtacgctgggaggtgcaatcaggcgaatcaaaccagatggtgcatatgaacgtgctcatcacatgcgtgtttgcggctttcgtgcttggcgcatttatcgcaggggtcgcagtgtattgttatagagatatgtttgttagaaaaaacagaaagattcataaagatgctgagagtgcccaatcatgcaccgattccagcggttcttttgccaaactgaatggcctgttcgacagtcccgtcaaagaataccaacagaatatcgatagccccaagctgtattccaatctgctcactagtcgtaaggagttgccaccaaatggcgatactaagtcgatggttatggatcacagggggcagccacccgagctggctgctctgcctacacctgagagcaccccagtgctacaccagaagactttacaggcgatgaagtcccacagcgagaaagcacacggacatggagcatccagaaaggaaacaccccaattctttccaagttccccacctccccactcacccctgtctcatggacacatacctagcgcaattgtgctgcccaatgcaacccacgactacaacacttctttttccaactcaaacgctcacaaggcagaaaaaaagcttcagaatatcgatcatcccctgacaaaatcttcctcaaaacgagaccaccgtagatccgtggactcccgcaacacactgaatgacctcttgaagcacctgaacgaccccaatagtaaccccaaagctatcatgggggatatacaaatggcccatcagaacctaatgctcgaccccatgggatcaatgagcgaagtcccacccaaggtgcctaatagggaggcgagtttatactcccccccttctacgcttccaagaaacagccctaccaagagagtcgacgtgcctactacaccaggggtccccatgacgagtctggagcgacaacggggataccataaaaacagctctcaaaggcactccatctccgctatgcccaaaaatctcaactcccccaatggcgtgctgttaagtcggcagccgtcaatgaaccggggaggatatatgcctacaccaaccggggctaaagttgactacatacaaggtacgcccgtgagcgtgcacctgcaaccttccctgtcaagacagtcttcttatacatccaacggcaccctccctcggaccgggctcaagagaaccccctctctgaagccagatgtgccccctaagccatcatttgtgccccagactccctcagtgagaccgctaaataaatacacctactag

SEQ ID NO: 53890 - DNA, 3222 bp, Artificial Sequence
  Description of Artificial Sequence: Synthetic coding sequence
atgcgggtgttcctgctgtgcgcgtatattctgctcctcatggtttcccagttgagagctgtttccttcccagaagatgacgagccactgaacacagtcgactatcactactcccgacagtatcctgtatttcgtggcagacctagtggcaatgagagccaacatagactggattttcagctgatgttgaagatcagggacaccctctacatagctgggagagatcaggtttataccgtgaatctgaatgagatgcccaaaaccgaagtgatccctaacaaaaagctgacttggcgaagccgccaacaggatcgagagaactgcgctatgaagggaaaacataaggatgagtgccataacttcatcaaagtgtttgttcctaggaatgatgaaatggtgtttgtgtgcggaaccaacgccttcaacccgatgtgtagatactacagactttccaccttggagtacgacggtgaggaaatatctggactcgctagatgtccattcgacgccaggcagacgaatgtggctctgtttgctgacgggaagctctactccgctaccgtggctgatttcctggcctctgatgctgtgatatatcggtctatgggtgacgggtcagcccttcgcaccataaagtacgacagcaaatggatcaaggaaccgcactttctgcacgccatcgagtatggcaactatgtgtacttctttttcagggaaattgccgttgagcacaacaacttgggcaaagccgtctactcccgggtcgcacgcatctgtaaaaacgatatgggcggttctcagagagtattagagaaacactggacatcctttctcaaggcccgtctgaattgttccgtgcccggagactcatttttctactttgacgttctgcaatctatcacagatatcatccaaatcaacggtatccctacagtcgtgggcgtgtttacaacccagctcaacagtattcccggaagtgccgtctgtgcattttccatggatgatattgagaaggtgttcaagggacggttcaaggaacagaagacacctgattctgtgtggaccgccgtgcctgaggataaagtccctaagccacggcctggctgttgtgcgaaacatggactcgccgaggcctacaagacgagtatagacttccctgacgaaaccctgtcgttcattaagtcgcacccattgatggatagtgcggtccctccaattgcggacgaaccctggtttactaagactcgcgtgagataccgactcacggcgatcagtgtggaccatagcgccggaccctatcaaaattatactgttatttttgtgggttcagaagccggaatggtcctgaaggtcctggcaaagaccagtccctttagtctcaatgatagcgtcctcttagaggagatagaggcctataaccacgcaaagtgtagtgctgaaaatgaagaggacaagaaggtaatctccctacagctcgataaagaccaccatgcactttacgtggcgttctcttcctgtatcattaggataccccttagcagatgtgagagatatggaagttgcaaaaaatcttgtatcgcttcccgagacccctattgcggctggctgagtcagggttcatgcggcagggtgacaccgggaatgctcgccgaggggtacgagcaggatactgagttcggcaataccgcccatttaggtgactgccacgagatacttccaacttccaccactccagattataagatcttcgggggacccaccagcgacatggaagtttcttcatcctctgtgactacgatggctagtatcccagagatcacccctaaagttatagatacatggcgccctaagctgacgagttcccggaagttcgtggtgcaggatgacccaaacacgagtgacttcacggaccctctgtctggcatcccaaaaggcgttagatgggaggtccagtccggagaatccaatcagatggttcacatgaatgtgctcattacctgcgtattcgctgcttttgttttaggcgcttttatcgcaggggtcgccgtatattgctaccgtgatatgtttgtgaggaaaaacagaaagattcacaaagacgcagagtctgcccagagctgtaccgattccagtggatcctttgccaaacttaacgggcttttcgacagtcctgtgaaagagtaccaacagaatatagacagccccaagctctatagtaatttgctcacctctcggaaagagttaccccctaacggtgacaccaagtctatggtgatggaccataggggccagcccccagagctggctgcccttcccacccccgagtccacgccggtcctgcaccagaaaactctccaagcgatgaagagccactccgaaaaagcgcacggccacggcgcatccaggaaagagactccacagtttttcccatcctccccaccccctcactctcctttgagtcatggccacatccccagtgccatcgtactacccaacgctactcacgattacaatacatcattcagcaattcaaacgcccataaagccgaaaagaagctgcaaaacatcgatcacccattaacgaagtccagtagcaaacgcgaccacaggcgcagtgttgattccaggaacaccctgaacgatctgctcaagcacctgaacgaccctaactccaaccccaaggctatcatgggagacatccagatggctcatcagaacctcatgctggacccaatgggaagcatgtccgaagtaccccctaaggtgcccaaccgcgaggcctcactctattcgcccccaagtactctgcctagaaatagcccaacaaaaagggttgacgtccctactacgccaggcgtgcctatgacatccctggaacggcagaggggctatcacaagaattctagtcaaaggcacagtatttctgccatgcccaaaaatctcaatagcccgaacggcgtgctcctttctaggcaaccctctatgaatcgcggaggctacatgccgactcccactggtgcaaaggttgactacatccaggggaccccagtgtcagtgcacctgcagccaagcctctcccgccaatcttcctacacaagcaatgggactttacccagaacaggactgaaacgtacgccctcactgaagcccgatgttcctcctaaaccttccttcgttccgcagacgccctctgtgcgcccactgaataaatacacatactag

SEQ ID NO: 53891 - DNA, 3036 bp, Artificial Sequence
  Description of Artificial Sequence: Synthetic coding sequence
atgagggtcttcctcttgtgtgcctacatcctacttctcatggtgtctcaactccgggcagtctcttttccagaagacgatgaacccctgaataccgtcgactaccactactctcgccaataccctgtgttccggggaaggcctagcggcaacgagtcgcaacacaggctggatttccaattgatgcttaaaattcgcgataccctttatatcgctggcagggaccaggtgtataccgtcaatctgaacgaaatgcctaaaacagaggtaattcctaacaaaaagctcacatggagaagcaggcagcaggacagggagaattgtgccatgaagggaaaacacaaagacgaatgtcataacttcatcaaagtatttgttcccaggaatgatgagatggtctttgtttgtggcacaaacgcctttaaccctatgtgtcggtattacagattatccaccctggaatatgatggggaagaaatcagtggtttggcccgatgcccctttgatgcaaggcagacaaatgtggcactattcgccgatggtaagctctatagcgctacagtcgcggatttcctggcgtccgacgccgtaatatatcgtagcatgggtgatgggagtgccctgcgcacaatcaagtacgatagcaagtggattaaagagccccattttcttcatgctattgagtacgggaattatgtatacttcttttttcgagagatcgcagtggagcacaacaacttgggtaaggcggtgtattcacgagttgctaggatctgtaaaaacgacatgggcggttctcagcgcgttttggaaaagcactggacatcattcctcaaagcaagattgaattgttcggtccccggtgacagttttttttacttcgacgttcttcaatccattacagatatcatccagatcaatggcatccctacagtcgttggagtgtttaccactcagttgaacagcatccccggaagtgccgtgtgtgcgttctccatggatgacatcgagaaagtgtttaagggtagattcaaagaacagaaaacccctgattctgtatggaccgctgttccggaggataaggtgcccaagcccaggccgggttgttgcgccaagcatggcttggcagaagcatacaagacatccattgacttccccgacgagaccctctcatttattaagtctcatccgctcatggatagtgcagtgcctccgattgctgacgagccttggtttaccaagaccagagtccgctatcgtctgactgcaattagcgtggaccacagcgccggaccgtaccagaattacaccgtcatattcgttggttcagaggccggaatggtattaaaagtacttgcgaaaacatccccgttctctcttaacgatagcgttctgctcgaggaaatcgaagcctataaccacgccaagtgttcggcagagaatgaagaggacaaaaaagtgatctcgttgcaactcgacaaagaccatcatgctctgtacgttgcctttagctcctgcatcattcgtatcccactgagtcggtgcgagagatacgggagttgcaaaaagtcgtgtatcgctagtagagatccatattgcggatggctgtctcaggggagctgtgggagggttacccctgggatgctcctcctcacagaagacttttttgccttccacaaccactcggcagagggttacgaacaggacaccgagttcggaaacaccgcacatctcggtgattgccacggcgtaagatgggaagtccagtcaggcgagagcaaccaaatggtccatatgaacgttcttataacttgtgtattcgccgcattcgtattgggggctttcatcgctggagtcgctgtgtactgctacagggatatgtttgttcgtaaaaacagaaagattcacaaagatgctgaatctgcccagtcatgcaccgattctagcggaagcttcgctaaactcaacggcttattcgactcacctgtaaaggagtaccaacaaaatatagatagcccaaagctctactcgaacttgttaacatcacgcaaggagttgcctcccaatggtgataccaagtccatggtcatggatcaccgtggccagccaccagaattagcagccctgcccactcccgagtcaacaccagtgttgcaccagaaaacattgcaggccatgaagagccactcggagaaggcacatggtcacggcgcatcacgcaaggagacaccacaatttttcccttcatcgccaccccctcactcaccattaagccacgggcacatcccttctgccattgtgctacccaatgcaacgcatgactataacacgtctttctcaaattctaacgcccacaaagccgagaagaagctgcagaatattgaccacccactgaccaaatccagctcaaagcgggaccataggcgctccgttgacagccgaaacacactgaacgatctcctgaagcacctgaatgacccaaacagcaaccctaaggctatcatgggagacattcaaatggcacatcagaatctaatgttagaccctatggggagtatgagtgaagtccctcccaaagttcctaacagagaggcctccttgtacagcccgcctagcactctcccgaggaactctccaactaaacgagtcgatgtgcccaccacaccaggcgtgccaatgaccagcttggaacgccagcgcggttatcacaaaaatagcagtcagcggcattctatatccgccatgcctaaaaacctcaattcacccaacggtgtactcttgtcaaggcagcccagtatgaacagagggggttatatgcctactcccaccggggcaaaggtagactatatacagggcacccctgtatccgtccacttgcagccatccttgagccggcagtcctcatatacaagcaacggtactctgccacggactggactgaagaggacacccagcctaaagcccgacgtgccgccaaagccctcgtttgtgccccagactccgtcagtgaggcccctcaataagtatacttactag

SEQ ID NO: 53892 - DNA, 3036 bp, Artificial Sequence
  Description of Artificial Sequence: Synthetic coding sequence
atgagagtgtttctgctttgtgcctacattctgctgttaatggtctctcaactgcgcgctgtctccttcccggaagacgatgagccgcttaatacagtggactatcactatagtcggcagtaccctgttttccggggaagaccttctggcaacgaaagtcaacaccgtcttgacttccaactgatgttgaaaatccgcgacacattatatatcgctggccgagatcaagtgtataccgtcaatctgaatgaaatgccaaaaactgaggtaatccctaataaaaagctgacatggcgatcaagacagcaggatcgagaaaattgcgcaatgaaaggtaaacacaaggatgagtgccacaacttcatcaaagtgttcgttccccgaaatgatgaaatggtatttgtctgtgggacgaacgcctttaacccaatgtgcaggtactaccgcttatctactctagagtacgatggtgaagagatttctggccttgctcgatgtccgtttgatgccagacaaactaatgtagcattgttcgcagatggcaagctgtattctgctaccgtggccgacttcttggctagtgatgctgtgatctacagatccatgggagacggcagcgcactgcggaccatcaagtatgattcgaagtggattaaggagccacattttctgcatgccattgaatacggtaactatgtctatttctttttcagagaaatcgccgtggagcacaacaatttgggcaaggctgtgtattcccgagtcgccaggatttgcaagaatgatatgggcggtagccagcgggtactggagaaacattggacctcttttctgaaggcgagactgaactgttccgttcccggagacagctttttctacttcgacgtgctgcagtcaattactgatattatccagatcaacggcatccctaccgtagtgggggtgttcactacccagcttaactcaattcctgggtctgccgtgtgtgccttttccatggacgacatcgagaaggtcttcaagggtcggtttaaggagcagaagactccagactccgtgtggacagcggtgcccgaggataaggtgccaaagcctcgccctggctgctgcgctaagcatggcctggcagaagcgtacaaaactagtatagacttcccagatgaaactctgtccttcataaagtctcatccccttatggattcggcagtgcctcccatagctgacgagccctggtttacaaagacccgcgtacgatacagattaacagccatctccgtggatcatagtgcgggtccgtaccagaactacacggtcattttcgttggaagcgaggctggtatggtgctgaaggtgcttgcgaaaaccagcccatttagcctaaacgattctgtactcctcgaagagattgaagcatataatcacgccaaatgcagcgccgaaaatgaagaggacaaaaaggttatcagtctgcagctcgacaaggatcatcacgccctctacgtggcgttctcctcgtgtattataaggattccattgtcgaggtgtgagcgctacggctcttgcaaaaagagttgcatcgcctcccgggatccctactgcggatggttatcccaaggttcctgcggtcgtgtgacccccggaatgctattgcttacagaggacttttttgcgttccataatcacagcgcagaggggtatgagcaggatactgagttcgggaatacagcacacctgggggattgccacggtgtccggtgggaagttcagtccggggaatcgaatcaaatggtgcacatgaacgtactgattacatgcgtcttcgccgctttcgttttgggcgctttcatcgcaggcgtggcggtatactgctatagagacatgtttgtgcgcaagaacagaaagatccacaaagacgcggaatctgcccagtcatgtacagactcatccggctccttcgccaagctgaacggactgtttgactcgcccgtgaaggagtaccaacaaaacatcgattcccccaagctctatagtaatctgctcacgagtcgcaaagaacttcctccaaacggggataccaagtcaatggtgatggaccaccgtgggcaacctcctgagctggctgctctaccaacccctgaaagcacacctgtgctccatcagaagaccttacaggccatgaagtctcactccgaaaaggcacatgggcacggagcctcccggaaagagacgccacagtttttccccagttccccaccacctcactcacctttaagccacggacacattccatctgcaattgttctgcctaatgccacacatgactataacacctcgttctcaaattccaatgcacacaaggcagagaagaaacttcagaacattgatcaccccctgactaagagttcaagtaaacgagaccaccggaggtcagtcgactcccggaacaccctcaacgacctgctgaagcacctcaacgacccaaatagcaaccctaaggctatcatgggtgatattcagatggcacaccagaacttgatgctggatcccatggggagcatgtccgaagtccctccaaaagtccccaatagagaagcgtccctttattcacccccatcaaccctgcctagaaattccccaaccaaacgagtggacgtgcctacgacccctggcgtgcccatgacatccctggagagacagagggggtaccataaaaattcttcacaacggcattctatctccgcaatgccaaagaatctcaacagccctaacggagtcttgctgagcagacagccttctatgaaccgcggtggctatatgcctactcctactggcgcaaaggttgattacattcaggggacccccgtttcagtgcatctgcagccttctttaagcaggcagtcttcttacaccagcaacggaactctcccacgcaccggattgaagcgcacacccagcctcaagcctgacgttccacctaaacccagcttcgtcccccagacaccctctgtgaggcccctgaacaaatacacctactag

SEQ ID NO: 53893 - DNA, 1794 bp, Artificial Sequence
  Description of Artificial Sequence: Synthetic coding sequence
atgagggtctttctgctatgtgcatacattctcctgctgatggtgtcgcaactgagagctgtgagcttccctgaagacgacgaacctctgaacaccgtcgattatcattatagtaggcaatacccagtgttccggggacggccttccggcaatgagagccagcatcgattggacttccagctgatgctgaaaattcgcgacacactgtatatagcgggaagggaccaggtgtataccgttaacctgaacgaaatgcccaaaacggaggttattccaaataaaaaactaacatggcgaagcagacagcaagaccgggaaaactgtgctatgaaaggaaaacataaggatgagtgccacaatttcataaaagtatttgtccccaggaatgacgaaatggtgtttgtatgtgggaccaatgcctttaatcctatgtgccggtactatcgcttatctactctggagtacgatggagaggaaatctctgggctggcacggtgccccttcgatgcgagacagacgaacgtagccctcttcgctgacggcaagctgtacagtgcaaccgtggctgactttctggcctctgatgcagttatttaccgatcaatgggagatgggtcagctctcagaactataaaatatgacagcaaatggatcaaagagccacatttcctccacgctatcgaatacggaaattatgtctatttctttttcagggaaattgccgttgagcacaacaaccttggcaaagcagtgtattctcgcgtggctaggatatgtaaaaacgacatgggcggatcgcagagggtgctcgagaagcactggacctcctttctcaaggccaggcttaactgcagcgtcccaggagattccttcttttacttcgacgtactccagagcattaccgacataattcagatcaatggtattccgactgtcgtgggagtctttaccacccagctcaacagcatccctggatccgccgtttgcgccttttccatggatgatatagagaaagtctttaaaggccgatttaaggagcagaaaacacctgacagcgtgtggaccgcagtgcctgaggacaaggttcctaaaccaaggcctggatgctgtgcaaaacatggattggcagaggcctacaaaacaagtatcgattttccagatgagaccttgtctttcataaagtcccacccactcatggactccgctgtgccccctatcgccgatgaaccctggtttaccaagacacgggtcagatataggcttaccgctattagtgttgaccactctgccggtccctatcagaactacacagtcatattcgtgggctccgaggctgggatggtcctgaaagtactggcgaaaaccagcccctttagccttaacgatagcgtgctccttgaagagatcgaggcttacaatcacgcaaagtgtagtgcggaaaacgaggaggataagaaggttatttctctgcagctggacaaagaccaccacgcactttatgtggccttttccagctgcatcattaggatcccgttgagtcgatgtgagcgatatgggtcatgcaaaaagtcatgtatcgccagtagggacccatactgtggttggctgagccaaggttcatgtgggagggtgaccccaggcatgctggccgagggctacgagcaagatacggaattcgggaatacagctcacctgggggactgtcacgatatggaagtttcgtcctctagtgtgaccaccatggtctatgacgggaaatcaagtctggagagtcctactagatggtccacttag

SEQ ID NO: 53894 - DNA, 69 bp, Artificial Sequence
  Description of Artificial Sequence: Synthetic coding sequence
atgcgggtgttcttgctttgcgcttatattttactcctgatggtgtcacagctaagagctgtgagctag

SEQ ID NO: 53895 - DNA, 660 bp, Artificial Sequence
  Description of Artificial Sequence: Synthetic coding sequence
atgcgggtgttcttactgtgtgcatacatcttgctgttaatggtgtctcaacttagagcagtttcattccctgaggacgatgagccactgaatacagtggactaccactacagtagacagtacccagtttttcgcggtagacccagcggaaacgagtcacagcaccggctggatttccagcttatgctcaagatccgggataccctgtacattgctggtcgcgaccaggtttacaccgtaaatctgaatgagatgcccaaaacagaggtgatcccgaataagaagctaacctggaggtcaaggcaacaggaccgggaaaattgcgccatgaagggcaaacacaaggatgagtgtcacaattttataaaagtgttcgtccctaggaatgatgagatggtgttcgtgtgtggaacaaacgcatttaacccgatgtgcaggtactatcgcttgtctacccttgaatatgatggcgaagaaatttcaggactcgccagatgtccttttgacgctagacagaccaacgttgccctatttgcagatggtaagctatattccgcaactgtggctgacttccttgcttcggacgccgtcatttataggagtatgggcgacggtagtgcccttcggacaatcaaatatgattctaaatggataaaatag

SEQ ID NO: 53896 - DNA, 6 bp, Artificial Sequence
  Description of Artificial Sequence: Synthetic coding sequence
atgtag

SEQ ID NO: 53897 - DNA, 447 bp, Artificial Sequence
  Description of Artificial Sequence: Synthetic coding sequence
atgcgcgtattcctgttgtgtgcctacatcctcctcttgatggtgagccaattgcgggctgtttccttccccgaagacgatgaaccactgaacaccgtggactatcactacagtagacagtaccccgtatttcggggaagaccctcgggcaatgaatctcagcacaggcttgacttccagcttatgctgaaaatcagggacacattgtatatcgcaggaagggatcaggtgtacacagtaaacctgaacgagatgcctaaaactgaagtgatacccaacaaaaaactgacctggcgaagtcggcagcaggaccgcgaaaactgcgcaatgaaaggcaaacataaagatgagtgtcacaacttcatcaaagtttttgtgccacggaacgacgagatggtgttcgtgtgtggcaccaatgcctttaatccgatgtgtagatattactag

SEQ ID NO: 53898 - DNA, 990 bp, Artificial Sequence
  Description of Artificial Sequence: Synthetic coding sequence
atggacgggccagttgctgaacacgccaaacaagagccattccatgtggtcactccgctgcttgagtcttgggccctctcccaggtggcaggcatgccggtgttcctgaagtgtgagaatgtgcagccttcgggctccttcaaaatccggggtatcggacacttttgccaggagatggcgaagaagggctgtcggcatctggtgtgttccagcggaggcaatgctggaatcgccgcagcgtacgccgctagaaaactaggcatacctgccactattgtgctcccagagtctacctcgttacaagtcgtgcagaggctgcagggtgagggcgcagaagttcaactcactggaaaggtatgggatgaagcgaatttaagggctcaggagttagctaagagagatgggtgggaaaacgtgccaccattcgaccaccctctgatttggaagggacacgcctcactggtgcaggaactgaaagcagtattgcgtacgcccccaggtgcactggtcttggcggtaggcggaggaggcctcttagctggggtcgttgccggtctgcttgaggtgggatggcaacatgtgcctatcatcgccatggaaactcacggggctcattgcttcaacgccgctatcaccgccggaaaactggtcacactgcctgatatcacgagcgtcgccaaatccctgggcgctaagacagtggcagcgcgagcgctggagtgcatgcaggtctgcaagattcacagcgaagttgtcgaggacaccgaagcggtttctgcagtgcagcagctactggacgacgaacggatgctggtagaacccgcttgtggagccgcactggccgcaatttactcaggcctgctacgtaggttgcaggctgagggctgtctgcccccttcactgactagcgtggttgtgatcgtctgcgggggaaataacatcaatagtagagagctgcaggctctgaagacacacctgggccaagtgtag

SEQ ID NO: 53899 - DNA, 990 bp, Artificial Sequence
  Description of Artificial Sequence: Synthetic coding sequence
atggatggccctgtggcagagcatgctaagcaggaaccattccatgtagtgacccctttgctagaatcatgggctttgagccaggttgcgggtatgccagtctttttgaagtgcgaaaacgtccagcccagcgggtcttttaaaatcaggggcatcggtcatttctgccaggagatggctaaaaaagggtgtcgacatctcgtatgctcttcaggcggtaacgcaggtattgccgcagcctatgctgccagaaaattgggcattcccgctaccatagtgctgcccgagagcacctcgttgcaggttgtgcagagactccagggagagggggcagaggtgcaattgacggggaaagtgtgggacgaggctaaccttagagcacaggagctggccaaaagggacggctgggagaacgtgccgccattcgatcaccctttgatatggaagggacatgcatctttagtgcaggagctgaaggctgtgctgcgcacgcctcccggagctctggtactggctgttggaggagggggactcctagccggagtggttgcgggtttactggaagtcggatggcagcacgtgcctattatcgctatggaaactcacggtgcccactgttttaacgcagcgatcacagccggtaagctggtcacattgcccgatattacaagcgttgctaagtctttgggtgctaagacagttgccgcaagggccctcgaatgcatgcaggtatgtaaaattcacagtgaggtcgtcgaagatactgaggccgtgtcggcagtgcagcaactccttgacgacgagcgtatgcttgtagaacccgcttgtggtgcagctttggctgccatttattccggcctcctgcgcaggctgcaagctgagggctgcttaccaccttctctcaccagcgtcgtcgtgatcgtgtgcggtggaaataatatcaatagccgtgagctgcaggcgctgaagacacacctcggtcaggtgtag

SEQ ID NO: 53900 - DNA, 90 bp, Artificial Sequence
  Description of Artificial Sequence: Synthetic coding sequence
atggatggcccagtagccgagcatgccaagcaggaaccatttcacgttgtcaccccactcctggaaagctgggcactgtcccaggtgtag

SEQ ID NO: 53901 - DNA, 1362 bp, Artificial Sequence
  Description of Artificial Sequence: Synthetic coding sequence
atgggctccgtcctcgggctgtgtagcatggcctcctggatcccatgtctgtgcgggtccgcgccatgcctactgtgccggtgttgcccttccggaaacaattccactgtcacccggctgatctacgcgctgttcctgctggttggagtttgtgtggcttgcgttatgctcatcccgggtatggaggaacagctaaataagattcctggcttttgcgaaaatgagaaaggcgtcgtcccctgtaacatcctcgtaggttataaggctgtatataggttgtgttttggactcgccatgttttatttgctgttgtctttactaatgatcaaggtgaaatcctccagcgaccctcgagcagcagtacacaacggattctggttctttaagtttgcggctgctatcgctattatcatcggtgctttctttatccctgaaggcaccttcactaccgtttggttttatgtagggatggccggagccttttgtttcatcctcattcagctggtactgctgatcgattttgcacactcgtggaacgaatcctgggtggaaaaaatggaagaaggtaacagcaggtgttggtatgcagccctgctctcagcaacagcccttaattaccttttatcactggttgcaatcgtattgttcttcgtttattacacacacccagcatcatgctcagaaaataaggctttcatctctgttaacatgctcctttgtgtgggcgcaagcgtcatgtcaattctccctaaaatccaggaaagccagccaagaagtggactgcttcagtcatccgtgatcaccgtttatacgatgtatctcacgtggtcagctatgaccaacgaacccgagactaactgtaaccctagcttgttaagcatcatcggctacaatacaactagcacagtcccaaaagaggggcagtccgtgcagtggtggcacgctcaggggatcattgggttaattctgtttctcctgtgcgtgttttactcttcaattagaacttctaataactcacaagtcaataagttgactttaacctccgacgagtcaactctgatcgaggatggtggagcaagatcggatggtagtctcgaggacggggatgacgtgcaccgtgcagttgacaacgaacgcgatggcgtgacatacagttactccttctttcattttatgctctttctggctagcttatatataatgatgaccctgactaattggtacagatacgagccttcacgcgagatgaagtctcagtggacggctgtatgggtcaaaatcagctcttcttggatcggaatcgtgctgtatgtgtggacgctcgtggctccccttgtgttgacgaacagagacttcgactag

SEQ ID NO: 53902 - DNA, 1362 bp, Artificial Sequence
  Description of Artificial Sequence: Synthetic coding sequence
atgggcagcgtgctcggcctgtgctccatggcctcctggattccatgtctctgcggcagcgctccctgccttctttgccgctgctgccccagcggcaataactcgaccgtcacgaggttaatttatgccttgtttctgctggtcggcgtttgtgttgcctgcgtgatgcttatccctggcatggaggagcagcttaacaaaattccagggttttgtgaaaatgaaaagggcgtggtgccatgtaatattctggtaggctataaagccgtgtataggttgtgcttcggtttggccatgttctatctgctgctgagcttgttgatgattaaagtcaagtctagttccgacccccgagccgcagtgcataacgggttttggtttttcaaattcgctgcagccattgctattataatcggagccttctttatccccgaaggtacattcaccactgtctggttttacgtgggaatggcaggcgctttctgtttcatcctcatacaattggtgcttctcatagattttgcacactcttggaacgagagttgggtggagaaaatggaggaaggaaattctcgctgttggtatgctgcgttgctctcagcaacagctctcaactacctactgtcactggtggccatagtcctgttttttgtatactacacacatccagcaagctgtagtgagaataaggctttcatcagcgtcaacatgctgttatgcgtgggcgcatccgttatgtcaatcctcccaaaaattcaggaatcgcaacctcgcagtggcctgttgcagagctccgtgataactgtgtacacaatgtatctgacctggtccgcaatgaccaatgaaccagagacgaactgtaacccaagcctactgtccatcatcggttacaatactacgtcaaccgtccctaaagagggacagagtgtgcagtggtggcacgctcagggcatcatcggactgattctattccttctgtgtgttttttactccagcattcgaacctcaaataattcgcaggttaacaagttgactctgacttccgatgaaagcaccttaatcgaggacgggggagccagatccgacggctcacttgaagatggagatgatgtccatagggccgtggacaacgaaagagatggcgttacgtacagctattccttctttcactttatgctgtttctggccagcctatatatcatgatgactcttaccaactggtaccgttacgagccaagtcgcgaaatgaaaagccagtggaccgccgtgtgggtaaaaatctcatcctcctggattggtattgtcctgtatgtctggacacttgtcgctccacttgttctgactaaccgggattttgactag

SEQ ID NO: 53903 - DNA, 1368 bp, Artificial Sequence
  Description of Artificial Sequence: Synthetic coding sequence
atgggagcgtgtttgggggcatgtagtcttctgagttgtgccagttgtctttgtgggtccgctccctgcattctgtgttcttgctgcccagcctcccgcaatagtaccgtttctcggttgatttttacgttcttcctgtttcttggcgtgctggttagtatcataatgttaagccctggtgtggagtcccagctgtataagctgccttgggtttgcgaggaaggagccggtatcccaaccgtactgcagggacatatcgactgcggatcactgctgggctatcgggcagtgtaccgcatgtgcttcgccactgccgctttcttctttttctttactctgctgatgctatgtgtcagcagctccagagaccccagagctgccatccagaacggcttctggttcttcaaattcctgatcctcgtgggcctaactgtgggagctttctatattcctgatggctcgttcacaaacatttggttttatttcggggtggtaggcagcttcctgttcatactgatccagctggttttacttattgacttcgcccactcatggaatcagagatggctgggcaaggccgaagaatgcgactctagagcctggtacgccggtttattcttcttcaccctgctgttctatctgctgagcattgcggcagtcgccctcatgtttatgtactacacagaacccagcgggtgccacgaaggcaaagtcttcatctcattgaacctgacattctgcgtctgcgtgtcaattgccgcagtcttacccaaggttcaggatgctcagcccaactctggccttctccaagccagtgtgatcaccctctatacaatgttcgtgacatggagcgccttgagcagcattccagagcagaaatgcaatccacacttaccaacccagctgggaaacgagaccgtggtggcgggacctgagggatacgaaacacagtggtgggatgccccatcaatcgtggggctgataatcttcctcctgtgtaccctgtttatcagcctgaggtcttcagatcatagacaggtgaattccctcatgcagaccgaagaatgtccacccatgttggatgcgactcagcaacaacagcaggttgcagcctgcgagggacgcgcattcgataatgaacaggacggcgtcacgtacagctatagctttttccacttttgcttggtgctggcttcactccatgtcatgatgactctgactaattggtacaaacccggtgagacacggaagatgatctcaacatggacagccgtgtgggtgaaaatttgtgcgtcatgggcaggactcctgctgtacctgtggacactggtggcgccactgctgttgaggaacagggactttagttag

SEQ ID NO: 53904 - DNA, 1395 bp, Artificial Sequence
  Description of Artificial Sequence: Synthetic coding sequence
atggacggcagaatgatgaggagtatgaggctcagggaagaggagtcaccaggaccctcccataccgctagttgcctgtgcggaagtgccccttgtattctgtgctcttgttgccccgcatctagaaactctacagtatcccgtctgattttcacctttttcctcttccttggggtacttgtaagtataatcatgctctctccaggcgtggagtcgcagctgtataaactgccctgggtgtgcgaggaaggcgctggcattccaaccgtattacaagggcatatagactgcgggagcttattggggtaccgtgccgtgtatcgaatgtgcttcgctaccgccgcattctttttcttttttactcttttaatgctgtgtgtatcatcgtcacgagaccccagagcggcaatacaaaacggattctggtttttcaaatttcttattctcgtgggtctgactgtgggcgcattctacatccctgatggcagcttcaccaatatttggttctatttcggtgtggtggggagtttcttgtttatcctcatccagctggtcctcctcatcgactttgcgcatagctggaaccaacggtggttaggcaaagccgaggaatgcgactcaagggcctggtacgccggtctctttttcttcaccctattgttctatcttttgagcatcgcagccgtggctctgatgttcatgtattacacggagcccagtggctgccacgaaggtaaggttttcattagcctgaacctgacattttgcgtttgtgtttccattgcagctgtcctgccaaaggtgcaagatgcacaacctaattcagggctcctccaggccagtgtgattacactgtatacaatgtttgtcacttggagcgcactgagctctattcctgaacagaagtgtaatccccatttaccgactcagttgggtaacgagacagtggttgccggaccggagggctatgagactcagtggtgggatgcgccttctatcgtggggctcatcatttttcttttatgtacgctgtttatatctctgcgcagttctgaccacagacaggtgaattccctaatgcaaacagaggaatgtcctcccatgctagatgctacccagcagcaacagcaggtcgccgcatgcgaggggagggccttcgataatgaacaggacggtgttacatactcttattcttttttccatttctgcttggtgttagcgtcgctccatgtgatgatgaccctgacaaactggtataaacccggagagacgaggaagatgatctccacttggacagcagtgtgggtcaagatctgtgccagctgggcaggcctactgctgtatctctggaccctggtggccccactgcttctgcggaatcgcgacttcagctag

SEQ ID NO: 53905 - DNA, 1380 bp, Artificial Sequence
  Description of Artificial Sequence: Synthetic coding sequence
atgggggcagaaggcgcacccgacttcctatcatgccccagagtgcgcagagccagttgcctttgtggctcagcaccctgtattctatgctcatgctgccccgcatccaggaacagcaccgtctcccggctgatttttactttctttctttttctgggagtgctcgtgtccattataatgctttccccaggcgtcgaatcccagctttataagctgccgtgggtgtgtgaggagggagcgggtattcctacagtcctgcaggggcatatcgattgcggcagcctgttaggatacagagccgtataccgcatgtgtttcgcaacagctgcatttttcttcttttttactctccttatgctgtgtgtctcttcaagccgggaccccagggcagccatccagaatgggttttggtttttcaagttcttgattctggtgggcttaacagttggcgcattctatattcccgacggctcttttaccaacatctggttctactttggagtggtaggttccttcctatttatattgattcagctggtactgttaatcgatttcgcgcattcctggaaccagaggtggctcggcaaagctgaagagtgcgattctagagcctggtatgcaggcctgttttttttcaccctgttattttacctgctgtccatcgcggcagtcgcactgatgttcatgtactacaccgaacctagcggctgccacgagggcaaagtgttcatcagcctcaacctgaccttttgtgtatgtgtcagcattgccgctgtgctgccgaaggtacaagatgcccagcccaactctgggttgctccaggcgtccgtcattactctgtacacaatgttcgtcacctggtcagcactgagtagcattcccgagcaaaagtgtaaccctcacctgccaacccagttgggaaacgagactgtggtggcgggacccgagggatacgagacacagtggtgggatgccccaagcattgtgggcttgattatcttcctcctgtgcaccctcttcatcagcctacggtcaagtgatcatcgccaggtgaactctttgatgcagaccgaagagtgcccccctatgttggatgccacccagcagcagcagcaagtggcagcctgcgagggcagagcttttgacaatgaacaagacggcgtgacttactcctacagcttcttccacttctgccttgtgctcgcaagcctacacgtgatgatgactttgacaaactggtataaacccggtgagacccgcaaaatgataagcacttggactgcagtgtgggtgaaaatatgtgcatcttgggccggacttctgctgtatctgtggacgctcgtagcgcctctgctgctccgcaatcgggattttagttag

SEQ ID NO: 53906 - DNA, 1380 bp, Artificial Sequence
  Description of Artificial Sequence: Synthetic coding sequence
atgcgctccatgagacttcgtgaagaggaatcccctggcccttctcacacagccagctgtctgtgtggctccgcaccttgtattctttgctcctgctgccctgccagtagaaattctacagtctcccgactcatcttcacctttttcctgtttctgggagtgcttgtgagtatcataatgttgagccccggtgtggagtcccagctctacaagctcccatgggtgtgcgaagagggagcaggcattccaactgttttacaagggcatattgactgtggcagcctgctggggtacagggcagtctatagaatgtgttttgcaactgccgcattcttcttctttttcaccctgttaatgctgtgcgtgagcagttcccgggaccctagagccgctatccagaatggtttctggttcttcaaatttctcatactggtaggcctgaccgtcggcgctttctatatacctgacgggtcatttactaatatctggttttattttggagtcgtcggaagctttctatttattctcattcaactggtactattaattgatttcgctcactcctggaaccagcggtggctgggcaaggccgaagagtgcgactccagagcctggtatgctggactgttctttttcaccttactgttttatctcctctctattgctgcagtagccctgatgttcatgtactatacggagccttcggggtgccacgagggtaaggtgtttatcagcctgaaccttactttctgcgtctgtgtctctatcgctgcagttctgccaaaggtccaggatgctcagccaaatagtggtctgttgcaggcctctgtcatcacactttatactatgttcgtaacctggtctgccctgtcctctatacccgagcaaaaatgtaatccccatttgccaactcagctcggtaatgagactgtggttgccggacctgaaggctacgagacacaatggtgggacgccccatctatagtgggactgatcatatttctcctatgcacactgttcatctctcttcgcagctctgatcatagacaggtgaactctctaatgcaaacagaggagtgcccccctatgctggacgcgacccagcaacagcagcaggttgctgcttgtgaggggcgagcctttgacaacgaacaggatggcgttacttacagctattccttcttccacttttgtctcgtcctagccagtctccacgtgatgatgactctgaccaactggtataaaccaggggagacccggaagatgatctccacatggactgccgtgtgggtgaagatatgtgcctcttgggccggactacttctatatttatggaccttggtggctccgctgctgctgcgaaacagggatttttcgtag

SEQ ID NO: 53907 - DNA, 825 bp, Artificial Sequence
  Description of Artificial Sequence: Synthetic coding sequence
atgagtatctccagccagcatggtattacattggcctcagttgaggccctccattcatcatactgttcttggtgcctgttgcagttgctgccgattccgggtaccaggaccgagcagcccagatctgggctgctgcaggcatcagtcatctcctgctatattatgtacctgacattctccgctctgagtagcagacctccagagagggtgattctccagggtcagaaccacacgctctgtcttcccggactatcgaagatggagccacagactccggacatctctctcgccatgctgtcagccagtattatgtatgcctgcgttctctttgcctgcaatgaagcctcctacctggccgaagtgtttggcccactgtggatcgtaaaggtctattcctatgaatttcagaagcccagtctttgcttctgctgtccagagacggtggaggccgataagggtcagcgcggaggcgctgccaggcccgcagatcaggaaacccctcctgctcctcccgtacaagtgcaacatttgtcatataactactctgcatttcattttgtctttttcctggctagcctttacgtcatggtaacccttactaactggtttagctatgagggggctgagctcgaaaaaacctttattaaggggtcttgggccactttctgggtcaaggttgcatcgtgctgggcttgcgtactcctgtatttaggactgctgctggcaccactgtgctggccgccaacccagaaaccccaacccttaatcctaaggagacgcaggcataggatcatcagccccgacaacaaatatccacccgtgtag

SEQ ID NO: 53908 - DNA, 1557 bp, Artificial Sequence
  Description of Artificial Sequence: Synthetic coding sequence
atggtcggagcaaaagccggaccgtcccccggaacttcactgggtctggcacagcaacacagcggaggttccagtgtcctggttaagagccctttttgtcaggtgtgttgctgcgggccagccccatgtgcctcatgctgtcactctcgctggcctagcctgacggcatcgacctgttctaggttgttctacatcctgctgcacgtgggcgcttccgccatttgttgcctcctgcttagcagaactgtggtggagcgcgtttgggggaagacacacagaatacaaatgccctcagggctgtgcgctcatctgtttggcttgagcgactgcccagtgctgtccggctccggtgccgtgtatcgagtttgtgctggcaccgccacatttcacctgttacaggctgtcctgctcgttcatctccacagccccaccagccccagggcccagctgcacaattccttttggctgctgaagcttctctttctgctcggactctgtgccattgctttttgcattccagatgagcacttgtttcccgcttggcactacattggaatttgtggcggtttcgcattcatcctcttacagctggtgttaatcactgcatttgcccacagttggaataagaactggcagactggtgccgcacaagactgcagctggtttctcgctgtgctcctcgcaacactcggcttctattccatggccggagtgggtgctgtgttgttattccactattacacccatcctgccggatgtctgctgaataaaatgctgctttccttgcatctttgcttttgcgggctgattagctttttaagcatagcaccttgcatccggctgaagcaaccacgctctggccttcttcaggcaagtgtgatcagctgttacatcatgtacttaactttctctgcattgtccagccggcctccagagagagttattcttcagggacagaatcacactctctgtctccccggattgtcaaaaatggagccacagacccctgacatttccctcgccatgctgagtgccagcattatgtacgcttgtgtgctgttcgcttgcaacgaggcgagttatcttgccgaggttttcggcccattatggattgtaaaggtgtattcttatgagttccaaaaaccgtcgctgtgtttctgttgccctgagacagtagaagcagacaagggccagcggggtggcgctgctagaccagctgaccaggagactccccctgcgccacctgtgcaagtgcagcacctctcctataactactcagcctttcattttgtctttttcctagcaagtctgtatgtgatggttactctaaccaattggtttagctatgaaggagccgaactcgaaaagacgttcatcaagggcagctgggctaccttttgggtaaaagtagctagctgctgggcttgtgtcctgctgtacctgggactactgctcgcccctctatgttggccgccaacgcagaaaccccagcctctaatactaaggagacgaaggcaccgcattatcagccccgacaataagtatcccccagtgtag

SEQ ID NO: 53909 - DNA, 291 bp, Artificial Sequence
  Description of Artificial Sequence: Synthetic coding sequence
atggtcggggctaaagcagggccatcaccgggaacttccctcggtctggctcagcagcacagcgggggtagttctgtgcttgtgaagtcccctttttgccagcaggtgtccacgtcactgccttgcatctgcagtacccctcggtgcgcagctgttggactcctgctggtacccgctgccgctacccttggcggacccctatccccacatccgctggctgccgcttgctcaaccagttcatcaatgtgggggcctcagcagagcgctgcctcatgttgtcagggacagtag

SEQ ID NO: 53910 - DNA, 1269 bp, Artificial Sequence
  Description of Artificial Sequence: Synthetic coding sequence
accggcagctgttgcgtggatcaactggcctgttgctgtggctccgctggatgtagtctgtgttgtgattgttgtcctagaattaggcaatccctaagtacaagatttatgtatgccctgtacttcatcttggtggtggtgctgtgctgtattatgatgagcacaacagtcgctcacaaaatgaaagagcatatcccattctttgaggatatgtgtaaagggataaaggccggagacacctgtgagaaactggtcggatattcagccgtctatagagtctgctttggaatggcctgctttttctttatcttctgcttgctgaccctgaagatcaacaatagcaagtcatgccgggctcacatacataatggtttttggtttttcaagttgttgctcttgggagctatgtgttcaggagccttctttatccccgatcaggatactttcctgaacgcttggcggtacgtgggcgctgtaggaggcttcctgtttattgggatccagctactactgctggtggagttcgcccacaagtggaacaagaactggaccgcagggacagccagcaacaaactgtggtatgcctctttggccttggtgacactgatcatgtattcaattgccaccggaggtctcgtgttgatggcagtgttctatacccaaaaagactcttgtatggagaacaaaatacttctgggcgtcaacgggggtctgtgtctcttaatctctctggttgctataagcccttgggtccaaaacagacagcctcatagtggactcctgcaaagcggtgtcataagctgttatgtcacctacctgactttttccgccctgagctcgaagcccgctgaagttgtactcgacgagcatggcaaaaatgtcacgatttgcgtccccgacttcggccaagacctctatcgcgatgagaatctagtgaccattctcggtacctctctcttaataggatgtattttatacagttgtctcacatccacgaccagatccagtagtgatgcacttcaggggcgatacgctgcccctgagctggagattgcccgatgctgcttttgtttttcccccggaggggaggatacggaggaacagcagccaggcaaagaaggcccacgcgtcatttacgatgagaagaagggcaccgtgtacatctactcctattttcatttcgtatttttcctcgcctccctgtatgtgatgatgaccgtgaccaattggttcaatcacgtcaggtcagcatttcatttgctgccctag

SEQ ID NO: 53911 - DNA, 1272 bp, Artificial Sequence
  Description of Artificial Sequence: Synthetic coding sequence
atgtcagcccagtgttgtgcagggcaactggcatgttgctgtgggtctgcaggctgttcactctgttgtgactgctgtcccaggatccggcaatctctgtctacccggttcatgtatgcgctgtatttcattttggtggtcgtgctatgctgcataatgatgtcgacaacagtggcccataagatgaaggaacatattcccttttttgaggatatgtgcaaagggattaaggcgggagatacatgcgagaaactggtggggtatagtgccgtataccgcgtgtgctttggcatggcatgcttcttcttcatcttctgcctgctcacgctcaaaatcaataatagtaaaagctgtcgagctcacattcataatggattctggtttttcaagctgctgctgctcggtgcgatgtgttccggggcattttttattcccgatcaagacacttttttgaacgcgtggcgttatgtgggggcagtaggcggatttcttttcataggcatacagctgctccttctagtcgagtttgcgcacaaatggaataagaattggaccgccggaaccgcttccaacaagctctggtacgccagcctggctcttgttacactgataatgtacagtattgccacaggaggcctggtgctgatggcagtgttttatacccaaaaagactcttgcatggagaacaagatcctgttgggtgttaatggtgggttatgcctgctaatctctctggtggcaatctcaccatgggtccagaatcggcagccccatagcggcctgcttcagtcgggggtcattagttgctacgtaacctatctgaccttcagcgcgctgagctctaaacctgctgaggtagtgcttgacgagcacggcaaaaacgttaccatatgcgtccccgacttcggccaggacctgtatcgtgacgagaatctggtaacaatcctaggcactagcctgttaatcggctgtatcctgtactcctgtctgacctccacaacacggagttcatctgacgctctccaggggaggtacgcagcccctgagctcgaaattgccaggtgttgtttttgtttttcccctggcggtgaagacacagaagaacagcagccgggaaaggagggcccacgcgtgatctatgatgagaagaaagggaccgtgtatatctatagttatttccattttgtgttttttttggcatctctatatgtcatgatgacagtaaccaactggtttaaccacgttaggagtgccttccacctgctcccttag

SEQ ID NO: 53912 - DNA, 1371 bp, Artificial Sequence
  Description of Artificial Sequence: Synthetic coding sequence
atgtcagcgcagtgctgcgctggccagttggcatgttgttgcggctctgctgggtgcagcctgtgctgcgattgttgccctaggattcgtcaatctttaagcacacggttcatgtacgctctttatttcattttagtcgtcgtgctgtgctgcatcatgatgtcaacgacggtcgcccataaaatgaaggaacatatcccattcttcgaggacatgtgcaaggggatcaaagcaggggacacctgcgagaaattagtgggctactctgcagtttaccgggtttgttttgggatggcttgcttctttttcattttctgtctgctgacacttaagatcaataattccaagtcatgtcgagcccacattcacaatggattctggtttttcaagctactgttgcttggcgctatgtgctcaggagcattctttattcccgaccaggacacttttctgaatgcatggagatacgttggcgctgtcggcggattcctctttattggtattcagctgctgcttctggtcgaattcgcccataaatggaacaaaaactggaccgccggtacggcttctaacaagctgtggtacgcatcactggcgctcgtcacactaatcatgtattccattgcaaccggaggtctcgtgcttatggcagtgttctacacccagaaagattcttgcatggagaacaaaattctcctgggagtaaatgggggactatgcctgctaatctccctggtggctatctccccctgggttcagaatcgccagcctcactccggactgctgcagagcggggtcatcagctgctatgttacatacctgactttttccgccctttcgtcaaaacctgctgaggtggacgagcacgggaaaaatgttaccatatgcgtacccgatttcgggcaagacctgtatcgtgatgagaatctagtgaccattctgggaacaagtcttcttattggatgtatcctctacagctgtctgaccagcacgacacggagctccagcgatgcactccaggggcgatacgcggctccggagctcgaaatcgccagatgttgcttttgtttcagcccgggaggcgaggacactgaggaacagcaacccggtaaagagggcccacgggttatctatgacgagaagaaagggacagtttacatatatagctattttcacttcgtgttttttctggcctccctgtacgtcatgatgacagtcacaaattggtttaagtggtccccgaccctgctgccaaggcttgagtacagtgggatgattttggcacattgtaacttgcatttgcctgatgtgaaaaggttttcgtgtctatctctgcccagctcctgggggtacagacacgtgcctccttag

SEQ ID NO: 53913 - DNA, 1386 bp, Artificial Sequence
  Description of Artificial Sequence: Synthetic coding sequence
atgagtgcacagtgctgtgccggacagctcgcttgttgctgtggctcggcgggatgttcgctttgttgcgattgttgccctcggatccggcaaagcctctccaccagattcatgtatgccctgtatttcatactggtagtggttctttgctgcataatgatgagcactacagtagctcataagatgaaagagcatatccctttcttcgaggacatgtgcaaaggcattaaggccggtgacacatgtgagaagctggtgggctattctgccgtgtatagggtctgctttgggatggcctgttttttcttcattttctgtctcctgacactgaagatcaacaacagcaagtcgtgtagggcccatattcataatggattctggtttttcaagctgctgctgctcggagccatgtgcagcggagccttttttatcccagatcaggacacgtttcttaatgcctggcgttacgtgggggctgtgggaggatttctttttataggtattcagctcctactactcgtggagttcgctcataagtggaacaaaaattggaccgcagggaccgccagcaacaaattatggtacgcctctcttgctcttgtcaccttgattatgtacagcatcgccactggcggactagttttaatggcggttttttatactcagaaggatagttgcatggaaaacaagattctattaggagtgaatgggggactgtgcctgcttatctccctggtcgcaatcagcccttgggtacagaaccgccagccacactcaggcctcctacagtccggagtgatctcctgttatgttacgtacctaacattttccgcactgtctagcaagcctgccgaagtcgtgctggacgaacacggcaaaaatgtcaccatatgcgtccccgatttcggccaagatctctatcgtgacgagaacctggtcaccattctcggcacaagtcttctaatcgggtgtattctgtactcatgtctgacttcaacgacaagaagctcctcagacgcactgcagggccgatatgccgcacctgagctggagatagctaggtgttgcttttgtttcagcccaggaggggaggatactgaagagcagcagccgggaaaagaaggcccacgggtgatttacgatgaaaaaaagggaaccgtctacatttactcttatttccacttcgtcttcttccttgcctccctgtacgtgatgatgacagtcactaactggttcaattatgaatccgccaatattgaatccttcttctccggttcttggtcaattttctgggtgaaaatggcaagctgctggatctgtgttctcttatacctctgtaccttggtggccccactctgttgtccaacccgtgaatttagtgtgtag

SEQ ID NO: 53914 - DNA, 216 bp, Artificial Sequence
  Description of Artificial Sequence: Synthetic coding sequence
atggccggaatggccctggctagggcctggaagcaaatgagctggttctactatcagtatttgcttgtgactgcgttgtacatgctggagccatgggaaagaaccgtgttcaatagcatgctggtgtctattgtggggatggcactctataccgggtacgtgtttatgccccagcatattatggctattctgcactactttgaaatcgtccaatag

SEQ ID NO: 53915 - DNA, 231 bp, Artificial Sequence
  Description of Artificial Sequence: Synthetic coding sequence
atggaccttaggcgcgtgaaggagtacttcagctggctgtactaccagtaccagattatatcgtgctgcgctgtgctcgagccctgggagcgtagcatgtttaatactatattactcaccattatcgccatggtagtttatactgcatatgtgtttatcccgattcacatccgtctggcctgggagttcttctcaaagatttgcgggtaccactcaactatatcaaattag

SEQ ID NO: 53916 - DNA, 231 bp, Artificial Sequence
  Description of Artificial Sequence: Synthetic coding sequence
atggatctgagaagggttaaggagtactttagttggctctactaccaataccagatcatatcttgttgcgccgtgctcgagccttgggaaagaagcatgtttaataccattttgttgacgataatcgccatggttgtttacacagcctatgtgtttattccaattcatatccggctggcttgggaattcttcagcaaaatttgtgggtatcattctactatttccaactag

SEQ ID NO: 53917 - DNA, 918 bp, Artificial Sequence
  Description of Artificial Sequence: Synthetic coding sequence
atggggcacgccttgtgcgtgtgctctaggggcaccgtgatcattgacaataaacgatatctgtttattcaaaagctgggcgaaggaggtttcagctacgtggacctggtcgaaggtttacacgatggccacttctacgctttaaagcgcatcctgtgtcatgaacaacaagatagggaggaagcgcaacgcgaggccgacatgcatcgcttgttcaaccatcctaatatcttacgcctggtggcctattgtctaagagagaggggcgctaagcacgaggcttggctgctgttaccattcttcaagcggggaaccttgtggaacgaaatagaaagactgaaagacaaaggaaattttctgactgaagaccagatcctgtggctccttttgggcatctgcagaggactcgaggccatccatgctaaagggtacgcccatcgggatctcaaaccaactaacatactgctgggggatgaaggacagcctgtgctgatggatctgggctcaatgaatcaggcttgcatccacgttgaaggatcccggcaggctctgacgttacaggattgggctgcacagaggtgcacaatcagctatcgagcccctgaacttttttctgtccaaagccactgtgttatcgatgaaagaacagacgtgtggtccctgggctgtgtactttacgcgatgatgtttggggaaggcccatatgatatggtcttccagaagggtgactccgtggcccttgctgtccagaatcaactgtctatcccccagagcccgcgtcatagcagtgccttaagacagctgctgaatagcatgatgacagttgacccccatcagaggccgcacatccccttgctgctcagtcaactggaggcacttcagccacctgcacccggtcagcataccactcagatttag

SEQ ID NO: 53918 - DNA, 918 bp, Artificial Sequence
  Description of Artificial Sequence: Synthetic coding sequence
atggggcatgccctttgcgtatgcagccgcggaactgtgatcattgataacaaacgctatcttttcattcagaagctgggcgaagggggattctcatacgtagacttagtcgaagggctgcatgacgggcacttttacgctctgaaacggatcttgtgccatgaacaacaggacagggaagaggctcagcgcgaggccgatatgcatcggcttttcaaccaccctaatatactgcggctggtggcctactgtctccgtgaacgcggagcaaagcatgaagcctggcttcttctgcccttttttaagaggggcacgttgtggaatgaaatcgaaaggctgaaagacaaggggaacttcctgactgaggaccagatcctgtggctgctgctcggcatttgccgaggcttggaggcgattcatgcaaagggctacgcccaccgcgacctgaaacctaccaatatacttcttggtgatgaggggcagcccgtcctgatggatctgggctccatgaaccaggcctgcattcacgtggagggcagcagacaggcccttaccttacaggattgggccgcacagcgttgcacaatctcttaccgagctccagagctgttcagcgtgcaaagccattgtgtaatcgacgaaaggactgacgtatggtctctgggctgcgttctgtacgcgatgatgttcggagaaggaccgtacgatatggtttttcagaaaggggattccgtggccctggcagtacagaaccagctgtctatcccccagtcccccaggcactcatctgctctaaggcagctgctgaactcgatgatgacagtcgacccacatcagagaccccacatcccattgctgctgagccaactggaggcgctgcagccgccagctcccggtcagcataccacacagatttag

SEQ ID NO: 53919 - DNA, 1269 bp, Artificial Sequence
  Description of Artificial Sequence: Synthetic coding sequence
atgggcatgactcgaatgttactcgagtgttctttgtctgataaattatgtgtgatccaagagaagcagtatgaggtgatcattgtacccactcttctcgtgacaatctttctgatccttctgggggttatcctctggctgttcattagagagcagcgcactcagcagcagcgcagtggaccccagggcattgcaccggtgcccccacccagagacttgtcctgggaggcgggtcacggcggaaacgtcgcactcccgcttaaggaaacgtccgtagagaattttctaggagccacaactccagcgctagcaaagctgcaggtccccagagagcagctgagcgaagtgttagagcagatttgtagtggcagctgtggtcctatttttagggcaaacatgaatactggggatccttcaaagccaaagtctgtgattctaaaagctctgaaagaaccagctgggctacacgaggttcaggactttctaggacgtattcagtttcatcagtatctaggcaagcataagaacctcgtgcagctggaaggctgttgtaccgaaaagctccctttatacatggtcctggaagatgtggctcagggtgacctgttgtcttttttgtggacttgtagaagggacgtgatgacaatggacggcctcttgtatgacctcaccgagaagcaagtttaccatatcggcaagcaagtcttgcttgcactggaatttctccaagagaagcatctctttcacggcgatgtggctgcaaggaatatcctgatgcagagcgatttaactgcaaaactgtgtggcctgggtctcgcctacgaggtctacacgcggggagctatatcatccacccagacaattcctctcaagtggctcgcccctgagcgattactgctgcgtcctgctagtatccgagccgacgtgtggtccttcggtattctcctgtatgagatggtaaccttgggcgcaccaccttatcccgaagtgcctccaaccagtattctcgagcacctgcagcgccgaaagataatgaagcggccatcttcctgcacacacactatgtactcaatcatgaagtcctgttggcgctggcgtgaggcagatcgcccaagccccagggagttgcgcctgaggctggaggccgcaatcaagacggcagacgatgaagccgtgctacaggtgcccgagttggttgtacctgaactctacgctgccgttgcaggcatccgagtcgaaagcctgttctataattattcaatgctgtag

SEQ ID NO: 53920 - DNA, 198 bp, Artificial Sequence
  Description of Artificial Sequence: Synthetic coding sequence
atggggatgacccggatgctgctagagtgcagcttaagcgacaagctgtgtgtcattcaagagaaacaatatgaggtgatcatagttccaactctgctggtgaccatctttctgatcctgctgggagtgatactgtggctgttcatacgtgaacagcgcacacagcagcagcggagcgggcctcagggaaaggcatag

SEQ ID NO: 53921 - DNA, 252 bp, Artificial Sequence
  Description of Artificial Sequence: Synthetic coding sequence
atgggcatgaccagaatgttgttggagtgctccctgtctgacaagttgtgcgtcatccaagaaaagcaatatgaagtaatcatagtccccaccctgttagtaacgatttttttgatcctgctcggagttatcctctggttattcattagagagcagcgcacacaacaacagcgcagtggcccacagggcatcgcaccggtaccaccccctagggatctttcctgggaggcaggtcacggagggaatgtatag

SEQ ID NO: 53922 - DNA, 126 bp, Artificial Sequence
  Description of Artificial Sequence: Synthetic coding sequence
atgggaatgactagaatgctcttagaatgctccctctcagataagctttgcgttatccaggagaaacagtacgaggtgataatcgtgcccacgttgctggtgaccatctttttgatcttgctgtag

SEQ ID NO: 53923 - DNA, 264 bp, Artificial Sequence
  Description of Artificial Sequence: Synthetic coding sequence
atgggaatgacccgcatgctgctggaatgcagcctgtccgacaaactctgcgttatacaggagaagcagtacgaagtgatcatagtacccaccctactggtgacaatctttttgattcttctcggggtaattctctggctgtttattagagaacagcggacccagcagcagcggtccggtcctcagggcatcgctcccgtgccgccaccacgggatctgtcctgggaggcagggcatgggggaaacgtggctctgcccctctag

SEQ ID NO: 53924 - DNA, 324 bp, Artificial Sequence
  Description of Artificial Sequence: Synthetic coding sequence
atgtcggaaccagacacctcaagcggtttctccggctccgtcgagaacggcacattcctcgagttatttcctacaagtctcagtacttcagtcgacccttctagcggtcatctgagtaatgtatacatctatgtcagtattttcctgagcttacttgcattcctcttgctgctgttaatcattgcactccagagattgaagaatatcatctccagctcttctagctaccccgagtacccaagcgacgcaggctcctccttcaccaacctggaggtgtgcagtataagcagtcagaggagcactttttcaaacttatcgagctag

SEQ ID NO: 53925 - DNA, 1182 bp, Artificial Sequence
  Description of Artificial Sequence: Synthetic coding sequence
atgcccggtcaccttcaggagggatttgggtgcgtggtcacgaacagattcgaccagctcttcgatgatgaaagtgatccattcgaagtgctgaaggccgctgagaataagaagaaagaagctggcggtggtggggttggagggcctggcgcaaagtctgcagcccaggcggcagcccagacgaacagcaatgcagctgggaaacagttacgaaaagagtcacaaaaagataggaagaacccactgcccccaagtgttggcgtagtggataagaaggaagaaacccagcctcccgtggcacttaagaaagagggtatcagacgagtgggtcggcgacctgaccagcagctccaaggagaaggcaaaatcattgaccggaggccagaacggaggccgccaagagagcgcagattcgagaaacctctggaggagaagggagagggaggcgagttttccgtcgataggccaatcatcgaccggccaattagaggcagaggaggcctcgggagaggacggggagggcgaggcagagggatgggacgcggagatgggtttgattcaagagggaagcgggagttcgatcgccacagcggatcagatcgcagttcttttagtcactatagcggactaaagcatgaggacaaaaggggcggtagtgggtctcacaactgggggaccgtcaaagacgaactgacagacctggaccaaagtaacgtaactgaagagacccccgaaggagaagaacatcatcctgtagccgataccgaaaataaagagaacgaggtcgaagaggtgaaggaagagggcccaaaagagatgaccttggatgagtggaaggcaatccagaacaaggaccgagccaaggtcgagtttaatattcgcaagcccaatgagggcgctgatggacagtggaaaaaaggcttcgtcctccataaatctaagtccgaagaggcccatgccgaggatagtgtcatggaccaccatttccggaaacctgccaatgacattacatcacagctcgagattaattttggcgatctcggcaggcctggcaggggaggcagaggaggtcggggtggccgagggagggggggtaggcctaataggggctcccggacagacaagagctctgcgagtgctccagacgttgatgatcccgaagcctttcctgctctggcctag

SEQ ID NO: 53926 - DNA, 1209 bp, Artificial Sequence
  Description of Artificial Sequence: Synthetic coding sequence
atgccaggacatctgcaggagggcttcgggtgcgtggtaactaatcggttcgatcagctgtttgatgacgaatcagatcctttcgaggtgctcaaggccgcagagaataaaaaaaaagaggccggaggtgggggagtgggcggtcctggggcaaagagtgctgcccaggctgccgctcaaactaatagcaatgcggctggcaaacagctcagaaaagagagtcagaaggataggaaaaacccacttccacctagcgtaggagtggtggacaagaaggaagagacacagcccccagtggctttgaaaaaagagggaataaggcgggtgggaagaaggcccgatcagcagttgcagggcgaaggcaaaatcatcgaccgcagaccggaacggcgtcccccaagggagcgccgatttgaaaaaccattggaggagaagggggaaggaggtgagttctcagtagaccggcctatcatcgaccgacccattagaggtaggggagggctcggcaggggccgagggggaaggggtaggggcatgggaaggggagatggcttcgacagcagggggaaaagggaatttgacagacacagtgggtccgaccggagcggcctgaaacacgaggacaagcggggtgggagcggaagccataactggggcaccgtcaaggatgagttgacggagagtcccaaatatatccagaagcagatctcatacaactatagcgacctggaccagagcaatgtgacagaggagacccccgagggggaagaacaccaccccgtcgcagatacagaaaacaaggagaatgaagtggaggaagtgaaggaagaaggaccgaaggagatgacattagacgagtggaaagcaattcagaacaaggatagagcaaaagttgagtttaacattcggaagccaaacgagggcgctgatggacagtggaagaaggggttcgtgctacacaaatctaagtccgaggaggcccatgctgaggatagcgtgatggatcaccattttcgaaagcctgcaaatgatatcacaagccagcttgagatcaactttggggatctgggcaggcctggacggggtggtcgcggagggagaggaggcagggggaggggcggaaggccaaataggggttctcgaaccgacaagagcagcgcctcagcccctgatgtggatgaccctgaagcatttccagctctggcctag

SEQ ID NO: 53927 - DNA, 1164 bp, Artificial Sequence
  Description of Artificial Sequence: Synthetic coding sequence
atgccgggacacctgcaagaaggcttcggatgcgtcgtgaccaataggttcgatcaactgtttgatgatgagagcgatccatttgaggtgcttaaggccgcagaaaacaaaaagaaagaggctggcggagggggtgtcggcggtcccggagcgaagtctgctgcacaggccgcagcacaaactaactccaatgccgctggtaaacagctacgcaaggagtcacagaaggatcgaaagaatcctcttcccccatctgtgggcgtggtcgacaagaaagaggaaacgcagccaccagtcgccctgaaaaaggaaggtattagaagggtggggaggcgccctgatcagcaactccagggggaaggtaagatcatcgaccgacgtcctgaaaggaggcctcccagagagcgcaggtttgagaagccattagaagaaaaaggagaaggaggggagttcagcgtggaccgtcctatcattgataggccgatccgaggccgaggcggtctcggccgagggagaggcggtaggggaaggggcatgggcagaggcgacggttttgattcccgcggaaagcgagaattcgacaggcattccgggagcgatcgctccggactgaagcatgaggacaaacgtggaggaagcgggagtcacaactggggaaccgtgaaagatgaactgaccgacctggaccagagcaatgtaacggaggaaacacccgagggcgaggaacaccaccccgtagccgacacagaaaataaagaaaacgaggtcgaagaagtgaaagaggagggtcccaaagagatgacactagatgaatggaaagcgattcagaataaggaccgagctaaggtcgagttcaacatccgcaaacccaatgagggggctgatgggcagtggaaaaagggattcgtcctgcacaagagcaaaagcgaggaagcacacgcggaggattctgttatggaccaccactttcgcaagccggctaatgatatcacatcgcagctcgagataaacttcggcgatttgggaagacccggaagaggaggccgaggcggaagaggaggcaggggaagggggggaaggcctaatcgcggatctagaacggataagtcaagcgcttccgcgccagatgtggacgatcctgaggcattcccagcccttgcctag

SEQ ID NO: 53928 - DNA, 1227 bp, Artificial Sequence
  Description of Artificial Sequence: Synthetic coding sequence
atgccaggccatctgcaagagggcttcgggtgtgtggtcaccaacaggtttgatcaactgttcgacgacgagtcagatcccttcgaagtgttaaaagccgctgaaaacaagaagaaagaagcgggtgggggaggcgtggggggacctggagccaaaagtgccgcacaggccgctgctcagactaatagcaacgccgcaggtaagcaactcaggaaggaatctcagaaggatagaaagaaccctctgccaccctcagtgggggtggtagacaaaaaagaagagacacagccaccagtggctctgaagaaggaggggataaggcgggtgggccgacgccctgaccagcagctacaaggtgaaggcaaaattatcgatcggaggccggagaggaggccacccagagagcggcgatttgagaagccccttgaagagaaaggagagggaggcgagttttccgtggacaggcccattattgatcggcctattaggggaaggggcggtctcggtagagggaggggaggacgcggtcggggaatggggaggggggacggatttgactcccgaggcaaacgcgagttcgacagacacagcgggtccgaccgatcatccttttctcactacagcgggttgaaacacgaggacaagagagggggatcaggtagccacaactggggaaccgttaaagacgaactgacagagagccctaagtatatccagaagcagatttcctacaactactctgatctcgaccaatccaacgtcactgaggagactccagagggggaggagcaccaccctgtagcggatacagaaaacaaggaaaacgaagtggaagaggtaaaagaggaaggccctaaagaaatgactctggatgagtggaaagccatccaaaataaggatcgggctaaagtagaatttaacatcaggaagccaaatgagggggcagacggtcaatggaagaaagggtttgtgctgcacaaatctaagagtgaggaggcgcatgctgaggattccgtcatggaccatcatttcaggaagccagcgaacgacattacttcccagttagaaattaatttcggggacttggggaggcctgggagggggggtcgtggaggcagaggcggaaggggtagaggaggacgacccaaccgaggtagcagaacagacaagtctagcgccagtgccccagacgtcgatgatccagaggctttcccagcgctcgcatag

SEQ ID NO: 53929 - DNA, 813 bp, Artificial Sequence
  Description of Artificial Sequence: Synthetic coding sequence
atgtttttcagcctgcatagagagacacccaaggagggcatgtttggtgccaatctcactacttttcatccaactttattcatcctcctgggaattccagggctggaacaataccatatttggctttcgattccattctacctaatgtatatcaccgctgtgttgggcaacggcgctttgatactggttgtcctgtcggagcacaccctgcacgtgttcctgtccatgctggccggaacagatatcctgttgtctacgacgacagtgcctaaggccttggctattttttgggtccatgcaggggagattgctttcgacgcctgcatcacccaaatgttctttatccacgtggcttttgtcgcagagtctggcatcctgctggccatggcgttcgactcctacgttgccatttgcacacccttacgctataccacgatcctgacatccatggtgaacggaaagatgactctcacaatttggggacaatctattgggactatttttcctgtgattttcctcctcaaaaggctgccatactgtcaaacaaacatcattccacactcttactgcgaacatataggtgtggctcaactcgcatgtgcagacattaccgtcaacatctggtatggcttttccgtacctatggctagcgtactggtggatgtggcgttcatcggcttttcatataccctcattctccaggccgtgtttcgactgccgagtcaggagagtcagcacaaggccctgaacacttgtgggagcaccctggagctgttttcatcatcgtcgtctcatcatttcctgctgagctag

SEQ ID NO: 53930 - DNA, 678 bp, Artificial Sequence
  Description of Artificial Sequence: Synthetic coding sequence
atgtttgccggaatggacacctttctcctggccgtgatcgcctatgaccgcttcgtcgcaatctgtcatccacttcagtatatggtgatcatcaatccccacctatgcggcctgctcgtgttggctagctggtttatcatattctggttttcgcttgtccatatcctgttgatgaaacgcctcactttttcgactgggactgaaatcccacactttttttgcgagcttgctcaggttttgaaggtagccaggagtgatgctttactaattaacatagtgctttatgtagccatggcactcttgggggttttcccagtggccggtatactgttctcttactcacagattgtgagcagcctcatgcgtatgagttccaccgaaggaaaatataaggccttctctacctgtggttcacatctttgtgtggtttctttgttttatggcaccggtctaggggtgtacctttcaagcgcagtcacacactccagccaatcttcttcaatggccagtgtcatgtatgccatggtgactcctatgcttaatcccttcatttacagcctgagaaacaaggacgtgaaaggggctctcgggcgtctactgtctagggccgcatcgtgtttgctgcgttatactacctcagaactccgcggatgctacgggtccctgaagcagatgtag

SEQ ID NO: 53931 - DNA, 480 bp, Artificial Sequence
  Description of Artificial Sequence: Synthetic coding sequence
atggagaaactgcgcagagtgttatccggacaggacgacgaggagcagggacttacagcacaggttctagacgccagcagcctcagctttaatacacggcttaagtggtttgccatatgtttcgtgtgtggcgtatttttcagcatacttggtacagggctgctgtggctcccagggggtatcaaactgttcgctgtcttttataccctgggcaacctggcagcgctggcctccacttgcttccttatgggcccagtcaaacaactgaagaaaatgtttgaggctaccaggctccttgcaaccatagttatgttgttgtgctttatattcaccctgtgtgcagccctgtggtggcacaaaaaaggcctggcagtgctcttctgcatccttcaatttttaagcatgacttggtattccttgtcttatatcccttacgctagggacgctgtaatcaaatgctgttcatctctgctctcttag

SEQ ID NO: 53932 - DNA, 483 bp, Artificial Sequence
  Description of Artificial Sequence: Synthetic coding sequence
atggacaaacttaagaaagttctcagtggtcaggacactgaagataggtccgggctgtccgaagtggtggaagcgagctccctcagctggtcaacccgtattaagggctttatcgcttgctttgcgattggaatcctgtgtagcctgttagggaccgttctgctgtgggtgccccgaaaaggcctgcatctctttgcagttttttatacatttggcaatattgcctcgataggtagcaccattttcctcatgggcccagtcaaacagttaaagaggatgttcgaacctacccgacttatagcgaccattatggtgctgctgtgctttgctcttaccctctgctcagctttctggtggcacaacaaaggcctagctctgatcttctgcattctgcagtctttagctctgacttggtattcgttaagctttatcccattcgctcgtgatgccgtaaaaaagtgcttcgcagtgtgcctcgcatag

SEQ ID NO: 53933 - DNA, 327 bp, Artificial Sequence
  Description of Artificial Sequence: Synthetic coding sequence
atggacaagctaaaaaaggtactgtccggtcaagatacggaagaccgctcaggactctctgaagtcgtggaagctagctccctctcctggtctacacgcattaaaggctttatcgcctgctttgccatcgggattttgtgcagtttgctaggcacggtgctactgtgggtcccacgcaagggactccacctcttcgctgtgttctacaccttcgggaatatcgcaagtatcggaagttgcgtcttacacttgccttgcgtcctgccctttggaggaatcacaagggacctccacctatcttctgccttttgctcactgtggcactag

SEQ ID NO: 53934 - DNA, 327 bp, Artificial Sequence
  Description of Artificial Sequence: Synthetic coding sequence
atggacaagctaaagaaagtgctgagtggtcaggacaccgaagaccggagcggtcttagtgaagtggtggaggcaagttctctgagttggtccacccgcatcaagggttttattgcctgcttcgccattggcatactgtgctccctgctgggaacggtgctgctttgggtcccccgtaaggggcttcacctatttgcagtgttttacaccttcggaaatattgcatcaatcgggtcttgtgtgttgcaccttccctgtgtgctcccttttggcggaatcaccagagatctgcatctctccagcgccttttgttctttatggcactag

SEQ ID NO: 53935 - DNA, 648 bp, Artificial Sequence
  Description of Artificial Sequence: Synthetic coding sequence
atggccgatctccaccgacagctccaggaataccttgcccagggcaaagcgggtggccctgctgctgcggagcccctgctcgccgctgagaaagccgaagaacctggcgatcgaccagccgaggagtggctgggcagagccggactgcgttggacgtgggcgcgatcccccgctgagtccgctgctgctgggctgacgtgcctccccagcgttaccagaggccagcggcttgccgcagggggtgggtgtttacttctcgcggctctctgctttggtttagctgcactgtatgctcccgtactgctgctcagggcacggaaattcgccctcctgtggtcactgggatcagctttggcactggccggaagcgccctcctcaggggaggcgctgcctgcggccgattgctgagatgcgaagaagccccaagcagacctgccctgctgtatatggctgcgttgggagcgaccctgttcgcggcactcggattacgttctaccctgcttacagtgttgggggcaggtgcccaggtggctgccttgctggctgcgctggtgggtctgctgccctggggtggcggtactgccctgagattagcactaggcagactcggtcgcggtgctggactggcaaaagtcctgccagtgtag

SEQ ID NO: 53936 - DNA, 6486 bp, Artificial Sequence
  Description of Artificial Sequence: Synthetic coding sequence
atgacacactcacccgctaccagcgaggatgaagaaaggcatagcgcctctgagtgccccgagggaggctccgagtccgatagttcccctgacggccctggcagaggacctagaggaacccgaggacagggaagcggggcacctggatcgctggctagcgttcggggattgcagggcaggtcaatgtccgtgcctgatgatgcccacttctccatgatggtgtttcgaatcgggatcccagacctgcaccagactaagtgcctccggttcaatcccgacgcgaccatttggactgccaagcagcaggtgctgtgcgccctctcagagtccctgcaggatgtgcttaactatggactgttccagcctgctactagcggaagagacgcaaatttcctggaggaggaaaggctcctgagagaataccctcagtcattcgagaagggagtgccatatctcgagttcaggtacaagacccgggtgtacaagcagacaaatctggatgagaaacagctagcgaagctccacaccaagacaggcctgaaaaaattcttggagtacgtgcagctcggtacatccgacaaagtggcacggctgctcgacaagggtctcgatcctaactaccacgatagcgatagcggggagacacccttgacccttgccgcacagaccgaagggagcgtcgaagtcattcgtaccctgtgtttaggtggagcccacatcgattttagagctagagatggaatgacggccctgcacaaggctgcctgtgcacgccactgtcttgccttgacagctctcctcgacctgggcggtagtcctaactataaggataggaggggattgacgcccctgtttcataccgcaatggtcggtggggaccctcggtgctgcgaactgctgctttttaacagagctcaattaggaattgccgacgaaaacggttggcaagaaatccatcaagcatgccagcgcggtcattcccagcatctggagcatctgctgttctacggagccgaacccggtgcccagaatgcatcgggaaacactgccctgcacatatgcgccctatacaataaagagacctgcgccagaatcctgctctacagaggggctgataaggacgttaagaataataacggccaaactcccttccaggtggcagttattgcgggtaactttgaactaggcgaactcattaggaatcaccgtgaacaagatgtcgtcccttttcaggagtcccccaaatatgcagcccgacgcagggggccaccgggaaccgggttgacagttcctcctgccctcctgagggccaattccgatacctccatggcactgccagactggatggtttttagcgccccaggcgctgctagttccggggcacccggtcccacttcgggctcacaggggcaatcgcaacccagcgcccctaccacaaagctctcgtcgggaacacttcgctccgcatcaagccctcggggagccagagcaagaagcccttcccgaggtcgacaccctgaagacgccaaacgacagccgagggggagacctagtagcagtggaaccccccgtgaagggcctgccggagggactggcggatccggaggtccaggtggttctcttgggagtcgcggtcgacgcaggaaactttattctgccgtgccaggtcggagtttcatggccgttaaatcctatcaagcccaggcagagggggagatcagtttatctaaaggagaaaagatcaaagtgctgagtattggggagggtggtttttgggaggggcaagtgaaggggagggtgggctggttcccaagtgactgtctagaggaagtcgccaatcgatcacaggaaagcaagcaggagtccagaagtgataaggccaagaggctctttcggcattacacagtgggaagttatgacagttttgatgcaccatccctgatggatggtatcgggcctggtagcgactacataataaaggaaaagaccgtcctcctgcagaagaaggactctgagggctttggcttcgtgctcaggggcgctaaagcccagacccccatcgaagaattcacccccaccccagcttttccggctcttcagtatcttgagagcgtagatgaggggggagtggcttggagggccggactcagaatgggggattttttgatcgaagtcaatggacagaacgttgtgaaggtgggccatcggcaggtagtcaacatgattcgtcaaggcggaaacaccttgatggttaaggttgttatggtgactcgccacccagatatggacgaagcagtgcacaaaaaagcaccccaacaggctaagcgtctaccccctcccacaatcagcttacgcagtaagtcaatgacttcagagctggaagaaatggagtatgaacagcaacccgctccggtccctagcatggagaagaagcgcacagtctaccaaatggcactcaacaaactggacgagatcctggccgctgcccagcaaactatctcggccagcgaatcccccggtcctggagggcttgcctctttaggaaagcaccggccaaagggcttctttgcaacagaatcgtcgttcgacccccaccatagggcccagccttcctatgagaggccaagcttcctccccccagggccaggcttgatgttgcgtcaaaagtccattggagctgctgaggacgatagaccatatctcgcccctcccgctatgaagtttagtaggagtttgtcagtgccgggatccgaagacatcccccctcctcccaccacctcgcccccagagcccccatacagcacccccccagtcccctcctcctccggacgtctcaccccctcaccacggggaggtccttttaacccaggatcaggcggtccgctgcccgctagttctccagcctcatttgatggtccctcgccacctgacactcgcgtcggctcccgggaaaagtctctgtatcacagtggacccctccctccggcacaccatcatcctccccaccaccaccaccaccacgcgccaccaccccagccacaccaccaccacgctcaccctcctcatccccctgagatggagactggtgggtcaccagacgatccaccacccaggctggctctggggcctcagccttccttaagaggctggagagggggtggaccctcacctacacccggagctccctctccatcccatcatggatcagctggcggtggcggtgggtcatctcagggcccagcgctccgatattttcagctaccacctcgcgctgcatccgcggcaatgtatgtgccagcccgatctgggagaggcaggaagggccctctggtgaaacagacaaaggtggaaggcgaaccgcagaaaggaggtggcctgccacccgctcccagccctacctcacctgcgtcacctcaaccaccaccagccgtggccgcaccttccgaaaaaaactcaatccctattccaacgattatcatcaaagcgccatccacatcttctagtggcagatcaagccaggggagcagcactgaagccgaaccacccacccagccagaacctacgggtggcggtggaggcggagggtcctcaccctctccggcaccagccatgagccccgtccccccatccccgtcccccgtgccgacgccagcctccccctccggacctgctacgctcgactttactagccagtttggtgcagcactggtaggtgccgcaagacgcgagggaggttggcagaatgaggcaagaaggaggtccacgctgttcctgtctacagatgcaggggacgaggacggtggcgatggcggactgggtactggtgctgcccctggcccaagactgaggcactctaagagtatcgatgaggggatgtttagtgcagagccttacctgaggctggagagcgctggctccggggctggctatgggggatatggggcagggtcccgggcttatggcggaggaggcggttccagtgctttcaccagttttctgccacccaggcccctggtccatccactgactggcaaagcactggacccggcaagccccctggggctggccctggcagcgcgtgagagagcgttaaaggagtccagcgagggaggtggagctccacagccacctcctcgacccccatcacctcggtatgaggcacctccgcctacccctcatcatcactccccacatgctcatcacgagcctgtcctgcggctctggggcgcatcaccacctgaccctgcaagacgtgaactcggttacagagcaggtttagggtctcaggagaaaagtctgcctgcctcaccccctgcggctcgaaggagcctgctgcaccgtctgcccccaacagcaccgggagtggggcctctgctactccagctggggactgaacctcccgcacctcaccctggggtctcgaagccatggagaagcgcggctcccgaagagcccgaacgcctccccttgcacgtgaggttccttgaaaactgccaacccagggctcccgtgactagcggacgcggaccaccgtccgaggacgggcctggcgtgcctccgccatctccccgacgttccgtgccccctagccccacaagcccaagagccagtgaggagaacggactcccgctcctggtcctcccgcctcccgcaccaagcgtggacgttgaggacggggagttcctattcgtagagcccctcccccctcccctggagttcagcaactcattcgagaagcccgagtcccctctcactccaggacctccccacccccttccggacactccggctcccgctacacccctaccccctgtcccgccaccagcagttgccgctgctcctccaacactcgactctacggcctcatctctcacctcctacgatagtgaagtggctaccctaacgcagggtgctagtgcagcgcctggcgacccccaccccccaggccctccagcacccgcagcacccgctcccgctgcgccacagcccggaccggaccctccaccagggacagattctgggatcgaggaagtggactcccgatcctcctctgaccaccccctagagaccatctcgagcgcatccaccctgtctagtctcagtgccgagggcggtgggtcagcaggagggggaggcggtgccggagctggggtagctagcgggccagagctactggacacatacgttgcttacctcgacggccaagccttcgggggttcatctaccccaggacccccttatccaccacagctgatgacccctagcaagctgcgcggaagggcgctcggcgcttccggcggtctgcggcctggacccagtggaggactccgggatcctgtgacacccacatcccccacagtctctgttacaggcgctggcactgacgggcttctagcccttcgggcttgctctggtcctcccacggccggtgtggctggcggacctgtggcggttgagcctgaagtcccccctgtgcccctccctaccgccagcagtttgcccaggaagcttttgccttgggaggagggacccggaccccctccaccgccactcccagggcctcttgcccagccccaagccagcgctctggcaacagtgaaggctagtatcatatctgagctgtcctccaaacttcaacagttcggtggaagtagtgcagccggaggtgctctgccctgggccagggggggtagcggcggaggcggtgacagtcaccacggaggagcttcatatgtgccagaacgcacaagttctttgcagaggcagcgcttgagcgatgacagtcagtcttcactgctgagcaaacccgtgtctagccttttccaaaactggccgaagccgccactcccccctctgcctacaggaacaggcgtgagccccaccgccgctgctgcccctggggcaaccagcccttccgcaagctcttccagtacatctactcgtcatctacagggggttgagtttgagatgagacccccactcctccgtagagcaccaagccccagcctgctcccggcatcagagcacaaggtgtcaccggcaccaaggccatcctccttgccaatactaccatctggaccgctgtaccctggactgtttgatattcggggaagccccacggggggtgcaggaggctccgcagatccctttgccccagtctttgtcccccctcaccccggaatctcaggtggacttggcggagctctgagcggcgcatcacgcagcctgagcccaacgcggttgctttccctgccccctgacaagccttttggcgcaaagccactgggattctggaccaagttcgacgtagccgattggttggagtggctcggccttgccgaacaccgggctcagttcctcgaccacgagatcgatggtagccatttgccagccttgaccaaggaagactatgttgatctcggcgtgacgagggtcggacaccggatgaatatcgatcgagcgctcaagtttttcttagagcgctag

SEQ ID NO: 53937 - DNA, 6458 bp, Artificial Sequence
  Description of Artificial Sequence: Synthetic coding sequence
atgacccactccccggctacaagtgaggatgaggagcgccattcagcatccgaatgccctgaggggggatcggaaagtgattcatctccagacggcccaggaaggggtcccaggggtaccagaggccaaggctcgggagccccaggctcactcgccagcgtccggggactccagggcagatctatgagcgttcctgatgacgcacacttttccatgatggtttttaggattggcatccccgaccttcatcagacaaaatgcctccggttcaaccccgatgcaaccatttggacagctaagcagcaagttctgtgcgccctgagcgagagcctccaggacgtacttaactacggcctattccagcctgcaaccagtggaagagacgcgaactttctggaggaggagaggctgttaagggaatacccccagagtttcgaaaaaggtgtaccatacctggagttcagatataaaactagggtctacaagcagacgaatcttgatgagaagcagctcgcaaagttgcacactaagaccggtctgaaaaaattcctagaatatgtgcaactggggaccagcgacaaggtggcacggctgctggacaaggggctggatccaaattatcacgacagtgactctggggagacgcctctgacccttgccgctcagacagaggggagtgtcgaagtgatcaggaccttgtgcctgggtggtgcacacattgactttcgggctagggatggaatgaccgcactgcacaaggctgcttgcgcacgacattgtctggcactgaccgcccttctggacctgggcggatctcctaactataaagatcggcgaggactgactccactcttccacactgctatggttggtggcgacccacgatgttgtgagcttctgctttttaatcgggctcaacttggtatcgctgatgaaaatggctggcaggaaatccatcaggcttgccagaggggccatagtcagcatctcgagcacctcttgttctacggtgcagaacccggagcccaaaatgcatcggggaataccgctctgcatatctgcgctctctataataaagagacttgtgctagaattctgctttacaggggggctgataaagacgtgaaaaacaacaatggacaaacaccattccaggttgccgttatcgcaggcaatttcgaattaggggagctcattcggaatcacagggaacaggacgtcgtcccattccaggagagccccaagtatgcagctcgacggcgaggacccccaggaaccggtctcaccgtgccccctgcactcctgagggcaaattccgacaccagcatggccctgcccgactggatggtgtttagtgcgccaggagccgcttcctccggggctcccggacccacaagtggatcacaagggcagtcacagccatctgcacccacaaccaagctgtcttccgggaccctgaggagcgcaagctctcccagaggcgcacgggcacgctcaccctcacgtggacgacaccctgaggacgctaaaagacaaccaagaggcagacccagttcctctggtacacctagggaaggcccagcaggcggtaccgggggttcgggaggtcctgggggttcacttgggtccaggggcaggcggcgaaagctgtactcggcggttcctggtagatccttcatggcagtgaagagctatcaggctcaagccgagggagagattagcctcagcaagggcgagaagatcaaggtcctgtcaattggcgagggcggattctgggagggacaggtcaaagggcgagtagggtggtttccaagtgactgtctcgaagaggtagctaataggagccaagagtcaaagcaagagagccgtagtgacaaggccaagcgccttttcagacattatactgtcggctcctacgatagctttgatgccccaagcgactatatcataaaagaaaagaccgtcctactgcagaagaaggactcagagggcttcggatttgtcttgcggggtgcaaaggctcagacaccaatcgaagagtttacccccacacccgcttttccagcattacagtacctagaatcagttgatgaggggggagtggcctggagggccggtttaaggatgggcgacttcttgattgaggtcaacggacaaaatgtggttaaagttgggcatcgccaagttgtgaacatgatccgccagggcggaaataccttgatggttaaggttgtcatggttacaaggcaccccgacatggacgaggccgtccacaaaaaggctcctcaacaggcgaagcggcttcctccaccaacaatttcgctgaggagcaaatctatgacctccgaattggaagagatggaatacgagcagcaacccgcacctgttccaagcatggagaagaagcgcaccgtttaccagatggcactgaataagctagacgaaatccttgccgcagcacagcagactataagcgccagcgagagccctggccctggcggactggcaagcctcggcaagcacagacctaagggcttttttgccaccgaatcttcatttgaccctcaccacagggcccagccctcttacgaacggccatctttcctacccccagggcctgggcttatgctcagacagaaatccatcggcgctgccgaggatgaccgaccttacttggcaccgccagccatgaaattttctagatccctgtccgttcctgggagtgaagacattcctccacctcctactacttcaccgcctgagcctccctacagcacaccaccagtaccttcaagttcagggcgactgacaccatcaccccgagggggaccattcaatcccggttctgggggacccctgccggcatccagtcccgcttcatttgatggtccatcgcctccagatacaagggtgggctcgcgcgagaagtctctataccactctggacctctcccaccagcccatcatcacccccctcatcatcaccaccatcatgcccctcccccacaacctcatcaccatcacgcccatccgcctcacccccctgaaatggagacagggggtagcccagacgatcctccccctcgcttggcacttggccctcagcccagcctgagaggctggcggggtggcggtccctcacccacacccggtgccccatcgccttctcatcacggtagcgccggagggggaggtggtagtagccaggggcctgctctacgttactttcagctcccaccgcgtgcggcttccgctgccatgtacgtgcctgcccgatctggtcgcggtagaaaaggaccattagttaagcagaccaaggttgaaggcgagccacagaaaggtggtggtttgcctcctgccccttcgcccacgtcaccggctagcccacagccgccacccgctgtggccgctccttctgaaaaaaattcaataccgataccaacaatcattatcaaggccccatctacaagcagctccgggcgatcctcacaggggagctctacagaggccgaaccaccaacacaacctgagcctacagggggaggtggagggggaggcagtagcccatcgccagctccagcaatgtcgcccgtccccccttcccccagtcccgtccctactcccgcttctccctcagggcctgccacgttggacttcacaagtcagttcggcgcagccctcgtgggggcagcacgacgagagggtggatggcagaacgaggcgaggagaagaagtacactgttcctgtcaacagacgccggagatgaggatgggggagatgggggactgggcaccggagccgcacccggacctcggcttaggcatagtaaaagtatagacgaaggcatgttctccgccgaaccatatctcagactcgagtccgccggttcgggagccggatatggtggttatggtgccggaagtcgggcttacggcggaggcggtgggtcgtcagcattcacaagcttcttgcctcctagaccactggtccatcctctgactgggaaggctctcgaccccgcaagtccccttggcctcgcacttgcagctagagagcgcgctctaaaggagtcctcagagggcggtggggcaccacaacccccacctcgcccaccatcacccagatatgaggccccacccccaactcctcatcaccactccccccatgctcatcacgaacctgtgcttagactgtggggggcatctccacccgatccggcacgtcgtgagctggggtaccgggctggcctgggcagccaggagaaaagcctgccagccagtcccccagccgctcgacgcagcctgctgcatcgtctgcctccgacagctcccggagtcggacccctgcttctccagctgggaaccgaacctccggcaccccatcccggtgtgtccaagccttggcggtcagcggcacctgaggagcctgagagattacctctgcacgtgcgtttcctggagaactgccagccacgggctcccgttacaagcgggagggggccaccatctgaggatggtccaggagtgccacctccatcccccagacggtcggtgcccccttctccgacttcccccagggcttctgaggaaaatggactccctctgctcgtgctgccccctccagcccctagtgtggatgtggaggatggggagtttttatttgtggagccattacctcctccactggagttcagtaacagttttgagaaaccagagagcccactgacccctgggcctccccaccccctgcccgatacacccgctcctgcaacacctctgccccctgtccccccaccagcggtggccgctgctccacccacattggactccacggcgtcatccttaacgtcctatgactctgaggtggccaccctcacacaaggcgctagcgccgcaccgggagatccccatccccctggacccccagctcccgcagcaccagcgccagcagctcctcagcccggacctgatccgccacccggaacagattctggcatagaggaagtcgattccagaagctcaagcgaccacccactggagaccatctctagtgccagcaccttgagttccctgagcgcggaagggggaggcagtgctggcggaggcggaggagccggagccggagtcgcttctggcccagagctgctcgatacctacgtagcctatctggacgggcaggcgtttggcggtagctctacaccgggtcccccatatcctccgcagctgatgactccctctaagctgagaggccgtgccctcggcgcttccgggggactgaggcctggcccatccggcggattgagagatccggtcacaccgacctctcccactgtttcagtgaccggcgctgggaccgatggcctgctggcgcttagggcatgttcaggcccacctaccgccggtgtcgccggtggacccgttgcagttgagccagaggttccccctgtgcctcttcctaccgccagctccctgccacgcaaactgctgccatgggaggaggggcctggaccaccaccacccccactgccagggcctctggcccagccacaagcatcggcactagcaactgtcaaggcgtccatcatcagtgagctctcgtcaaagctgcaacagtttggtgggagctcggctgcagggggagcccttccatgggccaggggaggaagcgggggaggaggagactcccatcatggaggagccagctacgtgcctgagcggacatccagtctccagcggcaaagattatctgacgatagccaaagcagtctgttgtccaagcccgtcagcagtctattccagaactggcccaagccaccgctcccacccctgcctactggcaccggggtctcgccaactgctgctgcggcacccggtgccacctctccttcggctagtagctcgtcgacctctacccggcatttgcagggggtcgagttcgagatgcgccctcctctgctgcggcgtgcaccttctccgagcctgctgcccgctagtgaacataaggtgagcccagcccctagaccctctagtctccccattttgccttcggggccactgtatcccggtctcttcgatatccgcggatcaccaacaggcggagccggagggagcgctgaccctttcgccccagtgttcgtgcctccccatccaggtatttctgggggactgggaggagctctctccggcgcatcacgtagtttaagcccaacgcgtcttttatcgctgcctcccgataagcccttcggcgcaaagcctctcggcttttggacgaagtttgatgttgctgattggctagagtggctaggcttggcagagcaccgggctcagtttctggatcatgagattgatgggtcacatttaccagcattaacaaaggaagattacgtcgacttaggggttacacgggttgggcaccggatgaatatcgatcgagcgctgaagttttttctggaacgcta

SEQ ID NO: 53938 - DNA, 4647 bp, Artificial Sequence
  Description of Artificial Sequence: Synthetic coding sequence
atgcagttgatggcactcgagcagagatttgggtccggcctgcctggaggagggcaacctctgtgtctcatgatgtcctctccactgcccccaccccctcctcacttcagctgtctgcccgcttccgactatatcataaaagaaaaaacggtgctgttgcagaaaaaagactctgaggggttcggatttgtcctaagaggggcaaaggcccaaacaccaatagaagagtttacccccacccccgcatttcccgcactccagtatctggagtctgtggatgagggaggcgttgcgtggagagcagggctgcgcatgggggattttctgatcgaggtaaatggacaaaatgtggtaaaggttgggcatcgccaggtcgtcaacatgatccgtcagggcggaaataccctcatggtgaaagtggtaatggtgaccagacatcctgacatggacgaagcagtccataaaaaggcaccacagcaggccaaacgcctgccaccccctactatctctttgcgtagcaaaagcatgacgtccgagctcgaggaaatggagtacgagcagcaaccagcacctgtcccctctatggaaaaaaagaggacagtctaccagatggcacttaacaaactggacgagatacttgccgctgcccagcagacaatatcggcttccgagagcccaggaccaggaggtcttgcatccctcggcaaacatcgtccaaaaggattctttgctactgagagttcatttgacccacaccatcgcgctcaaccgtcctacgagcgtccgagcttcctgcctcctggccctggtcttatgctcaggcagaaatctatcggggctgcagaagacgacagaccctaccttgcccctccggcaatgaagttttctagatcgctgagcgttcctggaagcgaggacattcctcctcccccaacaacgagtccacctgagccgccttatagcacaccccctgtccccagttcaagcggtcgactgacgccttctccgagaggagggccattcaacccaggttctggagggcctctccccgctagcagcccagccagcttcgatggcccatcacctcctgatacccgggtcggctctcgcgagaagtccctataccatagcggcccactaccccctgcacaccaccaccccccacaccaccaccaccatcacgctcccccaccacagccgcatcaccatcacgcacatccgccacatccaccggagatggagaccggcggaagtccagacgacccaccgccacgcctcgcgcttggtccacaaccatccttgcgcggttggagaggtggcggaccatctccaacaccgggtgcccctagtccttcccatcatggaagcgccggaggaggaggcggttcatctcaaggtccagcccttagatactttcaactgcctccacgtgccgcttcggccgcaatgtatgttcccgctcggagcgggcgtggaaggaaaggacccctggtgaagcagaccaaagtggagggcgaacctcaaaaaggagggggtctgcctccggctccatctccaaccagtcctgcgtcgccacagccgcctccagctgtggcagctccaagcgaaaaaaactccatccccatacccaccataatcattaaggcccctagcaccagttcatccggtagatcatctcagggatcctcaacggaagccgaaccccctacacagccggagcccacagggggagggggaggaggtggctcttcgcccagccctgcacctgccatgtctcctgttccgccaagcccatcacccgtgccaactcccgcaagccccagtggccctgcaacacttgactttacctcgcagtttggggctgctctggtgggtgctgctaggcgagaggggggttggcagaacgaagcgcgtcgtcgcagtactctattcctgtccacagacgcaggtgacgaggatggcggagatgggggtttggggactggagctgcaccaggccctcgtttaaggcatagcaaatcgattgacgagggcatgttctcagccgagccttacctacgcctggagtctgccggatctggtgctggatacgggggttacggcgcaggcagcagagcttacggtggagggggtggcagcagcgccttcacctcattcctacctcccagacctcttgtgcaccctttaacagggaaagccctggaccccgcaagcccactcggtctggcattggctgcccgagagagggcgcttaaagaaagctcagagggagggggtgcgccacagcccccaccccgacctccatcccctagatatgaggccccaccacctaccccccaccaccatagtccacatgcccatcatgaacctgtgctgaggttgtggggagcgagcccgcctgatccagccaggagggagctgggttacagggccggactcggctcacaggaaaaatcacttcctgccagtcccccagctgctcgacgtagcttgctgcaccggttgcctccaactgcacctggggttggtccattgctgctgcagctgggaactgaacctcccgctccacatcctggagtgagcaagccatggcggtcagccgctcctgaggagcctgagcggctgcccttgcacgtgagatttctcgagaattgtcagccaagggcacctgttactagcggtaggggaccacccagtgaggacggacccggtgttccaccgccatcacccaggcggtccgtgcccccaagccccacgagtccaagggctagcgaggagaacgggctccccctgcttgtcttacctccccctgcccctagcgtcgacgtggaggatggcgaatttttgttcgtcgaacccttacccccacccctcgagttttctaactcctttgagaagcccgagtccccattgacacctggaccaccacatcccctacccgacactcccgcaccagcgactccattgcccccagttcctcccccagccgtagctgccgctccacctacacttgattccacagccagcagtcttacttcttatgattccgaggtggcaacccttacacaaggcgcttcagcagcaccaggcgatccacatcccccagggcctcccgcaccggctgcccctgcccctgctgcgccacaacccggaccagatcctcctccaggcaccgacagtgggatagaagaggtggactcgagatcttcctccgatcatcctctggaaacgatttccagcgcttctacactctcatctttatccgcagaagggggtggatcagctggcggagggggaggcgcaggggctggggtggcatctggccctgaactgttggacacatatgtcgcctatctcgacggccaggcctttggcggatcttcaacccctggcccaccttatccaccccagctgatgactccttcgaagttaagagggagagccctgggagcctcaggagggctgagaccgggacccagtggaggccttagggatccagtgacacctactagtcccacggttagtgtcacgggggcaggaacagatgggttgcttgccctgcgggcatgttctggcccacccaccgctggcgtcgccggtggtcccgtggccgtcgaaccggaagtgcctcctgtccccctgcctacagccagtagtctccccagaaagctgctgccatgggaggaaggacctggtcccccacctcctccattgcctggtccgctcgcacagcctcaagcctctgccctagccacggtgaaagctagcatcatatccgaactgtcatcaaagctacagcagtttggtgggtcatctgccgcagggggtgctcttccctgggctcggggtggctccgggggtggcggtgacagccaccacggcggagcttcctacgttcccgagaggacctcctccttgcaacggcaacgcttatccgacgattcccaaagttcactgctgtctaaacccgtctcctccctgttccagaactggccaaaacctccgttgcccccactgcctaccggcacaggtgtgagcccaacggctgcagctgctcccggagctacgagcccttcagctagttcaagcagcacaagtaccagacatttacaaggggtcgagttcgaaatgcggcctcccctgcttagaagggccccttccccatccctgctgcctgccagcgaacacaaggtgagccctgcccctcgcccttcctccctgccaatcctcccgtccgggccactgtaccctgggctatttgacattaggggaagccctaccggcggagccggtgggtccgcagacccttttgcgcctgtgtttgttcctccccacccagggatttctgggggtctgggaggcgctttaagtggagccagccggtctctgtctcccacacgcttgttgagcctccctcccgataaaccgtttggcgcaaaacccttggggttctggacaaagtttgacgtggcagactggctggaatggttaggcctggctgagcatcgagcacagttcttggatcatgagatcgatgggtctcacctgcccgctctgaccaaggaggattatgttgacctgggcgtaaccagggtcgggcacaggatgaatattgatagggctcttaaatttttcttagagcgatag

SEQ ID NO: 53939 - DNA, 6509 bp, Artificial Sequence
  Description of Artificial Sequence: Synthetic coding sequence
atgacacacagcccagcaaccagcgaggatgaggagcgccattctgcctcagagtgtcccgagggcggttctgagagtgacagctcccctgacggtcctggccgaggaccgcgaggtactcggggacagggctcaggcgctcccggttcgctcgccagcgttaggggcctgcagggccgatccatgtctgtgcctgacgatgcgcacttttcaatgatggtttttaggatcggaattcccgatctgcatcaaaccaagtgtctccggtttaatccagatgccacaatctggacggctaagcagcaggttctgtgcgctctgagcgagtccctgcaggacgttttaaattacggcctcttccagccagcaacgtccggcagggacgccaacttcctcgaagaggagcggctcttgagagagtatccccagtcattcgaaaagggcgttccttacttggagtttagatacaaaacaagagtgtacaaacaaacaaacctggacgagaagcagttagctaagctacacacaaaaaccgggctcaagaagtttctcgagtatgtacaactggggacgagcgacaaggtggcaaggctactggataaaggcctggacccaaactaccatgacagcgattccggggaaacacccctgacgctcgctgcccaaacagaggggtctgtggaagttattaggactctgtgcttaggcggtgcacacattgacttcagagccagggacggcatgaccgcccttcacaaagccgcttgcgctagacactgcctcgctctgacggcactgctcgatctcggcggtagccccaactataaagataggaggggtctaacccctctcttccacacagccatggtcggcggagatccccgatgctgcgagttgctgttgtttaaccgagcacagctgggaattgcagatgagaatggttggcaggagattcaccaggcctgtcaaaggggacactctcaacatctcgagcatctactcttttatggggctgaacctggagctcaaaacgctagtggcaatacggcccttcatatttgcgctctctacaataaagaaacatgcgcaagaatcctgctgtaccgcggtgcagacaaagacgtgaagaataacaacgggcaaacgccatttcaggtggcagtaatcgcaggtaattttgagctgggggagttgatccgaaatcaccgggaacaggacgtggtcccgtttcaggagtcgcctaagtacgctgcaagaaggagagggccaccaggaacaggcctgaccgtgccacctgccctactcagagcaaactctgatacttctatggcgctaccagattggatggtgttttctgctccaggagctgcttcaagtggcgcacccggaccaacgtctggcagccagggtcagagccagccctctgccccaaccacgaaactcagtagcggcaccctccggagtgcttcttctcctcgaggagcgcgagctcgcagtcctagccggggacgccatcctgaggatgcgaagcgccagccgaggggacgccctagctccagtggaacgcctcgtgaggggccagcaggcggtacagggggatctggtgggccaggcggatcccttgggagccggggtcgacgcaggaaactctattcggccgtgcccggtaggtctttcatggcggtgaaatcctaccaggcacaggcagaaggcgaaatctccctgtccaagggcgaaaaaatcaaggtcctatcaatcggcgagggaggattctgggaaggccaggtcaagggcagagtgggctggtttccgagcgattgtctggaagaggtagcaaaccgctcacaggagtcgaagcaggaatccagatccgataaggccaaacgcctcttcaggcattacactgtggggagctacgattctttcgacgcaccttccttgatggatggaatcgggcctggaagtgactacatcatcaaggaaaagacagtgctcctccagaaaaaagatagcgagggcttcggcttcgtgctcagaggcgctaaagcccagactcccatagaggaattcacaccaactccagccttccctgcacttcaatatctggaatcagttgacgaaggtggcgttgcttggagagccggattaagaatgggggactttctgatagaagtgaacgggcagaatgtagtgaaagtcggccatcgacaggttgtgaacatgatcagacagggtggcaatactttgatggtgaaagtggtgatggtcacacggcaccccgacatggatgaagctgtccacaaaaaggctcctcaacaggccaaacggctgcctcctccaaccataagtctgcgcagtaaaagcatgacatctgaactggaagagatggtctcaccatggaaaaagaagagtgaatacgaacagcagcccgctccagtgccctccatggaaaaaaagagaacagtgtatcagatggccttaaataaactagacgaaatacttgcagctgcccagcagaccatttcagcctccgaatctcccggacctgggggattggcatccttgggtaagcacaggcctaagggtttctttgcgaccgaatcgtcctttgatccccaccacagagctcagcccagttacgaacggccttcctttctgcctcccggacctggactgatgctgcggcagaagagcatcggagcagcggaggacgacaggccatacctagcaccgccagccatgaagttcagccgatccttgagcgtaccagggagcgaggatatccccccacctcccactaccagtccgccagagccgccatattctaccccgcctgtgccctcctcatcgggcagattgaccccttccccacggggaggtcctttcaatcctgggtccgggggtccactgcccgcttcctcccccgcttcctttgacggtccatctccccctgataccagggtgggctctagagagaaatcactgtaccatagtggtccactccctcccgcacaccaccacccccctcatcatcaccatcaccacgccccaccccctcaaccccaccatcaccacgcccatcctcctcatccaccggagatggagactgggggatctcccgatgatcctccccctcgtcttgctctggggcctcaacctagcctccggggatggcggggtgggggtccttcccccactcccggagcccctagcccatctcaccacggttcagccggtggcggaggaggatcctctcaggggcctgctctcagatacttccagttaccaccgcgagctgcttcagcagccatgtacgtccccgcacgttcaggccgtggccgaaagggtcctcttgtcaaacagaccaaagttgaaggcgaaccacaaaagggagggggtctgccccctgccccatcaccaaccagtccagcttccccccaacctcctcccgctgtcgcagcgccatctgagaaaaattcaatccccattccaactattatcatcaaggctccatcaacctcatcttcaggccgaagtagtcaggggtcttccacagaagctgaaccacccactcaaccggagcctaccggtggtggcggtggcggtggatcttccccctctccagcaccagcaatgtccccagtgccaccctccccttcccctgttcctactcccgctagtccttcaggccctgcaaccttggatttcacatcccagttcggggcagcacttgtaggcgctgctcgcagagagggcggatggcaaaatgaagccagacgcagatctacgctgttcctttcaacggacgcaggcgatgaagatggaggcgatggcggtctcggaaccggcgctgcaccaggacctcgcctacggcactccaaatctatcgacgaggggatgttcagcgcagaaccttacctgcggctcgaaagcgctgggagtggggcagggtatggaggctatggtgctgggtcccgggcttacggaggcggagggggaagtagcgctttcacttcctttttaccccctcgcccactggtgcaccccctcacaggaaaagccctggaccctgccagtcccttgggcctggccctggctgccagggaacgggcattaaaggagtccagcgagggaggtggggctccacagcctccccctaggccacccagccctagatatgaggcgcctccgcctaccccccatcaccatagtccgcatgctcaccatgagccagtattaaggctgtggggtgccagtcctcccgatcccgcacggagagaactcggttacagggcaggcctcggatcccaggagaaatccctgcccgcaagtccccctgctgcaaggcggagcctcctgcatcgattgccaccgacagccccaggcgtgggccctcttttgctccagctcgggactgaaccgccagcccctcacccgggtgttagcaagccatggcggtctgcagctccggaagagccagaaagattgccgctccacgtccgctttctggagaactgtcaacctcgagccccagtgacaagcggcagaggaccgccatccgaagacgggccaggcgtccctccgccatcgccaagacggtctgttccccctagcccgacttctccaagagcttccgaggaaaatgggctaccattactcgtgctgccacccccagctccgtcggtggacgttgaagatggggaattcctctttgtggagcccttgccacctcctttggagttttcaaactcctttgaaaagcccgaaagtcccctgacccccggaccccctcacccactccctgacactcccgcacctgcaacccccttgcctcccgtgccgcctcccgcagtcgcagctgcacctccgaccctggactctacagcatccagcctgacatcctacgactctgaggtggctacccttacccagggagccagtgccgcacccggagatccgcaccctcccggtccacctgccccagccgcaccagcccctgctgcacctcaaccaggacctgatcctcccccaggtactgactctggcatagaggaggtcgactctagaagcagctctgatcaccccctggagactatcagtagcgcgtccaccctgagcagcctcagcgccgagggaggaggatcagccggtggcggaggtggggctggtgccggagttgcatcaggacccgagctgctggacacctacgtggcatacctagacggccaggcctttggtggatcatccacccctggcccaccataccccccacagctcatgacaccctctaagctcaggggtagagctctaggcgcatctggcggtctccgcccaggcccaagcggcggactccgcgaccctgtgacacctacctcccccactgtaagtgtgacaggagcgggaactgacggcctgctagcactgcgcgcatgctctgggccacctactgcaggtgtggctggaggccctgtggccgttgagcctgaggtccctccagtgcctcttcccactgctagttcattacccaggaaactgctcccttgggaagagggacctggccctccccctcctccactcccgggaccattggcccaacctcaggcttcggcacttgcaactgtgaaggcgtctattatttcggagctctcttcaaagctgcaacagtttggaggctcttcagcagccggaggcgcactcccttgggcacggggtgggtccgggggaggaggggattcccaccatggcggagcttcttacgttcccgagagaaccagctcactccagcgccagaggttgtccgatgattctcaaagctccctgctgtctaaacctgttagttctctgttccaaaattggcccaagcccccactgccacctttaccgaccgggacaggcgtcagcccgactgcggctgcagccccaggggcaacttcgccatcagcttcatcatcctcaacctcaaccagacatctacagggcgtggagtttgagatgagacccccattgttgcgacgtgccccttcgccttcattgttgccggcatctgagcataaggtgtctcctgcccctcgaccatccagcctgccaattttaccaagtgggcctctctaccctggtttgttcgatattagagggagcccgaccggcggagccggtggttcagctgaccccttcgccccagtattcgtgccccctcatcctggaatctcagggggactcggaggcgctcttagcggcgctagcagatccctctcacccactcgcttactcagtttgccgcctgataaaccttttggcgctaagcccctcggtttttggacaaagttcgacgtagccgactggctggagtggctcgggttagcagagcaccgggctcaattcttggaccacgagatcgacggctcccacctccctgccctgaccaaagaggactatgtggatctgggcgtgactcgagtgggccacaggatgaacatcgatagagccctaaaattctttcttgagagata

SEQ ID NO: 53940 - DNA, 2556 bp, Artificial Sequence
  Description of Artificial Sequence: Synthetic coding sequence
atgaccagccattacgtaatcgccatattcgccctgatgtcttcctgcttagccactgccggaccggaacctggcgctctgtgtgagttatcccctgtttctgccagccacccagttcaggccctgatggaatcatttactgtgctgtccggatgtgcatctcgaggcacaacaggactcccacaggaagtgcacgttttaaacctaagaacagccggacagggccctggacaattacagcgggaggtgactctgcacttaaatcccatctccagtgtacacattcaccacaagtccgttgtctttctgctcaatagcccccaccctctcgtgtggcatttgaaaacagaaagactcgcaactggcgtgagtcgcctgttcctggtttctgaaggttccgttgtgcaattttcctcagcaaactttagcctgactgcggaaacagaggagcggaatttcccacacgggaacgagcacttgcttaactgggctcgaaaggaatacggggcagtcactagcttcactgaactcaagattgccagaaacatctacattaaagtaggcgaggaccaggtgtttccaccaaaatgtaatatcggcaaaaacttcctctcactgaattacctggcagagtacctccaacccaaggccgcagagggctgcgttatgtctagccagcctcagaatgaggaagtacacattatcgagctgatcaccccgaacagcaacccatactctgcatttcaggtcgatatcaccatcgatatccgaccatcacaggaagacttggaagtggtcaagaatttaatcctgattctgaagtgcaaaaagagcgtcaactgggtgatcaaatcatttgacgttaagggttccctaaagatcattgcacctaactctatcggctttggaaaagaaagtgaaaggtcgatgaccatgactaaaagcataagggacgatatcccttccacacaagggaatctggttaagtgggcgctggacaatggctacagcccaatcacaagctacacaatggccccagtggcgaacaggtttcatctgcgcctggagaacaacgctgaggagatgggggatgaagaggtacacacaattccacccgaattacgaatcctgcttgatccaggcgctctgccagccctgcagaatccaccaatccggggtggtgaaggccagaacggagggcttcccttcccattcccagacatcagcaggcgcgtctggaatgaagaaggcgaggacggtttaccaaggcccaaggacccagtcatccctagcatccaactgttcccaggactgagggagccggaggaggtccaaggaagcgttgacatcgctctgtctgtgaagtgtgacaacgagaagatgattgtcgcagttgagaaggactctttccaggccagtgggtatagtggtatggatgtcaccctcctggacccaacttgtaaagccaagatgaacggcacacactttgtgctggagtcccctttgaatggctgcggaacacggcctcgttggtcagcccttgatggtgtagtgtactacaactccattgttatacaggttcccgctttgggcgactccagcggctggcccgacgggtacgaggaccttgagagcggcgacaatgggtttcccggagatatggatgagggcgatgcgagtctgttcacacgacccgagattgtcgtgtttaactgtagtttacagcaagtgagaaatccctcaagctttcaagagcagccccatgggaatatcaccttcaatatggagctatataacacagatcttttccttgtgccttcccagggtgtcttctcagtccccgagaacgggcacgtttacgtagaggtgagcgtcaccaaagctgaacaagagcttggcttcgcgatccagacgtgttttatatccccatatagcaaccccgatcgaatgagtcactataccataatcgaaaacatttgtccaaaggatgagagcgtgaagttctatagcccaaagcgcgtccattttcccatcccacaggcagacatggacaaaaaacggttttccttcgtcttcaaaccagttttcaatacatccctgctgtttctacagtgtgagctgactttgtgtaccaaaatggagaagcacccccagaaactacccaagtgcgtccccccagatgaagcttgtacaagtcttgatgctagcattatttgggccatgatgcagaacaaaaaaacttttactaaaccactggctgtgattcatcacgaagccgagtccaaggaaaagggcccaagcatgaaagagcctaaccctatctccccacccatttttcatggattggacacccttacagtaatgggaattgcttttgccgctttcgtgatcggggcacttctcacaggggcattatggtatatttattcccacactggggaaacagccggaaggcagcaggtgccgactagcccccctgccagcgagaattcaagcgccgctcacagcatcggctctacacagtctacaccatgcagcagctcaagtaccgcatag

SEQ ID NO: 53941 - DNA, 1161 bp, Artificial Sequence
  Description of Artificial Sequence: Synthetic coding sequence
atgaacataatggacttcaacgttaaaaaacttgccgcagatgccggtactttcctttcacgggctgtgcaattcaccgaagaaaaacttggccaggctgagaagaccgaactcgacgcccatctcgagaacctgctgtccaaggccgagtgcacaaagatttggactgaaaagattatgaagcagacagaggtccttttacagccaaatcccaacgccaggatagaagagttcgtgtacgagaaactcgataggaaggctcctagccgcattaacaaccccgagttgctgggacagtatatgatcgatgccggaaccgagtttggtcccggaacagcctatgggaatgcgctaatcaaatgtggagagacgcaaaagcgaattggaactgctgatagagagctgatccagacatcagcactgaactttttaacccccctccggaacttcattgaaggagactacaagacaattgctaaggagcgcaagcttcttcagaacaagaggctggacttggacgccgctaagacccgcctcaagaaggcaaaggcagccgaaacaaggaattcacagcttaattctgcccgactggaaggtgataacattatgatttgggctgaggaagtgaccaagagcgaacaggaactgagaatcacccaatctgagtttgatcgacaggccgaaatcactaggctcctgctggagggtattagttctacacatgctcaccaccttcggtgcctgaatgactttgtcgaggctcagatgacttattacgcccagtgctaccagtatatgttggatttgcagaagcaactgggctcttttccttccaactatttgtccaataacaatcagacatcagtaacgcccgtgccctctgtgctccctaatgcaatcggatcaagtgccatggctagcacatccgggttggtcatcacaagcccaagtaatctgagtgacctgaaagagtgctcaggttcacgaaaagcaagggtgctgtatgattatgatgccgcaaattctacggagctatcactactcgccgatgaagtgatcacagtgtttagtgttgttggaatggattccgattggctgatgggggagcgaggaaatcaaaaaggaaaagtgcccatcacctacctcgaactcctgaactag

SEQ ID NO: 53942 - DNA, 798 bp, Artificial Sequence
  Description of Artificial Sequence: Synthetic coding sequence
atgatagatgcgggaactgagtttggacccggaacagcctatggcaacgctctcatcaagtgcggcgagacacaaaagagaattgggaccgccgacagagaactcatccagacaagtgccttgaatttcctgacaccgctcagaaacttcattgaaggtgactataaaactatcgccaaagagcgcaagcttctacagaacaagaggttagatctggacgccgcaaagacacgccttaaaaaggccaaagccgctgagactagaaatagcagtgaacaagaacttagaatcacccagagtgaatttgatcgacaggccgaaattactagactgctgctggaaggtatttcctctacccatgcacatcacctgcgatgtcttaacgatttcgtggaggcccagatgacttactatgcacagtgttaccagtacatgttagatctgcagaagcagctgggcagttttccaagcaattatctgagcaacaacaatcaaacctccgtaacccccgtacccagcgttctgcctaacgccatcgggtcaagcgctatggcttccacatcaggcttggtcatcacaagcccgtctaatctgtcagatctgaaagagtgctccggcagcagaaaggctagggtcctttacgactacgacgccgcaaacagcaccgaactttcactactcgcagacgaggtcattaccgtcttttctgtagtcggcatggattcagattggctgatgggcgaaagggggaaccagaaaggcaaagttccgatcacctatctggagcttctcaattag

SEQ ID NO: 53943 - DNA, 2124 bp, Artificial Sequence
  Description of Artificial Sequence: Synthetic coding sequence
atggcagccgctgccacagctgccgagggagttccctctcgaggtcctcctggcgaagtcattcacctcaatgtgggcggaaagcggttctccacctctcgccagacacttacgtggattcccgacagtttctttagttcgctactgtccggcagaatttccaccctcaaagatgaaacaggcgcaatattcatcgacagggatccaactgtgtttgcccctattttgaacttcttgaggaccaaggagctcgaccctcggggtgtgcacggcagttccctgctacatgaggctcagttctatggcctgaccccattggtcagacggctgcagttgcgggaggagcttgatcgttcctcatgcggaaatgtcctgtttaatggttacctgccacctcctgtcttcccagtgaagaggaggaatcgtcatagcctggttgggccacagcaactcgggggaagacccgctcctgtacgcagaagtaatacaatgcctccaaaccttgggaacgccggactcctagggagaatgcttgatgagaagacccccccttctccctcaggtcaaccagaagaacctgggatggtgcgtctggtgtgtgggcaccacaattggatcgcggtggcatatacccaattcctggtttgttatcggctgaaagaagccagcggctggcagttagtcttcagctcaccacggctcgactggccaatcgagaggttggccctcactgctagagtgcacgggggagcactgggcgagcacgataagatggttgcagccgctactggctcggagatcctgctgtgggcactccaggcagaagggggtggctcagagatcggtgtgtttcacttaggggtgccagtcgaggctttattctttgtgggcaaccaactgatcgccacatctcatacgggcaggattggtgtctggaacgcggtaactaaacactggcaggttcaggaagtgcagccaattacaagctacgatgcggctgggtcttttttactgctcggatgtaataacggctccatctactatgtggatgttcagaaattccccctgcggatgaaggacaatgacctgctggtgtccgagttgtacagggatccggcagaggacggggtgaccgcactgtctgtttacctcacacctaagaccagcgatagcggcaactggatcgagatcgcctatggcacatcctctggaggagtgagggttatagtccagcatcctgagacggtcggatccggaccacagttatttcaaacatttacagtccaccgttcccccgtgaccaaaataatgctctctgagaagcatttgatcagtgtttgcgccgacaataatcatgtgagaacgtggagcgtcactaggtttcgaggcatgatttccacccagccgggaagtacccccctggcatcattcaaaatattggcgctagagagcgcggatggtcatggcggttgttctgctgggaatgatattgggccttacggagaacgagacgatcagcaagtctttattcagaaggtggtgcctagtgccagccaacttttcgtgcggctgtcatctacaggccagcgggtgtgctctgtcaggtctgtggacggctcccctacaaccgctttcacggtgcttgaatgtgagggctcccggagactcggttccaggcccagaaggtatttgctgacggggcaggcgaatgggagtctcgcgatgtgggacctgacgaccgctatggacggtttgggacaagcaccggctggtggcctgaccgagcaagagctgatggagcaactggagcactgtgagcttgccccacccgctcccagtgccccttcttggggatgcttaccttctcctagccctcgaatctctctgactagcctgcacagcgcgtcctctaacacatcattgtccggtcaccgaggaagtccaagtccaccccaggcagaagcgaggcgacgtggcggaggatctttcgttgagagatgccaggagcttgttcgctctggaccagatctgcgcaggcctcccacccccgcaccttggccgtcctctggactcggcacgcctctgacccccccaaagatgaaattgaacgagacatcattttag

SEQ ID NO: 53944 - DNA, 1464 bp, Artificial Sequence
  Description of Artificial Sequence: Synthetic coding sequence
atgccacctaatctcggtaacgccggactcctgggacggatgctggacgagaagactccaccctcgcctagcggccagcctgaagaacccggaatggtcaggctggtctgcgggcaccacaattggatcgccgtcgcctacacccaattcctggtatgttataggttaaaggaagctagcggttggcaactggttttcagtagccctcgactagattggcccatcgaacgactggctctgaccgcgagggtccatggaggcgctctgggtgaacacgataagatggtggcagctgccacgggctctgaaatactcctttgggccctccaggctgagggaggcggatccgaaattggggtattccatctcggagtgccggtggaagcactattttttgttggaaatcagctgattgccaccagccacacaggccgtattggcgtgtggaacgcagtgacgaaacactggcaggtccaggaggtgcagccgattacctcttatgacgccgctggaagttttctgctactcggatgtaataatggctccatttattacgtggacgtgcagaagtttcccctgcgaatgaaggacaatgaccttctggtctctgaactgtaccgtgatcccgcagaggatggtgtgaccgccctctcagtgtacctgacacctaaaactatctgcgccgataataatcatgttcggacatggtccgtgaccaggtttaggggcatgatctccacccagccgggtagcactcccctggccagcttcaaaatactcgccttggagtcagctgacggacacggaggctgctcggccggaaatgacatcggaccatatggagagcgagacgaccagcaggtgtttattcagaaggtggtgcctagtgcatcccagctgttcgttagactctcatctacaggccagcgcgtgtgcagcgtgcgcagcgttgacggaagtcctactaccgctttcacagtgctggagtgcgagggctccagacggctcggatcacggccaagaagatatttgctgacgggtcaggccaatggtagcctggcgatgtgggaccttaccaccgccatggatgggttgggccaggcacccgctggcggtctcacagagcaggaactcatggagcagctcgagcattgtgaactcgctccgcctgcaccatcagcaccatcttgggggtgcctgccttcaccctcccccaggatctcattgactagcctccactctgcaagttcaaacaccagtttatcgggccaccgtggcagcccatctcctccccaggccgaggcgaggaggaggggagggggatcgtttgtggagagatgtcaagagttggtcagatccggtcccgaccttagaagaccgcctaccccagccccttggccttccagcggactggggaccccgctcacaccgccaaaaatgaagctgaatgagacgagtttttag

SEQ ID NO: 53945 - DNA, 1893 bp, Artificial Sequence
  Description of Artificial Sequence: Synthetic coding sequence
atgcgtgagcgcggacaggacagcttggccggtttggtgctgtacgttggcctcttcggccacccagggatgttgcaccgtgcaaaatacagcaggtttagaaatgaatctatcaccagcctagacgagggatcctccgggggaagtgtgggcaataagggatccccacagcccccacatcctgccctcgctccccatctgcctacggaagacgccactctcccttcccaggagagcccgacccccctctgtaccctcattccacgcatggccagcatgaagctggctaatcctgcgacattgctatccctgaaaaatttctgcctgggaaccaaagaagtgccaagactcaagctgcaagaatcgcgggaccctggcagttcaggccctagttcaccggagacgagtctgtctagaagtggcaccgctccacccccacagcaggacctcgtggggcaccgagcaactgccctcactcctgattcttgccctttgcccggtccaggtgaacccactctgcgaagtcgacaggaccggcattttctgcagcacctactagggatgggaatgaattattgtgttaggtacatggggtgcgtagaagtgttacagagtatgcgcagtctggattttgggatgcgcacccaggtgacgagagaggcgatatcgagactgtgtgaggccgtgcctggcgctaatggcgctattaaaaagcggaaaccaccggtcaagtttctcagcacagttctggggaagtctaacctgcaattcagcggcatgaacatcaaacttacgatcagcacttgctccctcaccctcatgaacctggacaaccagcaaattatcgccaaccaccacatgcagtcgattagcttcgcatccggcggagacccggacacaaccgattacgtcgcctacgtcgctaaggatcccgtgaaccaacgggcatgtcacatactagagtgtcacaacggcatggcacaggacgtcatcagcaccatcggacaggcatttgagctcaggtttaaacagtacctcaagaaccccagccttaatacttcttgcgagtctgaggaggtgcacatcgactcccacgcagaggagcgagaggatcacgaatattacaacgaaatccccggaaagcaaccgccagttgggggtgtctcagacatgcgaatcaaagttcaggcgactgagcagatggcctactgcccgatccaatgtgagaaattgtgctacttgccagggaacagcaagtgttcatcagtttatgagaactgtctcgagcagtctcgggcaatcggaaatgttcacccccgaggggttcagtcccagagggatacctccctgctgaagcacacatgcagggtggacctcttcgatgacccttgctatattaatacacaggcactgcagtccactccaggcagcgcaggaaatcagaggtccgctcaacctctcggaagcccttggcattgtggtaaagctccagaaacagtgcagccgggtgcaactgcccagccggctagttcccacagcctcccccatattaaacagcagctctggtccgaggaatgctatcacggaaagctgtccaggaaagcagccgaatctctgctagtaaaagacggggactttcttgtccgagagtccgcaaccagccccggacagtatgtactgagcggcctccagggaggccaagctaaacacctcctgctggtagaccccgaaggtaaggtgagaactaaggatcatgtgttcgataacgtgggccatctgatccgatatcatatggataatagcctgccaattatatcgtctggcagcgaagtctctttgaaacagcccgtgaggaaggacaacaatcctgcgctcctccactctaacaagtag

SEQ ID NO: 53946 - DNA, 1164 bp, Artificial Sequence
  Description of Artificial Sequence: Synthetic coding sequence
atgctgccagctctggagcactggatcccgaaattttttagctttagaacaaggactggatcccctctaagtctcgcctgccgacagccaattgtgggaccttgcgaccacatcatcgccaatcatcacatgcaatctatctcgttcgcctcggggggagaccctgacacaacagattacgtggcatacgtcgcaaaggacccggtgaaccagagagcgtgccatattctagaatgccacaatggaatggcccaagacgtgatttccacgatcggtcaggcgttcgaattaagattcaagcagtatctcaaaaatccttccttgaacactagttgcgagagcgaagaggtgcacatcgatagccacgcggaggagcgggaggatcacgagtactacaacgagatccctggaaagcagccacccgtgggcggagtgtcagacatgcgcattaaggtacaggcaaccgaacagatggcctactgtcccatccaatgtgaaaagctttgctatctcccaggcaattcaaaatgttccagcgtgtacgaaaactgccttgaacagtcccgtgctatagggaacgtgcatcctaggggtgtacaatctcagcgtgacaccagtcttctgaaacacacttgccgggtagatttattcgatgatccctgctacatcaatacccaagctctgcaatccacacctggctctgccggaaatcaaagaagcgcccagcccctcgggtcaccttggcactgtggaaaagcaccagagacagtgcaacctggtgccacagcacagcctgcaagtagccatagcttgccacacattaaacagcagctgtggtctgaggagtgctatcatgggaagctcagcaggaaggcagctgagtctctgctggtgaaagacggcgatttcttagtgagagaatccgccaccagtcctggccagtacgttctatccgggctccaggggggacaggccaaacacctgctgcttgtggatccggaggggaaggttcgaactaaggatcacgttttcgataatgtgggacacctcattcggtaccatatggacaacagtctcccaataatctctagcggttccgaggtttcattaaagcagccagtgaggaaagacaacaatcctgcccttctgcactcgaataagtag

SEQ ID NO: 53947 - DNA, 888 bp, Artificial Sequence
  Description of Artificial Sequence: Synthetic coding sequence
atgtggggggcaaggaggtcatctgtttccagttcgtggaacgctgcatctcttttgcagctgctgttggccgctctgctggctgctggagcgagagcaagcggcgagtactgccatggctggctggatgcacagggagtctggagaattggattccagtgtcccgagcggttcgacggtggagatgccactatctgttgcggctcctgtgccctaaggtactgttgctcatcagccgaagcaaggctcgatcagggtggttgtgacaatgaccggcagcagggcgctggggagccgggtagagctgataaagatggaccagatggctccgccgtgccgatatatgtgccatttctgatcgttgggagcgtattcgtggcctttattatcttgggttctctcgtggccgcatgttgctgtcggtgtctgaggcccaagcaagatcctcaacagagccgtgcgccaggcggtaatcgcctcatggagactatcccaatgattccaagcgcttctacaagtcgcggatcttcttctaggcagtccagtaccgctgcctcgagttcgtcctctgccaactctggcgctcgcgcacctccaacacgttcccaaactaactgttgcttgcctgagggcactatgaacaacgtgtatgtgaacatgccaacgaatttcagcgtcctcaattgtcagcaggctactcagatagtcccacatcagggccagtaccttcacccaccctatgtggggtacacagtgcagcatgatagcgtgcctatgacagccgtgcccccattcatggatgggctgcaacccggatacaggcagatacagtctccgtttccacacactaactcagagcagaagatgtatcccgcagtgacagtgtag

SEQ ID NO: 53948 - DNA, 717 bp, Artificial Sequence
  Description of Artificial Sequence: Synthetic coding sequence
atgcgtgctctcttggccctctgtcttcttctcggatggcttcgctgggggccagccggagctcaacaaagcggagagtactgtcatggttgggtggatgtgcagggcaactaccacgagggctttcaatgtcctgaagattttgacactcttgatgcaaccatctgctgtggctcatgtgccttgcgctactgttgtgctgcagctgacgcaagattggaacaagggggatgtaccaatgatcgaagggagctggaacaccccggtatcaccgcacagcccgtatatgtccccttcctgattgtggggtcaattttcatcgccttcatcattctcggaagtgtcgtggcaatctattgctgtacttgcttgcgccctaaagagccctctcaacagcctatccggtttagcctccggtcctaccaaacggaaactctacctatgatcctgacatccaccagccctcgtgctccgtctcggcagtcttccaccgctacatcctcatcctcgaccggcggatctatcagacgcttttccttcgcccgtgccgaacctggatgtcttgtgccaagtcctcctcccccttataccacttctcattccatccatttagcccagccctccggattcctggtcagtccccaatattttgcctacccactgcagcaggaaccaccgttacctggaaaatcttgtcctgatttcagctcctcatag

SEQ ID NO: 53949 - DNA, 594 bp, Artificial Sequence
  Description of Artificial Sequence: Synthetic coding sequence
atgccacctgcgggactgcgccgagccgctcccctcacagccatcgctctgctggtgctcggcgctcctctcgtgttagccggagaggactgcttgtggtacctggatagaaacgggtcttggcatccaggcttcaattgtgaattctttaccttctgttgtggcacatgctaccatcgctattgttgccgggacctgaccctcctgatcactgaaagacagcagaaacattgccttgccttcagtccaaagacaattgctggaattgcttccgccgttattctgttcgtggcagtggtggccacaaccatctgctgcttcttgtgcagttgctgctacctttatagaaggagacaacagttacagtctcctttcgaaggtcaggagattccgatgactggcatccccgtacagccggtctatccatatcctcaagatccaaaagccggaccggctccccctcagccgggattcatttatcccccaagtggacccgcaccccagtacccgctgtacccagcaggtccacctgtttataaccccgctgcgcctcccccatatatgcctccccagccttcataccctggtgcatag

SEQ ID NO: 53950 - DNA, 1503 bp, Artificial Sequence
  Description of Artificial Sequence: Synthetic coding sequence
atggccctgcggaggcttctcctcctgctgctcctgtcactggaatcgctggatttactaccttccgtacacggcgcacggggaagggccgcaaatagaactttgtccgccggaggtgcagccgtgggcggtcggagagctgggggagccttggcccgaggcggtcgagaacttaacggcactgctcgcgctcctggtatccccgaagcaggtagcagaaggggccagcctgctgccgcagtcgcagccgctgccagcgcagcggttacgtatgagacctgctggggctactatgacgtatctggccagtatgataaggaattcgagtgcaacaattccgaatcaggctacctttattgctgcggcacctgctactaccgtttctgttgcaagaaacggcatgagaagttagaccaacgccagtgtaccaattaccaaagcccagtgtgggtgcagacaccaagcaccaaggtggttagtcccggtccagaaaataaatatgacccggaaaaagataagaccaacttcaccgtctatatcacctgtggcgtgatcgctttcgtcatcgtggcgggagtgttcgccaaagttagctatgacaaggcacacaggcctcctcgggagatgaacatccaccgagcattagccgatattctcagacagcagggaccaatccctattgcccattgcgaaagggaaacgatttccgctatagacacatcaccgaaggagaataccccagtcagaagttcctccaagaaccattacacccctgtgaggacagccaagcagacacccgagaaacctcgaatgaacaatattctgacatccgctaccgaaccttatgacctgagcttctcccggagctttcagaatttggcccatctgcctccaagttacgagtccgctgtaaagaccaacccctcaaagtattcttccctgaaaagactgacggacaaggaggcagacgaatactatatgcgccgacgacatctgcccgatctcgcagcgagggggacgttaccactcaacgtcatccaaatgagccagcaaaagcccctacctcgggagaggccacggaggcccatccgcgcaatgtctcaggaccgcgtgctgagtcccgatagagggctcccagatgagttcagcatgccctatgatcggatcctttctgacgaacaacttctgtccaccgagcggctgcacagtcaggatcctctgctgtcaccagagagaactgcgtttccggagcagagtctaagccgggctatctctcatacagacgtgttcgtgtcgacacccgtactcgaccggtacaggatgagcaaaatgcacagccatccgtccgcctccaataactcttacgccacgctcgggcaaagtcagacggctgctaagcgacatgcatttgcctctcgtcgtcataacaccgtggagcagttgcattacattcccggacatcacacttgctacactgcttcgaagacagaagtaacagtctag

SEQ ID NO: 53951 - DNA, 1599 bp, Artificial Sequence
  Description of Artificial Sequence: Synthetic coding sequence
atggcccttagacgtctgctgttactgctgctgttatcactagagtctctggacctgctgccatctgtgcacggcgctagaggacgggctgctaataggactttgtctgctggtggggctgctgtcgggggacggagggccggaggtgcattggcacggggaggaagggagttgaacggcaccgccagagcacccggtattcctgaggcgggttctcgtagagggcagcccgcagccgcagtggcggctgcagcctccgctgctgtaacgtatgaaacttgttggggatattatgacgtgtctgggcaatacgacaaggaattcgaatgtaacaacagcgagtctggatatctttattgctgcgggacctgctactaccgcttctgctgtaaaaaaagacatgagaagctggaccaacgacagtgtacgaattaccagagccctgtgtgggtccagactccatccactaaagtcgtgagccctggtcctgagaacaagtacgatcccgaaaaggataagacaaactttactgtatacatcacctgcggcgtaatcgcttttgtgatcgtggcgggtgtttttgcaaaagtgtcttacgataaggctcatcgcccaccaagagaaatgaatatacaccgggctctggcggatatattaagacagcagggtccgattccgattgcacactgtgagcgagagacaatttctgcgatcgatacttcgccaaaggagaacactccggtgcgctccagcagcaaaaatcattacacccccgttaggactgcaaaacagacaccaggccattatggaaaggacgcttataggtctggaggtcctgacctccacaattttatatcttccgggttcgtaactctgggcagagggcacacaaaggagaagcctaggatgaataacatactcacgagcgcaaccgagccttatgacctcagtttttcccggtccttccagaatctggcccacctgcctcccagttacgagagcgctgtgaaaacgaatccgtccaaatactcaagtctgaagagacttacagacaaggaagcagatgagtactacatgcgacgccgacatttgccagacttggcagctcgaggcacacttcccttaaatgtgatccaaatgagtcaacaaaagcccctgcccagagaaagacccagaaggccaattcgcgctatgagccaggaccgtgtgctctcccccgaccgagggctgcccgacgaattttcaatgccttatgacaggattttatcagacgaacaactgttgtctactgagcgccttcattcccaggatccgttattaagcccagagagaactgcatttccagaacaatccctgagccgcgcaatcagccatactgacgtgttcgtgagtacaccagttttagacaggtacaggatgagtaagatgcacagccatcctagcgcatccaataacagctacgcgacacttggccaatcccagaccgcagccaaaagacacgcctttgctagtcgcagacacaacaccgtggagcaattgcattatatccccggacatcatacatgctataccgctagtaagacggaagtcaccgtttag

SEQ ID NO: 53952 - DNA, 1656 bp, Artificial Sequence
  Description of Artificial Sequence: Synthetic coding sequence
atggccctgagaaggctccttttactcctgctcctgtcactcgagtcgctggatttgcttccctccgtgcatggagcacggggtagagccgcaaatcgtacactcagcgccggaggggctgcggtgggcggacgccgtgccggaggggctttggcccgaggagggcgtgaattgaacggtaccgcccgtgccccagggattccggaagccggatcgcggcgtggccagccagcggcagccgtggcagcagccgcttcagctgccgtcacctatgagacttgctggggctactacgatgtgagtggccagtatgacaaagaatttgagtgcaataattcagaaagcggatacctatattgctgtggaacatgttattatagattttgctgtaaaaagaggcacgagaagctcgatcagaggcagtgtaccaactatcaatcccccgtctgggtacagacgccaagcacaaaggtggtgagccctggacctgaaaataagtatgatcctgagaaagacaagaccaatttcaccgtctacattacatgtggcgtgatcgccttcgtgatcgttgctggcgtgttcgcgaaagtgtcgtacgataaagcacacaggccgcctcgtgaaatgaatattcaccgtgctctggctgacattctgaggcagcagggtcccattcctattgctcactgcgaaagggagaccatcagcgcgattgacacctcccctaaggaaaatacccctgtccgctcctccagcaagaatcactacacaccagtgaggacggctaaacaaacacctggacactacgggaaggatgcctaccgaagcggtggtcctgacttgcacaattttattagttcaggatttgtgaccctgggcaggggccatacaaagggcgaccatcagtacaatcaccccatacttagtagcgtgacccaaatccctcctcacgagaaaccacgtatgaacaacattctcacatctgccactgagccctatgacctgtccttttccaggtcctttcaaaacctcgcccacttgcccccatcttatgagtcagccgttaagacgaacccatcaaagtatagttcccttaagcgattgaccgataaggaggccgacgagtattacatgcggaggcgccacctgcccgatttagctgccagagggaccctgccactgaacgtgatccagatgagccagcagaaacccctgcccagagaacgccctcgaagacctatccgagctatgagccaggacagagtgctgtctccagaccggggacttccagacgagtttagcatgccctatgaccggatacttagtgatgagcagctgctttccaccgaaaggttgcacagccaggacccattactgtcacctgaaagaaccgcttttcccgaacagagtcttagcagagccattagccataccgacgttttcgtgtctacgcctgtcctggatcgctatcgtatgtctaaaatgcatagccacccgtcagccagcaacaactcttacgctactctgggacaatcgcagaccgctgccaaaagacacgcattcgcttctagacgccacaatacggttgagcaactgcactatattccagggcatcacacctgctacacagcatccaaaacagaagtcaccgtttag

SEQ ID NO: 53953 - DNA, 930 bp, Artificial Sequence
  Description of Artificial Sequence: Synthetic coding sequence
atgagcttcaacctgcagtccagtaagaaactgttcatattcttaggcaagtccctcttcagcttgctagaagctatgattttcgcacttttgcccaaacctcgcaagaacgttgccggagagatcgtcctcatcacaggcgctgggtcgggcctgggaaggctccttgcgctgcaatttgcccgacttggctctgtgctggtgctgtgggacattaataaagagggcaacgaagaaacttgtaagatggctcgggaggcgggtgccacaagagtacacgcttatacctgcgattgtagccagaaggagggtgtgtatcgagttgcagaccaggtcaagaaagaagtgggggacgtgagtatactgatcaataatgcaggtattgtgacagggaagaaatttttagactgcccggacgagttgatggagaagtcttttgacgtgaactttaaagcccatctttggacttataaggctttcctgcctgcgatgatcgctaatgatcatgggcacttggtgtgcatttccagcagtgccggactgtcgggcgtcaatggccttgccgactactgtgctagcaaatttgcggcttttggcttcgccgaaagtgtgttcgtggagacattcgtacagaaacaaaaaggcattaaaaccactatcgtgtgcccgttcttcatcaagaccggcatgtttgaaggatgcaccacaggttgtcccagtctgctgcccatcctggaacctaagtacgcggtggaaaagatagtcgaagcgattctccaggaaaagatgtatttgtacatgcccaagctgctgtactttatgatgttcctgaaaagcttcttaccgctgaagaccgggttgcttatagccgattatcttggcatacttcacgcaatggatggatttgtggaccagaaaaagaagctttag

SEQ ID NO: 53954 - DNA, 798 bp, Artificial Sequence
  Description of Artificial Sequence: Synthetic coding sequence
atgtcattcaaccttcaaagctcaaaaaagctgtttatcttcctcggcaaatcactgttctcattgctggaagccatgatttttgctctcttacccaaacctcgcaagaacgtagctggtgagatcgttttgatcacaggggcaggatctgggttgggacgcctgctagccttgcagttcgcacgtcttggctccgtcctggttctatgggacatcaacaaggaaggtaatgaagaaacctgcaaaatggccagggaagcaggggcaacccgcgtgcacgcgtatacctgcgattgctcgcagaaggagggtgtttaccgagtagcagaccagacttataaggccttcctaccggcaatgattgccaacgaccacggtcatctggtgtgcatctcctcgagtgcaggcctctcgggggtgaacggtctggccgattattgcgcctccaagttcgcagcctttggttttgccgaatccgtatttgtggagacattcgtccagaaacagaaagggatcaagactacaattgtctgtcccttcttcataaagactgggatgtttgagggctgtacaacgggctgcccttcactgctgccgattttggaaccaaaatacgctgtcgaaaagattgtggaagccattttgcaggagaaaatgtatttgtatatgccgaaacttttatatttcatgatgtttcttaagtcttttctcccgctgaagactgggctgctaattgcagactatctcggcatcctgcatgcaatggacggattcgttgaccagaagaaaaaactttag

SEQ ID NO: 53955 - DNA, 693 bp, Artificial Sequence
  Description of Artificial Sequence: Synthetic coding sequence
atgagtttcaatcttcagtcctcaaaaaagctgttcatcttccttggaaaaagcctgttttcactgctggaagccatgatatttgctctcctgcccaaaccccgaaaaaacgtagctggagagattgtgctgatcaccggggcagggagcggccttggccgtttgctggcgctgcagttcgccaggctgggcagcgtcctggtgctgtgggatatcaacaaggaaggaaatgaagagacatgcaaaatggcacgggaagccggagcgacccgagtgcatgcttatacttgtgattgttcccagaaggagggtgtctatcgggtagctgatcaagtcaaaaaggaggtcggggacgtgtcaatcctgataaacaacgccggtatcgtgacagggaagaagtttctggattgcccggacgaactcatggagaaatcttttgatgtcaattttaaagcgcacctttggacatacaaggcttttttgcccgcaatgatcgccaatgatcacgggcatctcgtatgtattagctcctccgctggcctgtccggggtcaacggtttagccgactactgcgcatccaaatttgccgcttttggctttgctgagagcgttttcgtggaaacttttgtgcagaaacagaaagggatcaaaactacaatagtgtgtccattctacaagaactggaacgtgtag

SEQ ID NO: 53956 - DNA, 1182 bp, Artificial Sequence
  Description of Artificial Sequence: Synthetic coding sequence
atggaccccaaacgtagccagaaggagtcagtccttattaccgggggttctggctatttcggcttcagactgggttgcgcactgaaccagaacggcgtgcacgttatcctgtttgatatttcgtccccagcccagacaatccccgaagggatcaaatttatccagggagacatccgccatctctctgacgtggagaaggccttccaagacgccgacgtgacctgcgtgtttcatattgcctcgtacggcatgtctggtcgcgagcagcttaacagaaacctcattaaagaagtgaatgttagagggacagataacatcctccaggtgtgtcagcgcaggagagtgccacggttggtgtacacctccacatttaatgtgatttttggcggacaagtgatcagaaatggggacgagtccctgccttatttgccccttcacctgcacccagaccactacagtcgcactaaatcaatcgcagaacagaaagtccttgaagctaacgcgacaccgctggaccgaggggatggagtgctgcggacatgcgctctgaggcccgctggcatttacggacccggagaacaaagacacctcccacggatcgtcagctatatcgagaagggcctctttaaatttgtgtacggggacccacgaagtttagttgagtttgttcacgtggacaatttggtccaggcacacattctcgcaagcgaagccctacgggcagataagggccatattgccagtgggcagccctatttcatatccgatggccgaccggtgaacaattttgaattctttcgccctctcgtggagggactggggtacacatttccctctacaagattgcccctcaccctggtgtattgctttgcctttctaaccgaaatggtacacttcattctcggcaggctatacaatttccaaccattcctgacccgtaccgaggtgtacaagacaggagtgacccattatttcagccttgaaaaagcgaagaaagaactgggttacaaagcacaacccttcgacctacaagaggctgtcgaatggttcaaggcccacggacacgggaggagtagcggcagtcgggactcagaatgtttcgtttgggacgggttgctcgtgttcttgcttattattgccgttctgatgtggctaccttcttcagttatcctctccctgtag

SEQ ID NO: 53957 - DNA, 369 bp, Artificial Sequence
  Description of Artificial Sequence: Synthetic coding sequence
atggacggctcccgcaaggaggaggaggaagatagtacttttaccaacataagcttggcggacgacattgatcacagtagtcgtatcctgtaccccagacctaaatctctgctgcctaagatgatgaacgctgacatggacgccgtggatgctgagaaccaggtggagttggaggagaagacccggctgattaaccaggtgctcgaactccagcacacattagaagatctttcagctagagtggatgccgttaaggaggagaacctaaagctgaaaagtgaaaaccaggtgttaggacagtacatagagaatttaatgagcgctagcagcgtcttccaaacaaccgatacaaagagtaagcgcaagtag

SEQ ID NO: 53958 - DNA, 480 bp, Artificial Sequence
  Description of Artificial Sequence: Synthetic coding sequence
atgagaagacgcgtctttagctcacaggactggcgagccagtggatgggatggcatgggtttctttagcagacgcacgttctgtggtcgtagcggtaggtcttgccgagggcaattagtccaggttagtcgccctgaggtgtccgccggttccctgctccttccagccccacaggcagaggatcactctagtcgaatcctgtatcccaggcccaaaagcctgctcccaaagatgatgaatgccgatatggatgccgtggatgccgagaatcaggtggagttggaagagaaaacgcgcctgattaatcaggtgctggaactacagcacactctcgaggatctgtctgccagagtcgacgcagtgaaggaggagaacttaaagctgaagtcggaaaaccaggttcttgggcaatatatcgagaacctgatgtccgcttctagcgtgttccagaccactgataccaaaagtaaacgaaaatag

SEQ ID NO: 53959 - DNA, 369 bp, Artificial Sequence
  Description of Artificial Sequence: Synthetic coding sequence
atggatggctcgcggaaggaagaagaagaggatagcactttcaccaatatttcactcgcggatgatatagaccactcatctaggatcctgtacccccgacctaagtctctcctcccaaagatgatgaatgcggacatggacgctgtcgatgctgaaaatcaggttgaacttgaagagaagaccaggctcatcaatcaggtattggaattgcagcacacacttgaagatctcagcgctagagtggacgctgtgaaagaagaaaatctgaagctaaaatccgagaaccaggttcttggtcagtacatagaaaacctgatgtccgctagctctgtgttccagactactgataccaaatcaaagaggaaatag

SEQ ID NO: 53960 - DNA, 369 bp, Artificial Sequence
  Description of Artificial Sequence: Synthetic coding sequence
atggatggatctaggaaagaagaggaagaggacagcacattcacaaatatctctttagctgacgatatcgaccatagctccaggatcctgtatcctcgcccaaagagcctgctcccgaagatgatgaacgccgacatggacgcggtggatgcagagaaccaagtggagttagaggaaaagacccggttaattaatcaagtgctcgagttacaacatactcttgaggatttgtcggctcgggtagatgcagttaaggaggaaaacctcaagttgaaatcagagaaccaggtactcggtcagtacatcgagaatctcatgagcgcctcttctgtgtttcagacgaccgacacaaaaagtaagcgaaagtag

SEQ ID NO: 53961 - DNA, 396 bp, Artificial Sequence
  Description of Artificial Sequence: Synthetic coding sequence
atgcgacgccgagtttttagttcccaggactggagggcctccgggtgggacggcatggggtttttttctcgtaggacattttgcggacgaagcggcaggtcttgccgcggtcaactcgtccaagtatcaagacccgaggtgtctgcagggtccttgttgctgccagctccgcaggctgaggaccactcgagcagaattctttatcccagaccaaagtccctgctgccaaagatgatgaacgccgacatggacgatttatccgctagagtggacgccgtgaaagaagaaaacctcaagcttaaatcagagaatcaggtgctgggccagtacattgaaaacctgatgagtgcctcaagcgtttttcagacaacggatacaaaaagcaagcggaagtag

SEQ ID NO: 53962 - DNA, 1191 bp, Artificial Sequence
  Description of Artificial Sequence: Synthetic coding sequence
atgctgcccctcttgctgctcccgctgctgtggggaggttctctccaggagaaaccagtttacgaactgcaggtgcagaaatctgtgactgtgcaggaaggactctgcgttctggtgccttgcagtttttcctacccttggaggtcctggtactcaagccctccactctatgtgtactggtttagagacggtgaaatcccttattacgctgaagtagtcgcaactaataatcccgatcgccgtgtgaaacctgagacacagggcagatttcgactgttgggtgacgtgcaaaagaagaactgcagcttaagtattggtgacgccaggatggaggataccggatcctattttttccgggtggaacgcggtagggacgtgaaatacagctatcagcagaataagctgaacctggaggtgaccgctttaattgagaaaccagatatccacttcctggagcctctcgagtcaggacgacccacgcgcctttcctgctcattgcccggttcctgtgaagcaggcccacccctaacgttttcttggactggaaacgctctctcccctctggacccagagaccacaagatcatctgagttgacactgacgcccagaccagaagaccacggcaccaatctgacatgtcaggtgaaacgccagggggcacaggtgactaccgagaggacagtccagctgaatgtatcttatgcccctcagaacttggccatttcaattttcttccggaatggaactgggactgccctgagaatcctgagtaatggtatgagcgttccgattcaagaaggacagagcctattcctggcttgcacagtggacagtaatccccctgcgtccctgagctggtttcgcgagggaaaggccttgaacccctctcagactagcatgtccgggaccctggagctgcccaatatcggtgccagagaagggggagaattcacctgcagagtacagcaccctttgggcagtcagcacctgagctttattctctctgtgcaacgctccagctcctcttgcatctgcgtcacagagaaacagcagggctcttggccactggtcctgactctcataagaggcgctctcatgggcgcaggtttcctcctgacttacgggctcacctggatttattacacccgctgcgggggacctcaacagagcagggccgagcgacccggatag

SEQ ID NO: 53963 - DNA, 987 bp, Artificial Sequence
  Description of Artificial Sequence: Synthetic coding sequence
atggagaagtcgatttggctgctggcctgtctcgcatgggtgctccccacgggcagcttcgtgaggacgaaaattgatacaacagaaaatctgctcaataccgaagtccattcctctccggctcagcgctggtctatgcaggtgccaccagaggtctccgctgaagccggagatgcagcagtgttgccttgcaccttcactcacccccatcggcattacgatgggccactaacagctatttggagggcaggggaaccctacgccggtccccaggtgtttaggtgcgccgcagcacggggttcagagctctgccaaacagcgctgagtttacatggcaggtttcggcttctaggcaacccgcgacggaacgacctgagccttcgtgtcgagcggttggcactggcagatgacaggcgatatttctgccgtgtcgagtttgctggagatgtgcatgatcgctacgagagcagacatggggtgcgcctccacgttactgccgcacccaggatcgtgaatatctccgtgctgccgagccccgcacatgcttttagggcactgtgcacagccgagggagaacctccacctgccttagcatggtctggccctgcccttggtaacagtctcgccgcagtgcgcagccctagggaaggtcacgggcatttggtgaccgctgagcttccagccctgacccacgatggccgatacacatgcaccgcagcaaactccctggggcgatctgaggcttcggtttatcttttccgcttccatggcgcaagtggtgcctcaacggtggcgcttttgctgggcgctttggggtttaaggcactgttgcttttgggtgtcctggcggcacgtgcggcacgcaggcgacctgaacaccttgatacccccgacacaccaccacgttctcaagcccaggagtcaaactacgaaaatctgtcccagatgaatccacggagccctccggcaaccatgtgctccccatag

SEQ ID NO: 53964 - DNA, 525 bp, Artificial Sequence
  Description of Artificial Sequence: Synthetic coding sequence
atgactgccacacgggctgccactgcatccgggtccgctcccaggatcgtcaatatctctgtgctccctagccctgcacatgcttttcgggcactgtgcacggctgaaggcgaaccccctcctgcgctggcctggtctgggcctgctctggggaactccctagccgcagtccgctcaccaagagaaggtcacgggcacctggtgaccgctgagctgcccgctctcacccatgatggcaggtacacctgtaccgccgcaaatagccttggacggtctgaggctagcgtgtatttattcaggttccatggtgcctccggagccagcacggtcgccctgctgctgggtgcacttggcttcaaagcactgttgttgctgggtgtgctcgccgctcgcgctgcccgtaggaggccagaacacctggacacgccggacactccacccaggagccaagcccaggagagtaactatgaaaatctgtcacagatgaatccacgatcacctccagctacaatgtgcagcccttag

SEQ ID NO: 53965 - DNA, 1494 bp, Artificial Sequence
  Description of Artificial Sequence: Synthetic coding sequence
atgatgtctagtgccgcttttcctcgttggctacaatctatgggcgtacctagaaccccctctaggaccgtgctctttgaacgagagcggaccggcctaacttaccgggtacccagtctcctccctgttccacccggacctaccctgttggcttttgtggaacagaggctcagtccggacgatagtcatgcccacagattagttctccgcaggggcactctcgctggcggatccgtgcgttggggggctttacatgtgctgggtacagctgcactggctgaacacaggagcatgaatccttgtccagttcacgacgcaggaactggcacggtgttccttttttttatcgcagttcttggtcatacgcccgaggcagtgcagattgcaacgggccgtaacgctgccagattgtgttgcgtggccagcagggatgccggtctgtcctggggttccgcgcgagacctaacagaggaagccattggaggcgctgtgcaggactgggctacatttgcagtcggcccaggccatggcgtgcaactcccttcagggcgactacttgtccctgcctatacataccgcgtggatcggcgtgagtgcttcggcaaaatctgtcgaacctcgcctcacagcttcgcattctattcagatgatcatggcagaacttggagatgtgggggactcgttccaaatctccgttccggggagtgtcagctggctgctgtggacggagggcaagcaggtagctttctgtactgtaacgctaggagtccactgggatctcgagtccaggccttgtcaaccgacgaaggcacgtcctttctgcccgctgagcgcgttgcctctctaccggaaacagcctggggatgtcaaggctccatcgtcggcttccctgctccggcaccaaatcgcccaagggacgactcctggagcgttggacccggatcacctctgcaaccccctttactggggccaggcgttcatgagcctccagaggaagccgctgtggatcctcgaggcggacaggtccctggtggcccatttagtcggctgcagccgcgtggagatggaccaaggcagccgggaccaagacccggtgtgagcggtgatgtgggctcttggaccctggcactccctatgcccttcgcggcaccaccacagagcccaacatggctcttatatagccaccctgtggggaggcgggcacgcctccatatggggattcgactttcccagtctccactggatcccagatcttggactgagccatgggtgatctatgaagggccaagcggttactccgacctcgcatcgatagggccagcccctgagggaggcctggtgttcgcctgtctctatgagtctggagccagaaccagttacgatgagattagtttctgtaccttctccttgcgtgaagtcttggagaacgtgcccgcatctcctaaaccaccaaaccttggagataagcctagaggatgctgctggccttcttag

SEQ ID NO: 53966 - DNA, 1455 bp, Artificial Sequence
  Description of Artificial Sequence: Synthetic coding sequence
atgggcgtcccgagaaccccatcaagaaccgtgctcttcgagagagagcgtaccgggcttacttatcgagtgccaagtctactgcccgtgcctcccggtccaacattactcgcattcgtcgaacagcgcctgagccccgacgattcccatgcccacaggctcgtgctgcggcgtggcacattggccggtgggagcgtgcgttggggcgcattgcatgtcctgggtaccgctgcactggccgagcaccgcagcatgaacccctgtcctgtacatgacgccggaaccggcactgtctttttgttcttcatcgccgtgctcggccatacacccgaggcggtacagatagcaacagggagaaacgctgcgagactgtgttgcgtggccagcagggacgcagggctgagctggggcagcgcgcgagacctcaccgaggaagccattggcggtgccgtgcaagattgggctacttttgccgtcggacccggacacggcgtgcagctcccttccggaagactcctggtacccgcatacacttatagagtcgaccggagggagtgtttcggcaaaatctgccgaacatccccacattctttcgctttttacagtgatgatcacgggaggacctggaggtgcgggggtctagttcccaatttgcggagcggagaatgccagctggctgctgtggacgggggacaggccggttcattcctgtactgtaacgccagaagtcccctgggttcccgcgttcaggcccttagtacggacgaaggaacatccttcctgcctgcagagcgggtcgcatcactgccagaaaccgcctgggggtgccagggcagcatcgttggatttccagcaccggcacccaataggcctcgcgatgacagctggtcagttgggcctgggagtcctctgcaacctcctcttctcggacccggagtacacgaacctccggaggaagctgccgtggacccgcgtggaggacaggtgcctggcggaccgttctccaggctgcagcccaggggcgatggccctaggcagcctggcccaagacctggggtctccggagatgtcggcagttggacccttgcgctaccaatgcccttcgccgctccccctcaatcccccacctggctgctgtactcacacccagttggtaggcgtgctagattgcacatggggattaggcttagccagagcccgctggaccccagaagttggaccgagccctgggtcatttacgaagggcctagcgggtattctgatctggcttctattggccctgcacccgagggcggactggttttcgcgtgcctctatgagtcaggagcaaggacatcctacgacgagatctctttttgtaccttttctctcagagaggtgctcgaaaatgtgccagcttctccaaagcctcctaatctgggggataagccacgtggatgttgttggccttcctag

SEQ ID NO: 53967 - DNA, 1491 bp, Artificial Sequence
  Description of Artificial Sequence: Synthetic coding sequence
atgatgtcctcagccgctttcccaaggtggctgagcatgggcgtgcctcgcaccccttcccgcactgtgctttttgagagagaacgcactggcctcacttacagggtaccttcgctgctacccgtgccacctggtcccacccttcttgcattcgttgaacagagactgtctccagatgattctcatgcccaccgactggtgctgcgtagagggactttagcaggcggaagcgtacgttggggggcactgcatgtcctgggcaccgcggcactggctgaacaccgctctatgaatccttgccctgtccatgacgctggcacaggaacagtgttcctcttctttattgccgttctcggccataccccagaagctgttcagatcgccaccgggagaaatgctgctaggctgtgctgtgtggccagccgggacgcgggattgagttggggctccgccagggatctaaccgaagaggccataggtggcgctgttcaggactgggcaacattcgcggttggacccggacacggagtgcagttaccctccggacggcttctggtccccgcttatacatatagagtggaccggagagagtgtttcggaaaaatctgtcgcacctccccacacagctttgccttctatagcgatgaccacggacggacctggagatgtgggggtttggtgcctaatctgaggtcaggagagtgccaactggctgccgtagacggaggacaagctggtagtttcctgtactgcaatgctcgatcacctctggggtctagagtccaagctcttagtacagacgaaggaacatcgttcctgcccgctgagcgagttgcctcattgccagagacagcctgggggtgtcaaggttcgatcgtgggcttccccgctccagcccctaacagacctcgcgatgacagctggagcgtcggaccaggctcccccctgcaaccccctcttctggggccaggagttcacgagcctccagaggaggctgccgtggatccgcgaggaggacaggtccctggcggacctttctcacggctacagcccagaggagatgggcctaggcagcctggccctcgaccgggtgtctctggggacgtagggtcttggacccttgccctccctatgccattcgcagcccctccccaatcccccacgtggctcctgtacagccatcccgttggcaggcgcgctcggctgcatatgggcatacgtctgtcacaatctccattagacccaagatcctggaccgaaccctgggtaatttacgaaggccctagcggctacagcgacttggccagcatcggtcccgctccggaaggcggtctagtctttgcatgcctttatgagtcaggcgctagaacttcctacgacgagatctccttttgtacttttagtcttcgcgaggtgctcgagaatgtccccgcttccccaaaaccccctaatttgggtgataaacccagagggtgctgttggccatcctag

SEQ ID NO: 53968 - DNA, 1455 bp, Artificial Sequence
  Description of Artificial Sequence: Synthetic coding sequence
atgggagtgccaagaacaccctcgcggactgtcctgttcgagagagaacgtacaggtctcacgtatagagtcccgtctctcctgcctgtgcctcccggtcccactctgctggccttcgtggaacagcggctgagtcccgacgacagccacgcgcacagactcgtgctaaggagaggcacactggccggtggcagcgtacgatggggcgctctgcatgtactcgggacagccgctctggcagagcatcgcagcatgaacccctgtccggtccatgatgccggaaccgggacagtgttcctttttttcattgctgtgcttggccacacccccgaagctgtgcagattgcaactggcaggaatgccgctcggctgtgttgtgttgcatcaagggatgcaggcttgtcctggggcagcgccagggatctgaccgaggaagcaatcggaggagctgtgcaggattgggcaacattcgctgtcggacctggtcacggcgtgcagctccctagcggtaggttattagtcccggcttatacttatagagtggaccgtagggagtgcttcggcaagatctgccgaactagcccccacagcttcgcattctactcagacgaccatggacggacctggcggtgcggcggactggtccctaaccttcgttccggggaatgccaattagctgctgtcgatgggggacaggccggaagttttctctattgtaacgcaaggtccccactggggagccgggtccaggccttgtccactgatgaaggaaccagtttcctgcctgcggagcgggttgccagcctgccagaaaccgcctgggggtgccagggctcaatagtggggttccccgctccagcgcctaaccggcctagagatgatagctggtccgtgggtcccggaagtcctctgcagcccccactactgggcccaggggttcatgagccacccgaagaggctgctgtggacccaaggggcggtcaggtcccaggcggacctttttccaggctgcagcccagaggagatgggcctcgacagcctgggccacgaccaggagtgagcggcgatgtcggaagttggacccttgccctcccaatgccgttcgctgctccaccccagagccctacctggttgctgtactcccatccggtcgggcgtcgtgctagactgcacatgggtatccgactgtcccagtcccccctcgatccgaggtcttggacagaaccttgggtgatttatgaaggcccttccggctacagtgatttagccagcattggaccagcccctgaaggtggcctggttttcgcctgtttatatgagtcaggcgctaggacaagttacgatgaaattagcttctgcacattttcattacgtgaagtgctcgaaaatgttccagcatcccccaaacctcctaacctgggcgacaaaccgaggggctgctgttggccatcttag

SEQ ID NO: 53969 - DNA, 1455 bp, Artificial Sequence
  Description of Artificial Sequence: Synthetic coding sequence
atgggggttcctaggactccctcaagaacagtgttgttcgaaagagaacggactgggctaacatatcgggttccatcattactgccagtgccgcctggcccaaccctgctggcgttcgtggagcaacggctgtcgccagatgattcccacgcgcaccggctcgttctacgcagagggaccctggccggaggctctgttcgttggggagcgcttcacgttctgggaacggcggctctagcagaacatcgctctatgaatccctgccctgtccatgatgcaggtaccggaacagtgttcctgtttttcatagcagtgttaggccatacacctgaagctgtgcagatcgccacggggagaaatgcggctcgtctgtgctgcgtagcatccagggatgccggactctcctggggaagtgccagagacctgactgaagaggccattggcggagcagtgcaagattgggcaacttttgccgtgggcccaggccacggggtccagcttccctctgggcgactgttggtgccagcttacacctaccgcgtcgaccgcagagaatgctttggtaagatttgccgcactagcccgcattccttcgccttttatagcgatgatcacggccgaacctggcgttgcggcggtctagtgcccaatctccgctctggagagtgtcaactggccgcagtggacggcggacaagccggatcctttctgtactgtaacgcccgtagccccctagggtcgagggtgcaggctctgtctaccgatgagggcaccagctttttgccagccgagagggtcgcctcactgcccgagacagcatgggggtgtcagggcagtattgttgggttcccggctcctgcaccgaaccgcccaagagatgacagctggagtgtgggcccagggtctcctctgcaacccccactgcttggcccaggcgtgcacgagccgccagaagaggctgctgttgaccccaggggcggacaggtgcctgggggtcctttcagtcggcttcaaccacggggtgacggaccccgacaacctggcccacgcccaggagtgtcaggagatgtcggctcctggactctggctttacccatgcctttcgcagcacctccacagtctccaacctggctgctgtacagtcatcctgtgggacggcgtgccaggctgcacatgggcataagactgagccagtcccctttggaccctcgcagctggaccgaaccgtgggtgatttacgagggaccaagcggatactccgatctggctagtatcggccctgctccggaaggaggtctagtctttgcatgcctatatgaaagcggggctaggacgtcctacgacgagattagcttctgcaccttcagtctccgtgaggtactggagaatgtcccagccagcccaaagcccccaaacttaggtgacaagccaaggggatgttgttggcccagctag

SEQ ID NO: 53970 - DNA, 783 bp, Artificial Sequence
  Description of Artificial Sequence: Synthetic coding sequence
atgggtgtaccaaggacaccatctaggactgttctgttcgagcgagagcgcaccggactcacatatagggtcccttccctgctccctgtgccccctggccctacgctcctagccttcgttgaacaaagactttccccagacgactcccacgctcatcggctagtactgcgcaggggaacgcttgcaggaggcagcgttaggtggggcgctctgcatgtcctgggcactgccgctctggccgagcacaggagcatgaatccttgccccgttcatgacgcagggactggcacagtgttcctttttttcattgcagtactgggccatacccccgaagccgtgcagattgccactggtcgtaatgctgcccgtctatgttgcgtggccagtcgcgacgctgggttgtcctgggggtctgcgagagatctgaccgaagaagccattgggggtgctgtccaagattgggccactttcgccgtgggaccagggcacggcgtacaactgccctctgggaggctcctggtgccggcttacacctatcgtgtagaccggagggagtgcttcggcaagatttgtcggacctcccctcatagtttcgccttttattccgatgatcatggcaggacctggcgctgcggtggcctggtgccgaatctgcggtctggagaatgccagttagcagctgtggatgggggtcaggccggaagtttcctctactgtaacgcgcgttcacccctgggcagtcgcgtgcaagcattgagcactgacgaaggaacttccttctag

SEQ ID NO: 53971 - DNA, 567 bp, Artificial Sequence
  Description of Artificial Sequence: Synthetic coding sequence
atgggcgtgccacgcactccatccagaactgtgttgttcgagcgagagcgaacaggcctgacctaccgcgtcccttctctactgccagtccccccaggaccaacactcctggcctttgtcgagcagaggctttctccagacgactcacacgcccacaggctggtgctgagaagaggcactctggccggtgggtctgtgcggtggggggcacttcatgtgcttggcaccgccgcactggctgagcacaggtcgatgaacccgtgccccgtgcacgatgcaggaacaggcaccgtattcttattctttatcgccgtcttgggccatacacccgaggccgtccagatcgctacaggaagaaatgctgcccgactgtgttgcgtggcgtcacgagacgccggactgtcctgggggagcgcgcgagatcttaccgaggaagcgatcggcggtgctgtgcaggattgggccaccttcgcagtcggcccaggccatggagttcagctgccctccgggcgtcttttggtgcccgcttacacctaccgtgtcgaccggagggaatgcttcggctag

SEQ ID NO: 53972 - DNA, 1485 bp, Artificial Sequence
  Description of Artificial Sequence: Synthetic coding sequence
atgaaactgcaggagggacataccgtcctgttatccttacccttgcgtctggccggaacggagacagaacacgggggtccatcttatccctttacagattctgcccttagagccggtgaggacggcccagatttaccccgagccctggctgccccacgcgctccgcctgacgattctcatgcccataggctcgtgctccgtcggggaacgctagcgggaggttcggtgcgctggggagctctacacgttctcgggacagccgctctcgcagagcacagaagcatgaacccatgtcccgtccacgatgcaggtacaggaacagtattcctgtttttcatcgcggtgctcggacacacccctgaggccgtacagatcgccacaggaagaaacgcggcacggctttgttgtgtggcgtcccgcgacgcgggactgtcttggggatccgcccgagatctgaccgaagaagctatcggaggtgccgtccaagattgggccacattcgcggtgggccctggccatggtgtgcaattgccttcaggcagactcctggtccctgcctacacttatagggtggaccgcagagagtgctttggcaagatctgccgaacgtccccacattcctttgccttttattccgacgaccacggaagaacatggcggtgtggtggccttgtgccaaacctgcgctcaggcgagtgccaacttgcagccgtggatggcggacaagcgggaagcttcttatactgcaatgcacggagccctttgggctcacgtgtgcaggccttgtctaccgatgaaggcacaagctttctaccagccgaacgggtggcctccctgccagagaccgcttgggggtgccaggggtcaatcgtgggattccctgctcctgctcccaatcgccctcgggacgacagctggtctgtcgggcctggctctccactccagcctcctctgctcgggcctggcgttcacgaacctcccgaggaagctgccgtagatcctcgaggaggacaggtgccaggagggccattcagtcgcttgcaacccaggggtgatggcccacggcagccagggcctaggcctggcgttagtggcgacgtgggctcatggactctggccctccctatgcccttcgctgctcctccccagagccctacatggctgctttattctcacccagtgggacggagagccaggcttcacatggggattcggttgtcccagagcccactggacccgagatcgtggacagaaccatgggtaatttacgaggggccatccggctattccgacctggctagtattggtccggctccagaggggggactcgtctttgcatgtctctacgagtctggcgcacggactagttatgacgagatttcgttctgcaccttcagtttgcgagaggtcctggaaaacgtgcccgcaagcccgaagccacctaatctgggggacaaaccacgtggttgctgttggcctagttag

SEQ ID NO: 53973 - DNA, 2484 bp, Artificial Sequence
  Description of Artificial Sequence: Synthetic coding sequence
atgcgcggatgcctgcgcctggcactgctgtgtgctcttccatggctcctgcttgcggctagccccggacaccccgcaaagtccccaagacagcctcccgcacctagacgcgatcccttcgatgcagcaaggggcgctgacttcgatcatgtttacagtggggtagtgaacctgtctaccgagaacatttactccttcaactacacttcacagcccgatcaggtcacagcagtgagagtgtacgtgaatagtagtagtgaaaatctgaattaccccgtgctggttgttgttcgccagcaaaaagaagtcctgagctggcaggttccgctcctcttccagggactttaccagcgaagttataactatcaagaggtgagccgcacattgtgtccctcagaggctaccaacgagaccggtccattgcagcaactaatcttcgtcgatgtggcttcaatggctccactgggtgcccaatacaagctcctggtaaccaaattgaagcatttccagctgcggactaacgtggcattccattttaccgcaagcccttcccagccacagtattttttatacaagtttccgaaagatgtggacagtgtcatcataaaagtagtatctgaaatggcctatccgtgcagtgtcgtgtctgtccaaaatatcatgtgcccagtttacgatttagaccacaacgtagagtttaatggggtctatcaatcaatgaccaaaaaagctgcaatcaccctgcaaaagaaagatttccccggagagcagttttttgtggttttcgtgatcaagccggaagattatgcttgcggtggcagctttttcatacaggaaaaagaaaaccaaacctggaaccttcagcgcaaaaaaaacctggaagtgacaatagtgccttccatcaaagagagcgtctacgtgaaatccagcctgtttagcgtcttcattttcctctcattctatctgggctgcttgttagtgggctttgtacattacctgaggttccagaggaaaagtatcgatggaagctttggttccaacgatggatccggtaacatggtcgcctcccatccgatcgcggcttcaacacctgaaggaagcaactacggaaccatcgatgagtcctctagctcaccaggacggcaaatgtcctccagtgatgggggaccacctgggcagagcgataccgactcttcagtagaagaatcagacttcgacaccatgccagatatagaaagcgataagaacatcattcgcacaaaaatgtttctatatctgagcgacctgtcccgcaaggaccggcgaatcgtgtccaagaaatacaagatctacttctggaatattatcacaattgcagtcttctatgcactgccggttatccagctggtcattacatatcaaacagtggttaacgtgacgggtaaccaagatatttgctactacaatttcctctgcgcccatccactgggcgtgctgagtgccttcaataacattttgagtaatttggggcatgtcctcctgggattcttatttctcctcatcgtgcttaggagagatatactccaccggagagctcttgaagctaaggatatctttgctgtagaatatgggatccctaagcacttcggcctgttctatgccatgggaatcgccctaatgatggagggcgttctgagtgcatgctaccacgtgtgccccaattacagcaactttcagttcgacacatcctttatgtacatgattgccggtctgtgcatgttgaagttgtatcagacaaggcaccccgacattaacgccagcgcttattcagcatacgcgtcgttcgccgtggtgatcatggtgacggtgctcggtgtggtctttgggaagaatgatgtttggttctgggtgatcttcagtgccatccacgtattggcttctcttgctttgagcacacagatctactacatgggaaggttcaagatcgatctgggcatcttcaggagagctgctatggttttctacacggattgtatccagcagtgctcgaggcctctctatatggatcggatggttttacttgttgtggggaacctcgtgaactggtcttttgctctgttcggactgatttatcggcctagggacttcgccagctacatgctcggcatcttcatttgcaatttactcctgtacctcgccttttacataatcatgaagctcaggtccagtgagaaagtcctacctgtgcctctcttctgtatagttgctacagccgttatgtgggccgcagctttatactttttttttcagaatctaagctcgtgggagggtaccccagctgagtccagggaaaagaatcgagagtgcattctcttggacttcttcgacgatcacgatatctggcactttctgtccgctaccgcgctctttttttccttcctcgtattactgactctggatgacgacttagatgtagtgcggcgtgaccagatccctgtgttctag

SEQ ID NO: 53974 - DNA, 2499 bp, Artificial Sequence
  Description of Artificial Sequence: Synthetic coding sequence
atgcggggatgtctccggctcgccctgctttgcgcccttccgtggctgctactggccgcttcacccggacatcccgctaaatccccaagacagccacccgctcccagaagagatccctttgatgcagcccgaggggctgacttcgaccacgtctattctggggttgtgaatcttagcaccgagaatatttactctttcaattacaccagccagccagaccaggtgacagctgtcagagtatacgtgaactctagttcagagaacttgaattaccccgtacttgtggtggttaggcagcaaaaggaagtcctgagctggcaggtgcctctgttgttccagggtctgtaccaacgctcatacaactatcaggaggtctctcgcacgctctgcccatccgaggccaccaatgaaaccggtcccctgcagcagctaatctttgtcgatgttgccagcatggcacccttgggcgcacaatacaaactgctggtaacaaagttgaaacattttcaactccgaacaaatgtcgccttccactttactgcatccccctctcagcctcagtatttcctctataagtttcccaaagacgttgacagtgtaatcatcaaagtcgtgagcgagatggcatatccttgctctgttgtgtctgtgcagaatatcatgtgccccgtatacgacctggaccataacgtggaatttaatggggtgtaccagtcgatgaccaagaaagctgcgataacgctgcagaagaaggactttccaggggaacagttctttgtagtgtttgtcattaagccagaggactacgcctgcggaggatccttcttcatccaagagaaagaaaaccagacctggaacctacagaggaaaaaaaatctcgaggtgaccatcgttccgtctattaaagagagcgtctatgtgaagtcatcacttttttcagtcttcatcttcctgtctttctacctgggatgtcttttggttggttttgtgcactatctgcgttttcagcgaaagagcattgacgggagttttgggagcaacgacgggagtggcaatatggttgcgagccatcccatcgctgcctcaacccccgaaggatctaactacggaacaatagatgagtcttccagttctcctggccgacaaatgtcttcatctgacggcggaccaccaggccaaagtgatacggatagttccgtcgaggagtccgactttgatacaatgccagacatcgagagtgataaaaatattatacgcaccaagatgttcttatatctgagtgacttaagtcgcaaggatcgtcgcattgtctctaaaaaatacaagatctacttctggaacattattaccatcgcagtgttctacgccttgcctgtcattcaattggtcattacttaccagacagtcgttaacgtcaccggcaatcaggatatttgctattataactttttatgcgctcatccactgggcgtgctctcggcttttaacaacatcctgtcaaacttagggcacgtgctactgggatttttattcttactcatcgttctgaggcgtgacatcctgcaccggagagcactcgaggctaaggacatcttcgctgttgaatatgggatccctaaacatttcggcctgttttatgctatggggatcgccctgatgatggagggagtgttatcagcttgttaccatgtgtgtccaaactatagtaactttcagttcgatacctcattcatgtacatgattgctggcctttgtatgttaaagctttaccagaccagacacccagacataaacgcaagcgcttattctgcgtacgctagcttcgccgtagtgatcatggtcactgttctaggagtagtgtttggtaagaacgatgtttggttttgggttatattctctgcaatacacgtgctggccagtctggccttatcgacccaaatttattatatgggacggttcaaaattgccattacgcctaccgatctaggcatcttccgccgagccgctatggtattctataccgactgtattcaacagtgttccaggcctctatacatggatcggatggtgctgctggtcgtcggtaacctagtgaactggtcatttgccctgttcggtctgatctaccggcctcgggacttcgcctcttacatgctgggcatctttatatgcaatctgttgttgtatctcgcattctacatcatcatgaagctgcgcagtagcgagaaggtgttgcccgtccccttgttctgtatcgtggctaccgccgtcatgtgggccgcagcattgtatttcttctttcagaacctgtcttcgtgggagggcacacccgctgaaagccgagaaaaaaatcgagagtgcatcctccttgacttcttcgacgatcacgatatctggcactttctatctgctactgcccttttctttagcttcctggtgctgttaacattagatgatgatctagacgtggtgcgcagagatcaaatccccgtgttctag

SEQ ID NO: 53975 - DNA, 2568 bp, Artificial Sequence
  Description of Artificial Sequence: Synthetic coding sequence
atgttcgccctgggtctgccctttctggtgctgttggtggcttcagtggaaagtcacctcggtgtcctcggaccgaaaaacgtgagtcagaaggatgccgaattcgagagaacttacgtggatgaggtgaactcagaactggttaatatttacacattcaaccataccgtgactcgtaacagaacggagggggtacgcgtgagcgtgaacgtgctaaacaaacagaaaggggctcccctactgttcgtcgtccgccaaaaagaggcagtggtcagcttccaagtgcctctcatcctgagaggcatgttccaacgaaagtacctgtatcaaaaagtggaaagaaccctgtgtcagccccctacgaaaaacgagagcgagattcagtttttctacgtcgatgtgtccaccctgtctccagtcaacactacctatcagttgagagtcagccgcatggacgattttgtgttaagaacaggcgaacagttttcctttaacacaactgctgcccagccacagtacttcaagtatgagttccccgaaggggtcgactcagttattgtgaaggtgacatcgaataaagcgttcccatgttccgttatctcaattcaggatgttctgtgccccgtgtacgatctggataataacgtcgccttcatcgggatgtaccagaccatgaccaaaaaagcagccattacagtgcaacggaaggattttccctccaactctttctacgtagtggtagtggtaaaaacggaagatcaggcttgcggaggttccctgccattctaccccttcgctgaagacgaacctgtagatcagggacatcgacaaaagactttgtccgttctggtgtcacaggcagtcacaagcgaggcctatgttagtggaatgctcttttgcctgggaatttttctgtccttctacctacttacagttctgcttgcatgctgggagaactggagacagaagaagaaaaccctcctggtcgccatcgacagggcctgtcccgagagtgggcaccctagggtgctcgctgatagcttcccaggctcatccccctacgaagggtataactatgggtcttttgaaaacgtgagcggcagcacagacggcctggtggattcggcagggaccggagatctcagttacggctatcagggccatgatcagttcaagcgcagattgcctagcggtcagatgaggcagctttgtatagctatgggccgaagcttcgaaccagtgggaacaagacctagagtggactccatgtcttctgtcgaagaagatgactatgatacactcactgacatcgattcagacaaaaatgtcataagaacgaagcagtacttatacgtggccgacttggcccgtaaagataaaagagtcctgcggaagaagtaccaaatctatttctggaatatcgccactattgccgtgttctatgctttgcccgtggtccagcttgtgataacgtatcaaacagtcgtgaacgtgaccggcaatcaggatatctgctattataattttctgtgcgcacatcctttggggaaccttagcgcctttaacaatatcttgagtaacctaggctacatcttgttgggacttctgttcctccttataatactgcaacgggagataaaccataaccgggcactcctgcggaacgacctgtgtgccctggagtgcgggattcccaagcatttcggcctgttctatgctatgggcacggcgctcatgatggaggggctgttgtccgcatgctatcacgtgtgtcccaactacacaaattttcaattcgacaccagctttatgtatatgatcgccggactctgtatgctgaagttgtaccagaaacgccaccctgacatcaatgcttccgcgtacagcgcctacgcctgtcttgcaatcgttatctttttctcggtgctaggcgtcgtgtttggtaagggtaataccgctttttggatcgtgttcagtatcatacatatcattgcgacactcctgctgtccacacagttatattatatgggtcgatggaagttggatagcgggatctttcgcaggattcttcacgtcctgtatacggactgtattcgtcaatgttctgggcctctgtacgtggaccggatggtgctgctcgtcatggggaatgttatcaactggagcctggctgcatatggattgatcatgagaccaaatgactttgcctcatacctgctcgccatcggcatttgcaacctcttattgtactttgctttttatatcatcatgaagctgcggagcggggaaagaatcaagcttatccctctactgtgcattgtgtgtaccagtgtggtgtgggggttcgcacttttctttttctttcaaggccttagcacctggcagaagactccagctgaatctagagagcataatcgggattgcatccttctcgatttcttcgacgatcacgacatttggcattttctctccagcatcgctatgtttggctcattcctggtgagcggtcccccagggagggcgggatgggtcagagaaggaagctcatgcctcctcctttgtggctag

SEQ ID NO: 53976 - DNA, 2499 bp, Artificial Sequence
  Description of Artificial Sequence: Synthetic coding sequence
atgttcgcactcggcctcccatttctcgtcctcttggtggcatctgttgagtctcatctgggtgtgctgggccctaaaaacgtatcccagaaagatgccgagttcgagaggacttatgtcgacgaggtaaactctgagctggtcaacatatacacttttaaccacaccgttacgagaaatcggacagaaggcgtacgagtttctgtcaacgtcttgaataagcagaagggtgctcctctcctgttcgtggtacgccagaaagaagctgtcgtctccttccaggtccccctcatactgaggggtatgttccagaggaagtacctctaccagaaggttgagcgaacactttgtcaacccccaacaaaaaacgaatccgaaattcagttcttctatgtcgatgtgtcaacgctgtcccctgtcaacacaacatatcagctgcgagtgtctcgaatggatgactttgtacttagaactggcgaacaattttcattcaacacaacggctgcgcaaccacagtactttaaatatgagtttcctgaaggtgtggactcagtgatagtgaaggtgacaagtaacaaagctttcccttgttccgtcatttccattcaggatgtgctgtgtccagtttatgatctcgataacaacgtggccttcatcggtatgtaccaaacaatgaccaaaaaggccgcaatcacagtgcaacgtaaggattttccctccaactcattctatgtcgtcgtcgtcgtgaagaccgaagatcaggcttgcggaggctccctccctttctacccattcgcagaggatgagcctgttgatcaagggcacaggcagaaaacgctatccgtattagtaagccaggcggtcaccagtgaggcatacgtgagcggaatgcttttttgcttagggatatttctgagcttttaccttcttaccgtcctactggcttgttgggaaaattggcgacagaaaaagaagacactgctcgtggccattgatagagcctgcccggaaagtgggcatcccagagtcctcgccgacagtttccccggaagtagcccatacgagggctataactatggctctttcgagaatgtcagcggcagtactgatggacttgtcgattccgctgggaccggcgaccttagctacgggtatcagggacgaagtttcgaaccagttgggacacgtccaagagtggacagtatgtcttctgtcgaagaagacgactatgatactctaaccgatattgacagtgacaagaacgtgatccgtacgaaacaatatttgtacgtcgcggacctggctcgcaaggataaacgcgtgcttcggaaaaagtatcagatatatttctggaacattgcaactattgctgttttctatgcgttacctgtagtgcagctggttatcacctaccagacagttgtcaatgtgaccgggaatcaggatatctgttactataactttctctgcgcccatccacttggaaacctgtccgcattcaataacatacttagcaacctgggctatatcctcctcggcctcttgttccttctcattattttacagagggaaatcaatcataaccgagccctgctgaggaacgatctgtgcgctctcgagtgtggcatccccaaacactttggtctcttctacgccatggggacagcgttaatgatggaggggctgctgtccgcttgttaccatgtatgtccaaactacactaattttcagttcgacacaagctttatgtacatgattgcaggactgtgtatgctgaagctgtatcaaaagcggcatcccgatattaatgcctctgcttattctgcatacgcatgtctggccatcgtgatcttcttcagcgtactcggggtagtgttcggtaaaggcaatactgctttttggattgtcttcagtataattcacataattgcaacattgctcttgagtactcaactctactacatgggtcgttggaaactggatagcggaatattcaggcggatccttcacgtgctgtacaccgactgtattcgccagtgctctgggcctctttatgtggaccgcatggtgttattggtgatgggcaatgtcatcaactggtccctggcagcttacgggctgattatgagacctaacgacttcgcctcctacctgctggctataggcatctgcaacttgctcctttattttgctttttacataataatgaaactgcgaagtggtgagcggatcaagcttatccctcttctgtgcattgtctgcactagtgtcgtctggggttttgcactgttcttcttcttccaagggctatctacatggcagaagacccccgctgaatcaagggaacacaatcgcgattgtattctgttggatttctttgacgatcacgatatctggcacttcctgtccagcattgcgatgtttggctctttcttggtactgctgacacttgacgacgatctggacacggtgcagagggacaagatctacgtcttctag

SEQ ID NO: 53977 - DNA, 561 bp, Artificial Sequence
  Description of Artificial Sequence: Synthetic coding sequence
atgttcgccttaggtctgccctttctcgttctcctggtcgccagcgtagagtcccatctgggagtcttgggacccaagaatgtttcgcagaaagatgccgagtttgaacggacctatgtagataggatggtgctactggtcatggggaatgtgatcaattggagtctagcagcatatggactcatcatgcgcccaaacgattttgccagctatttgttagccatcgggatatgcaaccttttgttgtattttgcattttacattataatgaaactgcggtcaggggagagaattaagctgatacctctgctgtgcatcgtgtgcacgagtgtcgtctgggggttcgcacttttttttttcttccaggggctgagcacatggcagaagacacccgctgagtcccgggaacacaaccgcgactgcattcttctcgattttttcgatgatcatgatatctggcacttcctgtcatcaatcgccatgtttggcagttttctggtgttgctgacactggatgatgatcttgacactgtccaacgcgacaagatttatgtgttctag

SEQ ID NO: 53978 - DNA, 2490 bp, Artificial Sequence
  Description of Artificial Sequence: Synthetic coding sequence
atgttcgccctcggtctacccttcttggtccttctcgtcgcttctgtggagtcacacttgggggtgttaggccctaagaacgtgagtcaaaaagacgccgagtttgaacgtacatatgtggatgaggtgaattcggagctggttaatatttacacttttaatcacacagtcacccggaatagaaccgagggtgtccgagtgtccgtaaacgtgctcaacaagcaaaagggggctccgctgctgttcgtagtgagacagaaggaggcagttgtctccttccaggttcccctcatactgcgtggcatgttccagaggaagtatctgtatcagaaggttgaacggaccctctgccaaccccctactaaaaacgagtcagagatacaatttttttatgtcgatgtttcaacactctccccagtgaatacaacctaccaattgagggtcagtcggatggacgattttgtgctgaggaccggcgaacagttttccttcaataccacagcggctcagcctcagtactttaagtatgagttccctgaaggggtcgacagcgtcatcgttaaggtgacctcaaacaaagcgtttccatgctccgtcattagcattcaagatgtattgtgtccggtgtacgatcttgataacaacgtggcgttcattgggatgtaccagacaatgaccaaaaaggcggcaattaccgtccaacgcaaagacttccctagcaattcattttacgtagtcgttgttgtgaagaccgaagatcaagcttgcggcggttcactaccgttttacccattcgcagaagacgaaccagtggaccagggccacagacagaagactctgtctgtactcgtgtctcaggctgtcactagcgaagcctacgtgagcggtatgctattctgtctagggattttcctgtcgttttatctgctaaccgtgctcctcgcctgttgggagaattggcggcagaaaaaaaagacactgttagtggccatagatcgggcttgccccgaatccgcctcactattgggacacccacgagtgctggctgactccttcccaggcagctccccctatgaggggtataactatggcagtttcgagaatgtctcaggttccacggatgggctcgtcgattccgccggaacaggtgacctgtcctacgggtaccagggcacccggccacgagtagactctatgagttctgtggaggaagatgactatgatactctcactgatatagactcggataaaaacgtgatacggactaagcagtatctgtacgttgccgacttggcgaggaaggacaagcgggtcctgcgcaagaaataccagatctatttctggaacatagcaactatcgcagtgttctatgctcttccagtggtgcaactggtgatcacctaccagaccgttgtaaacgttaccggaaaccaggatatttgctactacaatttcctgtgcgcgcacccattgggcaatttgtcagctttcaataacattctgtcaaacctgggctacattttgctggggctgctgtttttactgattattctgcagcgggagatcaatcacaatagagccctgctgaggaacgacctgtgcgctttggaatgtgggattccgaagcattttggcctattttacgccatgggaaccgcgctgatgatggaaggcctgctctccgcctgctaccatgtgtgtccaaattacacaaactttcagttcgatacctctttcatgtatatgattgccggtctgtgtatgttaaaactctaccagaaacggcacccagacatcaacgcttccgcctactcagcttacgcatgtttggcaatcgtgatattcttctcagttctcggagttgtatttggaaaggggaacacagccttttggattgtctttagcattattcacatcatcgctacccttttgttatccactcagctttattacatgggaagatggaaactggactctgggatctttcgacggattcttcacgtcttatacacagactgtatcagacagtgcagcggccctctgtatgtcgataggatggtgctcttagtgatggggaacgtgataaactggtccctggccgcttatggtctgataatgcgccctaatgacttcgcaagttatttacttgccatcgggatttgtaatctccttttatactttgccttctacatcattatgaagctccgaagcggagagagaataaaactcatcccactgctgtgtatcgtgtgtaccagcgtggtgtgggggttcgctctcttcttcttttttcaggggctgagtacctggcagaaaactcctgctgaatcaagagagcacaatagggattgtattctgctggactttttcgatgaccatgatatatggcattttctaagttccatcgcgatgttcggtagtttcctcgttttactgaccctggacgatgatcttgatacagtccagagggacaaaatatatgtgttttag

SEQ ID NO: 53979 - DNA, 330 bp, Artificial Sequence
  Description of Artificial Sequence: Synthetic coding sequence
atgttcgcgctagggcttccattcctggtattgttggttgcatctgtcgaatcccatctaggcgtcttgggcccaaagaatgtgagtcagaaggacgccgaatttgaacggacctatgtcgacgaagtcaacagcgagctggttaacatctacaccttcaaccataccgttactagaaaccgaaccgagggggtgcgcgtaagcgtgaatgtcctgaacaagcagaagggagccccactgctcttcgttgtgcggcagaaagaggctgtcgtctcattccaggtccctctcattctcaggggcatgtttcagagaaagtacctctactag

SEQ ID NO: 53980 - DNA, 333 bp, Artificial Sequence
  Description of Artificial Sequence: Synthetic coding sequence
atgttcgccttaggccttccattcttagttctcttagtggctagcgtggaatcccatcttggcgtgctggggccaaagaatgtaagccagaaagacgccgagttcgagagaacttatgtcgatgaagttaattctgagctagtcaacatatatactttcaatcacacagtaacccgaaataggaccgagggtgttcgcgtgtctgtgaacgtgttgaataagcagaaaggagcgcctctgctgtttgtggtccggcaaaaagaggctgtcgtttcctttcaagtgccactaatattgcgcggaatgtttcagcggaaatacctgtatcaatag

SEQ ID NO: 53981 - DNA, 6641 bp, Artificial Sequence
  Description of Artificial Sequence: Synthetic coding sequence
atggccaggggcgcaaggcctagcgcagcagggggaggcggaggtggtgccgaaccgcctgagagggcgggtcctggtcgcccacggggatctccccctgggagagccagaccatctcttgcaccacggccaggacccgaaccctctcggcctcgcgctgcaccagaaacatcgggcggagatacagcgggtgctggcagatgtggagggaggagagctgccaaactgggaccgggacggagaggatggtgggctcttttggctctgcaactgcacttactcagagccctcgcacaggatgacgtggctccctactttaaaaccgagcccggtctcccgcagattcatctggagggcaatcggctcgtgctgacttgcctggcggaaggcagctggccgctggagtttaagtggatgcgcgacgatagcgaactcaccacctactcctctgagtacaagtacatcattccatctctgcagaaattagacgccggattttacagatgtgtcgtgagaaacagaatgggcgctcttctgcagagaaagtccgaggttcaggtggcctacatgggttcttttatggatactgaccagcgaaagacagtgtcacaggggagggctgctattctaaatctactccctattacctcttacccacgcccacaggtaacgtggttcagggagggccacaaaattattccaagtaacagaatcgccattactttggaaaaccaactggtcatcctggctaccacaacctctgatgccggagcatattatgttcaggctgtaaatgaaaagaacggcgagaacaaaacctctcccttcattcatctgagcatagctcgtgacgttggtacaccagagaccatggcgcctaccatagtagtgccacctggcaacaggtctgtggtcgctggatcaagtgaaacgaccctggaatgtatcgctagcgcaagacctgtggaagatttaagcgtgacctggaaacgaaatggagtgaggatcacttcagggctgcatagcttcggcaggcgccttacgatcagcaaccctacatctgcagataccggaccatacgtttgcgaagccgcactacctgggtcagccttcgagcccgcaagggccaccgcatttctgtttataattgaacctccgtacttcacggccgagccagaatcccgaatctcggccgaggtcgaagagacagtcgatatcggatgtcaagcgatgggcgtgccactccctaccctgcaatggtataaggacgctatctcgatatccaggctgcagaatccccgatacaaagtgttggcctccggaggccttcggattcagaaacttagacccgaggattcgggcatattccaatgttttgcttctaacgagggcggtgaaatccaaactcatacttacctggatgtcactaatatcgcacccgtctttactcagcggccagttgacacaacggtcaccgacggtatgacagccattctccggtgcgaagtttccggtgctcccaagcctgccatcacctggaaaagagaaaaccacatcttggcttcagggtccgtgcgaattcctcggtttatgttgcttgagagcggaggcctgcagatcgcaccagtgtttattcaggacgccggaaattatacttgctacgcagctaatacggaagggagtctgaacgctagtgccacactgaccgtgtggaatcggaccagcattgttcatccccctgaggaccatgtggttattaaggggacaaccgcaacactccactgcggggcaacccacgatccacgggtgagcctacgctacgtctggaaaaaggataacgtagccctaaccccctccagcacaagcagaattgttgtggaaaaggatggttctttgcttataagccagacatggagtggagacattggagattattcatgcgaaatcgtgagcgaaggcggaaatgactctcggatggcccgtctggaagtcatagagctcccccacagcccccagaatctgctggtgtctcctaatagctcccattcccacgctgttgtcctgtcgtgggtacggccttttgatgggaattctccaatcctgtactacatcgttgaactgtctgaaaacaattcaccatggaaggtacacctgagtaatgtgggccctgaaatgaccggggtgactgtgtcaggccttactcccgctcgcacatatcagttccgcgtgtgcgctgtgaacgaagttggaaggggccagtacagcgccgagacttcccgccttatgttacctgaagagcctcctagcgcaccaccaaaaaatatcgtggcttcaggtcgcactaatcagagtattatggtccaatggcagccaccgcctgaaaccgagcacaatggagttctgcggggatacatcctgagatataggctggcgggtcttcctggcgaatatcagcagagaaacattaccagccctgaggtgaactattgcctagttactgatctgattatttggacccaatacgaaattcaggtggcagcttacaatggggctggtctgggggtgttcagtcgcgctgtcacagaatatacactgcagggggtgcctactgcccctccccagaacgtgcagacagaggctgtgaatagcacaacaattcaattcctgtggaatccacctccccagcagttcatcaatggaataaatcagggctacaagttgcttgcctggccagccgatgcacctgaggcggtgaccgttgtcacaatcgccccagactttcatggcgtgcaccatggccacatcacgaacttaaagaagtttacggcatactttacatcagtgctctgttttaccacccctggcgatggccctccttcaactccacagctcgtctggacgcaggaggataagcccggagccgttggtcatctctcctttacagaaatcctggatacaagtctgaaagtgtcttggcaggaacccctggagaagaacgggattattactggctatcagatctcctgggaagtctacggcagaaacgattccaggctaacccataccttgaactctaccacccacgagtacaaaattcagggcctgtccagcctgactacctatacaatcgatgtcgcagccgtcactgcagtaggaacgggcttagtgaccagctccaccatctcttccggcgtccccccagacttgcccggagctccatcaaacttggtcatctctaatatttccccaaggagcgcgaccctgcagttccgtccgggttacgacggcaaaacatctatttccaggtggattgtcgagggccaagttggggcaattggcgatgaagaagagtgggtgactctctatgaggaggagaatgaaccggatgcccagatgctggagatcccaaacctgaccccgtacacccattatcgatttcgtatgaaacaagtcaatatcgtgggcccaagcccttattcgcctagttcaagggtgatccagaccctgcaggcaccacccgacgtggcccctacgtcggtgacagtccgaactgcaagtgagacatcactgaggctccgctgggtgccactccccgatagtcagtacaacggcaacccggaatcggtaggctaccggattaagtactggcgctccgatctgcagagttccgctgttgcgcaggttgttagcgatcggttggagagggagtttaccattgaggagctagaggagtggatggagtatgagctgcagatgcaggcctttaatgccgttggcgcaggtccgtggagtgaggtcgtcagagggcgaacgcgcgagtccgtgcccagcgccgctcccgagaacgtctcagccgaggcagtgagctctacgcagatcctgctcacttggacaagcgtcccagagcaggaccaaaacgggctcatcttgggttataaaattttgtttcgggctaaggacttggaccccgagcccagatctcatattgttcgaggaaaccacactcagtccgctttactggccggtctcaggaagttcgtgctgtatgagctccaggtgctggcctttactcgtatcggcaatggggttcctagcacccccctgattttagaacgcacaaaagacgatgcgcctggccctccagtgcgtttggtgttccctgaggttcgcttaacctccgttaggatagtatggcagccacccgaagaaccgaacgggatcatcctaggatatcagatagcctacagactagcatcttccagcccacataccttcaccacagtggaagtgggcgctacagtgagacaattcactgcaacagacctagcgccagaatccgcatacatattcagactgtctgcaaagacgaggcagggctggggcgagcctcttgaggccactgtcataacaaccgaaaaaagagaaagacctgccccaccacgtgagttgctggtcccccaagcagaggtaaccgcccgttcattgcggctacagtgggtgccaggaagtgacggggcaagcccgattaggtatttcacaatgcaggtgcgggagctgcctcgtggagaatggcagacttacagcagtagcatatcacatgaagccaccgcttgcgtggtggatagattgcggccttttacaagttataagctgagactaaaggccacgaacgacattggggactccgactttagctctgagacggaagccgtgacaacactgcaggatgtccccggagagcccccaggctccgtttcagccacaccacatacaactagctctgtgttgattcagtggcagccaccgcgagacgagagtttaaacggtctcctccagggctataggatatattaccgggagctcgaatatgaggccggatccggcaccgaggccaaaacattaaaaaatcccatcgctctgcatgccgaacttacggctcagagctctttcaaaacagtgaattcttcaagcactagtacgatgtgcgagctgacacatctcaaaaagtacaggagatatgaagtaatcatgaccgcttataatattattggagagtctcccgcatctgcgcctgtagaagttttcgtaggcgaggccgctcccgctatggcaccgcagaatgtgcaggtgacaccccttaccgcctctcagctggaagtcacttgggaccccccaccaccggagtcacagaatggcaatatccaagggtacaaaatttactactgggaggcggactcacagaatgaaaccgagaaaatgaaggtgctgtttctgcccgagccggtggtgcgtctgaagaacctgaccagccatacaaaatatctcgtctcgatttccgcattcaatgcggcaggcgatggcccaaagagcgatccacaacagggcagaacacaccaagccgcacctggtgcaccatcgtttttggcatttagtgaaatcacatcaacgaccctgaacgtgtcctggggtgagcccgctgctgctaacggtattctgcaggggtaccgtgtggtgtacgaaccactcgcgcctgtgcagggggtgtctaaggtcgtgacagtggaggtcaggggaaactggcagagatggctcaaagttagggatctcaccaaaggcgtgacctatttcttcagagtgcaggctagaactatcacctatgggcctgagctccaagccaacattaccgcaggccctgccgagggatccccaggtagcccaagggatgtgctcgtcaccaagagtgcctccgaactcaccctgcagtggaccgaaggacacagtggagacactccgactaccggttacgtcatcgaggccaggccctcagacgaagggctatgggatatgttcgttaaagatatccctcggagcgcaacatcatatactttgtcattggataaactgcgccagggagtgacctacgagttccgtgttgtggccgtgaacgaagctggctatggcgagccatccaatccatcaactgccgttagcgcccaagtcgaggcccctttctatgaggagtggtggttcctgctcgtcatggccctgtctagtctgattgtgatactgcttgtggtattcgccctcgtgctccacgggcagaataagaagtacaagaactgtagcactggcaaaggtatatccaccatggaagaatctgtgacacttgacaacggaggcttcgctgccctggaactctctagccggcaccttaatgtgaagagtacattctcaaaaaaaaatggaacaagaagccccccaaggccttctcctggcggactgcattactcggacgaagatatctgtaataaatacaacggcgcagtcttgactgagagcgtgagcctaaaagagaagagtgccgatgcatctgagagcgaagctaccgactcagattacgaggacgcgctgcctaagcatagttttgtcaaccactatatgtccgaccctacctattacaactcatggaagagacgggctcaggggcgagcacctgcccctcatcgctatgaggctgtggccggttcggaggctggcgctcagttgcatccagtcatcacgactcaatccgcgggaggggtgtacactccagccggacccggagccaggacacccctaactgggttctcgtctttcgtgta

SEQ ID NO: 53982 - DNA, 1386 bp, Artificial Sequence
  Description of Artificial Sequence: Synthetic coding sequence
atgaaggttctgtttctgcccgaacccgtagttaggcttaagaacttaactagccacacaaagtatcttgtgtccatctctgcttttaatgctgctggagacggtccaaagagcgatccacagcaggggaggacacaccaggccgcaccaggcgctccttctttccttgccttctctgagattaccagcacaactcttaatgtaagctggggcgagcctgccgcagctaacggtattctgcagggttatagggttgtttacgagccactcgcccctgtccaaggggtaagcaaggtcgtgaccgtggaggttagggggaattggcagcgatggttaaaggtccgtgacctgactaagggtgtgacttacttctttcgagtgcaggctcgaacgattacctacggacccgagctacaagctaacattactgctggccctgccgagggctcccccggttcacccagggacgtactggtgacaaagagtgcgagtgaacttaccttgcaatggacggaaggtcacagcggggacacaccaaccacagggtacgtgatcgaggccagaccatctgatgagggactgtgggatatgttcgtgaaggatattcccaggtcagctacctcctacactttatcccttgataagctgagacaaggggtgacgtatgaatttagagttgtggctgtcaacgaagcaggatatggcgagccctccaatccttcaactgctgtatcagctcaggttgaagcgcctttctatgaagagtggtggttcctgctcgtcatggcattatccagcttaattgtaatcctgctcgttgttttcgcgttggtgctacacggacaaaataagaaatacaaaaactgcagcactgggaagggaatctctaccatggaggagtctgtgacattggataacggtggattcgctgctctagagctgtctagcagacacctaaacgtcaagtctacattttcaaaaaagaatggaaccagatccccccctaggccatcacctggtgggctgcactactctgacgaggacatctgcaacaagtacaacggcgcagtcttgaccgagtctgtgtctctgaaagagaagtccgctgacgctagcgaatcagaggccactgactctgactacgaagatgcgcttcccaagcactcctttgtcaaccactacatgtctgatcccacttattataacagctggaaaaggagagcccagggcagagcaccggctcctcatagatacgaagcggtggcgggttcagaggccggtgcgcagctccacccagtaatcactacgcaaagcgctggtggagtatataccccagccggaccaggagcacgcacaccccttacagggttttcatcattcgtgtag

SEQ ID NO: 53983 - DNA, 6650 bp, Artificial Sequence
  Description of Artificial Sequence: Synthetic coding sequence
atgtgggggctgctgatttggacactcctggcactgcaccagatcagggccgctagggcccaggacgacgtgagcccctatttcaagaccgagccagtccgaacacaagtgcacctggagggaaatagactggtgctgacctgtatggccgaagggagctggcctcttgaatttaaatggctccataataaccgcgaactaactaagtttagtctggaataccgatacatgatcacttcactcgacagaacccatgccggattctataggtgtatcgtcaggaatagaatgggggctttgctgcagagacagactgaggttcaagtggcctacatgggctcatttgaggagggtgagaaacaccagagtgtgagtcacggggaggctgctgtgatcagggccccacgaatagcctccttcccgcaacctcaggtgacttggttccgggacggcaggaaaatccccccaagctcccgaatcgcaataaccctggaaaacaccctcgtcatcttatcaacggttgcacccgacgcgggtcggtattacgtgcaggccgtgaatgacaagaatggggacaacaaaacttcccagccaattactctcacggtcgaaaatgtgggcggtccagcggaccccatagccccaacaatcatcatcccaccaaagaacacatctgttgtggccggaaccagcgaggtcactcttgagtgcgtggccaacgcacggcctttaatcaaactgcatattatctggaagaaggacggggtcctgctcagcggtggcatcagcgaccataaccgccgtcttacgattcctaatcctactggttctgacgccggatattacgaatgtgaggccgtgcttagatcgagcagcgtcccctctgttgtcagaggcgcttacctgagcgtcctggagcctcctcagttcgttaaggaacctgaacggcacattactgcagaaatggagaaggtggtggatatcccgtgccaagctaaaggtgtgccaccaccttccattacctggtacaaggatgcagccgtggtggaggtagagaaacttaccaggttccgacagagaaatgatgggggactgcagattagcggactcgtacctgacgataccggcatgtttcagtgcttcgcgagaaatgcggcaggagaggtgcagaccagtacctatttggccgtcacgagtatcgccccaaacattacccggggacctcttgactccactgtcatagacggcatgtcagtggttcttgcgtgtgagacaagcggagccccaagacccgctattacatggcagaagggcgaacgtattttagcttccggcagtgtgcaactgccgaggttcactcctctcgagagcgggtcgctgttgatttctccaacccacatctctgatgcagggacctacacttgtctagcaaccaactccagaggcgttgacgaagccagtgccgacctggtagtgtgggctcggaccaggatcaccaagcccccacaggaccagagcgtgataaagggaacacaggcctcaatggtgtgcggagtcacacatgatccacgtgtgactatccgatacatctgggagaaggatggggcaacgctgggcacagagagccatccccgtatacgcttggacagaaacggatcgctgcatattagtcagacctggagtggagatattggtacttacacatgcagggtcatcagcgcaggtgggaacgactctcggtcggcacatctgagggtccgacagcttcctcacgccccagagcatccagtggcaacattaagtacggttgaacgccgtgctataaaccttacctggacaaaaccctttgacggcaatagtcccttgattcgttacatactggagatgagcgagaacaatgcgccttggactgtgctgctcgcttccgtagacccaaaggccacatccgtgaccgtgaagggactggtgcctgcaagaagttaccagttccgattgtgcgccgtgaacgacgtcgggaaagggcaatttagtaaggacaccgagagagtttcactgccggaggaaccccctacagcaccaccacagaacgttattgccagtgggcgaaccaatcagtcaataatgatacagtggcagcctcctccggagagtcaccaaaacgggatacttaagggatatatcatacgatattgtctcgccggactgcctgtggggtaccaatttaagaacatcaccgacgctgacgtgaacaatcttctcctcgaagatttgattatctggaccaattacgagatcgaggtggccgcttataattctgctgggctgggcgtctacagcagcaaagttactgagtggaccttgcagggagtgccgactgtaccccctggcaacgtccacgcagaagccaccaattccaccaccatacggttcacctggaacgccccatctcctcaatttatcaacggaattaaccagggctataagttaatcgcatgggaacccgagcaggaggaggaggtgactatggtaaccgcaaggcctaattttcaagatagcatccacgtcggcttcgtttccggccttaaaaaattcacagagtacttcaccagtgttctgtgcttcacaacaccaggagacggaccgcgtagcactccgcagctggttcgcacacacgaggacgttcctggcccagtcggccacttgagtttctcggagatactggacacatccctcaaggtatcttggcaggagcccggagaaaaaaacggcatactgacaggatatcggatctcttgggaggagtataaccggactaacaccagggtaactcactatcttccaaacgtgacactcgagtaccgtgtgaccggtctcacagcattgacaacttacactatagaggttgcagctatgaccagcaagggccagggccaagtcagcgcaagcaccatctccagcggagtcccgcctgaactacccggtcctcctacaaacctgggaatttctaacatcgggcctagaagtgttaccctacagtttagaccgggatacgatggtaaaacatctatcagtagatggctggtggaggcccaggttggggtggtgggagaaggagaggagtggctgctcattcaccagctgagtaatgagccggacgccaggagcatggaagttcccgacctgaatcccttcacatgctacagctttcggatgaggcaggtcaacatcgtggggacttcgccgcctagtcagcctagtcgaaaaattcagaccctccaggcaccacccgatatggcccctgccaacgtgtccctgagaactgccagcgaaacgagtctgtggttgaggtggatgcctctccctgagatggaatacaacggaaacccagaatcagtgggttacaaaattaagtattcgcgcagcgatggacatggaaagactctgtcacatgtggtccaggatcgcgtcgagcgagattacaccatcgaggaccttgaagagtggactgagtacagagtccaagtgcaggcttttaatgccatcgggagtggcccatggtcgcagactgtagtaggtcgtacaagggagtctgttccgtcctcagggccaacgaatgtcagcgctctcgctactacatccagtagcatgctggtgaggtggtccgaggtcccagaggctgaccgcaacggtctggttctgggctacaaagtgatgtataaggagaaggactctgacacacaaccccgattttggctggtggaaggcaattcatctcggtccgcacagctgacaggcttgggcaagtatgttctctatgaagtgcaggtcttagccttcacacgaattggggacggtagcccatcgcatccccctatccttgaacgaactctggatgatgttcccggtcctcccatggggattctgtttccagaagtccgaaccacctccgttcgactcatctggcaaccgccagccgcacccaatggcatcatactggcctaccagatcacacataggctgaacacaacgacagccaacaccgcaacggtggaggttctggcaccttctgctagacaatataccgcgaccggcctcaagccagagtccgtatacctgttccgcatcaccgcgcagaccaggaaaggttggggagaggccgcagaagccctcgtggtaactacagagaagcgggaccgcccacagcccccttcccgcccaatggttcagcaggaggacgttagggccaggagcgtcctactgtcatgggagccaggatccgacggcctgtctcccgtacgttactataccatccagacccgcgagctcccctccggcagatgggcattacactctgccagtgtgtcacacaatgcttcttccttcatcgtggatagattgaaaccattcacctcctacaaattccgggttaaagccaccaatgacataggagatagcgaattcagtgaagagtctgagtccctgacaactctccaggccgctccagatgaagcaccaactatcctgtcagttacaccccataccactacatctgtgctaatcaggtggcaacctccagctgaggacaagataaacggaatactgctcggatttaggattcgctatcgggagctgctgtatgaagggcttcggggatttacacttcggggaatcaataatcccggtgccacttgggctgaacttacctcaatgtactctatgcgcaatctgtctcgtccttccctgacacagtatgaacttgataatctcaataagcataggaggtacgaaatccggatgtcagtctacaacgccgttggcgaagggccaagcagtccccctcaggaggtcttcgtcggcgaggcagtgcccacggcagcccctcgcaatgtcgtcgtgcatggggcaaccgccacccagctcgatgtcacctgggagccccctcctcttgattctcagaacggagatatccagggatataagatctatttctgggaagcacagcgcggaaacttaactgagcgggttaagaccttgttcctggccgaaaattcagtgaaattgaaaaacttgacgggctatacggcatatatggtcagcgtggccgcttttaacgccgcaggagatggccctcgatcgacccctacacagggccagacacagcaagccgctccctccgcacctagttcagttaagttttcagagctgaccaccacgagcgtgaatgtatcctgggaggccccacaatttccaaatggtatcttggaggggtatcgcctcgtatacgagccctgcagccctgttgacggcgtttcaaaaatcgttacagtggatgttaagggaaactctcccctctggctgaaagtaaaggaccttgctgaaggagtgacttacagatttcgtatccgtgcaaaaacatttacttatgggcctgagatagaggctaatgtcacaacaggacctggagaaggagcccctgggcctcccggagtgccaataatcgtaaggtactccagtgctatcgccattcattggtccagtggagacccagggaaaggacccatcacaagatacgtcattgaggccaggcctagtgacgagggtctgtgggacatcttaattaaagacatcccaaaggaggtcagctcctacactttctctatggacatcctgaagccaggagttagttacgattttagggtgatcgccgtgaatgattacggattcggtacaccctcctcaccaagccagtccgtgcctgcccaaaaagcaaacccattctacgaggaatggtggttccttgtggtaattgctctcgtcggcctgattttcatcctcttgctcgtgttcgtgctcataattaggggccagtcgaagaaatatgccaaaaagaccgattccggaaactctgccaaatctggtgccctaggacactctgaaatgatgtccctagatgagagcagttttccagcactggaacttaataatcgcagactctctgtgaaaaattctttctgtcggaaaaatggattatatacaagatcacccccaagaccatcaccagggagcttacactactccgacgaggatgtaacaaagtacaacgacctaattcccgctgaatcatcttctttgactgagaaaccttcagagatctccgatagtcaggggagtgattccgagtatgaagtggacagtaatcatcaaaaggctcacagttttgtcaatcattacatttccgatccgacatattataacagctggcgccgtcaacagaagggaattagccgagcccaggcgtactcttacactgagagcgattccggagagcctgatcatactaccgttactaatagcacctcaacacagcagggttccctgttccgtcccaaggcgtcacgtacacctacaccacaaaacccccctaacccccctagccaacaatccactctgtacagacctcccagcaaagctggcgtgcagaaagagggggaaaatagagaacggatgtgcgttgctagctcatccagcgcgctgcgatggtggggttcacttttaccttgggaattacacggcgctggcgaggttgccgtttcattgttgtggacgaggagtggtgcaggtatatggcgggaaaggggctccggaggtta

SEQ ID NO: 53984 - DNA, 6461 bp, Artificial Sequence
  Description of Artificial Sequence: Synthetic coding sequence
atgtggggtctgctgatatggacgctgctggctttgcaccagattcgagcagcacgcgcacaggacgacgtgtcgccgtactttaagactgaaccagtgcgaacacaggtgcacctcgagggaaatcggctcgtgcttacctgtatggcggaaggtagttggccactagaattcaaatggctgcataataatagagaattaactaagttttctctagaatacagatacatgatcacctcccttgaccggacacatgcaggcttttatcgttgtattgtgaggaaccgtatgggagctttgctgcagcgccagactgaggtccaagtcgcttatatggggagtttcgaggaaggagagaagcatcaatctgtgtcccacggagaagctgccgtgataagagctcctcgcatagcctcatttcctcagccccaggtgacttggtttagggatgggaggaagatccccccatccagccggattgcaatcaccctcgaaaatactctggtgattcttagcacagtggcgcctgacgcaggccgttactatgtacaagctgttaacgataagaacggggataacaaaacctctcagccaatcacactcaccgtggagaacgtgggtggccctgccgatcccatagcccctactatcatcatacctcccaagaatacctctgttgttgcaggaacctcagaggtgaccctggaatgcgtcgccaatgcgcgtcctctcatcaagcttcacattatctggaagaaggacggcgtgcttttgtcaggcggtattagtgatcataatcgaaggctgactatcccaaaccctacagggagcgatgctggctactacgagtgcgaggctgtcctgcgctcctcctcagttccatcagtcgtcaggggcgcttacctctccgttctcgaacccccacagtttgttaaagaacccgaaaggcacatcaccgcggaaatggaaaaagtggtcgacatcccttgtcaggctaagggggtcccacccccttccatcacatggtacaaggatgcggcagtggtggaagtggaaaaactgacccgcttccgacagcgcaatgacggcggtttgcagatttccgggcttgtacctgacgacacaggtatgttccagtgttttgcacggaatgcggctggcgaagtccagacctccacatacctggctgtgacaagcatcgctcccaacattaccaggggccctctggacagtacagttatcgacggcatgagtgtggtgctcgcctgtgagacatctggggcaccgaggcccgcaatcacctggcagaagggggaaaggatcctggcatcaggctctgtgcagctgcctcggttcacccccctcgaatccggctctctccttatctcccctactcatatctccgatgctggcacctacacctgtttggccacgaactcacgcggagttgacgaagctagtgccgaccttgtcgtgtgggcaagaactcgtattactaagccccctcaggatcagagcgtgatcaaaggaacccaggcgtctatggtatgcggtgtcactcacgaccctagggtgaccatacggtacatctgggagaaagatggggctaccctggggaccgaaagtcacccacgcattcgcctggacagaaacgggagcctgcatatttcccagacctggagcggagatataggcacatatacatgtcgcgttatctccgccggaggcaacgacagccggtccgctcacctcagggtgcgacagttacctcatgccccagaacacccagttgcaaccctgtctaccgtggaaagacgcgctatcaaccttacatggacaaaaccctttgatggcaactcgcccttaatccgctacatattggaaatgtctgagaacaacgcgccatggacagtccttttagctagcgtggacccaaaggccacctcagtcactgtgaagggcctggtccccgcacgctcataccaattcaggttgtgcgccgttaatgacgtgggcaagggccagtttagcaaagacacggagagggtctcattacccgaagagccccctaccgcgccacctcagaatgtgatcgcgtctggaaggaccaaccagtcgatcatgattcagtggcagcctccccctgaatctcaccagaacggaatcctgaagggctacatcattcgttattgtctcgcaggtctgcctgtggggtaccagtttaagaatataacagatgccgacgtcaataatctgctcctggaggaccttattatctggacaaactacgagatcgaggtggccgcttataactcagccggtctgggggtctattcaagcaaggtaactgaatggacattacaaggcgtacctacggtacccccaggcaacgtccacgcagaagctaccaattccacaactattcgcttcacctggaacgccccaagcccgcagttcatcaacgggataaatcaaggctataagctgatagcctgggaacccgagcaagaggaagaggtaacaatggttacagccaggccaaactttcaggatagcattcacgtggggtttgtgtcagggctcaaaaaatttacggagtactttaccagcgtgctatgcttcaccacacctggagatggtcccaggagtactcctcagcttgtgcggacgcacgaggacgtgccagggcctgtaggccatcttagcttctcagaaattctggatacctccctgaaggtctcctggcaggagccaggagagaagaatgggatccttacaggctataggatcagttgggaagaatacaaccggaccaatacacgggtgacccattatctccctaatgtgacgttagaatacagggtaacggggctgacagctcttaccacctatacaatcgaggttgctgcaatgacgtcaaaaggtcaaggtcaggtatccgcttccaccatcagctctggcgttcctcccgaactccccggtccgccaacaaacctggggatcagcaacataggcccaaggagcgtgacactacagtttcgccctggatacgacgggaaaacctcaattagccgctggctggtggaagcccaagtgggagtcgtcggagagggggaagagtggctcctcattcatcaattgtctaacgaaccggacgccaggagcatggaggtgcctgacctgaatccttttacgtgttatagctttcggatgcgacaggtgaatatcgtggggacatctcctccgtctcagccttcccgtaaaatccagaccctccaggctccacccgatatggcccctgccaacgtgtctctcagaactgccagcgaaacatctttatggctccgctggatgcccttgccagagatggaatataatgggaatcccgaaagcgtgggatacaaaattaagtatagccgatccgatggtcacggcaagaccctgtctcatgtcgtccaggatagagttgagcgcgactacacaatcgaggacttagaagagtggacagaatacagggtccaagtccaggctttcaacgccattggctccggaccctggtcccagactgttgtggggcgaacacgtgaaagtgttccttcctccggccctactaacgtctcggccttggccacgacaagttcaagcatgttggttcggtggtcagaagtcccagaagcggatcgcaacggactggtgctgggttataaggttatgtataaagaaaaagatagcgatacccaacctagattttggctggttgagggcaactcatccagatccgcacaactcaccggcctcggcaaatatgtcctttatgaggtccaggtgctcgccttcacccggatcggagatgggagcccttcacatccgccaatactcgaacgcaccttagatgacgtgcctggacccccaatgggaattttgtttcccgaggtgcggaccacctctgtgagactgatctggcagcctccggcagctccaaacggaatcatactagcttaccagattactcatcgtttgaacaccactaccgctaacactgccaccgttgaagtactggcgccatcagctagacagtacacagccaccggactcaagcctgaatctgtctatctgtttcggataactgcccagactcgtaaggggtggggcgaggcggctgaagctctggtagtgactactgagaagcgcgatcgacctcagccaccctctcgaccaatggtgcagcaggaagacgtgcgagcccgatcagttctgttgtcatgggagccgggttctgatggactcagcccagtgcgctactacacaattcagacccgcgagctgccctcaggacgctgggctttgcattcagcgagcgtctctcataacgcctcctctttcattgtggaccggctgaaaccatttacgtcttataagtttcgggtgaaggcgaccaacgatatcggcgattccgagttctcggaggagtcagaaagtctgacgaccctccaggctgctcccgatgaagccccaaccatactctctgtaactcctcacacaacgaccagcgtcctgatccgttggcagccacctgcagaagataagattaacgggatcctactaggcttccggatacgctatagagaactgctgtatgagggcttacggggatttactctgcggggaattaataatcctggggctacttgggctgaattgacatatttaaataagcacaggcgttacgaaattagaatgagtgtgtacaacgcggttggggagggaccatcgtcccctccgcaagaggttttcgtgggggaggccgttccaacagccgctcctaggaatgtggtggttcacggggctaccgccacccagcttgatgtgacgtgggaacccccaccacttgattcccagaacggtgacatccagggatataaaatctacttctgggaggcccaaaggggcaatcttaccgaaagggtcaaaaccctcttcctggccgagaactccgtaaaactaaagaacctgaccggctataccgcctatatggtgtctgtagccgctttcaatgccgcaggcgacggaccccgttcaacgccaacacagggacagacacaacaagcagccccatctgctccaagttcggtgaaattcagtgaactgaccactacatccgtgaacgtgtcatgggaggctccgcagttccctaacggcattctggaagggtataggttggtgtacgagccttgctctcctgtcgacggcgtatcaaaaatcgttaccgtcgacgtgaaaggaaacagcccgctttggcttaaagtcaaagatcttgccgaaggcgtgacttatcgtttccggattagagctaaaactttcacatacgggcctgaaattgaggccaatgtaaccacaggtccaggcgagggggctcccggtcctcccggagtccccatcattgtgcgctattcatccgctatcgctatacattggagctccggagatcccggtaagggacctatcacccgatatgttattgaagctcggccaagtgacgagggcttgtgggacattctaatcaaggatatcccaaaagaggtcagctcctacaccttctcaatggatattttgaaacccggtgtaagctatgatttccgggtcatcgccgtcaacgattacggattcggcaccccttcctctccgtcccagagcgttcccgcacagaaagctaatccattttatgaggagtggtggtttctcgtggtgattgctctcgtgggccttatttttatcctgctactggtgttcgtcctgattatccggggacagtccaaaaagtatgctaaaaaaaccgatagcgggaattcagctaaaagcggagccttggggcactcagagatgatgtcccttgatgaaagctcattccctgccctggaactgaataaccggcgactgtctgtaaaaaactctttctgtcgtaagaatggcttgtacaccagaagccctccacggccatctccaggatctctgcactatagtgacgaggatgtgacaaaatacaacgacctcattccggctgaatccagttctctcacggaaaagcccagcgagataagcgacagccagggaagcgattccgagtacgaggtcgacagcaatcatcagaaggcccactccttcgtgaaccattatattagcgatcctacatactataactcatggcgtcgccagcagaagggaatcagccgggcacaggcctactcctacacagagagcgactccggagagcccgaccacacgacagtaacgaactccaccagcactcagcagggcagcctcttcaggccaaaagcctcacggactcccaccccacagaatccccctaatcctccaagtcagcagagtactctttatagacccccaagcagccttgcccctggcagtcgggcacccatagccggattttcctctttcgtata

SEQ ID NO: 53985 - DNA, 6518 bp, Artificial Sequence
  Description of Artificial Sequence: Synthetic coding sequence
atgtggggcctgctcatatggactctcctggcacttcatcagataagagctgctcgagcacaggatgatgtatcgccatatttcaagaccgagcccgtgcggacacaagtgcacctggaaggcaatcggctcgtgctgacctgcatggccgaaggaagttggccccttgagtttaagtggctacacaacaacagagaacttacaaagttctcactggaataccgctatatgattacgtctctggatcgcactcatgctgggttttataggtgtatcgtgagaaatcgaatgggcgctcttctgcagcggcagaccgaggtccaggtggcttacatggggtcatttgaagaaggagagaaacatcaatccgtctcacacggtgaggcagccgttatccgtgcaccccgaatagcttctttcccacagcctcaggtcacgtggtttcgggatggcagaaagatacctcctagctcgcgcattgccattactcttgagaatactctggtaattttgtccactgtcgcacccgatgccggacgatattatgtccaggcggtgaacgacaagaacggcgacaacaagacctcgcagccaataaccctgactgttgagaatgtgggcggtcccgcagacccaattgcacctaccatcattattcctccaaagaacaccagcgtggtggccggaacctctgaggtaactctggagtgcgtggccaacgctcggcctctgatcaagctgcatatcatctggaagaaggacggggtgctgctgtccgggggaatctcagaccacaaccggaggctgactatcccaaaccccacaggcagtgacgcaggatactacgagtgcgaggccgtgctgcgctcatctagtgtccctagcgttgtccgcggtgcctatctctctgtgctggaacctccccagttcgtcaaggagcccgagagacatataacagccgaaatggagaaggttgtggatatcccatgccaggcaaagggtgttccgccacccagtatcacatggtataaagatgccgctgtcgtggaggtggaaaaattgacacgcttccggcagcgcaacgatggcggtctgcagatatcagggttggtgcccgatgacactggcatgtttcagtgctttgcgagaaacgccgctggagaggtgcagacaagtacttatttggctgttacctcgatcgcaccgaacatcacaaggggccctctcgattccaccgtgatcgacggaatgagtgttgtgctggcatgtgaaacaagtggggctcctcggccagcgattacttggcagaagggggagagaatactcgcatccggctccgtccaacttcccaggtttactccccttgagtctggctcattgctgatctcgcccacacacatttctgacgcgggtacctatacctgtctcgccactaactcaaggggcgtagatgaggcatccgcagatctggtcgtctgggctcgtacaagaattacaaagccaccacaggaccagtccgtcataaagggcacccaggctagtatggtatgtggagtgacgcatgatcctcgggtaaccatccggtacatatgggaaaaggatggggcaactctgggcaccgagtcccacccaaggattagactggatagaaatgggagtcttcatatctcacaaacatggagcggtgatatcggcacctatacctgccgcgtgattagcgccggaggaaatgatagtcggagtgctcacttgcgggtaagacaactaccccatgcccctgagcatccagtggccacactttctacagtggagcgacgcgcaattaacttgacttggaccaaaccttttgatgggaatagtcccctcatcagatacatcctcgagatgagcgaaaataatgcgccatggaccgtgctactggcttccgttgatccaaaagctacctccgtcactgttaagggactcgtcccggcacggagttaccagttccggctgtgtgccgtcaacgatgtgggcaagggtcaattcagtaaagacacagaaagggtgtcactgcctgaagagcctcccacagcgccaccgcagaacgtcatcgcaagcggacggacaaaccagagtattatgatacagtggcagcctcctcccgagtctcatcagaatggcattcttaaagggtacattattcggtactgtctggccggactaccggtgggctaccagtttaagaatatcacggatgccgacgttaacaatctgctgctcgaagacctaatcatttggacaaactacgaaatagaggttgccgcttataattctgcgggtctgggtgtctacagctccaaggtcacagaatggacacttcaaggggtaccaacagtgcctcctgggaatgttcacgcggaagcaaccaactctacgaccatacgcttcacttggaatgcaccctctcctcagtttattaacgggatcaaccaaggctataagcttatcgcatgggaaccagagcaggaagaggaagtgaccatggtgacagcccgtccgaattttcaagacagcattcatgtgggattcgtgagcgggctgaaaaaattcaccgaatacttcacgtctgtgctgtgtttcaccactcctggcgatggtccacggagcacgcctcagctagtacgcacccatgaggatgttcccggacccgtgggtcatctatcattcagcgaaattctcgacaccagtttgaaggtgtcctggcaagagcccggagagaagaatggtatcctgaccggttaccgcatatcttgggaggagtacaatcgaaccaatacacgggtcacacattatctgccaaacgtgacactcgagtaccgtgtgacggggctgacagccctgactacttacacgattgaggtggctgcaatgacctccaaggggcagggccaagtgtccgcgagcacaatcagcagcggagtgcctccagagttgcccggaccccctacaaatctcggaatcagcaatatcggacctcgttccgtgacccttcaatttcgtcccggatacgacggaaaaacatccataagtaggtggctggtcgaggcgcaagtgggcgtggtgggcgagggcgaagagtggctcctgattcaccaacttagcaatgagcccgacgctcgatctatggaggtgccggatctcaaccccttcacctgttatagctttcggatgcggcaggtgaacatcgttggtactagtccaccctcccagccctctcgaaagattcagacactccaggctcccccagacatggcacccgctaacgtctcattgcgaactgcttcagagactagcttatggttgcgctggatgcctctgccagaaatggagtacaatggtaatcccgagtctgtcggctacaagatcaaatacagcaggagcgacgggcatggtaaaacgctcagccatgtagtccaggaccgggtcgagagggactatactatcgaagacttagaagagtggacagagtacagggtccaggtgcaggcattcaatgccataggttcaggaccctggtcccagaccgtagttggcaggaccagagagtctgtcccaagctccgggccaacaaatgtgagcgcccttgcgacgacctcttcgagtatgctggtccgctggtcagaggtccccgaagcagataggaacggccttgtactggggtacaaggttatgtacaaggagaaggattctgacacacaaccaaggttttggctggttgaaggcaattcttccaggtcggctcaattaactggcctggggaagtatgtgctttatgaagtgcaggtcctagcctttactcgtatcggggatggatctccaagccaccctcctattttggagcgtacactagacgacgtaccaggacctcccatgggaattcttttccccgaggttagaaccaccagcgtccgcctgatttggcagcctccagccgcaccgaatggcattatcctcgcttatcagataactcaccgacttaacacaacaactgctaacactgctacagtggaagtactggctcccagcgccaggcaatacactgctaccgggctcaaacccgaaagtgtgtacctgtttaggattacagcccagacaagaaaggggtggggggaggcggcagaggcactagtagtcactaccgagaagagggaccgccctcagccaccctcccgccctatggtccaacaagaagatgtgcgggcacgaagcgtcctactcagttgggagcctgggtccgacggtctttctcccgttcgctactacaccatacaaacgagggagctgccttctggtagatgggcgctccattctgcaagcgtgtctcataatgcctcctcattcatagttgatagattgaagcccttcaccagctataagttccgcgtcaaggccaccaacgacatcggagattccgagttttcggaagaaagcgaatctcttacaaccctgcaggctgctcccgatgaagctcctaccatcctgtctgtgacaccccacacaactacaagcgtattgattaggtggcaaccgccagcagaagataagataaatggaattctcctgggcttcagaattaggtacagggagctgctgtatgaagggcttagggggttcaccctacgcggtatcaataatcccggagccacatgggccgaactgacttcaatgtacagcatgcgcaacctgtcccggccttctttgacgcagtatgagttggacaacctgaataagcaccgcagatacgagatacgcatgtcagtgtataatgctgtgggggagggcccatccagtcctccccaggaggttttcgtcggcgaggcagttcccactgcagcccctcgaaatgtcgttgtgcacggtgccaccgccacccagcttgacgtgacttgggagccccctcctctcgactctcagaacggtgacattcagggatataaaatctacttttgggaggctcagagagggaacctgacagaaagggtcaaaaccctcttcctcgcagaaaatagtgtgaagttgaaaaatctcaccggttacacagcatatatggtgtcagtggctgccttcaatgctgcaggcgatggtcctcgaagcacgccgactcagggccaaacccagcaggcagccccatctgcccctagttccgtcaaattctctgagctaaccactactagtgttaacgtgagctgggaggcaccacagtttcccaacggcattctggagggctaccggcttgtatatgaaccgtgttcccccgttgacggcgttagcaagatagttacagtcgacgtcaaaggcaatagcccactttggttgaaggtgaaagacctggctgagggggttacctaccgtttccgcatcagagcaaaaacatttacctacggcccagaaattgaagccaatgtgacaactggccctggggagggggctcctggaccccctggagtccctattatcgtgcgctactcatcagcaattgctattcattggtcttcaggcgatcccggtaagggacccatcacccgctacgtgattgaagcacggccaagtgacgaagggctatgggacatattaattaaggatatccccaaggaggtgagctcatacacatttagtatggatatattgaagcctggagtctcttatgactttcgagttattgcagtcaatgactatggttttgggacacctagttcacccagccagtcagtccctgcacagaaggccaacccattctacgaagagtggtggttcctggtggtgatcgccctcgtcggcctgattttcatacttttacttgtctttgtcctgataatccgcggtcaatctaaaaagtacgccaagaagactgacagcggcaatagcgctaaaagtggggctctaggccacagcgaaatgatgtctctggatgagtcctctttccctgccctcgaacttaataatagaaggctctctgtgaaaaactcattttgcagaaaaaacgggctgtacacaagatcaccaccccgtccctcccctggtagcctacattatagtgacgaagatgtcaccaaatacaatgacttgatccccgcagaaagttccagcctcacagaaaagccgtcagaaattagcgatagccagggtagtgattctgagtacgaggtggatagtaaccaccagaaggcccactcgtttgttaaccactacatctcagaccctacctattacaatagttggcgacggcagcagaagggtattagccgagcacaagcttactcttacaccgaatccgactctggcgaaccagaccataccacagtgacaaactcaacaagtactcagcaagggagcttattccgccctaaggcatcccggacacccacaccccagaatccacctaaccccccttcccagcagtctacactctataggcctcctagctcactcgctcctggatcacgagctccgattgcgggtttctcgtcctttgtgta

SEQ ID NO: 53986 - DNA, 969 bp, Artificial Sequence
  Description of Artificial Sequence: Synthetic coding sequence
atgagtggggaactaccccctaacataaacattaaggagccacggtgggaccaatcgacatttattggccgagccaaccattttttcaccgtgacggatccaagaaacatcttactcacaaacgaacagcttgaatctgctaggaagattgtccatgactaccgtcagggtatcgtcccacccggattgaccgagaacgaattgtggagggcaaaatatatttatgatagcgcattccatccagatacgggggaaaagatgatcttgataggtaggatgagcgctcaagtcccaatgaacatgaccatcactgggtgtatgatgactttctatcgcaccaccccagccgtcctgttctggcagtggatcaaccagtcttttaacgcagtcgtcaactacaccaacagaagtggcgatgctccgttgaccgtcaacgaactggggacggcctacgtttcagccacaacgggcgcagttgccacagcccttggtttgaacgcccttacaaagcatgtgtctccgctcatcggaaggttcgtcccatttgccgcagtggctgctgccaactgtatcaatattccactgatgagacaacgggagctcaaggtcgggatacctgtgaccgatgagaacggaaatcggctgggcgaaagcgcaaatgctgccaaacaggccattactcaggtggtagtgtcccgcatcctgatggccgctccgggtatggccataccaccttttatcatgaacactttggaaaagaaagcttttcttaagcggttcccctggatgtcagctcccatccaggtagggctggtcgggttttgtctcgtgtttgcaaccccactgtgctgcgcactgttcccacagaagtcatctatgagtgtgacatctctggaggctgaactgcaggcaaaaattcaggagtctcaccctgaattgaggcgggtgtactttaacaaggggttatag

SEQ ID NO: 53987 - DNA, 585 bp, Artificial Sequence
  Description of Artificial Sequence: Synthetic coding sequence
atgtctggggaactaccacccaacattaacatcaaagagcccaggtgggatcaaagcacctttattggcagggctaaccatttcttcactgtgactgatccgcgaaatatactgctgactaacgaacagcttgaaagcgctcgaaaaatcgtccacgattatcgacagggaatagttccgcctggcctgaccgaaaacgagttatggcgggcaaagtatatctacgacagtgcctttcacccagataccggagaaaaaatgattctgatcggccgaatgtccgcccaggtgcctatgaacatgactataaccggttgtatgatgaccttctaccgcactacccctgctgttctcttctggcagtggataaatcaatcattcaacgcggtggtcaattacaccaaccgcagtggggatgcacccctcaccgtgaatgagctgggaaccgcttatgtgtctgccaccaccggtgctgtcgcgacggctttgggactcaacgcgctgacgaaacatgtatctccattgatcggacgcttcgtaccctttgctgctgtggcggctgctaactgtatcaacataccgtag

SEQ ID NO: 53988 - DNA, 435 bp, Artificial Sequence
  Description of Artificial Sequence: Synthetic coding sequence
atgagtggggaattacccccaaatattaatatcaaggagcctagatgggaccagtctacatttataggacgcgcaaatcattttttcacagtgaccgatcctagaaacatactgctcaccaatgaacagctggagagcgcccgtaaaatcgtccatgattacaggcagggtatcgtccccccaggcctgaccgaaaacgaactgtggagagcaaagtacatatatgattctgccttccatcctgacaccggtgagaaaatgatcttaatcgggaggatgagtgcccaggtcccaatgaatatgactattactggctgcatgatgacgttctaccgcacaacccccgctgtcctgttctggcagtggattaatcagagttttaatgccgtggtaaactacaccaacaggtctggagacgcacccttgactgtctag

SEQ ID NO: 53989 - DNA, 969 bp, Artificial Sequence
  Description of Artificial Sequence: Synthetic coding sequence
atggaggctgatttgagtggtttcaatatcgacgccccaaggtgggaccaaaggacatttctcggaagggtgaagcattttctgaatataaccgaccctcggacagtctttgtatctgaacgagaactcgactgggccaaggtgatggtcgagaagtctcggatgggcgtggtgccaccaggtacgcaggtagaacagcttttgtacgctaaaaaactttacgactccgcatttcatcctgacaccggggagaaaatgaatgtgataggacgcatgtccttccagttgcctgggggaatgatcattaccggctttatgctgcagttctaccgaactatgcccgctgtcatcttttggcagtgggtaaaccagtcttttaatgctttggtcaactacacaaatagaaacgccgcttcccccacatcagtccggcagatggctctgtcatacttcactgcaactactactgccgtggcaacagccgtaggcatgaatatgctgacaaagaaagcaccacccttagtgggcagatgggtgccgttcgcagcagtggctgctgcgaattgcgtgaatattcccatgatgaggcagcaagagctaatcaagggtatttgcgtcaaggataggaatgagaatgagatcggtcattctcgacgagccgcagcaatagggatcacacaggtggtgatctcacggattaccatgtcggccccaggtatgatcctgctaccagtcattatggaaaggctcgagaagttacacttcatgcagaaggtaaaggtactgcacgcccctctgcaggtcatgcttagcgggtgttttctgatcttcatggtgcccgtggcctgtgggctgtttccacagaaatgtgaactgcccgtgagctatctggagccaaagctgcaggatacgattaaggccaagtatggcgagttggaaccttacgtgtactttaacaaaggtctgtag

SEQ ID NO: 53990 - DNA, 1134 bp, Artificial Sequence
  Description of Artificial Sequence: Synthetic coding sequence
atgtgtgaagaagaggatagcacagccctcgtctgtgacaatggcagcggactttgcaaagctggcttcgctggggatgatgcccctagggctgtgttccccagcattgtgggtcgtccccgtcaccagggtgtgatggtaggtatggggcagaaggacagctatgtaggcgacgaggctcagagcaaaagaggcatccttactctcaaatatccaatcgaacacgggattatcactaactgggacgatatggaaaaaatttggcatcactcgttctacaatgagctccgagtggcccctgaggaacaccctacgctgctcacagaggcaccattgaatccaaaggctaaccgagagaagatgactcaaattatgttcgagacatttaacgtaccagccatgtatgtcgcaatccaggctgtactgagcttgtacgcgtccggaaggacgaccggcatcgtgctcgactctggagacggggtaactcataatgttcctatatatgagggctacgccctcccccacgcaattatgcggttggacctcgctgggcgagacttgactgactacctcatgaaaatcttaaccgaacggggatatagtttcgtgaccacagccgagcgtgagatcgttagggatataaaagaaaaactgtgttatgttgccctggacttcgagaacgagatggctactgccgcttcatcttccagcctagaaaagtcctacgaactcccagacggccaggtgatcaccatcggcaatgaacgtttccgttgccctgaaacattattccaacccagttttatcgggatggagtcggcgggtatccacgaaacgacctataattccattatgaaatgcgatatcgacatacgtaaagatctctatgcaaacaacgtacttagtggcggtacaactatgtaccccggtattgcagatcgtatgcaaaaggagataactgctctggctcccagcactatgaaaatcaaaattattgcgcctcccgagagaaaatattcagtctggattggcggttccattctggccagcctatctacgttccagcagatgtggatctctaagcaggagtatgacgaagccggaccatctattgtgcacaggaagtgtttttag

SEQ ID NO: 53991 - DNA, 966 bp, Artificial Sequence
  Description of Artificial Sequence: Synthetic coding sequence
atgggagagttacctttggatattaacatacaggagccacgctgggatcagagtacttttcttggtcgggctagacatttcttcacagtgacggaccccagaaacttacttcttagcggggcacaactggaggcaagcaggaacatcgtgcagaactatagggctggcgtcgttactcctggcattaccgaggaccaactctggagagcgaagtacgtttatgattccgcttttcaccccgatactggcgaaaaagttgtgcttatcggtcgcatgagcgctcaggtccctatgaatatgacaataaccggctgcatgctcactttttacagaaaaacccctacagtggtgttttggcagtgggtgaaccagagcttcaacgctatagtgaactacagtaacagatcaggggatactccaattaccgtgcggcaactgggtactgcatatgtgtctgctacaaccggtgccgtggctactgccctgggtctgaagagtctcaccaagcatctcccccctctggtcggacgcttcgttcccttcgcagcagttgctgcagccaattgcataaatatccccctgatgcgtcagagggaactacaggtgggaatccctgtggctgacgaagccggtcaaagactgggctattccgtgactgcagccaagcaaggaatttttcaggtggtaatcagtagaatctgtatggctattcccgcaatggccatacctcctctgatcatggatacgctggaaaagaaggattttctaaagagacgcccatggctaggcgctccactccaggtcggactggttggcttctgtctcgtcttcgccacacccttatgttgtgcattatttcctcagaaatccagtatccacatatctaatctggagcccgagctaagggcgcagatccatgaacagaaccctagtgtcgaggttgtctactataataaaggtctttag

SEQ ID NO: 53992 - DNA, 987 bp, Artificial Sequence
  Description of Artificial Sequence: Synthetic coding sequence
atgtccctcgagcaggaagaggaaactcaaccaggacgcttgctgggtcgcagagacgccgtaccggcttttatcgaacccaatgtacgcttttggataacagaacggcaaagttttattaggcgctttttgcaatggactgaacttttggaccctactaacgtctttattagtgtcgagagcattgaaaactctcgtcagctgctctgcaccaacgaggacgtgtccagtcctgcctctgccgatcagagagctactgtccatcccgatagttccaatctgatccccaagctatttcggccagccgcatttctcccgtttatggccccaaccgtgttcctgagcatgacccctctgaaagggattaaatccgtgatcctgccacaagttttcctctgcgcatacatggcagcattcaatagtatcaatggcaatcgcagttacacatgtaagcccttggaacggagcctgctgatggctggggcagtggctagcagcaccttcctaggcgttataccgcaatttgtccaaatgaagtacggtctgaccggcccttggattaagcgactgctgcccgttatattcctcgttcaagcgtcgggaatgaatgtgtatatgtcccgcagcttagaatctattaagggaatcgctgtgatggacaaggagggaaacgtcctggggcacagccggatcgcagggacaaaggcagtgcgtgagaccttggctagccgtattgtgttgtttggcacatctgccctcatcccagaagttttcacctactttttcaagcgcacacagtatttcaggaagaaccctggctccctgtggattcttaagttaagttgcacagtgctcgcgatgggtttaatggtgcctttttcattcagcatttttccacagataggacaaatacaatactgtagtctggaggaaaaaatccaatcaccaacagaggagaccgagattttttaccatcggggagtgtag

SEQ ID NO: 53993 - DNA, 1014 bp, Artificial Sequence
  Description of Artificial Sequence: Synthetic coding sequence
atgagtctggaacaagaggaagaaactcaaccagggaggctgctcgggaggcgggacgctgtgccagcgttcattgagcctaacgtgagattttggattaccgaacgacagtcctttatcaggcgctttttgcagtggactgaactgttggaccccaccaacgtgtttatctccgtcgagtctatcgaaaactccagacagctgctgtgtaccaacgaagatgtcagcagtcctgctagcgcagatcaacgtattcaggaggcctggaaacgctcgcttgcaacagtacatccagattcgtccaacctgatacctaagttatttagacccgctgcctttctcccgttcatggcacctaccgtgtttttgagcatgactcctctgaagggtattaagtctgtcatcctcccccaggtgttcctgtgcgcctacatggccgcttttaactctattaatggaaatcgaagttacacttgcaagccattggaacggagcctgttgatggcgggagccgtagcatcttcaaccttcctcggcgtgatcccccagttcgtgcaaatgaagtatggattgacaggcccttggattaagaggctcctaccagtgattttcctagttcaggcgagcggaatgaatgtttacatgagcagatcactggagtccatcaaaggcatcgctgtgatggacaaagaaggtaatgtgttggggcattcgcggatcgcgggaacaaaagccgtgagggagacgcttgcgtccaggatcgtccttttcgggacctccgctctgattccagaggtttttacttatttcttcaaaagaactcagtattttcgaaagaaccccggtagcctttggatcctgaaactttcctgcaccgtgctagccatgggattgatggttccttttagcttctccattttcccccagatcggtcaaatccagtactgctccctggaagagaagatacagagcccaacagaggagacagaaattttctatcatagaggggtgtag

SEQ ID NO: 53994 - DNA, 537 bp, Artificial Sequence
  Description of Artificial Sequence: Synthetic coding sequence
atggctcctaccgtgtttctgagcatgacccctctcaaaggaatcaagagtgtgatcttgccccaggtgttcctgtgcgcttatatggcagccttcaactccattaacggaaataggagctatacctgtaagccgctggagagaagtctcctcatggcaggagccgtggcttccagcacgtttctgggagtgattccacagttcgtgcagatgaagtacgggctgacaggaccctggatcaagagacttcttcctgtgatatttctcgttcaagcaagcggaatgaatgtctacatgtccaggagcctggaatccatcaaaggtattgcagtgatggacaaagagggtaatgtcctgggccattcccgaattgcaggtaccaaagccgtccgggaaacattggctagtcggattgtcttatttggcacttccgcgctgatccccgaggtgttcacctattttttcaaacgaactcagtacttcaggaaaaatccagggtccctttggatcctgaagctgtcatgtacagtgctttag

SEQ ID NO: 53995 - DNA, 663 bp, Artificial Sequence
  Description of Artificial Sequence: Synthetic coding sequence
tcacctctggtatttctttcaatgacacccttgaagggcattaagagcgtcattctcccccaggttttcctttgcgcttacatggccgcttttaattccattaatggcaatagatcatacacctgcaagccccttgaaaggagtctgctaatggcgggtgccgtcgcctcgagcaccttcctcggagttatccctcaattcgtgcagatgaaatatgggctaaccggcccatggattaagcgcctcttacctgtgatttttcttgtacaggccagcggaatgaatgtgtatatgtctcggagcctcgagtccatcaaaggcattgctgtcatggacaaagaaggcaacgtgctggggcacagccgtattgcgggaaccaaagcagtgcgggagacacttgcctcccgcatagtcctcttcggcacttcagcactcatccccgaggtatttacatactttttcaaaagaacacagtacttccggaaaaatccaggctccctgtggattctcaagctgagctgcactgtgctcgcaatgggacttatggtgccgtttagcttttctatctttccacagattggccagatccagtactgttcgcttgaggaaaagatacagtcgcctaccgaagagactgagattttctaccatagaggagtgtag

SEQ ID NO: 53996 - DNA, 192 bp, Artificial Sequence
  Description of Artificial Sequence: Synthetic coding sequence
atggcgcctactgtattcctgagtatgactcccctgaagggtatcaaaagcgtgatactcccccaagtgtttctgtgtgcatatatggcagccttcaatagtatcaacgggaaccgaagttatacttgtaaacctttagagcgcagtttgctgatggcgggagctgttgcctccagtaccttcctgggctag

SEQ ID NO: 53997 - DNA, 1023 bp, Artificial Sequence
  Description of Artificial Sequence: Synthetic coding sequence
atggctgacactgcgacaacagcgtcagccgctgcagccagcgctgcttcagcctcttcagatgccccaccatttcagcttgggaaaccacgctttcagcagacctctttctacggtaggtttcggcattttctggatatcattgatcccaggacactgttcgtgactgagaggcgcctgcgcgaagcagtccagctgctggaagactataaacacggcaccctgagaccaggcgtaaccaatgagcagttatggagtgctcagaagataaaacaagccatcctgcaccccgacaccaatgaaaaaatcttcatgcctttccgcatgtctgggtatatcccgtttggaacaccgatagtggtaggcctgctcctgccaaaccagactctggccagcaccgtgttctggcagtggctgaaccaatcgcacaacgcgtgcgtgaattatgccaatagaaatgcaactaagccatcacctgccagtaagttcatccagggctacttgggcgctgtgatctccgcagtttccattgccgttggcctcaatgtcttagtccagaaagcgaataagtttacaccagcgacccggctgttgatccaacgttttgttcctttcccggcagttgcttccgccaacatctgcaacgtagtcctgatgcgctatggagaacttgaggaggggattgatgtgctggatagcgacggcaatctcgtgggttccagcaagatcgctgcaaggcatgcacttctggagactgcattaactcgagtggtcctaccaatgccaatactcgtgcttccacctatcgttatgagtatgctggaaaagaccgcactgctgcaggccaggcctaggctattgcttccagttcagtccctcgtgtgtctagccgcatttggcctagccctcccactggcgatcagcctgttcccccagatgtcagaaattgaaacctctcagcttgaaccagaaatcgcccaggctacctccagcaggaccgtagtgtataataaaggcctctag

SEQ ID NO: 53998 - DNA, 4389 bp, Artificial Sequence
  Description of Artificial Sequence: Synthetic coding sequence
atgggggcacaggatagacctcaatgccattttgacattgagattaatagggaacccgtcgggaggattatgtttcagttattcagtgacatctgtcctaaaacctgcaagaactttctctgtctgtgcagtggcgaaaagggccttgggaagactacagggaaaaagctgtgttacaagggatccacgttccaccgggtggtgaagaacttcatgatccaaggcggagatttttctgaaggaaacggcaagggtggagagtccatctacggaggttacttcaaagatgaaaacttcatactgaagcacgacagagccttcctgctaagcatggccaaccggggtaaacacacaaacggcagccagttttttattacaactaaacctgcccctcacctcgacggagttcacgttgtgttcgggctggtaattagtggcttcgaagtcattgagcagatcgagaacctgaagacggacgctgctagtcgcccatacgcagatgtccgcgtgattgattgcggcgtgctggcaacgaaaagcatcaaagacgtttttgagaagaaaagaaagaaacccacgcattctgaaggctctgacagctcgtccaatagttcatcttcctctgaatcttcctctgagtctgaactggagcacgagagatcgcgacgacgcaaacataagagacgcccaaaagtcaagcggtcgaagaagagaaggaaagaggcgagctccagtgaagagccccgaaataagcacgctatgaatccaaaaggtcactctgagcggagcgatactaatgaaaagagatcagtggactctagtgccaaaagggagaagccagtggtaaggccagaggaaatcccgccagttcccgagaatcggttcttgctcaggagggatatgcctgtcgttactgctgagcccgaacccaagattcctgacgtcgcccctatcgtttctgaccaaaaacccagcgtgtccaagtctggcaggaaaataaaagggagaggtacaattcgctaccacacaccacccagaagccgctcatgctctgaatctgacgacgatgactccagcgagactcccccacactggaaagaggaaatgcagcggctgagggcttatcgccctccctccggcgagaagtggagcaaaggggacaaactgagcgacccatgcagctcccgatgggacgaaaggtccctatcccaaaggtccaggtcctggagttataacggatattattccgatctgtcgactgcccgacatagtggacatcataaaaaacgaaggaaagagaagaaggtcaagcacaagaaaaaaggcaaaaagcagaaacactgcagaagacataaacagaccaaaaagagaaggatcttgatcccgtcagacatcgagtcgtcaaagtcctctacgcgcagaatgaaaagtagctgtgacagagagcggagctctcgatccagctcattgtccagccatcacagctcaaagcgggattggtctaaatctgataaggatgtgcaaagtagcctcacccacagctcacgagattcctatagatcgaaaagccattcgcagtcctattcccggggatccagccgttccaggacagcatctaagagctcctcacatagtcggagccggtcgaagtcaagatctagtagtaagagcggccatcgaaaacgggcatctaagtctccaagaaagacagcgtcacagctctcagagaataaaccggtgaaaaccgagccacttcgggctacaatggcacagaatgagaacgtggtggtccagcccgtcgtagccgagaacatccctgtgatccctttgagcgattctccgccaccttctcggtggaaaccaggacaaaaaccttggaaaccgtcctatgaacggattcaggaaatgaaagctaaaacaactcatcttctcccaattcagtctacatatagcctcgctaatatcaaggaaacaggttctagcagcagttatcataagcgtgagaaaaacagcgagtctgaccagtccacctactcaaaatatagcgaccggagttctgagtcttcgcctcgcagtagatctcgcagtagtcgctctcgctcttacagcaggagttacacccggtcccgatcactggcaagttcccattctagatcccggtccccgtccagtagatcacattctcggaataaatattccgaccacagccagtgctccagatcatcctcttacacctccatcagttccgatgatggtagacgggcaaagcgacggctccgcagttcaggcaagaaaaactccgtgtcccacaaaaaacactctagcagcagtgaaaagactctccactcaaagtacgttaagggtcgtgatcgctcctcctgcgtacgcaagtactcggaatccagaagctcgttggactatagctccgatagcgagcaaagttccgtgcaggccacacagagcgctcaggagaaggagaaacaggggcagatggaacgaactcacaataagcaggagaaaaatcgaggagaggaaaaaagcaaaagcgagcgtgaatgcccccattctaagaaaaggacgttgaaagagaatctgtctgatcacttgcggaacggcagcaagccaaagcggaaaaattacgctggatctaaatgggacagcgaatccaattctgaacgcgatgttaccaagaactccaaaaatgactctcatccctcatccgacaaagaagagggcgaagccacctcagacagtgagagcgaagtcagcgagatccacattaaggtgaaaccaaccacaaaaagctctacaaatactagtcttccagacgataacggcgcttggaagtcaagcaaacaacgaacatccacgtctgattccgaggggtcttgctcaaattccgagaataaccggggtaagccgcagaagcacaagcacggttctaaagaaaacctgaagagagagcataccaagaaggttaaggagaagttgaaaggtaaaaaagacaaaaagcataaggcgccaaagagaaagcaagcctttcattggcaacctcccctggaatttggggaggaagaagaggaagaaattgatgataagcaagtaacccaagaatccaaagaaaagaaagttagtgagaataatgagacaatcaaagataatatccttaagacagaaaagagctctgaggaggatctgtctggtaagcatgatacagtgacggtgtcgtcggacctggaccagttcacaaaggatgacagtaagctgagtatctccccaacagccctgaatacggaggaaaatgtcgcttgtctgcagaatatccaacatgtagaggaatctgtacctaacggtgtagaggatgtgttacaaacagatgataatatggagatttgtacccctgatcgaagctcaccggctaaagtggaggaaacatcaccactgggcaacgccagactcgatacccccgacattaacatcgtgctcaaacaggacatggctacagagcatcctcaggctgaagtggtcaaacaggaatcatcaatgtctgagagcaaagtgctcggcgaggtgggcaagcaggactcatcgtctgcttcgttggcttcagcgggtgagtcgacaggtaaaaaggaagtggcggagaaatctcagataaatctcatcgacaaaaaatggaaacctctgcagggcgtcggtaatttggccgcacctaatgcagccaccagcagcgcagttgaggtcaaagtgctcaccaccgtgccagaaatgaaacctcaaggtcttcgaattgagattaagagcaaaaataaggttaggcccggttctctgttcgacgaagtgcgtaaaaccgcaagactcaatagacgacctagaaatcaggaaagttcctctgatgaacagactcctagtcgggacgatgattcccaatctaggagccctagtcggagccggagcaagagcgagacgaaatctaggcatcggacgcgttccgtttcctactcccattctcgctcccgctctcggtcgtctacctcatcctacaggtcgcggagctacagcaggtcccgatcgcgaggctggtacagtcggggaaggacccggtctcggtcatccagttatcgtagttacaagtcccacagaacttctagcaggtcacggtctcggtctagttcctacgacccccacagtaggtcccggtcatatacctatgactcatactatagcagatccaggtctcgtagtagatcccagaggtcagattcatatcacaggggcagatcctacaatcgccgatcgcgctcctgccggagttacggttcagattccgaatcagacaggtcttactcacaccaccgtagcccttcagaatcaagccggtatagctag

SEQ ID NO: 53999 - DNA, 681 bp, Artificial Sequence
  Description of Artificial Sequence: Synthetic coding sequence
atggctgccgcagcagtgcagggaggcagatctgggggaagcggagggtgtagcggagctggtggtgcatccaactgcggcactgggagcggcagatctggactcctggacaaatggaaaatcgacgataaacccgtaaagattgataaatgggatgggtcggcggtaaagaattcccttgatgattccgcgaagaaggtgttactggaaaaatacaagtacgtggagaattttgggttgatcgatggaaggctcaccatatgcacgatctcatgttttttcgcgattgtggcattgatctgggattacatgcatcccttccccgaaagtaagcctgtgttagctctgtgcgttatcagttactttgtgatgatgggtatcctgaccatctacaccagctacaaagagaagtcaattttcctggtggcccataggaaagacccgaccggtatggacccagatgacatctggcagctgtcctcttccctgaagaggtttgacgacaaatacaccctcaagctaacatttatcagcggacggacaaagcagcagcgggaagctgagtttactaagtccatcgctaaatttttcgatcacagcggtaccctagtcatggacgcctacgaaccagagatcagccgtctgcacgatagtctcgctatcgaaaggaaaataaagtag

SEQ ID NO: 54000 - DNA, 543 bp, Artificial Sequence
  Description of Artificial Sequence: Synthetic coding sequence
atgaacacagtattaagccgagcaaacagcctgttcgccttctcactctccgttatggcagccttgactttcggatgtttcataactaccgccttcaaggatagaagcgtgcccgtcaggctgcatgttagccggattatgctgaagaatgttgaagacttcacaggtccaagggagcggagcgatctcggattcatcactttcgatataacagccgacctggagaacattttcgactggaatgtaaagcagttatttctgtacctaagcgctgagtatagcacgaagaacaacgctctcaatcaggttgtgctctgggacaaaatcgtgctgagaggtgataacccaaaacttctactgaaagatatgaaaaccaagtacttcttctttgatgatggcaacggcctgaaaggcaaccgcaatgtgacattgaccttatcatggaatgtggttcccaatgccggaattctcccccttgtaacgggaagcggacatgtgtcagtgccttttccagatacctatgagatcaccaaaagttattag

SEQ ID NO: 54001 - DNA, 1563 bp, Artificial Sequence
  Description of Artificial Sequence: Synthetic coding sequence
atgggtcctcagcggagattatctcctgcgggagctgccctgctgtgggggtttctgctgcagctgacggccgctcaggaggctatcctgcacgcaagcgggaacgggactactaaggactattgcatgctatataacccttactggaccgcgctgccaagcacacttgaaaatgctacgtccatttctctgatgaacctgacgtcaacccctctttgtaacttgtctgacatcccacctgtcggcatcaagagtaaggcggtggtggtaccctgggggtcatgccatttcctagagaaggctcgcattgcccagaaaggcggagcagaagcaatgctggttgtgaacaacagcgtactgttcccaccctcaggcaaccgcagtgaattcccggatgttaagatcctcatcgcctttatttcttacaaggactttcgcgacatgaaccagactctgggcgataacattacggttaagatgtactcccccagctggcctaacttcgactacactatggtggtcatcttcgttattgccgtgttcacagtagcactggggggatattggagcggattggtggaattggaaaaccttaaggctgtaacaactgaggatcgggagatgagaaagaaaaaggaagagtacctcaccttttcccccctgaccgtggtgatcttcgtcgtaatctgttgtgttatgatggttcttctgtatttcttctataaatggttggtgtatgttatgattgcgatcttctgtatagcatccgcgatgagtctgtataattgcttggcagctctgatacacaagattccgtacggccagtgcaccatcgcttgcagaggcaagaacatggaggtaagacttatttttctctctggtctgtgcatcgccgtcgccgtggtctgggcagttttccggaatgaggaccggtgggcatggattttgcaggacatcttgggtattgctttttgcctcaatctcatcaagacacttaaactgccaaatttcaagagttgtgttattctacttggactcctcctactgtatgatgtatttttcgtgtttattactccctttattactaaaaacggagaaagcatcatggtcgaacttgcagctggcccttttggtaataatgagaagctacctgtggttatccgcgtcccaaaacttatctacttttctgtcatgtccgtatgtttaatgcccgtgagcattttaggcttcggcgacattatagtccctggactcctgatcgcttactgccgccgtttcgatgtccagacgggctcttcttatatctactatgtgtcatcgactgtcgcatatgccatcggaatgatcctgacttttgtcgtgctagtgctcatgaagaaagggcagccggctctgctgtatcttgtgccctgcacattgatcacagccagcgttgttgcctggcggagaaaagagatgaaaaaattctggaaaggaaactcctaccagatgatggatcacttggactgcgctaccaatgaggaaaacccggtgatctccggtgaacagatagtgcagcagtag

SEQ ID NO: 54002 - DNA, 2055 bp, Artificial Sequence
  Description of Artificial Sequence: Synthetic coding sequence
atggcttgcttgggcttcctgctacctgtggggtttttactgctaatcagtacagtagcgggtggaaaatatggcgtagctcacgtggtctcagaaaattggtctaaagattactgcatacttttctcgagcgactatatcacactgcccagggaccttcaccacgccccactcctgcctctctatgatggcaccaaggccccatggtgtcctggcgaagattcccctcatcaagcgcagctaagatccccctcccagagaccactgcgccagactaccgcgatggtgatgagaggaaattgctcttttcacactaagggctggctcgcccagggtcagggcgctcatggcctcttaatcgtcagtcgggtgtctgaccagcaatgttccgacaccaccctggctccacaggatccacgccagcctctggcggatctgacgatcccagtggcgatgctccactacgcggacatgctcgatattcttagccacactagaggggaggcagttgtccgcgtggcaatgtatgcgccaccagaaccaattattgactacaacatgctggttatctttatcttggcagtcggcaccgtggctgcaggtgggtattgggccggactcactgaagctaaccgcctccagcgcaggagagcccgtcggggagggggatccggaggtcaccatcaactgcaagaggccgctgccgcagagggcgctcagaaggaggataatgaggatattccggttgacttcactcctgccatgacgggggtagtggtcactctctcatgtagtttaatgctccttctttattttttctacgaccattttgtgtacgtgaccataggaatctttgggcttggagccggaattgggttgtattcttgcctgtctcctttggtgtgccgcctgagtctacgccaataccagcgaccgcctcactcactctgggcctcactgccgttacctctcctcctgcttgcatccctgtgcgctaccgtgatcattttctgggttgcctaccggaacgaagatcggtgggcctggttactacaagacactctaggaatctcttattgcttgttcgtgctccacagagttcggctccccacactgaagaattgctcttctttcctgctcgcacttctggccttcgacgtcttttttgtcttcgttacaccattctttacgaaaacaggagagtccatcatggctcaggtggccctgggacccgctgaatcttcctcccatgagcggctcccaatggttcttaaagttccccgtttgcgcgtttcggcccttactctgtgtagccagcccttcagcattctgggattcggtgatatcgtggtgcctggatttctggtggcctactgctgtcgattcgacgttcaagtgtgtagtcgacagatttacttcgtggcgtgtactgttgcttatgcagtaggcctgctcgtaactttcatggccatggtgctgatgcagatgggtcagcctgctctactttatctagtatcaagtacactgcttacatcactagccgtagccgcatgccgtcaggaactgagcttattttggactggccaaggacgggctaaaatgtgcggacttggatgcgccccttctgctgggtcacgtcagaagcaggaaggagccgcagacgcacacacagcctccactctcgaacggggaacaagcaggggggcaggagatctggattctaatcctggcgaggacactaccgagatcgttacaatttctgagaatgaggcaacaaatcccgaagatcgatctgactcttccgagggctggagtgatgctcatctggaccctaatgagcttccttttatccccccaggcgcttcagaagaactaatgcccctcatgccgatggcaatgttaatccccctcatgcctctgatgccgccaccgtctgagttgggtcacgtccacgcccaggcacaggctcacgagactggtctgccttgggctggactacacaaacgaaaggggctgaaggtgcggaagagtatgtccacacaggcacccctgtag

SEQ ID NO: 54003 - DNA, 1155 bp, Artificial Sequence
  Description of Artificial Sequence: Synthetic coding sequence
atggctgaacagacctactcttgggcctactcactggtggactcaagtcaagtgtcaacattccttatatcaatactattaatagtttatggctctttcaggagccttaacatggatttcgaaaaccaggacaaagagaaagacagcaactccagcagtggaagttttaatggaaattcaaccaataattctatccagaccatagatagcacgcaggctctgtttttgcccatcggagcaagcgtcagcctgttggtcatgtttttcttttttgacagcgttcaggtagttttcactatctgcacagcggtgcttgcaacaatcgcttttgcgttcctcctgttgccaatgtgccagtacctaacaagaccctgctcacctcagaacaaaatttccttcggctgctgtggccgtttcaccgccgcagagttgctgtccttctcattgtccgttatgctcgtactgatctgggtgctcacgggccattggctgctcatggatgccctcgccatgggactgtgtgtggcgatgattgcattcgtgaggctgccctcactgaaggtgtcgtgcctgctgttatccggcctccttatctacgacgtgttctgggtgttcttttccgcctatattttcaattcaaacgttatggtgaaagttgccacgcagcctgctgacaatcctctggatgtgctgagcaggaaattacacctaggaccaaacgtcggcagggacgtcccccgactgtctctgcccggtaagctcgttttcccttcctctactggctcccacttttcaatgctgggtatcggtgacattgtcatgcctggactgttgctctgcttcgtgctccgatacgacaactacaaaaaacaagcttctggggacagttgcggagccccaggacctgctaacatcagcggtcgtatgcagaaagtctcttacttccattgcactctcatcgggtatttcgtggggttgttaacagcaaccgttgcgtctaggatacaccgagccgcacagccggctttactgtatctggtgccctttacgctgttacctctgcttacgatggcatacctaaagggcgacctgagaagaatgtggtcggagccattccactcaaaatcttcaagctcaagattcttggaagtctag

SEQ ID NO: 54004 - DNA, 1152 bp, Artificial Sequence
  Description of Artificial Sequence: Synthetic coding sequence
tctatccggacgcactgcatggcatatagtctagtcgattcctcacaggtatcaacattcctgatctcaattctcttgattgtttacgggtcgtttcggagcctcaacatggacttcgagaatcaagacaaagagaaagacagtaattctagctccggaagctttaacggaaatagtccaattattggcattcagactatcgacagtacgcaggctttgttcctgcctataggtgcatcagtaagcctgctcgtgatgttcttcttcttcgacagcgtgcaggtggtgttcactatttgcactgctgtattggccacaattgcctttgcatttctgctactgccaatgtgtcagtaccttacgcggccatgctccccacaaaataaaatctcgttcggatgctgtgggaggttcaccgctgcagagctgttatctttcagcttgtcggttatgctcgtccttatctgggtgctcactggacactggctgctgatggatgctctcgccatggggctgtgcgtcgctatgatcgcatttgttagactcccaagcctcaaagtgtcttgcctgctactgagcggcctcctgatttatgatgttttttgggtcttcttttccgcttacatatttaatagtaatgtgatggtcaaggtcgccacccagcctgccgataaccctttggatgtgctgtcgcgaaagctccacctggggccaaatgttggacgtgatgtccctcgcctctccctgcccggaaagctggtgttcccgagttcaacaggatcccatttctcgatgcttggcatcggtgatatagttatgccaggcttgttactgtgttttgtgcttagatatgacaattataaaaaacaggcctctggcgattcttgcggagcaccaggccctgcaaatatctctggtcggatgcaaaaggtctcatattttcactgcacattaatcggttactttgttggattgctgaccgcaaccgtcgcctcgcgcattcacagagcagcacagcctgctcttttgtacctcgtcccattcactttgctgcccctcctcaccatggcttatctcaaaggcgatctcagacgaatgtggtcggagcccttccactccaaatcctcctcttcgaggttccttgaagtgtag

SEQ ID NO: 54005 - DNA, 816 bp, Artificial Sequence
  Description of Artificial Sequence: Synthetic coding sequence
atggctagcgccgatagcaggcgggtggccgatgggggtggtgcaggcggtaccttccagccatatctggatacacttaggcaggagctgcagcaaacagaccccacactcttgtctgtcgtagtggcggtgctcgcggtcctcttaacccttgttttctggaaattaatccgcagccgcaggagcagtcagagggcagtgctcctggtggggctgtgtgacagcggtaaaacgttgttattcgtgcggctgctgactggtctttatcgtgacacacagacttctattaccgacagctgtgccgtctacagagttaataataatcgagggaacagtctcacactgatcgacctgccaggccacgagtctttgcggctgcagtttctcgaaagattcaaatcatccgctcgggcaatagtgttcgtcgtcgattcagccgcttttcagcgagaagtgaaagatgtagccgaattcctttatcaggtgctgatcgacagcatggggctgaagaacactccttcttttctgatcgcctgcaataagcaggatattgcgatggctaaaagcgcaaagctcattcagcagcaactggaaaaggagctgaacactctaagagttaccagatccgccgcaccttccacactcgactcatcttccactgcccctgctcagctggggaaaaagggcaaagaatttgaattttcccaactgcctctcaaggtggagtttcttgaatgcagcgccaaaggtgggcgtggtgatgtcggttcagctgacattcaggacctggagaagtggcttgccaaaattgcatag

SEQ ID NO: 54006 - DNA, 279 bp, Artificial Sequence
  Description of Artificial Sequence: Synthetic coding sequence
atggcatccgccgacagcagacgggtggccgacggcggtggggctgggggaacgtttcaaccatatctggataccttgcgccaagagctccagcagaccgaccctacactgctcagcgtcgtagtcgcagtgttggccgttctgcttactctggttttctggaaattgattcggtcccgccgatcgtctcagagggctgtgctgctagtgggcctgtgtgactccggcaagacgctgctttttgttcgtctgctcaccggcctttaccgggacacgtag

SEQ ID NO: 54007 - DNA, 861 bp, Artificial Sequence
  Description of Artificial Sequence: Synthetic coding sequence
atgcgcctcctcccaaggctgctcttactgctgttacttgtttttccagcaacagtactgttcaggggcggtcctagaggtcttctggccgtggcccaggacctaacagaagatgaggagacggtggaagactcaattattgaggacgaggacgacgaggcagaggtagaggaggatgagcctaccgatctggtcgaagataaggaagaggaagatgttagtggcgaacctgaagcgtctcccagtgcagatacaacaatcctcttcgtgaagggagaggatttccccgctaataatatcgtcaagtttctggtgggcttcaccaacaaggggaccgaagactttattgtggaatcgctggatgcctcattccgatatccacaggattatcagttctacatacagaatttcaccgccctaccactcaacacagtcgtgccaccccagaggcaggccacatttgagtacagcttcattcccgcagagccaatgggcggtcgaccctttgggctggtaatcaaccttaattacaaagatttgaatggtaatgtcttccaggatgctgtattcaatcagaccgtaactgtcattgagagggaagatggtcttgatggcgaaacaatcttcatgtatatgtttcttgcgggattgggactgctagtcattgtcgggttgcatcagctgctggaaagcaggaaacgcaagagaccgatccagaaggttgagatgggcacctccagtcagaacgatgtggacatgtcatggattccccaggaaacactcaaccagattaataaagcctcgccgaggcgactccctagaaaacgcgcacagaagagatccgttgggtccgacgaatag

SEQ ID NO: 54008 - DNA, 780 bp, Artificial Sequence
  Description of Artificial Sequence: Synthetic coding sequence
atgaggctcttgcctagattgcttcttctactccttctggtgttccctgcgacagtgctgttccgagggggaccgagaggcttgctggccgtggcccaagatttgaccgaagatgaggagacagtggaagatagcatcatagaagacgaagacgatgaagccgaggtggaggaagacgagccaactgacctggtgaagtacttccctgctaataacatagttaaattcctggtcgggttcaccaacaaggggaccgaggactttattgtcgagagcctcgatgccagcttccgctacccacaggactaccagttttacatccaaaatttcacagcgctaccactgaacacagtggttcctccacaacgtcaggcaacattcgagtacagcttcattccagctgaaccaatgggcggaagaccttttggattggtaatcaacctgaattataaggatctcaatggaaacgtgttccaagacgctgtctttaatcaaacagtgactgtaattgagagggaggacgggctggatggggagaccattttcatgtatatgtttctagccggactcgggctgctcgtgatagtggggttacaccagctgctggagagtagaaagcggaaacggcctattcaaaaagtggagatgggcacctccagtcagaacgatgtggatatgtcgtggatcccacaggagactctgaaccagataaataaggcctctccccgacggttaccaaggaaacgggctcaaaagcggtcagtggggtccgacgagtag

SEQ ID NO: 54009 - DNA, 558 bp, Artificial Sequence
  Description of Artificial Sequence: Synthetic coding sequence
atggctcctaagggatccagcaagcagcagtcagaggaggacttgctactgcaggatttctcccggaatctctccgcgaagtcgagcgctctttttttcggaaatgcctttatcgtttctgccatccctatctggttgtattggagaatttggcatatggatctcatccagagtgccgttctctactccgttatgacacttgtcagcacctacctagtcgcattcgcttacaaaaatgtgaaattcgtactcaagcacaaggtggctcagaagcgtgaagatgccgttagcaaagaggtcacacgaaaactcagtgaggcagataaccgcaagatgtctcgaaaggagaaagacgagcgcattctgtggaagaagaacgaggtggcagattacgaagccacaacgttctcaattttttataacaacactctgttcctagtagtggtcattgtggcctcattttttattcttaaaaactttaacccaaccgtgaattacattctgagtattagtgcttccagcgggctgattgctctcctcagtactggcagtaagtag

SEQ ID NO: 54010 - DNA, 597 bp, Artificial Sequence
  Description of Artificial Sequence: Synthetic coding sequence
atggctcctaagggctctagcaagcagcagtctgaggaggacttgcttttacaggacttctctaggaatctgagtgccaagtcatccgctctgttctttgggaatgccttcattgtgtctgctatccccatctggttatactggagaatctggcatatggatttgatccagtcagccgtgttatacagcgtgatgaccctcgtctctacctatctggtggcctttgcatacaagaatgttaaatttgtgctgaagcacaaggttgcacagaagagggaggacgctgtctcaaaggaagttacccgaaaactgtctgaagctgataacagaaagatgtctagaaaagagaaagacgagcgctttgatagctgcctcaagtatgggcaccacaaacggggtatactgtggaagaagaacgaggtggcagactatgaagccacgactttctctattttttataacaacactctctttcttgttgtggtcattgtcgcttccttcttcatccttaaaaactttaatcccaccgttaattacatcctttctatcagcgcatcgagtggcctgattgcccttttatcgacaggatctaagtag

SEQ ID NO: 54011 - DNA, 5351 bp, Artificial Sequence
  Description of Artificial Sequence: Synthetic coding sequence
atgacctctctcaaacggtcacagaccgagcggccacttgctaccgatcgggctagtgttgtgggcaccgatgggacgccaaaagttcacaccgatgacttctacatgagaaggttccgatctcagaacggctcattaggaagcagcgtgatggcgcctgtggggccacctagatcagagggtagtcaccatattacgagcactcctggggtccctaaaatgggagtcagagctagaattgctgactggcctcctcgaaaggaaaatatcaaggaatctagccgcagttcccaggaaattgagacttctagctgcctcgattctctctccagcaagagcagtcccgtgagccaaggcagtagtgtgagcctcaactcaaacgattcggccatgctgaagagcattcaaaatacccttaaaaacaagactcgaccctccgagaacatggacagccgctttcttatgcctgaagcctacccgagctcacccaggaaggcgttgagaagaattcgtcagaggtctaactccgatatcaccatttcagagctcgacgtagattcgtttgatgaatgtatctctccaacttacaagactggcccttctttgcaccgcgagtacgggagcacctcctcgatagataaacaagggacttctggcgagagtttcttcgaccttctcaagggctataaggatgataagagcgatcgcggacccactccgactaagctctctgattttctcatcacggggggtggaaagggcagcgggttttcactggacgtgattgacgggccaatttcccagagagagaatctccggctgttcaaagagagggaaaagcctttaaagcggcgatccaagagcgagacgggtgactcttctatcttccgaaaactgcggaacgcgaagggcgaggagcttgggaaaagctcagacctggaagataacaggagcgaggactctgtgcgtccctggacatgccccaagtgttttgctcactatgacgtacaatcgattctgtttgatctcaacgaagccatcatgaaccggcataatgtgatcaaacgccgtaacacgactaccggagccagcgccgcagctgtagcatccttggtgagcggccctctgtcccactccgccagcttctcctctcccatggggtccactgaggaccttaattctaagggctcactttcgatggaccaaggtgacgataaatctaacgagctagttatgtcttgcccttacttccggaacgagattggaggagagggtgaaagaaagatatccttgtccaaaagcaacagcggcagcttttcgggatgtgagtcagcttccttcgaatctactttaagtagtcactgcacgaatgcaggcgtcgcagtgctggaagtccccaaggagaatctggtccttcacctagaccgtgtgaagcgatatatagtggagcacgtggacttgggcgcatactactacaggaaattcttctaccagaaagagcactggaactattttggtgccgatgaaaatctcgggcctgtcgccgtatcaattcgtcgagagaaacccgacgagatgaaggagaatggctccccttacaattacagaattattttccgcacatctgagctgatgaccctgcgaggcagcgttcttgaggacgccatcccgtcaaccgccaagcattcaactgctcggggtttgccattgaaggaggttctggaacatgtggtgcctgagctgaacgtgcaatgcctacgtctcgcttttaacacacccaaggtgaccgaacagctcatgaagcttgacgaacaggggctgaattatcagcagaaggtgggcataatgtactgtaaagccggacagtcaacagaagaggaaatgtataacaacgagagtgccggaccagccttcgaggaattcttacagctgctgggcgaacgcgtaagacttaagggatttgaaaagtacagagcccagctggatacaaagactgacagcacaggcacccatagcctgtataccacatataaggactacgagatcatgtttcatgtgtctacaatgctcccgtacacacccaataacaaacagcagctcctgcgcaagaggcatatcgggaatgatatcgtcacaattgttttccaagagcccggagctcagccattttcacccaagaacatccgatcacatttccagcacgtgtttgtgattgtgagggttcataacccatgttctgattcagtgtgttattcagtggcggtgacacgtagccgcgacgtgcccagttttgggcctcccatcccaaaaggggtgaccttccccaagagtaatgtctttcgggattttctcttagccaaggtgatcaacgccgagaatgcagcacataagagcgagaaatttcgcgcaatggccacacgaacgagacaggagtatctcaaggatctagcagagaagaacgtgacaaatacccccattgatccctcaggaaagttcccattcatctctctggccagcaaaaagaaagagaagtccaaaccataccccggagccgagctgtccagcatgggcgctatagtgtgggccgtcagagccgaggactacaataaagcaatggagttggactgcctgttgggcatttcaaacgagttcattgtgctcatagagcaggagaccaaatccgtggtattcaattgttcttgtagagatgtaatcggatggacgagcactgacactagcctgaagatattttacgagcgtggcgaatgcgtgagcgtgggatcatttatcaatattgaggagattaaggaaatcgtgaagagacttcagttcgttagtaagggatgtgagtcggtcgagatgactctacgcaggaacggtctgggtcagctgggctttcatgtcaattacgaaggcattgtcgccgatgtagagccttatgggtacgcctggcaggcgggactcaggcaaggttctcggctggtggagatatgtaaagtggcagtggccactctttcccatgaacaaatgattgacctccttcggacgtcagtcacagtgaaggtagtgattattccgcctcacgatgattgcactcctcgccgtagttgcagtgagacataccggatgcccgttatggaatacaagatgaacgagggcgtgagttacgagtttaaattcccctttagaaacaataataagtggcagaggaatgctagcaaaggccctcactcccctcaagttccctcccaggtccaatccccaatgacgagccgcctaaatgccggaaagggtgatggcaagatgcccccacctgagagggcggcaaatatccctagatccatctcctcagacggacgtccacttgaacgacgcctgtcaccaggctccgacatctatgtgacagtctcgtctatggctctcgctagaagtcagtgccggaattctcctagcaatctgtcttcctcatccgacactggcagtgtcggaggcacctacaggcagaagtccatgccagaaggttttggcgtgagccgaaggagtcccgcttctatagacagacagaacacccagagcgacataggtggcagcgggaaatccactcccagctggcagcgttctgaagatagcatcgccgaccagatggagcccacctgtcacctgcccgctgtgagtaaggtgctccctgcttttcgcgaaagtccctccgggcgactcatgaggcaggatcctgttgtgcaccttagtcctaacaagcagggacatagtgactcccattactcaagtcacagctcttccaacaccctaagtagcaacgcttcaagcgcacacagcgatgaaaaatggtacgacggagatcggacagagtctgagctgaacagctataattatttacaaggcacttcagccgactcaggcattgacactacatcttacggcccatcacatggaagcacagcaagtctcggtgcagctaccagttccccacggagtgggcctggcaaggagaaggtagctccgctatggcatagctcctccgaggtgatttcgatggccgatcggacccttgagacagagagtcacgggctggacaggaaaacagagagcagcctgagtctcgacatccacagtaaaagccaagcaggttcgacgccacttacacgagagaactcaactttttccatcaatgacgcggcatctcacacatcaacaatgtcaagccgtcacagtgctagccctgtggtcttcacctcggctcggtcctcgccaaaagaggagctgcacccggcagctcctagccaactggcccctagtttttcatcatctagctccagttcctctgggcctaggtccttttatcctcggcagggagccacctcgaaatacctgatcggctggaagaagcctgaggggacgatcaacagcgtggggtttatggacacccgcaaaaggcatcagtcagatggaaatgagatcgcccacacacgccttagagcatctacgcgcgatctcagggcttccccaaagcccaccagcaagagcactatcgaggaggatctgaaaaaactcatcgacctagagtcgcccacacctgaaagtcagaagtcgttcaagttccatgccttatcctccccccagtcccccttcccctcaacaccgaccagccgcagggcccttcacagaacactgtctgatgagagtatttataattcgcagagagaacacttctttaccagccgggctagcctgctcgaccaggccctgcctaacgacgtgctgttttccagcacataccctagcttgcccaagtcccttcctctgaggcgcccttcatataccttagggatgaagagcctccacggcgaattctctgccagtgacagctccctgactgacatacaggaaactagacggcagccaatgcctgaccccggactcatgcctttgcccgacaccgccgctgacctggattggtcaaatctggtggatgcggctaaagcctatgaagtacagcgtgcttcatttttcgcagcctctgacgaaaaccaccgtcccctaagtgcagcgtcaaacagcgaccagttggaagatcaggcgctggcgcagatgaagccttactcttcttctaaagactcatctcccactctcgcgtccaaggttgatcagcttgagggtatgctcaaaatgctacgggaggatctaaagaaagaaaaagaggacaaggcgcacctgcaggccgaggttcaacatctgagggaggacaatcttcgccttcaagaggagagtcagaacgcgtcggataaactgaagaaatttacagagtgggtgttcaatactatagacatgagtta

SEQ ID NO: 54012 - DNA, 3774 bp, Artificial Sequence
  Description of Artificial Sequence: Synthetic coding sequence
atgaaagagaatgggtccccatataattaccgtataatctttcgcaccagtgagctcatgaccctaaggggatctgtgctggaagatgctatccctagcacggccaagcacagtacagccaggggcctgcctttaaaagaggtgctcgaacacgttgtgccagagctcaatgtacagtgcttgagattggctttcaatacgccgaaggtcaccgaacagctgatgaagcttgacgaacaggggctcaactaccaacagaaggtgggtatcatgtactgcaaggccggacagtctacagaggaggagatgtacaacaatgagtcagccggacccgcatttgaggaattcttacagctcctgggggaacgagtgaggctgaaaggatttgagaagtaccgtgcacagctcgacactaaaaccgactcgacaggcacccacagcttatatacaacatacaaggactacgagataatgtttcacgtatctactatgttgccctataccccaaacaataaacagcagctccttcggaagagacacatcggcaatgacatcgtgacgatcgtgttccaggagccaggcgctcagccgttttccccaaaaaatattcgcagccattttcaacacgtatttgttattgtccgggtacataatccctgctctgacagtgtttgctatagcgtcgctgttacgcgatctagagacgtaccatccttcgggccacctattcccaaaggcgtcactttccctaaaagcaacgtattcagagattttctactcgccaaggtgatcaacgctgaaaacgctgcgcataaatccgaaaaatttagagccatggccacccggactcggcaggagtatctgaaggatttggcagaaaagaatgtgaccaataccccaattgatccaagcggcaaatttcccttcattagtctcgcctctaagaaaaaggagaagagtaagccttatcctggtgctgaactgagtagcatgggtgctatcgtgtgggccgtgcgcgctgaggattataacaaggctatggagctcgattgccttctaggcatctccaacgagtttattgtgttaatagaacaggagaccaaatccgttgtttttaactgttcttgtcgggacgtgatcggctggaccagtaccgacactagcctgaaaattttttatgaaaggggcgagtgcgtttcagtcggttcatttatcaacattgaagagatcaaagagattgtgaagcggctacagttcgtctcgaaagggtgtgaaagtgtggaaatgactctccgcagaaatgggctcggtcaacttgggtttcacgtgaactatgagggaatcgttgccgacgtcgagccttacggatacgcatggcaagccggactgagacagggatctaggctcgtagagatttgcaaagttgcagtggccacgctgagccatgaacagatgattgacctgttaaggaccagtgtgacagtaaaggtggttattatccctccccatgacgattgtactcctcgcaggtcctgtagtgagacgtatagaatgcctgtgatggagtacaaaatgaacgagggggtgtcctatgaattcaagttcccgttcagaaacaacaacaagtggcagaggaatgcatctaagggcccacatagcccccaagtaccctcccaggttcagagtcccatgacgagtcggctgaatgcaggtaaaggagacggaaagatgcctcctcccgaacgcgctgcaaacattcccaggtctataagctccgacggcagaccgctcgagcgcaggctcagccccggttccgacatttatgttaccgtcagctctatggctttagctcggtctcagtgtaggaatagcccaagtaatcttagctcctccagcgatactggaagtgtgggcggaacgtaccgtcaaaaatccatgccagaaggcttcggcgtaagccgaagatcacctgcatctattgatcgtcagaacacccaatccgacattgggggatctgggaaaagcacaccgagctggcaacgctctgaggattcgattgcagatcaaatggaacctacgtgtcatttaccagccgtaagtaaggtgttgcctgcgtttagggaatccccctctggacgattaatgagacaggacccagtggttcacctgtcaccaaacaaacagggacattctgattcccattactcatcccacagctcctccaatacactctcttccaacgcctcatccgcccacagcgatgagaagtggtacgacggcgataggacagaatcagagctaaatagctacaattaccttcagggcaccagtgccgacagtggaatcgacacgacatcatacggtccgagtcatggatccacagccagcctgggcgctgccactagctcccctcgcagtggccctgggaaagagaaagtggctcctctgtggcactcttccagcgaggtaatttcgatggccgatcggacacttgagacagaatcgcacggtttggatagaaaaacggagtccagcctttccctggacattcacagcaaatcacaggctggtagtacccccctgacaagggagaacagcaccttctctattaatgacgccgcaagtcacacatcaaccatgtcttccaggcactcagcctcaccggtagtcttcacaagcgcccgatccagtccaaaagaagagctccatcctgccgcaccgtcccaactagctcccagtttctcctcctcatctagctcctcaagtgggccaagatctttttaccctcgccagggcgcaacttcaaagtacctcatcggctggaagaagcccgagggcactattaattctgtaggttttatggacacacgtaagagacaccagagcgacggaaacgagattgcacataccagattgcgtgccagtaccagagacctaagagcatctccaaaacctacctccaagagcaccatcgaggaggatctgaagaagcttatagacttggagtctcccacacccgagtctcagaagagcttcaagtttcacgcactgagctccccccaaagcccttttcccagcactcctacatcccgacgtgctttgcaccgtaccctttctgacgagtccatctacaattcacagcgcgaacatttcttcactagccgcgcttcacttcttgaccaggctctgcccaatgacgtcttgttctccagcacttatccatctctgcccaagtctctcccactgcgtaggccaagctacaccctgggtatgaaatcgctgcacggcgagttcagcgccagcgactcgtcgctgactgatattcaggagactcgaaggcaacctatgcctgaccccggacttatgccactgcccgacactgccgctgatctggactggagcaatctggtcgacgctgctaaggcatatgaggtgcaacgggcaagcttcttcgccgcatcagacgagaatcataggcctctctcagccgcttccaactctgatcagctcgaagatcaggctcttgcgcagatgaagccttacagctcgaaagacagctcgcccactctggcctccaaagtggaccagctggaaggcatgctgaagatgctgagggaggatctgaaaaaggagaaggaggataaggcacacctacaggccgaagtgcagcacttgagggaggataacctcaggctccaggaggaatctcaaaacgcttccgacaaactcaagaagttcacagaatgggtgttcaataccatcgacatgagttag

SEQ ID NO: 54013 - DNA, 5414 bp, Artificial Sequence
  Description of Artificial Sequence: Synthetic coding sequence
atgaccagccttaagaggtctcaaacagaaagaccgctggcgacggatagagcttccgtcgtaggtactgatggcacaccaaaggtgcatactgacgatttctacatgagacgattccgcagccagaacggatctcttggctcttctgtaatggccccagtgggaccccctcgcagcgagggatcacaccatatcacctccacccccggagtccctaagatgggggtgcgggctcgtatcgccgattggcctccgaggaaagagaacatcaaggaatcttccagatcttcacaagagatcgaaacctcctcttgtctggactcattgtcttccaagtccagtccagtgagccagggcagctcagtgtcgctcaacagcaatgactcagcaatgctgaaaagtatccagaatactctgaagaacaagacgcgcccatctgaaaacatggattcacgcttcttgatgccggaggcgtatccaagttcgccacgaaaggccctccgtcggatccgacagcgaagcaactccgatattacaatctcagaattagacgtagactcttttgatgagtgcatctctcctacctacaagacaggcccaagtctgcatagggagtatgggtcaacaagctctatagataagcagggtacttctggggagagtttcttcgacctgctgaaaggatataaagatgataaatctgacagggggccaacacctacaaagctcagcgattttctgatcacagggggaggaaagggctcaggattttcactggatgtgatcgacgggcctatctcccagcgagagaacttacggttgtttaaggagagagaaaaacctctaaagcgcaggtcaaaatcagaaacgggagattccagcatctttcgcaaactgcgaaacgctaagggagaagaactcggtaagagcagcgatcttgaagacaacaggtcggaggattccgtccggccttggacctgtcccaagtgtttcgctcactacgacgtgcagagcatccttttcgacttgaacgaggctataatgaatagacataacgtcataaagcgcagaaacacgactaccggggctagcgctgctgctgtggcgagcctagtgtcgggtcccctatcccatagtgcatctttttcttcccctatgggcagcacggaggatctgaattccaaaggcagtcttagtatggaccagggtgacgacaagagcaatgaactagtcatgagttgtccatactttcggaatgagattggcggtgaaggcgagcgtaagatttcactctcaaaatccaatagtggctctttctcaggttgcgaatccgcctcattcgagtccaccctttccagtcattgtactaatgctggggtggctgtgcttgaggtgcccaaggagaatctggtactgcatctggatcgggtaaagcgttacatagtcgagcacgtggatttgggggcttactattatcgcaaatttttctatcagaaagaacactggaactactttggcgcagacgaaaacctgggaccagttgccgtgtccatcaggagagagaaaccagatgagatgaaggagaatggatctccctacaattatcgcatcattttcaggaccagcgaactcatgacgctccgaggctccgtcctagaagatgccataccatctacggccaaacactcgacggctaggggcctcccacttaaggaggttctggagcatgtggtgcccgagctaaatgtgcaatgcctgagactcgcgttcaacaccccaaaagtgaccgagcagttgatgaagctcgacgaacaagggcttaactaccaacaaaaagtgggcattatgtactgcaaagcgggacagagtacagaggaagagatgtacaataacgagtctgctggaccggcatttgaagaatttctgcagctgcttggagagcgcgtgcggcttaaagggttcgaaaaataccgcgcacagctcgataccaagacagattctaccggtactcatagcctgtataccacctacaaggactacgaaatcatgtttcatgtctctaccatgctcccatatactccaaataataaacagcagctgttgcggaagcgacacattggaaacgatatcgtgactatcgtgtttcaggagcctggcgcacaaccgttctctcctaagaacattcggtcgcactttcagcacgtattcgtgatagtgcgggtccacaacccgtgttctgattcagtgtgctactccgtagcagtgactcggagccgcgatgtgccatcgtttggcccacccatccccaagggggtcacctttcctaagtccaatgtgtttcgcgattttctgctcgcgaaggtcatcaacgccgaaaatgctgctcataagtcagaaaagttccgggcaatggctaccagaacacggcaggagtatctgaaggatctggcggagaagaatgtcaccaatacacctatcgatccaagtgggaaattcccttttatctccttggccagcaagaagaaagagaagtctaagccttatcctggcgctgaactgagtagcatgggtgccatcgtctgggcggtccgggctgaggactataataaggctatggagttggattgcttgctaggaatctccaacgaattcatcgtgttgatagaacaagagactaagagcgtggtcttcaactgcagctgtcgggacgtcatcggctggacgagcacagatacatcgctcaaaattttttacgaacggggagagtgtgtgtctgtgggcagctttattaacatcgaagagataaaggagatcgttaaaagactgcagttcgtctccaaaggctgcgagtccgtggagatgacacttcgcagaaacggactcggccaactgggtttccacgtgaattatgagggcattgtagcggacgttgagccttatggctatgcctggcaagcaggattaagacaaggaagcagacttgtagaaatttgcaaggtggccgttgcgaccttgagccacgaacagatgattgacttgcttagaaccagcgtcactgtcaaagtcgtcatcattccccctcatgacgattgcacacctcgtaggtcttgcagcgaaacctatcgcatgcctgttatggagtacaagatgaatgagggcgtgagctacgagttcaagtttcctttcagaaataataataagtggcaaaggaacgctagtaaaggccctcactctccgcaggtgcccagtcaagtgcagtctcccatgacaagcagactgaacgccggaaagggcgatggcaaaatgcctccaccagagcgggctgcaaacatccctcgaagtatttcgtccgacggccgtccattggagcgacgattaagccccggaagcgatatctacgtaacggtgtcatccatggccctggcccgtagccagtgcaggaattccccctcaaacctgtcgtcctcctctgatactgggtcagtgggaggtacctaccggcaaaaaagtatgcctgagggtttcggcgtgagtagaaggtccccagcatcgatcgaccggcagaatacccagagcgacatcggcggttcagggaagtctaccccgagctggcagcgcagtgaagactcgattgccgaccaaatggcctattcatatagaggaccacaggacttcaatagcttcgtcttggaacagcatgagtatacagagccaacctgccacctgcctgctgtcagcaaggtcctgccggcttttagggaatctccgagcgggaggcttatgcgacaggaccctgtcgttcatctctcccccaacaagcaggggcacagtgattcccactatagctcgcactcaagtagcaacactctttctagtaatgccagtagcgcccactctgacgaaaaatggtacgacggcgatcgcaccgagtctgaactgaactcatataactacctacagggaactagtgccgattcaggaatcgatactacatcatacggaccctcccacggcagtacagcatcactgggcgctgctacaagcagtccaaggtccgggccaggaaaggagaaggtggctcctctatggcattcgtcgtcggaagttatttccatggccgacaggacattagaaaccgaaagccacggccttgacagaaaaaccgaatcaagcctttcactggatattcacagtaagagccaagctggaagcaccccactaacgagagagaactcaacattcagtattaacgacgccgcatctcacactagtactatgtcttcaagacactccgcttcccctgtggtctttacctcggcgagatcatctccaaaagaagaactccatcctgctgccccaagtcagcttgccccatcgttcagcagctctagttcatcaagctcggggcctagatccttttacccccgacaaggggcaacatcgaagtacttaattggctggaagaagccggaagggaccatcaattccgtgggcttcatggacacccggaagcggcatcagtcggacggcaatgagattgcccacacccggctccgagcgtccaccagggatttacgagcctcacccaaacccacatccaagtctactatcgaggaggaccttaagaagcttatcgacctggaatctccgacccccgagagccagaaaagctttaaattccacgcattgtcatcgccccagtccccattcccaagcacccccacctcacgccgtgcgctgcatcggacgctctccgacgaatccatctacaactcccagcgcgagcacttctttaccagccgggctagcctactggatcaggccctgcctaatgacgtgctcttcagttccacctaccccagtcttccaaagagcttgcccctgagacgtccctcttacacattgggtatgaaaagcctccacggggagtttagtgcatccgactcatcactgaccgatatccaggagacaaggagacagcccatgccggatcctgggctcatgccactgcctgataccgcggcagacctggactggtccaatcttgtagacgctgctaaagcatacgaggtgcagagagccagcttctttgctgcttccgacgaaaatcaccgcccactgtctgcggcaagcaacagtgaccagctggaagaccaggccctggcccagatgaagccttatagctcaagtaaagatagttctcccactcttgctagtaaggtcgatcaattggaagggatgctgaagatgttgcgcgaggacctgaagaaagagaaggaagacaaggctcacctgcaagccgaagtacagcacctgagagaggataatctgcggctgcaggaagagtcacaaaatgcttcagacaagttgaagaagtttacagagtgggtcttcaatacaatcgacatgtccta

SEQ ID NO: 54014 - DNA, 591 bp, Artificial Sequence
  Description of Artificial Sequence: Synthetic coding sequence
atgaaccaagcagaccctagactgagagctgtctgcttatggacactgacttctgccgcaatgagccggggtgacaattgcacagatctactggcactcggtattcctagcataacacaagcctggggtctgtgggtgttgctgggagccgtgaccctcctattcctgatatctttagcggctcacctcagtcaatggactagaggtagatctaggtcccacccaggccaaggacgatccggggagagtgtggaggaagtgcctttatatggaaatctgcactacctacagactggcagactctcccaagatcctgagccggatcagcaggacccaacactgggtggtcccgcaagggccgcagaggaggtgatgtgctatacttcccttcagctgagaccccctcaggggaggatcccagggcctggcactccagtgaaatatagtgaggtcgtgctcgacagtgagcccaaatcacaggccagtggccctgaacccgagctgtacgcatctgtctgtgcccagactcgtcgagcgagggccagctttccagatcaagcttatgccaactctcaaccagctgcctcctag

SEQ ID NO: 54015 - DNA, 1515 bp, Artificial Sequence
  Description of Artificial Sequence: Synthetic coding sequence
atggagcccgctggacccgctcctggcaggttaggtccgctgttatgccttctcctggccgcttcctgcgcgtggagcggagtcgccggtgaagaggaactgcaggtgatccaacctgataagagtgtgctggtggctgccggagagacagccacgcttagatgcaccgcgacctccctcattcctgtgggcccaatccagtggtttcgaggcgctggacctggaagagaactgatttacaaccagaaagagggccacttcccccgagtgaccaccgtgtcagatttgactaagcgaaataatatggacttctctattcgtattggaaatatcacaccagcagatgcagggacctattattgtgtaaagtttaggaagggctcccctgacgatgtagagttcaaatctggtgccggtacggaactctctgttagagccaaaccgtccgcccctgtggtctccggacctgctgcacgagccacgccgcagcacacggtatctttcacgtgcgagagccatggcttctcacccagagacatcacgctcaaatggtttaaaaatggtaacgaactcagcgatttccaaacaaatgttgaccccgtaggcgaatccgtgagctactcgatccattccacggcaaaagtcgtgctcacacgagaagacgttcatagccaggtaatctgcgaagtagcacatgtgacgctccaaggcgatcccctgagaggcacagccaaccttagcgagacaatccgtgtgcctcctacccttgaggtcacccaacagcctgttcgagctgagaaccaggtgaatgtcacttgtcaagtgcggaaattctaccctcagcgtctacagctgacgtggctcgagaatgggaacgtctccaggaccgagaccgcctcgacagtgacagagaataaagacggcacatacaattggatgtcttggctcttagtgaacgtgagcgctcaccgagacgacgtcaaactgacgtgtcaggttgagcacgatggccaaccagccgtgtcaaagagccacgacctgaaagtcagcgcccaccctaaagaacagggtagcaacaccgctgcggaaaacaccgggtccaatgaaagaaacatctacatagtggtgggtgttgtttgtaccttgctggtggcattgcttatggccgcactgtatctcgtacggatccgccagaaaaaagcacagggctcaaccagtagcactcgactgcacgagccagagaaaaacgcaagagagattacccaggatactaatgacatcacttacgccgacttgaaccttcctaaaggaaagaagcctgctccccaggcagcggaaccaaacaaccacacagagtatgcaagcatccagacgagtccccaacccgcatctgaggatactcttacctacgccgaccttgatatggttcatctcaatcggactccgaaacagcctgccccaaaaccagagccgagcttttctgaatacgccagcgtccaggttccgcgaaaatag

SEQ ID NO: 54016 - DNA, 1515 bp, Artificial Sequence
  Description of Artificial Sequence: Synthetic coding sequence
atggagccagccggacctgcccctggacgacttggcccactgttgtgtcttctcctggctgcttcctgtgcgtggagcggagttgccggtgaggaagagctgcaggtcattcaacctgacaaatcggtcttggtggccgctggcgaaacggcaacactgaggtgcaccgccaccagcctgattccagtcggacccattcaatggttcaggggcgcaggacccggtagagaactgatttataaccagaaagagggtcacttcccccgagtgactacagtctccgatctcaccaaacggaacaacatggacttctccatacgtattggcaacatcacaccagccgatgcaggcacatattattgcgtgaagtttcgcaagggctccccagatgatgtagaattcaaatcaggagccggtactgagttatccgtccgtgcgaagccatctgcccctgtggtttcaggcccagctgccagggctacgccacaacacaccgtcagctttacttgcgagtcccatgggttttctcctcgggacatcactctgaaatggttcaagaacggtaatgagttaagtgattttcagacgaacgtggacccagttggcgagagcgtctcctacagcatacattcaaccgccaaggtagtccttacacgcgaggatgtccatagccaggtcatatgtgaggtagcccatgtgaccctgcagggtgatccactccggggaacagccaatctgtcagagacaatccgtgtcccacctacattggaggtgacacagcagcctgttagggctgagaatcaggttaacgtcacgtgtcaggtgcgcaagttttatccccaaagactgcagcttacatggctggagaatggtaatgtttcccgcaccgagacagcaagtacagtgaccgagaacaaagatgggacctacaactggatgtcctggctgttggtcaatgtgtcggcacacagagacgacgtcaagctgacctgccaagttgagcatgacggacaaccagccgtgtctaaaagccatgacctaaaggtctcagcccatcctaaggaacagggctctaacactgcagcagagaacaccggttccaacgagagaaacatatacatcgtggtgggtgtggtatgtactctgctcgtcgcactactcatggcagccctttatctagtgaggatccgccaaaaaaaggcccagggcagcactagttccaccagacttcatgagcctgaaaaaaacgcacgggaaatcactcaggacacgaatgacattacatatgcagatctgaatctgcccaaaggtaagaagccggcaccacaggccgcagagcccaacaatcataccgaatacgcttccatccagacctctcctcaaccggcttctgaggataccctgacgtatgcagacttggacatggtccacctcaatagaaccccaaagcagcccgcaccgaaacccgagccctcatttagcgagtacgcatccgtgcaggtccccaggaaatag

SEQ ID NO: 54017 - DNA, 1527 bp, Artificial Sequence
  Description of Artificial Sequence: Synthetic coding sequence
atggagcccgcagggccagccccagggaggctcggtcccctgctgtgcctgctacttgctgcgagctgcgcatggtctggggtcgcaggcgaagaggaactccaggtcatacagccggacaagagcgtgctggtcgccgctggggagaccgccaccctcaggtgcaccgctacaagcctgatccctgttggaccaattcagtggtttaggggagcaggacccggtagggaactgatttacaaccaaaaggaggggcatttccctcgggtcaccacggtatctgacttaacgaagcggaacaatatggacttcagcatcaggattggtaatatcactccagctgacgccggaacctattactgcgtcaaatttcggaagggttcacccgatgatgtcgaattcaagagcggcgctggtaccgagttaagtgtgcgggcaaaaccttcagctcccgtggtctctggaccagccgcacgagctaccccacaacacacagtctcgtttacatgtgagtcacatggattctctccgagagacatcacgttgaagtggttcaagaacggtaatgagctgtcagacttccagactaacgtcgaccccgttggtgagagtgttagttattctatccattcaaccgcaaaggttgttctgacccgcgaggacgtgcactcacaggtgatttgcgaagtcgcacacgtcacactgcagggggaccctctccggggaaccgcaaacctgtctgagactatacgagttcccccaacgctggaagttacacagcaacctgtcagagcggagaatcaagttaatgtgacttgccaggtccggaagttctacccccaaaggctccagctaacatggcttgagaacggcaacgtgagtagaaccgagaccgctagcacagtgacagagaataaggacggcacctacaactggatgtcttggctgcttgtgaatgtgtccgcgcaccgggacgatgtgaaattaacctgccaggtcgaacacgatggtcagcctgcggtgagtaaatcacatgatctgaaggtgtccgcccaccctaaggaacagggcagcaatacagccgcagagaacaccggttccaatgagaggaatatttacatcgtggttggcgtcgtgtgcactctacttgtggcactgttgatggctgccctctatctcgttaggatacggcagaaaaaggcccagggctctacctcatctactcggttgcacgaacccgagaagaacgctagagaaatcacacaggtccagtctctcgacacgaatgacatcacctatgcagaccttaacctgccaaaggggaagaaacctgctccccaggctgccgaacctaacaatcacacggaatacgccagtattcagacctcccctcagcccgcttctgaagacacactgacctacgcagacttagatatggttcacctgaacaggacccctaaacagccagcaccgaaacctgaaccgagcttctcggagtacgccagtgtgcaagtacctagaaagtag

SEQ ID NO: 54018 - DNA, 543 bp, Artificial Sequence
  Description of Artificial Sequence: Synthetic coding sequence
atgccagtccctgcctcctggcctcaccccccatgcccattcctcctactcaccctcctgttgggccttaccggcgtagccggagaggatgagctccaggtgatccaacccgaaaagtcagtgagcgttgcagccggtgagagcgcaacactacgatgcgccatgactagcctgatccctgtgggccctatcatgtggttccgaggagctggagccggtagagagctgatctacaatcaaaaggagggacattttcctagagtgaccacggtctccgaactgacaaaacgaaataatctcgactttagcataagcatctccaacatcacacctgcagacgcagggacatattactgtgtgaaattcagaaagggcagtcctgatgatgtggagttcaagtcaggggcaggcacagaactgtccgtccgtgaggcggctctggcgccaacggctcccctgctggtggctctattactgggtcccaaattattgctagtggtgggtgttagcgcgatttacatttgctggaaacagaaagcttag

SEQ ID NO: 54019 - DNA, 1197 bp, Artificial Sequence
  Description of Artificial Sequence: Synthetic coding sequence
atgcccgtacctgccagctggccacatctgccgtccccctttctcctcatgaccctgttgttggggagacttacaggagtggctggggaggaagaacttcaggtgattcagccagacaaatcaatctcagtagccgctggcgagtctgccacgctccactgcactgtgacctctcttattcccgtgggacctatccaatggtttaggggggctgggccaggcagagagttgatttataatcagaaagagggacacttccccagggtgacaaccgtcagcgacctgaccaagcggaataacatggatttctcgatccgtatttcaaacatcaccccggcagatgcagggacttattactgcgtgaaatttcgaaaaggctccccagaccacgtcgagtttaaatcaggggctggcaccgaactgtctgtcagagctaagcctagcgcccctgtcgtctctggccctgccgcacgcgctacccctcagcataccgtctcatttacttgtgaatcccatggattcagcccacgcgatattaccctcaagtggtttaagaacgggaatgagttatctgattttcaaacgaatgtggatcccgcaggtgattctgtctcatacagtatacactcaacagcgaaagtagtgctgacacgcgaggatgtgcactctcaggtaatctgtgaagtggcccacgtaacacttcaaggagaccctctgaggggcaccgctaatcttagcgagaccatcagagtccccccaacactggaggtaacccaacaaccagtccgtgcggagaatcaggtgaacgtaacatgccaggtgagaaaattctatccacagagactacagctcacctggctggaaaacggcaacgtttccagaactgaaaccgcatcaaccctaactgaaaacaaggacgggacttacaactggatgagctggcttttggtgaacgtatcagctcacagagatgacgtgaagctgacctgtcaagtggaacacgacggccagcccgctgtatctaagagccatgacctgaaggtgagcgctcatcccaaggagcaaggatccaatacagccccaggtcctgccctggcgtcggccgctccgctgttgatagctttcttgttgggtcccaaagtgttactggtggtgggggtgagcgtgatatatgtatattggaaacaaaaggcatag

SEQ ID NO: 54020 - DNA, 519 bp, Artificial Sequence
  Description of Artificial Sequence: Synthetic coding sequence
atgccagtgcccgcaagctggcctcaccttccatcccccttcttgctgatgaccctgcttcttgggcgactcactggagtcgcaggagaggaagagctacaggtcattcaacccgacaagagcatcagcgtggcggctggggagagtgctactctgcattgcaccgttacttcactcatccctgtgggcccaatccaatggttccggggagctgggcctggacgtgagctgatctacaatcaaaaagaaggacactttcctcgagtaaccaccgtctctgaccttactaaacgaaacaacatggatttttcaatacggatatccaacatcactcccgctgatgcagggacctactattgcgtaaaatttcgtaagggaagtccggaccacgtcgaatttaaatctggtgcgggaaccgagctgtcggtcagagttctgcaggttaaggagattaaaatccctagaaccttagcaagcgtcgttatacaggtgtatttacttcaacatcccgtcgcgtag

SEQ ID NO: 54021 - DNA, 546 bp, Artificial Sequence
  Description of Artificial Sequence: Synthetic coding sequence
atgcctgtacctgcttcatggccccacctcccctcccctttcttacttatgactttgctactcgggagactaactggagtagctggtgaggatgagttgcaggtaatccaacctgagaaatcagtctctgtagcagcgggtgagtccgctaccctccgttgcgcgatgacatctctgatccctgtagggccaataatgtggttcagaggcgcaggcgctggacgagagctaatctacaaccagaaagagggtcacttccctagagtaacaaccgttagcgaactaactaagcgtaataatcttgactttagcatcagcataagtaacatcactcctgctgatgccggaacatactattgcgtgaagtttcgcaaagggtcacctgacgacgtcgagtttaagagcggcgctggcaccgaattaagcgtgcgagaggcggcactcgctccaaccgcgcctctccttgtggcactgttgctgggaccaaaattgctactggtagtgggcgtctccgctatttacatctgttggaagcagaaggcctag

SEQ ID NO: 54022 - DNA, 1197 bp, Artificial Sequence
  Description of Artificial Sequence: Synthetic coding sequence
atgccagtaccagccagttggccacaccttccgagtccttttctactaatgactctactgttagggaggttgactggggttgctggtgaggacgaactccaggttatccagcccgaaaagagtgtctctgtggcagcaggggagagcgcaactctacggtgtgcaatgacctccctaatccccgtaggccctataatgtggttccgtggggctggcgcagggcgtgaattgatctacaatcagaaggagggccattttccacgtgtaacaacagtgtcagagctgacgaagcggaataacctagactttagcatttcaattagtaatattacgccggcagacgctgggacatactattgcgtgaagtttagaaaaggaagccctgacgacgtagaattcaagtcaggggctggtaccgaactcagcgtccgggcaaagccgagcgcccctgtggtgtctggccctgcagtgcgcgcaactcctgagcataccgtttcctttacatgcgaaagccacggcttttcaccacgcgatatcactttgaagtggttcaagaacggcaatgagctgtctgattttcagacaaacgttgatcctgctggcgactcagtttcgtatagtattcacagcaccgcccgagtcgtcctgacccgcggagacgtgcactcccaagtgatctgcgagatcgctcacataaccctgcagggcgacccactaagagggacagccaacctgagcgaggctatcagagttcctcctacattggaggtcacccaacagcctatgcgggcagaaaaccaggccaatgtcacctgccaggtcagcaacttctatcctcgagggctgcagctgacatggcttgagaatgggaacgtctctagaactgagacggcctctaccctgattgagaataaggatgggacttacaattggatgagctggctcctagtgaacacctgtgcacatcgcgatgatgtcgttctgacttgtcaggtggagcacgacggtcaacaagcagtgtccaagtcctacgcactagagatttcggcccaccagaaggagcacgggagcgatattacccatgaggcagctctggctcctaccgctccattgctagtagcactgctgctgggcccaaagcttcttctggtcgttggcgtgagtgccatttacatttgctggaaacagaaggcgtag

SEQ ID NO: 54023 - DNA, 519 bp, Artificial Sequence
  Description of Artificial Sequence: Synthetic coding sequence
atgcttgccgctggggtcggtggacagggggagaggctggccggaagacgaagaaagatggcagtggaaagccgggtgacccaggaggagatcaagaaggaaccagagaagcctattgatagggaaaagacatgtccccttctcctgcgggtttttaccactaataacggcaggcaccataggatggatgaattcagccggggaaacgtgccttcttctgagttgcagatatacacctggatggacgccactctcaaggaactgacgtccctggtcaaagaggtctaccctgaggcccgtaagaaaggcacacattttaattttgctatcgtctttaccgatgtgaagcgccctggctaccgcgtgaaggaaattggttctactatgtctggccgaaaaggcacagacgattctatgaccctgcaaagccaaaagttccagatcggagactacctggacattgctatcacccctcccaatagggcccctccacctagcggcaggatgaggccatattag

SEQ ID NO: 54024 - DNA, 1020 bp, Artificial Sequence
  Description of Artificial Sequence: Synthetic coding sequence
atggaatcccggaaggatataaccaatcaggaggaactctggaaaatgaagcccagaagaaacctcgaagaggatgactacctccacaaagacacgggggagactagtatgctcaagaggcctgtgctgctgcacttacatcagactgcacacgctgacgagttcgattgtccaagcgaactccagcacacccaagaactttttccccagtggcacctgcctattaaaattgccgcaatcatagccagtcttacatttctgtacacactcctgagggaggtgatccatcccctggccacaagccaccagcaatacttctacaaaatccccatactggtaatcaacaaggtgctccctatggtatccatcacgcttttagcgctagtttacctgccgggtgtaatcgctgcaattgttcagctgcacaacggaacaaagtacaaaaagttccctcactggctcgataaatggatgctcacaaggaagcagtttggtctgttgtcctttttctttgcagtcctgcacgctatctactctcttagctatcccatgaggcgaagctatcgatacaagctgctgaattgggcctatcagcaggtgcagcagaataaagaggacgcctggatagagcacgacgtgtggcggatggagatttatgtgtcattgggaattgtgggtttagccattttggcactgttggctgtgaccagcatcccctcagtctccgatagccttacatggagagagttccactacatccagagtaagctcggcatagtctcactgcttctggggactatccacgccttgattttcgcttggaataagtggattgacataaagcaattcgtgtggtacacaccccctacttttatgattgctgtgttcctgccaatagtcgttctgatattcaagtccatcttattcttaccatgcctccggaagaagatcctgaaaatcagacacggatgggaggacgtgacaaaaattaataagactgagatttgcagtcagttgtag

SEQ ID NO: 54025 - DNA, 597 bp, Artificial Sequence
  Description of Artificial Sequence: Synthetic coding sequence
atgtgcgcatttccctggctcctcttacttcttctcctgcaggaggggtcacagaggcgtctatggagatggtgtggatcagaggaggtggttgctgtgttgcaggagagcatttctctcccacttgaaatcccaccggacgaggaagttgagaatataatttggagcagccacaaaagtctggctacagtcgtgcccggtaaggaaggccatcctgctacgatcatggttaccaatccccactaccaaggccaagtctcatttctagacccctcatacagtttacacatcagtaatctttcatgggaggattctggactgtaccaggcgcaggttaatctgcgaaccagtcagatcagcactatgcagcagtacaatatctgtgtgtaccaccccaactacgcatctgaaaagcccagtactgctttttgccttctcgccaaaggactgctaatcttcttgctgttagtgattctggctatgggactctgggtgatacgggtccagaagcggcataagatgcctcgaatgaaaaaactcatgcggaatcgcatgaaactgcggaaagaggcaaaacctggctctagtcccgcatag

SEQ ID NO: 54026 - DNA, 870 bp, Artificial Sequence
  Description of Artificial Sequence: Synthetic coding sequence
atgtgcgcattcccttggctactgctccttttactgctccaggaaggaagccagcgacggctgtggcggtggtgcgggagtgaggaagtcgtggccgtgctgcaagagtcaatcagtctgcccctcgaaatcccgccagacgaggaggtcgagaatatcatttggtcttctcacaaaagccttgccacggtcgtgccgggaaaggagggacatccagccactattatggttaccaatccacactatcaaggccaggtgtcatttctggatccaagttactcactccatatcagtaatctctcatgggaggacagtgggctataccaagctcaggtgaatctgaggacctctcagattagcaccatgcagcagtataacatttgtgtgtaccgctggctgagcgagcctcagatcacggtgaactttgagtcttccggcgaaggggcatgctccatgagtctagtgtgcagcgtagaaaaagccggaatggacatgacatacagctggttgagcagaggcgattcaacctataccttccatgaggggccagtgctctctacctcttggcggccaggggactctgccctctcctatacatgccgagccaataaccctatctccaacgtgtcctcctgtcccataccagatggacccttctacgccgatcccaattacgcctcagaaaaacctagcactgcattttgtctattagccaaaggcttgcttattttcctgctgctggtcatactggccatgggactgtgggttattcgcgtccagaaaaggcacaagatgcctcgcatgaagaaactgatgaggaatagaatgaagttacgcaaggaggcaaagcctgggtctagccccgcatag

SEQ ID NO: 54027 - DNA, 519 bp, Artificial Sequence
  Description of Artificial Sequence: Synthetic coding sequence
atgaaaatctggagcagtgagcacgtgttcggacacccgtgggatactgtcatacaggctgccatgcggaagtacccgaatccaatgaatcccagtgtgctgggcgtagacgtcctacagaggagggtcgatggacgcggaaggttgcatagcctgagattgttgtccaccgagtgggggctcccatctctagtccgggctatcctggggacctcaagaacgttgacgtatatcagggagcactccgtggtcgatcccgtggaaaagaaaatggagctttgcagcacgaatataactttgaccaacctcgtgagcgttaatgagagactggtgtatacgccgcacccagagaaccctgagatgaccgttttaacccaggaggctatcatcaccgtcaaaggcatttccctgggtagctacctggagtcgctgatggcgaacacgatcagctccaacgccaagaagggctgggctgcaattgagtggattattgagcactcagagagcgctgtgagctag

SEQ ID NO: 54028 - DNA, 519 bp, Artificial Sequence
  Description of Artificial Sequence: Synthetic coding sequence
atgaaaatctggagtagcgaacacgtgtttgggcatccatgggacacagttattcaggctgcgatgcggaaatatcctaatccaatgaatccaagcgtgttaggcgtggatgtcctgcagcgccgagtggacggacgtggcaggctgcacagtctgagattgctgtcaacagagtgggggctgccctcactggtgcgcgcaatactgggtacaagtcgaactttgacctacattagagaacacagtgtggtcgacccagtggaaaagaaaatggaactgtgttctaccaatataacgctcaccaatttagtttctgtgaatgaacgcctcgtgtatacccctcaccctgagaaccccgaaatgactgtgctgacgcaagaggcgatcattacggtgaagggaattagtctgggcagctaccttgaatctctcatggctaatacgattagtagtaatgctaaaaagggatgggccgcaattgagtggatcattgaacattctgaatccgccgtgagctag

SEQ ID NO: 54029 - DNA, 585 bp, Artificial Sequence
  Description of Artificial Sequence: Synthetic coding sequence
atgaagatttggacaagcgaacatgtctttgaccatccctgggaaactgtgactactgcggctatgcagaagtatccgaatcccatgaacccgtctgtggtgggggtcgacgtcctcgataggcacattgaccctagtggaaagctgcactcccatcggctgctgtcaacagagtgggggctgccttccatcgtgaagagtctgatcggagctgcccgaacaaagacttacgtccaggagcactccgtggtggaccctgtggagaagactatggagctgaaaagtactaatataagcttcactaatatggtcagcgtcgacgaacggctgatttacaaaccacacccgcaggatcctgagaagacagtcttaacgcaggaggcaatcatcaccgtgaaaggcgtctctctttcatcgtacctggagggactcatggcttccaccatatcttccaacgcctcaaagggacgtgaagccatggagtgggtgattcacaaattgaacgccgagatcgaagagctcactgcttctgccaggggaaccatccggacacctatggcggcagctgcctttgccgagaagtag

SEQ ID NO: 54030 - DNA, 2247 bp, Artificial Sequence
  Description of Artificial Sequence: Synthetic coding sequence
atgtcaaacccagggggtcgaaggaacggaccggtgaaattaagacttactgtactatgtgcaaagaatctggtcaagaaggacttcttcagactgccagatccgttcgctaaggtcgtcgttgatgggagtggccaatgccattcgacagacactgtcaaaaacacactcgacccaaaatggaatcagcactatgacttgtatatcgggaaatccgactctgtgacgattagcgtgtggaaccataagaaaatccataaaaagcagggcgctgggttcctgggctgcgtacgtctgctgagcaacgcaattaatcgtctcaaggatacgggctatcagcggttggatctatgtaaattgggcccaaacgataatgacacagtacggggtcagatcgtcgtgagtttgcagtctagagacaggattggcaccggtgggcaggtcgtggattgttctagactcttcgataatgatctcccggatggttgggaggaaagacggacagccagtggccgtattcagtacctgaatcatattactcgaactacccagtgggaaaggcccacacgcccagcctctgagtattcctctccgggacgacctttgagctgtttcgtggacgagaacacccctataagtggcaccaacggagctacctgcgggcaaagctccgaccctcgtctggcggaacgaagagtgcgatcccagagacatagaaactacatgtctcggacccacttacacaccccccctgatttacccgagggctatgagcagcggaccacccaacagggccaggtgtattttctgcacactcagacaggggtgagtacgtggcacgacccacgcgttccgcgagatctgtccaacatcaactgtgaagaactggggccactgccaccaggttgggagattcgaaacacggctacaggcagagtatatttcgtggaccacaacaacaggaccacacagttcaccgaccctaggctctctgctaatcttcacttggtcttaaacagacagaaccagctcaaggaccaacagcagcagcaggtggttagcttgtgtcccgatgacaccgagtgcctgacagtccctaggtacaaacgggaccttgtccagaagctcaaaattttgagacaggagctttctcagcagcagccccaggctggccattgtagaatcgaggtgagtagagaggagatctttgaggagtcttatagacaggttatgaagatgcgaccaaaggatctgtggaaaaggctgatgatcaaattccggggagaggaaggactggactatggaggggttgcacgcgagtggctctatctgctaagccacgagatgctgaatccctactacggactgttccagtatagcagagacgacatttacaccctccagattaatcctgactcagctgtgaacccagagcatctgagctatttccacttcgtcgggcgaattatgggtatggcagtatttcacggacattatatcgacggcggtttcacactgccgttttataagcagctgcttggtaagagcatcacgttggacgacatggaactggttgatcctgacctgcacaattcccttgtatggatccttgagaacgacatcacaggcgtgctggaccacaccttctgcgtggagcataatgcttatggtgaaatcatccagcatgaactaaagcccaatgggaaaagtattcctgttaacgaggaaaataagaaggaatacgtgagactctatgtcaactggaggtttttgcgtggaatagaagctcagttcctggccctgcaaaagggatttaatgaagtgataccccagcacctgctgaagacctttgacgagaaagagctggaactgatcatatgcggtctggggaagattgacgtgaacgattggaaggttaatactaggctgaagcactgcacccccgattccaatatagtaaagtggttttggaaggcggtggagttctttgacgaagaaaggcgggctagactactgcaattcgtcaccggatcctccagagtgccgctacagggatttaaggcgttacagggagctgccggaccccgtctatttaccatacatcagatcgacgcctgcaccaataatctgcctaaagcccacacttgtttcaatcgcatagacataccaccttacgagagctatgagaaattgtacgaaaaattgctgacagccatagaggaaacatgcggcttcgcagtggaatag

SEQ ID NO: 54031 - DNA, 294 bp, Artificial Sequence
  Description of Artificial Sequence: Synthetic coding sequence
atgacatcactgctcacaacccccagtccaagggaagaactgatgactacaccgatcctacagcccaccgaagcactgtctccggaagatggcgcttcaacagctttgattgcggtcgtgatcaccgtggtattcctcacacttctttcggtggtgatcctcatcttcttctatctgtataagaataagggaagctacgtaacctatgagcctaccgaaggtgagccctctgctatcgtgcagatggagtcagatctcgcaaagggttccgaaaaggaagaatacttcatttag

SEQ ID NO: 54032 - DNA, 294 bp, Artificial Sequence
  Description of Artificial Sequence: Synthetic coding sequence
atgacctcactcttaacaactcccagcccacgggaagaacttatgaccacccctatattgcagccaactgaggcgctgtctcccgaagacggggctagcactgcactgatcgctgtggtaattactgtggtgttcctgacccttttgtccgttgtgatattgattttcttctatctgtacaagaacaaaggctcttatgtgacgtatgagcctactgaaggggaaccgtccgcaatcgtgcagatggagtctgatctcgctaagggcagtgagaaggaggagtacttcatttag

SEQ ID NO: 54033 - DNA, 3282 bp, Artificial Sequence
  Description of Artificial Sequence: Synthetic coding sequence
atggcctcggcacccgctgaagctgagactagacagagacttttaagaaccgtcaagaaggaggtgaagcagattatggaggaggctgtgacgcgcaaatttgtgcatgaggattcgtctcacattatcagcttctgcgcggctgtcgaagcctgtgtgctgcatggcttgagaagacgcgcagccggatttctgaggagtaacaaaattgcagcccttttcatgaaggtaggtaagaactttcctccagctgaagacctgtctagaaaagttcaagaccttgaacaactcatcgagagtgcgcgtaaccagattcaggggctccaggagaatgtcaggaagttacctaaactacctaacctgagccccctggcaattaaacatctttggatccgtactgctctcttcgagaaagtgttggacaaaatcgttcattacctggtcgagaactcatctaaatattatgaaaaggaggccctccttatggatccagtggacggcccaatccttgcttctcttcttgtgggtccatgcgctttggagtacacaaaaatgaagacagcggaccacttctggacagatcccagcgccgatgagctcgttcaaagacacagaattcattccagccatgtgcgccaggactctccaacaaaacgacctgccctttgcatccagaagcgtcatagctccggctccatggacgatcgcccaagcctgagtgctagggattacgttgagagcttgcatcagaactcgcgggcaacgcttctgtacggcaagaacaatgtactggtacagccaagagacgacatggaggcagtccccggttacctgagcctccatcagaccgctgacgtgatgacactgaagtggactcctaatcaactgatgaacggaagcgtcggcgatctcgactacgagaagtccgtttactgggactacgccatgaccatccgactagaggagatcgtgtacctccactgtcaccaacaggtggatagcggcggaacagtggtgttggtgtctcaggatggaatccaacgccctccattccggtttccaaaaggcggacacctcctgcagtttctctcttgtctggagaatggactcctaccacatggacaactggacccgcctctttggagtcagcgcggaaaagggaaagtgtttcccaagttgcgtaaacgctcaccccagggctcagcagagtctactagctctgacaaagatgatgacgaggctactgactatgtgttccgaatcatttacccaggtatgcaaagcgaatttgtgccacaagatctcatggatgtctccgtgtccaatctgccctctctttggcagccatcaccacggaaatctagttgtagttcctgctctcagtccggatccgccgatggcagtagtaccaatgggtgtaatcatgagcgcgctcccttaaaactcctctgcgacaatatgaagtaccagattctgtcccgcgcattttatggatggctggcctattgccggcacttgtccactgtgaggacccacctcagcgctcttgtcaatcacatgatcgtatcacctgacctcccctgcgacgccggacagggtctcacggccagaatctgggaacagtaccttcacgacagtacgtcttatgaagagcaagaactgctgcggctgatttactatggcggaatccagcctgagatcagaaaggcagtttggcccttcctgttaggccattatcaatttgggatgacagaaaccgaacgaaaggaagtcgatgagcagatacatgcttgttacgcccagactatggcagagtggcttggatgcgaggctatcgtacgccagcgggagagggaaagccacgccgcagctctagcgaagtgttctagcggtgcatctctggattctcacctgcatcgcatgttgcacagggactcaactatcagtaatgagtcctcacagagctgcagctcaggtcgtcagaacattcgactgcactcagactccagctcatccacccaggtctttgaaagcgtggacgaggtcgaacaagtggaagcggaagggagactggaggaaaaacagcccaagatcccaaacgggaatcttgtaaacggcacgtgcagccctgatagtggtcacccctcatcccacaatttcagcagtggcctgagcgaacattccgaaccctctttgtcaacagaagattcggtactggatgcacagagaaacacccccactgtcctgaggcctagggatggaagcgtggatgatcgacagtcaagtgaagcgacaacctcgcaggacgaggcacccagggaggagctggcggtgcaagattccctagagtccgacctgctggctaacgagtctatggacgagttcatgtccattactggcagtctggacatggctttacccgagaaggatgatgtggtaatggaaggatggcggtccagtgagaccgagaagcacggacaggcggactccgaagacaacctgtcagaagagcccgagatggaatccttgttccctgctctcgccagcttggccgtcacaacatcggccaacgaggtgtcccccgtgagctcttctggggtgacctatagtcccgaattactcgacctgtacaccgtcaacctgcatcggatcgagaaggacgtgcagcgctgtgataggaactattggtacttcacacccgcaaacctggagaagcttaggaacattatgtgctcgtatatttggcagcacattgagatcggttatgtccaggggatgtgtgacctcctcgcccctttgttggtcatcctggatgatgaggccctggcttttagctgtttcacagaacttatgaagaggatgaaccagaatttcccacatgggggtgctatggacacccacttcgcgaacatgcgaagtctgatccagattctagattccgagctgtttgagcttatgcaccaaaacggcgactacacccacttctatttttgttaccggtggtttttgctcgatttcaagcgcgagcttgtgtatgacgatgtctttctggtgtgggagaccatctgggcggctaaacacgtctcatcagcgcactatgttttgtttatcgcactggcgctagtggaagtgtatagagacatcattcttgaaaataacatggacttcaccgatattatcaaattctttaatgaaatggcagaacggcacaacaccaagcaagtcctgaagctggcccgagatctcgtgtacaaggtgcagacccttatcgagaataagtag

SEQ ID NO: 54034 - DNA, 3447 bp, Artificial Sequence
  Description of Artificial Sequence: Synthetic coding sequence
atggcaagcgctcccgcagaggcagagacgagacaacgcctgttgcgcaccgtcaagaaagaagtgaagcagattatggaggaagctgtgacacgtaagtttgtgcatgaggattccagtcacataatcagtttctgtgccgctgtggaagcgtgtgtgttacatggtctcagacgcagggccgctggatttttgaggtcaaacaagatcgcggctctgtttatgaaggttggaaaaaacttcccccctgcggaggatttgagccgtaaggtgcaggatctcgaacagttgatcgagagcgctaggaatcagatccaagggctgcaggagaatgtcaggaaacttcctaagttgcccaatctttctcctctcgcaatcaagcacctgtggattaggaccgccctcttcgaaaaggtattagataagatagtccattacctagtggagaattccagcaagtattatgagaaggaggcgctcttaatggatcccgttgacgggcctatactggcttctctgctcgtgggcccatgcgcgctcgagtacacgaaaatgaaaaccgccgatcatttttggactgacccttcagccgacgagctcgtccagcggcacagaatccattcttctcacgtgcggcaggatagccctacgaaacggcctgccctatgtatacagaaacgacactctagcgggagtatggacgatcgtcctagcttatcagccagagattatgtcgagagtctacatcagaactcccgtgcaacactgctttacggaaagaacaatgtattggtgcaacccagggacgacatggaagcggtgccgggatatctgtctcttcatcagactgctgatgtgatgacattgaaatggactcccaaccagctgatgaatgggtctgttggcgacctggattatgagaaaagcgtttattgggactacgcaatgaccattcggctggaagaaatcgtctacctgcattgtcatcagcaagttgattcggggggaacagtggttctggtgagtcaagacgggattcagagacccccattccgtttcccgaagggcggacacctcctgcaatttctcagctgtctcgagaacggcctgctgccacatgggcagctggaccccccactatggagccagcggggaaagggtaaagtatttccaaaactccgcaaacgctctcctcagggcagcgcagagtcaactagttcagacaaggatgacgacgaggcaaccgactatgtgttccggattatatatcctggcatgcagtctgagttcgtcgcccctgatttcttgggcagcacttcttctgtcagcgtcggtccagcatggatgatggtgcccgcaggaaggagcatgttagtggttgcaagggggagccagtgggaacccgcacggtgggacactacactgccaacgccatcgcccaaggagcagccgcctatgccccaggatctgatggatgtgtcggtgtctaatctgccttcgttatggcagccttccccccgaaagtcatcctgctcttcttgcagtcagtctggatcggcggacgggtccagtaccaacggctgtaatcacgaaagagcccctctcaaacttctttgtgataatatgaagtatcagatcctctcgagagccttttatggttggcttgcttattgcaggcacctcagtaccgtgcgcactcaccttagcgccttggttaaccacatgattgtgtcccctgatctgccatgcgatgccggacaaggactcactgcacggatatgggaacagtaccttcacgacagcacttcttacgaagagcaggagctgctgcggctcatttactatggaggaatacagcccgagatccgcaaagcagtctggccttttctcctcgggcactatcagtttggaatgaccgaaactgaacgcaaagaagtggatgagcagatccacgcgtgttacgcccagaccatggctgagtggctggggtgtgaagcgattgtcagacagcgggagcgcgagagtcatgccgctgccctggccaagtgttcatcaggcgcatctctggacagccacctgcaccgcatgcttcaccgcgattctacaatcagcaacgagtcctctcaatcatgctcctctggcaggcagaacatccgcttacactccgacagttcgagcagcactcaggtgtttgaaagcgttgatgaagtggagcaggtagaggccgaaggcaggcttgaagagaaacagcccaaaatcccaaatggcaacctcgtgaacgggacttgttctcctgacagcggacacccttctagccataacttctcttccggcttgtcagaacatagcgaacctagcctgtcaacagaagacagcgtgttggacgctcagagaaatacccccacagttttgcgaccaagggatggctcggtagatgaccgccagtccagcgaggccaccacttcacaggacgaggccccacgtgaagaacttgctgttcaagactcactggaatccgacctccttgctaacgaatccatggacgagtttatgagcattaccggttcactggacatggccttgccggagaaagatgacgtggtcatggagggatggcgctcttccgagacggaaaaacatggacaggctgattcagaggacaacctgagcgaagaaccggaaatggaatcactgttcccagctctcgccagcctggctgtcactacgtctgccaacgaggtgtcccccgtttcctcaagcggggttacatattctcccgagctcctggacctctatactgtgaacttgcaccgaatagaaaaggacgtccaaagatgtgaccgcaactactggtatttcacgccggctaatctcgagaaactgcggaatatcatgtgctcttacatctggcagcacatcgaaattggatatgtgcagggtatgtgcgatctcttggcgcctctcctcgtcatcctggacgatgaagctcttgccttttcttgcttcacggagcttatgaagcgcatgaatcagaatttccctcatggaggtgcgatggacacccactttgccaatatgaggtcgttgattcagatcctagacagtgagctctttgagctcatgcaccaaaatggtgactatactcacttctatttctgctacagatggttcctccttgatttcaaacgggaactcgtctacgatgatgtcttcctcgtttgggagacaatatgggccgctaaacacgtgtcatcagctcactatgttttgtttatcgccctcgccctcgtggaagtgtatcgcgatattattctggagaataacatggactttacagatatcataaaatttttcaatgaaatggctgagcgtcataataccaagcaggtattgaagctcgccagggatcttgtttacaaagtgcaaacccttattgagaacaagtag

SEQ ID NO: 54035 - DNA, 3447 bp, Artificial Sequence
  Description of Artificial Sequence: Synthetic coding sequence
atggaggaagccgttacacgcaaatttgtgcatgaagactccagccacattattagcttttgtgccgctgtagaagcttgtgtgctgcacgggctgaggcgtcgcgcagctggcttcctgagatctaacaaaatcgccgctttgtttatgaaggtgggcaagaattttccgcctgcagaggatttgtcacggaaagtgcaggatcttgaacagctcattgaatccgctaggaaccagatccaggggttacaggaaaatgtaagaaagctcccaaagcttcctaatttgtcaccgctcgccatcaagcatctgtggatccgtacagccctgttcgagaaagtgctggacaagatcgtgcattatctggtcgagaattctagcaagtactacgaaaaagaggccctgctaatggacccagtggacgggccaatccttgcctcgctgcttgtaggaccgtgtgcactcgaatatacaaaaatgaagaccgctgaccacttttggacagaccctagtgccgatgagctggtccagcggcaccgcattcactccagccacgttcgacaggactctccgaccaaaaggccggctctgtgtatccagaagaggcactctagtggctccatggacgataggccatctttgagcgctagggattatgtggaatcactgcatcagaattctcgagccactctgctatacgggaagaataacgtgctcgtgcagccagggctcacacccggataccgcggaaagggactttccgggtcccggctaccaattcattcaagcatctacgctctcacacatgcacacattcacccacctaacactcacagcagcattcacctgtatctccatgcgccaattctgacctctattcatcctccaatcgttatatccatccaccctccaatcgttaccaccatacacccttcgacgcacctgtatatccatctcagtaatcatctctacattcaccctagcactcatttatacatccacccttccacacatctgtacatttacccaagtattcacccaagtattcacccgagtatctatccaagcattcattttagtgactatgtttttctaaaccagaccggccagacttatgtccactctaacagcagtaccatggctcgcccagaggacgatatggaggctgtcccgggatatctttcactccatcagaccgcggatgttatgacactaaaatggaccccaaatcagctgatgaacgggtccgttggggatctcgattatgaaaaatccgtttactgggactacgcgatgactataagactggaagagattgtctatctgcattgccaccagcaggttgactcgggcggaactgtggtcctggtttctcaggatggcatccagcgtccccctttcaggtttccgaagggcggacacctgcttcagtttcttagttgtcttgaaaatggacttcttccccacggccagttggacccgccactttggagtcagaggggcaaggggaaagtttttcctaaacttcgcaagcgcagccctcaggggtccgccgagtccacgtctagcgataaggacgatgatgaagccacagactacgtgttcaggataatctaccccggaatgcagtccgaattcgtgccccaggacctgatggacgtgagcgtgtcaaatctcccttccctctggcaacctagcccccgaaagagttcttgtagcagctgcagccagtctggctcggccgatggtagcagcactaacggatgcaatcacgagagagccccattaaagcttctgtgcgacaacatgaaatatcaaatcctaagccgtgccttttacgggtggctggcctactgtagacatctcagcaccgtgcgaactcatttatcagcacttgtcaaccacatgattgttagcccagacttaccatgcgacgcaggtcagggtctcacagcccgtatatgggaacaatacctgcacgatagcactagttatgaagagcaagaattactcagattgatttactacggaggaattcaacccgagatccgcaaagcggtgtggcctttccttctgggccactaccagttcggcatgacagagaccgagcgtaaagagtcaagccaatcatgctcaagtgggaggcagaatatccgcttgcacagcgatagttcatcatcaactcaagtcttcgaaagcgtggacgaagtcgagcaggtcgaggccgaggggcgtctcgaagagaaacagcctaaaatacccaatggcaatctcgttaacgggacatgttctccagatagcggacacccatccagccataacttcagcagcggcctgtccgagcatagcgaaccatctctaagcactgaggacagtgtcctggacgcccaaagaaatacaccaaccgtcctgaggccgcgtgatgggagcgtcgacgacaggcagagcagcgaagccacaacgtctcaagacgaggcaccacgcgaagaactggccgtccaggatagtttagaaagtgatctcctcgcaaatgaatccatggatgaatttatgtcaattacggggagcctggatatggccctgccagagaaagatgacgtcgtcatggaaggctggcgctctagcgagacagagaagcatggtcaggctgatagcgaagacaacctttccgaggagccggaaatggagtccttgtttccagcccttgcctcccttgctgtgacaacctcagctaatgaagtgtcaccagtgtcatcctccggcgtcacgtatagtccagaactgttggatctctatacagtgaacctacatagaattgagaaagacgtgcaacgttgcgatcggaactattggtatttcacacccgctaacctcgagaagctgaggaacattatgtgttcgtacatttggcaacacattgaaattggctatgtacagggaatgtgtgatctcctcgcacctcttctggtgattctggacgacgaggcgctggcattcagctgtttcactgagttgatgaagagaatgaaccagaatttcccccatggcggagccatggatacccactttgccaatatgcgctcattgatccaaattcttgattccgaactattcgaactgatgcaccaaaatggcgactacacacacttctacttttgttaccggtggtttctgttggatttcaaaagagaactggtctatgatgacgtgtttctagtctgggaaactatttgggccgctaaacacgtgtcgtccgcgcactatgtgctgtttatcgcactggccctcgtcgaggtctatagggatattatcttagagaacaatatggacttcacagacatcattaagttttttaatgagatggctgagcgacacaatacgaagcaggtgcttaagctggcccgtgatctggtttataaggtgcagacattaatcgagaacaaatag

SEQ ID NO: 54036 - DNA, 234 bp, Artificial Sequence
  Description of Artificial Sequence: Synthetic coding sequence
atgggtttgtgctttccctgtccgggtgaatcggcccctcctactccagacctggaggaaaaaagggccaagctggccgaggcagcagaaaggaggcagaaggaggccgcttctcggggaatcctggatgtgcaaagtgtccaggaaaagaggaagaagaaggagaagattgaaaaacaaatcgctaccagcgggcctccgcctgaggggggactgagatggacggtatcatag

SEQ ID NO: 54037 - DNA, 1365 bp, Artificial Sequence
  Description of Artificial Sequence: Synthetic coding sequence
atggcagagttttctcagaagcgcggaaaaagacgaagcgatgaaggactgggatcgatggtcgattttctgctggcaaacgcacgcttagtattgggagtcggcggagctgccgtccttggtatcgctaccctggccgtgaagcgctttattgacagagccacttctccaagagacgaggatgataccaaggcggattcatggaaggagctatctctccttaaagctactcctcacctccagccacggcctccgcctgccgctttgtcccaacccgtactgccactggcccctagctccagtgctcccgaagggccagcagagactgatcctgaagtgacgccccagttaagttcccctgctcccttgtgccttactcttcaggagcgtcttctagcattcgagagggatcgggtgactatacccgcagctcaagtggcccttgcaaaacaactcgcaggagacattgccctggagttacaggcctactttagatcaaagttccccgagcttccatttggcgcattcgttcctgggggacccctgtacgatggcctgcaagctggcgctgctgaccacgttcgtctgctcgtaccactggtcctcgagcccggactgtggtccctggtcccgggagtagatacagtggcacgagaccctcggtgctgggcggtcagacgcacacagctcgagttctgccctaggggcagttctccttgggatagattcctggttggaggatacctgagcagtagggtgttgctcgagctgttgagaaaggccctcgcagcctcggtaaattggcctgccatcggttccctgcttggctgcctcattaggccatcaatggctagtgaggaactcctcctggaggttcagcacgagagactcgagctgacagttgccgtgctggtggcggtgcccggagttgatgccgatgacaggttactactcgcctggcccctcgaaggtctggctggcaatctgtggctgcaggacctgtacccagttgaagccgctcggcttcgcgctctcgacgaccatgacgcgggaactcgcaggcgccttctactgctcttatgcgctgtatgccgtggttgcagtgcccttggacagctggggagagggcatctcactcaggttgttcttcggctaggcgaagataacgttgattggacggaggaggccttgggtgaaagattcctccaggctttggaattacttatcggctctctggagcaggcatccctgccttgtcactttaatcccagtgtcaacttattttccagtctgagggaggaagagatagatgatattggttatgccctatactccggattgcaagagccagaggggctgttgtag

SEQ ID NO: 54038 - DNA, 492 bp, Artificial Sequence
  Description of Artificial Sequence: Synthetic coding sequence
atggccgagttctcgcagaagcgagggaagagaaggagcgacgagggattgggctcaatggtcgactttttgctggccaatgcaagattggtgctcggtgtgggcggagcagccgtgttggggatcgccacacttgctgtaaagaggttcatcgacagagcaacttctccgcgagatgaggacgatacaaaggctgattcatggaaagagctgtcactgttgaaagcgactcctcatttacagccaaggcccccaccagcagctctgagccaaccagtcctccccttagctccctccagcagcgcacctggagagtggcactcctttccatcttttggcgtgactttcaagcggaggagccctgggtttgccctgacagactgtgttacattaagggagagtctgctgctgtcacggctgtgggccccacaaatctttaacggagggggagtttcacttccttgctcctggtccaaggttgtggctctgtag

SEQ ID NO: 54039 - DNA, 618 bp, Artificial Sequence
  Description of Artificial Sequence: Synthetic coding sequence
atggcagagtttagccagaaacgaggcaagagaagatccgatgagggtctcggcagtatggtcgactttctgctggctaatgctcggctggtcctcggtgtggggggtgccgctgtgttaggtattgccacgctcgccgtgaagcgctttatcgatcgcgcaacctctcctagggacgaggacgacaccaaggcagattcctggaaggagctcagcctactcaaggcaacaccacacctgcaaccacggcctcctccagccgcactgtctcagcctgtgctgccactggcaccatcctccagcgcccctggcgaagcagccggacttagggcagggccttgtgatcacccctcaagtcccggtggctttggacagaccgccggatggaggcatcggccaggcgctgcgggactccttagtgaacaggtgccgggaaccgcactatggggtattcgagcgtggggcgctgccctgcgtcgcgcagccggtggaggatgcggcccttgtgcaagtcccggagctacaggcgcaggagccggacctgtggaacctggggctggcagagggcactgtggagagggcccatccctgctcggacgcgcacaggatgctgcttag

SEQ ID NO: 54040 - DNA, 1398 bp, Artificial Sequence
  Description of Artificial Sequence: Synthetic coding sequence
atgggactcagccctaatctggacaggcagaccatggctgaattcagccagaaacggggtaaaagacgcagtgacgagggcctgggctcaatggtggatttcctcctggcaaatgcaagactggtcttaggcgttggtggggcagccgtgctgggtattgcgacactggccgtgaaaaggttcattgacagagcgacatccccaagggatgaggatgatacgaaggccgactcctggaaggagctgtcactgctgaaagcgacacctcaccttcaacctcggccaccgcctgccgctttgagccagcccgtactgcctttggctcccagttcttccgcccctgagggtcccgcagaaactgatcccgaggtgacaccccagctgagcagcccagcaccgttatgcctcactttacaggaacggctcctggcttttgaaagagatagggtgacgattcctgccgcacaggtagcacttgccaaacaactggccggagacatcgccctggagctgcaggcctactttcggtccaagtttccggagctgcctttcggcgctttcgtgcccggtggtccactatacgacgggctccaggctggcgcagctgaccacgtacgcctcctggtcccccttgttctggaacctgggctgtggtccctggttcccggtgtcgatactgttgcgcgagatcctcgctgctgggctgttagacggacccagttggagttctgccctcgcggatcctcaccttgggatagatttctggttggcggttatttgtcttctcgtgttctcttggagctcctaagaaaggctctggccgcatccgtgaactggcccgcaattggcagcctgcttggttgcctgattcgtccctccatggccagcgaagaactgctcttggaagtgcaacacgaacgactggagctcacggtggcagtcctagtggcagttccaggcgtggacgctgacgatagacttttactggcatggcctctggaggggctagccggaaatctgtggttgcaggatctgtaccccgttgaggcggctaggttgagagctctcgacgaccacgacgccggaacacggaggaggctgctcctcctactgtgtgctgtgtgcagaggttgtagcgcgttaggtcaactcggtcggggacatctgacgcaagtggtacttcgcctcggggaggacaacgtcgattggaccgaagaggctttaggcgagcggttcctgcaggctctggaactgctcatcggcagcctggagcaggctagtctaccatgtcacttcaatccgtccgtcaacctttttagtagtcttagggaggaggagatagatgacattggttatgccctctactccggactacaggaacctgagggccttctgtag

SEQ ID NO: 54041 - DNA, 1392 bp, Artificial Sequence
  Description of Artificial Sequence: Synthetic coding sequence
atggccggtgccggagaacgcaaaggcaagaaggatgataatggcatagggacagccattgacttcgttctgtcgaacgcaagacttgtgttgggagtgggtggcgcagcaatgcttggaattgctacattggcagtaaagagaatgtacgatagggctatatcagccccaacctcacctacccgtctatctcacagcgggaaaagaagttgggaggaacccaactggatgggcagccctcggctgctgaaccgcgatatgaaaaccgggttgagccgatctttacagactttgcccacagacagctcaacgttcgatactgatactttttgtcccccacgccctaaacccgttgccaggaagggacaggttgatttaaaaaagtcgagactgcgtatgagtctgcaggagaagctgctgacatactaccgtaaccgagcagctattccagccggagagcaagcccgagccaaacaggcagccgtggacatttgcgcggagctgaggagtttcctgcgtgctaaactgcccgatatgccattaagagatatgtacttatccgggtccctctacgatgatctgcaggtggtgaccgcagatcatattcagctgatcgtgcccctggtgttagagcaaaatttgtggtcatgcattcccggtgaggataccattatgaatgtgcccggtttctttctggtgcgcagagagaatcccgaatacttccctagaggttccagctattgggatagatgcgtagtgggcggatatttatcccccaagacagtcgcagatactttcgaaaaagtagtagctgggagcattaactggccggctatcgggagtttactggattacgtgattcggccagcccctcctcctgaggctctgactctcgaggttcagtatgaacgggataagcacctgttcattgatttcctgccatccgtgacattaggcgacactgtgctggttgctaaaccccatcggctcgcccagtatgataatttgtggcgactcagtctccgtccagcggagacagcccgtctgcgcgctctggaccaagcagactctggttgcaggtccttgtgtctgaagatcctgaaggccatatgcaaaagcacaccggctctcggtcacttaaccgcttcacagctgaccaatgtgatcctacatctcgctcaggaggaagcggattggtcgcctgacatgcttgctgacagattcctgcaagctctgagaggactaattagctatctggaagcgggtgttctcccctcggccctcaatcccaaagtgaacctgtttgccgagttgacacctgaggaaatcgatgaacttggctatacattgtactgctccctctctgaacccgaagtgttactacaaacgtag

SEQ ID NO: 54042 - DNA, 1437 bp, Artificial Sequence
  Description of Artificial Sequence: Synthetic coding sequence
atggcgggagccggtgaacgtaaggggaagaaggatgacaacggcatagggacagccatcgattttgtcctttcgaacgctaggctggtcctgggggtcggtggggctgccatgttgggaatcgccactttggctgtaaagagaatgtacgacagggccatttcagctcccactagccccactagattatctcatagtggcaagagatcatgggaggagcctaattggatgggttcccctaggctactaaatcgcgacatgaagacgggcctgagtaggagccttcaaacactacctacggattcaagcaccttcgacactgataccttctgtccacccagaccaaaacctgttgcgagaaagggccaggtggacctcaagaagtcccgcctgcggatgagcctccaggagaaactcctcacctactaccgtaatagagcggctatccccgcaggcgagcaggcacgggcaaagcaggcagctgtagacatctgcgccgagctgaggtcatttctgcgcgcaaaactccccgacatgccccttcgagacatgtacctgtctggcagtctttacgatgatctgcaggtggtgaccgccgatcacatccaattaatcgtcccactggtactcgagcagaacctgtggagttgcatccctggcgaagacacaatcatgaacgttcctgggtttttccttgtgaggcgtgaaaatccggagtacttccctagagggtcctcctactgggatcgctgtgtcgtggggggatacctgtctcccaaaactgtggcggatacttttgaaaaagtagtggctgggagtattaactggcctgctatcggatcgctgttggattacgtaatcaggcctgcacccccacccgaagctctgacactcgaggtgcagtacgagcgtgacaagcacctttttatcgattttctgccttccgttacccttggcgataccgtcctggtagccaagccccatcggctggctcagtatgataacctgtggagactctcccttaggccggcagaaaccgccaggctgagggccctggaccaggcggattccggctgccggtctctctgcttaaagatcctgaaagccatctgcaagagtacccccgctcttggtcatctgacggcctcacagctgacaaatgtgatcctgcacctcgcacaggaggaggccgactggagcccggatatgctagcggacaggttcttacaggcacttcgcggtttgatttcgtacttggaggctggtgtcctgcctagcgctctgaacccgaaagacaaagcactgaaagagcggtcgctccggcatcaggtgcgcatgatggaagttgactcaaggctaaatgtttcgtggaagattcaatcccttgttggggtgtggtggccatgctttctcccaaggcaggccctgctgttctag

SEQ ID NO: 54043 - DNA, 1392 bp, Artificial Sequence
  Description of Artificial Sequence: Synthetic coding sequence
atggcaggagccggagagcgcaagggtaagaaggacgataacggtatcggcaccgctattgactttgttctgtccaacgcaagactggtgctcggcgtgggcggagccgctatgctgggtattgctaccctggctgtgaagcgtatgtatgatcgagcgatctctgcccctacctccccgacgcgattaagccactcaggaaagaggtcttgggaggagccgaattggatggggtcccccaggctcctgaacagagatatgaaaacaggactgagccgtagtctgcagacccttcctaccgatagttccacttttgataccgatactttttgcccacctagacccaaaccagtcgctagaaaggggcaggtggatctgaagaagtctcgtcttaggatgagtctgcaggaaaaactgctcacatactataggaatcgtgcggctattccagccggagaacaagcacgagctaagcaggccgcagtggatatttgcgcagagctgaggtctttcctcagagctaagttacctgacatgcccctgcgagacatgtacctgtctggaagtctatacgacgatcttcaggtagtgactgctgaccacatccagctgatcgtgccccttgtgctggaacaaaatctgtggagctgtatcccaggcgaagatacgataatgaatgtcccagggttttttctcgttcggagagagaatcctgaatattttccacggggttccagttactgggaccggtgcgttgtggggggatatctgtccccaaagaccgttgctgacacgtttgagaaagttgttgcgggatccatcaactggcctgccataggctccctcctggattatgttattcggccagcccctccccctgaggccttaaccctcgaggtgcagtatgagcgggacaaacatctcttcattgatttcctgccgagcgtcacgctgggagataccgtcctcgtggcaaagccccaccggttggcccagtacgacaatctgtggcggctgagcttacggccagcggaaactgccaggctgagagccttggaccaggccgatagcggctgcagatcactgtgtttaaagattctgaaagccatctgtaaaagcactcccgcactcggacatctcaccgcctctcagctgaccaatgtgatcctgcacctagcccaagaagaggctgactggtcacctgatatgttggctgacaggtttctgcaggccctcagaggcctgatcagttatctggaagctggagtgcttcccagcgcattaaatccaaaggtgaatttgttcgcagaactgactccagaggaaatcgacgagctggggtacaccctgtactgcagcttatccgagcctgaggttttactccaaacctag

SEQ ID NO: 54044 - DNA, 447 bp, Artificial Sequence
  Description of Artificial Sequence: Synthetic coding sequence
atggctggagctggggagaggaagggcaagaaagacgacaatggaattgggactgcaatcgacttcgttttatctaacgcccgactggtgcttggagtcggaggtgctgcaatgctggggattgctactctcgccgtcaagaggatgtatgatagagctatctccgcacctactagccccactcgcttgtcacactccggaaagcgctcctgggaggagccaaattggatgggcagtcctagactgttgaacagagatatgaagacaggcttgtccaggagtctccaaactctgcctacggatagcagtaccttcgatacaggggagacttcctacctccttcctgaaccaggttcacacccttgctggcgcgcaggatctggccaggcttcctgttgtggacatatgtgtcgagcacctgagttgcccgcagggcaggttgcctag

SEQ ID NO: 54045 - DNA, 447 bp, Artificial Sequence
  Description of Artificial Sequence: Synthetic coding sequence
atggcaggtgctggggagagaaagggcaagaaggacgacaacggaatcggaactgctattgacttcgtgttaagtaacgcgaggctggtgctcggcgtggggggagccgcaatgctggggattgctactcttgccgttaaaaggatgtacgaccgcgctatcagcgctcctacctctcctaccaggttgagccactccggtaagcggagttgggaggaacctaattggatgggttcgcccaggctgcttaaccgcgacatgaaaaccgggttaagccggagcctgcagacccttcccaccgacagttctacttttgacaccggcgaaacttcctatctcttacccgagcccggtagccacccttgttggagagcaggcagcggtcaggcatcgtgttgcggacacatgtgtagagctccggaactgcctgcgggacaggtggcttag

SEQ ID NO: 54046 - DNA, 132 bp, Artificial Sequence
  Description of Artificial Sequence: Synthetic coding sequence
atggctggggctggcgaaaggaaggggaagaaggacgataacggcatcggcacagccatcgactttgttcttagtaacgccagactggtattgggggtaggcggagccgcaatgttgggtatcgcaacctag

SEQ ID NO: 54047 - DNA, 2067 bp, Artificial Sequence
  Description of Artificial Sequence: Synthetic coding sequence
atggctgccgagatcgattttttgagggaacagaaccgtcgcctcaatgaagactttcgcagataccagatggagtctttctctaaatacagctcagtacagaaagcggtatgccagggagaaggagacgacacttttgagaacctggtgtttgaccagagctttttagctcccctcgtgacggagtacgacaaacacctcggggaactgaacggacagctgaaatactatcagaagcaggtcggagagatgaaactgcagcttgagaacgtaattaaagagaatgagcgtctccatagcgaattgaaagacgcggtggagaagaaactagaagcatttccactgggcactgaggtcggtaccgacatttacgctgacgacgagaccgtaagaaatctgcaggaacagctgcagctggctaaccaagaaaagacacaagccgtggaactatggcagactgtctcccaggaactggaccgccttcacaagctgtatcaggagcacatgaccgaggcccaaattcatgtatttgagtctcagaaacaaaaggaccagctgtttgacttccagcagctgaccaagcaattacacgtcaccaacgaaaacatggaagtcacgaaccagcagtttctcaagacagtgaccgagcagtccgtcatcatcgagcagctgagaaaaaagcttagacaggctaagctggagcttagagtggctgtggctaaagtcgaggagcttacaaacgtgactgaagacctgcaagggcagatgaagaagaaagaaaaggacgtggtatctgcccacggacgggaggaggcctccgacagaagactccagcagttgcagagtagcatcaaacaattagagatcagactgtgcgtcactattcaggaagctaaccagctacggaccgagaacactcacctggaaaagcaaacgcgtgagcttcaggctaagtgcaatgaactggagaacgagaggtatgaggccatcgtgagggcgagaaactcgatgcaacttctggaggaagcaaatctccagaaatcgcaggccctattagaagagaaacaaaaggaggaggacatcgagaagatgaaagagacagtctccagattcgtgcaggatgcaactatacgcacaaagaaagaggttgccaatactaagaaacaatgcaatatccagatttcgagactgacggaggaactgagcgcacttcagatggaatgcgcagagaaacagggacagatcgaacgggtcattaaagagaaaaaggcagtggaagaagagttagagaagatctatagagaaggcagaggaaacgaaagtgactacagaaaattggaggaaatgcaccagcgtttcttagttagtgagagaagtaaagacgatctgcagcttaggctgactagagcggagaaccggattaagcagcttgagacagacagctctgaagaaattagtagataccaggagatgatccagaagctgcagaatgttctggaaagcgagagggagaattgcggacttgtgagcgaacagcgtctgaagctccaacaggaaaataagcaattgaggaaagaaacagaatcactcaggaaaattgcattagaggctcaaaaaaaggctaaggtcaagatcagtactatggaacatgagttcagcattaaggaacggggattcgaggtgcagctccgggagatggaggactccaacaggaactctattgtggagctccgtcaccttttggcaacccagcagaaagcggctaaccgctggaaagaggagacaaagaagctgaccgaatcggcagagatccgcattaataacctgaagtccgaactgagtcgacagaagctccatactcaagagctactaagccaactagagatggcgaacgagaaagtcgctgaaaatgaaaagctgattctagagcaccaggaaaaggctaatagactccagaggaggctgtcccaggcagaagagagagccgcaagcgcatcccagcaactaagcgtcataaccgttcagagaaggaaggctgctagtcttatgaatctggaaaacatctag

SEQ ID NO: 54048 - DNA, 924 bp, Artificial Sequence
  Description of Artificial Sequence: Synthetic coding sequence
atggcagccgagattgatttcctgcgggagcagaacaggagactcaacgaggattttagaaggtatcagatggaatccttctcaaagtatagctccgtgcagaaggcagtttgccaaggagaaggcgatgacaccttcgagaacctcgtgttcgatcaaagtttcttggcccctctggtgacggagtatgataaacacttgggggagcttaacggccagttgaagtactaccagaaacaagtaggcgagatgaagctgcagcttgaaaatgtgattaaggaaaatgagaggctgcattcagaattgaaggatgcggtcgaaaagaaacttgaggccttcccactcggcaccgaagtcggcactgatatttatgctgatgacgaaactgtgagaaatcttcaagagcagctgcaactcgcaaatcaagagaaaacgcaggccgtcgagttgtggcagaccgtgtcgcaggagctcgatcgcctgcacaagttataccaggagcacatgacagaggcgcagatccatgttttcgagtcccagaaacaaaaggaccagctctttgattttcagcagctgacaaaacagttgcatgtcacaaatgaaaatatggaagttacaaaccagcagtttctgaaaaccgtgaccgaacagtcagtgattatagagcaactccgcaaaaaacttcggtctgaactcagccggcagaaattgcatactcaggagcttttatcacagctggagatggctaatgaaaaggtcgccgagaatgagaagcttatcctggagcaccaagaaaaggccaaccgcctacagagacgcctctcccaggccgaagagcgcgcagcctcagcatcccagcagctcagtgtgatcacagtacagcgcagaaaggcagctagcttgatgaatttagagaatatctag

SEQ ID NO: 54049 - DNA, 528 bp, Artificial Sequence
  Description of Artificial Sequence: Synthetic coding sequence
atggccgctgagatcgacttcctaagggagcaaaacagaagattgaatgaagattttaggaggtatcagatggagagttttagtaaatacagcagcgttcagaaggccgtttgccagggggaaggggacgatactttcgaaaatttagtatttgaccagtctttcctggcgccactggtgaccgagtacgacaagcatctgggtgagctgaatggccagcttaagtattatcagaaacaggtcggcgagatgaaactacagctggagaacgtgatcaaggagaatgaacgttccgagctgtctcgacagaagctgcacacgcaagagctgctcagccagctcgagatggctaatgaaaaggtggctgagaacgaaaagctcattcttgagcatcaggagaaggcaaacaggttacaacgccgactgtcacaggcagaggaacgagctgcaagcgctagccagcagctatcagtgatcacggtgcagcgtcgcaaggctgctagcctgatgaacctggaaaatatttag

SEQ ID NO: 54050 - DNA, 240 bp, Artificial Sequence
  Description of Artificial Sequence: Synthetic coding sequence
atggcagctgaaattgatttcctgcgtgaacaaaatcggaggcttaatgaagacttcagacgctatcagatggagagctttagcaaatattcatccgtgcagaaagccgtttgccagggagagggggacgatacatttgagaacctggtttttgaccagtcttttctggcgcctttagttactgagtacgataagcacctgggggagttgaatggacagcttaagtactaccaagcctag

SEQ ID NO: 54051 - DNA, 738 bp, Artificial Sequence
  Description of Artificial Sequence: Synthetic coding sequence
atggagggcaacaaactcgaggagcaggactcaagcccaccgcaaagtaccccgggtctgatgaaagggaacaagcgcgaagagcaggggttgggacctgaaccagctgcaccccagcagcctacagctgaggaggaggccctgattgagttccataggtcctatcgggaactgttcgagttcttctgcaataacactactatccatggagcgatccgactcgtatgttctcagcataaccggatgaaaactgctttttgggctgttctctggctgtgcacttttggcatgatgtactggcagttcgggctcttgttcggcgaatattttagctacccagtcagcctaaatatcaacctgaacagtgataaactggtcttccctgccgtcaccatctgtaccctcaacccctaccgctatcctgagataaaagaggaactcgaagaactggataggatcactgaacagaccctgttcgacctgtataagtacagctcgtttaccaccctcgttgccggttcaaggtccagacgagacttaagaggaacgctccctcacccccttcaacggctgcgcgtgccaccacccccacacggagctcgcagagctcggtctgttgctagtagtctcagagacaataacccacaggttgactggaaggactggaagatcggatttcagttggagctgctcagcttgccccctccggatgtctggaaactcctctattttcagtag

SEQ ID NO: 54052 - DNA, 2187 bp, Artificial Sequence
  Description of Artificial Sequence: Synthetic coding sequence
atgggcatggcacggggttcattaacccgggtccccggtgttatgggggaaggcacacagggccctgagctgagcctcgaccctgacccttgttccccacagagcactcccggactgatgaagggtaataagctcgaggagcaggatcctcggccactacaaccaatacctggcctcatggagggaaacaagctcgaggaacaggattcatcccctcctcagagtacccccggtttaatgaagggaaacaaacgtgaggaacagggcctcggtcccgaacccgctgctccacagcagcctacggccgaggaggaggctctgatcgagttccaccggtcctaccgggagctgttcgagttcttctgcaataacaccacgattcacggcgcaatcaggctagtgtgttcccagcataacaggatgaaaactgccttttgggctgtgttatggctgtgtaccttcggtatgatgtattggcagttcgggttattattcggtgagtatttttcctaccccgtcagcctcaatatcaacctgaactccgacaaacttgtgttccctgccgtcacaatctgcaccctcaatccctaccgctacccagagatcaaagaggagttagaagaactggacagaattactgagcaaacattgttcgacctctataaatacagttcctttactactttagtggctggatcaaggtctaggagagacctacgaggcaccttgccccatccgctgcagcgcctcagggtacctccgcctcctcacggcgctagaagggcccgttcagttgcttcttctctgagagataataatcctcaggtggattggaaagattggaagattggtttccagctgtgcaatcagaacaagagtgattgcttctaccagacctattctagtggagtcgatgcagtccgcgaatggtaccgttttcattacatcaatatcctgtctagactcccagaaacactcccttctctggaggaggataccctaggcaacttcatttttgcctgcagatttaaccaggtgagctgtaaccaggcgaattattcacacttccaccatccaatgtacggcaattgttacacgttcaacgacaagaataactctaacctgtggatgtcttctatgccgggtatcaataacggattaagcctaatgctaagggcagaacaaaatgacttcatccctcttctgtccactgttacaggcgctagagttatggtccatggacaagacgagccagcttttatggatgacggtggtttcaatctcaggcctggcgtggaaacttcaatttccatgcggaaggagaccctggacagacttggcggagactacggagactgcactaaaaacggtagtgacgtacccgtggaaaatctgtacccctctaagtatactcagcaggtctgcattcactcctgctttcaagaatccatgattaaggaatgtggctgcgcttacatcttttacccgcgtccccagaatgtggaatattgtgactatagaaaacactcctcttggggttattgctattacaagttgcaggtagatttctcttccgaccatcttggatgcttcaccaagtgccgcaagccctgtagcgtcacctcatatcagctgtccgccggatatagtcggtggccctctgtgacaagccaggaatgggtgtttcaaatgctctctcgccagaacaactatacagttaataataaaagaaacggggtggccaaagttaatatttttttcaaagaactgaattacaagactaactctgagtctccctcagtcaccatggttaccttactgagcaacctgggcagccaatggagcctctggttcggttcttcagtgctgagcgtggtcgagatggcagagcttgtgttcgacctcctcgtgattatgttcctcatgctgctccggaggttccggagccgctactggagccctgggagaggaggtagaggagcccaggaggtggcaagtacattagccagcagtcccccttcccacttctgtccccaccctatgagtttgtctctctcccagccagggcctgccccttcgcctgcgctgacagcacctccccctgcatacgccactttaggcccacgcccttctccgggaggatcagccggtgcctctagcagtacatgtccactcggtggcccttag

SEQ ID NO: 54053 - DNA, 2079 bp, Artificial Sequence
  Description of Artificial Sequence: Synthetic coding sequence
atgagttctatcaaaggcaacaagctggaagaacaagaccccaggccactgcagccgatccctggcctcatggaaggcaacaagctagaggagcaggacagttcacccccacagagcacacccggtctgatgaagggaaacaaaagggaggaacagggactgggccctgagccagcggctccccaacaacccaccgctgaagaggaagctctcattgaattccaccgtagttaccgggagctatttgagtttttttgcaataacaccacgatacatggcgctatcaggctggtttgttctcaacacaacagaatgaagactgcgttctgggcagtcctttggttgtgtactttcgggatgatgtactggcagtttggtctccttttcggcgagtatttttcatacccagtgtctctgaacatcaacctgaattctgataaacttgtcttccctgcggtaacgatttgtacactcaacccataccgctaccctgagatcaaggaggagctcgaggaacttgacaggatcaccgagcagacattatttgatctgtacaaatattcctcgtttacaaccttggtggcaggaagcagatccaggagggacttaagaggcactctgccccatcctctccagagactgagagtgccccctccaccgcacggggcaaggcgtgcacgcagcgtcgcttcctccttgagggacaataatccacaggttgactggaaagactggaaaatcgggttccagctctgcaatcagaataaatcggattgtttctaccagacctattcatctggggtcgatgctgtgcgggagtggtaccgctttcactatatcaatatcttgtctagattgcccgagaccctgccttcactggaagaagatacactaggtaattttatcttcgcatgtaggttcaatcaagttagctgcaaccaggctaactattctcacttccatcatccaatgtatggcaattgttatacatttaacgataagaacaactccaatctttggatgagcagcatgccaggcattaacaacggtctgagcctcatgctcagagctgagcagaacgatttcatccccctgcttagcacagttaccggtgctagggtcatggtgcacgggcaggacgagcccgcttttatggacgacgggggattcaaccttcgtcccggtgtcgagacttcaatttctatgcgcaaggaaactctggataggttggggggtgattacggagactgcacaaagaacggcagcgacgttcctgtcgagaatctctatcctagcaagtatactcaacaggtatgcatccattcttgcttccaggaaagcatgattaaagaatgtggttgcgcctacatcttttacccacgaccccagaatgtggagtactgcgactaccgcaagcatagttcctggggatattgctattacaagctgcaggttgatttctcttcagatcatctcggctgtttcaccaagtgtagaaagccatgtagcgtgacatcctaccagctcagcgcaggctatagccgctggccttccgtgacatcccaggagtgggtgtttcagatgcttagtagacagaataactacactgtcaataacaaaagaaacggggtcgcaaaggtcaatattttttttaaagagttaaattataaaacaaactcagaaagtcccagtgtcacaatggttacactcctgagcaatctggggtctcagtggagcctctggttcggttcctccgtgttgtcagtggtcgaaatggccgaattggtgttcgaccttttggtgatcatgttcctgatgctgctccggcgattccggtccagatactggtcccccggacgaggtggacgcggtgctcaggaagtcgcgtctacgcttgcttcctcacctccatcccatttctgtccccacccaatgagtctcagcttgagtcagcctggccctgcaccgagtcccgctctgacagccccacctcccgcatacgccacactaggccctaggccttctccaggtggctccgcgggagcttcctccagtacatgtcctctaggtggaccatag

SEQ ID NO: 54054 - DNA, 477 bp, Artificial Sequence
  Description of Artificial Sequence: Synthetic coding sequence
atggtcccccacgccatcctagcgaggggcagggatgtctgccggaggaacggcctcttgatactgtcggtgctttccgtgattgtgggatgcctgcttgggtttttcttacgcactagaaggttgtcacctcaggaaatttcttatttccagtttcccggagagctgctgatgagaatgcttaaaatgatgattttgcctttggtcgtctcctctctgatgagcggattagcttccctggacgccaagacttctagcagactcggagtcctcactgtggcatactatctctggaccacgttcatggcggttattgtcggcatattcatggtgagtataattcacccgggaagcgccgcacagaaggaaaccactgagcaatcggggaagcctattatgtcatcagcggatgccctgctggatctgatcaggcagaaagaagaaagctggaggaacggtcctaagggcccagggtag

SEQ ID NO: 54055 - DNA, 1683 bp, Artificial Sequence
  Description of Artificial Sequence: Synthetic coding sequence
atggtccctcacgctatcctagcaaggggcagagacgtgtgccgacgcaatgggctgttaatcctgagcgtcctctctgtgattgtgggttgtttactggggttttttttgcgcactaggaggttatcaccacaggaaatatcttacttccaatttccaggggaactgctgatgaggatgctcaagatgatgattctgccccttgtggttagttccctcatgagcggattagccagcctggatgcaaagaccagtagcaggcttggcgttctgactgttgcgtattatctgtggacaaccttcatggccgtgatagtgggaattttcatggtttctatcattcaccctggttctgctgcccagaaggaaaccaccgaacagagtgggaagccaatcatgtcctcagccgatgcccttctggatctgattcggaacatgttcccagccaaccttgtcgaagcaaccttcaaacagtaccgcactaaaactacgcccgtggtgaagtctccgaaagtggctcctgaggaagcaccaccccgacgaatcctaatctacggggtacaagaagaaaatggcagccatgtccagaattttgctctggaccttaccccacctcccgaggtagtctataagagcgagcccggtacctcagatggcatgaacgtgctcggtattgtctttttttctgcgacaatgggtatcatgttagggcgaatgggagatagtggggcacctttggtcagcttttgtcaatgccttaatgagagcgtgatgaagatagtggccgtggctgtgtggtactttcccttcggcatagtgtttttgatagctggtaagattctcgagatggatgaccctcgcgcagtgggaaaaaaactgggtttctacagtgtgacagtagtctgcggacttgtgctgcacggtctttttattttgcctctcctctacttctttattactaagaagaacccaatcgtgttcattagaggcatactgcaggccctgctgatcgcgctggctacttcctcttctagcgcaaccctgcccatcacattcaagtgtctgctggagaacaaccacattgaccgcagaatcgcccgatttgtcctgcccgtcggggcaaccataaacatggatggtactgcactgtatgaagccgtggcagcgatctttatcgcccaggtgaacaactatgaattagactttggacagatcataactatcagcatcacagcgacagcagcatccatcggagcggctggaatccctcaggccggacttgtaacaatggtgatcgtgctgacctcagtggggttaccgacagatgatatcaccctaattattgccgtggactgggccctggacaggttcaggactatgattaacgtgcttggggacgctctggcagccggaatcatggcccatatatgtcggaaagactttgcacgcgacacaggaactgaaaaactcttaccatgcgaaaccaagcctgtctcgctacaggagattgtagccgctcagcagaatggttgtgttaagtcggtcgccgaagcttctgaattaacactggggccaacttgccctcaccacgtccccgtccaggtcgaacaggacgaagagttgccggcagctagcttaaatcactgcacaattcaaatctccgagcttgagaccaacgtgtag

SEQ ID NO: 54056 - DNA, 729 bp, Artificial Sequence
  Description of Artificial Sequence: Synthetic coding sequence
atgagcaatccacggtcccttgaggaggaaaagtatgacatgtccggcgcaaggctggccttgattctgtgtgtcaccaaggccagggagggaagcgaagaggacctcgacgccttagagcatatgttccgccagctgagatttgagagtacaatgaagcgagacccgactgcagaacagtttcaggaagaactcgagaagttccaacaagctattgactcaagggaggacccagtctcgtgtgcctttgtggttttaatggcacatggacgggaggggttcctcaagggggaggacggcgagatggtaaagctcgaaaatctgtttgaagccttaaataacaaaaactgccaagcattgagagcaaaacccaaagtctacataattcaggcttgtagaggcgaacagagagatcccggtgagacagtgggtggtgatgagatcgtaatggtgattaaggattcaccacagaccatcccaacctacactgatgccctccacgtttacagcacggtcgaaggctacattgcatacaggcacgatcagaagggttcctgcttcatccagacccttgtagatgtgttcaccaagcgtaaaggccatatcttggagctgctgacagaagtcactcgccgaatggctgaggccgagttggtccaggaagggaaagctaggaagacaaacccggagattcagtcgaccctgagaaaacgactatatctgcaatag

SEQ ID NO: 54057 - DNA, 1503 bp, Artificial Sequence
  Description of Artificial Sequence: Synthetic coding sequence
atgtcaatcgaccatgagcagccatggcagcaacctgttcccgcaggtgaacgaccagctgccggtccaggaggcctggcagccgctgccgctggcaagccagcagccgagtcgaccgctcatgcgccagctcctgctgatcatgacccccgagcacgggctgccctgcctgccccaaaacgtctgcacagtgctgacgggcagagaaggggacactggggtcaacctggactgtgtccggcacccatctcagcacatttgcctcccgaccaggtgctcctgttttcttggagggcatcggacgaagatgccgcagatgcgggagtaacatcccactgcctgcagccagggcatcggaatatgttcccacccaacctcgttgaggcttgctttaagcagtttaagactcaatattctactcgagttgtgaccaggacgatggttagaacggaaaatgggtccgagccgggagcttcaatgcctccccctttttcggtggaaaacggtaccagctttttggaaaacgtgacaagagccctcgggaccctgcaggagatgctttccttcgaagagacggtgcctgtgccaggatcagctaacggcataaatgccctgggactggtcgtattcagcgtagcttttgggctcgtcataggcggaatgaaacataaaggcagggtgttgagagacttctttgattctctgaacgaagctattatgcgtctcgtgggcatcattatctggtatgcacctgtcgggatccttttcctcatcgctgggaaaattcttgagatggaggatatggccgtgttaggaggccagttgggtatgtatactctcaccgttatcgttgggctatttcttcacgcagggattgtgcttcctttgatctactttctggtgacgcatagaaatccctttcccttcatcggcggtatgttgcaggccttaattactgcaatgggcaccagcagtagcagtgccactctacctattacattccgatgccttgaggaggggctgggtgtcgataggagaatcactcggttcgtgctgcccgttggggctacagtgaatatggacggcacagcgctttatgaagccttggctgccatcttcattgctcaagtgaacaactacgagctcaatctggggcagatcaccaccataagtatcaccgcgaccgcggctagcgttggtgcggctggaatcccccaagccggattggtcactatggtcattgtactgacctcagtcggcctgcctactgaagatataacacttatcatcgccgtggactggttcctggataggctgagaaccatgactaatgtgctgggagatagcataggcgctgccgtcatcgagcacttgtcccagcgcgaactggaactgcaagaagctgagctgacactgccttccttggggaaaccgtataagtcactcatggcccaggaaaaaggcgcatctagggggagggggggaaacgagtctgctatgtag

SEQ ID NO: 54058 - DNA, 618 bp, Artificial Sequence
  Description of Artificial Sequence: Synthetic coding sequence
accatgtcaagccatggcaatagcttgttcctccgggagagtgggcagcggctcggacgagtcggttggctccagcggttgcaggagtctctccaacaaagagcacttcgcactcgactgaggctccagacaatgactcttgagcatgtgctgcgattcttacgcaggaacgcatttatcctgctgacagtcagcgccgtggtgatcggtgtgagtctggcctttgccttaaggccctaccaactgacatacaggcagattaagtatttcagtttcccaggcgagctgctcatgagaatgctgcagatgctggtcctgccactcatcgtgtcctcactcgtcacaggtatggcctctctagacaataaagctactggacgaatgggaatgcgcgcagccgtgtattatatggtcacaacaatcatcgccgtatttatcggcattctgatggtgactatcattcatccagggaaaggatcaaaagaggggctgcacagggaggggaggattgagactattcctaccgccgacgcgtttatggatctgatccgaaacatgtttcctccaaacctggtagaggcatgcttcaagcaagtacgaggcaaatatacagtgtag

SEQ ID NO: 54059 - DNA, 939 bp, Artificial Sequence
  Description of Artificial Sequence: Synthetic coding sequence
atgtctagtcacggaaacagcctattcctgcgtgagtctgggcaaagattggggcgagtaggatggttacaacgactccaggagtctctgcagcagcgggctctgcgaacacgcctacgcctacaaacaatgactctggagcacgtgctccgatttcttaggagaaacgctttcatcttactgacagtgtccgctgtggtaatcggcgtcagtctggcctttgcactgcggccttatcaattgacataccgtcaaattaagtacttcagctttcctggcgagctcctgatgaggatgcttcaaatgctggtgttacctctcattgtcagttcgttggtaaccggaatggcatcactggacaataaggctacgggccgaatgggtatgcgcgcagctgtctactatatggtcacaaccataatcgctgtgttcatcggaattctcatggtgacaattatccatcccggaaaaggcagcaaggagggactgcatagagaggggaggatagagaccattcccacagctgacgcgtttatggatctgattcgtaacatgtttcccccaaacttagtagaagcatgtttcaagcagttcaagacacagtattcaactcgcgtcgtgacacggacaatggtgcgcactgagaatggatccgaacctggggcatccatgcccccacccttttctgtggagaacggaacatcctttctggagaatgttacgcgagccctggggacactgcaggaaatgctatcttttgaggagaccgtgccagttcccggatccgccaacggcatcaacgccctgggcctggtggtgttctcggtggcatttggactagttatcggtggaatgaaacacaaggggcgtgtcctcagggatttcttcgactcacttaatgaggctatcatgaggttagtcgggatcatcatttggtag

SEQ ID NO: 54060 - DNA, 1317 bp, Artificial Sequence
  Description of Artificial Sequence: Synthetic coding sequence
atgatccgtaagttgtttatcgtgctgttgcttctgctagtgacaattgaagaagccaggatgtcttcactctcgtttctgaacattgagaagacagagatcctgtttttcactaaaactgaggaaaccatcttggtctcttcctcctatgaaaataagcggcctaattccagtcacctgtttgtaaagattgaagatcctaaaatattacagatggtaaatgtcgctaagaagataagctctgacgccacaaacttcacgatcaacctggtgactgatgaggagggggaaaccaacgttacaattcaactttgggactcagagggtcggcaagaacggttaatcgaagagattaagaacgtgaaagttaaagttttgaagcagaaggatagcctcttgcaggctcccatgcatatagaccgtaacattttgatgttgattctcccgcttattctgctcaataagtgtgcttttggctgtaagattgagcttcagcttttccagacagtatggaaacggccactacctgtgattcttggagccgtgacccagttcttcctcatgccattctgcggatttctgcttagccagattgtagctctgcccgaggcccaggcatttggcgttgtaatgacctgtacgtgccctggtgggggtggaggatatctcttcgccttactgctcgacggtgatttcaccctggcgatattaatgacatgtacttccacacttctggccctcatcatgatgcctgtcaatagctatatttactctaggattttaggactgtctggaacatttcacatcccagtgtccaaaatcgtcagcaccctgctgttcattctagtgcccgtttcaatcggaatcgtgattaagcaccgcatccccgagaaggcttcctttctcgaaagaatcatcaggccactgtccttcatcttaatgtttgttggaatttacctgaccttcacagtcggccttgtttttttgaagactgacaatcttgaagtgatcctgctcggactgcttgtgcctgcccttggcctattatttgggtatagctttgcaaaagtgtgcactctgcctctacccgtgtgtaaaaccgtggctatcgaatctggcatgttgaattcatttttagccctagcagtcattcagttgtcttttccgcagtctaaagccaacttggcaagcgtggcacctttcacagttgccatgtgctcaggatgcgaaatgctcttaatcatcttggtgtacaaagctaagaaacgctgcatattcttcttgcaagacaagaggaaaaggaacttccttatctag

SEQ ID NO: 54061 - DNA, 258 bp, Artificial Sequence
  Description of Artificial Sequence: Synthetic coding sequence
atgcggctgctggagcgaatgcggaaggactggttcatggtcggaattgtgctcgctatcgcaggcgctaagttggaaccaagtataggcgtgaatggcggacccctgaagccagagatcaccgtgagttacatcgccgtagccaccatattttttaattcaggattatctctgaaaacagagtttgccgattctcgtcttcacgcgagtgcatgtgttttttgctccgatttcaatcaaggcagctggtggaagtag

SEQ ID NO: 54062 - DNA, 1023 bp, Artificial Sequence
  Description of Artificial Sequence: Synthetic coding sequence
atgcgcctactggagaggatgcggaaggattggtttatggtggggatcgtcctggctatcgcgggagccaagctagaacccagtatcggggttaacggcggacctcttaagcctgaaattaccgtatcatatatcgccgtggcgacaatcttctttaatagtggactgtcactgaagaccgaagaacttaccagcgccttggtgcatctgaaactgcacctgttcattcaaatcttcacattggccttttttcctgcaaccatttggttattcctccagctcctgtctataacacccattaacgaatggctgctgaaggggctgcagaccgtgggttgcatgcccccacctgtgtcttctgctgtgattctcaccaaagcggtggggggaaacgaggcagctgctatctttaactcagccttcggaagctttttaggcatagtcattaccccccttttgctattgctgttcctgggttccagcagctccgtgccgttcacctctattttcagccagttatttatgaccgtagtcgtgccgctcattataggtcagatcgtcagaagatacattaaagactggctggagaggaagaaaccaccattcggagctataagtagtagcgtactactgatgattatctacactacattctgcgacaccttttcaaatcccaatatcgacttggacaaatttagcctggtactgattctgtttatcattttttccattcaattgtccttcatgttgttgaccttcatctttagcactcgcaacaactcgggcttcacccctgcagacacagtggccattatattttgtagcacacataagagtctgaccctgggaattccaatgttgaaaatcgtctttgctggccacgaacacctgtcccttatctctgttcccctccttatctatcaccccgctcagattctcttgggcagcgttttagtccccactatcaaatcttggatggtctcacgccagaaaggcgtgaagctgactagaccaactgtctag

SEQ ID NO: 54063 - DNA, 480 bp, Artificial Sequence
  Description of Artificial Sequence: Synthetic coding sequence
atgcgcttattagagagaatgcggaaggactggttcatggtcgggattgtgttggctattgctggagccaagttagaaccctctattggggtcaacgggggacccctaaagcccgagatcacagtgtcctatatcgcagtggccaccatcttcttcaacagcggtcttagcttgaagaccgaggaattaacctcggcgctggtgcacctgaagctgcatctcttcatacagatttttaccttggcattctttcctgcaacaatctggctgtttcttcagctgttgagcatcacccccattaacgagtggctgctcaaaggactgcagacagttggctgcatgccgcctccagtatcttcagccgtaattctgacaaaggcagtgggtggtaacgaggctgccgcaatattcaactccgcgttcggaagttttctggtgtcaaaacactctctgacctgcctgctccaacttctcctgtag

SEQ ID NO: 54064 - DNA, 1077 bp, Artificial Sequence
  Description of Artificial Sequence: Synthetic coding sequence
atgcgcctcctggagagaatgcgcaaggattggttcatggtcggaatcgttctcgccatagcgggtgctaaactggaaccatccataggagtgaacggcggacctctgaagccagagattactgtctcctatatcgccgttgccaccatcttcttcaattcgggactctcgcttaaaacagaggagttgacgagtgccctcgtccacctgaagctgcatctgttcattcagatctttaccttggctttctttccagctacgatctggctgtttttacagctgctgagtattactccaataaacgaatggcttctgaagggtttacagactgtggggtgtatgccacctcctgtgtccagtgctgtgatcttaacaaaagctgtgggaggtaatgaggctgccgctatcttcaactccgcctttggtagcttcctgggcattgtcataaccccattattgctcctgctgttcctgggaagcagttcatctgtgccctttacatccatatttagtcaacttttcatgaccgtcgtggttccattaattatcggtcagatcgtgcgcagatacattaaagattggcttgagaggaaaaagcccccatttggtgccattagctcctctgtgttactcatgattatctacacaaccttttgcgataccttttctaatcccaacatcgacctggataagtttagcctcgtcctgattttattcattatctttagtatacaattaagctttatgctgttaactttcattttcagcaccagaaacaattcgggatttacgcccgctgacacggtagcgataatcttctgttcaacccataagtccctcacccttggcatccctatgctaaagattgtcttcgctgggcatgagcacctgagcctgatctcggtaccacttttgatctatcacccggctcagattctgctgggttctgtgctcgttcctactataaaaagctggatggtctctcgccagaaaaagctattacagacacgaggcccactagcaaatcttaataatccagagggcctagagtacttgtcaatcaaattcggacactag

SEQ ID NO: 54065 - DNA, 984 bp, Artificial Sequence
  Description of Artificial Sequence: Synthetic coding sequence
atgcgactcctagagcggatgcgaaaagattggtttatggttgggattgtgctggctatcgcgggtgccaagcttgagccttcaattggagtgaacgggggaccgctcaaaccagaaatcaccgtgtcgtatatcgccgtggccacaatcttttttaactcaggcctgtctctaaagaccgaggagttgacatctgcattagttcatctgaagctacatctgttcatccagatttttacgcttgccttctttcccgctacgatctggctctttctgcaactcttgtccattacgcctattaatgaatggctgctaaagggccttcagaccgttggctgcatgccgcctcctgtgagctccgctgtaatcttgacgaaggcagtgggaggcaacgaaggaattgtgattacccctctcctgctgctgctattccttggctcttcaagctctgtaccttttacaagtatattttcccaattgtttatgactgtagtagttcccctgatcatcgggcagattgttcgacggtatatcaaagactggctggagagaaagaagcctccatttggagcaatcagttccagcgtgctcctgatgattatatacacaacgttttgtgatactttcagcaaccccaacatcgacctcgataagttcagcctagtcttgatccttttcataattttctcaatccaacttagcttcatgctgttgacctttattttctcaacccgaaataatagtggattcacccccgcagataccgtggcaatcattttctgcagtacacacaagagcttaaccttgggcatcccaatgttaaagatcgtgttcgctgggcatgagcacctcagcctgatcagtgtacctctgctgatctatcaccctgcccagattttgctggggagcgttcttgtcccgacgattaaatcttggatggtctctagacagaagggagtcaaacttacccgacccacagtctag

SEQ ID NO: 54066 - DNA, 195 bp, Artificial Sequence
  Description of Artificial Sequence: Synthetic coding sequence
atgcggctgctggagagaatgaggaaggattggttcatggttgggatcgtgctggcaatcgctggggctaagctggaaccaagcatcggggtgaatggcggtccgttgaaacctgagatcaccgtctcatacatagccgtcgctactatctttttcaactctggactctccctgaaaactgagctccttacctag

SEQ ID NO: 54067 - DNA, 1077 bp, Artificial Sequence
  Description of Artificial Sequence: Synthetic coding sequence
atgagacttttggaacggatgcgcaaagattggttcatggtcggtatcgtgctcgcaatcgcaggcgctaaattagagccctccataggagttaatggaggcccactaaagcccgagatcactgtgtcgtatatcgcagtggccaccatatttttcaattctggcctgtcacttaagactgaggagctaacttcagccttagtgcacctaaagctacacctgtttatccaaattttcaccctggccttttttccagcaactatttggctcttcctccaacttctgtctataacgcctattaacgagtggctcctgaagggcttgcagactgtgggctgcatgcctcctcccgtttccagtgccgtgatcctcacgaaggcagttggcggaaacgaggccgctgctatatttaactccgcctttggaagcttcctgggtattgtgattacccctcttcttctcctgttattcctcggctcttcttccagcgttcccttcacatctatcttcagtcagctgtttatgacagtggttgtacccctcattatcggtcagatcgtgcgcagatatatcaaggattggttagaaagaaaaaagcctccctttggcgctatttcaagttcagtgctgctgatgatcatttacaccacattctgtgataccttttctaaccctaacattgaccttgataaattctctctggttttgattctgtttatcatattttctatccagctgtcattcatgctgctgactttcatcttcagtacaaggaataatagcgggtttaccccggctgatacagtggccattattttttgttcgactcacaagtctctgacacttggtatcccaatgctgaagatcgtcttcgcaggacacgagcatctgagcctgatcagcgtgccactgttgatctaccacccagcccagatcttactcgggtccgtattggtgcctacgattaaatcctggatggtcagccgacagaaaaagttgctgcagactcgcggtcctttagccaatttgaataatcccgagggcctcgagtacctgagcattaaattcggccattag

SEQ ID NO: 54068 - DNA, 1707 bp, Artificial Sequence
  Description of Artificial Sequence: Synthetic coding sequence
atggtattgggtcctgagcagaaaatgtccgacgacagcgtcagtggtgaccatggtgaatcagcttcattagggaatataaacccagcttactcgaaccctagtctctcccagtcccccggtgacagtgaagaatatttcgccacttacttcaacgagaaaattagcataccggaagaggagtacagctgcttctctttcaggaagctatgggcctttacaggtccaggattcctcatgagtatagcctacctggaccctggcaacatcgagtctgacttacaatctggagctgtggccggatttaaattgctctggatactgcttcttgctaccttggtgggcttgctgctgcaaagactggccgcacgactgggtgtagtaacaggactgcacctggcagaagtgtgccatcgtcaatacccaaaggtgcccagagtcatactctggctaatggtcgagttagctatcattggatcggatatgcaggaggtaatcggatctgcaatcgcaatcaacctgctgtcggtgggtcggattcccctatggggcggagtactgatcactatcgctgatacatttgtcttcctgttcctggacaaatatggccttcgcaaactcgaagcatttttcgggttcctgataacaatcatggctctcacgtttgggtatgagtatgtgactgttaaaccctcccaatcccaggtgctgaaaggcatgtttgtcccaagctgttcagggtgtcgcacgccccaaatcgaacaggctgtgggcatagtaggcgctgtgatcatgcctcataatatgtatctgcattcggccctggtgaagtcacggcaagtcaatcgcaacaacaagcaggaggtccgcgaggcaaacaaatacttcttcatcgagagctgtattgccttatttgtctcttttattataaacgtgtttgtagtcagtgtcttcgccgaagctttcttcggaaagaccaacgaacaggtcgtagaggtgtgcaccaacacttcttcaccacatgcagggcttttccctaaagataactcaactctcgctgtggacatctacaaaggaggcgtggtgcttggctgttacttcgggccagcagccctgtacatctgggccgtgggtatactcgccgcagggcagtcttctaccatgactggcacatactcaggccagttcgtcatggaaggcttcttgaacctgaaatggagtcggtttgcgcgagtggttttgactaggagcatcgcgattatcccgactctcctcgtggcagtcttccaggatgttgagcacctcaccgggatgaacgactttttgaacgtactgcagagtctgcagttacctttcgcactcattccaattctgaccttcacctcactcagacctgttatgagcgacttcgccaatggcctggggtggcgcatagctggcggaatcctcgttctgatcatatgctccattaacatgtactttgttgtagtgtatgtgagggatctgggccatgtggcactctatgtcgtggctgctgttgtatcagtcgcatatctcggcttcgtgttttatttggggtggcaatgcctcattgccttgggaatgagcttcctcgactgcggccatacgtgtcacctgggcctgacagcccagcccgagctatacctgctaaacacaatggacgccgactcattggtctctaggtag

SEQ ID NO: 54069 - DNA, 1686 bp, Artificial Sequence
  Description of Artificial Sequence: Synthetic coding sequence
atggtcctcggacccgagcagaaaatgagcgacgactcagtgagcggggaccacggcgagtccgcaagcctaggcaatatcaatccagcttacagtaacccttctctatctcagtcacctggcgactccgaggagtattttgcgacatatttcaacgaaaagataagcatccctgaggaagagtatagctgcttcagtttccggaaattatgggcctttaccgggccagggttcctgatgtccattgcatatctggatccaggaaacatcgagtcagacctgcaatccggggctgtggctggttttaagttgctctggatcttactactcgcaactctcgtgggcctcctcctccagcggctggctgcccgtctcggggtggtgaccggcctgcacctggctgaagtctgccatcgtcagtatcccaaagtgcctagggttatcctctggctcatggttgagcttgccattattgggagcgacatgcaggaggtgattgggtctgctatcgcgattaacttgctgagcgtaggtcgcattcccctgtggggtggcgtcctcatcacaattgccgatactttcgtgttcctctttttggataagtacggcctgaggaagctggaggcattctttgggtttttgattaccatcatggccttgacgttcgggtacgaatatgttacggtaaagccgagtcagtcacaggtgctgaagggcatgtttgtgccatcttgttccggctgtcgaacccctcaaatcgagcaggccgtggggattgtgggggcagtcataatgcctcacaatatgtaccttcatagcgcgctcgtcaagtccagacaggtgaatcgcaataacaaacaagaagttagggaagcaaacaaatatttttttatcgagagctgcatcgctctctttgtaagctttattattaacgtgttcgttgtgagcgtgttcgccgaggccttttttggaaagacaaatgagcaggtcgttgaggtgtgtactaacactagctcaccacatgccggtctgttccctaaggataactccacactggccgttgacatctataaaggtggggtggtcctcggctgctattttgggcctgcagctctttatatttgggccgtggggatcctcgccgctggtcagagctccaccatgacaggaacatactcagggcagtttgttatggaaggcttcctgaacttgaaatggtcccgctttgctcgagtcgttctgacgagatctatcgccatcatcccaactttgctggtcgctgtgttccaggatgtggaacaccttactggaatgaacgacttcctaaatgtcttacagtcacttcagctgcccttcgcccttattcctatcctcacattcacaagcctacgtcccgtgatgtctgacttcgccaacggcctgggctggaggatagctggtggaattctcgtcttgatcatctgtagtattaatatgtacttcgtggttgtatatgttcgagatctgggacacgtcgccctctatgttgtcgcagcggtcgtgtcggttgcctatttgggtttcgtgttctacctgggttggcagtgcctcatagccctgggaatgtcattcttggactgtggccacactgtatctatcagtaaaggacttcttaccgaggaagccacaagaggatacgtgaagtag

SEQ ID NO: 54070 - DNA, 1773 bp, Artificial Sequence
  Description of Artificial Sequence: Synthetic coding sequence
atgaggaagaaacagttgaaaacagaagccgctcctcactgcgagcttaagtcatattcaaaaaactccgctacacaggtcagcaccatggtgctagggccagagcagaagatgtcggatgacagtgtgtcaggtgatcacggcgagtccgcctccctggggaatatcaatccagcttactcaaacccgagtctgtcccagtctcctggggactccgaggagtacttcgctacatatttcaacgagaaaatatcgattccggaggaggagtatagctgtttcagcttccggaagctctgggcttttaccggcccagggttccttatgagcatcgcttacttagaccccggtaatattgagtcagatcttcagtctggcgctgtggctggatttaagcttctctggatacttctcttggccaccctggtgggcctgctcctgcagagattggccgcaagattgggcgtggtgacaggactgcacctagctgaagtctgtcaccgccagtatcccaaggtgccccgtgtaatcctgtggctgatggtcgagctggccattatcggttctgacatgcaggaagtgattggaagtgctattgcaatcaatctactgagcgtgggacgcattccactgtggggcggtgtcctgatcaccatcgcggatacctttgtgttcctattcctggataagtatggcctgagaaaattagaagcgttcttcggtttcttgattaccattatggcacttacctttggttacgaatacgtgaccgtgaagccctctcaatctcaggttctgaaagggatgtttgtgccctcctgtagcggatgtcgcactccacagattgaacaagcagttggcattgttggggcagtgatcatgccccataacatgtacctacactccgctctggtgaaatcaaggcaggtaaatagaaataacaagcaggaggttagagaggcaaataagtacttcttcattgagtcatgtatcgccctttttgtgagtttcataataaatgtgttcgtggtgagcgtctttgcagaggcattcttcggtaaaacgaatgaacaggttgtcgaggtctgcaccaacacttccagtccccacgccggactattccctaaagataactccaccctggcagtcgatatctacaagggtggcgtcgttttgggttgctactttggtcccgctgccctgtacatctgggctgttggaattctcgccgcagggcagtcgtccactatgactggtacctacagcggtcaatttgtgatggagggcttcctgaacctgaaatggagccggtttgcgagagtcgtgctgacaaggtccattgctatcatcccgacattgctcgttgccgtgtttcaggatgtggagcatcttacaggcatgaacgatttcttgaacgtgctgcaatctctgcagctccctttcgccttgataccaatcttgaccttcacctcattacggcctgtcatgtccgatttcgcgaatggacttggttggaggattgccggaggcatcttggtgttaatcatttgctctattaacatgtactttgtggtggtgtacgttagagatctagggcatgtggccctgtatgttgtggccgcagtagtcagcgtcgcctacctgggtttcgtcttctatctggggtggcagtgtctcattgcacttggaatgtcattcctggattgcggccacaccgtctcaatctctaagggtttgttgactgaagaggcaactcgcggttacgtcaagtag

SEQ ID NO: 54071 - DNA, 1686 bp, Artificial Sequence
  Description of Artificial Sequence: Synthetic coding sequence
atggtgctaggtcccgagcagaagatgtctgacgattccgtgtctggggatcacggtgagtccgcatccctgggcaacatcaacccggcatattcaaatccttccctctcccagagtcctggtgattcagaggagtattttgctacttacttcaatgagaaaatcagcatacccgaggaggagtattcttgcttctcgtttcgcaagttgtgggccttcactgggccaggatttttgatgagtatcgcttaccttgatcccggaaatattgagtctgacctccaatctggagccgttgcgggatttaagctcctgtggatccttctactcgctactctggtcgggcttctgctgcagagactggctgccaggctaggcgtcgtgactggcttgcatctggccgaagtctgccaccggcaatatccaaaagttccaagggtcatcctgtggttgatggtggagctggccatcattggatcagacatgcaggaagtgatcggctctgccatcgccatcaacctgctctctgtgggcagaatccccttatggggaggggtattaatcacaatcgctgatacgttcgtctttttgtttttggacaaatatggccttcggaaactggaggccttctttggcttcctcattacgataatggctctgacttttggctacgagtatgtcacagtgaaacctagccagagccaggtgctgaaaggcatgttcgtgcccagctgttccggatgtcggaccccgcagatcgaacaggctgtggggatagttggggcagttataatgccccacaatatgtacctgcattcagctcttgtgaagtccaggcaagttaacaggaataacaaacaagaggtgcgcgaggctaacaagtatttcttcatcgagtcgtgcattgccctgtttgtcagctttatcatcaatgtctttgtggtgagcgtgtttgctgaggccttctttggtaagactaacgaacaggtggtcgaagtctgtaccaacacaagctcacctcacgccggactgttccccaaggataattcaacgctggccgtcgacatttacaagggtggggttgtgctgggttgttattttgggcctgctgccttgtatatttgggccgtgggaatcctggctgccggacagtcctcgacaatgaccggaacgtatagcgggcagttcgtcatggagggctttctgaacctgaagtggtctcgatttgcgagggtggttctgactagaagtattgccattatccccaccttgcttgtcgccgtatttcaggacgtcgagcacttgacaggcatgaacgatttcctcaatgttctacagagtctgcagttaccatttgccctgatccccatcctaaccttcacatctcttagaccagtcatgtccgacttcgctaatggcttgggatggaggattgcgggagggatcctcgtattgattatctgttcgatcaatatgtatttcgtggttgtgtatgtgagggacctgggccacgtggccctgtacgttgtggcggctgtggtgtctgttgcctacctgggttttgtgttctacttggggtggcaatgtctgatagctcttggcatgagcttcttagactgcggacataccgtgtctataagcaagggcctcctgactgaggaggcgacgagggggtacgtgaagtag

SEQ ID NO: 54072 - DNA, 1674 bp, Artificial Sequence
  Description of Artificial Sequence: Synthetic coding sequence
atgagtacagtggactatctgaatagcgtgagcggcgaccatggcgagtctgcatctcttggcaatataaatcctgcctattctaacccttccctgtcgcagtcaccaggagatagtgaggagtatttcgcaacttacttcaacgagaaaatttccattcctgaggaagagtactcctgcttctcttttcggaaactgtgggcatttaccgggccaggattcctgatgagcattgcgtatctcgatccagggaacattgagtctgaccttcagagtggcgcagttgcagggttcaaactgctgtggatacttctgctggcgactctcgtaggacttctgctccagcgactggcagcccgactgggggttgtaactggattacacttggccgaggtctgtcatcggcagtacccgaaagtgccaagagtgatactctggctcatggtcgagctggcaatcatcggaagcgatatgcaggaggttattggctcagcaatcgccattaacctcctgtccgtgggaagaatcccgttatggggtggggtcctgataaccatagctgatacgttcgttttcttgttcctagacaaatatggtctccggaaactcgaggcgttcttcggattcctgattaccataatggccctgacatttggctacgagtatgtgactgtgaagccctctcaaagccaggtgttgaaaggcatgttcgtcccaagctgtagcggttgtagaacaccacagattgagcaggcggtgggtattgtcggcgctgtgatcatgcctcacaacatgtatctgcattcggccttggtgaaatcaagacaagtgaaccggaacaataagcaggaggttcgcgaagccaacaagtactttttcatcgagtcctgtatcgccctgttcgtgtcctttattataaatgtttttgtggtttctgtttttgcagaggccttctttgggaagaccaacgaacaggttgtcgaggtctgcactaacaccagttcaccacacgctgggttatttccgaaagacaactccacgctcgctgtggatatttacaaggggggtgttgtgctcggctgttacttcgggcctgctgcgttgtatatctgggctgtgggcatcctggccgcaggccagtcctccacgatgaccgggacttatagcggccagtttgtcatggaaggttttttaaatctaaaatggtctcgctttgccagggtggtgctaacccgctcaatcgcgattatccctacactgctagtagccgtgttccaggacgtggagcacctcacaggtatgaacgattttcttaatgtcttgcagtccctccagctcccattcgcactcattcccattcttacatttactagcctacgccctgtgatgagtgacttcgcaaacggcctgggctggcggattgctggaggaatcctggttttaattatttgttcgatcaacatgtactttgtggttgtgtacgtgcgggaccttgggcatgtagccctatatgtagtagctgccgtggtgtccgtggcttacctcggcttcgtattttatctcggatggcaatgcctgattgcgcttggcatgagtttcttggactgtggtcacacagtgtctatttcaaagggtctgctcacagaagaagccacgcgcggatatgtcaagtag

SEQ ID NO: 54073 - DNA, 1707 bp, Artificial Sequence
  Description of Artificial Sequence: Synthetic coding sequence
atggtgctcggtcccgagcagaagatgtctgatgattccgtgtccggggatcacggagagtctgcttctttgggaaatattaatcctgcctattccaatccgtcccttagtcagagtccgggtgattctgaagagtacttcgccacttattttaacgagaagatttcaattccggaagaagagtactcgtgtttcagctttcgcaaactctgggcctttaccggcccaggatttctgatgtcgatagcctatctcgaccccggaaacatcgaatccgacttgcagtccggcgcagtggctggttttaagctgctgtggatccttctgctagcgacactggtggggctgctgttgcaaagattagcggcaaggttgggcgtggtaactggcttacatctggctgaggtctgccatcgacagtaccctaaagtgcccagagtcatcctgtggctgatggtcgaactggctataattggcagcgacatgcaagaagttattggtagcgccattgctataaatctgctctccgtggggagaatcccgctctggggcggtgttcttatcacaattgctgataccttcgtgttcctgtttctagataaatacgggctgcgaaaattagaggctttcttcggcttcttgatcactatcatggccctcacattcggctacgagtatgtcacggtgaagccttcgcaaagtcaggtcttgaagggtatgtttgtcccttcgtgttctggttgtagaaccccacagatcgaacaggctgtcggaatcgtgggtgccgtgatcatgcctcacaatatgtatctgcatagcgctcttgtcaaatcccgccaggtcaatcggaacaacaagcaggaagttagggaggctaataaatacttctttatcgaatcttgcattgcactcttcgttagcttcataatcaacgtcttcgtcgtaagcgtgtttgctgaggcttttttcggtaaaaccaatgagcaagtcgtcgaggtgtgtactaacacttcgtcgccacacgctggactctttcccaaggacaacagcactcttgccgtggacatatataagggcggagtagttctggggtgttattttggccctgccgctttgtatatctgggccgtggggatcctggcagcaggccaaagtagcactatgacaggtacatattctggtcagtttgttatggagggctttcttaatctcaagtggtcaaggttcgctcgcgtggtcctgaccagatcaattgcaatcatccctaccctgttggtggccgttttccaggatgtggaacacctgacggggatgaacgacttccttaacgtgctgcagagccttcagctaccgtttgcccttattccaatcttaaccttcacatctctcagacccgtgatgtccgacttcgccaacggcctgggatggaggatcgccggaggaatcttggtgttgatcatttgcagtataaacatgtatttcgtggtcgtttatgtgagggacctgggacatgtcgccctttatgtggtggccgcagtggtctcggtggcttacctagggtttgtgttctacctgggctggcagtgcctaatcgcgctcggcatgagcttcttggattgtggtcacacctgccatctgggcctcactgcgcagccagaactgtacctgctgaacaccatggatgcggattctctggtatcgcggtag

SEQ ID NO: 54074 - DNA, 1449 bp, Artificial Sequence
  Description of Artificial Sequence: Synthetic coding sequence
atgagcatcgcttacctagatcccggtaacatcgaatctgatttacagtcgggcgcagtggctggattcaaattactctggatactgcttctggcaaccctggttggactgctcttacagcggttagcagccaggctcggtgtcgtcactggcctgcacctggctgaagtgtgccatagacaatacccaaaggtacctagggtgattctgtggcttatggtggaattagccattattggcagtgatatgcaagaggtcatcggatcggccatcgccataaacctactttccgtgggtcgtatccctttgtggggtggagtgctaatcactatcgctgataccttcgtgttcctgttcctcgacaaatacggcctcagaaagctggaagccttctttggttttctgattacaattatggccctgacttttggttatgaatatgtcacagtcaaacccagtcagagccaggtgctgaaaggaatgtttgtacctagttgttctgggtgccgcacacctcagattgagcaggcagtcgggatcgtcggggctgtgataatgccgcataacatgtatttgcactctgcactcgttaagagccgtcaggtgaaccgaaataacaaacaagaggtgcgggaggccaataagtattttttcattgaaagctgtattgccctattcgtttccttcattattaacgttttcgtggtgtctgtgttcgctgaagcgtttttcggcaaaactaatgagcaggtggtggaggtgtgcacaaacactagtagccctcacgccggactattcccaaaggacaatagcaccctggctgtggatatctacaagggaggggtagtgctcggatgttactttggccctgccgctttatatatatgggccgttggcatccttgctgccggacagtctagcacgatgactggcacttatagtggacagtttgtgatggaagggtttttgaacctgaaatggagcaggtttgccagggtcgttcttactaggagcatcgccataattcctacactcctagttgcggtgtttcaggatgtcgagcacttaacgggcatgaacgatttcctcaacgtcctgcagtccctgcagctgccctttgctcttattccaattttgacattcacatccttgcgccctgtgatgagtgattttgccaacgggcttgggtggagaattgccggaggcatcttggtgttgatcatatgctctatcaatatgtacttcgtggtggtgtacgtgagggacctcggccacgtcgccctttacgtcgtggcagccgtggtgtcagtggcatacttgggcttcgttttctacctggggtggcagtgtctcattgccctaggtatgtctttcctggactgcggccatacagtaagtatatccaagggcctgttgacagaggaggcaacgagaggctatgttaagtag

SEQ ID NO: 54075 - DNA, 1707 bp, Artificial Sequence
  Description of Artificial Sequence: Synthetic coding sequence
atggtactggggcctgagcaaaaaatgtctgacgattcggtgtccggtgatcacggagaaagtgcctcacttgggaatattaacccggcttactctaacccaagtctctcacagtcccccggtgatagcgaggaatatttcgctacctacttcaatgaaaagattagcattccggaggaagaatacagttgcttttcattcaggaaactgtgggcattcacggggcctggattcctaatgtctattgcttacctcgaccctgggaacattgaaagtgatctccaaagcggcgctgtcgctggtttcaaattactgtggatcctgctcctcgcaacactggtcggcttgctgctccagcgcttggcagcccgactgggcgtcgttactgggctccacttggctgaagtctgtcaccgccagtacccaaaggtgccccgtgtcattctttggcttatggtggagttggctattataggcagtgacatgcaggaggttatcggatctgccattgctattaacctgctctccgtcggcaggatcccattatggggcggagtcctgattacgattgcggatacatttgtctttctgtttctagataagtacgggctcagaaagttagaagctttttttgggttcctgataacgattatggcccttacttttggctacgaatacgttacagtaaagccctcgcagtcccaggtgctgaagggcatgttcgtcccctcatgctccgggtgccgaacgccacagattgagcaggctgtcggtatcgtcggcgcagtcatcatgcctcataatatgtacttacatagtgccctcgtgaagtcccgtcaggttaaccgtaataacaagcaggaggtccgggaggccaataaatacttctttattgagagctgtatagccctgttcgtcagttttatcatcaatgtctttgttgtgtccgtattcgccgaagccttctttggaaaaactaatgaacaagttgtcgaggtttgcaccaataccagcagccctcacgcgggactgttccctaaggacaattctactcttgccgtcgacatttacaagggcggagtggttttagggtgctatttcggccctgctgcgctttacatttgggctgtcggcatactggcagccggacaatcttcaaccatgactggaacttacagcggccagtttgtgatggagggattcttgaacctcaagtggtctagatttgcgcgtgtggtgctgactaggtccatcgcgattatacccacccttctagtagcagtcttccaggatgtcgaacacctcacaggaatgaatgactttctgaatgtacttcaatcactgcagctgccttttgccctgatccccatcctcaccttcacctccctgcgcccagttatgtcagactttgcaaacggactggggtggaggattgcgggagggatcttggtcctgattatttgtagcataaacatgtattttgttgttgtgtacgtgcgtgatctaggtcacgtggctctgtacgttgtggctgcagttgttagtgtggcctacctgggcttcgtattctatcttggttggcaatgcctcatcgcgttgggaatgtctttcctggactgcggccatacatgtcatctgggtctgacagctcagcctgagttatacctcctgaatacaatggacgcagacagtctggtctctagatag

SEQ ID NO: 54076 - DNA, 1773 bp, Artificial Sequence
  Description of Artificial Sequence: Synthetic coding sequence
atgcggaagaaacagctgaagacagaagccgcaccgcactgcgaactgaagagttatagcaaaaactcagctactcaagtttccacgatggtgttgggcccagagcaaaaaatgtcagatgactccgtgagcggcgaccatggagaaagcgcatccctcggaaacattaaccctgcgtattcaaatccctccctgagccagtcccccggagatagcgaggaatactttgcaacatattttaatgagaaaatttccattcccgaggaagaatatagttgcttcagctttcggaagctctgggcattcactggaccgggttttctgatgtctattgcctacttagaccccggaaatatcgaatctgacctgcaaagcggcgcagtagccggtttcaagctgctttggatcctgttgctcgccaccctcgtggggctacttctccagcggctggctgctcggctgggggttgttactgggctccaccttgcggaagtgtgccaccgacagtatccaaaagtccctcgggtcattctgtggcttatggtggagcttgccataattggcagcgacatgcaggaggtcatcggtagtgctatagctatcaatttgctttcagttggcagaatccctctttggggtggagtacttatcacgatcgctgatacattcgtgtttttattcttggacaagtatggactgaggaaactggaggccttctttggatttctcattacaatcatggccttaaccttcggttatgagtatgtgacagtgaagccaagccagtcccaggttctcaaaggcatgttcgtgccatcttgtagcggctgccggacaccacagatcgagcaggccgtgggaattgttggcgctgtaatcatgccccataacatgtacctccacagcgccctggttaagtcccgacaagtcaatagaaacaacaagcaggaagtccgggaagccaataagtacttttttatcgaatcctgcattgccttgttcgtgtcttttatcatcaatgtgttcgtcgtgtcagtctttgctgaggcgtttttcggcaaaactaacgaacaggtcgtcgaagtgtgcactaatacatcctcaccacacgctggcctgttccccaaggacaactccaccctagctgtggacatctacaagggcggtgtggtgctagggtgctatttcggacccgcagctctctatatctgggctgtgggaattctggcagcgggtcagtcaagtacaatgacgggcacttattccgggcagttcgtcatggaaggcttcctcaacttgaaatggtctcggttcgctcgcgtggtcctgaccagaagcatcgctataatcccgacactgcttgtcgctgtgtttcaggacgtagagcacttgaccggcatgaatgactttctgaacgttctgcagagcctccaactgccatttgccttgattccgattttgaccttcacttctctccgcccagtgatgtcagattttgccaatgggctgggatggcgcatcgccggtggcatcctcgtattgatcatttgcagcatcaacatgtatttcgtcgtggtatacgtccgggacctgggtcatgtagccttgtacgtcgtggccgcagtcgtgagtgtggcgtacctgggtttcgttttttatcttggttggcagtgcctgattgccttgggaatgagctttctggattgtggccacactgttagcattagcaaggggctgctaactgaagaagccacccgtggctacgtcaagtag

SEQ ID NO: 54077 - DNA, 12 bp, Artificial Sequence
  Description of Artificial Sequence: Synthetic coding sequence
atggtcctgtag

SEQ ID NO: 54078 - DNA, 450 bp, Artificial Sequence
  Description of Artificial Sequence: Synthetic coding sequence
atggtcttgggacccgagcagaagatgagcgatgattcagtctctggcgatcacggcgaatccgcctcattgggcaacattaatcccgcatatagcaacccatctctgtcgcagtcccctggcgactcggaagaatattttgctacatactttaacgagaagatttccattcccgaggaggagtactcctgtttcagctttaggaagctgtgggctttcaccggccctggtttcctgatgagtatcgcctatctcgatccaggcaatatcgagagcgacttacagtcgggagccgtggctggcttcaaactgctctggatactgcttctggccactctggttggcctgctgttgcaaagactggctgccagactgggggtggtgacaggccttcatctcgctgaggtgtgccatagacagtatcccaaggtgcctagggtgatactctag

SEQ ID NO: 54079 - DNA, 2145 bp, Artificial Sequence
  Description of Artificial Sequence: Synthetic coding sequence
atgacacagatgtcgcaagtgcaggagctctttcacgaagccgctcaacaggatgccctcgcccagcctcagccgtggtggaagactcagctctttatgtgggagcctgtgctcttcggaacttgggatggagtcttcacatcatgtatgatcaatatcttcggagttgtgctctttctaaggacgggatggctggtgggtaacacaggtgttctccttggcatgttcctggtgagcttcgtcattctcgtggcattggtaaccgtactttcgggcatcggagttggcgagaggagcagtatcggctctggcggagtgtactctatgataagctcagtcctcggcggacagactgggggaacgattggtctcctatacgtgttcgggcagtgtgttgctggcgcaatgtacatcactggcttcgctgaaagtatctcggatctgctgggcctgggaaacatctgggccgttcgcggtatctccgtcgccgtgctcttggctttgctgggcattaatctcgctggcgtcaagtggatcatccggttacagttgttgttattgttcttgctcgctgtttccacgctggattttgtagtcggaagtttcacccacctcgatcctgaacacggtttcatcggctattccccagagttattgcagaacaacactctgcctgattactcccctggtgagagtttctttacggtgtttggcgtcttctttcctgctgccacgggggtgatggccggtttcaacatgggaggcgaccttcgcgagcctgccgctagcattccccctggcagtctggccgctgtgggtatttcctggtttctatacataatttttgtctttctcctgggcgcaatctgcactcgcgaagccctccgctatgatttcctaatcgccgaaaaagtgtctctgatgggctttctctttctcttaggcctttatatttccagcctggcctcttgcatggggggactgtatggcgctccccgaatcctgcagtgcattgcccaggagaaggtgattcctgctctggcatgtctaggccagggcaagggccctaacaagacaccggtggctgccatatgcctaactagcctggtgaccatggcattcgtgttcgttgggcaagtcaacgtacttgcaccaatcgtgacgatcaactttatgctgacctacgttgcggtggactattcatacttttctttgtctatgtgctcctgtagtctgacaccagttcctgagccggttttgagggaaggcgcagagggccttcattgtagcgaacatctacttttagagaaggccccttcgtatgggagtgagggtcccgcacagagggttctggaagggacccttctggagttcacaaaagatatggaccaactgttgcagctaacccgcaagcttgagtcctctcaaccgagacagggtgagggaaaccgcacccctgaatctcaaaagaggaagagcaaaaaggcaacaaaacagactcttcaggacagcttcctgttagacctgaagagcccgccttcgttcccagtggaaatatcagacaggctgccagccgcaagttgggagggacaggagtcatgttggaataaacagacctcgaaatccgagggcactcaaccagaggggacctacggggagcagttggtacccgaactttgtaaccaaagcgaatcttccggtgaggactttttcctgaagagtaggctccaggagcaggacgtgtggcgacgaagcactagcttttacactcatatgtgtaacccctgggtttctctcttgggagcggtgggctcgcttctcataatgtttgtgattcaatgggtttacaccctagttaatatgggggttgcagccattgtgtacttttacattgggagagccagcccaggtctccatctgggttccgcttccaacttcagctttttccgatggatgcgatctctacttctgccaagctgtcgaagtctgagatcgcctcaggagcagataatcctggccccttccctggccaaagtcgacatggagatgacccagttgacccaagaaaatgcagattttgccactagggacagatatcatcacagttccctagtcaatcgtgagcagctgatgccccactattag

SEQ ID NO: 54080 - DNA, 2145 bp, Artificial Sequence
  Description of Artificial Sequence: Synthetic coding sequence
atgactcagatgtcccaggtgcaggagctgttccacgaagccgctcagcaagatgccttagcccagccccagccttggtggaaaactcaactgtttatgtgggaacccgtccttttcggcacttgggatggggttttcacatcctgtatgatcaacattttcggcgttgtccttttccttcggaccggatggctggtgggcaataccggcgtcttgctgggaatgttcttagtcagtttcgtaattttggttgctcttgtaaccgtgctgagtggaatcggggtaggagagcggagttccataggcagtggaggcgtgtactctatgattagtagtgtcctgggcggacagacaggcggaaccattggcctgctctacgttttcgggcaatgcgtggccggtgccatgtatatcactggtttcgctgagtccatctcagacctgctcgggcttggcaacatttgggccgtccggggtatttccgttgctgtactgctcgctttactgggcattaacctggcaggcgtgaagtggattattcgcctgcagctcttgctcctgttcttactcgctgtgagcactctggattttgtggtgggaagcttcacacacttggatccagagcacggcttcataggctattccccagaactccttcagaacaacaccctcccagattatagcccaggcgagtccttctttactgtatttggtgtgttttttccagctgctacaggggtcatggccggatttaacatggggggagacttacgagagccagccgcaagtattccaccaggctcgctggcagccgttggaatctcctggttcctgtatattatctttgtattcctgctaggcgctatttgcacgagagaggccctccgctatgattttctcatcgccgagaaggtgagtctgatggggttcctgtttctgctgggtctgtatattagcagtctcgccagttgcatggggggactctatggagctccacgaattctccagtgcattgcccaggaaaaagttatccctgctctagcatgcttgggtcaggggaaggggccaaataagacccccgtggcagccatttgtttaacttcattggtcactatggctttcgttttcgtggggcaagtcaacgtcctcgcgcctattgtcacaataaatttcatgttgacttatgtggccgtggattactcttatttcagcttgtccatgtgttcttgtagcctgacccctgtgccagaacctgtgctgagggagggcgcagagggattacactgttcagagcatttgctactggaaaaggccccttcctatggatctgagggcccagctcaacgggttctggagggaactcttttggagttcacgaaggatatggatcagctgctgcaactcacgcgcaagctcgagagctcgcagccacgccagggcgaggggaacagaacgcccgaatctcagaaaagaaaatccaaaaaggctacaaaacagaccctgcaggacagcttcctcctggatctgaaatctccccctagctttccagtcgagatttctgaccgtctcccagcggctagctgggaagggcaggaatcctgttggaacaaacagactagtaaaagcgagggcacccagccagaggggacctatggcgaacaactggtccccgagctgtgtaatcagtcagagtcctccggcgaagattttttcctcaagtcacggctgcaagaacaagacgtgtggagaagatctaccagtttctacacacatatgtgcaacccatgggtgtcactgctcggagctgtcgggagcttactgattatgtttgtgatccagtgggtctatacacttgtgaatatgggcgtggccgcaatagtgtacttttatatcggaagagcttctcccggtttgcacttgggaagcgcttccaatttcagcttcttccgttggatgaggagcctgctgctccctagttgccgctcactgaggtcacctcaggagcagatcattctcgcaccaagcctagctaaggtggatatggagatgactcagctgacccaggagaatgccgactttgcaaccagggacaggtaccatcactcaagccttgtgaatcgcgagcaactaatgccacattattag

SEQ ID NO: 54081 - DNA, 1617 bp, Artificial Sequence
  Description of Artificial Sequence: Synthetic coding sequence
atggcatccgagtcttcaccgcttctggcgtatcgcctcctcggggaggagggcgtcgcgctcccagctaatggcgctggaggccctggtggtgcatccgcgaggaaactgtctacttttctgggagttgtcgtcccaacagtcctttctatgttctcaatagtcgtattcttgaggattgacgccaccggcccatcagggctaagagtgttgccacaggggtacggctggaacctgctctacggctctctgctactgggcctagtggggggagtgtgtacactgggggctggcctttatgcaagggcaagtttcctgacctttttattggtatccggctctcttgcctctgtgctgatatcatttgtggccgtgggcccaagggatatcaggctgacccctagacctggaccaaacggaagcagcctccctccccgattcggccattttactggattcaacagctcaacactcaaagataatcttggcgctggatatgcagaggactacaccacaggagccgtgatgaacttcgctagtgtgttcgcagtattatttaatggttgtactggcatcatggctggtgcaaacatgtcgggagaactgaaagacccttcccgcgctatccctcttggcaccatagtggctgtcgcatacacctttttcgtctacgttctgctgttcttcctgagctcctttacatgcgatcgcactctgcttcaggaggattacggcttcttccgggctatctctttatggccacccctcgtcctgattgggatctatgccacagcactatccgccagcatgtcaagtctaattggagcaagtagaattttgcacgccttagccagggatgacctcttcggagtcatccttgccccagccaaggtcgtgtcaagaggcggtaacccttgggctgctgtactgtactcatggggcctagtacagctggtgcttctcgctggcaaactgaataccctcgctgctgtggttactgttttttacctggtggcatacgccgcagtggacctaagctgcttgagcttagagtgggcttcggcgcctaactttcgccctacgttcagcctgttctcctggcacacttgcctcttaggggttgccagctgcttattgatgatgttcctgattagtcctggggctgccggtggttctctgttactcatgggcctcctggcggctttgctgactgctcggggaggaccctctagctggggttatgtgtctcaggccctgctctttcaccaggtccgcaagtatttgctccgtctggatgtccggaaggatcacgtgaagttctggagaccccagctcctcctgctggtcggcaacccgagaggcgcattgccactgttacgactggccaaccaacttaaaaaaggcggactgtatgtcctcggccatgtgactcttggagatctggatagcctgccttctgatcctgtacagccacagtatggggcttggctgagtcttgtggaccgagctcaggttaaagcctttgtggatctgacgcttagcccctccgtcagacaaggggctcagcacctgctgcggataagcggactggagtctaattcacaccccctcccttag

SEQ ID NO: 54082 - DNA, 2745 bp, Artificial Sequence
  Description of Artificial Sequence: Synthetic coding sequence
atggcatccgaatcttcccctctgctggcctacaggctcctgggcgaagagggcgtggctctgcctgccaatggagccggagggcctggcggagcttctgccaggaaactctcaactttccttggagttgtggttccaactgtgctgtcgatgttttccatcgtcgtgttcctgcgcattggtttcgtggtgggccacgccggacttctgcaggccctagcaatgctgcttgtagcctattttatcctcgctctgactgtgttgtccgtatgtgcaattgcaactaacggtgctgtgcaaggcggtggagcatacttcatgatttccaggacgcttggtcccgaggtgggcggttctattgggctcatgttctacctggccaacgtctgtggctgcgctgtatcactgctgggcctcgttgaatctgtgctcgatgtattcggagccgacgctacagggccttccgggctccgggtgctgccccaggggtacgggtggaacttgctgtacggaagtctgctcctggggcttgtgggaggtgtttgtactctcggggcagggctttacgcacgggcttcatttctgacatttcttttagttagcgggagcctggcatctgtgctaatctcattcgtggccgttggcccacgggatattcggcttacccctcggccaggtcctaacggttcatccctccctccgcgtttcggccacttcacagggtttaatagtagtactctcaaggacaacctcggcgcaggatacgcagaagattatacgactggcgcagtaatgaatttcgcatcagtgtttgccgtgctcttcaatggatgtaccggaattatggccggagcaaatatgagcggcgagctgaaagatcctagccgggcaatcccattgggaacaattgtcgcggttgcctatactttttttgtgtacgtccttctgtttttcctgtcatcttttacctgcgatcggacattgctccaagaggattatggcttcttccgggcaattagtctttggccccctttggtgctgattgggatctacgctaccgcactctctgcctcaatgtccagcctcatcggggcttcacgtattctgcacgccctggctcgggacgacctttttggggtcatacttgcccctgcaaaggtcgtatcaaggggaggcaatccttgggctgcagttctttatagttggggattggttcagctggtgctgcttgccggtaagcttaacacactggctgcagttgtgacggtcttttaccttgtagcctatgctgccgttgaccttagctgtcttagtctggagtgggcatcagccccaaacttccgccctaccttttcactctttagctggcacacctgccttctgggtgtggccagctgcctcctgatgatgtttcttatctcccccggagccgctgggggaagcctgctgttaatgggtctcttggcggctctgctcaccgcacgcggagggcctagtagttgggggtacgtgagtcaggctctcttgtttcaccaagtgcggaaatatctactaagactagatgttcgaaaggatcatgtcaagttctggaggccgcagttgctcctgttagtcggtaacccaagaggggcactccccctactgagactggctaaccagctgaagaagggcggactgtatgtcctgggccacgttactctgggcgatcttgattccctcccatcggatcccgtgcagccccaatatggcgcatggctgtctcttgtcgatcgcgcacaggttaaggctttcgttgacctgactctcagcccttctgtgcgccagggagcgcagcacctcctgaggatcagtggcctgggcggtatgaagccaaatacattagtactcggtttctacgacgatgcacctccgcaggatcactttttgacggacccagccttcagcgagcccgcagactctacaagggaagggagttctcccgctctctcaacgttgttccccccacctcgggctccaggttctcccagggcattgaatcctcaagattacgttgccaccgtggccgacgccctgaagatgaataaaaacgtcgtcctggctagggcctccggggctctgcccccagagcgtctgagcaggggatcggggggaaccagccagctccaccacgtggatgtatggcccctgaatctgctacgccctcgagggggacccggttatgtagacgtatgcggattgttcttgctccagatggctaccattctgggcatggtccctgcctggcactctgcccgtttaaggatattcctgtgtctgggaccgagggaagcacccggagctgcagaaggacggctgcgcgctctcctgagtcagctccggattcgtgctgaagtgcaggaagtcgtctggggagagggcgctggcgcaggcgagcccgaggcagaggaagaaggagatttcgtgaactctggacggggtgacgctgaggctgaggcactcgccagaagcgcaaatgcactggtgcgggctcaacagggacggggtacaggtgggggaccagggggacccgagggcggagacgccgaagggccaatcacggccctaacattcctctatctgccacggccacccgctgacccggcacggtaccctcgctacttagctcttctggagacactgaccagagacctggggccaactctgttggtgcatggggtgacacctgtaacatgcaccgatctgtag

SEQ ID NO: 54083 - DNA, 1617 bp, Artificial Sequence
  Description of Artificial Sequence: Synthetic coding sequence
atggcgagcgagagtagcccgctgctagcataccgccttttaggtgaggagggggtcgctttgccagccaatggcgcagggggaccaggtggcgctagcgccagaaaactctccactttcctcggcgtggtggtgcccactgtcctgagcatgttttctatcgtggtgttcctgagaattgatgctacaggccctagtggactgagagtgctccctcagggttacgggtggaacttactgtacgggagtctcctgctcgggctggtcggcggagtttgtacactgggtgcgggattgtatgcccgtgccagttttctgacatttctacttgttagcggcagccttgccagtgtgctgattagctttgtcgccgtcggacccagagatatcaggctcaccccccgaccaggcccaaacggaagcagcctccccccaaggttcggacatttcaccggctttaatagttccaccctgaaggacaaccttggggcaggctatgccgaagattacacaaccggagctgtgatgaatttcgcatctgtttttgctgtccttttcaatggatgcacaggcattatggccggagccaatatgtccggtgagctcaaggaccccagccgagccatcccattaggaactattgttgcggtggcgtacacatttttcgtgtacgtactgctcttctttctctctagtttcacgtgtgataggaccctgcttcaagaggactacggcttttttagagctatttccctgtggcctcccctcgtgctgattggcatctacgctacagccctgtcagcctccatgtcctcccttattggtgcaagccgcatcctgcatgcccttgctagagacgatctcttcggcgtgatacttgcgcctgcaaaagttgtaagcagaggcggtaacccttgggccgctgtcctttactcatggggactcgtacaactcgtgttgctggccggaaaactgaacaccctcgccgcagtggtcaccgtcttctacctcgtcgcttacgcggcagtcgacctgtcctgcctgtctctggagtgggcgagtgctccaaattttaggccgactttctctctcttctcctggcatacctgcctgttgggagtggcctcatgtcttctgatgatgtttttaatttcaccaggggcagccggtggatcattattacttatgggtctgctggctgccttgctgaccgcacgcggaggacctagttcctggggatatgtctcccaggccctcctttttcatcaagttcgaaaatatttgcttcgcctggacgtgaggaaagaccatgtaaagttttggcggccacagttactgctgctcgtgggtaatcctagaggcgctctgcccctgctgcggcttgccaatcagctgaagaagggagggctgtatgtcctcggccacgtgacactgggcgatctcgacagtctgcccagcgatcctgttcagccccaatatggtgcatggctgtctctcgtcgacagagctcaggttaaagcctttgtggacctaacattgagcccctctgtcagacagggagcacagcatctgctacggattagtggcctggaatctaacagccatcccctaccctag

SEQ ID NO: 54084 - DNA, 1884 bp, Artificial Sequence
  Description of Artificial Sequence: Synthetic coding sequence
atggccagcgaatcctctccactgctggcctacagactcttaggggaagagggagtggccctgcctgctaatggtgctgggggtcccggtggggcaagtgcccgtaagctctccacgttcttaggtgtggtggtccccacagtgcttagtatgttctccattgttgtattcctgcggattggcttcgtggtaggccatgccggtctgttacaggccctggccatgctgctggtggcctatttcatcctggccctgacagtgttgtcagtctgtgcaatcgcaactaatggcgctgtgcagggaggcggtgcctacttcatgatatcccgaaccctcggacctgaagttggagggagcatcggcttaatgttttatctggctaacgtctgcggatgtgccgtcagcctgctggggctggtggagagtgttctcgatgtcttcggcgcagatgcgactggaccaagtggtctgcgcgtactgccccaagggtacggctggaatctactctatgggtcattgctactgggacttgtgggaggagtctgtacactcggcgcaggtttgtatgctagggccagttttctgacctttctcctcgtgagcgggtccctcgccagcgtgctaataagcttcgtggccgtcgggcctagggacattagactgaccccgcgacccggacctaatggatcgagtttaccacccaggttcggtcatttcactggatttaatagcagtaccctgaaggacaatttaggggctgggtatgctgaagactacacaacgggggcagtgatgaacttcgcaagcgtgtttgccgtcctcttcaacggctgcactggtattatggctggggctaacatgagcggtgaattgaaggacccttctagggcgatcccattgggaaccatcgtagcagtggcgtacacattctttgtctacgtgctcctgttcttcctgagttctttcacctgcgatcgaactctcctgcaggaggattatggatttttccgtgcaataagcctgtggccacctttggtgctgattggaatctacgcaacagctttgtcagctagcatgtcctctcttatcggtgcctcacgaatcctacacgccctggccagggacgacctttttggggttatccttgctcccgctaaagtggtgtctcgcggaggcaacccttgggcagccgtgctttacagctgggggcttgtgcagctagtcctacttgctggaaagttaaataccctagctgccgtggtaactgtgttctacctggttgcttacgcggcagtcgatctgtcttgcctgtccctcgagtgggccagtgcccctaacttcaggccgacgttttctctgttttcgtggcatacgtgcttactcggagtcgccagctgtcttctgatgatgttcctcataagtcccggagccgcaggcggttctctgttgttaatgggccttctggcggctttattgaccgctcggggaggcccttcctcatggggctatgttagccaagccttactgttccatcaggttaggaagtacttgttgcgcttagatgtgcgcaaagaccatgtgaagttttggcgaccccagttactgcttctggtgggtaaccctcgaggagccctgccgcttcttcggttggctaaccagctgaagaagggagggttgtacgtccttggacacgtcacactgggagacctagatagcctgccgtccgacccagtccagccacagtacggagcctggctgtccctggtggatcgggcacaggtcaaagcttttgttgacctgacgcttagcccttccgtgcgccaaggagcacaacacctacttaggatttctggactggagtccaacagtcacccactcccgtag

SEQ ID NO: 54085 - DNA, 390 bp, Artificial Sequence
  Description of Artificial Sequence: Synthetic coding sequence
atggcctctgaaagctcccctctcctggcatataggctgttgggagaggagggggtggccctgcctgcaaacggagccggaggcccaggcggagcttctgctagaaagctctctaccttcctaggggttgtcgtccccacggtgctgagcatgttttccatcgtggtgtttctccgcatcggattcgtcgtcggtcacgcaggcctgctgcaggccctcgcaatgctgctggtggcctactttatcctcgccctaaccgtcctgtctgtgtgtgccattgcaacaaacggagcagttcagggcggaggtgcatattttatgatctcccgcaccctcggacccgaagtgggcggatcaattggtctgatgttctatctcgccaatgtctag

SEQ ID NO: 54086 - DNA, 1461 bp, Artificial Sequence
  Description of Artificial Sequence: Synthetic coding sequence
cactttggcgtccactggcattcacttgtgttcactggaattctgggagtgcactggcacttcgggaccactgccagacttctcgcgctggcccaactggttctcctcgccggaaagttgaataccctggcagccgtagtaacagtgttctacctggtggcatatgccgcagttgacctatcttgtctgagtctagagtgggcctcagcgccaaattttcgcccaacctttagcttgttcagctggcatacatgtctcctgggcgtggcctcctgtctgctgatgatgttccttattagtccaggagccgctggcggtagtctgttgttaatgggcctgctcgcggcactgctgacagctcgtggcggtccgtcatcctgggggtacgtgtctcaggcgctgctgttccaccaggtcaggaagtacctcctccgccttgacgtcagaaaggatcacgtaaaattctggaggcctcaactgctgctgctagttggaaaccctcggggagcgctgccactcctgcgcctggctaaccagctcaagaagggtggtctgtacgtccttggtcacgtgacccttggagatctcgattctctgccgtcagatccagttcagccacagtacggcgcatggctttcactggtcgacagagcccaagttaaggcctttgttgatctgaccctcagtccgagcgtgcggcaaggagctcagcacctgctacggatcagcggcctgggagggatgaagcccaacacccttgtgcttggattctatgacgatgctcctccccaggatcactttcttaccgatcccgctttctcagaacctgcagatagtacgcgagaagggagcagccccgctctttctacactctttcctcctccccgagcccctggttccccccgtgccctgaatccccaagactacgtggcaacggttgctgatgctttaaaaatgaacaaaaatgtcgttttagcgagagcatctggagctttgccaccagagcgacttagcagggggagcggaggaacatcccagcttcaccacgtggacgtgtggcctctgaatctgctgcgtccgaggggcggtccagggtatgttgatgtgtgtggcctcttcttgttacagatggcaacaatactgggcatggtgcccgcttggcactcagctaggttaagaatttttctttgcctgggaccgcgtgaggctccaggcgctgcagagggtagactgcgggcacttttgtcacagctgcgtatcagggcagaggtgcaggaggttgtctggggcgagggcgctggagccggagaaccagaagccgaggaggagggagatttcgttaacagcggtcggggagatgccgaagctgaagcactagcccgtagcgccaacgccttggtgcgtgctcagcaggggagacaccggagaagggcaggttgggccggtgggtggggttgctag

SEQ ID NO: 54087 - DNA, 1896 bp, Artificial Sequence
  Description of Artificial Sequence: Synthetic coding sequence
atggcctccgaatcatcccctctcctcgcatataggctgctgggggaggaaggggtcgccttgcccgctaacggggctggagggcctggcggtgcgtctgcccgaaaactaagcacattcctgggtgtggtggtgcccacagtgttgagcatgttttctattgtcgtgtttctgaggataggctttgttgtggggcacgccggattgcttcaagctttggcaatgctgctcgtcgcctatttcatcctggctctgacggtgctctccgtctgcgccattgccacaaatggagcggtgcagggaggcggagcttattttatgataagcaggacattgggccctgaggttggcggttcaatcggactgatgttctatctggcaaacgtttgtggatgtgcagtgagtctcttaggcctggtggaatcagtgctggatgtcttcggtgctgatgcgacaggccctagcggccttagggtgctgccccaaggatatggctggaatttactttacggatcactactcctggggcttgttggaggcgtttgcaccctgggcgcaggactctacgccagagcgagtttcctgacctttttgcttgtaagtggatctcttgcaagtgtcctgatttcatttgtcgcagtggggccacgcgacatccgcctgacccctaggccaggaccaaacgggtcaagcctcccaccccgtttcggacatttcaccggttttaatagttccactcttaaagacaatttgggggctgggtacgccgaggactacactactggtgccgttatgaactttgcatcagtgtttgctgtcctctttaacggctgtaccgggatcatggctggcgcaaacatgtcaggcgaacttaaggacccgagcagggcaatccccctggggacaattgttgcagttgcgtacacctttttcgtctatgtgctgctgtttttcctgtctagtttcacgtgtgatcggaccctactgcaggaggattacggcttttttagagctattagcctgtggcctcccttggttctgatcggaatttatgctaccgccctctcagcaagtatgtcgtccctgattggagcttctaggatcctgcacgcgctggccagggacgacctttttggcgtgattcttgcgcctgcaaaggtggtcagccgtggcggtaacccttgggccgctgtcctttactcgtggggactggttcagctcgtcctcttggcaggaaagctcaatacactcgccgctgtggtgactgtcttttacctggtggcgtacgcagccgtcgacctgagctgcctgtccctggaatgggccagtgcacctaactttagacccacattctctcttttcagctggcacacttgcttactaggtgtagcctcttgcctcctgatgatgttcctgatttcccctggagctgctgggggttccctgctgctgatggggttgttagccgcactgctgacagcgagagggggtccatcttcctggggctacgtttcccaggccttgctgtttcatcaggtgagaaagtatttacttcgacttgatgtgcggaaagatcacgtgaaattctggcgaccccagctacttttgttggtcggcaatccaagaggggcactgccgcttctgcgcctggccaaccaattgaagaagggcggactttatgttttgggccacgtcacactgggggacctagatagcctccccagcgacccagtccagccgcagtatggagcatggttgagcctggtcgatcgcgcacaagtgaaagcgttcgtggatttgacactctctccatcagtcagacaaggagcccagcatctcctacgaatctccgggctggagtctggcacgctgctgccatgggggtttagaagttag

SEQ ID NO: 54088 - DNA, 2097 bp, Artificial Sequence
  Description of Artificial Sequence: Synthetic coding sequence
atgaacccctttcagaaaaatgaaagtaaagagaccttgtttagtcccgtaagcatcgaagaagtgcccccaagaccaccatcgccgccaaagaaaccctctccaactatctgtggaagtaactaccccctctccatcgcctttattgtcgtcaatgagttctgtgaaaggttcagctattatggcatgaaggctgtgctgattctttattttttgtattttctacattggaacgaggacacttcaaccagcatctaccacgctttttcctccctctgctactttaccccgatactgggagcagccattgccgactcctggctgggcaagttcaaggtgctttccttgatcgggctctcactcattgccctggggaccggcggtattaagccgtgtgtggcggctttcggtggcgaccagttcgaggaaaagcacgctgaagagaggacgagatacttctcagttttttacctctctattaacgcaggttctcttatcagtacattcatcacaccgatgctcagaggcgatgtacagtgtttcggagaggattgctatgccctggcatttggcgtgccaggactgctcatggtgatcgccctggtcgttttcgcaatggggtctaagatatacaataagcctcccccagaaggaaacattgtggcccaggtgttcaaatgtatctggtttgccatcagcaacaggtttaagaacagatcaggggatattccgaagaggcagcactggctggactgggccgctgagaaatatcctaaacaactgatcatggatgtaaaggctctcactagggtcctgttcctgtatattcccttgccaatgttctgggcgttgctagaccagcaaggatcaaggtggacactgcaggccattagaatgaaccgaaatctggggtttttcgttctccaaccggaccagatgcaggtcctcaatccactcttggtccttatattcatcccactgtttgactttgtcatctatagactggtttccaagtgcgggataaacttttcctctctccggaagatggccgtcggtatgatactggcatgtcttgcttttgccgttgctgccgctgttgaaattaagattaacgaaatggctcccgctcaacccggtcctcaagaggtttttctccaggttttaaatttggctgatgatgaggtgaaggtaacagttgtcggaaacgagaataactccctcctgatcgaatcaattaagtccttccagaaaactccgcattactccaaattacatctcaaaacaaagtcacaagattttcacttccacctcaagtaccacaatctgagtttatacacggagcacagtgtgcaggaaaagaattggtattcactggttattcgcgaggacggtaactctatctccagcatgatggtcaaggatactgagagcagaaccaccaatggcatgacaacagtccgcttcgtcaatacactgcacaaggacgtgaacattagtctgtcaaccgatacttccctgaacgtaggagaggactacggggtatctgcctatagaaccgttcagcgaggcgagtacccagcagtgcactgcaggaccgaggataaaaattttagtctaaacctcggcctcctcgacttcggcgcagcttaccttttcgtcatcactaataatactaatcaggggctccaagcctggaagatcgaggatattcctgcgaataaaatgtctatcgcatggcagttaccgcaatacgcactggtgacagcaggtgaagtgatgttctctgtgacaggactcgaattttcatattcccaggccccatcctcaatgaaatctgtgcttcaggcagcatggctgcttacgatcgcggtcggtaacatcatcgtccttgtggttgcacagttcagcggcttggtgcaatgggccgagtttatcctgttcagctgcctgctgcttgtcatttgtttaatctttagcatcatggggtactattacgtgcccgtgaagaccgaggacatgagaggcccagccgataagcacattccacacatccaaggcaacatgatcaaactggagacaaaaaaaactaagctatag

SEQ ID NO: 54089 - DNA, 2190 bp, Artificial Sequence
  Description of Artificial Sequence: Synthetic coding sequence
atgaaccccttccaaaagaatgagagtaaggagactctctttagtcctgtgtctattgaggaggtgcctccacgccctcctagcccccctaagaaaccaagtccgactatctgcggctcaaactacccactcagtattgctttcatcgtcgttaatgagttttgcgagcggttcagctactatggaatgaaggccgtattgatcctctactttctgtactttcttcattggaatgaggacacatcgactagcatctaccatgccttttcatcactctgttacttcaccccaattttgggagcagccattgctgattcctggcttggcaagttcaaaaccatcatttacctaagtctggtgtatgtgttgggacatgtcataaaaagccttggagctttgccaattctcggtggccaggttgtgcacactgtcctgagtttaattggattgtcactgatcgcattgggcacaggcggaattaagccctgcgtggcagctttcggcggagaccaatttgaggagaagcatgcagaagagcgaacaagatacttctctgttttttacctcagcatcaatgcaggctccctcattagcactttcatcacgcctatgcttcggggtgacgtgcagtgtttcggggaggattgttatgcacttgcgttcggagtacctggattgctgatggtcatcgccctagtggtctttgcaatggggtccaagatttacaacaaacctcctccagagggaaatatcgtggctcaggtgttcaaatgtatttggttcgccatttctaacaggttcaagaaccgatcaggcgatatccccaaaagacagcactggcttgattgggctgccgagaaatatcctaagcagttgataatggacgtcaaggcgctaacccgtgttctgttcctgtacatcccactgccaatgttttgggctctcttggatcagcaaggctccaggtggaccctccaggcaattaggatgaatcgaaatctaggattcttcgtactccaaccggatcagatgcaagtgttgaaccctctcctggtacttatttttattccccttttcgacttcgtaatatacaggctggtgagcaaatgtggcataaacttttcatccttaaggaagatggccgtagggatgatccttgcgtgccttgcttttgccgttgctgcagccgtagagatcaagattaatgaaatggcacccgctcaacctggcccacaggaagtgtttctccaggttctgaacctggccgacgacgaggttaaggtcaccgtagtggggaacgagaacaactcactcttgatcgagtccatcaagagcttccagaaaaccccccattattcaaagttgcacttaaaaacgaaaagtcaggattttcacttccatcttaagtatcataatttgtctctgtataccgaacacagcgtgcaggagaaaaattggtatagtcttgtaatccgcgaagatggaaactctatctctagtatgatggttaaggatacggagtccaggaccacaaatggcatgacgaccgtgagatttgtaaacaccctccataaggacgtgaacatcagcctgtctaccgataccagtctaaacgtcggggaagattacggcgtgtctgcttaccggactgtgcagcgaggagagtaccccgcagtgcactgtagaaccgaagacaagaatttcagcctgaatttagggctcctggacttcggggcagcttacctgtttgtcattacgaacaataccaaccaaggtttacaagcctggaagattgaggatatccccgctaacaaaatgagcatcgcttggcagctcccacaatatgcactggtgaccgccggtgaggttatgttcagcgtcacgggattggagttctcatactctcaggccccttcatctatgaaatctgtgctacaggccgcatggctcctgactatcgcggtcgggaatatcattgtgttagtggtggcccagttcagcggcttagtgcagtgggcagagttcatactgttctcctgtctcctgctcgtgatttgcctcatcttctccatcatgggctattactatgtgccagtgaagaccgaggacatgcgtggccctgcggataagcatatcccacatattcagggaaacatgattaagctggagaccaaaaaaactaaattatag

SEQ ID NO: 54090 - DNA, 2076 bp, Artificial Sequence
  Description of Artificial Sequence: Synthetic coding sequence
atgtcgccacgcaagttatttttccctgtgagcattgaggaggtacccccacgccctcctagccctcccaaaaaaccttctcctaccatttgcgggagtaactatcccttatcaatagcgtttatcgtggtaaacgaattttgcgagaggttttcttattacgggatgaaggcggtgctgatcctgtacttcctgtatttcctgcactggaatgaggatacctcaacatctatttaccacgcttttagctccttatgctacttcacacctattctgggcgcagcgattgcagacagctggttggggaaatttaaagtgctgtcactcatcgggctttccttgatagcattgggaacaggcggaatcaagccatgcgtcgcagcgtttggaggcgaccagtttgaggagaaacatgcagaggagagaacccgctatttttcagtcttctacttgtctatcaatgctggaagtctgatctccaccttcatcactcctatgctgcgaggtgatgtgcaatgcttcggggaagattgctacgcattagcttttggagtacctgggctgctgatggtgattgctttagtggtctttgcaatggggtcgaaaatttataataagccccctcctgagggtaatattgttgcccaggtcttcaagtgtatttggtttgccatatctaatagatttaagaaccgctccggcgatatccctaagagacagcactggttagattgggctgccgagaaatatcccaaacagttgatcatggatgtaaaggctctgacgcgggtcctgttcttgtacatccctctgcccatgttttgggctctactggaccaacaaggcagtcggtggactctccaggctatcaggatgaacaggaacctgggattttttgtcctccaaccggaccagatgcaggtgctgaatcccctgctcgttttgatttttattcccctgtttgatttcgtcatctatagactcgtatccaagtgtgggatcaacttctcctcccttagaaagatggccgttggaatgattctggcctgtcttgcatttgccgtggctgccgctgtcgagataaagattaatgagatggcccctgctcaacctggccctcaagaagtgtttctgcaggtcctgaatttagccgatgatgaggtaaaggtgacagtggtgggcaacgaaaacaactccctgttaatcgaatctataaagagttttcagaaaaccccgcactattccaaactgcacctgaaaactaaatctcaggacttccattttcaccttaagtaccacaacctctccctgtataccgaacactcagtccaagaaaaaaattggtattccctcgtgattagagaggacggtaacagtatctcctccatgatggttaaagacacagagagccgaacaacgaatgggatgacaaccgttcgattcgtgaacactttacacaaggatgtcaatattagcctgtctacagacacctccttgaatgtcggggaagactacggtgtgtcagcgtatcggaccgtccagagaggggaatacccggcagtccattgccggacggaagataagaacttttctctcaacttggggcttcttgacttcggcgcagcctatctgtttgtgattaccaacaatacaaatcagggcctgcaggcctggaaaatcgaagatattcctgcaaataagatgagcatcgcttggcagctgccccagtatgcccttgtcactgcgggagaggtgatgtttagcgttaccgggcttgagttctcttattcccaagctccctcctccatgaagtccgtactccaggcagcctggctgctgaccatcgccgttggcaatatcatcgtcttggttgtggctcagtttagtggactagtccagtgggcagagttcattcttttttcatgcctcttgctggtgatttgtctgatcttcagtatcatgggatactattacgtcccagtcaaaacggaggacatgcggggacctgcagacaagcatattcctcacattcaaggaaatatgattaagctggagaccaagaagacgaagctgtag

SEQ ID NO: 54091 - DNA, 1506 bp, Artificial Sequence
  Description of Artificial Sequence: Synthetic coding sequence
atggctgcatcttggaggttaggttgcgatcctcggctgctcagatatctggtggggtttcctggacgcaggtccgtaggtctagtgaaaggagctctggggtggtcagtcagccgcggagccaactggcgctggtttcacagcactcagtggctccggggtgaccccataaagatactgatgccctcactaagccctactatggaggagggcaacatcgtgaagtggctcaaaaaagagggagaagccgtatcagcaggcgacgcactttgcgaaattgagacagacaaggctgtggtgacccttgacgcctctgacgacggaatcttagccaaaatagtggtggaggaagggagcaagaacatccggctcgggtctctgatcggcctcatcgtcgaggagggggaggattggaaacacgtggaaattcccaaagatgtgggtccccctcccccagtgtctaagcctagcgagccacgaccttcacccgaacctcaaatctccatccccgtgaagaaagaacacatacctggtaccctcaggttccgactgagtccggcagcacgaaatatacttgaaaagcactccttggacgcctcccagggcaccgccacaggtccgaggggaattttcactaaggaagatgcgcttaagctagtgcagttgaaacagacaggcaaaatcacagagtcacgccctacgcccgctcccacggcaacaccgaccgccccaagcccgctgcaggctaccgctggccctagttatccgaggcctgtgattccaccagtgtctacccccggacagcctaatgcagtgggcacctttaccgaaatacccgctagcaatatccgtagggtaatcgccaaaaggcttactgagagcaagtccactgtgccacacgcatatgcaacagcagactgtgacctgggtgccgttctgaaagtacgacaggatctggttaaggacgatatcaaggtgtccgttaatgatttcatcattaaggctgccgctgttaccctcaagcagatgccagatgtcaacgttagctgggacggcgaagggcctaagcagctgccattcatagacataagcgtggcagttgcaacagataagggtctgctgacccctataataaaagatgccgcagcgaagggtatacaggagattgctgattccgttaaggcattgagcaagaaagccagggatggtaagcttctgccagaagaataccaggggggatccttttcaatatcaaaccttggaatgtttggcattgacgaattcacagctgtcatcaatccccctcaggcgtgtatcctggctgtgggaaggtttcgtcccgtcctgaagcttacggaggacgaggagggaaacgcaaagctgcagcagagacagttaatcacggtgacaatgtcctctgacagccgtgtggtggatgatgaactagccacacggtttttgaagtcttttaaagcaaatctggagaacccgattagacttgcctag

SEQ ID NO: 54092 - DNA, 942 bp, Artificial Sequence
  Description of Artificial Sequence: Synthetic coding sequence
atgcccgctcccagggcacgcgagcaacccagagtgccgggtgagcgacaacccttgttgccacgtggtgctagaggaccccgacgatggagacgggcagcaggggctgccgttttgttagtagagatgctggagagggcagctttctttggtgtgaccgccaatcttgtgctatacttgaattccacaaacttcaattggaccggcgagcaggccaccagggcagcgttggtcttcttgggcgcttcttacctgctcgcacctgtgggagggtggttggccgacgtttatctcggcagatacagggcggtggccctgtcactgctcctttatctcgccgctagtgggttgcttcctgctactgcctttccggatggcagatcgtcattctgcggggaaatgcccgcttccccacttggtccagcttgtccgtcagcagggtgccccaggagcagcccttctccctactgtgctcccgtgctttacgcagggctgttgttattgggcctggcagcctcatcagtcaggtctaatcttacgtcctttggtgccgatcaagtgatggacttgggcagagatgctactagaaggtttttcaactggttcaccggcgcttccacctgggtcctgtgttgtaggtgttggtggtggaggctgttcagcagaacaagcgcatcctgttgggctactgcatccctatgggccgtgtgggcctggcattttagcagcagtagcctccccccaccttctagtagtccctcaccacgttgggccgctaagtgtcctttatgcctcagcagtctgtctaagacagccgctcccagttgtggaaatgacacaaggcccgaaacggtgaacgtacctgcctgctggccaacacgcggactgcccagccagggcttgcccagaaaacggacaagccccacaagccgatgttggtag

SEQ ID NO: 54093 - DNA, 1734 bp, Artificial Sequence
  Description of Artificial Sequence: Synthetic coding sequence
atggagggatctggtggcggagccggagagcgggctcccctgctgggagcacgacgtgccgcagccgcagctgctgcagccggtgcatttgccggtcgcagagccgcttgtggagctgtgctgcttaccgaacttcttgagcgagccgctttctacggtattacctccaatctcgtgctgtttctgaacggagctcctttttgctgggaaggggctcaggcatccgaggctctacttctcttcatgggcctcacttacttgggttctccgttcggaggctggctcgccgatgctagactcgggagggccagggccatcttactaagcctggctctttatctacttggcatgttagcctttcccctgctcgctgctcctgccactcgggctgctttatgtggcagcgcacggctactgaactgcaccgctcccggacctgacgcagcagctagatgctgctctcctgccacctttgccggactggtgcttgtcggacttggcgtggcaacagtgaaggcgaacatcaccccgtttggtgctgatcaggtaaaagatagaggtccggaagcgactagacgtttcttcaactggttctattggagcatcaatttgggtgccattctctccttggggggtatcgcttatattcagcagaatgtttcctttgtgaccggttacgccatacccactgtgtgcgtgggacttgcgtttgtggtattcttatgcgggcagtcggtcttcattaccaagccccctgatggctctgcttttactgacatgtttaaaatcctaacatactcttgttgtagccaaaaaaggagcggcgaacgccagagcaacggcgaggggatcggtgtgtttcagcagtcctcaaagcaaagcctgtttgattcgtgtaaaatgtcacacggtgggccattcaccgaggaaaaagtcgaggacgtgaaagccctcgtcaagatcgtgcccgtgttccttgctcttattccttattggaccgtgtattttcagatgcaaactacttacgtactgcaatccctgcatcttaggatccccgagatttcaaatatcacaacaactccacacacactacccgcagcttggctgaccatgttcgatgcagtgctgatcctgttactgatcccccttaaggacaagctagtggatcctattctgagacgccatgggcttttaccttcaagcctgaagcgaatagccgtgggaatgttttttgtgatgtgtagtgccttcgccgctggtatccttgagtccaagaggctcaacctcgtgaaagagaagaccataaatcagactatcggtaacgtggtctatcatgctgccgatttgtccttatggtggcaggttccacagtacctgctaatcggtataagtgagatcttcgctagcatcgccggactggagttcgcctactcagcggcacctaagagcatgcagtcagccatcatgggactctttttcttcttctctggtgtgggctcctttgtggggtccggcttgctggcgcttgtgagcatcaaggctattggttggatgagctcccacactgattttggcaacataaatggatgttacctcaattactatttctttctcctcgctgccatccagggagcaactcttttgttatttctgattatctctgtgaaatacgaccatcatagggatcaccagagatctagagcgaacggcgtaccaactagtagaagagcatag

SEQ ID NO: 54094 - DNA, 1320 bp, Artificial Sequence
  Description of Artificial Sequence: Synthetic coding sequence
atgcttaaacgagagggtaaggtccagccttataccaagacccttgatgggggatggggctggatgattgtgatacacttctttctcgtgaacgtatttgtgatggggatgaccaagacgttcgctattttttttgtcgtctttcaggaggagtttgagggcacgtcagaacaaattggatggataggctctatcatgagtagtttgcggttttgcgcaggtctgggatcagcttttctgtatcaagtggcagctgtggttactactaaatattttaaaaagcgcctagccctgagtacagccatagcgcgtagtggcatgggccttacatttctgttagcaccttttaccaagtttctgatcgacttgtatgactggactggtgcattgatcctgtttggcgctattgccttgaatctggtgccaagttccatgctcctgcgtcccattcatatcaagtcagaaaacaatagcgggattaaagataagggttcttcactcagcgcacacgggccagaagcccacgcaacagagacccattgccacgaaactgaggaatccacaatcaaggacagcacaacacaaaaagctggtctcccatcaaagaatctgaccgtatctcaaaaccagtccgaggagttttacaacggcccaaaccgcaaccggctgctgctgaaatccgatgaggagtctgataaggtaatttcctggtcttgcaaacagctctttgacataagcctcttccggaatccgtttttctacatttttacctggagtttcttactttcacagctggcctactttattccaacgttccatttagtagcaagggcaaagacactcggaatcgatattatggatgcctcctatctggtctctgtggcaggaatcctggagaccgtttctcagatcatttccggctgggttgccgaccagaactggatcaagaagtatcactatcacaagtcatacttaattctgtgtggcatcactaaccttcttgcgccactggctactactttccctttgttgatgacatatactatctgctttgccatctttgccggaggatacttggcattgattctgcctgtgctggttgacctttgtcgaaatagcacggtcaatagatttttggggctcgctagtttctttgccggtatggccgttctatccggaccgccaattgccggttggttgtacgactatacccaaacctacaatggtagcttctacttcagtggaatctgttatcttcttagttcagtaagcttctttttcgttccactcgcagagcgctggaagaatagcctcacatag

SEQ ID NO: 54095 - DNA, 1416 bp, Artificial Sequence
  Description of Artificial Sequence: Synthetic coding sequence
atgccggcacctcaaagaaagcatcgacgtgggggatttagccaccgctgctttcccacaccacagaccgctatgaccccgcagcctgccggaccacccgacggcggttggggttgggtggtggctgccgcagcatttgccatcaatggactgagctacgggcttctgaggtccttaggactggctttccctgatttggcagagcacttcgatagaagcgcccaagatacagcctggatttccgcacttgctctcgccgtgcagcaggctgcaagccctgtgggaagcgcattgtcaacccgctggggcgctaggcccgtggtcatggtgggaggcgttctggcttccctgggcttcgtgttctcagcgttcgcaagtgatttgctacacttatacctcgggcttggtttgctggctggcttcggctgggcacttgtgtttgcccctgccctgggcaccctgtccagatacttctctcggaggcgtgtccttgcggtcggactggcactcaccggcaacggggcaagctcccttctgcttgccccagccctgcagctactgcttgatactttcggctggcgcggagctctgctgctgctaggcgcaatcacgctgcacctgacgccctgcggcgctctgctcctccctttggtgcttcctggagacccacccgctcctccgcgaagccctctggccgctctcggactttccctttttaccagaagagcattctcaatatttgcacttggaacagcactagttgggggaggctacttcgtgccctacgtgcacctcgcccctcacgcactggacagaggactcggagggtatggggcagccctggttgtggctgttgccgctatgggagatgccggtgccaggctcgtctgtggatggctggccgatcagggctgggtgcctctcccacgcctcctggcagtcttcggcgctctcactggcctggggctgtgggttgtaggcctcgttccagtcgttggcggagaggagtcatggggcggacctttgctggcagccgcagttgcctacgggcttagcgccggatcatatgcacctctggtgttcggcgtgctgccaggccttgtcggagtcgggggtgtcgtgcaggcaacagggctggtgatgatgctgatgtccctgggaggtcttctcggccctcccctgtctggcttcttgcgcgatgaaactggcgacttcaccgcctcatttctcctgagcgggtcgctcatcctgtcggggtcttttatttacattggcctcccacgtgcgcttccttcatgcggcccagcttcaccgcctgcaacaccaccgccagagactggtgagttgctcccggcaccacaggccgtccttctgtcaccaggagggccaggatctacacttgataccacttgctag

SEQ ID NO: 54096 - DNA, 1320 bp, Artificial Sequence
  Description of Artificial Sequence: Synthetic coding sequence
atgactcctcagccagccggaccacctgatggcggatggggttgggtcgtagccgctgcggctttcgcgataaatggtctatcctacggattactgagatccctcggactggcattcccagatcttgccgaacattttgatcggtccgcccaggacacagcatggatttcggcgctcgcactcgctgtgcagcaagccgcatcacctgtggggagtgccctgagcactagatggggtgcacgccctgtggtgatggttggcggagtgcttgcctctctggggtttgtgtttagcgcttttgcaagcgacttactccatttatacctaggactcggcctgctcgccggatttgggtgggcactggtgtttgcaccagctctggggactctgtcgagatattttagtcgtcgccgtgtgttagccgtcggcctggcactcaccggcaatggcgcttcatccttgctgttggccccagctctgcaactgctcctcgataccttcggctggcgcggagcactgctgttgttaggagctatcacgcttcatctgaccccttgtggcgctctcctgctgcccctggtgttaccaggggatcccccagccccaccaaggagtccgttagccgctctgggactatccctgttcacccgccgtgctttttcgatttttgccctgggcacagctcttgtcggcggaggctactttgtcccctatgtgcatctcgcaccacacgccttggaccgcggtctgggtggatacggagccgctctggtcgttgctgtggccgctatgggagacgccggagcccgactcgtttgcggttggttggccgaccagggctgggtgcccctgccaagactgctggccgtgtttggtgcgcttacgggcttagggttgtgggtcgttggactttcctgggggggaccgttgttggccgcagcggtagcatatgggctgtccgcagggtcatacgcccctctcgtgttcggagtgttgccagggctggtcggcgttggtggggttgtgcaggcaaccggactggtgatgatgctgatgagcctcgggggtctcctcgggcctccactctcagggttcctgcgagatgaaactggcgattttaccgccagcttcctgctgagcggatccctgattctttctggctccttcatctacatcggcctgcccagagcccttccaagttgtggtccggcttctcctcccgctacaccccctccagagacaggagaactgctgccggctcctcaggctgtgctcctgtctccaggcggaccaggcagcacacttgacacgacgtgttag

SEQ ID NO: 54097 - DNA, 1281 bp, Artificial Sequence
  Description of Artificial Sequence: Synthetic coding sequence
atggctcgtcgtacagaacctcccgatggcggttggggctgggtggttgtgctttctgctttcttccagagtgccctagtgttcggcgtccttcggagcttcggagtgtttttcgtggaattcgtggctgccttcgaggaacaggccgctcgagtatcatggattgcctccattggcatcgccgttcagcaattcggaagcccagtgggctcggctctgagtaccaaattcggccctaggcctgtggtcatgaccgggggaatccttgcagcgctgggtatgcttctggcctcattcgccactagcctcacccatctttatttgtcaatcggcctactgtccggaagcggatgggccctgacttttgctccgacactagcctgcctgagttgctacttctcccgtaggagaagcctggcgacaggactggctttgaccggggtcggcctctcgtccttcacatttgcccctttctttcagtggctcctgtcccattacgcatggcgagggtcccttcttcttgtgagcgccctttcactccaccttgtagcttgtggagccctgctgcgtccccctagcctggcagaagacccggctgtcgggggaccacgtgctcagctaacatccttgcttcatcacgggccattcttgcgctacacagtagctttaacactgatcaacacagggtacttcatcccctacctgcatctcgtcgctcaccttcaggatctggactgggacccactgcctgcggctttcctgctttcggtggttgctatctccgacctagtagggagagtcgtcagcggttggctgggcgatgcagttcccggacctgtgacccggctgctcatgctgtggacaaccctgaccggagtgtcacttgccctgtttcctgtggcccaggcccctacagcacttgtggccctagctgttgcttacggatttacgtctggagcccttgcgccactggcgttttcagtgctcccagagctgatcggcacgagaagaatttattgcggcttagggcttctgcagatgattgaaagcatcgggggattattgggaccacctctgagcggctacctgagagatgtaaccggcaactatacagccagttttgtagtggcaggcgcattcttactatcaggatcaggcatccttctgacattgccacatttcttttgcttttccaccactacctcaggtccccaagaccttgtgaccgaggccctggatacaaaggtcccactgccaaaagagggactggaggaggattag

SEQ ID NO: 54098 - DNA, 1533 bp, Artificial Sequence
  Description of Artificial Sequence: Synthetic coding sequence
atgtacacgagccacgaggacatcgggtatgatttcgaggacggccctaaggacaaaaagacccttaagccgcacccgaacattgatggcggttgggcatggatgatggtcctttctagcttttttgtgcatatcctgattatggggtctcagatggcactgggcgtactcaatgtggagtggctggaagagtttcatcagtcacgaggactgacagcttgggtgtctagcttaagtatgggcattacactaatcgttggtccctttattggcttgttcattaacacttgcggttgcagacagaccgccataatcggagggttggtgaattcactgggctgggtgttgagcgcatatgccgcaaatgttcactatttgtttatcacttttggggtagccgctggcctgggatcagggatggcctacctcccggctgtggttatggtgggacggtactttcagaagcgtcgcgcattagcccaggggctgagcactaccgggacaggatttggcacctttctaatgactgtgctgctgaaatacctttgcgctgaatatggttggcgaaacgccatgcttatacagggggcagtatcactgaatctttgtgtgtgtggcgctctcatgcggcctctgtcaccaggaaagaatcctaacgaccctggggagaaagacgtgcggggtttacctgcacattccactgaatccgtgaaatcaactggacagcagggacgcactgaagagaaggacggtggactggggaacgaggagactctgtgtgacttacaagctcaggaatgcccagaccaagctggtcaccggaagaacatgtgcgctctgagaatcttgaagacagtgtcttggcttaccatgcgagttcggaaaggtttcgaagactggtactccgggtatttcggcacagcctctttgtttacgaaccgaatgttcgtagcgttcattttttgggctctcttcgcctattcgtccttcgttatcccttttatccatctccccgagatcgttaacctatacaatctttcagagcagaatgacgtctttccgttgacctccattattgctatcgttcacatctttggaaaggtgatccttggagttattgcggacttgccatgcatcagtgtgtggaacgtgtttttgctggctaacttcactttagtcttatctatctttatactcccgctgatgcacacttatgccggtctggcggtaatttgtgccctgattgggttctctagtggttatttctccctgatgccagtggtcactgaggacttagtcggcatagaacacctggccaacgcatatgggatcattatatgtgccaatggcatatccgctctgctgggacccccattcgcgggttggatttacgacattacccagaagtatgacttcagcttctacatttgcggattactctatatgatcggtattctgttcctcctgatccaaccatgcatccgaatcatcgagcaaagtcgcaggaagtacatggacggagcccatgtttag

SEQ ID NO: 54099 - DNA, 1458 bp, Artificial Sequence
  Description of Artificial Sequence: Synthetic coding sequence
atgtatacttctcacgaggatataggctacgactttgaagacggtccaaaggacaagaaaacgctgaagccacatcctaatatagacgggggttgggcctggatgatggtactcagctccttctttgtgcacatcctgataatgggtagtcagatggctctgggcgttttgaatgtcgagtggcttgaggaattccaccagagccggggattaacagcatgggtttccagcctttcaatggggattacgttgattgtgggccctttcattggcctattcattaatacctgcggatgtagacaaacagccattatcgggggtctcgtaaattcactgggctgggttctgagtgcttatgccgcaaacgtgcattacctgtttatcacttttggggtcgccgcaggcctgggctccggcatggcctacttgccagctgtcgtgatggtgggcaggtattttcagaagcgtagggctctggcccaaggactctctaccactgggaccggctttggaacctttttaatgacagttctgctaaagtacctgtgtgccgagtatggatggcgaaacgcaatgctcatacagggcgcagtcagccttaatctatgcgtctgtggggctctgatgcgcccactgtctcctggaaagaaccccaatgaccccggagagaaagatgtccgcggactcccggctcatagtacagagagtgttaagagtactggtcaacagggccgaaccgaagagaaagacggtggcctcggaaacgaagaaactctgtgcgatctgcaggcacaggagtgccctgatcaggctggccaccggaaaaacatgtgtgcattgagaattcttaaaacggtcagctggttgaccatgcgtgttaggaagggattcgaggactggtactcaggttattttggcaccgcctctctgttcaccaatcgaatgttcgttgctttcatcttttgggccctgttcgcctacagttcttttgttatccccttcatccacttaccagagattgtgaacctatataatctttcagagcaaaacgatgtgtttccactcacatccatcattgccattgtccatatttttgggaaggtgattttgggagtcatcgctgacctcccctgcatctcagtgtggaacgttttcctcctggctaattttaccttggtgcttagcatattcatcctgccactgatgcacacatatgctggtctagcggtgatttgcgctctcatcggatttagctcgggatacttcagcctaatgccagtcgttaccgaggacctcgtgggcatcgaacatttggctaatgcatacggcatcattatttgcgctaacggtatatccgcgttgcttggaccccctttcgccggaaaacttagcgaagttctcagggctcagtctgcttgtacttacggcgcactgtgttacaaggttccagacaagtag

SEQ ID NO: 54100 - DNA, 129 bp, Artificial Sequence
  Description of Artificial Sequence: Synthetic coding sequence
atgtacaccagccatgaagacatcggatatgattttgaagacggacctaaagacaagaaaactcttaaaccccaccccaacattgacgggggatgggcctggatgatggtcctgtcatctttcttttag

SEQ ID NO: 54101 - DNA, 57 bp, Artificial Sequence
  Description of Artificial Sequence: Synthetic coding sequence
atgtatacatctcatgaggatatcggctatgactttgaggacggtcccaaggattag

SEQ ID NO: 54102 - DNA, 1470 bp, Artificial Sequence
  Description of Artificial Sequence: Synthetic coding sequence
atgtacacttctcatgaggacattggatatgattttgaagacggtccgaaggataaaaaaacgctcaagccacacccaaacatcgatggaggatgggcctggatgatggtcttgtcttcttttttcgtgcatatcctgatcatgggaagtcaaatggcactaggcgtcctcaatgtggaatggctggaagaattccaccagagcagaggattgaccgcatgggtgtcctcactctccatgggtatcacactgatcgtaggccctttcattgggcttttcataaacacttgcggctgccgccagacggctatcatcggcggactggtgaattcactgggatgggtcctctcagcttatgccgctaacgtgcactacctgttcattaccttcggcgttgccgcaggtctgggatcaggtatggcttacctgccggcagtcgtcatggtgggaaggtattttcagaaacgacgggcattggctcagggccttagcaccactgggactggtttcggtacattcctgatgacggtgcttctcaagtatctgtgtgccgaatatgggtggaggaacgccatgctgattcagggcgctgtaagcctcaatttgtgcgtctgcggggcactgatgcgccctctgagtcccggaaagaaccccaatgacccaggggagaaggatgtacgcggactgccagcacacagcacagagagtgtcaaatccacgggacagcaggggagaacagaagagaaggacggcggactgggtaatgaagagactttgtgcgatttacaggcacaagaatgtccggatcaggccggtcatagaaagaacatgtgtgcgctgagaatcctgaagacggtatcatggctgactatgcgggtgcgcaaaggcttcgaggactggtacagtggatattttggaaccgcctccttatttaccaaccgtatgttcgtggcatttatcttttgggcccttttcgcatatagttcctttgtaatacctttcattcatctacccgaaatcgttaatctctataatctgtccgagcaaaacgacgtgttcccattaaccagcatcattgcaattgtgcacatattcgggaaagtaatcctgggggtgatcgcagatctaccatgcattagtgtctggaatgtgtttttgttagccaacttcacgttggttcttagcatctttatcttgcccctgatgcacacctacgcgggtctcgcagttatttgcgcactgattggtttttcgtctggatatttctccctcatgccagtggttacagaagatctggtgggaattgagcaccttgctaatgcctatggtattattatttgtgctaacggcattagtgctctacttgggccacccttcgccggaaaactgagtgaagtgctccgcgcacaatccgcatgcacttatggcgcattatgctataaggttcctgacaaagaggagggtttctag

SEQ ID NO: 54103 - DNA, 1464 bp, Artificial Sequence
  Description of Artificial Sequence: Synthetic coding sequence
atgctcaagcgcgagggcaaagtccagccctacactaaaacgctcgatggaggctggggctggatgatcgtaatccatttcttcttagtgaacgtctttgtaatgggcatgacaaagacgtttgccatcttctttgtcgtgtttcaggaagaattcgaaggaacaagtgaacagattggttggatcggcagcattatgtccagcctaaggttttgcgccggacctcttgttgccattatctgcgatatactcggggaaaagacaactagtattctgggcgcatttgtggttactggcggatacctgataagttcttgggccacatctatacctttcctctgcgtgacaatggggcttcttccagggctcggatctgccttcctgtaccaggtggctgccgtggtgacgactaaatacttcaagaagaggctggctctgtccacagcaattgcaagatcaggtatgggcttgacttttctgctggccccatttactaaatttctaatagacctgtacgactggaccggcgctttgatcttatttggggctatcgctctaaaccttgtgccatcatcaatgctattaaggcccatacatattaaatctgagaacaatagcgggatcaaagataagggcagtagtctctccgcacacggcccagaggctcatgcaacagagactcactgtcatgaaaccgaagagagtaccattaaagacagtacgacccagaaagccggtctgccaagcaaaaacttgacagtatcccagaaccagagcgaggagttttataatggccctaaccgaaatagacttctgctcaagtcggacgaggaatcggacaaagtgatttcttggtcttgcaagcaactctttgacataagcctgtttcggaatccatttttctacatcttcacttggtcgttcctccttagtcagctggcctattttatccctactttccacctggttgccagggccaaaacgctggggattgacatcatggatgcatcctacctggtgtctgtggctgggattctagaaacggttagtcagattatttccggatgggttgccgaccaaaattggatcaagaagtaccattaccacaagtcctatttaatcctttgtggaataactaatctgctggccccattggcgactacttttccattactaatgacctatacaatttgcttcgccatatttgctggcggttacctggccctcatactgccggtcctggtagacctgtgtagaaattctactgtgaaccgtttcctgggattggcttccttcttcgcagggatggccgttctgtcaggaccccctatagccggttggttatatgactacacacagacttacaatggtagtttctactttagcggaatttgctatttgctctcttctgtgtccttctttttcgttccgctggcagaacgttggaagaattctctcacgtag

SEQ ID NO: 54104 - DNA, 960 bp, Artificial Sequence
  Description of Artificial Sequence: Synthetic coding sequence
atgttgaaacgggaggggaaagtgcagccatacactaagaccctggacggagggtggggctggatgatagtaatacactttttcctcgtgaacgtttttgttatggggatgaccaagacattcgctatcttcttcgtagtcttccaggaagagtttgagggaacaagtgagcagataggctggatcggcagcatcatgagctctctgcgcttttgtgcagggccattggtcgccattatttgtgatatcttaggggaaaaaacaactagtatcctgggcgcttttgtcgtaaccggcggatatttgataagcagctgggcaacaagtattccattcttatgcgtgactatgggcctgcttccaggcctaggctcggccttcctgtaccaggtggccgcagtagtcacgactaagtacttcaagaagaggctcgcacttagtacagccattgcacggtctggcatgggcctgacattcctcctggccccattcaccaagtttctaatcgatctgtacgactggaccggtattctggagacagtaagccaaattattagcggatgggtagcggaccagaattggatcaagaagtatcactaccataaatcctacctaattctgtgtgggattacgaatctgctcgctcctctggccacaacattcccgttgctgatgacctacaccatttgcttcgctatcttcgccggaggctacttggctctcatcctcccagtcttagttgatctgtgcaggaatagtactgtaaaccgatttctgggactggcgtcatttttcgccggaatggccgtgctcagcgggcctccaattgccggttggttgtacgactacacccagacctacaatggctccttctatttttccgggatttgctatctgctttcttcggtgtccttctttttcgtgcctctggccgagagatggaagaactcactgacatag

SEQ ID NO: 54105 - DNA, 1149 bp, Artificial Sequence
  Description of Artificial Sequence: Synthetic coding sequence
atggggatggatgattgcgatagcttcttcccgggattgggcagtgctttcttgtatcaggtagcggctgttgtgaccacaaagtactttaaaaagcgattggccctctctacggcgattgccaggtccggtatggggttaacctttctgttagctccatttaccaagttcctgatagacctttatgattggactggcgctctaatcctgttcggagctatcgctctcaatctggtccccagtagtatgttgctgcgccctatacatataaagagcgagaataacagtggcattaaggacaagggttcgtcccttagcgcacatggacccgaggctcatgccaccgagactcattgtcatgagacagaagaaagcacaattaaggattcgactacacaaaaggcaggcttgcctagcaaaaacttaaccgtgtcccagaaccagtccgaagagttctacaacgggcctaataggaataggctactgctcaaatccgatgaggaaagcgataaggttatcagctggtcatgcaaacagctttttgacatctctctgttccgcaatcccttcttctacatctttacctggagctttctgctcagccagctagcgtatttcatccccacttttcacctggtggccagagctaagacccttggtatcgacattatggacgcatcttatttagtctctgtggccggaattctagaaacagtaagccagataatttccggatgggtcgctgaccagaactggatcaagaaataccattatcacaaatcctatctgattttgtgcggaattacaaaccttctggccccactggctactacctttccactactgatgacctacactatctgtttcgctatcttcgccggaggctatctcgctttaattcttccagttttagtagatctctgccgaaactctaccgtcaaccgctttctcgggcttgcatcttttttcgccggaatggccgtgctttctgggccaccaattgccgaaattatccctagtttccaggctggatatatgattatcccacgacatactatggccttgtctacaagtctcgcctacgctatttcctcattacagtttcctttttttctgtaccattggccaaaagatggtaagaccgtttag

SEQ ID NO: 54106 - DNA, 1278 bp, Artificial Sequence
  Description of Artificial Sequence: Synthetic coding sequence
atgggcatggacgattgtgatagcttttttccaggacctctggtcgcgatcatttgcgatatcttgggagagaagacgacaagtatcttgggggcattcgttgtcactgggggatatctaatttcctcctgggccacctccatccctttcctgtgcgtaactatgggcctcctgcctggattaggctccgctttcctgtaccaggtcgccgctgttgtgactaccaagtacttcaaaaagcgattggctctttcaaccgcaatagctaggagcgggatgggactcacattcctgcttgccccattcacaaagtttctcattgatctttacgactggacaggcgctttgatcctctttggtgctattgctttgaatcttgtgccaagctccatgctgctccggccaattcacatcaaatccgaaaataacagtggaatcaaagacaagggcagcagcctctccgctcatggccctgaagcacacgccactgagacacattgccatgagaccgaggagtcaactataaaagactcgacaactcagaaagccggattgccttcaaaaaacctgacagtttcacagaaccagtcggaggagttttataatgggcctaacagaaatcggttgctgctcaaatctgacgaggaatctgacaaggtaatttcatggtcctgtaagcaactgtttgatatctctttgttccgaaatcccttcttttacatctttacatggtctttcctgctctcccagctcgcttattttatccctacgtttcacctcgtcgctagggccaagactcttggaatcgacataatggatgctagttacctggtgagcgtcgctggaatcctggaaaccgtgtctcagataatttccggatgggtggcagatcagaattggattaagaagtaccattatcacaagtcttacctgattttgtgtgggattactaatctgctcgctccactcgcaactactttccctctgctgatgacttacaccatctgctttgcaatcttcgcgggaggttacctggcattgatcctgccagttttagttgatttatgccgcaatagtacggttaatcgctttcttgggctagcatcctttttcgccggtatggccgtgctatcgggcccacctattgccggttggctgtacgattacacgcagacatacaacggaagcttctatttttctggaatttgttatctgctctctagcgtctccttttttttcgtaccattggctgaaagatggaagaattcgctgacctag

SEQ ID NO: 54107 - DNA, 1518 bp, Artificial Sequence
  Description of Artificial Sequence: Synthetic coding sequence
atgccgcaagccctggagagggccgacggatcctgggcctgggtagtgcttctcgcaactatggtgacccagggcttaaccctgggctttccaacctgcataggtatcttctttacagagcttcagtgggagttccaggcgtccaattctgagacaagctggttccctagtattcttaccgcagtgctacacatggcaggacccctttgctctatcctagtgggcaggtttgggtgcagggttaccgtgatgctcgggggagtgctggcctcactgggtatggtggctagttcgttcagccacaacctgagtcaactatacttcacggccggatttatcactggactggggatgtgcttcagcttccaatcaagcataactgtcctgggcttctacttcgtgcggagacgggtcctcgccaatgccctggcaagcatgggggtctccctcggtattaccctttggccgctattatctcgataccttctagaaaacctcgggtggcggggaacctttctggtttttgggggtatatttctgcattgttgtatctgcggcgcaatcatacgcccagtggcgactagcgtagcacccgagaccaaagaatgcccgcctccccctcccgagacccccgcattgggctgtctggctgcctgcggaaggacaattcaaaggcatctggcattcgatatactccgacacaatactgggtactgcgtctacatcctgggagtgatgtggagtgtgttggggtttcctctgcctcaggttttcctcgtgccttatgccatgtggcatagtgtcgacgaacagcaggccgctttgctaattagcatcattgggtttagtaacatttttctccgcccacttgccggactgatggctggcagacccgcatttgcctcccaccggaaatacttgtttagtctcgctctccttcttaacggcctgactaacttagtgtgcgctgcatctggtgatttttgggttctagttgggtattgtttggcatacagtgtatcaatgtctggcattggcgcactgatctttcaggtcctgatggatattgtgccaatggaccagttccctcgggcattaggattattcacagtgctggatgggcttgctttccttataagcccgccactggccggtctcctgttagacgcaaccaacaacttttcttatgtgttctacatgtccagcttctttctcatttctgcagccctatttatgggcggtagcttttacgccctgcaaaaaaaggaacagggaaagcaggctgtggccgcagatgccctcgagagagatctgttcctggaagcaaaggacgggcctggtaaacagcggtcgcccgagatcatgtgtcagagctcacgccagcccagacccgcaggcgtgaacaaacatttgtggggctgccccgctagcagccgaacttctcatgagtggctgctttggcccaaggctgtgcttcaggccaagcagactgcactgggctggaattcacccacgtag

SEQ ID NO: 54108 - DNA, 1518 bp, Artificial Sequence
  Description of Artificial Sequence: Synthetic coding sequence
atgccacaggctctggaacgcgcagatggctcctgggcttgggtggtcttgctcgcaaccatggtgacccagggattgacactgggctttccaacatgcatcggcattttctttactgagctgcagtgggaatttcaggcctcaaacagtgagactagctggtttccttcgatcctgaccgccgtactgcacatggccggaccactctgttcgattttggttgggaggtttggctgccgcgtcacagtcatgctcggtggagtgctagcctctctagggatggttgcaagttccttttcccataatctgtcccaattatattttactgccggatttataaccgggttaggcatgtgtttcagtttccagtcaagcataacagtcctaggtttttacttcgtgcggagaagagtcctggctaacgcccttgctagtatgggcgtgagtcttggcattacattgtggcctctgctaagccgttatctgctggaaaatttgggctggcggggaacgttccttgtctttggcggaatttttctacactgttgtatttgtggtgccataataagaccagtcgccacgagtgtcgctcccgaaaccaaggaatgccctccaccacctcctgagacgcctgcgctgggatgccttgccgcatgcggtcgcacaattcagcggcacctggcctttgacattttgcgccacaacaccggttactgtgtttatatactgggagtgatgtggtcagtgttaggcttccctcttcctcaggtcttcctcgtaccgtacgccatgtggcacagtgtagacgaacaacaagcagcccttctgatctccatcatcggcttcagtaacatattcctccgcccactcgcagggcttatggcaggacgacccgctttcgcgtctcatcggaagtacctttttagcttggcgctcctgctgaacggcctgactaacctggtgtgcgcagccagcggagatttctgggtgctcgtgggttattgtctcgcctacagtgttagcatgtccggaattggcgctttgatcttccaagtgctcatggacattgtgccaatggaccagttcccaagagccctcggtctgtttacagtcctggacgggctggcttttcttatcagccctccgttggccggtctgctgctcgatgctaccaataacttctcctacgtgttttacatgtcgtcatttttcttaatctcagccgcactcttcatgggcggatcattttatgccttacagaagaaggaacagggcaaacaagccgttgccgctgacgctctggagcgtgatctcttcctggaggctaaggatgggccaggcaaacagcgatccccggaaatcatgtgccaatcttcgaggcaaccgaggcctgccggagttaacaagcacctctggggttgccccgctagcagtcggacctcccacgagtggctgctctggcccaaggctgtgttgcaggcaaagcaaactgctctggggtggaattctccaacatag

SEQ ID NO: 54109 - DNA, 1503 bp, Artificial Sequence
  Description of Artificial Sequence: Synthetic coding sequence
atgcctaggccaacccgcggacccctcgctacgtctcaaggctggtgtcctagtgtcacccccggtacctgggctgccgctacacttgccgtgaggccttggcagcgaaggcaacagcgaatgcctcaggctctggaaagagcggatggatcctgggcctgggtcgtgttactggccacaatggtcactcagggtctgaccctgggctttcccacctgtatcggcatttttttcaccgagcttcaatgggagtttcaggccagcaattcagagactagttggttcccctctatcctcacggccgtgcttcatatggctggcccattgtgtagtatcctcgtcggccgttttggctgccgcgtcaccgtgatgctgggcggagtcttggcttcgctgggaatggtggcgagttcctttagtcacaatctgagtcaactctactttacagccggatttatcacaggcttaggcatgtgtttctctttccagtcctcgattacagttctcggattctactttgtaagacgtagggttctcgccaacgcactagccagcatgggtgtgagtctgggtatcaccctgtggcctctcctctcccgctatctacttgaaaatttgggctggcggggaaccttcttggttttcgggggaattttcctgcattgctgtatttgtggggctattatcagacccgtcgccacctccgttgccccagaaacaaaggagtgcccccctccaccacccgagaccccagctttggggtgcctcgctgcatgcgggcgaactatacagcggcaccttgcatttgacattctgaggcataacacgggttattgtgtttacattctcggagtgatgtggagtgtgctgggcttcccccttcctcaggtgtttctggtgccttatgctatgtggcacagcgtagacgaacaacaggctgccctcctgattagtatcatcggcttctccaacatcttcctgcgccctctcgcagggttaatggcagggaggcctgctttcgcttcacacagaaaatacctgttttccctagctttgctgctaaacggcctcacgaacctggtctgcgctgcgagcggtgacttctgggtcttagttggctattgtctggcgtacagcgttagcatgtccggaataggggcattaatcttccaggtccttatggatattgtgccaatggatcaatttccccgagccctgggactctttacagtgcttgatgggttagcgttcctcatatcacctcctctagccggtctgctactggatgcaactaataacttcagctacgtcttttatatgtcatctttttttctgatcagcgccgcactgttcatgggaggctctttctatgcgctgcagaaaaaggaacaagggaaacaggctgtcgcagccgatgccctcgaacgcgatctatttcttgaggcaaaagatggtcctgggaagcagagatcccctgaaatcatgtacgtcacttcagtctag

SEQ ID NO: 54110 - DNA, 1572 bp, Artificial Sequence
  Description of Artificial Sequence: Synthetic coding sequence
atgactcagaataaactgaagttatgttccaaggccaacgtgtataccgaggtgcccgatgggggttggggatgggccgtggctgtctccttcttcttcgtggaagtgttcacctacgggattattaagacattcggcgtctttttcaacgatctgatggattcttttaatgaaagcaattcacggatctcttggatcattagtatatgcgttttcgtgttaacattcagcgcaccactggctactgtgctgagcaatcgctttggacatagattggtggtaatgctgggcggactgttggtatctacaggaatggtcgccgcaagcttttcacaggaagtcagtcacatgtacgtcgccattgggatcatctcaggtctcggttactgtttctcgttcctgcctaccgtaaccattttatcccagtatttcggcaaacggagatctatcgttaccgccgtggcgagtacaggggagtgctttgctgtttttgcatttgctcctgcaatcatggccctcaaggagcgcatcggctggcgctactccctacttttcgtaggcctactgcaattgaacatcgtcattttcggagctttgttgcgcccaattttcatacgcggtcctgcttccccaaaaatcgtgatccaggaaaataggaaagaggcccagtacatgctggagaacgagaagactcgtacgtctattgactcgatcgattcaggtgtggagttaactacatccccaaagaatgtgccgacgcataccaatctcgagctcgagcctaaggcagatatgcagcaggtcctggtgaagacatcgcccaggccaagtgagaagaaggcccctctcctggattttagcatactgaaagaaaaaagctttatatgctacgctttgtttgggctgtttgcaactctagggttctttgctccttccctgtatatcatccctctaggaataagcttggggatcgaccaggaccgagctgccttccttctgagcaccatggcaattgccgaggtctttggcagaattggtgccggatttgtcctcaacagagagcccattcgcaagatttatattgagctcatatgcgtgatcttgctgacggtcagcctgtttgcctttaccttcgccaccgagttttggggtctgatgtcttgcagtatcttcttcggctttatggttggcacaatcggaggaacacatataccattacttgctgaagatgacgtggtgggaatcgaaaaaatgtcatccgcagccggagtgtacatcttcatccagtccattgccggactcgccggacccccactggctggtctgctcgtcgatcagtcaaagatttatagcagggccttttattcctgtgccgcaggaatggcactggcggcagtgtgtcttgctctagtgagaccctgcaaaatgggcctttgccagcaccaccactccggggaaacaaaggtggtctcacacagagggaaaactctgcaggatatccctgaggacttcctggagatggatcttgctaagaacgagcacagggttcacgtgcagatggagcccgtctag

SEQ ID NO: 54111 - DNA, 1515 bp, Artificial Sequence
  Description of Artificial Sequence: Synthetic coding sequence
atgggcgcagggggaccaaggcggggagagggcccacctgacggaggatgggggtgggtcgtcctgggagcttgcttcgtggtgacaggctttgcctacggctttcctaaggcagtgtccgtctttttcagggccctgatgcgggatttcgatgctgggtatagtgataccgcttgggtttcatctataatgctggccatgctctacggtacggggccagtatccagcattcttgttacccggttcggatgtcgccctgtgatgctggccggagggctgctggcttccgccggtatgattctggcctcgtttgccacacggttgttggagctgtacctgaccgcgggagtcctcaccggcctgggacttgcccttaactttcaacctagtctcattatgctgggactctacttcgaacggagaagaccactggctaatggactggccgctgcgggatcgcctgtgtttctgagcgcgttgtcacccctcggtcagcagctactagagcggtttggctggagaggcggatttctgctgctaggcggactgctcttgcattgctgcgcctgtggcgcagtcatgaggccaccacctgggccaggccctagaccacggagagactctgccggagatcgtgcaggagatgcccctggcgaagcagaagccgacggtgccggacttcagttgcgagaagcaagtcctagagtccgtccccgtaggcgcttgctggacctggctgtctgcaccgacagagccttcgccgtgtacgccgtcactaaattcctgatggcgctggggctgtttgtccctgcgatccttcttgtcaactacgccaaggacgcgggagtgccagataccgatgccgctttcctgctctcaatcgtcggttttgtcgacatcgtcgcacgccctgcttgcggtgcactggcgggtctggccagactacgtccccacgtaccatatcttttttctctggcactcctcgccaatggattaactgatttgtcttctgcgcgtgcccgatcatatggtgcactggtggctttttgcgtggccttcggcttaagttacggcatggtcggagcccttcagttcgaggtgctgatggccgctgtgggcgctccaaggttcccaagtgctttaggtttggtgttgctggtagaggccgctgctgtactgattggccctccttctgcagggaggctggtggacgtcttaaaaaattatgaaattatcttttacttagccggttctgaggtggccctcgccggtgtattcatggcggtggcaacgaactgctgcctaaggtgcgctaaggcagctccttccggacccggaaccgagggcggagcctctgacaccgaagacgctgaggctgagggagactccgagcccctccctgtggtggcagaagaacccggtaacctcgaagctctggaagttctttcggcccgtggcgaaccaacagagcccgagatagaggccagacctaggctggctgcagagtcagtctag

SEQ ID NO: 54112 - DNA, 294 bp, Artificial Sequence
  Description of Artificial Sequence: Synthetic coding sequence
atgggcgcagggggacccagaagaggagaaggtccacctgacggcggatgggggtgggttgtcctgggcgcatgttttgtggtgaccggcttcgcatatggattccctaaagccgtgagtgtatttttcagggcacttatgagagactttgatgctggttattctgataccgcctgggtgagcagtattatgctggcaatgctttacgggaccggccctgtgagctccatcctggtcacccgttttggctgtagacccgtaatgctagcagggggacttctcgctagcgcatag

SEQ ID NO: 54113 - DNA, 1500 bp, Artificial Sequence
  Description of Artificial Sequence: Synthetic coding sequence
atgctccacgccctgctaaggagccgcatgatccaaggccgtatcctcctgctgacgatatgtgccgctgggataggtggcacattccagtttggttacaatttatctattatcaacgcccctacacttcatattcaggaatttaccaacgaaacttggcaggccaggacaggagagcccctcccagaccatcttgtactgcttatgtggagcctgatagttagtttgtatccactgggaggactgttcggggctctgctcgctggaccactggctatcactctgggtcggaagaagtcactgttagtgaataacatatttgtcgtttcagcggctatcctctttggattctccaggaaggccggatcattcgaaatgatcatgctcgggaggctccttgtcggagttaacgctggagtgtcaatgaatattcaacccatgtatttaggggaatcagccccaaaagaattacgcggagccgtggcaatgagctctgccatctttacggccctgggcatagtgatgggccaagtggttgggcttcgcgaactcctggggggtcctcaggcatggcccttattgctggcaagctgtttagtgccaggtgcgcttcagctcgcctcgctcccacttcttccggagtcaccacggtatctgctgatcgactgtggcgacaccgaagcctgtctggctgccctccgcagactcagaggctcgggtgacctggccggtgagctagaagagttggaggaagagagagctgcatgtcagggttgccgcgcacggaggccttgggagctgttccagcacagagcactcagacgacaggtgacaagcttggtggtcctcgggtccgctatggaactctgtggaaatgactccgtgtacgcatatgcctctagtgtgttccgaaaagccggtgttccagaggccaagattcagtatgcgatcatcggcaccgggtcatgcgaactgctgacggcagtagtctcatgtgtggtgattgagagagttgggaggagagtgcttctcattggaggctactcgttgatgacatgttgggggagcatttttacagtcgccctttgtctgcagtctagcttcccatggaccctgtacctcgctatggcctgcattttcgcgttcattctgtcatttgggatcggcccagcaggggtcacgggcatcttggctaccgagctgtttgatcagatggctaggccggctgcctgcatggtgtgcggtgcgctgatgtggattatgctgatcctcgtgggtctgggctttccatttattatggaagcacttagtcactttctttacgtaccattcctcggggtttgcgtgtgcggggcaatctacacaggattgtttctaccagagaccaagggcaaaacttttcaagagattagtaaggagctgcatcggctgaactttcccaggcgggctcaaggaccaacttggcggagcttggaggtaatccagtcgacggagctgtag

SEQ ID NO: 54114 - DNA, 1491 bp, Artificial Sequence
  Description of Artificial Sequence: Synthetic coding sequence
atgagagcacttagaaggctgattcagggcagaatcttactactgacaatttgtgcagcaggaatcgggggtacctttcagtttggatataatttgtctattatcaacgctccgacactccatatacaagagttcaccaatgaaacctggcaagccagaaccggcgaacctctacctgatcatctcgtactcctgatgtggtctctgatagtgtccctgtacccgctcgggggactctttggagccctcttggcagggccactcgcgattacattgggaaggaaaaagagtctgctggtgaacaatatatttgtggtgtcagcagccattctgttcggattctcccggaaggctggatcgttcgagatgataatgttgggcaggttgctggtgggcgttaatgccggagtttccatgaatattcagccgatgtatcttggcgagtcagcccctaaggagctgcgaggagcagtggcgatgagttctgccatttttactgccctgggaattgtgatgggtcaggttgttggccttcgagagctgcttggcggacctcaggcttggccactgctgcttgccagctgcctggtgcctggggctttgcaactggcctctctaccccttttgcctgagtctcccagatatttactgattgattgtggcgatacagaggcctgcctggccgcactgcgacgactccgcggatccggagatttagccggagagctggaggaattggaggaggagcgagctgcgtgccagggatgccgtgccagacggccttgggaactgtttcagcaccgcgctctacgtaggcaagtcacaagccttgtcgtgctgggcagcgcaatggagttatgcgggaacgacagtgtgtatgcttacgcttcttctgtttttcgcaaggctggcgttcccgaggccaagattcagtatgctattataggaaccggcagctgcgaactgctcaccgccgtggtatcctgtgtcgtcattgagcgagtgggcaggcgcgtgctcttgattggcggttactcactcatgacctgctggggctccatcttcaccgtagcactctgcttacagtcttctttcccatggaccttatacctggctatggcctgcatcttcgcttttattctcagtttcggaatcggacctgcaggggtcacgggaatcctggctacagaactcttcgatcagatggcgaggcccgctgcctgtatggtctgcggagccttgatgtggatcatgctgatcctagtgggtctggggttcccctttataatggaggctctgtctcatttcctgtatgtcccatttctaggggtgtgcgtatgcggtgccatctacactggcctctttctacctgaaaccaaagggaaaactttccaagagatctcaaaagagctccatcgtcttaattttccaagacgagcgcagggccctacatggaggagcctcgaggtgattcagagtaccgagctctag

SEQ ID NO: 54115 - DNA, 1512 bp, Artificial Sequence
  Description of Artificial Sequence: Synthetic coding sequence
atggaggacgagcttgaaccctccttgcggcctaggactcagatccagggccgaatcctgctgctgaccatatgtgcggctggaatcgggggaactttccagttcggctacaatctgagcattatcaatgcccctactctccatattcaggagtttactaatgagacgtggcaggccaggactggcgaacctctgccagaccatttggtgctgttaatgtggagtctgatcgtctcgctgtatccactcggaggcctctttggcgctctccttgccggtcccctcgcgatcacgcttggaagaaagaagagtctgctggttaacaacatttttgtggtttccgctgcaatactctttggcttctcaagaaaggctggtagcttcgagatgattatgctcggcaggctcctagtgggcgtgaacgccggagtttccatgaacattcagcccatgtacttgggtgaatccgcccctaaggagctgcggggagccgtagctatgagctccgcaattttcactgcccttggcatagtgatgggacaggtcgtgggtctacgagaattgttgggcggaccacaggcttggcctctgctgctggcaagctgcctggtgcctggagcccttcaactggccagccttccccttctgccagaatccccgagatatcttctcattgattgtggcgacacagaggcttgtcttgctgctctgagaaggctaaggggctctggtgatctcgcaggagagctagaggaactggaggaggaacgagcagcctgccagggttgccgagctagacgaccatgggagctgttccaacaccgcgcacttcgacggcaggtgacaagcctggttgtgctcggaagcgctatggaattatgtggcaacgattctgtgtacgcgtacgccagctcggtgttcagaaaggccggtgtaccagaagcaaaaattcagtacgccatcatcgggactgggtcttgcgaactgttgacagctgtcgtaagttgtgtcgtcatcgagagagtcggcagaagagtgttactgattgggggatactccctaatgacatgctggggaagcatttttacagtggcactgtgtttgcaatcaagctttccgtggaccctctacctggcgatggcctgcattttcgccttcatactatccttcgggattggcccagcaggagtcacgggaatactcgctacggagttgtttgatcagatggccaggcccgctgcctgcatggtttgcggagcactcatgtggataatgttgattctggtgggtctaggttttccatttatcatggaagctctaagccatttcctctatgtgccctttctgggcgtgtgcgtctgcggggctatctatactggcctcttcctgccagagacgaaggggaaaactttccaggaaatttctaaggagctccatcgcctgaattttcccagaagggctcaagggcctacttggagatccctggaagtgatccagtcaacggagttatag

SEQ ID NO: 54116 - DNA, 1104 bp, Artificial Sequence
  Description of Artificial Sequence: Synthetic coding sequence
atggaggacgagctggagcccagccttcgtccacgaacacagatccaaggccgaattctgttgctgactatttgtgcagccggaatagggggaacatttcagttcgggtataatctaagcattatcaacgcccctacactgcatattcaagagttcacaaacgagacttggcaagctaggacgggagagccgctgcctgatcacctggttctgctgatgtggagcctcatcgtgagcttgtatccgctcggcggtcttttcggagcccttctcgctggcccattagctatcacccttggcaggaaaaagagcctgctcgtcaataacatctttgttgtcagcgccgcaatcttgtttggctttagcaggaaagccggatcctttgagatgatcatgctgggcaggctactggtgggcgttaacgcaggggtgtctatgaatatccagccgatgtatctcggcgaatccgcccctaaggagctaagaggcgctgtggctatgtcctcagctatctttacagctttgggtattgttatgggccaggtcgtcggactgcgcgagttgctcgggggaccccaagcgtggcctttgctgcttgccagttgtcttgtacccggtgcccttcagctggcaagcctgcccctgttaccggaatcacctaggtacctcctcattgactgcggtgataccgaggcttgcctggctgccctccgacgactgcgcggatctggcgatctggcaggggaactggaggagcttgaggaagaaagggcagcttgccagggctgtcgggctcgaagaccgtgggagctgtttcaacaccgggctttacggagacaggttacatctctcgtggtcctggggtccgcaatggagctctgtggcaacgactccgtgtacgcctacgctagtagtgtgtttagaaaggctggcgtcccggaggcaaagattcaatacgcgatcataggtacgggaagctgtgagctgctgactgccgtcgtgtcagtgagtcttgaaggggcactgccaccgccagcgctatggggaggcacccctcgaagttccgccctgaaccagtttactcttcagaagaaaaagaagtag

SEQ ID NO: 54117 - DNA, 1104 bp, Artificial Sequence
  Description of Artificial Sequence: Synthetic coding sequence
atgagagccctacggagactgatccaagggaggatcttgctgttaactatttgtgcagccggaattggcggaacgttccaattcggatataatcttagcatcattaatgcccctacactgcatatacaagagtttacgaatgagacgtggcaggccagaacaggcgaacctctcccggaccacttggtcctgcttatgtggtcactgatcgtgtcactctaccctctggggggtctgtttggtgccctcctcgctggacccctggccattaccctggggagaaaaaaaagtctcctcgtcaacaacatcttcgttgtttccgctgccatcctttttggcttttcacgaaaggccggaagttttgagatgattatgttaggaagattactagtgggtgtgaacgcgggagtgagcatgaacattcagccaatgtacctcggcgagtctgccccaaaagaactccggggagccgtggccatgtcatcagctatattcacagctctggggatcgtgatgggacaggtggtaggactgagtactaccgctgcacctggcctccgcggactggggcgtggtgccggtggcgctgggggaggagctaggtgtttaccaggcctgccttgtaggccttgggaactcttccaacaccgggcactgcgacgtcaggtcacaagccttgtcgtgctggggtccgcaatggaactgtgcggaaacgactcagtttatgcttatgcatcaagcgttttcaggaaggcaggggtcccagaggccaagattcagtatgccatcatcggcaccggaagctgtgagctcctaaccgccgtggtgtccgtctcgctcgagggtgccctacctcctcctgcgctttggggcggaacgccgagaagctccgccctcaaccagttcactcttcagctcatggtattgaaatgttccgaaggccctggggcagtggcgcatgcatgcaagccttccaccctgggcggacgtggaggttggataacgaggtcaggtgtcagagaccagccagggcaacactctgagacgccagttagcactaaaaagtataaaaaactttctaggagaggaggcggaagattgtag

SEQ ID NO: 54118 - DNA, 1392 bp, Artificial Sequence
  Description of Artificial Sequence: Synthetic coding sequence
atggaggatgaactggagccaagtctaaggccacgaacccagattcagggcaggatcttgttacttactatctgtgctgctggaatcggcggtaccttccaatttggctacaacttgagcataataaacgcccctacactgcatatacaggaatttaccaatgagacatggcaggcccgaaccggtgagccactcccagaccacctggtactcctcatgtggtcactgatcgtgtccctgtaccctctcggcggtctcttcggcgctctactggcagggccactcgccataacgcttggacgtaaaaagtcactgctggtgaacaacattttcgtggtctccgcagctattttattcggcttcagtcgcaaggcaggaagctttgaaatgatcatgcttggcagactcctggtaggggtcaatgcaggcgtttccatgaatatccaacccatgtaccttggggaaagtgccccaaaggagctgcgaggagctgttgccatgtcatccgccatatttactgctctagggattgtcatgggccaggtggtgggactgagggagctgctgggtgggccacaggcctggccgctgttgctggcctcctgtctagtcccgggagccttacaattagcatccctgcctttgctcccagagtcgcctagatacctgctgattgattgcggggacaccgaggcatgtctagctgcactccgcagactgagaggtagtggcgatctggccggagagctcgaagaactggaggaagagcgggctgcctgtcagggatgcagggcacggaggccttgggaactgtttcagcacagggcacttaggcggcaggtcacttctctcgtggtgctgggcagcgcaatggagctgtgtggcaacgactctgtctacgcctatgcaagctccgttttccgcaaggcaggtgtgcccgaggctaaaattcagtatgccatcatcggaacaggcagctgcgagctgctcaccgcggtggtgagcgtggctggggtagacgaggggtggggcgtgcaggcaggacttacatccacctctcctcctccaaggccacgtcaatcctccttcccctggaccttgtatctagctatggcatgcatcttcgccttcattctcagctttggcattgggcctgctggggtgactgggattctggctaccgaactgtttgatcagatggccagaccagctgcgtgtatggtgtgcggagccctgatgtggatcatgttgatcttagtcgggctagggttccccttcatcatggtgctgggttcttttctcattgcgggtggcctggtgccccttccgctgtgccccttcccttggtgtctgtgtctgtggggacacctgcattggccagtcccatcttag

SEQ ID NO: 54119 - DNA, 1854 bp, Artificial Sequence
  Description of Artificial Sequence: Synthetic coding sequence
atggtccctgttgaaaataccgaaggtccttccctgctaaaccagaaagggacggctgtggaaactgaaggatccggctctaggcatcctccatgggcccgaggctgtgggatgtttacttttctgtccagcgtgacagccgctgttagcggcctactggtagggtacgagcttggaattattagcggcgcattgttacagattaagacccttctcgcccttagttgtcacgagcaggaaatggtagtctctagtctggtcattggtgctctgctggcatcactcaccggtggggtcttaattgatcgatacggccgaaggactgctatcatcctgagcagctgtctgttggggctgggctctctcgtgctcatcttatcgctctcatataccgtgttaattgtcggcagaattgccatcggagtaagtatctccctgagctctatagcgacctgtgtgtacatcgccgaaattgcaccccagcaccgaaggggccttcttgtcagtctgaatgagctgatgatagtgatagggatcctttcggcatacatcagtaattatgcattcgcgaatgtctttcatggatggaagtatatgtttggactcgtgattcctctgggtgtcctccaggctattgcaatgtatttcctgccgccatcccctaggttcctggtgatgaagggccaagagggggcagcctctaaagttctgggaaggctgagagcattgtcagacactactgaggagttgaccgtgattaagagcagcctgaaagatgaatatcaatatagcttttgggatctgttccggtcaaaggataacatgcggacacgtattatgattggcttgactctggtgttctttgtgcagatcactgggcagccgaacatactcttttatgccagcaccgtccttaagagcgttggttttcaatccaatgaggctgctagccttgcctccactggagtaggagtggtcaaggtgatcagcaccatccccgctaccttactagtcgaccacgtgggaagtaagacctttctgtgcatcggtagtagcgttatggcagcctcactagttaccatgggtatcgtgaacttaaacatacacatgaatttcacccatatctgccgctcccacaactcaataaatcagtctctcgatgagtcagtaatctacggcccaggcaacctgtctacaaataataatactcttcgtgaccactttaaaggtatctcttcgcattccagatcaagtcttatgcctttgcggaacgacgtagacaagagaggggagaccacaagcgcatctttacttaacgcagggctgtcacacacagagtaccagattgtaactgacccaggagacgtacccgcttttttgaaatggctcagtctcgcatcccttcttgtgtacgtagctgcattttctattggattgggccctatgccctggcttgtcctcagtgagatttttccagggggtattcgcggaagggcgatggcactgactagtagcatgaattgggggattaatcttcttattagccttacattccttaccgtcacagacttaatagggcttccgtgggtctgcttcatctacaccattatgagtctggcttcacttctgtttgtggtgatgtttattccagaaacgaaaggctgtagtctagagcaaatcagcatggagctggccaaggttaactacgtgaagaacaacatctgcttcatgtcacaccatcaagaggagctggtgccaaagcaaccccagaagaggaagccccaggagcagcttctcgagtgcaacaaactctgcggaagaggccaaagtagacagttgagtcctgagacatag

SEQ ID NO: 54120 - DNA, 1656 bp, Artificial Sequence
  Description of Artificial Sequence: Synthetic coding sequence
atggcacagtttgtccaagtacttgctgaaatcggcgacttcggaaggtttcagatacagctgctgatcttgctgtgcgtccttaatttcctgtccccgttttatttttttgcccacgtcttcatggtgctagatgagccacatcactgtgcagtggcatgggtcaagaaccacacattcaatttatccgccgctgagcagttggttttgagcgtcccccttgacacagccggacacccagagccttgtctcatgttccggccacccccagccaacgcttccttacaggacattctgtcacatagattcaatgagactcaaccctgcgacatggggtgggaatatcccgaaaaccgtctgccctccctgaagaatgagtttaatctggtctgcgacaggaaacaccttaaagatacaacacagtcagtctttatggctggtctgctggtgggcacactcatgttcggtcctctctgcgaccgcatcgggaggaaggctactatcctggctcagctactcctgttcactttgattggattggcaacagcatttgtgcccagtttcgaattatacatggcgcttcgcttcgccgtggccaccgccgtcgccggactctccttttcaaacgtcactttgctcacagagtgggtgggaccaagctggcggactcaagcagtggttctggcacagtgtaacttttctctggggcagatggtgttggccggacttgcctatggatttaggaactggcgtctattgcagatcactggaaccgcacccggtttacttctgttcttctatttctgggcactgcctgagagcgcccgatggctcctcacgcggggaaggatggacgaggccatccagctgatccagaaggccgcttcagtcaaccggaggaagctgtcgccggaactgatgaaccagctggttccggagaagacagggccttccggcaatgctttagatctgttcaggcacccccagttacggaaggttacacttattatcttctgcgtttggttcgtggactccctggggtactatgggttgtctcttcaggttggtgattttggactagacgtttacctgacacagctcatctttggggcagtggaggtgcctgccagatgctccagtatattcatgatgcagagattcgggaggaagtggagccagctagggacacttgtcctcggcggactcatgtgtattatcatcattttcattcccgcagatttgcccgttgtggtcacgatgctagccgttgtgggtaaaatggctaccgctgccgcattcaccatctcatacgtgtattcagcggagttgttccctaccattctgcgacaaaccggtatggggttggttgggattttctctagaatcggtggaatcctaactccattggttatattgcttggcgaataccatgctgctctgcctatgctcatctatggctccctgccgattgtcgccggactcttatgcacactcttaccagaaacgcacggccagggcttgaaggataccctgcaagatctggagctcggtccacacccaaggagtccaaaatccgtgccttctgagaaggagactgaggcaaaaggtcggacttcctctcccggtgtggcattcgtgagttcaacatatttctag

SEQ ID NO: 54121 - DNA, 618 bp, Artificial Sequence
  Description of Artificial Sequence: Synthetic coding sequence
atggtactcgacgagccacaccactgcgccgttgcttgggtgaagaaccacacatttaatctgtccgccgctgaacagctggtgctgagtgtgccattagacaccgcaggacaccctgagccctgtctgatgtttagaccacctcctgcgaatgctagcctgcaggatatcctcagtcaccggttcaacgaaacccaaccgtgcgacatgggctgggaatacccggagaaccgactgccgtctcttaagaacgagttcaacctcgtttgcgatcggaagcacctgaaggatacaacacagtcagtttttatggcagggttgctggtgggcaccctaatgttcggcccactctgcgatcgcgacaggatggggggtgcccttatggaggacgcgggacgaggcccagggcctgtccaattactgcctcgagctgatggggcttgtggaactcggctgagatttcctcagctcgaagccccaagtgaccatcgacactgcgcatggctgacagcacttctgctgctgcttggctcagccagaatatgcactctcgctccggacccctgggaagatggtcggggtgataccaccgatccagaggggggtcttggccagtag

SEQ ID NO: 54122 - DNA, 1662 bp, Artificial Sequence
  Description of Artificial Sequence: Synthetic coding sequence
atggcctttcaagatctgctggggcacgccggtgatttgtggagattccagatcttgcagaccgtttttctgtcaattttcgccgtggctacttatctccattttatgctggaaaactttaccgcttttatcccgggtcacagatgctgggtacatattctcgataatgatacagtaagtgacaatgacaccggggctctctcccaggacgccctgctgaggatttcgatcccattagactcaaatatgagacctgagaaatgcagacgctttgtccaccctcaatggcagctgctgcacttaaatggaaccttcccaaatacatcagatgcagatatggaaccatgcgtcgacggctgggtgtacgatcggataagcttctcctcaaccatcgttactgaatgggacctggtgtgtgatagtcagagcctgaccagtgttgcaaaatttgtctttatggccggaatgatggtaggaggaatcctaggcggtcatctttccgacagatttgggaggaggtttgttctgcggtggtgctatctccaggttgctatcgtgggaacttgcgcagcactggcacccaccttcctgatttactgcagccttaggttcctctccgggatcgccgctatgtccctaattactaataccattatgcttatcgctgaatgggccacccatcggtttcaggccatgggtatcacactgggcatgtgcccctccggaatcgctttcatgactctcgccggtctggcgttcgctattcgagactggcacatcttacagctcgttgtgtctgtaccctattttgtgatttttcttactagttcctggctgcttgagtctgctagatggcttatcattaacaacaagccagaggaggggttgaaggagttgcggaaggcagctcatcgctctgggatgaaaaacgctagggacaccctgaccttggagattcttaagtctactatgaagaaggaactggaagcagcacagaagaagaaaccttccctatgcgagatgcttcatatgcccaatatttgcaagcggataagcctgctgagctttacacgattcgccaactttatggcttacttcgggcttaacctgcacgtgcagcacttgggcaataatgtcttcttgctgcaaacactgttcggagccgtgattttgctggccaactgcgttgctccttgggcacttaaatacatgaatcgcagagcttctcaaatgttgctcatgtttttgctcgccatttgtctgcttgccatcattttcgtgccacaagagatgcagacactgcgcgaagtactggccacccttgggctgggagcctccgccctagcaaatactttagcattcgcccatggaaacgaggtgatcccaactataatacgggctcgagccatgggtataaatgctactttcgcaaatatagcaggagccctggctcccttgatgatgatcctgagcgtgtattccccaccactcccatggataatttatggcgttttcccctttatctctggattcgcatttctactgctcccagagacccggaacaaaccactcttcgataccatccaagatgagaaaaatgagaggaaagatccgagggaacctaagcaggaggatcctcgcgtggaagtcactcagttctag

SEQ ID NO: 54123 - DNA, 717 bp, Artificial Sequence
  Description of Artificial Sequence: Synthetic coding sequence
atggcttttcaagatctccttggacatgccggagatctttggagatttcaaatactgcaaactgtgtttctgagtatattcgcggttgctacttatctgcactttatgctcgaaaacttcactgctttcatccctggccacagatgctgggtgcacatattagacaatgataccgtctcggacaacgatacaggtgccttatcacaagacgccctcctgcggatcagtatacccctggacagcaacatgcgaccagagaagtgtagacgctttgtgcatccccagtggcaactgctgcatcttaacggcacctttcccaacactagcgatgcggacatggagccttgcgttgatggatgggtctacgatagaatttctttttcgagtaccatagttactgagtgggatcttgtctgcgatagccagagtctcacctctgtggccaaatttgtgttcatggctgggatgatggtggggggaattctgggaggccatctctccgactcgtcgcgggtagggaacactcaaatccccggacatggcaactacatcggcaacgtgcccttctggtactgtatttatgatcccggacggcctggtttctgccactctcgcctagcctacccccctgccggaggcgtgtgtacgattctttgcgacctgagcgatttgaaactggcggctagagtctgttcagttgcccattaccagcagtag

SEQ ID NO: 54124 - DNA, 1626 bp, Artificial Sequence
  Description of Artificial Sequence: Synthetic coding sequence
atggcattcgaggagttactcagccaagtcggcggtcttgggcgatttcagatgcttcacttggttttcattctgcccagcctgatgctcctgataccacacatcctcctggaaaacttcgccgctgccattccgggacatcgctgctgggtacatatgctggacaataatacgggttctggcaacgaaacaggaatcctgtcagaggatgcactccttcgaattagcataccgctggactcgaatctgagacccgagaaatgtcgacgcttcgtccacccccaatggcagttactccatctgaacggaacaatccactctactagcgaagccgatacagagccttgtgtggacggttgggtatatgatcagtcgtacttcccttcaacaattgtcactaagtgggacctcgtctgtgactaccaatccttaaagtcagtcgttcaatttctcctcctcaccggaatgttggtcggagggataatcggtgggcacgtgtcagataggtttggacggaggttcatcctccggtggtgcctgctgcaactggcaattacggacacctgcgccgctttcgcccctacattccctgtttattgtgtcttaaggtttctcgccggattctcttccatgattattattagtaacaacagcctaccaattaccgagtggatccgtcctaatagtaaggctctggtcgtcatcttatcctctggcgctctgagcatcggccagatcatcctgggcggtctggcttatgtgttccgtgactggcagaccttgcacgtggtcgcctcagtccccttcttcgtcttctttctgctgagtcggtggttggtcgaatcagccagatggctgattattacaaataaactggacgagggtcttaaggccttgaggaaagttgccagaacaaacggcattaaaaatgccgaggagactctgaatatcgaggtagtccgcagcaccatgcaggaggagctggatgccgctcaaaccaagaccaccgtttgcgacctgttcaggaatccttctatgagaaagcgcatttgcattctcgtgttcctgaggtttgctaacactatcccattctacggaaccatggttaatctacagcacgtaggctctaatatctttctgctccaggtgctgtatggcgcagtggcacttatcgttcgatgtcttgccttgctcacgctcaaccatatggggcgtagaatttcgcagattctgtttatgttcctagtggggttgtccatactggctaacacattcgtgcctaaggaaatgcagactttgagggtggccctcgcatgcctgggcattggatgctcagccgctacatttagttctgtcgccgttcacttcattgaactgatccctacagtgctgcgcgctcgggcatctggaatcgatctgacagcctctcgtataggggctgctttagctcccctgctaatgaccctgacagtgtttttcactacactgccatggatcatctatggcatctttcccatcatcggtggcctgattgttttcctgctgccagaaacaaagaacctcccactccctgacacaatcaaagacgttgagaaccaaaagaagaacctgaaggagaaagcctag

SEQ ID NO: 54125 - DNA, 1119 bp, Artificial Sequence
  Description of Artificial Sequence: Synthetic coding sequence
atgttggacaacaataccgggagcggcaatgaaacaggcatcctcagcgaagacgcactgctgaggatctccatcccgctggattctaatctgcgccctgagaaatgtcgaagatttgtgcacccacaatggcagctcctgcacctcaatggcactattcatagtaccagcgaagccgacactgagccgtgtgttgacggttgggtctacgaccagagctatttccccagtaccatcgttaccaaatgggacctagtgtgcgattatcaatctctcaagtcagtagtgcagtttttattgttaacagggatgctcgttgggggtatcatcggaggtcacgtaagcgataggttcggtcggaggtttattctgcgctggtgcctgctccagttagccattacggacacttgtgcggcattcgcacctaccttcccagtgtattgtgttctcagatttttggcgggattttcatcaatgatcatcatctcaaacaattctttgcccattaccgaatggatcagaccaaatagtaaggccttagtcgttattctgagctcaggcgctttgagcatcggccagataatcctaggcggtttggcctacgtgttcagggattggcagactcttcacgttgtggcctcggttccttttttcgtattctttctgctgtcacgttggctggtcgagtcagcaagatggctaataatcactaataaattggatgaaggcctgaaggcactacggaaggtagccagaaccaacggcattaaaaacgcagaggagaccttgaacattgaggtagtccggagtaccatgcaggaggaattggacgcggcacagacgaagacgaccgtatgtgacttattcaggaacccaagcatgagaaagagaatctgcatcctcgttttcctcagatttgcaaacacaattccgttctacggaaccatggtgaaccttcagcatgtgggctctaacatctttcttttacagaagtgtcgaccttgcgtctggctctggcatgtgtgggaatcggccgtcctgctgcttctctttccggtgctactctttacctctctcaactcgtccccccttttctctggacaagagctgcaggagtag

SEQ ID NO: 54126 - DNA, 444 bp, Artificial Sequence
  Description of Artificial Sequence: Synthetic coding sequence
atgattataatatccaataactccctgccgatcacagagtggatccgcccaaactccaaagcattggtggtgattttatcatccggagcactgtccatcggccagattatattggggggtcttgcatacgttttccgggactggcagactcttcatgtcgtcgccagtgtacccttcttcgtgttttttcttctcagcaggtggttagtcgaatcggccaggtggctcatcatcacaaacaagttggacgaggggttaaaggccctgcggaaggtggcgaggaccaacggcattaagaacgccgaggagacactgaacattgaggtagtccgtagtacgatgcaggaagagctcgacgcggctcagacaaagaccacagtttgcgacttatttcgaaacccaagtatgcggaagagaatctgcatcctggtttttctacgttag

SEQ ID NO: 54127 - DNA, 810 bp, Artificial Sequence
  Description of Artificial Sequence: Synthetic coding sequence
atgcttgttggcggtataatcggagggcatgtttctgatagatttggaaggcgtttcatcctacgttggtgcctattacagctggctatcacagacacttgcgcagctttcgcccctacttttccagtgtattgcgtgctacgctttcttgcaggattcagctccatgataataatatcgaataattccttgcccatcacagaatggatcaggcccaactcgaaggcgcttgtcgtgatattgtcttcgggcgctctaagtattggtcagatcatacttggcggacttgcctacgtgttccgcgactggcagaccctgcacgtggtggcgtccgtccccttctttgtattcttcctgcttagtagatggctggttgaatctgccagatggttgatcataacaaataagctcgatgaaggactcaaagcactgaggaaagtggcacgtacgaatgggattaagaacgccgaggagacattaaacatcgaggtggtccgatcaaccatgcaggaggaactggacgcagcacagaccaaaacaactgtgtgtgatcttttcagaaacccatctatgcgaaaaagaatttgcatcttggtgtttctgaggttcgcgaatactattccattctatggaactatggtgaatctgcaacacgtgggaagcaatatcttcttactgcagaagtgcaggccttgcgtttggctttggcatgtttgggaatccgccgtactgctgcttctatttcctgtcctcttgtttacctcgcttaatagctctcctctcttctccggccaggagctgcaggaatag

SEQ ID NO: 54128 - DNA, 1785 bp, Artificial Sequence
  Description of Artificial Sequence: Synthetic coding sequence
atggctggtgaagaaaacttcaaagaggagctcaggtcccaagatgcctcacgcaacctgaatcagcatgaagtcgcgggacacccccacagctggagcctggagatgcttctcagacgactcagggccgtccacaccaagcaggatgacaagtttgccaacctcctggacgcggtaggagagtttgggaccttccagcagaggctggttgcccttacctttattccctcgattatgtcagcttttttcatgtttgccgatcatttcgtcttcactgcacaaaaaccttactgtaacacctcatggattttggccgttggcccacatttgtctaaggcggaacagttaaacctaaccatacctcaggcgccaaatggatcgtttctgacctgttttatgtacctacctgtgccctggaacttggacagcattatccagtttggcctaaatgatacagatacgtgccaggacggatggatctaccccgatgccaaaaaaaggagcctcatcaacgaattcgacctggtgtgcgggatggagaccaagaaggacaccgctcagatcatgtttatggccggactcccaataggatctttaatttttaggctgattactgataaaatgggcagatatcctgcaatcctgttatctctgctcggcctgattattttcggtttcggaacggcattcatgaattcttttcatctatacttattttttaggttcggtattagccagtccgtagtcgggtatgcgatttcaagtatctcactggcaacagaatggcttgtgggggagcatcgggctcacgccattatcttgggtcattgtttctttgctgtgggcgcagtgctgctgacaggtatcgcctatagtctccctcattggcagctgttgttccttgtgggaggaattctggtgatccctttcatcagctatatctggatacttcccgagtcccctcgatggctgatgatgaagggcaaggtcaaagaagccaagcaggtgttatgttatgccgctagtgtgaacaagaagacaatcccaagcaatctcctggacgagctgcagctgccgagaaagaaagtgactagagcgagcgtcctggacttctgtaagaatcgacagctttgtaaagttacgctagttatgtcctgcgtgtggtttaccgtgagctacacttacttcaccctgtccttgcggatgcgagagttgggggtgagcgtacacttcagacacgtggtcccaagtatcatggaggtgcccgcacgtttgtgctgcatttttctgctgcagcagattggcaggaagtggtctctggctgtgaccctactccaggcaattatttggtgcctgttgctgctgttccttccagaaggcgaagatggcctccgtttgaaatggcccagatgtccagcaaccgagctgaagagcatgaccattttggtgctgatgttgcgagagttcagcctagctgccacggtgaccgttttcttcctgtatacagccgagctgctccccacagtccttcgagccacaggcctcgggctggtttctttggccagcgtggctggagctattctgtcactgactataatctcccagaccccatcacttcttcctatcttcctgtgctgtgtgctcgccattgtcgccttttcactgtcttcactcctgccagaaacccgagaccagcctttgtctgagtcattaaaccatagctctcagatcaggaataaagtgaaagatatgaaaactaaagagacgagtagtgatgatgtgtag

SEQ ID NO: 54129 - DNA, 1785 bp, Artificial Sequence
  Description of Artificial Sequence: Synthetic coding sequence
atggcaggcgaggagaactttaaggaagagttgagatcgcaggatgcctctcgaaacttgaatcagcacgaagtcgccggtcatccacactcttggagcctggaaatgcttctcaggcggctcagagctgttcacacgaagcaggacgacaagtttgcaaacctcctggatgctgttggcgagtttggtacttttcagcaacggcttgtggccctaacatttatcccttccatcatgtctgccttctttatgtttgctgaccactttgtatttactgcccaaaaaccgtattgcaatacaagctggattttggcagtgggcccacacctctccaaagccgagcagttaaatctgactataccccaggcccctaacggcagtttcttgacctgtttcatgtatctccctgtgccctggaatctggattcaatcatccaatttggactgaatgatacggacacctgccaggatggttggatctaccctgatgctaagaagaggtctctgatcaacgaattcgacttagtgtgtggcatggagactaaaaaagatactgcacaaatcatgtttatggcaggattgcctatagggtcgctcatcttccggctaatcaccgataaaatggggagatatcctgccatattgctgagtttactgggcctgataattttcggattcggaaccgctttcatgaactccttccatctgtatttgttttttcgatttgggatctcacagagcgtggtggggtacgccatcagcagcatctctctggccactgagtggctggttggagagcaccgagcccacgcaatcattcttggacactgcttctttgcagtgggcgcagtgctactgactgggattgcgtactcactcccacactggcagctgttatttctggtcggcggtattctcgtcatccccttcatatcctatatctggattttgcctgaatctcccagatggttgatgatgaagggcaaggtaaaggaggcaaagcaggtcttatgttacgctgccagcgtaaataagaaaacgattccttccaacctgctcgacgagctccagttgcctcgtaaaaaggtcacgagagcctccgtgttggatttctgtaagaaccgccagctttgtaaagtgacgttggtaatgtcctgcgtttggttcaccgtgagttacacgtacttcacgctctctctgcgcatgagagagctcggggtgtctgtgcacttccggcacgtggttccaagcattatggaggtcccagcacggttgtgttgtattttccttctgcagcagatagggagaaagtggtccttggccgtgaccctgctgcaggccattatctggtgcctcttgttgttgtttctgccagagggcgaggatggccttcgactgaagtggcccaggtgtcccgcaacggaactgaaatccatgactatcttagtgctcatgctacgggagttctccctggctgctacagtgaccgtgttctttctgtacacagctgagctgctcccaactgtcctgagagctactggattgggtctggtgtcactggcgagcgtggccggagccattctaagtcttaccatcataagtcagaccccttcccttctaccgatatttctgtgttgcgtgctggccatcgtcgctttctccctgtcaagtctgctacctgagacaagggatcagcctctgtcagaatccctgaaccactctagccagattaggaacaaggtcaaagacatgaagaccaaggaaacctcctctgacgacgtgtag

SEQ ID NO: 54130 - DNA, 1275 bp, Artificial Sequence
  Description of Artificial Sequence: Synthetic coding sequence
atgcagggagccagagcccctcgggatcagggacgctcccctggacgcatgtccgcacttgggaggtccagtgtgatcctcctgacctacgtactggccgcaacagagctaacgtgtctgtttatgcaatttagtattgtgccgtacttaagtcgcaaactggggttggactctattgcctttggctatctacaaaccaccttcggcgtgctccagctgctcggtggccctgtgttcgggaggtttgccgatcagcggggagcacgggctgctctgaccctaagctttttggccgcactagccttgtatctgctactggcggctgcaagcagcccagcgctgcccggtgtctatctccttttcgcaagtcgtttgcctggcgctttgatgcatacactgcctgcggctcagatggtgatcacggatctgtccgcaccagaagagagaccagcagccctcgggagactcggcctgtgttttggagttggggtcattctcgggagcctgttgggtggaactctggtgagtgcctacgggattcaatgtcctgctattttggcagctttggcaactttgctaggcgctgtattaagttttacgtgcattcccgctagtaccaaaggggcaaagacagatgcacaggctccactgcctggcggtccccgtgcatccgtcttcgatttgaaggcaatagcatctctgctgagactgccggacgttccacggatattcctagtgaaagtcgcctccaactgcccaacaggccttttcatggttatgttcagcattatcagcatggatttcttccagttggaggcagcacaggctggatacttgatgtcgttctttggactcctgcagatggttacccagggccttgtcatcggtcagttgagttcacatttttctgaggaagtattgcttagggcatcggtgctcgtgtttatcgtagtggggctggctatggcttggatgtccagtgtgttccatttctgtctgttggttccaggactcgttttctccctgtgcaccctcaatgtggtgacagattcaatgttgatcaaagccgtgagcaccagcgataccggtacgatgcttggactgtgtgcttcggttcagcctctcctgcggaccctcgggccaaccgttggaggcctgctgtataggagctttggcgtccctgtgtttgggcatgtgcaggtcgccatcaatactctggtcctgctggtcctgtggaggaagcctatgccacagcgcaaagacaaggtgcgctag

SEQ ID NO: 54131 - DNA, 1275 bp, Artificial Sequence
  Description of Artificial Sequence: Synthetic coding sequence
atgcagggcgctagagccccaagagatcagggcaggtcacctgggagaatgagcgccctgggtcgctcatccgtaatcctgcttacttacgttctggccgcaaccgagctcacctgcctgttcatgcagtttagtatcgtcccatacctgtcccgcaaactggggctggattctatcgctttcgggtacttgcaaaccaccttcggcgtgctgcagttgctgggaggcccagtttttggcaggttcgcagatcagcgcggagctcgagccgctctcaccctatctttcctagctgcccttgctttgtatcttctgttggcggcagcgagctcccccgctttgcccggtgtttatctgctgttcgcctcccgcctgcctggagcgttgatgcatacccttccggctgcccaaatggtgattactgacctaagcgccccagaggagaggccagccgcactgggccgactgggactatgctttggggtgggtgttatccttgggtctcttttaggaggtaccctggtttcagcttacggaatccagtgtcctgcaatcctggccgctttagcgactcttctgggggctgtactgtcatttacctgcatccccgcaagcaccaagggtgctaaaacggacgcacaggccccattgccaggcggaccccgtgcaagcgtctttgacctgaaggcgatcgccagcttgttgaggctgccagatgtcccaagaattttcctagtcaaggtggcttctaattgtcccaccgggttatttatggtaatgttctcgataatcagtatggacttcttccagcttgaggctgcccaggcaggttacctgatgtcttttttcgggctgctccaaatggtaactcagggcctggtcatcggacaattgagctcccatttcagtgaggaagtgctcctcagagccagcgtgctggtgtttattgtggtcgggctggccatggcctggatgagttcagtgttccacttctgtttactggtccctggcttggtgttcagcttgtgtactctgaacgtagttaccgactccatgttgatcaaagctgtatccactagcgatacaggcactatgttgggactctgcgctagcgtgcagccgcttcttcggactttaggtccaactgtgggcggattattatatcgctcctttggagtcccggttttcgggcacgtgcaggtggccattaacacactggtgctgctggttctatggcgaaaacctatgcctcagcgcaaggataaggtgagatag

SEQ ID NO: 54132 - DNA, 1275 bp, Artificial Sequence
  Description of Artificial Sequence: Synthetic coding sequence
atgcagggcgctcgggctccaagagatcaaggtaggagccccggaaggatgtctgccctgggcaggtccagtgtaatcctgctaacgtacgtacttgcagcaactgagctgacgtgcctctttatgcagttcagcattgtcccttatctgtcccggaagctggggttagacagcattgcattcggctacctgcaaacaacttttggcgtgttacagctgctgggcggtccagttttcggaaggtttgcggatcagagaggggcacgggcagcactaacactgagcttcctcgccgctctagctctgtacctccttctagcagctgcgtcaagtcctgcactaccaggcgtttatctactatttgcatctcgactgcccggagccctgatgcacacccttcctgctgcacaaatggtgataacagacttgtcggcacctgaagaaagaccggctgcactgggacggcttggactgtgcttcggcgtaggagttattttgggctcccttctaggtggcactctcgtctctgcctacggaattcagtgtccggcaatcctggcagcgctggccaccctactgggagcagtactctctttcacctgcatcccagcttccactaaaggagccaaaactgatgcccaggccccactgccaggtggccctcgggcatctgtatttgatctgaaagccattgcatctttactaagactccccgatgtgcctagaattttcctggtgaaagttgcttccaattgtcccacaggcctcttcatggtcatgttttcgattatttctatggacttcttccagctggaagccgcacaggccggatacttgatgtctttcttcggcctgctgcagatggtgacgcaaggtttggtgattggccagctgtcctctcatttctctgaagaagtgcttctgcgagcttcggtgctagtgttcatcgtggtcggtctcgctatggcctggatgtccagtgtctttcacttttgcctgctagtcccgggtttagtattcagcctgtgtacacttaacgtggtgactgactctatgctcatcaaagcagttagcaccagtgataccgggactatgctcgggctgtgcgccagtgtgcagcccctgttgagaacattagggcctactgtcggcggactgctgtaccggtccttcggcgtgcccgtcttcggacatgtgcaggtggcaatcaacacacttgttctgttggtgctgtggaggaaacctatgccccagaggaaggataaagtccggtag

SEQ ID NO: 54133 - DNA, 981 bp, Artificial Sequence
  Description of Artificial Sequence: Synthetic coding sequence
atgcagggcgctagggctcctcgtgatcaggggagaagtccgggtcgaatgagtgcactgggtaggagttctgtgatcctgttgacctacgtactggccgcaacagaacttacttgtctgtttatgcagttttctattgtcccctatctgtcccggaaactcggtctagattctatcgcatttgggtatcttcaaacgacattcggcgtcctgcagctgctggggggacccgtattcggtcggattcagtgtccagccattctggccgctttagctacactactgggcgcagtgttaagctttacatgtattccagcctctaccaaaggggctaagacggatgcccaggccccacttcccggtggacctcgagcctcagttttcgacctgaaagccatcgcttctctgctacggttaccagatgttccaaggatattccttgtgaaagtggcctcaaactgtccaacagggctgttcatggtgatgttttctataatcagcatggacttttttcagctggaagctgctcaggccggttaccttatgtcattctttggactgcttcaaatggtgacccagggactcgtcatcgggcaactgagttcccatttttcagaagaggttctgctccgcgctagtgtgttagtgtttatcgtagtcgggctagcaatggcgtggatgagtagcgtgtttcacttttgcctattggtgcctggcctggttttctctctttgcaccctgaatgtcgtcacagactccatgctcatcaaagccgtatctaccagcgacacagggacgatgctcggcctgtgtgccagcgtgcagccactgctgaggactctaggccctacagtgggaggcttgctgtatcggtcattcggggtcccagtcttcggacacgtgcaagtggccatcaatacacttgtgcttcttgttttgtggcggaagcctatgccccagagaaaggataaggtgcggtag

SEQ ID NO: 54134 - DNA, 405 bp, Artificial Sequence
  Description of Artificial Sequence: Synthetic coding sequence
atgcagggggctcgggcaccgcgagaccaggggaggagccctggcagaatgtccgcattaggtcgttcatcagttatcttgctgacctacgtactcgctgcaacagaattaacatgtctcttcatgcagttttcaatcgtcccttacctgtcccggaagttaggtttggatagcatcgcttttgggtatctccagacaacattcggcgttttgcagctgctcggtggtcccgtctttgggagattcgcggaccagcgaggagcaagagctgccttgactctcagcttccttgcagcacttgcactctatctcctgttggcagctgctagttcaccagctctgcccggtgtgtacttattatttgccagcaggctgccaggtgcactcatgcatacgcttccctag

SEQ ID NO: 54135 - DNA, 1644 bp, Artificial Sequence
  Description of Artificial Sequence: Synthetic coding sequence
atggcctttcaagaccttctggatcaggtgggcggattaggaagattccaaatcttacagatggtgtttctaatcatgtttaatgtaattgtctaccaccagacgcaattagagaatttcgccgcatttatactggatcataggtgctgggtacatattttagacaatgacactatccctgataatgacccaggaacccttagccaggacgccctcctgaggatctcaattccgttcgatagtaacctgagacctgagaaatgccgccgtttcgttcaccctcagtggaagctgattcacttaaatggaactttccctaatacttccgaacccgatacagagccctgcgtggacggctgggtttatgatcagtccagcttcccgtctaccatcgtgaccaaatgggacctggtgtgtgaaagtcagccactaaactccgtcgctaaattcttatttatggctgggatgatggtcggtggaaacctgtatgggcatctgagtgaccgtttcggacgtaaatttgtgctgcgctggtcctatctccaacttgccatagtgggcacgtgcgcagccttcgccccaactatactggtgtattgctccctccggttcttggctggggcagctacattttcgatcattgtcaacacagtgcttctcatagttgaatggattacccaccagttctgtgccatggccctgaccttgaccctgtgcgccgctagtatcggacatattaccttaggatctttagctttcgtgatccgcgaccagtgcatccttcaactcgttatgtccgctccttgctttgttttttttctcttctcccgctggttggcagagagtgcaaggtggttgataataaacaataaacccgaagagggcctcaaagagctgaggaaggccgcacaccggaatggaatgaaaaatgcagaagacatactcacaatggaggtgctgaaatccaccatgaaacaggagctcgaggctgctcagaaaaaacattctctgtgtgagttactgcggatcccaaatatatgtaagaggatttgcttcttgtccttcgtgagattcgcatcgacaatcccattttggggattaaccctccacctccagcacctgggcaacaatgtgttcctgctgcaaactctattcggtgccgttaccttgctggcgaattgcgtcgcgccttgggctctcaatcatatgtctcgccgactaagccagatgcttctgatgtttctgttagcaacctgcttgcttgcaatcatctttgttcctcaggaaatgcagaccctgcgtgtggttctcgcgactctcggcgttggagccgcatcgttgggaattacgtgcagcactgcccaagagaatgagttgatcccgtccatcattcggggacgcgcaacaggtatcacagggaactttgctaacattggaggagcactggccagcttaatgatgatactctcgatttatagccggcctctaccttggatcatatatggagtatttgcaatcctgtccggcttggtcgtgctactgctgccggagacccgaaatcagcctctgctggacagtatccaggacgtggaaaatgagggtgtgaactcgttagcagcaccacagcggtccagcgtgctgtag

SEQ ID NO: 54136 - DNA, 705 bp, Artificial Sequence
  Description of Artificial Sequence: Synthetic coding sequence
atgaacatgtttggacgtaagtttgtccttaggtggtcctatcttcagctggctatcgttggaacttgcgctgctttcgctccaactattctggtgtactgctcactgcgatttttggcaggggctgctacatttagtatcatagttaacacggtgctgcttatcgtcgaatggattacccaccagttctgcgctatggctttgaccctgaccctgtgcgcagcatccattggtcacattaccctcgggagcctggccttcgtgatccgcgatcagtgcatcctccagctggtaatgtctgcaccctgcttcgtgttttttctgttctcgaggtggctcgcagaaagtgccagatggttgattattaacaacaaacccgaagagggcctgaaggagctgagaaaggccgcacataggaacggtatgaaaaacgctgaagacatcttgacaatggaagtcttgaagtctacaatgaaacaggaattggaagccgctcaaaaaaaacacagtctatgcgaactgttgcggatccccaatatttgtaagcgaatctgtttcctcagtttcgtgaggagcgctggagtatgctggcggtccactcctgacccagtttgtctcggcatcacatctggcggatgccgcactgctaaaattcctgcttgcagctttctgtggaagctgcacttccgcggagccccagcctag

SEQ ID NO: 54137 - DNA, 609 bp, Artificial Sequence
  Description of Artificial Sequence: Synthetic coding sequence
atggccttccaagacctgctcgaccaagtgggaggtttgggcagatttcagatattgcagatggtttttctgatcatgtttaatgtcatcgtgtatcaccagactcagttggaaaacttcgcagctttcatcttggaccatagatgctgggtgcatatactagataatgatactatacccgataatgatccgggtacgcttagccaggacgccctactgcggattagcatccccttcgacagtaatttacggcctgagaaatgccggcgttttgtgcatcctcagtggaaattgatccatttgaacggcacgtttcccaacactagcgagccagacactgagccctgcgtggatggctgggtgtacgaccagtccagttttccatctactatcgtgacgaagtgggatctggtctgtgaatcacaaccactaaactccgtagcaaagttcttgtttatggcgggaatgatggtgggaggaaatttgtacggccatctgtccgacaggaagccattaagcagtcccaaccatgtctctaccgactgcgacgaggggctagaggtgccgattgctatacaccagcaccatgttttttggtacctgagttag

SEQ ID NO: 54138 - DNA, 1200 bp, Artificial Sequence
  Description of Artificial Sequence: Synthetic coding sequence
tgattccaggacctgttagaccaggtcgggggactcggtagattccagatcctgcagatggtattcctgataatgtttaacgtgatagtctatcaccagacccaacttgagaattttgcagcattcatactagaccaccggtgttgggtgcacatcctggacaacgatacaataccagataatgaccctgggactttatctcaagacgcgttgttaaggatatctataccatttgacagtaatctcagacctgaaaagtgtagacgttttgtgcacccacagtggaaactcattcacctcaatgggacttttcctaacacctcggagcccgacactgaaccttgcgtagatggttgggtctatgatcaaagctcatttcccagcactattgtcaccaagtgggacctggtatgcgagtcacagcccctcaatagcgtggccaagtttctgttcatggcagggatgatggttgggggaaatctgtacggtcatctgagcgaccgatttggccgaaagtttgtgctcaggtggtcctacctccagcttgccattgttggaacctgtgcagcatttgcaccaaccatcttggtgtactgtagtctacgctttctggcaggagctgcgacattctctattatagtgaacacggtgcttctgattgttgagtggattacgcatcagttttgcgcaatggctctcaccttgacactctgtgctgcaagcattggtcatattacccttgggtcgcttgcattcgtgattcgagaccaatgcattcttcaactggtgatgtcagcaccatgttttgtattcttcttgtttagccgatggctggcagaatctgcacgttggctgataattaataacaaacctgaggaaggactgaaagagctccgcaaggccgcacaccggaacggcatgaaaaacgcagaggacatactgaccatggaagtgctgaagtccacaatgaaacaggaactggaggcagcacaaaaaaaacactccctgtgcgagctgttgcggatacctaatatttgcaaaagaatttgcttcctgtcattcgtccgatctgcaggagtctgctggaggagcacccccgatcccgtctgccttggcataacaagtggcggatgtagaactgcaaaaatccccgcatgtagcttcctatggaaactgcattttcgtggagcgcctgcctag

SEQ ID NO: 54139 - DNA, 1482 bp, Artificial Sequence
  Description of Artificial Sequence: Synthetic coding sequence
atgtctcgttcccccctaaatccttctcagttgcggagcgtggggagccaagacgctttggcccctctgcctccacctgcccctcagaacccaagtacgcattcttgggaccctctttgcggaagtcttccatggggcctttcttgtcttctggcccttcagcatgtactcgtgatggcctctctcttgtgtgtcagccacttgctcctcctttgctctttaagtccaggcggactgtcttacagtccatcgcagctgctggcatcctcattttttagttgcggaatgagtacaatcctccagacatggatgggctcaaggcttcccctcgtgcaggccccttctctcgaatttttaatccccgctttagttttgacaagtcaaaagctgccccgagccatccagactccgggtaattctagtcttatgctgcacttgtgtcggggaccctcatgccacggcctcggccattggaacactagcctacaggaggtgtcgggcgcagtcgtagtatccggcttactgcagggtatgatgggactgctcggttccccaggtcatgtcttcccgcactgtggccctctggttttggccccttccctggtggtggcagggctgagcgctcatagggaggtcgcacagttctgctttacacattggggacttgccttgttgacctgggctccggcttcctttatgtgtgctcccggaggagagctgcagcgtcaccaactgaccctcctgtctctcagtagcggctcattccgaaactgtttgcccccacctcgccatcacggatttggctgcttgacccaggcgggatctcaacaggtagctcacctggtggggcttctttgtgtgggcttgggcttgtcgccccgactggcccagcttttgacaacaattccactgcccgttgtgggaggagttttgggcgtcacccaagcagttgtgctttcggccggattttcctcattttacttggccgacatcgacagtggcagaaatatctttatagtcggcttctcgatctttatggccctgctcctgccacgttggtttagagaagccccagttctattttccaccggttggagtcctctggacgtactcctccattctcttctgactcagcctatttttctagcaggcctatcaggatttctattggaaaacacgatcccgggaacgcagctggagcgtggcctggggcagggcctcccttccccgttcaccgcccaggaggcccgaatgccacagaagcccagggagaaagctgcgcaggtgtatcggctgccttttcctattcagaacctatgcccatgcatcccgcagcctctacactgcctctgcccactgcccgaggacccaggcgacgaagagggcggatcttcagagcccgaagaaatggccgacttgcttccaggaagcggcgagccttgcccagaaagttcccgagaaggttttcggtcacagaaatag

SEQ ID NO: 54140 - DNA, 585 bp, Artificial Sequence
  Description of Artificial Sequence: Synthetic coding sequence
atggcctctttactgtgcgtctcacacctcttgttactttgctccctttcgccaggcggactgtcctactcccccagtcaactgctggcctcttcatttttttcttgtgggatgagcaccatccttcagacatggatgggctccaggctgccgctcgttcaggctccatccctggagtttcttattcccgctctcgtcctgactagccaaaaacttcctcgagcaatccagaccccgggaaattcttcgctgatgctgcacctgtgtagaggtcctagttgtcacgggctcggccattggaatacttctctgcaagaggggtaccctgctcacggcggactcttctctgcacccggactgctgcctgtgtcctgcgttccactcgaggcgtcgttcaacgtcataaattcccacagctcaccgtgcctaccggcaccattcggcgcagacccatctggactgtgcgtagactgcttttgcctgtgcggcatccagtgttacccgccaggaacggtgtgcccacaccaagggaccatggacctggccgcaagtcccaggctcgacctgagtaaatggctcacgtag

SEQ ID NO: 54141 - DNA, 1833 bp, Artificial Sequence
  Description of Artificial Sequence: Synthetic coding sequence
atgagtcggtctcccctgaatccatcccagttacggtccgtgggttcacaggacgcactagcccctctccccccacccgcaccgcagaatccttccacacacagttgggatccactgtgcgggagccttccatggggtcttagctgcttgcttgccctgcagcacgtcctggtcatggccagtcttctttgtgtttctcacctgctgcttctgtgcagtctgtcgcctggcggtcttagctactccccgagccagctactcgcttctagcttcttttcctgtgggatgagcaccattttgcagacttggatgggttctcggttacctttggtgcaggcaccttctctggagtttctcatccccgcacttgtcctgacttcccaaaagttgccacgcgcaattcagactcccggtaatagtagcctgatgctgcatctgtgcagggggccaagctgccacggtttgggccactggaatacctcgttacaggaggtcagcggagctgtggttgtgagcggtctgcttcaaggcatgatgggtttactggggtccccaggccacgtgtttcctcactgtggtcccttagtgctggcaccatcccttgtcgtggcgggattgtccgcccaccgtgaagtagcccagttctgcttcactcactggggcctggccctgctggtgatattactaatggttgtgtgttcccagcacctggggagctgtcagttccatgtctgcccttggagacgggcatccacttcttccacacatacccctctgcccgtgtttaggctgctgtcagtgttgatccctgttgcttgtgtctggatcgtcagcgcgttcgtcggcttttctgtcattccacaggagttgtcagcacccaccaaggccccatggatatggctgcctcaccctggcgaatggaattggcctctactaactcctcgggctcttgctgccggtatctcaatggcacttgccgcatctactagctcattgggttgttatgcactgtgtggaaggctgctgcatcttccccctcccccaccgcatgcgtgcagtcggggactctcgctggaaggtctagggtccgtcttggccggtcttttgggatcacctatgggtaccgcgtccagtttccctaacgtgggcaaagtggggctcattcaggctggctcccagcaggtggctcacctggtgggactgctgtgcgtgggtttaggactcagcccaagactggcccagctgctcactaccatacctctgcccgtggttggaggcgtgctcggagtgacacaagcagttgtcctgagcgccggtttcagttctttttatctggctgacattgacagcggacggaacatctttatcgttggctttagcatcttcatggcgctgttgctgccgaggtggttccgggaagcccctgtgctgttttcgacaggttggagccctctggatgtgcttctgcacagccttcttacacagcctatcttcctggctggactgtcaggctttcttcttgaaaatactatcccagggacgcagttggagaggggattaggacaagggctgccctcaccttttacggcgcaggaggcgaggatgccacaaaagcccagagagaaggcagcacaggtgtacagattgccattccctatccagaatctgtgcccctgcatccctcagcccttacactgcttgtgtccactcccagaggatccaggtgacgaggaaggtggctcctcagaacctgaggaaatggccgacttgcttcctggaagcggagaaccttgccctgagtcatcgcgcgaggggtttagaagccagaagtag

SEQ ID NO: 54142 - DNA, 1857 bp, Artificial Sequence
  Description of Artificial Sequence: Synthetic coding sequence
atgtcgaggagcccgctgaatcctagccagcttcgctccgtagggagccaagatgccctggcacccctgccaccacccgcaccacaaaacccaagcacccacagctgggatccattatgcggctctctcccttggggtctgagctgtttgcttgcgttgcagcatgtgctggttatggcctcactcctgtgtgtatcccatctgcttttgctctgttcactctctcccggaggtttaagttactccccatcccagcttctagcctcgagtttcttctcgtgtggcatgagtactatcctacagacctggatgggaagcagattgcctctggtccaggcaccaagtcttgagttcctgattcctgctttggttctgaccagccagaaactgcctagggccatccagacgcctggcaactgtgagcaccgggcaagggcaagagctagccttatgctgcacctgtgtaggggtccttcctgccatgggcttgggcattggaacacttccttacaggaagttagcggcgcagtggtcgtcagcggcctgctgcagggtatgatgggcctgctgggcagcccaggtcatgtgttcccccattgcggcccacttgtgctagccccttcactagttgtggccggattgtccgctcacagagaggtggcccagttttgttttacccattggggcctggctctgctggtgattctgctgatggtggtgtgctcgcagcacctggggagctgccagttccacgtgtgtccttggaggcgggcatctacttcttccacacacacaccactccccgtgtttcggctcctcagcgttctcattccagtcgcttgcgtgtggattgtgtctgcttttgtaggatttagtgtgatccctcaggaactcagcgccccaaccaaggcgccatggatctggctgccccacccaggagaatggaactggccacttcttactcctcgcgctttggctgccggtatctcaatggcactggctgcgagcaccagtagcctgggatgctacgccttgtgtggcagactgctgcatctccctcccccaccgccacatgcctgctctcggggacttagtttagagggcctagggtccgttttagccggacttctgggcagcccaatggggaccgcatcttctttcccgaatgtaggcaaggtgggcctgatacaggccggttctcagcaggtggcccacctggtgggactgctctgtgtcggactcgggctgtccccaaggctcgctcaattactcaccaccatcccgttgccggttgttggcggagtcctgggagttacacaggccgtggtgctgagcgccggatttagctccttttacctcgctgatatagattcaggacggaacatttttattgttgggttctccatcttcatggcattactcctgccccgatggttccgggaagcccctgtgctgttttccactggctggagtccgctagacgtgttgctccactcactgttaactcagcccatattcttggctggcctgagtggattcttgctagaaaacactatcccaggtactcaactggagagagggcttggccagggactgccctcacccttcactgctcaagaggccagaatgccacagaaacctcgggagaaagcagcccaagtgtatcgactcccattccctatacagaacctctgcccctgtatcccgcagccgttgcactgtctgtgtccgctgcccgaagatcccggagacgaagaaggcggatctagcgaaccagaggagatggcagacctattgcccggttcaggcgaaccctgccccgaatcgagcagggagggattcaggtcccagaagtag

SEQ ID NO: 54143 - DNA, 1434 bp, Artificial Sequence
  Description of Artificial Sequence: Synthetic coding sequence
atgcttcgttggctacgggattttgtgctgcctacagctgcctgccaggacgcggagcaacccacaaggtatgagacgctgttccaggcgctggacagaaatggcgacggggtggtcgatatcggagagctgcaggagggccttcggaatcttggcatcccactggggcaagacgccgaggagaaaatcttcacaaccggagacgtcaacaaggacgggaagttagacttcgaggaatttatgaaatatctaaaggatcacgaaaagaagatgaagttagccttcaagagcctagataaaaacaacgatggtaaaatcgaagcctcagagattgtacagtctcttcagacccttggacttaccatttctgaacaacaggccgaactgatacttcaatccattgacgtggatgggacgatgacggtggactggaacgagtggcgtgattacttcttgtttaacccagtgactgacatcgaagaaataatccgattctggaagcatagcaccgggatagatattggggactcgcttacaattccagacgagtttaccgaggacgaaaaaaagtccgggcaatggtggaggcagctcctggccggaggcatcgcaggtgctgtatcaagaactagtacggccccacttgatagactgaagatcatgatgcaagtgcatgggtctaagtccgacaaaatgaatatttttggcggattccgccagatggttaaggagggtgggataagaagcctatggaggggtaacggtaccaatgtcatcaagatcgcccctgaaacggccgtgaagttttgggcgtatgaacagtacaagaagttgctgacggaagaggggcagaaaatcggcacatttgaaaggtttatctcagggtcaatggctggtgccaccgcacagactttcatctatcctatggaagtgatgaagacgcggctcgcggttggcaagaccggacagtactctgggatttacgattgtgctaaaaaaatcctgaagcatgagggcttgggcgcattctataagggatatgttcccaacctgttgggaattataccatacgccggaattgatctcgctgtgtacgaattattaaagagctactggctggacaacttcgcgaaggacagcgtgaatccaggcgtgatggtcttgctgggctgcggtgctctgtcatctacctgcggtcagctcgcctcctacccactcgctctcgtccggacaagaatgcaggcacaagccatgctcgaggggagtccccagctgaacatggtcggtctgttcaggcggattatctctaaagagggcatccctggactctacaggggcatcacgccaaatttcatgaaggtgttgccagctgtcggaatctcctacgtagtgtatgagaatatgaaacagaccctcggggttactcagaaatag

SEQ ID NO: 54144 - DNA, 1449 bp, Artificial Sequence
  Description of Artificial Sequence: Synthetic coding sequence
atgcggggaagtccaggagatgcagaaagacggcagaggtggggacgcctgtttgaagagctggatagcaacaaggatggtagagtggacgtgcacgaattgagacagggcttagcgagactgggaggcggtaacccagacccaggggcacagcagggtatctccagtgagggcgatgcagatcccgacgggggactggacctggaggagttttcaagatatctacaagagcgcgagcaaaggctacttctcatgttccattcactagatcgtaaccaggatggacacatagacgtgagcgagatccaacagtctttccgcgcattgggaatctccatttctctcgagcaggccgaaaaaatcctgcactctatggacagagacggtacaatgacaattgattggcaagagtggagggaccacttcctgctccattcactggagaatgtagaggatgttctatatttctggaagcacagtacactttcttccgctgggtttagtgcctggattaaagactcaacagcagagcagaacagatctaaaaccacggtgctggctagacgaagtggtagccatcttaagtcacagcacttcggtcgtcccaagtgggcagaccacgaggttctggatataggcgaatgcctgacagtgcctgatgagttcagtaagcaggagaagctaactggtatgtggtggaagcagctggtcgccggtgccgttgcaggggcagtgtctcgtaccggcaccgccccacttgaccgtctgaaggtctttatgcaggtgcacgcgtcaaaaaccaacagactgaacatcctgggtgggctgcggtctatggtcctcgaaggagggatacgctccctatggcgcggtaatggaattaacgtgctgaagatcgccccagagagcgcaatcaagtttatggcatacgaacagatcaaacgcgcaatcctgggacaacaagagaccttgcacgtacaggagcggtttgtggccggttctttggctggagcgaccgctcagactattatctaccctatggaggttctcaaaactaggctcactttgcggcgaacagggcagtacaagggactgctggactgtgccagacgcatactagagcgggagggcccaagagccttctatcgagggtacctgccaaacgtgctcggaattatcccatatgcaggaatagatctcgctgtgtacgagaccctaaagaactggtggctacaacagtatagccatgattcagcagatcctggaatcctcgtcttgctggcctgcgggacaatttcttctacctgcggccagatcgctagctaccctcttgccctggttcgcactcggatgcaggctcaaggctggagcactgtggcccgatttcagatcaccgcgacctccgcttttcaggtgcaggcgattcttttgccccagcccccagaatag

SEQ ID NO: 54145 - DNA, 1407 bp, Artificial Sequence
  Description of Artificial Sequence: Synthetic coding sequence
atgcggggttcacccggtgatgctgagaggagacagcgatggggccgactctttgaggaattggactccaacaaggacgggcgagtggatgtgcatgaacttaggcaggggctggcaaggttgggcggagggaatcccgatccaggagcccagcagggtattagcagtgagggtgatgccgaccccgatggcggtctcgatttagaagagtttagccgataccttcaggaaagagaacaacggctgctgctcatgttccattcgctggataggaaccaagacggccatattgatgtgtccgagattcagcaatccttccgtgcgctggggattagtatttccttagagcaagccgagaaaatcctgcactcaatggatcgcgacgggacaatgacaatcgactggcaagaatggcgcgatcactttctcctacattctctcgagaatgtggaggatgtgttgtacttctggaagcactccacagtactggatatcggcgaatgtctgaccgtgccagatgaattcagcaaacaggaaaaactgaccgggatgtggtggaaacagctagttgcaggcgcagtggctggagctgtttctaggaccggaacagctcctctggatcgcctgaaagtcttcatgcaagtccacgcatcaaagaccaatagactcaacatactggggggactgcgttccatggtgcttgagggtgggatcagaagcctttggcgcggtaatgggataaacgtgttgaaaattgctcccgagtcagccattaagttcatggcttatgagcagatcaagcgtgcgatcctgggtcagcaggagacccttcacgtgcaggagcgtttcgtggctggctctctggccggagccaccgcccaaactattatttaccccatggaagtgctcaaaacccgcctgacactgaggaggaccggtcagtataaagggcttctggactgcgcccgtaggattctggagagggaaggcccaagggcattttacaggggttaccttccaaatgttctgggcattatcccctacgcaggaatagacctggctgtttatgaaactctgaaaaactggtggctacagcagtattcccacgactcagcagaccctggcatccttgtgctgctggcctgtgggacaatttccagtacctgtgggcagatcgccagctatcccctggcacttgtacggactagaatgcaagcacaggcctcaattgagggtggccctcaactctccatgcttgggctgctgaggcatatcttgagccaggagggcatgcggggattgtaccgcggtatcgcacccaactttatgaaggtgattcctgcggtttccatctcctacgtcgtctacgaaaacatgaagcaggcactgggagtgacgtcaaggtag

SEQ ID NO: 54146 - DNA, 1317 bp, Artificial Sequence
  Description of Artificial Sequence: Synthetic coding sequence
atgcggggatcgcccggtgacgcggaacgccgacagaggtggggccgtctattcgaagaactcgactctaacaaagatggtcgcgtagatgtgcacgagctccgacagggactggccaggttggggggtggcaaccccgaccccggtgcccaacaggggatatcctctgaaggggatgctgaccccgatggaggcttggacctagaagagttctcaaggtacctccaagagcgtgaacaacgtttgcttctcatgtttcactcgcttgatcgaaaccaggacggccacattgacgtgtcagagattcagcagtcttttagggcgctcgggatatccatttccttagaacaagccgagaagattctacatagtatggacagggacgggacgatgaccatagattggcaggagtggagagatcactttcttttgcattcccttgaaaacgtggaggatgttctgtacttttggaaacactcaaccgttctcgatattggtgagtgtctaacagtcccggatgagttttccaagcaggaaaagttgactggtatgtggtggaagcaattagtcgcgggagctgtggcaggcgcagtgtccaggaccgggaccgcgcctctagataggttaaaggtgtttatgcaagtgcacgcctcaaagacgaataggctcaatatactcggaggattgaggtcaatggtccttgaagggggaattcgtagtctgtggaggggaaacggcattaatgtgctcaaaattgccccagagtccgctatcaagttcatggcttacgagcagattaaacgcgctatactgggacagcaggaaaccctgcatgtgcaagaaaggtttgtggccggaagcctagcaggtgcaaccgcacaaacaatcatttatccaatggaagttctgaagactcgcttgacactccgccgtacggggcagtataagggcctgctggattgtgccagacggatcctggagagagaagggcctcgggctttttaccgtggctacctgccaaatgtgctggggatcatcccctacgccggaattgatctagcagtgtacgaaaccctgaaaaattggtggttgcagcagtacagccatgatagcgcagaccctgggatccttgtgctgctcgcctgcggcacgatctcctctacatgcggccagattgccagctacccccttgcactggtaaggacaaggatgcaggcacaggacgtgtccgtgtataagacagatactgtgcccacactgatcgagctaaccgggagaagaggcaggaagatgttgaataagtccttttggaactag

SEQ ID NO: 54147 - DNA, 690 bp, Artificial Sequence
  Description of Artificial Sequence: Synthetic coding sequence
atgtggtggaaacagctcgtggccggagcggtggcgggtgctgtgtccagaactggaacagccccattggaccgtctgaaagtattcatgcaggtgcatgcctcgaaaacaaatagattaaatatcctgggaggcctgcgttctatggtccttgagggcggtataaggtccctctggagggggaatggcattaatgtgctaaagattgcaccagaaagtgctatcaaatttatggcctacgagcagatcaagcgagccatcctgggccagcaagaaactctgcatgtgcaagagcggttcgtggctgggagcctcgccggagctacagcccagaccataatatacccaatggagacacttaaaaattggtggctgcaacagtatagtcatgattctgccgaccccggaattctcgtgctgcttgcctgtgggactatctcaagtacctgcggtcagatcgccagctatcccctcgccctggtcagaacacggatgcaggcacaggcctcaatcgaaggcggaccacaattgtccatgttgggcctactccgacacattctgtctcaggaaggtatgcgcggactgtaccgaggaatcgcccctaacttcatgaaagtaataccggctgtttctatttcgtacgtggtgtacgagaatatgaagcaggcccttggagtgacaagccgatag

SEQ ID NO: 54148 - DNA, 372 bp, Artificial Sequence
  Description of Artificial Sequence: Synthetic coding sequence
atggaggtgttaaaaacacgcctgacattgaggcggaccggtcagtacaaaggactcctcgattgtgcccgtcgaatcctggaaagagaagggcctagggctttttaccggggatacctcccaaatgtgctgggaattattccatacgcgggaatcgacctggccgtttacgagacgcttaagaactggtggttgcagcagtacagccatgactcagctgatcctggcatattggtcttgttggcttgcggaacaatttcctcaacctgtggacaaattgcttcatatcccttggccctggtcaggactaggatgcaggctcaggctggtggacacgccatgagcagcctgatggagcgcactatgtggtag

SEQ ID NO: 54149 - DNA, 1434 bp, Artificial Sequence
  Description of Artificial Sequence: Synthetic coding sequence
atgctaagatggcttagggactttgtcctgccaactgcagcttgtcaagatgcggaacaaccaactaggtacgagaccctttttcaggccttagacagaaatggtgatggagtcgtagacatcggggagctccaggaaggtcttcggaacctcgggatacctctggggcaggacgctgaagagaagatatttactaccggtgacgttaacaaagacggtaaactggactttgaagagtttatgaaatacctgaaggaccacgaaaaaaaaatgaagttagctttcaaaagccttgacaagaataatgatgggaagatcgaagcctcggagatcgtgcaaagtctgcagaccctgggcctcacaatttctgagcagcaggctgagctgatcttacagtcaatcgatgtcgatggcacaatgacagtagattggaatgaatggcgtgactatttcttattcaacccggtcaccgacattgaggagattattaggttctggaaacatagcacaggcattgacatcggagactcactcacaattccggacgaattcaccgaggatgagaagaagtcagggcagtggtggaggcaactgctggcaggcggaatcgctggcgctgtaagccgcacaagtactgctcccttggaccggctgaaaataatgatgcaggtgcatggatccaagtcagacaagatgaacatttttggagggttcagacaaatggtgaaagaagggggtattcgctctctgtggaggggcaacggcacaaacgttatcaaaatcgcaccagaaaccgccgtcaagttctgggcctatgaacagtataagaagctgctcacagaggagggccagaagattggtactttcgagcggttcatctctggttcaatggcgggtgctacggcacagacatttatctaccccatggaggtaatgaagaccagattggcagttggaaagacggggcagtactccggtatatacgattgtgcgaagaaaattctaaagcacgagggcctgggtgcgttctataaaggatacgtcccgaatctcctcggcataatcccatatgccggaatcgacctggcagtatatgagctgctgaagtcatattggttggataactttgctaaagacagcgtgaatccaggcgtaatggttctgctagggtgtggggctctctcaagcacctgtggccagctggcttcgtacccacttgctcttgtgcgcaccaggatgcaggcacaggctatgctggagggctcgccacaactgaatatggtggggctatttcgacgcatcatctccaaggaaggaattcctgggctgtaccgcggaatcacacctaactttatgaaggtactgcctgccgtgggcatttcatatgttgtgtacgagaatatgaagcagactttgggggtgactcagaagtag

SEQ ID NO: 54150 - DNA, 1377 bp, Artificial Sequence
  Description of Artificial Sequence: Synthetic coding sequence
atggattcactttacggcgatctattctggtacctggattacaacaaggacggaacactggacatctttgaactccaggaaggtttggaggacgtcggtgcgatccaatcactggaggaagcgaagaagatatttaccacgggcgatgttaacaaagacggcaagctagacttcgaggaattcatgaaatatttgaaggaccacgaaaaaaagatgaagctggccttcaagagtctggataagaataatgacggcaaaatcgaagcaagtgagatcgttcagagtctgcagactctaggtctgacaatctcagaacagcaggccgagttgatcctccagtcgattgacgttgacggcactatgactgtggactggaatgaatggagggactatttcctgttcaatccggtgacggacatcgaggaaatcatcaggttctggaagcacagcaccgggatcgatattggtgattcactgaccatccctgatgaatttacagaggacgagaaaaagagcggtcaatggtggaggcagcttttagccggtggcatcgctggagcggtatctcgcacatcaaccgcccctcttgaccggcttaaaatcatgatgcaggtacacggatccaagagcgataagatgaatatttttgggggattcagacagatggtaaaggaggggggtattcggtccctgtggaggggtaacggaacaaatgtgattaagatcgccccagagaccgccgttaagttctgggcttatgagcaatacaaaaagttgcttacagaagagggtcaaaagatagggaccttcgagcggttcatctctggttccatggcaggagcaaccgcccagacattcatctacccaatggaggtcatgaagacccgcctggcggttggcaagaccggacagtattctggtatctatgactgcgcaaagaaaatcctcaagcatgagggcttgggagcattttacaaaggatacgtccccaatttattgggcataataccctatgctggtatcgaccttgcagtgtatgagctgctgaagtcttattggcttgacaatttcgccaaagattcagttaatcccggtgtaatggtactgctggggtgcggggctttatcttcaacctgcggccagctcgcttcttaccccctggctctcgtacgcactaggatgcaggcacaggccatgctcgagggttcgccacaactgaatatggtcggactatttcggcgaattattagtaaggaagggatccccggactgtacagaggcataactccaaatttcatgaaggtgttgcccgctgtcggaatcagctacgtcgtatacgaaaacatgaaacagacactgggtgtgacacagaagtag

SEQ ID NO: 54151 - DNA, 1410 bp, Artificial Sequence
  Description of Artificial Sequence: Synthetic coding sequence
atgttgtgtctttgtttatacgtgccagttatcggagaagcacaaaccgagttccagtacttcgagtctaaaggtctgcccgctgaactcaaatccatttttaaactgtcagtgttcattccaagccaggagttcagcacatatcggcagtggaagcagaagatcgtacaggcaggcgacaaggatctcgatgggcagctcgatttcgaggaattcgtacattacttgcaggatcacgagaagaagctcaggctcgtgtttaaatccctggacaagaaaaatgacggccgaatagacgcgcaagaaatcatgcagagcttacgtgacttgggtgtcaaaatctccgagcagcaggccgagaagatccttaagtcaatggacaaaaacggcacaatgacaatagattggaacgagtggagggactatcacctacttcatcctgtcgaaaacatcccagagattatcctctactggaagcattcaacaatattcgatgtgggagagaatcttaccgtccccgacgagttcaccgtggaggaacgacagaccgggatgtggtggagacacctggttgccggaggcggagcaggggctgtatcccgcacgtgcacagcacctctggacaggctcaaagtgttgatgcaagtgcacgcctctagaagcaacaatatgggcatagtggggggtttcacgcagatgatacgtgaaggcggtgccaggtccctgtggagaggtaatggcattaatgttctgaagatagctccggaatctgctatcaaatttatggcctacgagcaaatcaagcgcctcgtaggatctgatcaagaaacccttcggatccatgaacgacttgtggccggaagcctcgctggcgctattgctcaatcaagtatctaccccatggaagtccttaaaacaagaatggccctaagaaaaaccggacagtattcgggcatgttggactgtgccaggcgaatcctggccagggagggggtggctgcattttataagggttatgttccaaacatgctggggattatcccctatgctggcatcgaccttgccgtgtacgaaacccttaagaatgcttggctccagcactatgctgtgaattccgccgatccgggagtgttcgtactgttggcctgtgggaccatgtcatccacgtgcggacagcttgcctcctaccctttagccctcgtccgcacgcgcatgcaggcccaggcatcaattgaaggcgcacccgaagtgacaatgtcctctctctttaaacacatcctcagaacggagggtgccttcggactttaccgcggattagcgcctaatttcatgaaagtcatccccgctgtgtcaatcagttacgttgtatatgaaaacttgaaaattaccctcggagtgcagagccgctag

SEQ ID NO: 54152 - DNA, 1506 bp, Artificial Sequence
  Description of Artificial Sequence: Synthetic coding sequence
atgctgcagatgttgtggcacttccttgcctccttttttcctcgtgccggatgtcacggatcccgcgaaggggacgatcgtgaggttcgcggaactccagcccctgcgtggagagatcagatggcctcattcctcgggaaacaggatggcagggccgaggccaccgaaaagcggccaacaattctcctggtcgtgggtcctgccgaacagtttccaaaaaaaattgtgcaggccggtgacaaagatctagacggccagctcgattttgaggagttcgtgcactatttgcaggatcacgaaaaaaagctgaggctcgtgttcaagagcctggacaaaaaaaacgacggtagaatcgatgcacaagagattatgcagtcactgcgagacctgggcgtaaagattagcgaacaacaggccgaaaagatcctgaagcggattcgcactggacatttctggggcccagtgacctacatggacaagaatgggacaatgaccatagattggaatgagtggcgcgactaccatctgctccaccctgtcgaaaatatccctgagatcatcttgtactggaaacatagcaccattttcgatgtaggtgagaacttgactgttcccgatgaattcacagtggaagaacgacagaccggcatgtggtggcgccacttggttgcaggcggaggcgctggtgcggtgtcacggacatgtacagccccactggaccggctcaaagtgcttatgcaggtgcatgcgtcccggtcaaataacatgggcatcgtcggcggtttcacccagatgattcgcgaggggggagccaggagcttatggagaggcaacggtatcaacgtgctgaagatcgctccagagtcagcgataaaattcatggcatatgaacagatcaagaggttggtgggctcagaccaggaaactctgagaatacacgagaggctagttgcagggagccttgccggagccattgcccagtccagtatctatccaatggaggtgcttaagactcggatggcccttagaaagactggccagtactcggggatgttggactgcgcgaggagaattctagctagggagggggttgcagctttttataagggttacgtgcctaacatgctcggaatcatcccatacgccggtatcgacctggcggtctacgagacactgaagaacgcttggctacagcactacgccgttaattcagcggaccccggtgtgtttgttctcctggcctgcgggactatgtcatccacctgtggccagctggccagctatcccctggcactcgtccggactcgcatgcaggcccaggccagcatcgaaggggctccggaggtcacaatgtcatcactgttcaaacacatcctgcggactgagggtgcctttggtttgtacagagggctggcgccaaattttatgaaagtaattcccgctgtctcaataagttacgtggtctatgaaaacctgaaaatcactctgggagtgcaatcaagatag

SEQ ID NO: 54153 - DNA, 1512 bp, Artificial Sequence
  Description of Artificial Sequence: Synthetic coding sequence
atggtgagtagcgtgctgtgtcgatgtgtcgcctcgcctcctcctgacgcagctgcgaccgccgcttcctccagcgcaagctcccccgcaagcgtgggggatccatgcggcggtgccatctgcggcggacccgatcatcgattgcggctgtggagactttttcagacacttgatgtaaacagggacggaggcctgtgcgtaaatgatctggcagtcgggctgcgacggctgggattgcatcgtacggagggggaactgcagaagatagtccaggccggagataaggatctcgacggccagcttgattttgaggagtttgtgcactatctgcaggatcatgaaaagaaactcaggctggtgttcaaaagtcttgacaagaaaaacgacgggaggatcgacgcacaggaaatcatgcagtcactccgtgacctgggcgtgaaaatttccgagcaacaggccgagaaaattttgaagagcatggataaaaatggaacgatgaccatcgactggaacgagtggagggattaccacctcctgcatcctgtcgagaatattcccgaaattatactatattggaagcattccacgatttttgatgtcggcgaaaatctgaccgtaccggatgagttcacagtcgaagaacgacagactggaatgtggtggcggcacttggtcgcgggaggaggggcaggagccgtcagcaggacttgtaccgcaccattggacagactgaaggtgttgatgcaagtgcacgccagcagatccaacaatatggggatagtggggggatttactcagatgatacgcgaaggaggtgctcgatctctgtggagggggaacggcattaatgtacttaagatcgcaccagagagcgccatcaaattcatggcctatgaacagattaagcggctggttggatccgatcaggagacgctcaggatccacgaacgcttggtggctggatccctggccggtgcgatcgcacaaagctccatttaccccatggaagtgctgaaaacacggatggccctgaggaaaacgggacaatatagtggaatgctggactgtgcacggagaattcttgccagagagggcgtggctgctttttacaagggctatgtgcccaatatgctgggcataatcccttacgcaggaattgacctcgccgtgtatgaaacactgaagaacgcctggttgcagcactatgccgtgaattctgccgacccaggtgtgttcgtccttctagcctgcggcaccatgtcctctacatgcggtcaactggctagctatcccctggcgttagtcagaaccaggatgcaagcgcaggcaagcatcgagggtgcacccgaggtgacaatgtcctccctgttcaagcacattctgcgtacagagggcgcattcggcctataccgaggtctagccccaaattttatgaaggtaatccctgccgtgagcatctcttatgtcgtatacgagaacctcaaaattactctgggggtgcagtccagatag

SEQ ID NO: 54154 - DNA, 1548 bp, Artificial Sequence
  Description of Artificial Sequence: Synthetic coding sequence
atggtaagcagcgtgctgtgtcgatgtgtggcatctcctccacctgatgccgctgccactgctgcctcaagcagcgcgtcttctcctgccagcgtcggtgatccgtgcggcggagctatctgtggcggaccagatcaccggctgcggctctggagactgttccagaccctcgacgtgaaccgggacggtggcttgtgcgttaacgaccttgctgtaggactgaggcgtttagggttgcatcgcactgagggcgaactgcagaagatcgtgcaggcaggagacaaagatctggacggtcagctggattttgaagaatttgtccactatctccaggaccacgaaaagaaactccgcctggtgttcaagtccttagataaaaaaaacgacggcagaattgacgctcaagaaataatgcagtcactgagggacttgggcgtgaagatctccgagcagcaggccgagaagatcctcaagaggatacgtaccgggcacttctggggtccagtgacttatatggataagaacggcaccatgaccatcgactggaacgagtggcgcgattatcacctccttcaccccgtggagaatattccagaaattatactgtactggaaacacagcacaatttttgatgtcggagagaacttgacggtgcctgatgagttcacggtggaggagaggcagaccgggatgtggtggcgccatctggttgccggtggcggtgccggtgctgtttcccgtacgtgtaccgccccacttgaccgcctcaaggtgctcatgcaggtgcatgcaagccggtccaacaacatgggcatcgtcgggggttttacccaaatgatacgggaggggggagccagaagcctgtggcgcggaaatggcattaacgtgctcaagatcgcaccagagtcagccatcaagttcatggcctacgaacagattaagagactggtaggctccgatcaggaaacactacgtattcacgagcgtctggtggcgggaagtttagccggagctattgcacagagcagtatctaccccatggaagtattgaagacacgcatggcgctaagaaaaactggacagtactccgggatgctggactgcgcgaggcggatcctggcaagagaaggcgtagccgcattttataagggttatgtacctaacatgctggggatcatcccttatgccggaatcgacttagcggtttatgaaacactgaaaaatgcttggctgcagcactacgctgtgaactcagcggatcccggtgtgtttgtgctcctggcgtgcggtaccatgagcagcacttgcggccaactggcctcgtaccccctggcattagtcaggacgcgcatgcaggctcaagcctccatcgagggtgccccagaggtgacaatgtcctccctgtttaaacatattctgaggaccgaaggtgctttcgggttgtacagagggctagctcctaattttatgaaggtgatcccggctgtgtccatttcttacgtggtgtacgaaaacttgaaaatcacactcggagttcagtcccgctag

SEQ ID NO: 54155 - DNA, 1470 bp, Artificial Sequence
  Description of Artificial Sequence: Synthetic coding sequence
atgctacagatgctatggcatttcctggcttccttcttccctcgggcaggttgccatggcagcagggagggagacgatcgggaggttagaggaacaccggcaccagcttggcgcgaccaaatggccagctttctgggtaaacaggacggtagggccgaggccacagagaagcggcctaccatcctgctcgtcgtaggccctgccgagcagtttcctaagaagatagttcaggctggcgataaagacctggacggacagttggactttgaggagttcgtacactatctgcaggaccatgagaagaaactgagactcgtatttaagtctctagataagaagaatgacggcaggatcgacgcccaggagattatgcagtcgctgagggacttgggagtgaagatttcggaacagcaggccgagaaaattctgaaatcaatggataagaacggaacaatgaccattgattggaacgaatggagggattaccacctccttcatcccgtggaaaacatccctgaaattatcctctactggaagcactctaccatctttgatgtgggtgagaacctcaccgttcccgacgagtttacagtcgaagaacgccagactggtatgtggtggcgtcacctcgttgccggtggcggagctggcgctgtaagccgcacatgcactgcccctctggaccgtctgaaagtgctgatgcaggtgcatgctagcaggagtaacaatatggggatcgtggggggatttacacagatgatacgggaaggtggcgcaagatcactttggcgcggaaacggtataaatgtgcttaaaattgcccctgaatccgctatcaaattcatggcttatgagcagattaagcggctggtgggttctgaccaggaaaccctgcgcatccatgaaagattggtcgcagggtcactggctggggctatcgcccagtcatccatttacccgatggaggtcttgaagacccgcatggctctgagaaagaccggccagtacagcgggatgctggactgcgctcgacgtatcttggctagggagggcgtggcagctttctacaaggggtacgtcccaaatatgctgggcatcattccctacgccggaatcgacttggcagtctatgagacactgaaaaacgcttggctgcagcactacgccgtgaacagtgctgacccaggggtgtttgtgctgctggcctgtgggacaatgagttcaacatgcggccagctggcctcctacccactagccctggtgagaacacgcatgcaggcgcaggcaagcatagagggagccccagaggtgacaatgagcagcttgttcaagcatatcttgagaacggagggggcattcggtctgtacagaggtcttgccccaaattttatgaaggtcatcccagcagtctccatttcatatgtggtgtacgagaacctgaagatcacccttggtgtacagtctaggtag

SEQ ID NO: 54156 - DNA, 1101 bp, Artificial Sequence
  Description of Artificial Sequence: Synthetic coding sequence
atgcagtccctccgggacttgggcgttaagattagcgagcagcaggcagagaaaattctgaaaagcatggataagaatggcacaatgaccatcgactggaacgaatggcgagactaccacttgctacaccctgtggagaacattccggaaatcatcttatactggaagcacagtactatctttgatgtcggggagaacttgaccgttccagatgaatttaccgtggaagaaaggcaaaccggcatgtggtggcggcacctggttgcaggaggcggagccggagccgtgtctcgaacctgcaccgctccgcttgaccgccttaaagttctgatgcaggtgcatgcgtccagatccaataacatgggcatcgtggggggattcacccaaatgattagggaaggaggagcccgaagcctttggcggggaaatggcattaacgtcctgaaaatcgcgcctgaatctgccataaaattcatggcatatgagcaaattaaacgtctggtcgggagcgaccaggagacactgaggattcacgaacggttagtagctgggtctctggctggcgcaatcgctcaaagttccatttaccctatggaggtgttaaaaaccagaatggctctgcggaaaactggtcagtacagtggtatgctcgactgcgcccgtcgcatcctggccagggagggcgtggccgctttctacaaggggtacgtccccaatatgcttggaatcattccatatgctggaatcgacctggctgtctatgagactttaaagaacgcctggctgcagcattatgccgtgaacagcgcggatcccggtgtcttcgtgctgctggcgtgtggaaccatgtcctccacttgcgggcagctagcgagttatcctctcgccctcgtcaggactaggatgcaggcgcaggctagcatcgagggggctccggaggtgaccatgagcagcctttttaagcacatcctgagaactgaaggcgcattcggtctgtataggggtctggcccctaactttatgaaggtgattcccgcagtgtctatctcatacgtcgtttacgaaaatctgaaaatcactcttggagtacaatcccgatag

SEQ ID NO: 54157 - DNA, 894 bp, Artificial Sequence
  Description of Artificial Sequence: Synthetic coding sequence
atgatcgattcggaagctcatgaaaaaagaccccctattctcactagctcaaagcaggacatctcaccgcacatcaccaacgtcggcgagatgaaacattatctttgcggatgttgtgccgctttcaataacgttgccatcacctaccccatccaaaaagtgctattccggcagcaactgtatgggataaagacaagagatgccgttctgcaattgcgacgcgacggctttagaaatctttatagaggcatattacccccactgatgcagaaaacgaccaccttagccttgatgtttgggctgtatgaggacttatcctgtttgcttcgtaaacacgtgagagccccagaattcgccactcacggagtggctgcggtgctggcgggtactgctgaggcaatcttcactccactggagcgggtgcaaactctactccagaatcacaagcaccatgacaagtttactaatacttatcaggcgttcaaggcactaaagtgtcacggaatcggcgaatactacagggggctggtcccgattctgttccgcaacggtctgagtaatgtcctgttctttggtctccggggtccaatcaaggagcacctgccaacggcaaccacgcattccgcccacctcgttaacgattttatcggaggcggactcttaggtgcaatgcttggctttctgtgctttccgattaacgttgtgaaaactcggcttcagtcccagataggcggtgaatttcagtcgttccccaaagtttttcaaaaaatctggttggagcgcgaccggaaacttataaacctgtttaggggagctcatttgaattatcatcggtccctcatctcctgggggatcatcaatgcaacgtacgaatttctccttaaattcatctag

SEQ ID NO: 54158 - DNA, 912 bp, Artificial Sequence
  Description of Artificial Sequence: Synthetic coding sequence
atggctctcgactttctagcaggttgtgctggcggtgttgccggagtgttggtagggcatccattcgacacggtgaaggttcggctccaggtccaaagcgttgaaaaacctcagtatcgtggaaccttacactgttttaaatctatcatcaagcaggaatcagtattgggcctctataaaggtctcggatcccctctgatgggacttacttttatcaacgctttggtttttggggtgcagggtaacactcttcgcgcactgggccatgattctcccctgaatcaattcctggcaggggctgctgcgggagccattcagtgcgtgatctgctgccctatggagctggccaaaaccaggctgcagctgcaggatgcaggaccggcaagaacttataaagggtcgctggactgtctcgcccaaatttacgggcacgagggactgcgtggggtgaataggggaatggttagcaccctgttgcgagagacaccttcctttggggtatactttctcacttatgatgccttaacccgggcattgggctgcgaacctggagatcggttgctggtgcctaagctcttgttagcaggcggaaccagcgggattgttagctggctttctacctaccccgtggacgtagttaaaagcagactacaggcggacggtctgagaggagccccacggtaccgcggaatactcgactgtgttcatcaatcctacagagccgaaggctggcgagtcttcacacgtgggctcgcttccacactgctgcgggctttccccgtgaacgccgcaacttttgcaaccgtgacggtagtccttacgtacgctcgaggggaagaagctggacccgaaggcgaagctgttccagccgcaccagctggacccgcactagcacagccctcatctctttag

SEQ ID NO: 54159 - DNA, 714 bp, Artificial Sequence
  Description of Artificial Sequence: Synthetic coding sequence
atgggtctcacatttataaacgccctggtgttcggtgttcagggcaacacattgcgcgctttgggacacgattcaccactcaaccagttccttgccggagccgctgcaggggctattcagtgcgttatttgttgccctatggagcttgccaaaacccgactgcagcttcaagacgccggtcccgctcgcacctataaaggctctctggactgtttggctcagatatatgggcatgagggcctgaggggcgtgaacagaggcatggtctctaccctgcttcgggaaactccgtcctttggagtgtacttcctcacatatgacgccttaacgcgagctctgggctgtgagccaggggaccggctactggtgccaaagctgctgttggctggaggaaccagcggcattgtttcctggctcagcacttaccccgtagatgtggtgaagagccggcttcaggcggatggtctcagaggggcaccacggtaccggggtatcctggactgtgttcaccagtcatatcgcgctgaagggtggcgcgtcttcaccaggggtcttgcttcaactctgttgagagcttttcccgtcaatgccgctacgttcgccactgtgacggtggtgctgacatacgccaggggcgaggaagcagggccagaaggcgaggccgtgccagcagccccagctgggccagccctggcacagccatcttctctttag

SEQ ID NO: 54160 - DNA, 714 bp, Artificial Sequence
  Description of Artificial Sequence: Synthetic coding sequence
atgggcctgacttttatcaatgccttggtcttcggggtccaagggaataccctgcgcgcactaggccatgactccccattaaaccagttcctggcaggggctgctgctggagccatacagtgcgttatctgttgccccatggaacttgccaagacaagactccagctgcaagacgccggtcccgctcgaacatacaaagggtcattggactgcttggctcagatttatgggcacgagggcttaaggggcgtgaacagaggtatggtttctacgctgctcagggagaccccttcgttcggcgtctattttctgacatacgatgccctcactagggccttgggctgcgagccaggtgaccggctgctggtacctaagctgctactcgcaggtgggacgagcggaattgtctcatggctgtcaacctatccagtcgacgtagtgaagtctaggctgcaggcagatgggctgagaggggctccacgctaccgagggatccttgattgcgttcatcaatcgtacagagctgaaggttggagggtatttacaagagggcttgcatcgaccctcttgcgcgctttccccgtcaatgcagctacctttgcaacagtgactgtggtactcacatacgctcgaggtgaggaggctgggccagaaggcgaagctgtgcctgctgctcccgctggtcccgcacttgcacaaccttcatctctgtag

SEQ ID NO: 54161 - DNA, 714 bp, Artificial Sequence
  Description of Artificial Sequence: Synthetic coding sequence
atgggcctgacctttattaacgcactggtattcggggtgcagggcaatactctgagggccctggggcacgattcacctctcaaccagttcctggcaggcgcagcagcaggggctatccagtgcgtgatttgttgtcccatggaactagccaagacaagacttcaactgcaagatgccggtccggcacgtacatataaaggatccctggactgtctggctcagatttacggtcacgagggactcaggggggttaaccgcggtatggtcagcactctgctgagggagactccttccttcggagtttactttctcacttatgacgccctgaccagggctcttggttgtgagcccggagatcgcctgctggtgcccaagttattactggctggcggtacgtcagggatagtctcttggctgtctacctaccccgttgacgtggtaaaaagcaggttacaggccgacggtctgcgcggagcacccagatatagaggcatcctggattgcgtacatcaaagttacagggccgagggatggagagtgtttaccagagggctggcttcaaccctcctccgggcattccccgttaacgctgctacttttgccacggtgacagtggttctcacgtacgccaggggggaggaggccggacccgagggcgaggctgttcccgcagcccctgcaggccctgcacttgctcagccctcatctctttag

SEQ ID NO: 54162 - DNA, 714 bp, Artificial Sequence
  Description of Artificial Sequence: Synthetic coding sequence
atgggtctaactttcatcaatgccttggtgttcggagtgcagggcaacacgttgagagccctgggccatgacagccctcttaatcagtttctggctggcgcagcagcaggcgctatccaatgcgttatatgctgtcctatggagctggccaaaacacgtctgcaactgcaggatgctggtcccgcacggacctacaaggggagtctggactgtttggcgcagatttacgggcacgagggacttcgcggagttaaccgcggtatggtgtccacccttctacgcgagacaccatcattcggggtgtatttcttgacatatgacgctcttactcgtgccttaggttgtgaaccgggagaccgcctgctggtaccaaaactgttgctggccggaggaacctcaggtatagtctcttggctcagtacttatccggtagacgttgtgaaatcacgcctccaggccgacggtttacgcggagcgcctcggtacaggggcatcttggattgcgtgcaccagtcctatcgtgccgagggatggagggtgtttactcgcggacttgcaagcacccttctgcgggcattccctgtaaatgctgcgacctttgcaactgtgacggttgtcctgacctatgccaggggcgaggaagccggtcctgagggagaggccgtccctgccgcaccggcaggccctgcactcgcccagccatcctccctctag

SEQ ID NO: 54163 - DNA, 936 bp, Artificial Sequence
  Description of Artificial Sequence: Synthetic coding sequence
atgtctcagcgcgacaccctagtgcacctgtttgccggagggtgcggcggaactgtgggcgcaatattgacctgtcccttggaagtagtcaaaactcgcctacagtccagcagcgtgacgttgtacatctctgaggtacagttgaatacaatggctggcgcatccgtgaacagggttgtatctccaggaccactgcactgcctcaaagtcatcctggaaaaagaagggccacgctccttattcaggggactgggccctaatctggtgggggtcgcgcctagtcgggctatctacttcgcagcctattcgaattgcaaggaaaagctaaacgacgtgtttgacccagattccacacaggttcacatgatcagcgccgcaatggcgggattcaccgccatcacggcgaccaatccaatttggcttatcaaaacccggctccagcttgatgctagaaatagaggcgagaggaggatgggtgccttcgagtgcgtacgtaaggtgtatcaaaccgacggcttgaaagggttctaccggggtatgtctgcaagctacgcaggcattagcgagacagttattcattttgtgatctacgagtccatcaagcagaagttgctggaatataagactgcgtcaacaatggaaaatgatgaagagtctgtcaaggaggcatcggattttgtaggcatgatgttagctgctgccacatcaaagacatgtgcaaccacaatcgcttatccacatgaagttgtcagaacgcggctgcgcgaagagggtaccaaatatagatcattttttcagacgctgtctctgttggttcaggaagaaggatacggcagcttatatagaggccttacaactcaccttgtaaggcagatccctaacaccgccatcatgatggccacatacgagctggtggtgtatctcctgaatgggtag

SEQ ID NO: 54164 - DNA, 933 bp, Artificial Sequence
  Description of Artificial Sequence: Synthetic coding sequence
atgtcccagcgtgataccttagtgcacttgtttgcaggtggttgtggcggaactgtgggagccattctcacctgccccctggaagtggtaaaaacccgcctgcagagctcttccgtcaccttgtatatctctgaagtgcaacttaatactatggccggtgctagcgtaaatagagtcgtaagcccaggcccattgcattgtttgaaagtcatccttgagaaagagggccctcgatccctgtttcgtggtcttggccctaacctcgtgggtgtggccccatctagggctatttattttgcagcgtacagcaactgcaaggaaaagctaaatgacgtgtttgaccctgattcaacccaggtgcacatgatcagcgctgcaatggctggattcacggctatcaccgctactaacccaatctggctcatcaaaacccgcttgcagcttgatgcgagaaacaggggggagaggcggatgggcgctttcgaatgtgtgcgtaaagtataccaaacagatggactgaaaggattctatcgtgggatgagcgcgtcttacgccggaatttcggaaacagttattcactttgtgatctatgaatcgattaagcagaaacttctagaatataagactgcatccacaatggagaacgacgaagagagtgtgaaggaggctagtgattttgtgggaatgatgctggcggctgctactagcaaaacctgcgccacgaccattgcttatccccacgtagttaggacacggctgcgcgaagaaggtaccaagtatcgctcattttttcagacattgtccctgctggtgcaggaggaaggatatggctcactttatagaggcctgacaacccaccttgtgcgacagatcccgaacacagccattatgatggcaacctacgagctggtggtgtaccttttgaacggctag

SEQ ID NO: 54165 - DNA, 927 bp, Artificial Sequence
  Description of Artificial Sequence: Synthetic coding sequence
atggactttgtagccggagctatcggaggtgtatgcggtgtggctgtcggatatccgctggatacagttaaagtccgcatccagacagaacccaaatacacaggaatatggcactgtgtgcgtgacacatatcatagggagcgcgtttggggcttctacagaggactgtcgcttcccgtgtgcacagtgagcctggtctcgtccgtgtcttttgggacctatcgacactgtctcgctcacatttgtcggctgaggtacggaaatcccgacgccaaacctacaaaggccgacatcacgcttagcgggtgtgctagcggcctcgtccgcgtgttcctgaccagcccaacggaagtcgcaaaagtgagactgcagacccagacccaggcccagaaacagcagagaagactatccgcttccggaccactggctgtcccacctatgtgccctgtacctccagcatgtcccgagcccaagtacagaggccctctgcattgtttagccaccgtcgctcgtgaggagggactgtgcgggttgtataaaggctcatccgccctcgttctccgggatgggcactccttcgctacttattttctgtcttacgcggtgctgtgtgagtggctgtctcccgcaggccattctcgccctgacgtgcctggcgtgctggtcgctgggggttgtgcaggggtcctggcctgggcagtcgcaacaccaatggatgtgatcaaatctaggctacaggccgacggccagggacagagacgctataggggtctgctccattgtatggtgacgtccgtgcgcgaggagggaccaagggtactattcaagggcctcgtgttgaattgctgccgcgcattccccgttaatatggtggtatttgtagcttatgaggcggtacttcggctcgcccgaggcttgctgacttag

SEQ ID NO: 54166 - DNA, 876 bp, Artificial Sequence
  Description of Artificial Sequence: Synthetic coding sequence
atgggttcatttcagctcgaggacttcgccgctggatggattggtggcgcagcctccgtgatcgtggggcatccactcgacacggtcaaaactcggcttcaagccggtgtgggctacggtaatactctgagctgcatccgcgtggtgtaccggagagaatccatgtttggattctttaaaggtatgtccttccccctggcgtccatcgcggtgtacaattcggtcgtgttcggcgtattcagtaacacccaaagattcctgagtcagcataggtgtggcgagcctgaagcttccccaccgcgaacgctttccgaccttctcctcgcctctatggttgccggtgtggtgagcgtggggctcgggggacctgtggatctcattaagattcgactgcagatgcagacccagccattccgggatgccaacttgggactcaagtccagggctgtcgcgcctgctgagcagcccgcatatcaaggacccgtgcactgcatcaccaccattgtccgcaacgaaggactggcaggtctataccggggagcctccgctatgctcctccgggacgtgccgggatactgtctttactttattccttacgtgtttttgtccgagtggatcacccctgaagcttgtaccggacccagcccttgtgcggtctggctggccggagggatggctggcaagggctctagttcttggtccagaacacctgtgcaagccacagctgtcggccagctcgggaactgtcatgccctgctctccccagggggaggacaggataccttcagatattcccctaataattctttgctgggcacatactctgtgcccggaccactaccgcctcagtctcacccctttcctatgcagctttag

SEQ ID NO: 54167 - DNA, 474 bp, Artificial Sequence
  Description of Artificial Sequence: Synthetic coding sequence
atgggtagtttccagctggaagactttgcagcaggttggatcggcggagctgcctcggttatcgtggggcatccactggatactgtcaaaactcgactgcaggctggagtgggctatggcaatactctcagttgcattagagtggtgtaccgccgtgagagcatgtttggatttttcaaaggcatgtcctttcctctcgccagtattgcggtctataatagtgtggtcttcggcgtcttctccaacacccagcggtttttatcccaacatcgatgcggggaaccagaagcttctccaccccgtaccctgtctgacctattgctggcgagcatggtggctggggtggtctctgttgggttaggaggacccgtggatctcatcaaaatccgtcttcagatgcagactcagccttttcgagacggcggtgagcacagaatgaccacagtgtttccagggccacacttgtgcatgtag

SEQ ID NO: 54168 - DNA, 936 bp, Artificial Sequence
  Description of Artificial Sequence: Synthetic coding sequence
atgggtagctttcagctcgaggacttcgctgctgggtggatcggcggtgccgctagcgttatagttggccatcccctggacaccgtcaagaccagattgcaagccggagttggctatggcaacactctttcttgtataagggtagtttatagaagagaatctatgtttggtttctttaaaggcatgtcttttccgctcgccagtatcgcagtctataattcagtggtcttcggggtctttagcaacacccagcgattcctaagccagcacaggtgtggagagccggaagctagtcctccccgaaccctgagcgatctgctgctggcatctatggttgccggtgtggtcagtgttggtttaggaggcccagttgacctgatcaaaatacgtctccagatgcagactcagccattccgggatgcaaatctggggctcaagtctagggctgtggctcctgctgagcagcccgcttatcaagggccagttcattgcatcacaactattgtacggaacgaaggactggcaggtctttaccgcggagcctcagcaatgcttttacgggatgtcccaggatactgcctgtacttcattccctacgtatttctgagcgagtggatcacacctgaagcgtgtacaggaccgtccccgtgtgctgtttggctggccggtggaatggccggagctatttcctggggaactgctacacccatggacgtggtgaagtctagactgcaagcggacggagtttacctgaataaatacaagggcgtgctagactgcatctcccaatcataccagaaagagggattgaaggtgtttttcagaggtataacagtgaatgcagtccgcggtttccctatgtcagctgccatgttccttggatatgagttgagcctgcaggcgatccgcggtgaccacgccgtgacctcaccatag

SEQ ID NO: 54169 - DNA, 774 bp, Artificial Sequence
  Description of Artificial Sequence: Synthetic coding sequence
atgttcggcttcttcaaggggatgtctttcccattggcctctattgctgtgtataactctgtagtattcggcgtattctctaacacccagcgttttctgagccagcaccgttgtggcgaaccggaggccagtccgccaagaactctgtccgacttgttgctggcatcaatggtggccggtgtcgtgtcagtaggactgggaggcccagtcgatctgattaagattagattgcagatgcagacccaaccatttagagacgcaaatttagggctaaaatctagagccgtggcacccgctgagcagccagcataccagggtcccgttcactgcataaccacaatcgttaggaatgaggggctcgctggactctaccgaggcgcttccgcaatgctgcttcgtgacgtgcctggatattgcctttatttcataccatatgttttcctaagcgagtggatcactcctgaagcttgtacaggcccatctccttgcgccgtctggctggccggtggtatggctggcgctatcagttggggtacagccacaccgatggatgttgtcaagagtaggttgcaggctgacggcgtatatctgaacaaatacaaaggagtgctcgactgcatttcccagtcttatcagaaggaggggctcaaagtattcttcagaggaatcactgtgaatgcggtgagaggatttcctatgagtgccgcaatgttcctcggctatgagctatccctccaggccattcgtggggaccacgcagtaactagtccctag

SEQ ID NO: 54170 - DNA, 2106 bp, Artificial Sequence
  Description of Artificial Sequence: Synthetic coding sequence
atggatgagtcccctgaaccactgcagcagggaagaggcccagtgccagtcaggcgccagagacccgctccacgcggtctgagagagatgctcaaagccagactttggtgttcctgctcgtgcagtgtactgtgcgtgcgggcactggtacaggatctattgcccgctactaggtggttgcggcagtaccggccaagagagtacctggctggggacgttatgtctggactcgtaataggcatcatcttggtgcctcaggctatagcctacagtctcctcgccggactgcagccaatttatagtctgtacacttctttcttcgccaaccttatctattttctgatgggtacaagccggcatgtctctgtgggaatcttctctctgctgtgtttaatggtgggacaggtggtggatcgtgagctgcaactggcagggtttgatccgagtcaggatgggctgcagccaggcgctaactcttctactctaaacgggtccgcagcaatgctggactgtggcagagattgctacgcgattagagtcgccacagccctgactctgatgaccgggctttaccaggtgctaatgggtgtgttgcggttgggatttgtttccgcctacttatcccaacccctgctggatggctttgctatgggtgccagtgtcactattctcacaagtcagctaaaacatctgttaggcgtgcggatacctcggcaccaggggccaggtatggtggtcttgacttggttgtctcttcttagaggcgctgggcaggcaaacgtgtgcgatgtggtaactagtacagtatgtctggctgtcctgctcgctgctaaagagctgtctgatagataccggcaccgtttgcgggtccctttacccaccgagctcttggtgattgttgtggccacgttagtgtctcattttggtcaacttcataaacgtttcggttcaagcgttgcaggggacatacctactggtttcatgccccctcaggtgcccgagcccagacttatgcaaagggtggcgctggacgcagtcgctctggcactggttgccgctgccttctccatatccctggcggaaatgtttgctagatcacacggatactctgtgcgcgctaatcaggagctcctggcggtcggttgttgtaatgtgctaccagcattcctccattgctttgcaacaagtgccgcactggccaagtcactcgttaagactgccaccgggtgcagaactcaactgtcttcagtggtctctgctaccgtagtgcttctcgtgctcctggcacttgcacccctgttccacgacttgcagagaagcgtgttagcatgcgtgattgtagtatctctgcgaggggctcttcggaaggtgtgggacctcccccgtctttggaggatgagtccagccgacgccttggtttgggcaggcaccgcggctacatgtatgctggttagtaccgaggccggactgctcgcaggtgtcatcctttccctgctctcccttgctgggaggactcaacggccaagaacagccctcctcgccaggataggagacacggcattctatgaagatgctactgaatttgaggggctcgttcccgaaccaggggtcagggtatttaggttcggaggacccctgtactacgctaataaggacttttttttacagtcactgtatagtctcaccggattagacgctggctgtatggccgcacgcagaaaggagggcggatccgagaccggtgtgggtgaggggggacccgcacaaggagaggacctaggacccgtgagcacacgagctgccctagtgcctgcagcggcaggctttcatacagttgtgatagattgtgcacctttgctgtttctggatgccgctggcgtcagcactctgcaagacttacggagagattacggagcattgggcatcagcttactcctcgcttgctgtagtccccctgtaagggatatcctgtcacgtggaggatttctcggcgaggggccaggcgatactgccgaggaagaacagctctttctgtccgtgcatgacgctgtgcagactgcacgcgcacgacacagagaactagaagcaacagatgcccacctgtag

SEQ ID NO: 54171 - DNA, 2106 bp, Artificial Sequence
  Description of Artificial Sequence: Synthetic coding sequence
atggacgaatcccccgagcctctgcaacagggaagagggcctgtacctgttagacggcagcggcctgcgcctcgcggactgcgcgaaatgctgaaagccagattgtggtgttcgtgtagttgttcagtgctgtgtgtgcgagccctcgttcaagatttgctcccagccacccgttggctgagacagtacaggcccagagagtatctcgctggggatgttatgtccggccttgtgatcggaataattcttgtacctcaagccattgcctactcactgctcgcgggactgcagcccatctacagcctatacacctcattcttcgctaatctcatctactttctgatgggcacaagcagacacgtctctgttggcattttttctttattgtgtctgatggtcgggcaggtagtggaccgcgagctgcagctggcgggtttcgacccatctcaggacggactccagccgggtgctaattcttcaactctgaatgggtcagcggctatgctagattgtggaagagattgctacgccatccgtgtcgcaacggccctgaccctaatgaccggtctttatcaggtgttgatgggagtgctccgcctggggtttgtgtccgcctaccttagccagcctctgcttgacgggttcgctatgggtgcctctgtcacaattcttaccagccagcttaaacatctcttgggagtgcgcatcccccgacaccaaggtcccggaatggtggtcctaacgtggctaagtttattacgaggggctggtcaagctaacgtgtgtgacgtggttactagcaccgtgtgcctcgccgtgctgctggccgcaaaggaattgagcgacagatatcgccacagactgcgagtgcctctgcccactgaactgctggtgattgttgtggcaacactggtgagccacttcggtcagctacacaaacgttttggctcttcagtggcgggtgatatacccacaggatttatgccaccacaagttcccgagccgcgtttgatgcagcgcgtggcgttggacgctgtggccttggctctcgtggctgccgctttctctattagcttggcagaaatgttcgctagaagccatggctacagtgtccgagcaaaccaggaattgctagcagttgggtgttgtaatgtactcccggcattcctccactgcttcgccacttccgctgctctagcaaagtctctggtaaaaacggcgacaggttgccgcactcagctgtcatctgttgtatctgcaacagtggtactgctcgtgctcctggctctcgcacccttgtttcatgatcttcagcgatctgtactggcctgcgtcatagtcgtgagcttacgaggggctctccgtaaggtgtgggacctccccagactttggcggatgagtccagccgacgcgttagtttgggccggtaccgccgcaacttgtatgctggtttctacagaagctggtctgcttgccggtgttatcctgagtctgttatctctggcgggacgtacgcagcgaccacgcacagccctacttgccagaataggtgacaccgcgttttatgaagacgccacagaattcgaagggcttgtccctgagcctggcgttcgcgtctttcggttcggaggacccttatactatgccaacaaggacttttttctgcaatcactgtacagcctaacaggactggatgccggttgcatggcagcgcgtcggaaagagggcggtagtgagaccggtgttggcgaggggggtccagcacagggcgaggatctaggcccagtatccactcgggcagctcttgtgccggctgccgctgggttccacacagtggtgatagactgcgccccactgctgttcctagatgccgctggcgtatcaacactgcaggatctccgaagggattacggggctctgggaatctccctgctcctcgcgtgttgcagcccccctgtcagagacatcctttcccgtggaggcttcctgggagagggccctggggacaccgcagaggaggagcaattatttttgtccgtgcatgatgcagtgcaaacggctcgggcaagacaccgcgagctggaggccactgacgctcacctgtag

SEQ ID NO: 54172 - DNA, 675 bp, Artificial Sequence
  Description of Artificial Sequence: Synthetic coding sequence
atggacgagtctccagagcccttgcagcaaggcagagggcctgtgcccgtacgaaggcagcgaccagcgcctcgcggtctgagggagatgctgaaggctcgtctttggtgcagctgctcctgctcggtattgtgcgtacgtgcactggtccaagaccttctgccagcgacgcgatggcttcgccagtacagacccagagagtacttggcgggagatgtgatgagcggcttggtaatcggtattatactggttcctcaggccattgcatacagcctgttggctgggcttcaaccgatctacagcttatatacaagtttcttcgcaaacttgatctattttttgatgggtacatcacgccatgtttcagtaggcatcttcagcctgctgtgcctgatggtcgggcaagtagtggaccgagagctgcagctggccggtttcgatccatcacaggacggactgcaacccggagccaactcatctacacttaacgggtccgcagccatgctcgattgcggccgtgattgttatgccatcagggtggccaccgcccttactctgatgactggtctatatcaaaccagttgggggcgaaacagtttccagcaacacccatggcaattaacgcagcggagcgactctcaggaactgctggaggaagaagagcgatcatgctag

SEQ ID NO: 54173 - DNA, 1365 bp, Artificial Sequence
  Description of Artificial Sequence: Synthetic coding sequence
atgaggcttgatctggcgtccttgatgtctgctccaaagtccctcggctccgcctttaaatcctggcgcctggataaggcaccaagtcctcagcacacgttcccttcgacttcaattcccggtatggccttcgctctcctggcatccgttccaccagtatttggcctgtacacgtcctttttccccgtgctgatctattcactccttggcactggcagacacctgtccaccggaacctttgcgatcttgtccctcatgaccggatccgcggtagaaagactggttccggaaccgctggtcggtaacctgtctggcatcgaaaaagagcagttggacgcccagcgagtcggcgtcgccgcagccgtcgctttcggatcaggggcattaatgctgggcatgttcgtgctgcagctaggcgtgctgtcaacttttctttcagagcctgttgttaaagctcttacatccggtgctgctttacacgttctgttgtctcagttgccaagtctgttgggcctgtctcttcccaggcaaatcggatgcttcagtctgttcaaaaccctggcgtccctgctaaccgcactgcccagaagtagccctgcggagctgaccatttctgcgctgagtttagccctcctcgttcctgtgaaggagctcaacgtgcgctttagagaccgacttccaactcccattcccggagaagtcgtgttagtcctgctggccagcgtactctgcttcacaagctcagtcgacactcgttaccaggtacagatcgtagggctgctgcctgggggattcccccagcctctgctccccaacctcgctgagctgcctaggattctggctgatagtttgcccattgcactggttagcttcgccgtctccgcgtcccttgccagcattcacgccgataagtattcttatacaatcgactccaatcaggaattcttggcccacggagcgagcaacctgatatcaagcttgttttcttgcttcccaaactcagccacactggccaccaccaatcttcttgttgatgccggaggcaagacgcagttagcagggctattctcttgcacagtcgtgctgtcagtcctcctgtggctcggtccatttttctattatttacctaaggccgtgctggcatgtatcaacatcagttcaatgaggcaggtgttttgtcagatgcaggagctgccacaactgtggcatattagtcgcgtcgattttgctgtatggatggtcacttgggtggctgtggtgaccctgtccgtagatctgggacttgccgttggggttgtttttagcatgatgaccgtggtttgtcgcactcggtcatccagccgatccaggggcagtgcaagctag

SEQ ID NO: 54174 - DNA, 1821 bp, Artificial Sequence
  Description of Artificial Sequence: Synthetic coding sequence
atgccttcgtctgttaccgcacttggccaggccagaagctcaggaccagggatggcgccttcagcgtgttgttgttctcctgccgctctgcaaagacgccttccaattctcgcgtggctgccaagctattcgttgcagtggctgaaaatggactttgtcgccggactgtcagtcggactcacagccataccacaggcccttgcctatgctgaagtcgccggactgccccctcagtatgggctgtatagtgcatttatggggtgttttgtgtacttctttctcgggacatcccgcgacgtgaccctgggccctaccgcaatcatgagtctgctcgtgtcattctatacctttcacgaacccgcttatgccgttctgcttgcatttctaagcggatgtatccaattagccatgggggtgttgagacttgggtttctgctcgattttatatcctatcctgttattaagggtttcacctctgctgcggctgtcacgataggcttcgggcagatcaaaaatcttctgggactgcaaaatatccctagaccattctttctgcaggtttaccatactttcctgcggatcgcagagacgcgcgtcggcgatgccgtgcttggcctggtttgcatgctcctgctactggtcctgaagctcatgagggaccatgtcccgcctgtccatccggagatgcctcctggagtgaggttaagtagaggcctcgtgtgggctgccaccaccgcgagaaatgccctcgtggtgtcctttgcagccttagtagcgtacagtttcgaagtgaccggataccagccattcatcctgaccggcgagactgcagaaggattacccccagtccgcattccccctttctcagtgaccacagcaaatggcaccatctcatttactgaaatggtgcaggacatgggagcaggtctggcggttgtgccgttgatgggactgctggagtctatagctgtggccaaagccttcgcgtctcaaaacaattaccgcattgatgcgaatcaggagttgctcgctatcggtctcacaaacatgttgggatctttggtttcaagttatcccgtaacaggatccttcggccgaactgcagtcaacgcacagtcaggcgtttgcacgcccgctggcggactcgtaaccggtgtactggtcctcttatctttagactatctgacttccctattctactatattcctaaatccgcattagcagccgtgatcatcatggctgtggccccactttttgacacgaaaatttttaggactctttggcgcgtgaagcgactggaccttctgcctctttgcgtgaccttcctgctgtgcttctgggaggtgcagtatggtattttggcgggtgctttggtgtctctgcttatgctcctgcacagcgccgcaaggcccgaaactaaagtgagcgaagggccagttctggtgctgcagcccgcttcagggctgagtttccccgcaatggaagccttaagggaagagatattgtcccgcgctctcgaggtgtccccacccaggtgcttggtcctggagtgtactcatgtttgcagtatagactataccgttgtgttaggactcggcgagttgctccaggactttcaaaagcagggggtagctctcgcatttgtgggtttgcaagtgcccgtgttaagagtgctgctctctgcagatctgaaaggtttccagtatttttccacgctggaagaggctgagaagcacctacgacaggaacctggtacccagccttataatattcgggaagactccattctggatcagaaggtagcactgctcaaggcctag

SEQ ID NO: 54175 - DNA, 1821 bp, Artificial Sequence
  Description of Artificial Sequence: Synthetic coding sequence
atgcccagtagcgtcaccgctctaggacaggcaaggagctccggcccaggaatggctccgagtgcctgctgctgctcccctgccgctctccaacgcaggctacccattcttgcatggttaccttcttattccctgcagtggttaaagatggatttcgtcgccggtctgtctgtcgggctcacagccatcccccaggctcttgcctatgctgaggttgccggtttgccccctcagtacggcttatatagcgccttcatgggttgtttcgtttactttttcttgggtacttcacgggatgtcacactgggccctactgctatcatgagcttgctcgtaagcttttacacttttcacgagcccgcatatgccgtactattagccttcttatctggctgtattcagctcgccatgggggtgctgcgcttagggtttctcctggatttcatttcttaccccgtcattaaaggctttacctccgctgctgcagtcacaattgggttcggtcaaattaaaaacctgctcggactgcagaatatccccagacccttctttttgcaggtttaccacacctttctgcgcatcgcagagactagggtcggagatgccgtgctgggcctggtctgcatgcttctactcctggtgctgaaattaatgcgggatcatgtcccgccagtgcatcctgaaatgcctcctggcgtccgcctctccagaggtcttgtctgggccgctacgaccgcgcgtaatgccctcgttgtctcattcgccgcactggtcgcctattccttcgaggtaactgggtaccagcctttcatcctcacgggggaaactgctgaaggcctaccacccgtaaggatcccgccatttagcgtaaccacagctaacgggaccattagctttactgagatggtgcaggatatgggtgctgggctggcagttgtgccgttgatgggtctgcttgagagcattgctgtggctaaggccttcgccagccaaaacaactatcgtatcgatgccaatcaggaactactggccatcggattgactaatatgttgggatccctggtgagtagctaccccgtgacaggaagtttcggaagaaccgccgtgaatgcccaaagcggcgtgtgcacccctgctggaggcctggtcaccggggtcctggtcctgcttagtttggactacctgactagtcttttttactacatccccaagtcggctctagccgcagtgattatcatggcggtcgctcccctgttcgacaccaagattttcagaaccctctggcgggtgaaacgccttgatttactcccgctctgtgtaactttcctactgtgtttttgggaagtccagtatggtattctcgcaggtgccctggtttccttgttgatgctgctgcattctgcggctcgacctgagacaaaggtcagtgaagggccagtactcgtgcttcaacctgcttcaggactgtccttcccagccatggaagcactgcgcgaggaaattctcagccgagctctagaggtttcacccccacggtgcctggtactggagtgcacccatgtgtgcagtatcgactacactgttgtactcggattgggagagctgctgcaggacttccaaaagcagggtgtggctttggcctttgttggccttcaagttccagtactccgggtcctactctctgccgacttaaagggctttcagtacttttccactctggaggaagctgagaagcatctgcggcaagaacccggaactcaaccatacaatattagagaagatagcattttagaccagaaggtcgccttgttgaaggcttag

SEQ ID NO: 54176 - DNA, 1821 bp, Artificial Sequence
  Description of Artificial Sequence: Synthetic coding sequence
atgccatcaagtgttacggctctgggccaggcgaggtcatccggaccaggaatggctccttccgcttgttgttgctcgccagccgctctccaaaggagactgcctatcttggcttggctgccatcatattccctgcagtggctcaaaatggacttcgtcgcaggactttcagtcggactgacggccatcccacaggctctcgcgtacgctgaggtggcagggttaccccctcagtacgggctctactcagccttcatgggttgttttgtatactttttcctgggtacatcaagggatgtgacactaggcccaacagccatcatgtccctcctcgtaagcttttacacgttccatgaaccggcatacgccgtcctgctggctttcttgtcgggatgtatccagttggcgatgggcgtattaagacttggattcctcctggacttcatcagctaccccgttattaagggcttcacgtctgccgctgccgtcactatcggattcggacagatcaagaacctcctgggcctgcagaacataccacggccttttttcctgcaggtgtatcatacctttcttcgcatagccgaaacaagagtgggcgatgcagtactgggcctggtatgtatgcttctgctgttagtgctgaagctgatgagggatcacgtgccacccgttcatccggaaatgccccctggagtcagactaagcaggggcttggtatgggccgcaaccacagccagaaatgccctcgtggtcagtttcgccgcactagtcgcctatagttttgaagtgactggctaccagccgtttatcctgactggagagactgctgaaggcctgcccccagtacggattcctcccttcagtgtcacaacagccaacggcacaatcagttttactgagatggtgcaagatatgggggcaggcctcgccgtcgtccctctcatggggctacttgaatctattgccgtagccaaggcctttgcctcacagaataattacaggatcgacgcgaaccaagaactccttgcaataggccttacaaatatgttagggtcactcgtcagctcctaccctgtgacgggttcattcggccgaacagctgtgaacgcacaatcgggggtgtgcacgcctgctggcggactggtcaccggagtactggtgctgctgtcactggattatctcacctcattgttttactatatcccgaagagcgctctagccgcagtcatcattatggcagtagcgcctctattcgacacaaagatttttagaacgctgtggcgggtgaagcgcctggacctgctgcccttgtgcgtgacctttcttctctgcttttgggaggtgcagtatggaatcctcgcgggagcactcgtttcactcctgatgctgttgcattctgcagccaggcccgaaactaaggtttcagagggcccagtgctggtcctgcagccagcttccgggttgtctttccccgcaatggaagcactgagggaagaaattctctctcgggctctggaagtatccccgcctcggtgtcttgtgttagagtgtactcatgtatgctctattgattatacagtcgttctgggtctgggcgaactactccaggattttcaaaaacagggcgtggccttagcattcgtgggtttacaggttccagtccttagagttctgctcagcgcagatctgaaggggttccaatacttctcaacccttgaggaggcagagaaacatctgcgacaagagccaggaacgcagccttataatatcagagaagatagcatattagaccagaaggtggctcttcttaaggcatag

SEQ ID NO: 54177 - DNA, 1971 bp, Artificial Sequence
  Description of Artificial Sequence: Synthetic coding sequence
atgactggagccaagaggaagaagaaaagcatgctgtggagcaaaatgcatacccctcagtgtgaagatattatccagtggtgtagaagaagattgccgatcttggactgggcccctcactacaacctcaaagaaaacttgctgccagacaccgtctccggaattatgctggctgtacagcaggttacacagggtctagcgtttgcggttctgtcttcagtgcatccggtgtttgggctttacgggtcactcttccctgcgataatctatgcaatcttcggtatgggacaccacgttgccacaggaaccttcgcgctgacatcactgattagtgcgaacgccgtagagcggattgttccgcaaaacatgcagaacctaaccacccaatctaacacctctgtgctgggcctcagcgatttcgaaatgcagaggattcacgtcgctgctgcagtttcatttctgggcggagtgattcaggtagccatgtttgtgctccaactcggaagtgctaccttcgtggtcaccgagcctgtcattagcgccatgactacaggcgctgcaacacacgtcgtaacctcccaggtgaagtacctgcttggaatgaaaatgccatatataagcggccctctgggcttcttttacatctatgcatatgtgtttgagaatattaagtcagtccggctggaagcgctgctcctgtctctgctgagcattgttgtgctcgttctcgtgaaggagctcaatgaacagttcaagcggaagatcaaggtagtgttgcccgtggatctggttctgattattgccgcaagttttgcatgctattgcactaacatggaaaacacttacggtctggaggtggttggccatatcccccagggtattcctagtcccagggctcctccaatgaacattctgagcgcagttataaccgaagccttcggtgttgcattggtggggtacgtcgcctccttggctctcgcacagggatctgccaagaaatttaagtactcaattgatgacaaccaggagtttctcgcacacggattgagcaatattgttagctcattcttcttttgcatcccaagcgccgcagcaatgggcaggaccgcgggattatattctactggcgctaagacccaagttgcctgcctgatctcatgtatattcgtcctgatagtcatttacgctattggccctctgctgtattggctcccaatgtgcgtccttgcctccattatcgtggtggggctcaagggcatgctgatccaattccgggatctgaagaaatactggaacgtggacaagatcgattggggcatctgggtatccacctacgtattcaccatttgcttcgccgcaaacgtcggtctactgttcggcgtggtgtgcactatcgctattgtgatcggtcgcttccctagggccatgaccgttagcattaagaatatgaaggaaatggagtttaaggtgaagacagaaatggatagcgagactttacagcaagtgaagattatttcgatcaataatccgcttgtcttcttgaatgcgaagaaattttacacagacttaatgaatatgattcagaaggagaacgcctgcaatcaacccctggacgatattagtaagtgcgagcaaaataccctgttaaacagcctctcaaatggcaattgtaacgaagaagcctctcagtcatgccctaacgaaaagtgttatctcattctggattgttcaggctttacattttttgactactccggagtgtcaatgctggtagaagtttacatggattgcaaagggaggtccgtcgatgttctgctggcacattgtactgccagtcttatcaaggccatgacgtactacggtaacctcgatagcgagaagcctattttcttcgaaagcgtatctgccgctataagtcatattcattctaacaagaacctgtcgaagttgtcagatcattcagaggtgtag

SEQ ID NO: 54178 - DNA, 1992 bp, Artificial Sequence
  Description of Artificial Sequence: Synthetic coding sequence
atgacgggcgctaagaggaagaaaaagtctatgttatggtctaagatgcacaccccgcagtgcgaagacatcatccagtggtgcagacgacgattgccaatcttagactgggcaccacactataatctcaaagagaacctgctgcctgataccgtgtcaggaataatgctggcggtgcaacaggtgacacagggcctggccttcgctgtgctgtcatctgtgcaccccgtgttcggtctgtacggcagcctatttccggctatcatctacgcaatctttggcatgggccatcacgtggctacaggcacatttgcactaacctcgctgatttccgctaatgccgtcgagcggatagttccccaaaacatgcagaatctcacgactcagtcaaatacatccgttttgggtctcagtgatttcgagatgcaaagaatccacgtcgccgcagctgtttcctttctggggggagtgatccaggtggccatgttcgttctgcagctgggatcagccacattcgtcgtgacagagccagttattagcgccatgactaccggcgcagcgacccacgtggtgacctcccaggtgaagtatctgctggggatgaaaatgccctacattagcggccctttaggatttttctacatctacgcctatgtgtttgaaaatatcaagtctgtacggcttgaggctctgttgctgtcgcttttaagtatagtcgtgctggttcttgtcaaggagttgaacgaacagtttaaaaggaagattaaagtcgtgctccctgtggatcttgtcctcatcatcgcagcaagctttgcctgttactgcacaaacatggagaacacctatggtctagaagtggtgggacacatccctcagggaatccctagcccacgcgctcccccaatgaacattctgtcggctgtgataacagaagcctttggcgtagctttagtggggtatgtcgctagcctcgcactcgctcagggctccgcaaagaaattcaagtacagcatagatgacaaccaggaatttcttgctcatgggctttctaacatcgtcagttcattcttcttttgcatcccttccgctgccgctatgggccgtaccgccggattgtactccacaggggcaaagacccaggtcgcttgcctgatatcatgtatctttgtgctgatcgttatttacgctattgggccattactgtattggctgccgatgtgtgtgctggcctccataattgtagtcggcctgaaaggtatgttaatccagttcagggacttgaagaaatactggaatgttgacaagattgattggggaatctgggtgtctacatacgtgtttacgatctgtttcgccgctaacgtggggctgctgttcggagtagtctgcaccatcgcgatcgtaatcgggaggttcccacgcgctatgactgtaagcatcaagaatatgaaggagatggaattcaaagtgaaaactgagatggattccgagacacttcagcaagtgaagattataagcatcaataaccccctggtgtttctgaacgcgaaaaagttctacacggatctgatgaacatgatccaaaaagagaatgcctgcaatcagcccctggacgacatatctaagtgcgagcagaataccctattaaattcactctccaatggaaactgtaacgaggaggcatcacaaagctgccctaatgagaagtgctacctcattctcgactgtagcggattcacctttttcgactatagcggagtaagcatgcttgttgaggtgtacatggactgtaaaggcagatctgtggacgtacttcttgcccactgcactgccagcctcatcaaagccatgacctactatgggaatctggactcagagaagcctattttctttgaatctgtctccgccgcaatctctcatatccacagtaacaaggcaagctacaagctgctcttcgacaatctggatctaccaactatgccgcctctctag

SEQ ID NO: 54179 - DNA, 624 bp, Artificial Sequence
  Description of Artificial Sequence: Synthetic coding sequence
atgacgggggcaaagcgaaagaaaaaatctatgctgtggtccaagatgcacactcctcagtgcgaagacatcattcagtggtgccggaggcggctgcctatcctggactgggcccctcactacaatctgaaagagaacctcttgccagataccgtcagcggtataatgctagcggtccagcaggttacgcagggccttgcctttgcggtgctgtctagcgtacatccagtgttcggcctttatgggtccctcttcccagcaattatttatgctattttcgggatgggacatcatgtggcaacagggacatttgctctgacttccttgatttccgctaacgctgtggagcggattgtcccacagaatatgcagaacctgacgacccagagtaacacaagtgtgcttggcctgagcgacttcgagatgcagcgtattcacgttgctgccgcagtatccttcctcggcggtgtcatccaggtggcgatgttcgtgctgcagctgggctccgcgacctttgtggttactgaacctgtgattagtgccatgaccactggagcagcaactcatgtggttacaagtcaggttaaatatttgctcggcatgaaaatgccgtatatcagttag

SEQ ID NO: 54180 - DNA, 1971 bp, Artificial Sequence
  Description of Artificial Sequence: Synthetic coding sequence
atgaccggcgcaaaacggaagaagaagtcaatgctgtggtcaaaaatgcacacaccacagtgcgaagacatcatacagtggtgccggaggcggttgcccattctcgactgggcaccgcactacaatctgaaggagaacttgctccctgacacagtatccggtatcatgttggccgtacagcaagtgacacaaggccttgccttcgctgtgctgtcttcggttcaccctgtgtttggtctgtacgggtcactgttcccggcaatcatatatgcgatcttcgggatgggccatcacgttgcaactgggacatttgccttgacttctctgatcagtgccaatgccgtggaacggatcgtgccccagaatatgcagaacctgacgacccaaagtaatacgagtgttctggggttgtccgattttgagatgcagagaatccacgtcgcggcagcggtaagtttccttggcggtgtgattcaggtagcaatgttcgtgctgcaactcggctcagctacctttgtggtcacagagccagtcatttctgccatgactaccggtgctgccacccacgtggtgacctctcaggtaaaatatctgctcgggatgaagatgccatacatttccggaccactgggctttttctacatttacgcatatgtgtttgaaaatatcaagagcgtgcggttggaagcactgctcctctcactactgtctatcgtggtcctggtcctggttaaggagctgaatgaacagtttaagcgtaaaattaaggtcgtactgccagtggacctcgttcttatcattgcagcttcatttgcctgttactgtactaatatggagaacacatatggtctcgaggtggttggacacatacctcaaggtatccccagtcctagggcacctcccatgaacattttgagcgcagtgatcactgaagcgttcggggttgccttggttggctatgtggcttctctggcactggcacagggcagtgccaagaaattcaaatatagcattgatgataaccaagagtttcttgctcatgggctttctaatattgttagctcctttttcttttgtatcccgagtgccgctgctatggggagaacagccggattatacagtacaggcgcaaaaacccaggttgcctgtctgatcagttgtatattcgtgttgatcgttatctatgcgatcgggccactgctatattggcttcctatgtgcgttctggcctccattattgttgtgggactcaaaggaatgctcatccaattccgtgatctgaaaaagtattggaacgtggataagatcgactgggggatttgggtttcaacttacgtctttaccatttgcttcgccgcaaacgttgggttgctatttggcgttgtgtgcacaatcgccatcgtgatcggacggttccccagagccatgacagtgtcgatcaagaacatgaaggagatggaatttaaggtgaaaaccgaaatggatagcgagactttgcaacaagtaaaaattatcagtattaataacccactcgtttttttgaatgctaaaaagttttacacagacttgatgaatatgatccagaaggaaaatgcttgtaaccagcctctggacgacatcagcaagtgtgaacagaatactcttctgaattcactgtccaacggcaactgtaacgaggaggcaagccaatcctgtccaaacgagaagtgttacctgattttggattgctctggattcacattttttgactattccggagtgagcatgctcgttgaagtgtatatggattgtaaaggcaggagtgtggatgtactgctggcccactgtactgcctcattgataaaagccatgacatactacgggaatcttgattccgagaagcccatcttcttcgagtctgtgtctgcagctatatcacacatccactctaataagaacctgagtaagttatccgatcactccgaggtttag

SEQ ID NO: 54181 - DNA, 2913 bp, Artificial Sequence
  Description of Artificial Sequence: Synthetic coding sequence
atggcccagctggagcgctcagccattagtggctttagcagtaaatctcggcgaaactcctttgcctacgacgtgaagagagaagtgtacaacgaggagaccttccaacaggaacataagagaaaagcaagttcctccggaaacatgaatattaatatcactacattcaggcaccatgtccagtgcaggtgctcatggcaccgctttctgcgctgcgtcctgacgatttttccatttttggagtggatgtgcatgtacagattaaaagattggctcctgggtgatctgttggccggtatatccgtaggcctggttcaagtcccacaggggttgactctgagtttactagcccgacaacttatcccccctttgaacatcgcttacgctgccttctgttcctccgtgatctacgtgattttcgggtcatgccaccagatgtccatagggtccttcttcctggtttcggcactcctcatcaatgtgcttaaggtgtctcccttcaacaacgggcaactggttatggggagtttcgtgaagaatgagttcagcgctcccagctatttgatgggctataacaagagccttagcgtcgtggccaccactacctttcttacgggcattatacagttgatcatgggagtacttgggctgggcttcattgccacttacctgcctgagagcgctatgtccgcatacctggccgctgtcgccttacacatcatgttgagtcagttaacctttatctttgggatcatgatttcctttcacgctggcccaatttcctttttttatgacatcatcaattattgtgtcgctttaccaaaagccaattcaacttctatcctggtgttcctcactgtggttgtggccttgagaattaacaagtgcatccgcatttccttcaaccagtaccccattgagtttccaatggagctctttcttattattggctttaccgtcatcgcaaacaaaatctccatggctaccgagacgagccagacattaattgatatgatcccttattccttccttctccccgtgaccccggatttctcacttctccctaagattatactgcaagcttttagcctttcactggtatcatcatttctcctcatttttcttggcaagaaaattgcttctctccacaactacagtgtgaattctaatcaagatctaattgcgattggtctgtgtaacgtcgtgagttccttttttcgcagctgtgtgtttactggggctattgcaaggacaataatccaggataagagtggcggtaggcagcaatttgcatcactggtaggcgctggggtgatgttactgttaatggtcaagatggggcatttcttttatacgctacccaatgctgtcctcgccggtattatcctctccaatgtgatcccgtatctggagactatttctaatctccctagcctgtggcgtcaagaccagtatgattgcgctctctggatgatgactttctcaagcagtatttttctggggctagacatcgggctgattatttctgtagtttcagcattcttcattacgacggtgaggtcacaccgcgctaagatcctgctcctgggacagatacctaatactaatatctatcgctcaattaatgattacagggagatcattacaattccgggagtcaagatctttcagtgctgcagttcaattacgttcgtcaatgtgtactacctcaaacataaactgctgaaagaagtggatatggtgaaagtgcccctcaaagaagaagaaatctttagcttatttaacagttcagacaccaaccttcaagggggtaaaatctgtagatgcttctgcaattgcgacgatctcgagcctttacctagaatactttatactgaacgctttgaaaataaactcgatcctgaggccagttctataaacctgattcactgtagtcactttgaatcaatgaacacttcccagaccgcgtccgaagatcaggtcccctatacagtgtcaagcgtctcccagaaaaatcagggccagcagtacgaggaggtcgaggaggtttggctgcctaataacagctctagaaactcttcaccaggcctccccgatgtggccgagagtcagggtcggaggtccctgataccatatagcgacgcctcgctcctcccctccgttcacactattattctggatttcagcatggtccattacgtcgattcacgcggtctggtcgtgctgcgccaaatttgtaatgcattccagaatgccaatatcctcatccttatagctgggtgccatagttcaatcgtgcgtgccttcgaacgtaacgacttctttgatgccggtattaccaaaacccagctttttctttccgtgcatgacgccgtgctgttcgcactgtcccgtaaggtcattggttctagcgaactgagcatagatgaaagtgaaaccgtgattagggagacctattctgaaaccgacaagaatgacaactcccggtacaagatgagttcctcttttctcgggagccagaaaaacgtttcacctggcttcattaaaatacagcagccagtggaggaggaaagtgagctcgatctcgaacttgagagcgagcaggaggccggactgggcctggatttagacctagaccgggaattagaaccggaaatggagcccaaggccgagaccgagacaaagacccaaaccgaaatggagccacaacccgaaaccgagccagaaatggaacccaatcctaagtcgcgacccagagcacacacctttcctcaacagcggtactggccgatgtatcaccccagtatggcatcaacccagagccagactcagaccagaacctggtccgtggagcgacgcaggcaccccatggattcttacagcccggaaggtaatagtaatgaggacgtgtag

SEQ ID NO: 54182 - DNA, 2598 bp, Artificial Sequence
  Description of Artificial Sequence: Synthetic coding sequence
atggcccagttggagaggagcgccatctccggattctccagcaagtcgagaagaaactcatttgcctacgatgtcaagcgagaggtgtataacgaggagacattccagcaagaacacaagcgaaaggctagtagttccggcaacatgaatattaacatcacaactttccgtcatcatgtccaatgcaggtgctcatggcatcggttcctgagatgtgtactgacaatcttcccgtttctggagtggatgtgcatgtatagattgaaagactggctcttaggagatctcttggcgggaatttctgttggcctcgtgcaggttccgcagggcctgacattgtcgttgctagcacggcagctgatcccgcctctaaatatcgcttatgcggcattctgtagcagcgttatctacgtgatctttggctcctgccaccaaatgtctatcggatccttctttctagtgagtgcccttcttatcaacgtgttaaaggtgagtcctttcaataacggacaacttgtcatgggttcttttgtaaaaaacgagttttctgcaccgagttatttaatgggctataacaaatctttaagtgtggtagccaccacaacctttctcactggaattatacagattatcggctttactgtgatcgccaacaagatttctatggccactgaaactagccaaaccctaatcgacatgatcccatacagtttcctcctgcctgtcacccctgacttcagtctgctgcccaagattatcctgcaggccttcagtctgtcgcttgtttccagctttcttctgatcttcctgggaaagaaaatcgcatctctacataactactctgttaacagcaatcaagatttaatcgcaattggactgtgcaatgtcgtttctagcttctttaggtcctgtgttttcacaggcgctatcgcgcgtacaatcatccaggacaagagtggcggacgtcagcagttcgcatcactagtgggcgctggggttatgctgctgttgatggtcaagatgggccatttcttttacacactacctaatgccgtgctcgccggtatcattctgagcaatgtcataccatacctcgagactatctcgaatctgccttccctgtggagacaagaccagtatgactgcgcgctgtggatgatgaccttcagctccagtatctttctggggttggatataggactaattatatccgtcgtttcagcgttcttcattacgactgtccgatctcaccgcgctaagatacttctcctcggacagatcccgaatacgaatatctataggagtattaacgactatcgagaaattataaccatccctggcgtcaaaatttttcagtgttgttcctcaataacatttgtgaatgtgtattacctgaagcacaaactgctgaaggaagtggacatggtgaaggtgcccctcaaagaagaggagatcttctcgctcttcaacagctctgatactaatctccagggcggtaagatttgtaggtgtttttgcaattgcgatgacctggaacccctaccccgaatcttgtataccgagcgtttcgagaacaaactggaccctgaggccagctccatcaatctgattcactgtagccacttcgagtctatgaacacgagccagacagcttcggaggaccaggtgccctacaccgtatcaagcgtttcccagaaaaatcagggccagcaatacgaagaagttgaggaagtgtggttgcctaacaactcgtccaggaatagttccccaggactgccagacgtggcagagtctcagggacgtcggtctctgataccatactcagacgctagcttactgccttccgttcataccataattctcgattttagtatggtccactatgtggattcgcggggactcgtagtgctgcgccagatttgcaacgcttttcagaatgccaacattttaatcttgattgccggttgccattcaagtatcgtgcgggcattcgaacggaatgactttttcgacgctggaatcacaaagacccagctgttcctttccgtgcacgacgcagtgctttttgctctgtcccggaaggtgattggctccagcgaactgtcaattgatgagagcgaaaccgtgatccgtgagacatacagtgaaaccgacaaaaatgacaactccagatacaagatgtcatcctcatttctgggcagtcagaagaacgtctctccagggttcatcaagatccagcaacccgtcgaggaagagtctgagctggatctagaactcgaatccgaacaggaggcgggacttgggctggacctcgatttagatagagaactggaaccagagatggaaccaaaagctgagaccgaaacgaagacccagacggaaatggagccgcagccagagacagagcccgagatggagcccaatccaaagtctcggccaagggcccacaccttcccccaacagagatattggcccatgtaccatccatctatggccagcacccaaagtcagacgcagaccagaacttggtccgtggagcgcagacgccacccaatggactcatacagccctgagggaaattccaacgaagacgtatag

SEQ ID NO: 54183 - DNA, 2913 bp, Artificial Sequence
  Description of Artificial Sequence: Synthetic coding sequence
atggctcagttggaacgttccgcgatcagcggattttcatcgaagagccgcagaaacagttttgcatacgacgtgaagcgcgaagtgtacaacgaggagactttccagcaagaacataaacggaaagcctcatcatctggcaacatgaatataaatattacaacgtttcgccaccatgtacagtgccgttgctcctggcatagattcctgaggtgcgtgctcacgatatttccttttctggagtggatgtgcatgtaccgcctcaaagactggcttctgggtgatttactagctggcattagtgtgggccttgtgcaagtcccccagggtctgactctgagcctgctggctcgacagctgatcccaccgctgaacatagcctacgctgccttctgttccagtgtaatctatgtcatttttggaagctgccaccagatgtccataggctccttcttcttggtttcagccttgctgatcaacgtgctgaaggtaagcccattcaacaacggacaactggttatggggtcatttgtaaagaacgagtttagcgccccttcctatctgatgggttacaataagagtttgagcgttgtggcaacaactacatttctgacaggtattatccaattaattatgggggtcctgggtttaggattcatcgctacttacctgcctgagagcgccatgagcgcatatctcgccgcagtggcactgcacataatgctgtcacaactgacttttatcttcggtatcatgatttcatttcatgctgggccaatctccttcttttatgacatcatcaattactgcgtagcactgcctaaagctaacagtacaagcatcctggtatttctcaccgtcgtagtggcactgcgcataaacaaatgtatccgtattagtttcaaccagtatccaatcgagttcccgatggagctgtttctgatcattgggttcaccgtgatcgccaacaagatcagcatggctaccgagacatcccagactctgattgatatgatcccatatagttttctgctccctgtcacccccgatttttccctattgcccaagataatactgcaggccttttctctctctcttgtctcatcgtttctgctgatctttctgggcaagaaaattgcttcccttcataattacagcgttaatagcaatcaagacctcattgcgataggcctgtgcaatgtagtctcctcctttttcagatcttgcgtctttacaggcgctattgcacgaactataatccaggataaatctggcggaaggcaacagtttgcaagcctcgtgggcgcaggtgtgatgctgctgctcatggttaagatgggccattttttctataccctgcctaatgcagtgttggccggaattattctatccaacgtgatcccctacttggaaacaatctccaaccttccttctttgtggagacaggaccagtacgactgtgccctgtggatgatgacattcagttcctcaatttttcttggattggacatcggattgatcatcagcgtggtgagcgccttctttatcaccacggtacgctcccacagggctaagatcttgctgctgggtcagattccaaataccaatatttatagaagtattaacgattacagagagattattacgatacctggcgttaaaatcttccaatgctgctcctctatcactttcgtgaatgtatactacttaaaacataagctgttaaaggaggtcgacatggttaaagtccctcttaaagaagaggaaattttctccctttttaactccagtgacactaatctgcaaggtggtaagatctgcagatgcttctgtaactgtgatgacctggagcccctccctcgcatcctgtatactgagcgctttgagaataaactggatcctgaagcctccagtattaacctgattcactgtagtcacttcgagtccatgaatacatcccagaccgcttccgaagaccaggtcccctacaccgtatccagcgtctcacagaaaaatcaaggccagcaatatgaagaagtggaggaggtctggcttcccaacaacagctcacggaactcctcacccggactgccagacgtggccgaaagtcagggccgtcgctcattgatcccttacagtgacgcaagcctgctgccttcagtccatactataatcctcgacttcagcatggtgcattacgtggattcgagagggctcgtggtgctgcgtcagatctgcaacgccttccagaacgccaatatccttattctgatcgccggttgtcatagctcaattgttcgtgcttttgaacgcaatgacttctttgacgcgggtatcactaagacccaactgtttctgtccgtgcatgatgccgtactgttcgccctcagtcggaaagttataggcagctcggagttgtccatagacgagagcgaaactgtaattcgcgagacatattcagagactgataagaacgataattcacgctataaaatgtcttccagctttctcggaagtcagaagaacgtgagccctgggttcataaaaattcagcagcccgttgaagaggagtccgaacttgatctggagttggagtctgagcaggaggctggactcggactcgacctcgatcttgaccgcgaactagaaccggagatggagcctaaggcagagacggaaactaaaacccagacagagatggagccacagcctgagacagagccagaaatggagccgaatccgaaaagtcggcctcgcgctcacaccttcccacagcagcggtattggccaatgtaccacccttcaatggccagtacacaatcacagacgcaaacaaggacatggtcagttgaacgcaggcgccaccctatggatagttatagtccagaggggaactcaaacgaagacgtctag

SEQ ID NO: 54184 - DNA, 2664 bp, Artificial Sequence
  Description of Artificial Sequence: Synthetic coding sequence
atgagccagccgcgaccacggtatgtggttgatcgggctgcgtatagcctgactctgttcgacgacgagttcgaaaagaaggatcggacgtaccccgtgggagagaagcttcgcaacgcctttcgatgcagcagcgccaaaatcaaagcagtcgtgtttggactgctgccagtccttagctggttgcctaagtataagatcaaggattatataatccccgatctgctgggaggactgagtggcggtagtatccaggtcccacagggaatggcattcgctctgttggctaatctaccagccgtgaatggcctttatagttctttctttccccttttaacctatttcttcctggggggtgttcaccagatggttccaggcacgtttgctgtgatctccattcttgtgggaaacatctgtttgcagctggcgccagaatcaaagttccaggtttttaacaacgccacaaacgagtcttatgtggacactgcagccatggaggcggagcggctacacgtttctgccaccctcgcctgtcttaccgccattattcaaatgggtctgggattcatgcaatttggattcgttgccatatatctatcagaatcatttatccggggtttcatgaccgctgcgggacttcagatactcatctcagtccttaagtatatttttgggctcaccatcccttcttatacaggaccagggagtattgtctttacgttcatagacatctgcaagaatctccctcatactaatatagcttcactgatattcgcccttatcagtggggctttcctggtcctggttaaggaactgaacgcgaggtatatgcacaagataaggtttcctattccaaccgagatgatcgtagttgttgttgccactgcaatcagcggcggttgtaaaatgcctaaaaaataccacatgcagatcgttggagagatacaacgcggttttcccacacctgtgtcaccagttgtgtctcaatggaaggatatgatcggcaccgcctttagccttgctatcgtttcgtacgtgattaacttggccatgggaaggaccctcgccaataaacacggatacgacgtggactctaatcaggagatgatcgccctcggatgttccaatttcttcggctcctttttcaagatacacgtgatctgctgcgccctgtcagtgacccttgccgtggatggcgcaggcggaaaatcccaggttgcttccttgtgtgtatcgctcgtagtgatgatcactatgcttgtcctggggatatacctgtaccccttacccaagtccgtcctgggcgcactcatagctgtcaatcttaaaaatagtcttaagcagcttaccgatccctattacctgtggagaaagtcaaagttggactgctgcatttgggttgtgagcttcctatctagtttttttctgtctctcccttacggcgtggctgttggggtagctttttctgtgttggtcgtcgtttttcagacgcagtttcgaaatggatacgcactcgcccaagttatggatacagatatctatgtcaacccaaaaacttacaaccgcgcacaggacatacaagggataaagatcattacatactgttccccactgtactttgccaacagcgagatcttccggcagaaagttatagcaaagaccgggatggacccgcagaaggtgctcctggccaaacagaaatatctgaaaaaacaggaaaagcgccgtatgagaccaacacaacagaggaggtcactgttcatgaagaccaagaccgttagcttgcaggagctgcaacaggactttgaaaatgctcctccaaccgaccccaacaacaatcagacgcccgctaacgggacttcggtgtcctatatcaccttctcccctgactccagttccccagcccagtccgagccccctgctagtgcagaggcgcctggggagcccagtgacatgctcgcttccgtcccacccttcgtgactttccataccctcatcttggacatgtccggcgtgagcttcgtggatctcatggggataaaagccttggctaagttgtctagtacctatggcaaaattggagtgaaggtgttcctggttaatattcatgcccaggtatacaacgatatttctcacggaggtgtatttgaggacgggtctctcgagtgtaagcacgtgtttcccagtattcacgatgcagtgctgtttgctcaggcaaacgctagggatgtcacacctgggcataacttccagggtgccccaggggacgccgaactgtcgttgtacgacagcgaggaggatattaggagttactgggacttggaacaggagatgttcggctccatgtttcacgccgagactttaactgcactggagtctttgtcggccgcaggcggatgctatccatatcgttccgagagcctcgtcagccccttattcacccgccaggcccttgcagctatggataagcctcctgcccacagcaccccacctacctctgcactgtctctggccgcagagggtcaccttgattttcagttgctcagggtttcacagaaacagaaggacaaatataactgcgccggactcctttataagctccaaaaagtgtcccagtctcctcacggcagcgtaagcgatggagttcgactatctaggacgtag

SEQ ID NO: 54185 - DNA, 2664 bp, Artificial Sequence
  Description of Artificial Sequence: Synthetic coding sequence
atgtctcagccgaggccgagatatgtcgtcgatcgagccgcttattcactaactctgtttgatgatgaattcgaaaagaaggacaggacttacccagttggggaaaagcttagaaatgccttccgctgttcatcagcgaagatcaaggctgtggtctttggccttctcccagttttgtcttggctccccaagtataagatcaaggactacattatacctgatttgcttggcggattgagtggaggctccattcaagtgcctcaggggatggctttcgcactgcttgccaaccttcccgcagtgaatggtctttactccagcttcttccctctcctgacatatttctttttgggcggagtgcaccagatggttccaggaactttcgccgtgatttccattttggtcggcaatatatgtttgcagctggcccctgaatccaagtttcaggtgtttaataacgctactaacgagtcctacgtggacactgctgctatggaagccgagcgtcttcacgtcagtgccactttggcctgcctgacggcaataattcagatgggcctgggattcatgcagtttggttttgtcgccatctatctctcggaatcttttatccggggatttatgacagccgcaggcctacaaattctgatcagtgtcttaaagtacatcttcggactaacaatacccagctatacaggccctggatccatagtgttcacctttatcgacatctgcaagaatctgccacataccaacatcgcgagcctaatattcgctctcatttctggggctttcctggtcctggtgaaagaactaaatgctcgatatatgcacaagattaggtttccgattcccaccgagatgatcgtcgttgtggtggcaaccgccatctcaggcggatgcaagatgcctaaaaaataccatatgcaaattgttggcgagatccaacgaggtttcccgaccccggtgagtcctgtggtttcccaatggaaggacatgattggtactgcgttcagtctagctattgtgagctatgtcatcaatctcgcaatgggacggaccctcgctaataagcatggatacgacgtagacagcaatcaagaaatgattgcactgggctgcagcaactttttcgggagctttttcaagatacacgtgatctgttgtgcattgagtgttacgctggctgtggacggcgcaggaggaaagagtcaagtggcttctttgtgcgttagtcttgttgtgatgattactatgctagttctgggaatatatctgtatccccttccaaaaagtgtgctgggtgctctgattgcagtgaaccttaaaaacagcttgaaacagcttaccgatccatattatttgtggaggaaaagcaagttagattgctgcatctgggtggtgagtttcctgtcgagcttctttttgtctctaccatacggagtcgctgttggtgtggccttcagtgtccttgtagtggtgttccagactcagtttcggaatggctacgctctggcccaggtgatggacacagacatctacgtgaaccccaaaacttacaatagggcgcaggatatccaagggatcaagattatcacatactgttcacctctgtacttcgcaaacagcgagatcttcagacagaaagttatcgccaagaccggtatggatccgcagaaagtactgctcgcaaagcagaagtaccttaaaaagcaggaaaaacggcgaatgcgtccaactcagcagagaagatccctctttatgaagaccaagaccgtctcactacaggaacttcagcaggacttcgagaatgcccctcccacggatccaaacaataaccaaacccctgcgaacgggacctctgtgtcatacatcacctttagccccgactccagttctccagcgcagtccgaacctcccgctagcgccgaggcgcctggggagccctcagacatgttagcgtccgtgccccctttcgtcacatttcacacgctgattctggatatgtcgggcgtgtcctttgtggacctcatgggaattaaagccctggccaaactgtcatcgacatacgggaagatcggtgtgaaagtctttttggtgaacatccacgcccaagtttataatgacataagtcatgggggagtctttgaagacggctctcttgagtgcaagcatgtgttcccgtcaattcacgacgccgtgctattcgctcaggccaacgcaagggatgtgacgccagggcacaatttccagggtgcccctggcgatgcagagctgagcttatatgattcggaagaggacatccgtagttactgggaccttgagcaggagatgttcgggagtatgttccatgctgagacattaaccgccctagaaagtctgtcagcggctggcggatgctatccgtaccggagtgagagcttagtgtcccccttgtttactcggcaggcactcgcggcaatggataaacctcctgcccacagcacaccaccaacatctgccttgtccctcgccgcagaagggcacctggactttcaacttctgcgtgtctcacaaaaacagaaggacaaatataactgcgccggacttctgtataagctgcaaaaagtttcccagagcccccatgggtcagtgtcggacggtgtgagactgtccagaacgtag

SEQ ID NO: 54186 - DNA, 2376 bp, Artificial Sequence
  Description of Artificial Sequence: Synthetic coding sequence
atgagtcaaccaaggcctcgatatgtggtggaccgggcagcttatagcctgactttgtttgatgatgaattcgaaaaaaaggaccgcacctaccccgtcggggaaaagctcaggaatgcctttcgatgttcctccgccaagattaaagccgtcgtctttggtctgctccctgttctgtcctggttgcctaaatataaaattaaggactacattatcccagatttgctcggtggtctatctggaggatcaatccaagtgccccaggggatggcttttgctctgcttgctaacctacctgccgtaaacggtctgtactccagtttcttccccctcctgacctattttttcttggggggagttcaccagatggtccctggtacgtttgcagtgatttcaatccttgtcgggaatatctgcctacaactggcgcctgaatctaagttccaggtgttcaataatgccacaaatgaatcctacgtcgatacagccgctatggaggccgaacggctgcatgtgtctgccactctcgcttgcctgaccgccataatccagatggggctgggctttatgcagttcgggtttgtagccatctatttgtcagaatctttcatcagaggcttcatgacagccgctggactgcaaattctgatatccgtgctaaagtacattttcggcctgaccattcccagctacacaggaccaggcagcatcgtgtttacatttatcgatatctgtaagaacctcccgcacacaaatatcgccagtctcatcttcgccctgatttcaggcgctttcctggtactagtgaaggagctcaacgcccgatacatgcataaaatacggttccccattcccaccgagatgattgtcgtggttgtcgccaccgcgataagcggtgggtgcaaaatgccaaagaagtaccacatgcagatcgtcggggagattcaaagggggttcccaaccccagtttcgcccgtcgtgagccagtggaaggacatgatcgggacggcattcagcctggcaatcgttagctacgttattaacctggccatgggacgcacgcttgccaacaaacacgggtacgatgtagattctaatcaggagatgattgcactcgggtgctctaacttcttcggatctttcttcaaaatccatgtgatttgttgcgcattaagcgtcactttagccgtggacggcgcaggaggaaagagccaagtcgcgagtctttgcgtgtctctggttgttatgatcacaatgctggtccttggaatttacctgtacccccttcctaagtcggtattgggggctctcatcgcagtgaacctcaaaaactctctgaaacagctgaccgatccttattacctttggagaaaatccaagctggattgttgcatctgggttgttagctttctctcttccttcttcctgtctctgccatatggcgttgccgtgggagtcgccttttctgtgcttgtagtagtgttccagactcaattccgtaacggttacgccctggcgcaggtgatggacacggatatctacgtcaatccaaagacatataatcgggcacaagatatacagggcattaagatcattacctactgttcccccctatacttcgccaatagtgagattttcaggcagaaagttattgccaagacaggcatggatccacagaaggttctgcttgcaaagcagaagtacctgaagaagcaggaaaaacggcgaatgagaccgacgcaacaaagacgttctctattcatgaagacaaagacggtctctctacaggagctgcagcaggacttcgaaaatgctccacccactgaccctaataataatcaaacccctgccaatggcaccagtgtcagctacatcacttttagccccgacagctcctcccctgcgcagtctgagcctccagcaagtgcagaggctccgggtgaaccatcagacatgctcgccagtgtcccaccttttgtcacttttcacactctcatcctcgatatgagcggtgtctcatttgtggatttgatgggcatcaaagctctggccaaactctctagcacgtatgggaagataggggtaaaggtcttcctggttaacatccatgcccaggtttataacgacatcagccatggcggtgtattcgaagatggctctctggaatgtaagcatgttttcccctctatccacgacgctgtgctgtttgcccaggcgaacgcaagggacgttacccccggacacaactttcagggcgcacccggagacgcagaactgagtttatatgacagtgaggaagatatccggtcatattgggacttggagcaggaaatgtttggctctatgttccacgcggagacccttacagccttgtag

SEQ ID NO: 54187 - DNA, 1860 bp, Artificial Sequence
  Description of Artificial Sequence: Synthetic coding sequence
atgctgctctcttggcttaccgtcctgggagccggtatggtggtcctgcactttctgcaaaagctgcttttcccatatttctgggacgacttctggttcgtgctcaaagtggttcttatcatcatacggcttaagaagtacgagaaaagaggggagttggtgactgtcttggacaagtttctgtcacatgccaaacggcaacctcgcaagccctttatcatttatgagggggacatttacacataccaggatgtagataagcgttcttcacgggtggcccacgtttttctgaaccactcatctctgaaaaaaggcgacaccgtcgccctgctgatgagcaatgaacccgacttcgtccacgtctggttcggcctggcaaagctaggatgtgtcgtcgcgtttctgaacacaaacataaggtccaacagcctgttaaactgtattcgcgcatgcgggccaagagccctggtcgtgggggcagatctcctgggtaccgtggaggaaattttgccaagtctgtccgaaaacatttccgtctggggcatgaaggatagcgtcccccaaggtgttatcagtctgaaagagaaactgagtacttcaccagacgaaccggttcccaggtcccaccacgtggtatcacttctcaaatccacttgcctttacattttcactagcgggactaccgggctcccaaaggcagccgtgatttcccaactgcaggtgctccggggaagcgccgtcttatgggctttcggatgcaccgcccacgacatcgtctacatcacactgccactgtatcattcatctgccgcaattctcggtatctctgggtgtgttgagttgggagccacatgcgtacttaaaaaaaagttctcagcttcccaattttggtcagattgtaaaaagtatgatgtaacggtgttccaatacattggggagttgtgcaggtacctctgtaagcagtccaagcgcgaaggcgagaaggaccataaagttagactggctatcggcaacgggatacgaagtgatgtgtggcgagagttcctggataggttcgggaacatcaaagtctgtgaactgtatgccgctaccgagagcagtatctcttttatgaactacacagggcgtatcggggctataggcaggaccaatttattttataagctgcttagtactttcgacctcatcaagtacgactttcagaaggatgagccaatgaggaacgagcagggctggtgcatccacgtcaagaaaggcgagcccggtctgcttatttctcgtgtaaatgcaaaaaatccttttttcggctacgccggaccctacaagcatactaaagacaagctcttgtgcgacgtgtttaaaaagggcgatgtgtacctgaatacaggagacctgatcgtccaagatcaggataacttcctgtatttttgggacaggacaggcgatactttccggtggaaaggtgagaacgttgccactacagaagtcgctgatgtgattgggatgcttgattttatccaggaagctaacgtgtatggcgtcgccatatcaggttacgagggacgcgctggtatggccagtattatacttaaacctaatacatctctggaccttgaaaaagtctacgaacaagtagtaacattccttcccgcatacgcatgtccaagattcctgcggatccaagaaaagatggaggctaccggaaccttcaaattgctcaaacaccaactagtggaagatgggttcaatccactgaagatatcagagcctctgtacttcatggataacctaaaaaaatcatatgtccttctgactcgcgagctatacgaccagatcatgcttggtgagatcaaactttag

SEQ ID NO: 54188 - DNA, 1860 bp, Artificial Sequence
  Description of Artificial Sequence: Synthetic coding sequence
atgctcctttcctggttgaccgtgcttggtgctgggatggtggtactgcactttttgcagaaactgttgttcccatatttttgggacgacttttggttcgtcctgaaagtcgttctaatcatcatacgactgaagaaatatgagaagcgaggtgagctggttactgttctagataagttcctcagccatgccaagcgccagcccaggaaaccctttattatttatgagggcgacatatacacataccaagacgtcgataaacgtagctccagggtggcccatgtgtttctcaaccactcaagcctaaaaaagggagacactgtggccctattaatgtcgaacgagccagatttcgtgcacgtgtggtttggcctggcgaaactgggttgcgtggtcgcttttttgaacactaatatccggtccaattcactcctcaactgtatccgggcttgtggcccacgcgctttggttgtgggagctgaccttctcggaacagtcgaggagatactgcctagtttgtctgaaaacatcagcgtgtggggcatgaaggattcagtgccacagggagtcattagtctcaaggagaagctcagtacatctcctgacgaacccgtgccgaggtcccaccatgttgtctctctgctgaagtcaacatgcctgtatattttcacgagcggaacaacaggcctgcccaaagccgcagtcataagccagctgcaggttctgcgaggttctgccgtgttgtgggccttcggatgtaccgctcacgacatagtttacatcacactccctttataccactcgagtgccgcaattttaggaataagtggttgtgtagagttgggagccacatgtgtgcttaaaaaaaaattttctgcttctcaattctggtccgattgtaaaaagtacgatgttactgtgtttcagtacatcggagaactctgcaggtatctgtgtaagcagtccaaaagagagggcgaaaaggaccacaaggtgcgtttggcaattggaaatgggatccggagtgatgtgtggagggagttcctggatcggtttggtaacataaaggtgtgcgaactgtacgccgctaccgaaagctctatcagtttcatgaattacactggtagaataggtgccatcggaaggacgaacctgttctacaagctcctcagcacttttgatttgatcaaatacgattttcaaaaggacgagcccatgaggaacgaacagggatggtgcatccacgtaaaaaagggggaaccgggattgctgatttccagggtcaatgcgaagaaccccttctttggttatgccggaccttacaaacacaccaaggacaaactgctgtgcgatgttttcaagaagggagacgtctacctgaatacgggagatctgattgtgcaggatcaggacaactttctgtacttttgggaccggactggcgatacatttcgttggaaaggcgaaaacgtggcgaccaccgaggtggctgacgtgattggcatgctggacttcatccaggaggccaacgtgtacggagtcgccatctcgggttacgaagggcgtgctggcatggcatctattatcctgaagccgaatacctccctggacctggaaaaagtgtacgagcaggtcgtaacctttctgcctgcctacgcctgccctaggtttctccgaattcaggagaaaatggaagcaaccggcacattcaagttgctcaagcatcaattggtggaggatgggtttaaccctctgaaaatttctgagcctctctattttatggataacctgaagaagagctatgttctgttgacccgggagttgtacgatcaaatcatgctgggagaaattaagctctag

SEQ ID NO: 54189 - DNA, 1860 bp, Artificial Sequence
  Description of Artificial Sequence: Synthetic coding sequence
atgctcctgtcctggctcacagtgctgggggcaggcatggttgtgctgcactttctacagaagctcctttttccttatttttgggatgacttctggttcgtcctgaaagtggtgcttatcattattcgcctcaaaaagtacgagaaacggggagagttagtaactgttctcgacaagttcctaagccacgcaaaaaggcagccacgcaagccctttatcatttatgagggagacatatacacttatcaggatgtggacaaacggtcatcacgcgtcgcacacgtatttctgaatcactcctctctcaagaaaggagacacagttgctttactgatgtccaacgaacccgactttgttcacgtctggttcgggctggcgaagcttgggtgcgtagtcgctttcctgaacaccaacattcgaagcaactccctgttgaactgtataagggcttgcggccctcgagcactggtggttggcgcagatctgctgggaaccgtcgaagagatcttgccttcattaagcgagaacatcagcgtgtggggaatgaaggactcagtgccccagggtgtcatttccctgaaagagaagctgtccacatccccagacgaacctgttccccgaagccatcacgtggtttccctgctaaagtctacttgcctgtacatatttaccagtggaacgaccgggttacccaaggcggctgtcatctcacaactgcaagtgttaaggggtagtgccgtactctgggcctttggctgcaccgcacacgatatcgtctacataacacttcccctctatcactcgagtgccgcaattcttgggatttcagggtgcgtagagctcggagctacgtgtgtcctgaaaaagaagttttctgcctctcaattctggagcgactgcaagaagtacgatgtcactgtatttcagtacatcggcgaactatgtcggtatctctgcaaacagtctaagcgcgagggagaaaaagaccacaaagtgaggttggccattggcaacggcattcgtagcgatgtttggcgggaattcctggacaggttcgggaatatcaaagtttgcgagctctacgcagccactgagtcatccatctcattcatgaactatacaggacgcattggtgccattgggaggactaatctgttttacaagctcctgtccaccttcgatcttattaagtatgatttccagaaggacgagcctatgagaaatgaacaggggtggtgcatccacgtgaagaagggagagcctggactgttgatctcaagggtaaatgctaaaaatcccttcttcgggtatgctggaccatataaacatacaaaagacaagctgctgtgcgacgtgttcaaaaaaggggacgtttatttaaacactggagaccttatagtgcaagatcaagacaacttcctgtatttctgggatcgaacaggagacacattccggtggaagggggagaatgttgccactacggaagttgcagatgttatcggaatgctcgacttcattcaggaagccaacgtgtatggcgtcgccatctcagggtacgagggacgagccggaatggcgagcattattttaaagcccaataccagcctggatctggagaaagtatatgaacaggtcgtcacattcctacctgcatacgcatgtcccaggttcctgcgcatccaagaaaaaatggaggccaccggcactttcaaactgctcaagcaccaactagttgaggacggttttaaccccttaaagatttctgagcccttgtatttcatggacaacctaaagaaatcttacgtactgttgaccagggagctgtatgatcaaataatgctgggggaaattaagctttag

SEQ ID NO: 54190 - DNA, 1593 bp, Artificial Sequence
  Description of Artificial Sequence: Synthetic coding sequence
atggggagtgtggggtcacagcggcttgaagagccgagcgttgccggaaccccagatccaggcgtcgtcatgagtttcacttttgatagtcatcagctggaagaagccgctgaggcagctcagggacaggggctgcgcgctcggggtgtgcctgcctttaccgacaccacccttgatgagcctgttcccgacgatcggtaccacgccatttacttcgcaatgcttttggccggtgttggttttctgcttccttacaacagtttcatcacagacgtggattacttgcatcacaaatacccaggcacaagtatcgtctttgacatgtcccttacttatatactggtagcccttgctgccgttctgctgaataatgttctggtagaacgtctgactcttcacacccgaattacagccggatatcttttagctctgggccctctgctgtttatctccatttgcgatgtttggctgcagctgttctcacgagaccaggcctacgcaattaacctggctgctgtgggcaccgtagcatttgggtgtactgtccagcagtcatctttttatggttacacaggcatgctgccgaagcgctatacccagggagtgatgaccggggaaagtaccgccggtgtaatgatcagccttagcagaattctcacgaagttgctgctccctgacgagcgcgcaagcaccctgatcttttttctggtctctgtggccctggaactgctgtgcttcctcctgcacctgttggtccgcaggtccagatttgttctcttttacactaccagacccagagactctcacagggggcgtcccggactgggaagaggatatggctatcgggtgcatcatgacgttgtggcgggagatgtgcatttcgagcatcctgcccctgccctggcccctaacgagagccctaaggattcccccgcacacgaggtaaccgggtccggtggtgcctatatgaggttcgatgtacccagaccgagggtacagcggagttggccaacttttcgagcactgctgctccacaggtacgtcgtggcccgagtaatctgggctgatatgctttcgattgctgtgacctacttcatcactctttgtcttttcccgggtctggagagcgaaattaggcattgtatcctaggagagtggctgcctattctcattatggccgtgttcaatctgtctgatttcgtgggtaagatcctagccgctctaccagtggactggcgtggcacacacctgctggcttgttcttgtcttcgcgtggtttttatccccctgtttatcctgtgtgtgtaccccagtggtatgcctgctctcaggcatccggcatggccctgcatcttctcgctgctgatggggatttcaaatggctatttcggttctgtgcccatgatcctagcggcaggcaaggttagcccgaagcagcgcgaacttgctggaaatacaatgaccgtgagttatatgtcaggactgaccctgggaagcgcagtcgcatattgtacctactctcttacccgggacgcacacgggagctgtctgcacgcctccactgcgaacggatctatattggccggactctag

SEQ ID NO: 54191 - DNA, 1593 bp, Artificial Sequence
  Description of Artificial Sequence: Synthetic coding sequence
atggggagcgtcgggtcccagcgcctcgaagagccaagcgtggcgggaacacccgaccccggtgtagtgatgtcctttaccttcgatagccaccagctggaggaggccgcagaggctgcacaggggcaaggcctgcgcgcaaggggagttccagctttcaccgacacaactctcgacgaacccgtgcctgatgatcgctaccatgctatctactttgctatgttgctggctggggtaggtttcctcctgccatataacagtttcattacggatgttgattacctccaccataagtatcctggcacttccatcgtttttgatatgtccctgacatatattctggtggcattggccgcagtcctgctcaataacgttctggttgagagactgacactccacacccgcatcactgctggttatctcctcgcactggggccacttctttttatatccatctgcgacgtttggctgcagttgttcagccgggaccaggcctatgctatcaaccttgctgcggtgggcaccgtggccttcgggtgcacggtgcaacagagttctttctacggctatacaggtatgcttcccaaaagatatactcagggcgtgatgacaggcgagtcaaccgctggcgtaatgatatccttgtccagaattctgaccaaattacttttaccagatgagcgcgcttcaacactaatcttcttcctggtgtcagtagccttagagctcctgtgctttctgctccatttacttgttaggagatcccggtttgtgctattttacaccaccaggcctagggactctcataggggccgtccaggactcggcaggggttacggctaccgcgtgcaccacgacgtggttgccggtgacgtgcatttcgaacaccccgctcccgctttggcccctaatgagagcccaaaggattcacctgcccatgaggtgacgggtagtgggggagcctacatgcgcttcgatgtccctcgacctcgagtccagaggtcctggcctacgttccgcgcactgctgctgcaccgatacgtggtggccagagtgatctgggctgatatgttgagcattgcggtcacttactttatcacactatgtctgttccctgggctggaatcagagatcaggcactgcattctcggggagtggctgccaatacttattatggccgtgtttaacttaagcgattttgtggggaaaatcctggctgccctgccagttgattggagaggaacccaccttctggcatgtagttgtttgcgcgtggtttttattcccctgtttatcctctgtgtctacccttccggtatgcccgctctcagacaccctgcttggccctgcatcttctccctcctcatgggcatctctaatggatatttcggatccgtcccgatgattctggcggcaggcaaagtgagtccaaagcagagagagctcgctggaaatacaatgactgttagttacatgagcggcctgactctcggcagcgctgtcgcatactgtacctatagcctgacgcgagacgcccatggctcctgtcttcacgccagtaccgcaaatggcagcatactggctggcctgtag

SEQ ID NO: 54192 - DNA, 492 bp, Artificial Sequence
  Description of Artificial Sequence: Synthetic coding sequence
atgggctccgtaggatcgcagcggctggaggagccatctgtcgctggcacccctgaccctggggttgttatgtccttcacgttcgatagccatcagctcgaggaagctgccgaggctgctcaagggcaggggctccgcgctagaggggtaccggcatttactgacaccacgctcgatgaaccagttcccgatgatcggtaccacgcaatctattttgccatgcttctggccggagtaggtttccttctcccctataactcttttattacagatgtagattatctgcaccataagtatccagggacttctattgtgttcgacatgtctctcacgtatattttagtcgcgctggctgccgtgttgctgaacaacgttttggtggagcgcctgaccttacacactcggataacagcaggttacctgttagccctcggacctttgctgtttatttctatatgtgacgtgtggcttcagttgtttagcagggactag

SEQ ID NO: 54193 - DNA, 1707 bp, Artificial Sequence
  Description of Artificial Sequence: Synthetic coding sequence
atgttaccagggctggccgcagctgcagcccatcggtgttcatggagttctctttgtagactgagacttagatgtcgtgctgcagcctgcaatccttcagatcgccaggagtggcagaacctcgtgacctttgggagcttctccaacatggtcccctgctctcacccctacatcggcaccttaagccaggtcaaactttatagcacaaacgtgcagaaggaagggcaaggctcacagacgcttagagtagagaaagtaccctccttcgaaacggcagaaggtataggcactgaactaaaggccccactgaaacaagagccccttcaggtgagggttaaggcagtgttgaagaaacgggaatatggctccaaatatacacagaataattttattacgggagtgcgggcaattaatgaattttgtctcaaatcgtcagacctcgaacagttacgaaagataagaaggaggagtcctcatgaggacacagagtccttcaccgtatacctgcgctccgatgttgaggctaaatccctcgaagtctggggctcacctgaggcgctcgccagagagaaaaaactgaggaaagaggctgagatcgagtatagggagaggctgttccgaaatcaaaagattctccgcgagtatagagacttcttgggaaacacaaagcccagaagccgaaccgcttccgtgttcttcaaagggccaggcaaagttgtgatggtggcaatttgtatcaatgggctgaattgcttctttaaattcctggcctggatctacaccgggtcagcctccatgttttccgaggcaatccactccctctctgatacctgtaaccaggggctgctggctttaggaatttcaaaatcagtacaaactcccgatccaagccacccctatggtttttctaacatgcggtacattagcagtcttatttccggtgtcggcatcttcatgatgggcgcaggactcagctggtaccacggggtcatgggcctgttgcatcctcagcccattgagtcccttctgtgggcttactgtatactggcagggagcctggtaagcgaaggcgcaaccctcctggtcgccgtcaatgagctgcgcaggaacgccagagctaaggggatgagcttttacaagtacgttatggaatccagggacccttccactaacgtgatcctcctcgaggatactgctgcagtactcggagtgatcattgctgctacctgcatgggactgacgtcgattaccgggaatcctctgtacgactcactcgggtctctgggggtgggtacattactcggcatggtaagcgcctttcttatctatacgaacacagaggctctgctcggcagaagtatccagcctgagcaggtgcagagacttaccgaactgctggaaaacgacccatcagtccgggctatccacgacgtaaaagctaccgatctggggttaggtaaggtgcgctttaaggccgaggtcgactttgatggtagggttgtgacgcggtcttatcttgaaaagcaggattttgatcagatgctgcaggagatccaggaggtgaaaactcctgaagagctggagaccttcatgctcaaacatggggagaatataattgatacgctgggcgctgaagtggacaggctggaaaaggaactgaaaaagagaaaccctgaggtgaggcacgttgatctggaaatcctgtag

SEQ ID NO: 54194 - DNA, 1191 bp, Artificial Sequence
  Description of Artificial Sequence: Synthetic coding sequence
atgtggaaacaaaatctctggaagttcggtgaggcactgaaactgctgcccgagaaaaaactgcgcaaagaagcagagatcgaatatagggagcgcctctttcgcaaccaaaagattttacgtgaatatagggatttcctggggaataccaagcctagatctcggaccgccagtgtcttttttaagggccctggaaaggtcgtgatggtcgcaatctgtattaacgggctcaactgcttcttcaagtttctagcatggatttacactgggagcgccagtatgttttccgaagccatccattccctgtctgacacatgcaaccagggcctcctcgccctggggatttccaaatcggtccaaactccagatcccagtcacccctacggtttctctaacatgagatacatttcaagtctcatcagcggagtcggtatcttcatgatgggagccggactgtcatggtaccacggggtaatgggcctgttacatccacagcccatcgagtccctactatgggcatactgtatcttagctggttctttggtatcggaaggtgccaccctgctggtggcagtgaacgaactcaggcggaacgctagggcaaaaggcatgtccttttataagtacgtcatggagtccagggatccgtctacaaacgttatcctgctggaggatacagctgctgtcctgggcgttattatcgccgcaacatgcatgggactgacctcaatcaccggtaaccctctgtacgatagcctgggaagtcttggcgtggggactcttttgggcatggttagcgcatttctgatctacactaatactgaggcgcttttgggacggagcattcagcctgaacaggtgcaacgcctgacagagctcctggaaaacgatccctctgttcgtgccatccacgatgtaaaagccacagacctgggtcttggcaaggtgcggttcaaagctgaggtggactttgacgggcgtgtggtaacccgctcctatctggaaaagcaggatttcgaccagatgttacaggaaattcaggaggttaaaacacccgaagagttggaaacgttcatgcttaaacatggggagaacataatcgacactctgggggcagaggtggatcgactagagaaggagttgaaaaaacgcaatcccgaagtgcggcatgtggatctagaaattctgtag

SEQ ID NO: 54195 - DNA, 1446 bp, Artificial Sequence
  Description of Artificial Sequence: Synthetic coding sequence
atgggagcgttggcccgagcattgccatcaattttgttagccctgctcctgacttccaccccggaggctctcggcgcaaacccgggactcgtcgctcggattaccgacaaggggctgcagtatgccgctcaggagggccttctggctctacagtccgaactcctgcggattactctacccgatttcacaggcgacctccgtatcccccacgttggcagagggagatatgaatttcattcgctgaacattcactcctgtgaactcctccattcagcactgcgtccagtgccaggacaggggttgtccctgagcatctcagacagcagcattcgtgttcaggggagatggaaggtcagaaagtcatttttcaagctgcaaggctccttcgacgtgtcagtcaaaggcatatccatatccgtaaatctattactcggatcagagtccagcggaagacctaccgttacagcctcaagttgctcctcagatatcgctgacgtggaggtggacatgtctggggacctcgggtggttattgaatctgttccataaccagatcgagtccaagttccaaaaagtcctggagagccgcatctgcgagatgatccagaagtcagtctccagcgatctgcagccatatctgcagacacttccagtgactacagagattgactcttttgctgacatcgactatagtctcgttgaggcacctagggccacggcacaaatgctggaagtgatgttcaaaggggagattttccatcgcaaccaccggagtccagtgaccttgctcgctgcagtgatgtcattgcctgaagagcacaacaagatggtctatttcgcaatttcagattacgtttttaataccgcctctctggtgtaccacgaggagggctaccttaactttagtatcactgatgatatgattccaccggattctaacattagacttacaaccaaaagttttcgacctttcgttcctagattggcgaggctgtaccccaacatgaacctcgaactccagggcagtgtgccaagcgctccactgctcaacttctccccagggaatctgagcgtggatccatacatggaaatcgatgccttcgtcctccttccatcatcctcgaaggaacccgtatttaggttgagcgtcgctaccaacgtgtccgctaccctgactttcaatacctccaagataaccggttttctgaagccaggtaaagtcaaagtcgaattaaaggagtccaaagtgggactctttaacgctgagcttctcgaggccctgcttaattactatattttgaatacgttctatccaaaatttaatgacaaactggcggaaggatttccactgcccctgctcaaacgggtgcagctttatgatcttgggctgcagatccacaaagactttcttttcctgggggctaacgtgcagtatatgcgcgtttag

SEQ ID NO: 54196 - DNA, 1233 bp, Artificial Sequence
  Description of Artificial Sequence: Synthetic coding sequence
atggccgctgctgcagtgggggctggccacggagccggtggtcccggagcagccagctcgtctggcggtgccagagagggtgcgcgagttgcagccctttgtcttctctggtacgcactcagcgccggtgggaacgtggtcaacaaggtgatcttaagcgcattcccgttccccgtcactgtgtctctttgccacatcttggccttgtgcgccggtctcccaccattgctgcgggcttggcgagtcccgccagcccctcccgtgtccggcccaggcccaagcccccacccctcaagtggaccattgttacccccacggttctaccccagatacgtgttgccgcttgccttcgggaagtactttgcaagcgtcagcgcacatgtttctatctggaaagtgccagtctcctacgcccatactgtgaaggccactatgccaatttgggtggtgctcctgagccgaataattatgaaggagaaacagtctacaaaagtttatctgtcgctgatacccataatatccggcgtactcttggccacggtcaccgaactgtcctttgacatgtggggcctggtatctgccctcgctgccacactttgtttcagtctgcagaacatcttcagcaagaaagtgcttagagacagtcggatccaccatctcagactgttgaacatcctgggttgccacgcagtctttttcatgattcctacctgggtccttgtcgatttgagtgcattccttgtttcgagtgacctgacatatgtgtaccagtggccctggacccttctgctccttgcagtgtctggattttgtaatttcgcacaaaacgtgattgcctttagtatcctgaatctcgtttcgcccctatcctattctgtggccaatgccacaaagcgcatcatggtaatcacagtttcacttattatgctgagaaaccccgtgacaagcacaaacgtgctgggaatgatgactgccatcctcggtgtgtttctctataataaaaccaagtacgatgctaaccaacaggcccgaaaacacctcctgcccgtcacaacggctgatctgtctagcaaggagaggcacagatccccactggagaagccccacaacgggcttctgttcccacagcatggggattatcaatacggccgtaacaatatcttgacagatcacttccagtatagtagacagtcttatcctaattcatatagcctcaatcgatacgacgtctag

SEQ ID NO: 54197 - DNA, 1458 bp, Artificial Sequence
  Description of Artificial Sequence: Synthetic coding sequence
atggatgtgaaggccgctccaaacggcgttgcaacaatcgaagacaggatcctccgcatcacgggctactacgggtattaccccggttatagctcacagaagagtacttcccggtctagcgtgacccgttgcaaacctggcgcaaactgcccctcctcccattctggcatatcacgccagttaagtccattatccgtgaccgaggatagttccgccccaatcttagagctccagaaccaagggtcctcaggtgtgtgtgggcacagggtggagcggcagaaccgctctgcagatgacggcacccagactcattctgaaaactctagccaggagaatagaattaaggctaggtgcctatcctgtacgagcatggtgctgaaaggtatatggggactgctgattatcctgtctgtctcctcgtcgtgggttggtactactcagatagtcaagataacgtacaaaaacttttactgcccttttttcatgacctggtttagtactaactggaatataatgttttttcccgtatattattctggtcaccttgcgaccgcacaagagaagcagtctccaatgaagaaattcagagagtgttcacgaatttttggcgaggatggcttaactctgaagctgttcctcaaacgcactgcgccatttagtattctgtggactctcaccaattacctgtatctgttagctctgaagaagctgaccgcgaccgacgtgtcagctctattctgctgtaacaaagctttcgttttcttgctgtcgtggatcgttctgaaagacagattcatgggggtacgcatcgtcgcagccatcatggcaatcactggaatcgttatgatggcctacgcggataattttcatgcagactctataatcggcgtggccttcgccgtcggcagcgctagtacttccgccctctacaaggtgctgttcaagatgtttcttggcagcgccaatttcggagaggcagcccacttcgtcagtaccctgggtttttttaacctgatttttatcagtttcactcccgtcatcctctatttcactaaagttgagcactggagctctttcgctgctttgccatggggttgtctctgtgggatggccggactgtggctggcttttaacatcctggtgaatgtaggggtcgtgctgacatacccaatcctgattagtattgggaccgttctcagcgtccctgggaatgcggcagtcgatctactcaagcaggaggtgatatttaatgtggtgcggttggccgctacgattatcatttgtattggatttctcctgatgctgttgcctgaggagtgggacgagattactctgaggttcattaatagcctcaaggaaaagaaatctgaagagcacgttgacgatgtgactgatccttcgatccacttgagaggcagaggcagggcaaatggcaccgtttccattcctctcgcatag

SEQ ID NO: 54198 - DNA, 975 bp, Artificial Sequence
  Description of Artificial Sequence: Synthetic coding sequence
atgtccgtggaggatggtggcatgcccggactcgggaggccaaggcaggctcggtggacgttaatgctcctgctgtcaaccgccatgtacggcgcacatgcccctttgcttgccttatgtcatgtggacggcagggtgccgtttcggccttcgtcagctgttctgctgaccgagttgacaaaattgttactgtgcgcttttagcctgttagtgggatggcaggcttggcctcagggtccccctccatggcgccaggctgccccttttgccctcagcgctctcttgtacggtgctaacaataacctagtgatttatttacagcgctacatggaccctagcacttaccaagtgttaagcaacttgaagatcgggtctacagccgtgctgtattgcctgtgtcttagacaccgtttaagcgttcgccagggactggcactgctgttgctgatggccgctggcgcttgttatgctgctggcggtctacaagtgcccggtaataccctgcctagtcctcctcccgctgcagctgccagtccaatgccacttcacatcacccccctcggactgctgttactcattctatactgtctgatcagtgggctgagctcggtgtacaccgagttgctgatgaagagacagagactgcctctggcccttcagaatctttttctctacacatttggggtcctcctgaatctgggcttgcacgcaggaggcggaagtggaccagggctgctggaaggcttcagtggatgggctgcgctggtggttctgagtcaggccctaaacggactgctgatgtctgccgtgatgaaacatggcagttcaatcactaggctgttcgtggtgtcctgcagcctcgtcgtgaatgcggtgctctctgccgtccttctgagactccagcttaccgctgctttttttcttgcgacattgctcattggtctggctatgcgcctttactacggatccagatag

SEQ ID NO: 54199 - DNA, 537 bp, Artificial Sequence
  Description of Artificial Sequence: Synthetic coding sequence
atgccactgattctcagtattctgtcaggaaacgtccctagactgttgctccctggctcatggctgcacaaccttatcttccctaagcgggttgcaattcccgcagctccagggactagcgagcctctgccgcttcacttttggtgtgcttccgaatcccgctcggcctgctggcgcaggctgtggcccaggcctccgggacggtttctgcggatggggagcacacggggtgccgagccgggaacaaaatggactgcacacgtgtgctgtcacgaagcttggcagcaacaccatactcccctgtgcggagtgcttcttgctggaggacaacgccgtgctttatcctcccctgccaccgcagccgcacattctagattgcttcccggacacattgcacactggccaggtcatgcgccagtgctctggcagcccctcgtccctgataacttccaccctgatagtggaccttgccggttgggcgctacaacccggagcccctcccaggcatttttgccgctgccgtcagccgcattatag

SEQ ID NO: 54200 - DNA, 975 bp, Artificial Sequence
  Description of Artificial Sequence: Synthetic coding sequence
atgtctgtcgaagacggcggaatgcccggactcgggagacccagacaggcaaggtggacccttatgctgctgctttctactgcaatgtatggagcccatgccccattgttggccctgtgtcacgtggacggcagggtaccctttagaccaagtagcgcagtcctgctgaccgagttaaccaaattgctgctgtgcgccttcagtcttttagtgggatggcaggcatggcctcagggcccacctccttggcggcaggctgcaccttttgctctcagtgccctgctttatggcgcaaacaacaacttggtcatctacttgcaacgctatatggatcccagcacttaccaggtactctccaaccttaagataggtagtacggcggtgctctattgtctttgtctcagacatagactgagcgtgcgacagggcctggcactactgttactgatggcagcaggcgcttgttacgccgctggaggtttgcaagtgccgggtaacactctcccttctccaccgcctgcagcagccgcttcacctatgcctctgcatataacccctctgggcttactgctgctgatcttatattgcttaatatctggcctctcctcagtgtacaccgagttgctgatgaaacgacagagactccccctcgctctccagaatttgtttctgtacacattcggcgtgcttctcaacctcggcttgcacgccggaggagggtcgggccctgggctgcttgagggattcagtggttgggctgcattggtggtcttatctcaagctttaaacgggttgttgatgagtgccgtcatgaagcacggctcttcgatcacgcgtctgtttgtggtgtcatgttccctggtagtgaacgccgtgctgagcgcagtgctgctcagactccagctaactgccgcttttttcctggcaacattgctgattgggctcgctatgagattgtattatggttccaggtag

SEQ ID NO: 54201 - DNA, 267 bp, Artificial Sequence
  Description of Artificial Sequence: Synthetic coding sequence
atggagaaacagtgctgctcccaccccgttatctgttctctgagtacaatgtatacgtttttgcttggcgctatctttatcgccttgagcagctcacgaattctgttagtgaaatactccgcgaatgaagagaacaagtacgactacttgcctacaacagtgaatgtctgctcagaattagtcaagttagtgttctgcgtgctagtatcattttgcgtgatcaaaaaggatcaccagagtcggaacctgaagtacgctagttggtag

SEQ ID NO: 54202 - DNA, 444 bp, Artificial Sequence
  Description of Artificial Sequence: Synthetic coding sequence
atggaaaagcagtgttgcagccaccctgtgatttgctcactgagcaccatgtacacctttctgctgggggcaattttcatagctctctcatcaagtcgaattctattagtgaaatacagcgccaatgaagagaacaagtatgactatctgccaaccacagtcaatgtctgctcagagcttgttaaactcgtcttctgcgtgttggtcagcttctgcgtgatcaaaaaggaccaccagagtcgaaacctgaaatacgctagctggaaagagttctctgacttcatgaaatggagcatccctgcatttttgtactttcttgacaatctcatcgtcttctacgtactctcctacctgcagccggcaatggctgtgatcttttccaacttttctatcatcacgacagctctcctcttccggattgtgctaaaaaggagacttaactag

SEQ ID NO: 54203 - DNA, 1275 bp, Artificial Sequence
  Description of Artificial Sequence: Synthetic coding sequence
atggagaaacagtgctgttcacacccggttatctgcagtctgagtactatgtatacttttttgctcggggctatattcatcgctcttagctcctccagaattttgctggttaaatactccgctaatgaagaaaataagtatgattacctgccaacaaccgtgaacgtttgttctgaactggtaaagctggttttctgcgtactggtgagcttctgtgtgatcaaaaaggatcatcaatccagaaatcttaaatatgccagctggaaggaattttctgatttcatgaaatggtctatccccgcattcttatattttctcgataacctgatcgtgttttatgtcctgtcctacttacagcctgctatggccgtgatctttagtaacttttcgatcattaccactgcgctgctgtttcgtatcgtcctaaaaagacgcctcaattggatccagtgggcatccctgcttacactattcctctctattgttgccctgactgccggaactaagacactgcagcacaacctagccggtcgcggatttcaccatgacgcgtttttctctccctccaacagctgtttgctcttcaggagtgaatgccctcggaaggacaattgcactgccaaagaatggaccttccctgaggccaaatggaataccactgccagggtctttagccacattagattagggatgggtcacgtcctaataatcgtgcagtgcttcatatcaagcatggccaacatatacaacgagaagatcttgaaagagggcaatcagctcacagagagtatcttcatccaaaattcaaagctgtacttttttggcattctttttaatggtttaacccttggattacagaggtctaatcgggatcaaataaaaaattgtggatttttttatgggcacagcgctttcagcgtggctctgatcttcgtcaccgccttccagggactgtcagttgcattcatacttaagttcctggataatatgtttcatgtacttatggcacaagtaactactgttatcatcactacggtctctgtcctggtcttcgattttaggccatccctagagttcttcctagaggcaccctccgtactgttgtctatttttatttacaacgccagcaaaccacaggtgcccgaatatgctccacgtcaggagagaattagagatctgtctggaaatctttgggaacggagcagtggcgacggcgaggaattggagcggctaaccaagcccaaatccgacgagtccgacgaggatacattctag

SEQ ID NO: 54204 - DNA, 1098 bp, Artificial Sequence
  Description of Artificial Sequence: Synthetic coding sequence
atggggcgttgggctctggatgtggcttttctgtggaaggccgtgcttacgctcggattggttctgctttactactgtttctctattggcattactttctataataagtggttgaccaaatcctttcacttccctctcttcatgacaatgcttcacctcgctgttatatttctgttctctgccctctccagagccctggtacagtgtagttcccatcgcgctcgagtggttctgtcttgggccgattacctccggcgagtggctccaacagccctagccactgcattggacgtgggactatccaattggagctttttgtatgtgactgtgagtctgtacacaatgactaagtccagcgccgtgctgtttatcctgatatttagccttatcttcaagttggaagagctgagagctgcactggtcctggtagtattgctcatcgcaggaggcctgttcatgtttacctacaaatcaacacagtttaatgtggaggggtttgcgcttgtgttaggagcaagttttatcggcggaatccgctggaccttaacgcaaatgttgctgcagaaggcagagttagggctccaaaatcctattgacactatgtttcacctccaacctctcatgtttctcggcctcttccctttatttgcagtattcgaaggactgcacctgagcacctctgaaaaaatttttcggttccaggataccggcctgttgctccgcgtcctggggtcactttttctcggaggcatactggccttcgggcttggattcagcgagttcttgctggtgtcccggaccagctcattgaccctgtccattgctggcatttttaaggaggtctgtaccctgctgctcgctgcccacctcctgggagatcaaatctcgctcctgaactggctcggttttgccctctgtctaagtggaatatcactccatgtggccttaaaggcccttcactcgaggggcgatggaggccctaaagcactcaaaggcctgggcagtagccctgacctagagcttttgctccggtcctcacagcgggaggagggagacaacgaagaggaagagtactttgtcgctcaaggccagcagtag

SEQ ID NO: 54205 - DNA, 1035 bp, Artificial Sequence
  Description of Artificial Sequence: Synthetic coding sequence
atggggcgatgggcactcgatgtggcattcctgtggaaagccgtgttaacccttgggttggtgctgctgtactattgctttagtattggcattactttttacaacaaatggctgacaaaaagctttcattttcctctgtttatgaccatgctgcatctagctgtgattttcctgttctccgctttgtctagggccctggtccaatgttcaagccatcgggctcgagttgtgctaagctgggctgattacctgagacgagtggccccaaccgccctggcaaccgctctagatgtgggcctatccaattggtcctttctgtatgtgacagtgtcgttatacaccatgaccaagagcagcgcggtccttttcatcttgattttttccctgatcttcaaacttgaagaactgtctacccaattcaatgtggaaggcttcgcactggtactgggtgcaagctttatcggcggaattcggtggactctgactcaaatgttgctgcagaaggccgaactgggcctccagaaccccatcgatacgatgttccatctacaacctcttatgttcctgggtctcttcccactttttgcagtctttgagggcctgcatctatctacttctgaaaagatctttcgcttccaggatacaggactgctgcttagggtgctcggctctctgttcctcgggggtatcttggctttcggcctgggcttttcggagtttctgctagtaagccggacctccagcttgaccttatcaatcgccggtattttcaaggaggtttgcactctcctgcttgccgcacatctactgggagaccagatttccctgctgaactggctgggattcgcactgtgcttaagcggcatatccctgcatgtggccctcaaggcactgcactccaggggcgacggcggaccaaaggccttaaagggactcggctcaagccctgatcttgagctattactccgatcgagtcagcgcgaggagggcgacaatgaggaagaagaatatttcgtcgcccaaggccagcagtag

SEQ ID NO: 54206 - DNA, 477 bp, Artificial Sequence
  Description of Artificial Sequence: Synthetic coding sequence
atgggccgatgggccctggatgtggccttcctctggaaagctgttctgacgctgggcctcgtactcttatattattgcttctcgattggcattactttctataacaagtggctgacaaaatcgttccattttccacttttcatgacaatgttacatttggccgtgatattcttattcagtgccctgtctcgcgctctggtccaatgtagctcgcaccgggcaagagtcgtgcttagttgggccgactacttacggagggtggctcctacagcccttgcaactgctctcgacgtgggactttcaaattggtcattcctgtacgtcactgtatctctggctcgtcactggtcttggtggagtagctcaagcccaggtgtgagctcatgtagcccaacaagtccacacagcagcacatggagagcttccccatggtgctggggcccacgatcctccgtcgctttcgccggacctagttag

SEQ ID NO: 54207 - DNA, 702 bp, Artificial Sequence
  Description of Artificial Sequence: Synthetic coding sequence
atggaattgaaaagggcggcactggtgttagtggtgttgctcatagccggaggactttttatgttcacatacaagagcacccagttcaacgtggagggatttgccctcgtgctaggagcgtcttttattgggggtatccgttggaccctcacccaaatgctccttcagaaagccgaactcgggttacagaatcccattgacacaatgttccatctgcagcccctgatgttcctgggcctattcccgctgtttgcagttttcgaaggactccatttgagtacttctgaaaagattttcagatttcaggatacaggtttgctgctccgggtcctgggttccctcttcctaggcggtatcctcgcctttggacttggatttagcgaattcctcctggtgtctcgcacttccagtttgaccttgtctatagcaggaatatttaaagaagtctgtactcttcttctggctgcacatcttttaggagatcagatctcgctgctgaattggcttgggtttgccctctgtctgtctggaatcagtctgcacgtggccctgaaggcacttcacagccggggagatgggggaccgaaggcactaaagggcctgggaagctcacccgatctggaactgctcttgagaagtagtcagcgtgaggaaggagacaacgaagaagaggaatactttgtggctcaggggcaacagtag

SEQ ID NO: 54208 - DNA, 1098 bp, Artificial Sequence
  Description of Artificial Sequence: Synthetic coding sequence
atggggaggtgggccctggacgtcgctttcctttggaaggctgtgctgaccctgggcctggtcttattgtattattgtttttctatcggaatcaccttctataacaaatggttgaccaaatccttccactttccactttttatgacaatgttacatctagccgtcatcttcctgttttcagctctgagtagagcccttgtccagtgttcttcccacagagcccgtgtggtgctttcatgggccgattatctcagacgggtagctccgactgccctggcgaccgcacttgatgtgggcttgtcaaactggagcttcctctacgtgaccgtctctctgtatacaatgacgaagtcctcggctgtgctgttcatccttatcttctccctgatctttaaattggaggagctgagagccgctctggtgctggtggtgcttctgatcgccggagggctgttcatgttcacttacaaaagtacccagtttaacgtggaggggttcgccctggtcttaggagcgtctttcattggagggatccgctggaccctaactcaaatgctgctgcagaaggctgagctggggctgcaaaatcctattgacaccatgttccatctccagccactgatgtttttgggacttttccccctgttcgcagtctttgaaggactgcacctctccaccagtgaaaaaatttttaggtttcaggatactggattactcctgcgcgttcttgggtctttgttcctcgggggaatcttggcctttggactgggattcagcgaattcctactggtgagccggacctcctcccttacattatccatcgccggaatattcaaagaagtgtgtacactgttactcgctgcacacctgctcggggatcaaatatctctgttaaattggctggggttcgctttgtgtctatccggcatatctctgcatgtcgccctgaaggcactgcatagtaggggagacggcggtcctaaggctttgaagggcctgggtagttctcctgacctggaacttctgctgagatcaagccagagagaggaaggcgacaacgaagaggaagagtattttgtagctcagggacagcagtag

SEQ ID NO: 54209 - DNA, 699 bp, Artificial Sequence
  Description of Artificial Sequence: Synthetic coding sequence
atggaactacgtgcagccctggtgctggtcgtgctcctaatcgcgggaggactgttcatgttcacctataagtctactcagtttaacgtcgaggggttcgcgctagttcttggcgcaagcttcattggtggaatacgatggacactgacgcagatgctgctgcagaaggctgagcttggactgcagaaccccatcgataccatgtttcatttgcagccgttgatgtttctggggttgttccccctcttcgctgttttcgagggcctccatctatcaacgtccgagaagatcttcagatttcaggataccggcctgctcctacgcgtgttaggatccctgtttcttggcggaatcttggctttcggtttagggttctctgagttcttactggtgtcgcggacctctagtttaaccctctctatcgctggtattttcaaggaagtatgcaccctgctgctggctgcgcatctgctgggtgaccagatcagtcttcttaactggcttggatttgccctgtgtctaagtggcatctcattgcacgtagctttgaaggccttacatagtcgcggagatggcggaccgaaggcgctaaaaggcctcggcagtagtccagatcttgagctactgcttcgcagttcacagcgtgaagaaggcgacaacgaagaagaggaatattttgtcgcccagggccagcagtag

SEQ ID NO: 54210 - DNA, 1098 bp, Artificial Sequence
  Description of Artificial Sequence: Synthetic coding sequence
atggggcgatgggcccttgatgttgcctttctatggaaagcagtcctgaccctcgggctggtcctgctctactactgcttctctattggcattactttttacaacaaatggcttaccaagtccttccattttcctctcttcatgacaatgttacacctggccgtcatcttcctcttttccgccttgagccgggcattggtccagtgtagcagccatcgggcacgagttgtgctctcttgggccgactacctgaggcgtgtggctcctaccgctctggcaacggctctggacgttggtctttccaactggtcttttctatacgtgacagtgtccttgtatacaatgacgaagagttcagccgtcctgtttatcctaatttttagcctgatctttaaattggaggagcttcgggcagccttagtgctcgtggttctgctcattgctggaggactgttcatgttcacatacaaaagtacacagtttaatgtggagggattcgcactggtcctgggcgctagctttataggcggtatccgctggaccttgacccagatgttactccagaaagccgagcttgggctgcagaatcctattgacaccatgttccatctccagcctctgatgttcttaggactgtttccgctgttcgcagtgttcgaaggccttcatctttccaccagtgaaaagatctttcgttttcaggatactggactgctgctgcgagtgctcgggtccctgtttttggggggtatcctcgcctttgggctcggattctccgaattccttctcgtaagtagaacgtcctctctgaccttaagcatcgccggaatcttcaaggaagtgtgcaccttactattagccgcacatctcctgggtgatcaaatttctttactcaattggctgggctttgccctgtgccttagcggcatcagcctccacgtggccctgaaggcactccactccagaggcgatggcggtcctaaagccttgaaagggcttggttcctcacccgatctggaactcttacttcgatcctcccaaagagaagagggagataatgaagaagaagagtacttcgtggcccaaggacagcaatag

SEQ ID NO: 54211 - DNA, 591 bp, Artificial Sequence
  Description of Artificial Sequence: Synthetic coding sequence
atgggcaggtgggccttagacgtggctttcctgtggaaggcagtactgaccctgggcctggtactcttgtattactgcttcagcattggcattacgttctacaataagtggctgactaaatcattccactttcccctgttcatgacgatgctgcacctggccgttatattcctgttcagcgcactcagcagagctctggttcagtgctcctcacaccgagcaagagtcgtcctcagttgggctgattatctgcgacgcgtggcaccaaccgcgcttgccacagccctggacgtcggcttgtccaactggagcttcctgtatgtgacagtctccctgccccattcctctacttggagggcttctccatggtgttggggccctcgatcaagtgtcgccttcgcaggtccatctcctagatgtagctgtcgtcgcctcaacagtgctagtcggattccctctacaccctgctccacgtgctcgcactcttgttcttgggggtctagcttatctctgttgtacttgaaagtttccatctgcccccacctgagaaagagcagcgtttcccgcacacaggggtgcagctgtggctag

SEQ ID NO: 54212 - DNA, 477 bp, Artificial Sequence
  Description of Artificial Sequence: Synthetic coding sequence
atgggccgatgggctctggacgttgctttcctttggaaggcggtactgacactggggctcgtcctcttatattactgcttctctatcgggattacgttttataataagtggctcactaaatcattccactttcctctgtttatgaccatgctgcatttggccgtgatcttcctgttttctgctttgagtcgtgccctcgtgcagtgttcaagtcaccgcgcacgagtcgtcttgtcctgggctgattatctccgccgtgttgcgcctaccgctctggccaccgctctcgatgtgggcctctctaattggagctttctatatgttacggtgagtctcgctcggcactggtcttggtggtcttcatcctctcctggagtgagcagttgcagccccacaagccctcattcctctacctggagggcctctccctggtgctggggtccacggagctcggttgcctttgccggtccaagctag

SEQ ID NO: 54213 - DNA, 1185 bp, Artificial Sequence
  Description of Artificial Sequence: Synthetic coding sequence
atgggcagggtcagcacgtcacatcagcccctccgcggagtccctgcccctgccgactctggcgcacccgtactgcagccccctcgcatgggacgatgggctctagatgttgccttcctgtggaaggccgttttaactcttggtctggtgctgctgtattattgtttctctatcgggataaccttttacaacaaatggctgaccaagtcattccattttccattgtttatgacaatgttgcaccttgctgttattttcctattcagcgcgctgtctagagccctggttcagtgctccagccaccgagctagggtggtactgtcatgggccgattacttgcgccgtgtggctcctacggccctcgcaacagcattggacgtgggcctgagcaactggtcgttcttatatgttactgtttccctgtacactatgaccaaatctagtgcggtcctcttcattttaattttttcactgatctttaagctcgaggaactccgcgcagctttagtcctggtggttcttctcattgcagggggtcttttcatgttcacgtataagagcacccagttcaatgtggagggtttcgccctggttctgggggcaagtttcatcggtggcatacggtggactctgacccagatgcttttgcagaaggccgagctgggcctgcaaaaccccatcgacaccatgttccacctgcaacccctcatgttcctgggcctgtttcccctcttcgcagtttttgaggggcttcatctgtcaacatccgaaaagatattccgatttcaggacactggcctgctgctgagagtgctcggatccctctttctgggtggcatcctggcgtttggcttagggttcagtgagtttttgcttgtatccaggacctctagtctaacccttagcattgccggaatcttcaaggaagtgtgcacactcctcctcgccgctcatctccttggcgatcaaatcagcctccttaactggcttggctttgctctgtgtctgagtggcatttcactgcatgttgccctcaaagcactgcactcccgcggtgatgggggtccgaaagcattaaagggcctgggaagctcaccagatttggagttgttattaagatccagccaaagagaagagggcgacaatgaagaagaggaatatttcgtggcccaaggccaacagtag

SEQ ID NO: 54214 - DNA, 1233 bp, Artificial Sequence
  Description of Artificial Sequence: Synthetic coding sequence
atggctgccgctgccgtgggcgctggtcatggtgctggaggcccaggagccgcttcaagctccggaggggcacgggaaggtgcccgagtggcagctctttgtctactgtggtatgccctgagcgccggtgggaatgtggtcaataaagttattctatccgcctttccattccctgtgaccgtttccctgtgccacatcttggcactttgcgctggcctaccccctctcctgcgggcttggcgggtcccccctgctcccccagtatcaggtcctggcccaagtccacaccccagctctgggcctcttctccccccaagattctatccgcgatatgttctgcctcttgctttcggaaaatatttcgccagcgtgagcgcccacgtttctatttggaaggtccccgtatcctacgcgcataccgtgaaagccaccatgcccatctgggtagtacttctatcacgaataattatgaaggagaaacagtcaaccaaagtgtatctctccctcataccaattatctcaggagtattgctcgccacagtcacagaactgtcttttgacatgtgggggttggtttccgctctcgcggctactctttgcttctccctgcagaacatattttctaaaaaggtgttgagagacagtcggatacaccacctgagactgctcaatatccttgggtgccacgccgtcttctttatgatccccacatgggtgctcgtcgaccttagtgctttcctcgtgagctcggatcttacatatgtttaccaatggccctggacactactcctactggctgtgtctgggttctgtaattttgcccagaatgtcattgcgttttcaatattgaatctagtcagtcctctcagctatagtgtcgcaaatgccaccaaacgcataatggttattaccgtgagtctcataatgctgcgaaacccagttacgtcaaccaatgtgttaggaatgatgaccgcaatcctcggggttttcctgtacaataagaccaagtatgacgcaaaccagcaggccagaaaacacttgctgcctgtgaccaccgcggacctctcctccaaagaaaggcaccgctcacctttggaaaaacctcacaacgggctcttgttcccgcagcacggcgactaccagtatgggagaaacaatatactaactgaccacttccagtacagtcggcaatcttaccctaactcttacagcctgaaccgctatgacgtgtag

SEQ ID NO: 54215 - DNA, 315 bp, Artificial Sequence
  Description of Artificial Sequence: Synthetic coding sequence
atgaaggaaaagcagtctacgaaggtctatctgtcactgatacccatcatctctggcgtgttgctcgcaacggtgaccgaactatctttcgatatgtggggtctggttagcgcgcttgctgcaaccttgtgtttctccttgcagaatatcttttccaaaaaggtgctgcgcgattcaagaatccaccatctgcgcctactaaatattctcgggtgccacgcagtattttttatgatcccaacttgggtcctagtggatctaagtgcattcctggtatcatctgatctgggcctgcctagtgaaaatgtattgtag

SEQ ID NO: 54216 - DNA, 801 bp, Artificial Sequence
  Description of Artificial Sequence: Synthetic coding sequence
atgtcctcatccgtcaaaactcccgcattggaggagctcgtacctggaagtgaagagaaaccaaagggtcggtctccccttagctggggctcattatttgggcacaggtccgagaagatcgtctttgctaagagcgatggcggtacagatgaaaatgtgctgaccgttacgatcacagaaactacagtaatagaatccgacctaggggtgtggtcttccagagcattgttgtacctcaccctgtggttcttcttttccttttgtaccctctttcttaacaaatatattttatccttgcttggaggggagcctagcatgctcggtgcggtgcagatgttaagcactaccgttatcggttgcgtcaagacacttgttccatgttgcctgtatcagcataaagcccgtttgtcatatccccctaactttctgatgaccatgctcttcgtaggactgatgaggtttgctacagtagtgctcgggctggtgagtctgaaaaacgtcgccgtgagtttcgccgagaccgtgaaatcttctgccccaatcttcacggtgatcatgtccagaatgatcctgggtgaatacaccggacgccctagtgatagggaggagagggaggaactccagttgcagcctggtagaggggcagccgcatccgacagaaggagtccggttcccccatctgagagacacggagtgaggccacacggggagaatttgcctggagacttccaggttccacaggccctgcatcgggtggcgctttcaatggctctgccgtgtccaatgctgcctgcttcttag

SEQ ID NO: 54217 - DNA, 741 bp, Artificial Sequence
  Description of Artificial Sequence: Synthetic coding sequence
atgagcagctctgtgaagacaccagcccttgaggaactggtccctggcagcgaagaaaaacctaagggacggagccccctgtcatgggggagtctgttcggtcacagaagcgagaaaatcgtctttgccaaaagcgacggcggaacagatgagaacgtcctgaccgtgactataacagagacaacagtgatagagtctgatctcggtgtgtggtcttctcgagcactactctatttgacactgtggttttttttctcattttgtactctctttttaaataagtacatattgagtctcttaggtggggagccttctatgttaggagcagttcagatgctctcaactacagtaatcggatgtgttaaaacactggtcccatgctgtttatatcagcataaagccaggctcagctatccacctaacttcctgatgaccatgctctttgtaggacttatgagattcgctactgtagttctcgggctggtaagtctcaagaacgtagcggtctcctttgcggagaccgttaagtcaagcgcacccatcttcacagttatcatgagcagaatgatcctcggagaatacacgggcagaccgagcgaccgtgaggagcgcgaagagcttcagcttcaaccaggtcgtggcgctgcagcttctgacaggcgatcaccagtgcccccaagtgaaagacatggagtccgcccacatggtgaaaatctccctggtgactttcaagcccagtag

SEQ ID NO: 54218 - DNA, 741 bp, Artificial Sequence
  Description of Artificial Sequence: Synthetic coding sequence
atgtccagttctgtgaaaacccctgcccttgaggagttggtcccaggctccgaagagaagcccaaagggaggtcccctctgagctggggcagcctgtttggacaccggagcgaaaagattgttttcgcaaagtccgatggtggtactgacgaaaatgtcttaactgttacaatcacagaaactaccgtgatcgaatccgatctgggcgtgtggagctcccgggctctgctatacctaacactgtggtttttcttctccttttgtacattattcctcaataagtatatcctcagtctcctgggtggcgagccctctatgctcggcgctgtgcagatgttatctacaactgtcattgggtgtgtcaaaacactggtgccatgctgcctctaccaacacaaggccagactgtcctacccacccaactttctgatgactatgttgtttgtgggcctaatgagattcgccaccgtcgtgctcggcctggtaagcctcaaaaacgtggctgtgagttttgccgagacagtgaagtccagcgctcccatattcaccgtcatcatgagtagaatgatcctgggagaatataccggaagacccagcgatagagaggagcgggaagagctccagctgcagcccggacggggagccgctgccagcgaccggcgttccccggtgccaccttctgagaggcatggtgtcaggccccacggcgagaatttgccaggcgatttccaggcgcagtag

SEQ ID NO: 54219 - DNA, 966 bp, Artificial Sequence
  Description of Artificial Sequence: Synthetic coding sequence
atggctttgggagcatgcgggctacttctcctgctcgctgtgcctggagtgagcctgcgcaccctgcagcccggatgtgggaggccacaagtgtctgatgccggtggcagaatcgtcggaggccatgctgcacctgccggtgcctggccgtggcaggcatcgctgagactgcggagagtgcatgtctgcggcggaagtctgctcagtcctcagtgggttttaacagcagctcattgcttcagtgggtctcttaacagctccgactaccaggtccatctcggagagttggagattaccctctcaccgcacttctccacagttcgccagataatcctccattcatccccgtcagggcagcctggtacttcgggcgacatagccctcgtcgaactcagtgtccccgttaccttgagttcccggatcctgccggtgtgtttgccggaggcgagtgatgacttttgccccggaattcgctgttgggtcaccggctggggttacacccgcgagggtgagcctctgcccccaccttattcactccgggaggttaaagtcagcgtggtcgacaccgagacctgccgcagagactatcccggaccaggcggatccattctgcagcccgacatgctgtgtgctagaggtccaggcgatgcttgtcaggacgactcaggcggacccctagtgtgtcaggtgaatggcgcatgggtgcaagctggcactgtgtcctggggtgagggttgcggcagacccaatcgaccaggagtctataccagagtgcctgcgtacgttaactggataaggcggcacatcacagctagtgggggaagcgaaagtggttaccccagactgccattgctggcaggcttctttctgcccggacttttcctacttctggtaagctgtgtgctgctggcaaagtgccttctgcaccctagcgccgacggcacccccttccccgcaccggattag

SEQ ID NO: 54220 - DNA, 1218 bp, Artificial Sequence
  Description of Artificial Sequence: Synthetic coding sequence
atgtcttccagtgtcaagacacccgctttggaggagctggtgcctggcagtgaggaaaagccaaagggccgaagcccccttagttggggcagcctgtttggacatcggtcagagaagattgtgttcgcgaaatcagatggaggaaccgacgagaacgtactgacggtgacgattacagaaactactgtgattgaaagcgatctcggagtctggtcatcgcgcgctttgctctaccttaccttgtggttcttcttctctttctgcaccctgttcctcaacaagtacattctgtcacttctcgggggagagccaagtatgttaggggctgtgcagatgctgtctacaactgttatagggtgcgtaaaaacgcttgtcccctgctgtctgtaccaacacaaggccagactgtcctacccgcctaatttccttatgacaatgctgttcgtgggcctgatgcgttttgctactgtggtgctgggactggtcagtctgaaaaatgttgccgtttcttttgccgagactgtcaaatctagcgcccctatcttcacggttattatgagtaggatgattctgggggaatacaccggattgctcgtgaacctgagcctcatcccagtaatgggtgggctcgctttatgcactgcaacagagattagttttaatgttctgggattttcagccgcactgagcaccaacattatggactgcctgcaaaatgtattttccaagaaattactctctggagataaataccgatttagcgcgccagaactgcagttctacactagtgccgctgctgtcgctatgcttgtaccagctcgtgtcttcttcactgacgtgcccgtgatagggaggtccggaaaatcattcagctacaatcaagatgttgttctgcttctccttacagacggtgtgcttttccatctgcagtcagtaactgcatacgcattgatgggcaagatctcccctgtaacgttttcggtggccagcactgttaagcacgctttgagtatatggctgtcggtgattgtttttggcaacaaaataacttcactgagtgccgtaggaacagcactggtgaccgtgggagtgctgctctataacaaggccagacagcaccagcaagaagcccttcaatcattggccgctgccacaggccgagcccctgatgacactgttgagcccctgctcccacaggacccccgacagcacccatag

SEQ ID NO: 54221 - DNA, 942 bp, Artificial Sequence
  Description of Artificial Sequence: Synthetic coding sequence
atggcactgcttgtcgacagggtgcggggtcactggaggatcgccgctggcctgctgttcaacctgctcgtcagcatttgtattgtcttcctgaataagtggatttatgtctatcacggctttcctaacatgtcccttactctggtgcatttcgttgttacatggctcgggctttacatctgccagaagctcgatatttttgcaccgaaatctctcccaccctcacggctcctactgctggccctgtccttctgcggatttgtcgtgtttacaaatttgagcctgcagaataacaccatcggcacataccagctggctaaggctatgacaacccccgtcatcattgccattcagactttttgttaccaaaaaacattttcaactagaattcagctcacgctcatcccgataacattgggagtaatcctgaatagctattacgatgtgaagtttaattttttgggtatggtcttcgccgcactgggagttctcgtcactagcttatatcaggtgtgggtgggagccaagcagcatgagctgcaagtgaacagcatgcagctgttatactatcaggctcccatgtctagcgccatgctgcttgttgcggtcccgttctttgagcctgtatttggcgagggcggaatctttgggccatggagtgtaagtgcattactgatggttcttctgtctggcgtgatcgccttcatggtcaacttaagcatctactggatcataggtaacacttcccctgtgacatataacatgtttggacatttcaaattctgtatcaccttgtttgggggatacgtcctgtttaaggatccactttcgattaaccaggcgctcggcatcctctgcactctgttcgggattctggcctatacccattttaagttgagcgaacaagaaggtagcaggtctaagctggcacagaggccttag

SEQ ID NO: 54222 - DNA, 705 bp, Artificial Sequence
  Description of Artificial Sequence: Synthetic coding sequence
atgtgtagatgcccaccggagcaccacgacggacgaatgacctccgcggaggtgggcgcagctgccggtggagctcaggctgccggtcctccagagtggccgcctggttccccacaggctcttagacaacccggacgcgctagagttgctatggctgcactcgtatggctgctcgccggagcaagtatgtcaagcttaaataaatggatctttacggtgcacgggtttggtcgacctctgttgttaagtgctctgcacatgttagtggctgccctggcatgccatagaggagccagaagacccatgccaggtggcacacgatgccgcgttctgctgttgtcattaacatttggcacaagcatggcttgcggaaatgttggtcttcgtgccgttccgctagacctcgcccaactcgttactacaacgacccccctgttcaccttggcactgagcgctctcctgctaggaagacgccaccatccccttcaactcgcagcgatgggaccgctgtgtctcggtgccgcatgtagcctggctggcgagttccggactccacctacaggctgtgggtttttactcgctgcaacatgtttacgcggactgaaaagcgtccagcaaagcctgtccttccagatctgtaagatggagctgatgatccctatggaacgggttcgcatgcgaagtgctggtcaggggcaggaatag

SEQ ID NO: 54223 - DNA, 1053 bp, Artificial Sequence
  Description of Artificial Sequence: Synthetic coding sequence
atgtgcaggtgcccacccgagcaccacgatggcaggatgacaagcgcagaggtgggtgcggctgctggtggagcgcaggctgcaggcccacccgagtggcccccaggaagcccccaggccctgaggcagcctgggagggccagagtcgccatggcagcactggtctggctcctggccggagcaagcatgtcctctctcaataagtggatatttaccgtacacggatttggacgtcctcttcttttgtcagcgctgcatatgctcgttgccgcactggcctgccataggggggcacggaggcccatgcccggaggcacccgatgccgcgtcttgttgttgtcgctaacattcggcacatctatggcgtgcggaaacgtcggcctgagggcagtgcccctggacctggctcagttggtaactactacaactcctctgttcacacttgctttaagcgcccttctgctcgggcgacgacaccatccattacagttagctgcaatgggcccactatgcctgggagcagcttgtagcttagcgggagaatttcgaaccccccctactggttgcggctttcttttggctgctacatgcttgcgcggactgaagagtgttcagcagagcgctctcttgcaggaagagcggctcgatgccgtgactctgctgtacgctacctccctaccgtcattttgtctgctggcaggcgctgcccttgtgctagaagccggtgtcgctcccccaccgactgctggagattctaggctctgggcctgcatcctgcttagctgcttactcagcgtgctgtataacttggcctccttctctttgctggccctgacgtccgcactgactgtgcacgttctgggcaacctaaccgtggttggaaatctcatcctttcccgcctgctcttcggaagtcggctgtccgcactctcctatgttggaatcgcgcttacactgagcggaatgtttctctatcacaattgtgaattcgtggcctcctgggcagctcgtaggggactgtggagacgtgaccagccaagcaagggattatag

SEQ ID NO: 54224 - DNA, 705 bp, Artificial Sequence
  Description of Artificial Sequence: Synthetic coding sequence
atgtgtcgttgtcctcccgagcatcacgacggacgcatgaccagcgctgaagttggggcagctgcgggtggggcacaggcagctgggcctcccgagtggccgccaggcagtccccaggccctgcgccaacccggaagggccagggttgccatggctgccctggtttggctcctagcaggcgctagtatgagttctctgaacaaatggatttttacagtccatggcttcggacgtcctttacttctcagcgcgctgcacatgctggtcgcagcactggcgtgtcatcggggtgccagaagaccgatgcccggagggacacgctgccgtgtgctcctgctttcactgacgttcggcacaagcatggcttgtggcaacgttggcctgagggctgttccactggatctcgcacagctggtcacgactacaacgcctctctttacactcgccttgtcagcccttttgctaggtagacgacaccatccacttcagctggccgcaatgggcccactttgtttgggcgcagcttgctctctggccggagagtttagaaccccaccaacaggatgcgggttcctgctggcggctacttgcctcagggggctgaagtccgtccagcagtccctgtctttccagatatgcaagatggagctcatgatacccatggaacgagtccggatgagaagtgctgggcagggccaagaatag

SEQ ID NO: 54225 - DNA, 1227 bp, Artificial Sequence
  Description of Artificial Sequence: Synthetic coding sequence
atgattcctcctgaacagccccagcagcaattacagccaccttcaccagctcccccaaaccatgtagtgaccactatcgagaacctccccgcagagggcagtggagggggtgggagcctttccgcctctagccgtgcgggtgtcaggcagcgcattaggaaggtgttgaatagggagatgctgatcagcgtggccttaggtcaagtgctgtcacttttaatatgcggcatcgggctgacctccaagtatttgtcagaagatttccatgccaatactcccgtctttcaatcattcttgaattatatacttctgttcctggtgtataccacgacacttgctgttcggcagggagaggagaatctcctcgctattctccgcaggcgatggtggaagtatatgatcctcggtttgattgacttggaggccaactatctggtggtgaaagcttatcagtatactaccttgaccagtatccagcttctggattgttttgttattcctgtggttattttgctgtcatggttttttttactgattaggtataaagctgttcactttattggcatcgtcgtatgtattctggggatgggctgcatggtgggagctgatgtcctggtgggccgtcaccaaggagccggtgagaacaagctcgttggtgatcttttggtgttaggcggagcaacactttacgggataagcaacgtctgggaggagtacatcataagaacattgtctagagttgagtttcttggcatgatcggactctttggcgctttctttagtggaatccagctcgcaatcatggaacacaaggagcttctgaaagtgccatgggactggcagatcggcttgttatatgtgggtttttccgcttgcatgtttggtttatactcctttatgcctgtagttattaaaaagaccagcgccacctctgtcaatcttagtcttctgacagccgatctgtactccctgttttgcgggctatttttgttccattacaaatttagcggactctatttactgtcgttcttcacaattctcatcgggttggtgctttatagcagtacttccacttatattgctcaggatcctagggtttacaaacaattccggaatccctccggccctgtagtagacctgcccacgaccgctcaggtagagccatctgtgacctacacctctctgggccaagaaactgaggaggagccacatgtgagggttgcatag

SEQ ID NO: 54226 - DNA, 681 bp, Artificial Sequence
  Description of Artificial Sequence: Synthetic coding sequence
atggctctatcatggtttatactgcacgctcgatacagggtgatccattttattgctgtggcagtgtgcttgctcggggtcggaactatggtaggcgcagacatactggcagggagggaggacaactcaggatctgacgtgctcatcggtgatatactcgtactgctaggggctagcctttatgccatctctaatgtatgtgaggagtatatcgtgaaaaagctgagcagacaggaattccttggcatggttggcctctttgggacgattatctcggggattcagctactgatcgtcgaatacaaagacatcgccagtattcattgggactggaaaatagccttactcttcgtggccttcgccctctgcatgttttgcttgtactcctttatgccattggtgattaaagtgacgagcgcaacatctgtgaatctgggtatcctcactgctgacctatactctttgtttgtgggactattccttttcgggtacaaatttagcggattatatattctgtccttcaccgttatcatggttggatttatcctctactgctctacccctacgagaacagccgagcccgctgaatcctccgtcccaccagtcacttcgatcggcattgataacctgggactcaaattagaggaaaatctccaagagacacacagcgccgtgctgtag

SEQ ID NO: 54227 - DNA, 984 bp, Artificial Sequence
  Description of Artificial Sequence: Synthetic coding sequence
atgctgtccctctgtatttgcggcacagctattactagccagtatttggccgagagatataaggtcaatacacctatgctccagagttttataaattactgcctcttgttcctgatctacacagtgatgctggcttttcggtcaggaagcgacaacctgttggttatcctaaagcgaaagtggtggaaatatatccttctgggtctggccgacgttgaggctaactatgtgattgtcagagcgtaccaatacacaaccttaacttccgtgcagctattagattgcttcggcatacccgtcctgatggcgctgagctggttcattctgcatgccagatatagggtcattcatttcattgcggtcgcagtgtgtctcctgggagtgggcaccatggtcggcgctgacatactagctggaagagaggataactctgggtctgacgtgcttattggcgacatactggtgcttcttggtgcatctctctatgccatttccaacgtctgcgaggaatacatagtcaaaaaactatccagacaagaattcttgggaatggtggggttgtttggcaccatcatctctggcattcagctgttgatcgttgagtataaagatatagctagcatacactgggattggaaaatcgcccttctcttcgttgctttcgcactgtgcatgttctgcttatattcattcatgcccctggttatcaaggtaaccagcgccaccagtgtgaacctggggattctgacagccgacctgtattctcttttcgtgggcctctttctgtttggatacaagttcagcgggctctatatcctctctttcacggtcataatggtgggtttcatcctgtactgcagcactcccacaaggaccgccgagcccgctgaatctagcgtgcctccggtgacatctattggaatcgacaatttgggtttaaaattagaagagaatctgcaggagactcatagcgcagtgctgtag

SEQ ID NO: 54228 - DNA, 1125 bp, Artificial Sequence
  Description of Artificial Sequence: Synthetic coding sequence
atggaggccgatagtcccgcaggcccaggtgctccagaacctctggccgagggcgcagcagcagaattttcatcactgctccggcgaatcaaaggaaagctcttcacttggaatattctgaaaacaattgccttgggtcagatgcttagtttatgtatatgcggaacagcgattacttcccaatacctggccgagcgctacaaggttaacaccccaatgctgcagagtttcatcaattattgcctgctgttcctgatttacactgtgatgttagcattcaggagtggaagcgacaatctgttagtcatcttgaaacgcaagtggtggaaatacatactgttgggtttggcagatgtggaagccaattacgtgatcgtgcgtgcttatcagtacactaccctgacatctgtccagctcctcgactgcttcggcatccctgtcttgatggccttgtcctggttcattctccatgcccgataccgcgtaatacactttattgccgtggccgtctgcctgttaggcgttggcaccatggtcggagccgacatcctcgctggtcgcgaagacaactctggtagcgacgtgcttatcggtgacatcctggtgttactcggggcttccctctacgctatctctaatgtttgtgaggagtatattgttaagaaactgtcacgccaggagttcctgggtatggtgggcctattcggcaccattattagcgggatacaattactgatcgtcgagtacaaagacatagcctctatacattgggactggaagatcgcgctgctcttcgttgctttcgcactgtgcatgttctgcttgtattcatttatgcccttggtaataaaggtgacatcagcaacatcagtgaatcttggcatccttacagctgatctttactcactgttcgtgggactttttctatttggttataaattctctggactctacattctgagctttaccgtcatcatggtcggttttatcctgtactgcagtacgccaacaagaacggctgagcccgcagagtcttcagtgccccctgtaacgagtatcggtatcgataacctgggactgaagttggaagagaaccttcaggagacccattccgctgtcctgtag

SEQ ID NO: 54229 - DNA, 1074 bp, Artificial Sequence
  Description of Artificial Sequence: Synthetic coding sequence
atggaagcagattctccagccggtccaggtgctcctgagccacttgcagagggggctgctgcggaatttagctcactgctgcgtaggattaaaggcaagctgttcacctggaatatactcaagactatcgctttaggccagatgctgtcgctttgtatatgtggaacagccatcactagtcaatacctcgccgagcggtataaagtgaacacaccaatgctgcagagttttattaattactgcctcctgtttctgatttataccgtgatgctggcgttcagatcaggtagcgacaatctgctcgtaattctgaagcggaagtggtggaaatatattctgctaggcttagccgacgtggaagccaactacgttattgttagagcctatcagtatacaaccctgacctctgtgcagctgctggattgctttggcatccccgtcctgatggctctttcatggttcatccttcatgcacggtatcgggtcatccactttatcgcggttgcagtgtgcttgctgggcgtaggaactatggtgggtgcggatatactggccggtcgagaagacaactcaggttccgacgtgctcataggcgacatcctagtgctgttaggcgcttctctttatgcaataagcaacgtctgtgaggaatatatcgtaaagaaactttccaggcaggagttcctcggcatggttggtctttttgggacaattattagcggaatccagctgctgatcgtggaatataaagatattgctagcatacattgggattggaaaatcgccttactttttgttgcgtttgcgctgtgtatgttctgtctctactccttcatgcctcttgtcataaaggtcacctcagctacctccgtcaacctgggcattctaactgccgacctgtatagcctgttcgtcggtctgtttctattcgggtataaggattccacatcatgtccttctctgtcgtcctggtggggtctgtcgtgtacagccccacccctgctagcacggccttcaagactcaaggcagcctgcctgcaatccccggcactggggttgacgacctggggatag

SEQ ID NO: 54230 - DNA, 1125 bp, Artificial Sequence
  Description of Artificial Sequence: Synthetic coding sequence
atggaggccgattcccctgctgggccaggcgctccagaaccgttagcagagggcgctgccgctgaattttcttctctgctacgacggataaagggcaagctctttacctggaatatcctcaagaccatagcactaggtcaaatgttaagtctgtgcatctgtggcacagcgatcacatcccaatacctggccgaacgctataaggtaaacacgcctatgcttcagtcattcatcaattactgtctcttgttcctgatttacactgtgatgcttgctttccggtcaggttccgacaatcttctcgtaatcctgaaacggaaatggtggaaatatatcctgctgggcctcgctgacgtcgaggccaattacgttatcgtcagggcctaccagtatacaaccctgacctctgtccagctgctagattgtttcggaatccccgtactcatggcactgagctggttcattcttcacgcacgttacagagtgatccattttattgcggtggcagtgtgtctcctgggagtcggcaccatggtgggcgctgatatattggccggacgggaggataattctgggtcagatgtcctcattggcgacatcttggtgctgttgggggcaagtctgtacgcaattagtaatgtatgcgaagaatatatcgtaaaaaagctcagtcggcaggaattcttaggaatggttgggctctttggcactattataagtggtatccaattgctgatcgtggaatacaaagatatcgcctccattcactgggactggaaaattgccttacttttcgtggcattcgccttgtgcatgttttgcttgtacagcttcatgcccctggtcatcaaagtaactagcgcaactagtgtgaacctgggcatccttacagctgatctgtacagtctgttcgtgggcctctttttattcgggtacaagttttcaggactgtacattttatccttcactgtcatcatggttggctttatcctctattgttcaacacccacccgtaccgcagagccagcagagtcttctgtgccccctgttacttctattggcatcgacaacttgggacttaagctggaagagaatctgcaggagacccacagtgctgttctgtag

SEQ ID NO: 54231 - DNA, 1266 bp, Artificial Sequence
  Description of Artificial Sequence: Synthetic coding sequence
atgaagaaacacagcgcgagggttgccccactttcagcctgcaacagtcccgtgctgaccctgaccaaggtggagggtgaggaacgccctagggactcacccggtccagcagaggcccaggcacctgccggtgtggaagctggcggacgcgcaagtaggcgctgctggacatgcagcagggcccaattgaagaagattttttggggagtagcggtggtgctttgtgtctgcagttcctgggccggtagcacacagctagctaagctcacatttaggaagtttgacgccccttttacgctgacatggtttgccactaattggaacttccttttctttccactctattatgtggggcacgtatgcaaatctacagagaagcagagcgtgaaacagcgatatcgggaatgctgtcggttttttggtgacaatggcctcacattaaaagtcttcttcaccaaggcagccccttttggggttctgtggaccctcactaactacctgtacctccacgccataaagaagattaatacgacagatgtctcagttctgttctgttgtaataaggccttcgtgttcctgctttcatggatcgtcctgcgggacagattcatgggcgtgcggatcgttgcagccattctagctattgctggcatcgtgatgatgacctacgcggacggatttcactctcacagcgttatcggaatcgcactggttgtggcctccgcttcgatgtctgctctctacaaagtgcttttcaagctgctcctaggttccgctaaatttggggaagccgcactttttttgagcatcctcggcgtcttcaatatattgtttattacctgtattccaatcatcctctacttcacgaaagtcgagtattggtcttcctttgatgacataccatggggaaacctgtgcgggttcagtgtccttttgctgaccttcaacatcgtactaaacttcggaattgcagttacctaccccaccctaatgtcgttgggcatcgttctctctattcctgtgaacgcggtcattgatcattatacttcccaaatcgttttcaatggggtcagggtcattgccatcatcattattgggctgggctttctgctgctcttacttcctgaagaatgggacgtatggcttatcaagttgctgacccgacttaaggtcaggaaaaaagaggaacccgcagaaggtgcagccgacctcagctccggcccacagtctaagaatcgacgcgcacgaccatccttcgcaagatag

SEQ ID NO: 54232 - DNA, 1473 bp, Artificial Sequence
  Description of Artificial Sequence: Synthetic coding sequence
atgggcatcagagagttccctagtggagcacctagaggtaagtctatagccgtggggatgcggaggtcaccagatgtgtcccctcgacgcctttccgatataagccctcaactgaggcagctgaagtatctggtagtggacgaagcaattaaggaagatcttaagtggtcgcgcagtgtagaggacctaacctctggaccggttggcttaacatccatcgaggaacgtatcctgcgcatcaccggatactatggttaccagccctgggcagccagctgtaagcgtgaggaacgcccacgcgacagccccggtccagcggaggcccaagcccctgcaggtgtggaagccggaggaagagccagccgcagatgttggacatgctccagagcccagctaaagaaaatcttttggggggtcgccgtggtgctgtgtgtctgttcaagctgggcaggctctacacaacttgccaagctgacctttcggaaattcgatgcaccttttacacttacttggtttgcaaccaactggaacttcctgttctttccgctgtactatgtagggcatgtttgtaagtccacggaaaagcaatctgtgaagcaacgctacagagaatgttgcaggttcttcggcgataacggcttaactttgaaagtgttcttcacaaaagccgctccgtttggtgtcctttggaccctgacaaattacctgtacctgcatgcaattaaaaaaataaacactacagatgtgagcgttttgttttgttgcaacaaggcctttgtgtttttattgtcatggatcgtgcttcgcgatcggttcatgggagttagaattgttgccgcaatcctggccattgcaggaatcgtgatgatgacctacgccgacggattccattcccatagcgtaattggaattgctctggtggttgcttctgccagcatgagtgcactgtataaagtgctgttcaaacttctgctgggtagcgcaaagttcggagaggcagccctgttcctttctatcctgggggtattcaatatcctgttcattacctgtatcccgattatcctgtattttactaaagttgagtactggtcaagcttcgatgacattccatgggggaacctatgtggattcagtgtgctgctgttgacttttaatatcgtgttgaactttggcatcgcagtcacttaccccaccctgatgtcattaggtatagtactctctatccccgtgaatgccgttatcgatcactacacctcccagattgtgtttaacggggtgcgcgtcattgcgataataataatcgggctcggattcttactcctgttactgcctgaggagtgggatgtgtggctaataaaattgctgacgcgcttgaaagtccggaagaaagaggagccggctgagggcgctgctgatctgtcatccggccctcagagcaagaatcgtcgggctcgtccctcattcgctcgatag

SEQ ID NO: 54233 - DNA, 1566 bp, Artificial Sequence
  Description of Artificial Sequence: Synthetic coding sequence
atggatgagctgttgcttgatttgtttcataaacttacgtctggtcgccaacttgcagctggcaatgggctctgcggcatttcccacaaggaacaggaagtctggaagccagggcataatattcttgtgaagatgaggaaagaagataagagtttggtgtggcttatccattcaacattggccagatatacacaggtcaccaacttcctgggtacatcccggtcctctgttacacggtgcaagcctggcgctaactgcccgtcatcccattcaggtatttcgcggcaactgagccccctatctgtcaccgaggacagcagcgcacccatcctggagctccagaatcaaggaagctctggggtgtgtgggcacagggtggagcgccagaaccgctccgccgatgacggaacccagacccacagcgagaactcaagtcaagaaaataggatcaaagctcggtgcctgtcctgtacttctatggtgctgaaaggaatttggggcctgcttatcatcctctcagtgtcctcttcttgggtaggcaccacccagatcgtaaaaatcacctataaaaatttctactgcccttttttcatgacttggttttcaaccaactggaatataatgttctttccagtttactactccggacaccttgcaacagctcaggagaagcaaagtccaatgaagaaattccgagaatgtagccgaatattcggcgaagatggcctcacgctgaagctgtttctaaaaaggacggccccattctcaatcttgtggacattaactaattacctatacctgctggcactgaaaaagttaaccgccactgacgtaagcgcgcttttctgctgcaacaaagcttttgtgttcctgctatcctggatcgtattgaaagataggtttatgggtgttcggattgtggcggctatcatggctatcactggtatagtgatgatggcctacgctgataattttcatgcggattctatcattggggtagcatttgcagtcggaagcgcatctacgagcgctttgtacaaggttttgttcaaaatgtttttgggatccgccaatttcggcgaagctgcgcacttcgtttcaacgttgggtttctttaacctgattttcatcagctttacacccgttatcctgtacttcactaaggtggaacactggtcttcatttgcagccttgccctggggctgcctctgcggcatggctgggttgtggcttgcttttaatatcctggtgaatgttggagtggtcctgacatacccaatcctgatttcgatcggcaccgttctgagcgtacctggaaacgccgcagtggatctcctgaagcaggaggttattttcaacgtggtgcggctagcggcaaccattattatctgtatcgggtttttattgatgctgctgcccgaagagtgggatgagattacacttaggttcatcaacagcctcaaagagaagaagtccgaggaacacgtggatgatgttactgatccctcaatacacctcagggggagaggccgtgccaatggcaccgtctctattccactggcgtag

SEQ ID NO: 54234 - DNA, 1572 bp, Artificial Sequence
  Description of Artificial Sequence: Synthetic coding sequence
atggttcctcctcgtcgccacagaggagccggtagaccgggagtcctatctagttccccaccattcaggctgcgatcagctaagtttagcgggatcgccttagaggatttgaggagggctctgaagacccggctgcagatggtctgcgttttcgtaatgaacagaatgaacagccagaatagtggctttactcaacggaggaggatggctttgggtatcgtcatccttctgcttgtcgatgtgatttgggttgcaagttcagagttaacttcctacgttttcacgcagtataataaaccttttttttcaactttcgctaaaacctcaatgttcgtactgtatttgctggggttcatcatctggaaaccctggcggcagcagtgtactaggggtttgcggggaaagcacgctgcgttcttcgccgatgccgagggatactttgccgcttgcactacagacactaccatgaactcttccctgtctgagcccctgtatgtccctgttaaatttcatgatttaccctccgagaagccggagtccactaacatcgacacagagaaaactccaaagaaatcccgcgtaagattttcaaatatcatggagatccgccagctgccgagcagtcacgccctggaagccaagctgagtcgtatgtcctaccccgtgaaagaacaggagagtatactgaaaacagtggggaagctcacagccactcaggtggccaaaattagctttttcttttgctttgtatggtttctcgctaacttaagttaccaggaggcactaagcgatactcaagtcgcaatcgttaatattctttcctcaacctctggtctctttacactcatcttggcggcagtatttccttccaacagtggagataggttcaccctctccaagttgctagcagtgatcctgtctatcggcggagtggtgcttgtcaaccttgcaggctctgagaaacccgctggcagggacactgtgggctctatttggagtctggcaggtgccatgctctacgctgtctacattgttatgataaaaaggaaagtagatcgagaagacaagctggacattcccatgtttttcggctttgttggactatttaacctcctgctcctgtggcccggattttttctactgcattacaccgggttcgaggactttgaattccccaataaggtcgtgttgatgtgcattatcataaacggactcatcggcaccgtactctcagagttcctctggttatggggatgctttcttacttcctctctgattggtacattagccctgtccctgacaatacctctgtccattatcgccgatatgtgtatgcagaaagtgcagttttcatggctgttttttgccggagccattccagtgttcttcagcttctttatcgtgacgcttctgtgccactacaacaattgggatcctgtaatggtcggcattagacgcatcttcgcatttatctgtcgtaagcatcgcattcagagagttcctgaggacagtgagcaatgcgagagtctgatttcaatgcatagcgtgagccaggaagatggtgcttcctag

SEQ ID NO: 54235 - DNA, 1554 bp, Artificial Sequence
  Description of Artificial Sequence: Synthetic coding sequence
atggacagttccggctggcgaggcgttctttcttcctcaccaccatttaggcttaggtctgctaagttctccggaattgcgcttgaggatttgcgcagggctctcaaaactcggctgcagatggtctgtgtttttgtcatgaaccgcatgaattcccagaactctgggtttacgcagaggcgacgtatggcacttggcattgtaatcctgctgctcgtggatgtgatctgggtggcctcttctgagctgacttcttacgtgttcacgcaatacaacaagcccttctttagtactttcgctaaaacaagcatgttcgtgctgtaccttctaggatttattatctggaagccctggcgccagcagtgtactcggggactgcgcggaaagcatgccgctttctttgccgatgcggaaggttattttgcagcatgcaccacggacaccactatgaacagttccctgtctgagcctctctatgtaccagttaagtttcacgacctgccttccgagaagcctgaatcgacaaatatcgatactgaaaagacaccgaagaaaagtagagtacgcttctctaacatcatggaaatcagacagttgccctcctcccacgctctcgaagcaaaattgtcccggatgagctatccagtgaaagagcaagagtccatcctcaaaaccgtcggcaagctgacagccacacaggtagccaagatcagtttttttttctgttttgtgtggttcctggccaatttgtcataccaagaggccctgagtgatacccaggtggccatagtcaatatactgtcctctacatccggtctgtttactttaatcttggcggcagtgtttccttccaacagtggcgatcgcttcactctatctaagttgctcgctgtgatactttcaatcggcggtgtggtgttagtgaatttagccggaagtgaaaagccggctggcagggataccgtaggatctatctggtccttggccggagccatgctctacgcagtctacatcgtgatgattaagaggaaagtcgatcgcgaggataagctggatattcctatgttcttcggctttgtgggactctttaatctcttgttactctggccgggtttctttttactacattacacagggtttgaagactttgagttcccaaataaagttgtcttaatgtgcatcattataaacggtcttatcgggaccgtacttagtgaatttctgtggttatggggctgttttctgactagtagtttgatcgggacccttgctctgtcgcttaccatccccctgtctataattgccgacatgtgcatgcaaaaagtgcagttctcttggctgttttttgctggggcaatccctgtgtttttctcctttttcatcgtgacgctactgtgtcactacaacaactgggaccccgtgatggttggcattaggagaatttttgcattcatctgtcgaaagcatagaatccagcgtgtccccgaagatagcgaacaatgcgaatctctaattagtatgcatagtgtgtctcaggaggacggggcttcatag

SEQ ID NO: 54236 - DNA, 1095 bp, Artificial Sequence
  Description of Artificial Sequence: Synthetic coding sequence
atgcggcctcaggattcgaccggcgtggcagagctccaggagccaggtctgccactgaccgatgacgccccacctggcgctaccgaagagcctgccgcagcagaggctgccggagcacctgacagaggacggtgctggctgtgcctgtccagcccttgctgtagccgaacagagcctgccaagaaaaaggccccttgccccggtcttgggctgttttatacgctgctctccgccttcctgttttcagtggggtcactgttcgtaaagaaggtgcaggacgtgcacgccgtggagatcagcgccttcagatgtgtctttcagatgttggtggtgataccatgtctgatctacaggaagaccggcttcatagggccaaagggacagcggatattcctgatcctgcgaggcgtccttggatcgaccgctatgatgcttatttattatgcatatcagaccatgagcctggccgatgccacagtaatcacgttttcatctccggtgtttacaagcattttcgcatggatctgcctgaaagagaaatactccccgtgggacgctctcttcacagtgtttaccattacaggcgtgatcctgatagttagacccccatttctttttggtagtgacacctccggtatggaggaatcctattccggccatcttaagggaacgttcgccgctatcggcagcgccgtgttcgccgcaagcacactggtgatcctgcggaaaatgggcaaatccgtagactactttttgtcgatatggtattatgtcgtcttaggccttgttgagagtgtgatcatactctctgtgctgggagaatggagtctcccctattgcggtctcgacaggttatttctgattttcatcggattgttcggcctaggcggacagatcttcatcacaaaagccctgcaaattgaaaaagccggacctgtggccattatgaagactatggatgtggtgtttgctttcatctttcaaattatcttttttaataatgtcccaacctggtggacagtaggcggagcactctgcgtggtggcctccaatgtgggtgctgccattcgcaagtggtatcagtcttcaaagtag

SEQ ID NO: 54237 - DNA, 1098 bp, Artificial Sequence
  Description of Artificial Sequence: Synthetic coding sequence
atgcggcctcaggactccaccggagtagcagagctgcaagaacccggactaccgctcacagatgacgctccacccggtgcaactgaagaacctgcggcagccgaggcggctggggcaccggaccgaggaagatgttggctttgcctaagctccccatgttgttctaggacggaaccggaggccaagaagaaggccccatgtcccggacttggacttttttacactttactctccgcgtttctgttttctgtcggctctctgtttgtaaagaaggttcaagatgtccatgccgtagagatctctgcattccgatgcgtgttccaaatgctggtggtgattccctgtctgatataccggaagaccgggttcattgggcctaaagggcagcgcatttttctgatcctccggggagttctgggatcaactgcgatgatgctgatatattatgcataccaaaccatgtccctcgccgacgctacagtgatcactttctcatccccagtgttcacctcgattttcgcgtggatatgcctgaaggaaaaatactctccctgggacgctctgtttaccgtgttcaccattactggggtaattcttatcgtccgaccaccgtttctgttcggttccgatacctccggtatggaggagagctattccggacacctcaaagggaccttcgctgccattggttctgccgtgttcgccgcaagcaccctggtgatcctccggaaaatggggaagagcgtggattatttcttgagcatatggtattatgtggtgctgggcctcgtggaatccgtcatcatcttgagcgtgctgggcgaatggtccttaccgtactgtggtcttgaccggcttttcctaatattcatcggactgttcgggctcggcggacaaatattcataacgaaagccttacagatcgagaaggcaggacccgtagccattatgaaaactatggacgtggttttcgcttttatctttcagataatttttttcaataatgttcctacgtggtggacggtgggaggcgctctgtgcgtggtggcctctaatgtgggcgctgccattcggaaatggtatcagtcctcgaagtag

SEQ ID NO: 54238 - DNA, 1017 bp, Artificial Sequence
  Description of Artificial Sequence: Synthetic coding sequence
atggctggttcacacccatatttcaaccagcccgacagtactcacccaagtcccccttctgccccaccctctctgaggtggtatcagcgctgccagccctccgacgccacctccggcctgctcgtcgccctgcttggaggcggtcttcctgcgggtttcgtgggtccactctcaagaatggcctaccaggccagcaatcttccaagcttagagctcctgatttggagatgtctctttcatctgcctattgcactactgcttaagctgcggggagatccactccttggcacaccagatatccggagccgagccttcttttgcgcgctgttaaatattctgtctatcggttgtgcatactcagctgtgcaggtagtccccgcagggaacgccgcaactgttcggaaaggctcatcaaccgtatgcagtgcagttctgaccctgtgccttgaatctcaagggctgagcggctatgattggtgcggcctgcttggctgcattttggggcttattatcatcgtcgggcctgggttgtggacattgcaggaaggaacgaccggagtctacactgctcttggttacgtagaagcattcctggggggactcgccctttctcttcgtttgctggtgtatagatccctgcactttccaccctgcttaccaactgtagccttcctgtcgggacttgtgggattgctgggatccgtgcctggcctatttgtgctgcaggctcccgttcttccatcggacctcctgtcctggtcttgtgttggtgctgtcggcatcctggctttagtaagcttcacgtgtgtgggctacgctgtgactaaggcccaccctgccttggtgtgtgctgtgctgcactcagaagtcgtggttgccttgatcttacagtactacatgctccatgaaacagttgccccaagtgacattgttgcagcgggtgtggtgctcgggtctatcgctattatcacggcccagaacctttcttgcgaacgaacaggtcgcgtagaagagtag

SEQ ID NO: 54239 - DNA, 1017 bp, Artificial Sequence
  Description of Artificial Sequence: Synthetic coding sequence
atggctggttcccatccgtattttaacctcccggatagcactcatccgagtccacctagtgcgcctccctccctgcgttggcatcagaggtgccagcctagtggggctaccaacggcctgctagtcgccctcctcggtgggggactgcccgcagggtttgttggaccactgagtcggatggcataccagggctccaacctgccctccttagaactgctcatctgcaggtgcctcttccatctccccattgccctcctgctcaagttacgaggggacccactgttgggccctccggacattcgcggatgggcctgtttctgcgccttgctaaatgtcctcagcataggctgcgcttactcagccgtgcaggtagttccggcaggaaatgctgccaccgttagaaagggtagctccactgtgtgctcagccgttctcaccctatgcctggaaagccaggggttggggggatatgaatggtgcggccttctgggtagcatactggggctgattattattttgggcccaggactctggacactccaggagggcactaccggggtttatactactttagggtacgtccaagcatttctcgggggattagctctttctctgggactcctggtttaccggtcactgcacttcccttcatgtctccccaccgtcgctttcttgtcaggactggtgggccttctggggtgtgtacctggattattcgtgctgcagacacctgtgctcccttcagatttgctgtcttggtcctgcgttggagccgagggaatactggctcttgtgtctttcacctgtgttggatacgcggttactaaggcccacccagccctggtttgcgccgttctccatagcgaggttgttgtggccctgatcctccagtattacatgctgcacgaaactgtcgccctcagtgacatcatgggagctggcgttgtgcttggaagcatcgcgattattactgctcggaacttaagttgcgagagaaccggaaaagttgaagagtag

SEQ ID NO: 54240 - DNA, 1158 bp, Artificial Sequence
  Description of Artificial Sequence: Synthetic coding sequence
atgcgaagcagtttagctcccggtgtgtggttcttccgggcattcagtcgagattcatggttcagagggctgatactcctgctgacctttctcatttacgcttgttatcacatgagtaggaagcccatcagcattgtgaagtctagacttcaccagaattgctccgagcagatcaaaccaataaatgatacccactcgctgaacgataccatgtggtgttcctgggcaccctttgacaaggacaattataaagaacttctggggggagtagacaatgctttcctgatcgcatacgctatcggaatgtttatctccggcgttttcggtgaaaggcttcctctgcggtattacctctctgctgggatgcttctgtccgggctctttacatctctgtttggcttgggatacttctggaatatacatgagttgtggtactttgtggtaattcaggtctgcaacggcttagtgcagaccacaggttggcccagcgtcgtaacatgtgttggtaactggtttggcaaaggaaagcgcggatttattatgggtatttggaacagccatacctcggtgggcaatattctcgggtccctgatcgctggcatctgggtgaacggacaatggggattatccttcattgtcccaggaataattaccgcagtcatgggagtcattacattcctctttttaatagaacaccccgaggacgtcgattgcgccccaccgcaacaccacggggagccagcagaaaaccaggataacccagaagaccccggtaactcgccatgctccatacgcgagtcaggtctggaaactgttgcgaagtgctctaaagggccatgcgaagaacccgctgccatctctttcttcggtgctctcaggatcccaggagtcgtcgagtttagtttatgcctcttgttcgctaagctcgtgagttatactttcctgtactggcttcctctgtacatagcaaacgtagcccatttttccgccaaagaggctggtgacctgtccacccttttcgacgtcggcggtataatcgatgtaccagtacagcttcattggcctgggcgagattgtcagcttcattccgatgccgatcacctttggggcccaggacagtggcctatccgggctcatcaccactgttgcctgtgctag

SEQ ID NO: 54241 - DNA, 1518 bp, Artificial Sequence
  Description of Artificial Sequence: Synthetic coding sequence
atgcgttctagcttggccccaggcgtctggtttttccgggcattcagtagagactcttggttccggggactgattttgttgctgacgtttctaatttatgcctgctatcacatgtccaggaagccaatctccatcgtgaaatcaaggttgcaccagaactgcagcgaacagataaagcccattaatgacacacattctcttaacgacacaatgtggtgctcctgggccccatttgataaggataactacaaggaactgctgggtggagtggataatgccttcctcattgcttacgcaataggaatgttcatctcgggagtgttcggggaaaggctgccactgcgctattacctcagcgctggcatgctgctgagcgggctatttacatctttgttcgggcttggctacttttggaacatacatgaactctggtatttcgtggtcatacaggtatgtaacggcctggttcagacaactggctggcctagtgtcgtcacctgtgttggaaactggttcggaaaggggaagagaggatttattatgggcatttggaactctcacaccagtgtcgggaatatcctgggaagtcttatcgcaggaatctgggttaatggacagtggggcttaagctttatcgtcccaggaattattacagctgtcatgggggtcattaccttcctgtttctgatagaacatccagaggacgtcgattgtgcccctccccagcaccacggcgagccagccgagaatcaggacaatcctgaagacccaggaaattccccgtgcagcatcagagagtctggactggaaacagtggccaagtgtagcaaagggccttgcgaagagcctgcagccatctcgttttttggcgctttgaggatccccggtgtcgtggaattcagtctttgcctgctctttgctaaactcgtgtcctacacttttctctactggctgcctttgtatattgcgaatgtcgcgcactttagcgcaaaagaggccggtgacctgagcacactgttcgacgtgggcggtattatcgggggaatcgtggccggtctggttagcgattacacaaatggtcgcgcaaccacctgctgcgtgatgctgatcctcgcggctccgatgatgttcctatacaattatatcggtcaggatggaattgcttctagcattgtaatgttgatcatatgtggaggcttggttaacgggccatacgctctaatcacaactgcggttagcgctgatctcggtactcacaagtcccttaagggaaacgccaaggccctgtccacagtaaccgctattattgacggaaccggctccatcggcgcagccctcggacctcttctcgccggattaatcagtccaactggctggaacaacgtgttctatatgctaatttcggcagacgtgctcgcctgtctgctgctgtgccggctggtatacaaagagatcctagcctggaaagtcagcctgtcccgcggttccgggtcatctatggttctgacccaccagtag

SEQ ID NO: 54242 - DNA, 1506 bp, Artificial Sequence
  Description of Artificial Sequence: Synthetic coding sequence
atgagatcttccctagcgccaggtgtgtggttcttcagagctttttctcgcgactcctggttccggggactgatactgctactcactttcctcatctatgcttgctatcacatgtcccgcaagccaatctctattgtcaagtcgcgccttcatcagaactgttctgaacagattaaacccattaatgacactcactcactcaacgatacaatgtggtgttcctgggcccctttcgacaaggacaactataaagagcttctggggggagtggacaacgcattcctgatcgcatatgctataggtatgttcatctccggggtgttcggcgagcggctgccactaaggtactacctgagtgcaggcatgttactgagcgggttgttcacttcactgtttggcttgggctacttctggaatatccacgaactttggtactttgtagtaatccaggtgtgcaatggcctcgtgcaaactacaggctggcctagcgttgtgacctgcgtcggcaactggttcggcaagggcaaaagggggtttattatgggaatttggaattcacataccagcgtcggaaatatcctcggctcattgatcgctgggatatgggtcaacggacaatggggtctcagcttcattgttccagggattatcaccgcagtgatgggagtaataacttttctgttcctcatcgagcatccggaggacgtcgactgtgccccaccccagcaccacggagagccggcagagaatcaggacaaccccgaggaccctgggaacagtccgtgtagcataagggagtctggtttagaaacagtggccaagtgttccaaggggccatgtgaggagcctgcagccataagttttttcggggcactccgtattccgggagtcgtggagttcagcctttgcttactgtttgctaaattggtcagctatactttcctctactggctccctttgtatattgctaacgtcgcacatttttcagcaaaggaggctggtgatctgtccactctctttgacgtcggcggtatcatcggcggaattgtggccggactagtgtctgattatacaaatggaagagccaccacatgttgtgtcatgctgatactagcagcacctatgatgtttctctacaattatattggtcaagacgggattgcttcatctatagtgatgctgattatctgtgggggactcgtcaacgggccatacgccctcattaccaccgcggtgtcagccgacctcgggacccataagtctcttaaaggaaatgctaaagccctctcaaccgttactgctatcatcgatggcactggctcaatcggtgcggcactcgggccactgctcgctggcctgatcagcccaacggggtggaacaatgttttctatatgctgatcagtgccgatgtgcttgcctgcctgctgctctgtagactcgtctacaaggagatactcgcgtggaaagtgtcgctgtcgaggggatctggctacaaggaaatttag

SEQ ID NO: 54243 - DNA, 1518 bp, Artificial Sequence
  Description of Artificial Sequence: Synthetic coding sequence
atgcggtcaagccttgccccaggcgtttggttcttccgggcattctctcgggacagctggtttcgtggcttgatcctgctcctgacattcctgatctacgcctgctatcatatgtctaggaaacccatatctatcgtgaagtctagactccatcaaaactgctccgagcagatcaagcccatcaacgatacgcacagcctgaatgacaccatgtggtgttcttgggcacccttcgacaaggacaattataaagaattactgggaggagtggacaacgcttttttaattgcctacgctattggtatgtttatcagcggcgtcttcggcgagcgcttaccactgcgatactacctatctgctgggatgctgctctctggactattcactagcctgttcggtctgggctatttttggaatatacatgagttgtggtatttcgtggttattcaagtgtgcaacggtctggtgcagaccacaggctggcctagcgtggtgacctgtgtggggaattggttcgggaagggaaagagagggtttattatggggatatggaactcacacacatctgtggggaatatcctggggtctctcattgcaggaatctgggtgaacgggcaatggggcttgtcctttatcgtgccagggatcatcacagcagtgatgggagtgatcactttcctattcctgatagagcacccggaggacgtggactgtgcacccccacagcaccacggcgagcccgcagagaatcaggataacccagaagaccccggaaactcgccatgcagcattagagaatccggcctcgagaccgttgcgaaatgcagcaagggaccgtgtgaagaacccgctgccatcagtttctttggggcactgcggattcctggcgtcgtggagttctcactgtgtctcctctttgccaagctggtgtcatacacattcttgtattggctccctctctatatcgctaacgtcgcccacttctcagctaaagaagccggtgacctctcgactttatttgatgtcgggggaataattggcggaatagtggccggattggtaagcgattacacgaatggaagggctaccacctgttgtgttatgctcatcttggctgccccaatgatgttcttatacaactacattggtcaggacggcatcgcctcctcgatcgtgatgttgatcatttgcgggggattagttaatggtccatatgcccttatcaccacagccgtgagtgccgacctgggcacccataagtccctcaagggtaatgctaaggctctaagcaccgtgacggcgatcattgacggcacggggtctattggagccgctttggggcctttattagctggcttgatctctcctactggatggaataacgtgttctatatgctgatttcggctgatgtgcttgcctgtctcctgctgtgtcgactggtctacaaggagatactggcctggaaagtgtccctgtccagagggtcaggatcaagtatggtgctgacgcaccagtag

SEQ ID NO: 54244 - DNA, 1485 bp, Artificial Sequence
  Description of Artificial Sequence: Synthetic coding sequence
atggcctggcctaatgtctttcagaggggcagcttattaagccagtttagtcaccaccacgtggtggtgttccttctcacattcttttcctattctctcttgcatgcctctcgcaaaactttctctaacgtcaaggtgtctatcagtgagcagtggacaccaagcgccttcaacacatccgttgagctccctgtggagatctggtcctccaaccatctgttcccttccgccgagaaggcaactctgttcttggggaccttggatacaatcttcttgttcagctacgctgttggcctttttatttccggaattgtgggagaccggctgaacctgagatgggtcctgagcttcggaatgtgcagtagtgcgttagttgtatttgtcttcggagcactcaccgaatggctcagattctacaataagtggctttattgctgtctgtggatcgttaacgggttactccagagtactggatggccttgtgtcgtggcggttatgggaaactggttcgggaaggcaggtcgcggagtggtgtttggcctctggtctgcctgtgccagcgtgggtaacattctaggcgcatgcctcgcctctagcgtgctgcagtatgggtatgagtatgcttttttggtgaccgcgtcggtacagtttgccggaggcatagtaatcttctttggcttgctggttagtcctgaagaaattggcctttcaggaatagaagccgaggagaactttgaagaagattcacaccgacctcttataaatggcggtgaaaacgaggacgagtacgaaccaaactatagcatacaagacgactcatctgttgcgcaagtgaaggccatttcgttctatcaagcctgctgtctgccaggtgtgattccctattctctggcttatgcctgtttgaaattagtcaactatagtttttttttttggctgccattttacctgtcaaataactttggctggaaggaagctgaagctgacaagttatcaatctggtacgatgtgggagggattattggcggtaccctgcaggggttcatttccgacgtcctgcagaagcgtgctccagtactagcgctgtcccttcttctggccgtgggatctctgataggatattctagatcccccaatgataaaagtatcaacgccctgctgatgactgtgactgggtttttcatcgggggaccgtcaaacatgatcagcagcgctatatccgctgatttaggcagacaggagctgatccagcggtcaagcgaggcacttgctacggttacaggaattgtggacggatccggaagcattggtgcagccgtgggtcagtacctggtgtctctcatccgggataagttggggtggatgtgggttttctatttttttatcctcatgacaagctgcaccattgtatttatctcaccactaatcgtacgagaaatcttttcactcgtgctgcgcagacaagctcacattctgcgtgagtag

SEQ ID NO: 54245 - DNA, 1332 bp, Artificial Sequence
  Description of Artificial Sequence: Synthetic coding sequence
atggcttggccaaatgtattccagagagggtccctcctgagccagttcagtcatcatcacgtcgtggtctttctgcttacttttttttcttacagcctgctgcatgcttcaagaaagacattttctaatgtgaaggtgtcaataagcgaacaatggacaccaagtgccttcaatacatcagtggaactgccagtggaaatttggtctagtaatcacctcttcccctctgccgaaaaggccacactctttctgggaacgcttgacactatttttctctttagttatgccgtaggtctttttatttcgggcattgttggagatcggttaaacctgagatgggttctgtcctttggaatgtgttcttctgctttagtggtgtttgtgttcggggcactaacagaatggctgcgcttttataataaatggctgtattgttgtctgtggattgtaaacggtctgctacagagtactggctggccatgtgtggtcgctgtcatgggtaactggtttgggaaggcgggacgaggagtcgtatttggtctctggagtgcatgcgcctctgtagggaatatacttggcgcatgcctggcctcctcagtcctgcagtacggctacgaatacgcctttcttgtcacggcttcagtgcaatttgccggaggcatagtaattttttttggccttctggtatcacccgaagaaattggcttatctggcatcgaagccgaggagaactttgaggaggattcacatagacccttgatcaatggcggagagaacgaggatgagtacgagcctaactactccatccaggacgacagtagcgtggcccaggtgaaggctatctccttctatcaggcctgttgcttgccaggtgtgattccttactccttggcttacgcatgtttgaaactggttaactactcttttttcttctggcttcccttctacctgtctaacaactttggctggaaagaggccgaggcggacaaactctcaatctggtatgatgtcggcggtattattgttttctcggtgtctgatcctggacaagccagaatggatgtcggattcttgctttttcattcacacgacaaactgtacaactgcgtttaccttgccattaatagtgaaggcaatatattatccagggcgaaagagaccggtagccacatagagggagtgaccggggcacgtgagacagagcgcacaatgtctgctacctccggaccacttggcctgagagtctgcccaaatttgggtctgagccggtcatcaagcctgatcttggattgccaggcatccctaaacaccgcgtctcacctgcggtgctag

SEQ ID NO: 54246 - DNA, 471 bp, Artificial Sequence
  Description of Artificial Sequence: Synthetic coding sequence
atggcatggcctaatgttttccagcgagggagccttttgagccagtttagccaccaccatgtagtggtctttttgctcacattcttcagctactcattgttgcacgcttcccggaagacctttagtaatgtgaaggtgtccatcagtgaacagtggacccctagtgcttttaatacctcagtggagctgccggtggagatctggtcttctaaccacctattcccttccgccgaaaaggcgacgctattcctgggcacactagacactatcttcctcttcagttacgccgtcggtttatttatttctggtatagtaggggatcggttaaatctgcgctgggttctgtctttcggaatgtgttcatctgctctggtaacaaggagctgcttttggtccctcgaatgtctttgttttggaggacagcattttggcagcgttccctcgtttttttgctcaagtgtgtggctgtag

SEQ ID NO: 54247 - DNA, 1437 bp, Artificial Sequence
  Description of Artificial Sequence: Synthetic coding sequence
atggcgtggcctaacgtcttccagagaggatcacttctgtctcagttttcccatcatcacgttgttgtcttcttgttaacatttttttcatatagcctgttacatgcgagtcggaagaccttctccaatgtgaaagtgtcaatctcagaacagtggaccccttctgctttcaacaccagcgtcgagctacccgtcgagatttggagcagtaatcacctctttccctctgcggagaaggcaaccctctttctgggaacgctggatacaattttcctattctcatatgcagtcggattattcattagcggaatagtcggagatagattgaatttaaggtgggttctgtcatttggcatgtgcagttctgcactggtagtatttgtgttcggtgccttgactgagtggcttcggttttacaataagtggctctattgttgtctctggattgtcaatggcctgttgcagtccactggttggccatgcgtcgtcgccgtgatggggaattggtttggcaaggcaggaagaggggtggtgttcggactgtggagcgcatgcgcaagtgtcgggaatatcctgggagcatgcctcgcttctagtgtccttcaatacgggtatgagtatgcattcctcgtaactgcctcagtccagttcgccggaggcatcgtaattttcttcggcttgctggtgtctcctgaggagattggtctgagcgggatagaggccgaagagaatttcgaagaggatagtcacagaccactcattaatggcggtgaaaatgaggatgagtacgagcctaattactccatacaggatgactcatcggtggcccaggttaaagctatcagcttctaccaagcatgctgtttaccaggcgtaattccttattctctggcctacgcatgccttaaattggtcaattattcatttttcttctggcttccattttacctgagtaataacttcgggtggaaggaggccgaggccgataagctgagcatttggtacgacgtcggcggtatcattgggggaactttgcagggttttataagcgatgtgctgcagaagagggcccctgtgctggccctgtcacttcttctggctgtgggctccctgattggctactcccgctttttcataggaggacctagcaacatgatctccagcgccatttcagccgatctcggaaggcaagaattgatacagcgatcatccgaagctttggcgacggtgacagggattgttgatggcagcggaagtatcggtgccgctgttggccagtatttggtatctctgatccgcgacaaacttgggtggatgtgggtgttctactttttcattctgatgacttcctgtaccatcgtgttcatctcacccctgattgtaagggaaattttcagcctcgtgctgagaagacaggcccatattctcagggaatag

SEQ ID NO: 54248 - DNA, 45 bp, Artificial Sequence
  Description of Artificial Sequence: Synthetic coding sequence
atggcgtggccaaacgtcttccagagaggctccctactgtcatag

SEQ ID NO: 54249 - DNA, 714 bp, Artificial Sequence
  Description of Artificial Sequence: Synthetic coding sequence
atggcctggcccaacgtgtttcaacgcggaagcctgctgagccagttctctcatcaccacgtggttgtgtttctgctgacttttttctcctactccctcctgcacgcatccagaaaaaccttctccaatgtgaaggtgtccatttctgagcagtggactccctctgctttcaacaccagtgtggaactcccagttgaaatctggtcatcaaatcacttatttccaagcgctgaaaaagccacactctttctgggcactctggacactattttcctgttctcctacgccgttggtttattcatttctgggatagtgggggaccggctgaacctgaggtgggttctcagcttcgggatgtgcagcagtgcgctcgtcgtctttgtcttcggagcgctgacagagtggctgcggttttacaataaatggttgtattgttgtctctggatcgtgaatggcctgctgcagtctaccggctggccctgtgtggtggcggtgatggggaactggtttggcaaggctggtaggggcgttgtatttgggctgtggtctgcttgcgcgtccgtgggaaatatcttgggggcatgccttgcgtcctctgtcctgcaatatggatatgagtatgcattcctggttactgcctctgtgcagtttgctgggggtatagtgattttctttggcctgctagtttcccccgaagaaatagggaaactgtag

SEQ ID NO: 54250 - DNA, 2343 bp, Artificial Sequence
  Description of Artificial Sequence: Synthetic coding sequence
atgaccgcagccgctgccagcaattgggggctgatcaccaatatagtgaattccatcgtgggggtatccgtactaacgatgccattctgttttaaacagtgcgggatagttctgggggcactgcttctcgttttctgtagctggatgactcaccagtcctgcatgttcctggtgaagagtgcatcactgagcaagaggagaacttacgcaggactcgcttttcacgcttatggaaaggccggaaagatgcttgtggagacgtcgatgatcgggctcatgctgggtacttgcattgcattttatgtcgttattggggacctgggctctaactttttcgcccgacttttcggattccaagttgggggaacatttagaatgttcctgctttttgcagtttccctgtgcatagtccttcctttgagcttacagcgcaacatgatggcctccatccagagcttctctgctatggcgctgcttttctacacagtctttatgtttgtgattgtactgtcttctcttaagcacggtctcttctctgggcagtggctccgcagggtgtcttacgtgagatgggagggggtctttcggtgcattcctatatttggcatgtcgtttgcatgtcagtctcaggtgctgcctacatacgactccctagacgagccttctgtgaagacaatgtctagcatatttgcatcctctcttaatgtagtaacgacattctacgttatggtggggttttttgggtacgtcagctttacggaggccacagccggaaatgtactgatgcacttccccagcaatctcgtcactgagatgctaagagtgggctttatgatgtccgtcgccgtaggcttccccatgatgatcctgccatgccgccaggccctgagcaccctgctgtgtgagcaacagcagaaagatggaacatttgcggctgggggttacatgccccctcttcggtttaaggccctaacgctcagcgtggtattcggcaccatggtcgggggaatcctcatccccaacgtggagacaatcctaggcctgactggcgctactatgggatccctcatatgcttcatctgtcctgcactcatatataagaagattcacaaaaatgccctctcctctcaggtggtcctgtgggtgggacttggggtgctagtggtttctacagtcacaacattaagcgttagtgaagaagtccctgaggacctcgcagaagaggcgccagggggacgactcggggaagctgaaggactcatgaaggtggaagccgcacgtttgtccgcccaagatcctgtcgtagccgtagccgaggatggaagggaaaaaccaaaattgccgaaggagagagaagagcttgagcaggcacaaattaaaggcccagtggacgtccccggtagagaagacggcaaggaggccccagaggaggcccaactcgatagacctggccaaggcatcgctgtgcccgttggcgaggctcatcgccacgagccacccgttccacacgataaggtggtggttgacgaaggccaggacagagaagttccagaggaaaacaaaccccctagtcggcatgcgggtggtaaggcccctggcgtacaggggcaaatggctccacctttgccggatagcgagcgggagaaacaggaacctgagcagggggaggtgggcaaacggccaggacaagcgcaagccttggaagaggccggagacttgcctgaagatcctcaaaaggtaccggaggccgacgggcagcccgctgtccagcctgcaaaggaggacctgggtccaggtgaccgaggtctgcatccccgaccccaagcagtgctttctgaacaacagaatgggctggcggttggtggcggagaaaaagcaaaggggggacctcccccaggtaatgccgcaggcgataccggacagccagccgaggatagcgaccatgggggtaaacccccattgccggcagagaagccggctccagggcctggacttccccctgagcccagggagcagagagatgttgaacgggcaggaggtaatcaggctgccagtcaactagagggaaaagcgtcagctctgcagcccccagcatcaggccctggctccgggtctcccctgccacagccatggggggatgcccaggtgatactgggaagtcccgctcggcctccattttccttccagccacctgcagaacagacccccaggcgagcgttctgttctcttccaatctcaagcctcctgtctggcaacctcctctctgccctcctgccgttcaagcatctccgacatcgacatatggcctgcgactatcgattcattagcctggcacctctgtag

SEQ ID NO: 54251 - DNA, 3360 bp, Artificial Sequence
  Description of Artificial Sequence: Synthetic coding sequence
atgacagcagccgcagcaagcaattggggcttaataacaaatatcgtgaattcaatcgtgggcgtcagcgtgctcaccatgccattctgttttaagcaatgcggcatcgtgttgggagctttgctgctcgtcttctgtagctggatgacgcatcagtcgtgtatgttcctcgtaaagtcagcgtcgttgtctaagcggaggacttacgccggactggcgttccatgcctatggaaaagccggaaagatgctggtggaaacatccatgataggactgatgttaggaacgtgcattgccttttacgtagtcatcggggacctggggtccaatttcttcgccaggctgttcggcttccaggtgggcggaacattcagaatgtttttgcttttcgcggtttcactgtgtatagttcttccactctctttgcagcgaaacatgatggctagtattcagtcgttctctgcaatggcactgttattttacaccgtgttcatgttcgtcattgttctatcttctctcaaacatggcctgttttctggacagtggttgaggcgggtcagctatgtgcggtgggagggggtctttcgctgtattccaatcttcgggatgagcttcgcctgtcagagtcaagtgttgcctacttacgacagtctggacgaacctagcgtcaagactatgtcctcaatttttgcgtcttcacttaacgtggtaacaaccttttatgtgatggtaggctttttcggttatgtgtctttcactgaagcgacagcgggaaatgttttaatgcactttccctccaatctggtgacagaaatgttacgtgtcggctttatgatgtctgtggctgtgggtttcccaatgatgatactcccatgtcgccaagccctcagtaccttgttatgtgagcaacaacagaaagatgggacctttgcagccggaggctacatgccccctctgcgattcaaggctcttacgcttagcgttgtgtttggtacgatggtcggaggaatccttataccaaacgtggaaacgatcctgggtctgactggcgcaactatgggatccctcatttgttttatctgccccgctttgatttataagaaaatccataagaacgccctttccagccaggtggtcttgtgggtcgggcttggcgtcctcgtcgtcagtactgtgaccacccttagcgtgtctgaagaggtacctgaggatctggcagaggaagctcctggtggtcgtctcggggaagctgagggactgatgaaagttgaggctgcacgcctctctgcacaggaccccgtcgtggccgtcgcagaagatggcagggaaaagccaaagctccctaaggagcgggaagaacttgaacaggcacagatcaagggccctgtggacgttccagggagggaagatggcaaagaggccccagaggaagctcaactggaccgaccaggacagggcattgcagttcccgttggcgaggctcatcgacacgagccacccgtgccacacgacaaagttgtggtcgacgagggtcaagacagagaagtgcccgaggaaaacaagcccccatcccgccacgccggtgggaaagcccctggcgtacagggtcagatggcacccccattaccagactcagaacgagaaaagcaagaacccgagcaaggggaggtcggtaaacggcctggacaggctcaggccttagaagaagcaggggatttgcccgaggatccccagaaggttcccgaggcagatggccaacctgccgtgcagcctgcgaaagaggatctaggcccaggcgatcggggtcttcaccctaggccacaggctgtgctgtcagaacagcagaatggacttgccgtcggagggggagaaaaagctaaaggcggacctcccccaggtaatgccgcaggagacaccggtcagccggcagaggattctgaccacggcggaaaaccccctctgccagctgagaagcctgcaccaggacctgggctccccccagagccacgcgaacagagggacgtagagcgcgcaggcggaaatcaggcagcttcacagctggaggaggcgggacgcgcagaaatgctggaccacgcggtcctgttgcaagtcatcaaggagcagcaggtgcaacagaaaagactactcgaccagcaggagaagcttctcgctgttatcgaagaacagcataaagaaattcaccagcagcggcaggaagatgaagaagataagcccagacaggtggaggttcaccaggagccaggcgcagccgtcccccgtggtcaagaggcaccagagggtaaagcaagagagacggtcgagaacctgccacccttacctcttgaccctgtgttacgagctcctggtggtaggcctgcaccctcccaggacttgaaccaaagatccctggagcattccgaagggcctgtggggagggatcctgcgggaccacctgacggtgggcctgacacggaaccaagagccgcacaggccaaattacgcgacgggcagaaagatgctgcccctcgagccgctggaacagtcaaagaacttcctaagggcccagaacaggtgccagttccagatcctgctcgggaagccggagggcctgaggaacgtctggccgaagaattcccgggtcagtcccaagacgtaactggaggcagtcaagacagaaagaagccaggaaaagaggttgctgcgactggaacctcaatcctaaaagaggctaattggcttgttgccggacctggcgctgaaacaggtgaccctagaatgaagcccaaacaagtctccagggaccttggcttggctgcagacctgccagggggagcagagggagcagcggctcagccccaggctgttctgcgccaaccagaactccgggtgatttctgatggagagcaaggcggacagcaagggcacagactggaccatgggggacacctcgaaatgcggaaggctcgtggaggcgaccacgtcccggtatcgcatgaacagcctcgagggggagaggacgctgccgtgcaggaacccagacagagacctgagccagaacttggattaaagagggctgtgccaggtggtcagcgccctgataatgctaagccaaacagagatctgaaactgcaggctggaagcgacctgaggcgcaggagaagggatctgggtccacacgcggaaggccaactcgcccctcgggacggcgtgatcataggactcaatccactgcctgacgtccaggtgaacgatttgagaggtgctctggatgcacagctccgacaggcagccggaggggcactccaagtagtccactctcgccaactgcgacaggcaccgggtccccctgaggaatcctag

SEQ ID NO: 54252 - DNA, 1155 bp, Artificial Sequence
  Description of Artificial Sequence: Synthetic coding sequence
atgaagcaggcaggattcccgcttgggattttactgcttttctgggtctcatacgtcaccgatttctccctggtcctgctgataaaaggcggagctctgtccgggacagatacttaccagtctctcgttaacaaaacatttggcttcccaggatatcttctgctctctgtactccaattcctgtatccatttatagtggatccagaaaacgtctttattgggagacattttattattggcctgagtacggtcacattcactcttcccttgagtctgtatcggaacattgccaagttgggaaaagttagcctgatctccacaggcttgacgactctgatcctgggtattgtgatggcgagagctattagcctcggcccacatatccctaaaaccgaggacgcctgggtttttgcgaaacccaacgctattcaggcagtgggagtgatgtcattcgcatttatctgccaccacaactcattcctggtctactcatctctggaggagccaacagtagccaagtggtctagactcattcacatgagcattgttatttctgtctttatctgtatctttttcgccacgtgtgggtatcttaccttcaccggttttacccaaggcgatctcttcgaaaactattgcaggaatgacgacttggttactttcgggcgattctgctacggagtcacagttatcctgacctacccgatggaatgctttgttacaagagaggtgatagccaatgtgttcttcgggggaaatttgtctagcgtcttccatattgtcgtgactgtgatggtgatcacagtggccaccctggtgagcttgctgatagattgtctcgggatcgtgctggagttaaacggggtcttgtgcgccaccccactgatctttataatccctagcgcgtgttacctcaagctgtctgaagaaccgaggacccactccgacaaaattatgtcctgtgtaatgctgcctatcggggctgtcgtcatggtgttcggattcgtcatggccattacgaacacccaggattgcactcacgggcaggagatgttttactgctttcctgacaacttttcccttactaatacaagtgaaagccatgtgcagcaaacaacacagttgtctactctaaacatctcgatctttcaatag

SEQ ID NO: 54253 - DNA, 1221 bp, Artificial Sequence
  Description of Artificial Sequence: Synthetic coding sequence
atgaaacaagcgggattcccgctgggcatcctattgctgttctgggtctcttacgtcactgactttagcctggtgttacttattaagggcggtgcattgagcggtactgacacgtaccagagccttgtcaataagacgttcggctttccaggctatctcttgctttctgtactgcaatttctctatccatttattgccatgatcagctacaacatcattgcaggagacactctcagcaaagtttttcagcggattccaggtgtggaccccgaaaatgtctttataggccgtcatttcattataggactttctactgtcaccttcaccttgcctctgtccctgtatcgcaatattgccaagctgggtaaggtgagtcttataagcacaggattgacaaccttgatattgggaatagtcatggcgcgagccatctcgttgggccctcatatcccgaagaccgaagacgcgtgggtgttcgcaaagcccaatgctatacaggctgtcggtgtgatgagcttcgcctttatctgccaccataatagtttcctggtgtactcctcactggaagagccaacagttgcaaagtggtcacgcctgatccacatgtccatcgtgattagcgtgtttatatgcattttcttcgctacatgcgggtatttgaccttcacgggttttacacagggagatctgtttgaaaactactgtagaaacgatgatctggtgactttcggcagattttgttatggtgtgaccgtgatcctgacatatcctatggaatgtttcgtgaccagggaggtgattgccaatgtgttctttggcggaaatctttcttccgtgttccacattgtagtgaccgtcatggtaataaccgttgcaactctcgttagtcttctaatagattgcctgggaatcgtgttagagctgaatggtgtgctgtgcgcgactccgctaatcttcatcattcccagcgcatgctatctgaagctctcagaggaacctcgaacccacagcgacaagattatgtcatgcgtcatgctgcctattggggcagtggtcatggttttcggcttcgtgatggcgatcaccaatacccaggactgtactcacggacaggaaatgttctattgctttcctgacaatttcagcctcaccaatacctccgagtcccacgtccagcagacgacccagttaagtactctcaacatttctatctttcagtag

SEQ ID NO: 54254 - DNA, 1221 bp, Artificial Sequence
  Description of Artificial Sequence: Synthetic coding sequence
atgaagcaggccggtttccctctgggtattctgttgttattctgggtctcctatgtgactgacttctccctggtcctgttgattaaaggtggagccttgagtggaacagatacctaccaaagcctggtcaataagacttttggttttccaggatacctcctgttgagcgtcctgcagtttctctacccatttattgctatgatttcttacaatattatagctggcgacactctgtcaaaggtatttcagaggatcccaggagttgacccagagaatgtttttattggacggcacttcattatagggttgtctacagtgacattcaccctgcccttgagcctgtaccgaaatattgccaagctgggtaaagtctctctgatttccacaggactgacaaccctcatccttggcattgtcatggcaagggccatctcactgggaccccacatccctaaaaccgaggacgcctgggtgtttgccaagcccaacgcaatccaagccgtgggtgtgatgagctttgcctttatttgtcaccacaattcttttttagtctactcctctctggaagaaccaaccgtggccaaatggtctcgtcttatccacatgtccattgtaatcagtgtctttatatgtatctttttcgccacttgtggctacctcacgttcaccggattcacccaaggtgatctgtttgagaattattgcagaaacgacgacctggtgacctttggcaggttttgctatggagtgacagtcatcttgacgtatcccatggagtgcttcgtgaccagggaggtgattgcaaacgtgttttttgggggtaatctatccagtgtgtttcacatcgtggtgaccgtgatggtaattaccgtcgctaccctagtatcattactaatcgactgtctgggcattgtgttagaattgaatggggtcctatgtgcgacccccttgatttttatcattccctccgcctgttaccttaaactgagcgaagaaccgagaacccacagcgacaaaatcatgtcttgtgttatgctacccattggtgctgtggtgatggtgttcggatttgtgatggcgatcactaacacacaagactgtacacatggacaggagatgttctactgttttccagataatttttccctgacgaacaccagtgaaagccacgttcaacagacaacccagctctcgacactgaacatttcaatattccaatag

SEQ ID NO: 54255 - DNA, 1371 bp, Artificial Sequence
  Description of Artificial Sequence: Synthetic coding sequence
atggaagctagctggggaagctttaatgcagaaagaggatggtatgtgtccgtccagcagccagaagaagcggaagccgaagaattatctccactgctttccaatgagctgcatcggcagagatctccaggggtcagcttcggactgtccgtttttaatctcatgaacgcaattatggggagcggcatcctcgggctggcctacgtgttagccaacaccggggtgtttgggttctcgttcctgctcctcacagtggcacttctggctagctattcagtgcacctcttgctgagcatgtgcatccagaccgctgtgacgagctatgaggaccttggactcttcgctttcggtttgccgggtaagctggtggtggctgggacaataatcattcaaaatatcggggctatgagttcctatctactcattataaagacagagctgcctgccgctatagccgaattcctcaccggggactacagtagatactggtatcttgacggccagaccttgttaattatcatctgtgtgggcatcgtatttcctcttgccctgctgcctaaaataggctttttgggctacactagcagcttgtcttttttttttatgatgtttttcgcactggtcgtaatcataaagaaatggagcatcccttgtccccttacactcaactacgtagaaaaaggctttcagatcagcaatgttactgacgactgtaagccgaagcttttccatttttctaaagagtccgcctacgcattgcccacaatggcctttagcttcctttgccacacatccatcctgccgatttattgtgaactgcaatccccaagtaaaaaaaggatgcaaaacgtcaccaataccgccattgcattgtcattcctcatctatttcatctcagctttgtttgggtacctgacgttctacgacaaggtggaaagtgagcttctgaagggttattctaaatatctatctcacgatgtggtcgtgatgaccgttaaattatgcatcctattcgcagtcttactcaccgtccctctgatccatttcccagcgaggaaagcagtgaccatgatgtttttcagcaatttcccgttttcttggattcgacactttctcatcaccctggccctcaacattataatagtcctcctcgccatctatgtgccagatatccgaaacgtgttcggcgtggtgggcgcatcgacttctacctgcctgatttttatttttcctggcttgttctaccttaagcttagcagggaagacttcctgtcctggaaaaaattgggggctttcgtgctactcatttttggaatccttgtgggtaacttctcccttgccttaatcatcttcgactggattaataagtag

SEQ ID NO: 54256 - DNA, 1566 bp, Artificial Sequence
  Description of Artificial Sequence: Synthetic coding sequence
atggaagcaagttgggggtcttttaacgctgagcggggatggtatgtgtctgtgcagcagccagaggaagctgaagcagaggaactatcccctcttctatccaacgagcttcaccggcaaaggagtcctggcgtctccttcgggctctccgtattcaatctcatgaacgcgatcatgggatccggcattctgggcctggcatatgtgctggctaacaccggagtcttcggttttagttttctcctgctaacggtcgcgttgttggctagctattccgtacacctcctgctctctatgtgcatccagactgccgttacatcttatgaagacctcgggctgtttgctttcgggctgcctggaaaactcgtggttgccggaaccatcattatccagaatatcggcgctatgtcctcatacctcttaataattaaaaccgagttgcccgcagccatcgcagagttcctgaccggagattacagccgctactggtacctggatgggcagacactccttatcattatctgcgtgggcattgtgtttcctttagctctgcttccaaaaatcggtttcctcgggtatacctcctccctgagtttcttttttatgatgttctttgcactggtggtaattatcaagaaatggtccatcccttgtcctttaacactgaattacgtggaaaaagggtttcagatttccaatgtgacggatgattgcaaaccaaaactcttccatttttcgaaagagtccgcttatgcactcccaaccatggccttcagctttctctgccacacctcgatcctgcctatctattgtgagttacagagcccttccaaaaaaagaatgcagaatgttacgaacacggcaatcgcactaagtttcttaatctacttcatctcagccttatttggctacttaactttctacgataaggtggaatctgagctgctcaagggctatagtaagtatctgtcacatgacgtagttgtaatgacagtcaagctctgtatcttgttcgctgttctgttgactgtgcctctgatacactttcccgctcgtaaagccgttactatgatgttcttcagtaacttccctttctcttggataagacacttcctcatcacactggcccttaacatcatcatagtgctgctcgcgatctacgtccccgatattcggaacgttttcggcgtcgtgggggctagtacctccacttgcctaattttcatatttcccggtctcttttacctgaaactttcccgggaagacttcctcagttggaagaagctgggaggccttatcctctcacatagactcgcttgttctggcgtcatctcagcccattgcaacctgtgcctgcctgacagctccaaccctcccacctccgcttctcgtgtagctgagaccacaggaagagatactatggagatgtgtacccagcgaaagggacacgcacggacccaacaggaaggaaattgcttacaggccaaagggagaggactgaggcgcactaagcgtgtgcatacgctaatccttcattttccaaccagcagaaccgtgtccaaatag

SEQ ID NO: 54257 - DNA, 1551 bp, Artificial Sequence
  Description of Artificial Sequence: Synthetic coding sequence
ggatccttcaacgcagaacgcggatggtacgtgtccgtacagcagccagaggaagctgaagcagaagaactcagccccctcctgagcaacgaacttcacaggcagcggtcacccggtgtatcatttggactgtcagtgtttaacctgatgaacgctatcatgggctctggaattctggggcttgcatacgtgctcgccaatacaggtgtgttcggctttagtttcctgctgctcaccgtggctttactggcctcatattccgtacacttacttttaagcatgtgcattcagacagctgtgactagctacgaagaccttggactttttgctttcggccttccagggaagctggttgtagccggaaccatcatcattcagaatataggcgcaatgagtagttacctcctcatcattaaaactgaactgcctgctgccattgcagagttcctgacgggtgattattccaggtactggtatctcgatggtcagacactcttgatcattatttgtgttgggatcgttttccccctcgcactgctgccgaaaataggctttctcgggtatacgtcatctctgtcattttttttcatgatgtttttcgctctcgtagttattataaagaagtggtcgatcccatgcccactcacactgaattacgtggagaaggggtttcaaattagcaacgtgacggatgattgcaagccaaagctttttcactttagcaaggaaagtgcctacgcactgccaaccatggctttctcatttctctgtcatacaagcatccttcctatttattgtgaattgcagtcacctagcaaaaagagaatgcagaacgtcactaataccgctatcgctctaagctttctgatctatttcataagcgccctcttcggttacttgactttctatgataaagtcgagagcgaattgcttaagggctactccaaatacctctcccacgacgtcgtcgtgatgacggtgaagctctgtatactgtttgccgtgctgctgaccgttccgctcattcactttcctgccagaaaggctgtgacaatgatgtttttctcaaattttccattttcctggatccgacacttcctcatcacactggctctgaacatcattattgtgctgctggcgatctatgttcccgacattcggaatgtgtttggagtggtcggagcctccacgagcacatgcctaatcttcatttttcccggactcttttatcttaaactttcccgtgaggatttcctgtcctggaagaagttgggcggacttatccttagccataggttggcctgctcgggcgtgatttctgcccactgcaatctgtgtctgccagattcatctaacccacccacatccgccagcagggtcgccgagaccactgggagagacaccatggagatgtgcactcagagaaaagggcatgccaggactcagcaagaaggcaactgcctgcaggccaagggtaggggactgaggaggactaaaagagtgcacactctgattctccacttccctaccagccgaaccgtcagcaaatag

SEQ ID NO: 54258 - DNA, 1464 bp, Artificial Sequence
  Description of Artificial Sequence: Synthetic coding sequence
atgtctgggcctaggatcatgtattccttgcttctagagttgcacaggcagcggagtccgggagtttcttttggtctgagcgtttttaatctgatgaatgccatcatgggcagcgggattctggggctcgcctatgtgctggctaataccggggtgttcggattttcttttcttctgctcacagtggccctgttggccagctatagtgttcatctgctgttgtctatgtgtattcagaccgccgttacctcctacgaagatctgggtctgttcgcctttggcctgcccggaaagttggtcgtagcaggtactatcattatccaaaacataggcgctatgtcttcttaccttctcatcatcaagaccgaactgccggcagctatcgccgaatttctcactggtgactacagcagatactggtatctggatggacagacactcctgattattatttgtgttggaattgtctttccgctagccctccttccaaagataggttttctgggatacacttcttcactgtctttcttttttatgatgtttttcgccctggtggtgatcattaaaaagtggagtattccttgtcccttaaccctgaactacgtggagaaaggatttcaaatttccaacgttactgacgattgtaaacctaaactatttcacttctccaaagaaagcgcctatgccctgccaaccatggcattcagcttcttatgccacacgagcatcctgccgatttattgtgaactccagtcgccctcgaagaaacggatgcagaatgtcactaacactgccattgcgctctcttttctgatttattttatatcggccctcttcggctatttaacgttctacgataaggtagaatccgagctgctgaaggggtatagtaaatatttgagtcacgatgtcgtcgtaatgactgtcaagttatgcattttattcgctgtccttctaaccgtcccgcttatccattttcccgcacgcaaggccgtgaccatgatgtttttctctaatttcccatttagctggatccggcactttctaatcacgctggcccttaatatcatcattgtactgttggccatttatgtgcctgatattagaaacgttttcggagtggtgggggcatctactagcacttgcttgatcttcatatttcctgggctcttttacctgaagctcagtcgggaggatttcctctcctggaagaaactggggggactaatccttagccatcgattggcttgtagcggggtgattagcgcccactgtaacctctgtctgcccgactccagcaacccacccacaagcgcctccagagtggctgagacgaccgagaaagaagagattccttggcgctgcgctcctagaggcaaagccactcagggccatagcaagaaagcgacagtgtataaaccacgcgaagaagcatctggcgagccaaacgtttcaactccttag

SEQ ID NO: 54259 - DNA, 1686 bp, Artificial Sequence
  Description of Artificial Sequence: Synthetic coding sequence
atggccaacatgaactctgattcccgacacctcggcacctccgaagtggaccacgaaagggaccctgggcctatgaacattcaattcgagccttcagatctgcgatcaaaacgccctttttgcattgagcctaccaatatcgtaaacgtgaatcatgttatccagcgagtgagcgatcatgcttccgctatgaataaacgtattcactattactctagactaactactcccgcagataaagctctcattgccccagaccacgttgtgccagcgccagaggaatgctatgtgtactcccccctgggcagcgcttacaaactgcaatcctatactgagggctacggcaaaaacactagtttggttaccatattcatgatctggaacacaatgatgggaacgagtattctctccataccttggggaatcaagcaggcgggtttcactacaggtatgtgtgtgattattctcatgggcctccttactttgtattgttgttaccgtgttgtgaagtctcgcaccatgatgttctcgttagacaccacaagctgggaataccctgatgtttgtcgtcattacttcgggtccttcggtcagtggtcttcactccttttttcgctcgtttcactgattggcgctatgatcgtttactgggttctgatgtctaacttcctttttaacaccggcaagtttatatttaattttattcatcatattaatgatacagatactatcctctcaactaacaattccaacccggtcatatgtccctctgcgggatctggaggtcatcctgacaactcctcgatgattttctatgccaacgacacaggcgctcaacaattcgagaagtggtgggacaaatcaagaactgtgcctttctatttggtggggctcctgttgccgctcctgaactttaagagtccctctttcttctccaaatttaacattctcggaactgtatctgttttatatctgatctttttggttactttcaaagccgtaaggctggggttccatctggaattccactggtttatccccacggagttcttcgtgcctgaaatccgctttcagtttcctcaattgacaggcgtgcttacgctcgcgttctttattcataattgtattatcacgctgctcaagaacaacaaaaaacaggagaataatgtaagagatctttgcattgcatatatgttggtcacactaacctacctttacatcggggtgttggtgttcgcatctttccctagcccgcctctgagtaaggattgtatcgagcagaatttcctggacaattttccttctagtgataccctgagctttatcgcccgtatcttcctgctgttccaaatgatgaccgtttatccgctgctaggctatttggcacgggtgcagttacttggtcatatttttggcgatatttatccatcgatctttcacgtgctcatccttaatctcatcatcgtaggggctggcgtgatcatggcgtgcttttatcccaacattggaggtattatacgatacagcggcgcagcgtgcgggctggccttcgtgtttatttatccctctttgatttacatcatctctctgcaccaggaggaaagactgacatggccaaaactcatatttcacgtgtttatcattattctgggggttgctaatctgattgtgcaattcttcatgtag

SEQ ID NO: 54260 - DNA, 1686 bp, Artificial Sequence
  Description of Artificial Sequence: Synthetic coding sequence
atggccaatatgaattcagactcacgacacctcgggacttctgaggtggatcatgagcgggaccccggacccatgaatattcaatttgaaccatctgatcttcggagcaagcggccattctgtattgaacctacaaatattgtaaatgtaaatcacgtgattcagcgcgtcagcgatcacgcatccgccatgaacaaacgaatacactactatagtagactgaccacgccagccgataaggcactcatcgcgccagatcacgtggtgcccgcacctgaagaatgttacgtgtacagtccgttgggctcagcttataagcttcaatcctatacggagggatatggcaagaatacgtcactggtgacgattttcatgatatggaacacgatgatgggaacttcgattttaagcatcccttgggggatcaagcaagcgggtttcaccaccggtatgtgtgtaatcattctcatgggactgttaacattatattgctgttaccgcgtggtgaagtcccggaccatgatgttttccttggacacaactagctgggagtatcctgacgtgtgccggcactattttggcagcttcggccagtggtcctctctgttgtttagtctcgtttcactgataggtgctatgatagtctattgggtattaatgagcaactttctctttaatacagggaagttcatatttaattttatccaccatattaacgatactgatacaattctctccaccaataacagtaatccagtgatctgtccctctgcgggatccggaggacaccccgacaatagttctatgatcttctacgctaatgacacaggagcccagcaatttgaaaaatggtgggacaaatctcgaactgttcctttctatttggtggggttgcttctgcccctccttaattttaaaagcccttcctttttcagtaaattcaacatactaggaaccgtgtctgtgctgtacttgatcttcctggtgacctttaaagctgtgcgattgggcttccacctcgagttccattggtttatccctacagagttttttgttccagaaattcgctttcagttcccccagttgaccggggtgctcacactggcttttttcatccataactgcattatcacccttctgaagaataataagaagcaggagaacaatgtccgcgacttgtgtatcgcctatatgctggttacgctgacctatctctacatcggtgttttagtgttcgcctcattccccagtccgcctctgtcgaaggactgcatcgagcagaactttctggataacttcccgtccagtgacactctttcattcatcgcccgtattttcctcttgtttcagatgatgaccgtttatcccctgctcggttacctcgctcgagtgcaactgctcggccacatctttggtgacatctacccaagtatctttcacgtgctgatactgaatcttattatcgtaggcgcaggcgtgattatggcttgcttttacccgaacattggcggtatcatccggtactcaggagccgcttgcggcctggcttttgtattcatctacccctccttgatctacattatttcgttacatcaggaggagagactgacttggcccaaactgatcttccatgtgttcataattatcttgggtgtagcgaaccttattgtccagttcttcatgtag

SEQ ID NO: 54261 - DNA, 1314 bp, Artificial Sequence
  Description of Artificial Sequence: Synthetic coding sequence
atgatctggaatacgatgatgggtacctccattctgagcatcccgtggggcatcaaacaggccggatttacgaccggcatgtgcgtgattattcttatgggcctcctcacactttactgctgctacagggtcgtgaaatcacgcaccatgatgttttcccttgatactacttcatgggaatatcccgacgtgtgcagacattacttcggttctttcggccagtggagctctctgctgttctctctagtgagtcttatcggagctatgatcgtgtactgggtgttgatgtcaaactttctgtttaacaccggaaagttcatctttaacttcatccaccacatcaatgacacggacaccatactgtccacaaacaatagcaaccctgtcatatgtccgagtgcaggttcaggaggccaccccgataatagttctatgatcttttacgccaatgacacgggagcacaacagtttgaaaagtggtgggataagagtagaaccgtccccttctatctggttggacttcttctgcctctgttaaatttcaaatctccatctttctttagcaaatttaacatcctggggaccgtctccgtgctttatctgatcttccttgtgacctttaaggctgtgcggctgggctttcacctggaatttcactggtttatccccacagaattttttgtacccgaaattcgctttcaattcccccaactgaccggtgtgctgacgttagctttcttcatacacaattgcattattacactactgaaaaacaataagaagcaggagaataatgtccgagatttgtgcatcgcatacatgctggtgacactcacttatctctatataggcgtccttgtttttgccagctttccatccccgcctttaagtaaggactgcatagaacagaacttcttggataatttcccttctagcgacaccctgtcatttattgccagaattttcttgttgttccagatgatgaccgtgtatccactgctgggctatctcgctagagtacagctcctgggccacatattcggcgacatttacccgagtatcttccacgtgttaattttaaacctgatcatcgtcggagccggagtgatcatggcttgtttttacccaaatattggcggaataattagatactctggggctgcgtgtgggttggccttcgtcttcatctacccctcactgatatatatcatctcacttcaccaggaggagcggcttacctggccaaaacttatctttcatgtcttcatcatcattctcggagtggcaaatcttatagtccagttttttatgtag

SEQ ID NO: 54262 - DNA, 396 bp, Artificial Sequence
  Description of Artificial Sequence: Synthetic coding sequence
atggcaaatatgaacagcgattccagacacttgggaaccagcgaagtggatcatgaacgtgatccaggacctatgaacatccaatttgagccctccgatctgcggagtaagcgccctttttgcatcgaacccacaaatatcgtaaatgtcaatcacgtgatacagagggtaagcgaccacgcgtctgccatgaacaaacgcatacattattactctagattgaccactccggcagacaaggctctcatcgctcctgaccacgtggtccccgctcccgaggaatgctatgtgtacagccctttgggctcggcctataagttacagtcttataccgagggatacggcaagaatacctcacttgtaaccatctttatgatttggaacacgatgatgtag

SEQ ID NO: 54263 - DNA, 114 bp, Artificial Sequence
  Description of Artificial Sequence: Synthetic coding sequence
atggcaaacatgaactccgacagccggcacctgggcacaagcgaggtggaccacgagagggatcctggccctatgaatattcaattcgaaccgagcgacctccgtagtaaatag

SEQ ID NO: 54264 - DNA, 114 bp, Artificial Sequence
  Description of Artificial Sequence: Synthetic coding sequence
atggctaacatgaattccgactctaggcatctggggacaagtgaagtggatcacgaaagagatcctgggcctatgaacatacagtttgaacccagcgacttgagatccaagtag

SEQ ID NO: 54265 - DNA, 1497 bp, Artificial Sequence
  Description of Artificial Sequence: Synthetic coding sequence
atggcaatctgcatattgacctggcggattcgccctttctgcatcgaacctacgaatatcgtgaacgtcaatcacgtcatccaacgggtgagcgaccatgcgtccgccatgaacaaacggatccactattacagcaggctgaccactccagcagacaaggctctcattgcacctgatcatgtggtgcccgcacccgaagaatgctacgtgtatagtcctctcggcagcgcttacaaacttcaatcctataccgagggttatgggaaaaatacctcacttgtgaccatcttcatgatttggaataccatgatgggcacaagtatccttagcatcccctggggaatcaagcaggccggatttaccacaggaatgtgcgttataatcctgatgggtctgctgactctatattgctgctaccgtgtggtgaagtcgagaaccatgatgttcagtttggatacaactagctgggagtaccctgatgtctgccggcactatttcggcagcttcgggcagtggtcctcattgctgttttctctggtttcccttatcggggctatgattgtttactgggtgttgatgtccaatttcctttttaacactggcaaattcatctttaattttatacaccacatcaacgacaccgataccatcctgtcaactaacaattccaatccagtgatttgtcctagtgccggttccggcggacaccctgataacagcagtatgatcttttacgcaaacgacactggtgcacagcagttcgagaaatggtgggacaaatctcgaacagtgccattttacctcgtgggactcctactccctctccttaatttcaagtcaccctccttcttcagcaagtttaatattctggaaatccgattccaattcccacaactgaccggagtactcacactcgctttctttatccataattgcatcattactttgttgaagaacaataaaaagcaggaaaataatgtgagagacctttgtatcgcctatatgttggtaaccctgacctacctctacatcggcgtgctcgtttttgcttcattcccatcccccccactctcaaaggactgcattgagcagaatttcttagacaactttccctcgagcgacacccttagcttcattgcgagaatctttcttctttttcaaatgatgaccgtgtatccactgttaggttacctggccagagtccagctgctcggccacattttcggtgacatctatccaagcattttccacgtgttgatcctgaatcttatcatagtcggcgctggcgtgataatggcatgtttttaccctaacatcggaggaatcattaggtacagtggagccgcatgtgggttggccttcgtattcatctacccctctctgatttacatcatttccctgcaccaagaagagagactgacatggccgaagctcattttccacgtgtttattattatcctgggggtggccaatctgatcgtgcaattttttatgtag

SEQ ID NO: 54266 - DNA, 81 bp, Artificial Sequence
  Description of Artificial Sequence: Synthetic coding sequence
atggcaaacatgaactctgattctcgccatttaggcacatctgaagtggaccatgaacgggaccccggacccatgaactag

SEQ ID NO: 54267 - DNA, 294 bp, Artificial Sequence
  Description of Artificial Sequence: Synthetic coding sequence
atggctaacatgaactctgattccagacacctcggcacaagcgaagtagaccatgagagagatcctggccctatgaatattcagtttgagcccagtgatttgcgcagtaagcgacctttttgcattgagcccactaacatcgtgaacgtgaatcatgtgatccaaagggtcagcgatcacgctagtgcaatgaacaagagaatccactactattcccgtctgaccacaccggctgataaggccctgatagcccctgatcacgtggtgccagcgcctgaagaatgctatgtctag

SEQ ID NO: 54268 - DNA, 1497 bp, Artificial Sequence
  Description of Artificial Sequence: Synthetic coding sequence
atgaataaaagaattcattactattctaggctgacaactcccgctgataaggcactgattgcccctgaccatgttgtccctgccccagaggagtgctacgtgtacagtccactcgggtctgcatacaagcttcagtcctatactgagggctacggtaagaacactagcctagtcaccatttttatgatctggaatactatgatgggaacaagtatactgtcaatcccttgggggatcaagcaagcagggttcaccaccgggatgtgcgtgatcattcttatggggctcctaaccctatactgctgttacagagtggtgaagtctcggactatgatgttctcgctggacaccacctcatgggagtacccagacgtttgccggcactacttcggatcgttcggtcaatggtcctctctgctctttagtttagtgtccctaattggcgcaatgatcgtctactgggtgcttatgagcaattttctgttcaacactggtaaatttatcttcaacttcatccaccatattaatgacacggacactatactgagtactaataacagtaaccccgtgatatgtcccagcgccggatcaggcggacatcccgacaatagctccatgattttctatgccaacgacactggggctcagcagtttgaaaaatggtgggacaagtccaggaccgttcccttttacctcgtgggtcttctgctcccactcttgaatttcaagtcaccttctttttttagtaagtttaatatcctgggaaccgtgagcgtattgtatctaatctttctagttacctttaaggcggtccgcttgggattccacctggagttccactggtttatccctaccgagttcttcgtgccagagatccggtttcagtttccacaattgactggtgtactgaccctggccttctttatccataactgtatcatcacgctgctgaagaataacaagaagcaggaaaataacgttcgggacctgtgcatcgcatacatgctggtcactctgacctacctctatatcggcgtgctagtgttcgcatccttcccttcaccccctctgtctaaggattgcattgaacagaacttcctggataacttcccatcatcagacactttgagctttattgctagaatcttcttactgttccaaatgatgaccgtgtatcctttgttaggctatctggctcgcgtccagctgcttggccacatttttggggacatttatcctagcatcttccacgtattgatcctgaaccttattattgtgggggcaggagtcattatggcatgcttttacccaaatatcgggggaataattcgctactcaggcgctgcatgcggcttggcgttcgtctttatctatcccagtcttatttacataataagtctgcatcaggaggagcgactcacatggcccaagctcatcttccatgtgttcataattattctgggcgtggccaatctcattgttcagttttttatgtag

SEQ ID NO: 54269 - DNA, 1389 bp, Artificial Sequence
  Description of Artificial Sequence: Synthetic coding sequence
atggccaatatgaacagtgactcgcggcatctcggaacgtccgaagtggatcatgaacgcgaccccggacctatgaacatccaattcgagccaagcgaccttaggtctaaaaggccgttctgtattgagcccaccaatatcgtcaatgtgaaccacgtgatccagagagtcagtgatcatgcctctgccatgaacaaaaggatacattattattctaggctgacgactcctgccgataaagctctcattgctccagaccatgttgtccctgcaccagaggaatgttacgtctattccccattgggaagcgcatacaaactgcaatcttacaccgagggatacggcaaaaataccagtctcgttacgatctttatgatctggaacactatgatggggacaagcatcctgagtattccttggggaattaaacaggccggatttaccacaggtatgtgcgttatcatcctgatggggctgctgactctctactgttgttaccgggtggtgaagtcccgaactatgatgttcagccttgatacaactagttgggaataccccgatgtttgtcgtcactattttggatccttcggacaatggtctagcctgctcttttcattagtgtccttgatcggagcaatgattgtctattgggtcctgatgagcaacttcctgttcaatactggaaagtttatcttcaactttattcaccatattaacgacactgacaccatcctaagcacaaacaatagcaaccccgtaatctgtccaagcgccggttccggtggccacccggacaattcctctatgatcttttacgctaacgacaccggagcacaacagtttgaaaagtggtgggacaagagccggacggtgccattttacctcgtaggattactcctgccactgctcaatttcaagagccctagttttttttccaagttcaacatcctcggcaccgtttcagtgctctacctgattttcctcgtgacattcaaagccgtgcgattgggcttccacctagagttccactggtttatacctaccgagttctttgttccagagatccggtttcagttcccacaactgaccggagttcttaccttagcctttttcattcacaactgcatcataacgctgcttaaaaataacaagaaacaggagaacaacgtccgggatctttgcattgcttacatgctcgtgacactcacatatttgtatatcggagtcctggtgttcgctagctttccgtcgccgccactgtccaaagattgcatcgagcaggtcagacacagagttccctcgttgtgcgattgcgttcactttcatgtctttatcgtgggcagggtaattcagtggcaggacattacatccgacaggccagggttctag

SEQ ID NO: 54270 - DNA, 1008 bp, Artificial Sequence
  Description of Artificial Sequence: Synthetic coding sequence
atgctacaagggcacagttctgtgtttcaggccctcctgggtacatttttcacgtggggcatgaccgccgctggtgcggctctcgtgtttgtatttagtagcggccagcgacggattctggacggcagcctgggttttgcggcaggagtgatgcttgctgcgagttattggtccctactggcccctgctgtagagatggctacgagctctgggggattcggggctttcgcctttttcccggtcgccgttggcttcactcttggcgcagcatttgtatatctggctgatctcctaatgcctcaccttggggctgcggaggatccacagaccacgctggccctgaacttcggttccacgctgatgaagaaaaagtcagacccggagggccctgcactcctgtttcctgagtcagagctgagcattcgtatagacaagtcagaaaacggagaagcataccaacgcaaaaaagccgctgctaccggcctacctgagggacccgcagtgcccgtgccttctaggggcaatctagcccagcccggtggcagctcatggcgcaggatcgcattattgatactcgccataaccattcataatgtgcctgagggcctggcggtgggtgtgggattcggtgcaatcgaaaaaaccgcttccgcaactttcgagagtgccaggaacttagcgataggcatcggaattcaaaactttcctgaggggctagccgtgtctttgccactccgcggagccggttttagcacctggcgtgccttctggtatggccaactcagcggcatggtggaacctctggcaggcgtgttcggcgctttcgctgtggtccttgccgagccaattttaccttatgccctcgccttcgcagccggagctatggtgtatgtggtgatggacgatataattcccgaggctcagatcagtggcaatgggaagttggccagctgggcctccattctcggttttgtagtgatgatgagtttagacgtcggtttggggtag

SEQ ID NO: 54271 - DNA, 1029 bp, Artificial Sequence
  Description of Artificial Sequence: Synthetic coding sequence
atgctccaagggcattccagtgtgttccaggctctgctcggtacattctttacttggggcatgaccgcagccggtgccgcattggtgttcgtgtttagctcaggccagagacggattctcgatgggagcctcggatttgctgctggggtgatgctagccgcatcttactggagcctcctcgctcccgctgtagagatggcaacctcctcaggaggtttcggggctttcgcattcttccctgtcgccgtgggcttcacgctgggggctgcgttcgtgtatcttgccgatttgctgatgccccacctcggcgcagccgaggacccacagactaccctggcgctaaattttggatctacactaatgaaaaaaaagtccgaccctgagggtccagccttgctgtttcccgagagcgaactcagcatcagaatcggccgagccggattactctctgataaatccgaaaacggcgaagcttatcagagaaagaaggcggcagctaccggccttccagaagggcctgctgtcccagtgcccagtagagggaatctagcacagcccggaggcagcagctggaggcgcattgctctcttaatcctggctatcactattcataatgttccagagggcctggccgtgggtgtgggctttggcgcaatcgagaaaaccgcatccgcgaccttcgagagcgccaggaacctagccattgggatcggaatccagaatttccctgagggattggcagtgtcactgcctctgagaggagctggcttcagcacatggagggcattctggtacgggcagctgtctgggatggtggagccccttgctggggtcttcggtgcattcgccgtcgtattagccgaaccaattttgccttacgcccttgcctttgcagcgggtgctatggtttatgttgtgatggatgacattattcccgaggctcagatttccgggaacggaaagctcgcttcctgggcctcgattctggggttcgtggtcatgatgagcttagacgtcggcctcgggtag

SEQ ID NO: 54272 - DNA, 1623 bp, Artificial Sequence
  Description of Artificial Sequence: Synthetic coding sequence
atgatgggaagccctgtctcccatctgttagccggattttgtgtttgggtggtcctgggttgggttggcggaagcgtccctaaccttggcccagccgaacaggagcaaaaccactacctggcacagttgttcggactttacggcgagaatggcaccctgacggcgggtgggctcgcccgattgcttcatagtctgggactcgggagagtgcaaggtctgcggcttggccagcatgggccacttactggcagagcggcaagccccgctgcagacaactctacccaccggccacagaatcccgagctgagcgtcgacgtgtgggctggcatgccacttgggccttccgggtggggggatctggaggaatcaaaagcccctcacttgccgcgtggacccgcaccttcagggctcgacctactgcaccggttgctgctcctggaccactcgttggccgatcatctgaatgaggattgtctgaacggcagccagctgttggttaactttggcctgtctccagctgctcctctgacacccaggcagtttgccttgctgtgtcccgctctactgtaccagatcgacagccgggtgtgcattggtgcccctgccccagctcctcccggagatctcttgtctgcacttctccagtctgcactagcagtcctgctgctctccctcccatcccctttgtctctcctgcttttgcgactgttgggacccagactcctgcggcctctactgggcttcctgggcgctctggcagtcggaacactctgtggcgacgcactgctccatctcttaccgcacgcccaggaaggcagacacgcaggtccaggagggttgcctgaaaaagacctgggacccggtctgtctgtactgggcggactgttcctcctgttcgtgctagaaaatatgctcggccttctgcgccacaggggcctgagacccagatgctgtcgcaggaaacgtcgcaacttagaaacaagaaatcttgaccctgaaaatgggtctgggatggctctgcaaccgctgcaggcggctcccgagccaggtgcccagggacagagggagaagaatagccagcatccccctgccctagcccctcccggacaccaaggacactcacacggccaccagggaggaactgatatcacatggatggttcttctaggggatggcctgcacaaccttaccgacggcctcgctatcggggcagcctttagtgatggcttcagttccgggctttctaccacgctggctgtcttttgccatgagcttccccacgaactgggtgactttgcaatgctgctccagtcaggcctctctttccgacgcctgttgcttctgtctctggtgtcaggtgctcttgggctgggcggagctgtcctgggggttggcctctccctcggtcctgtgccgctcacgccctgggtctttggggttaccgcaggagtcttcctgtatgtggctcttgtggacatgttgccagcactgctgagaccgccagagcccctgccaaccccacatgtccttctgcagggacttgggcttcttttgggtggagggctaatgctggctataaccctcctcgaggagagactcttacctgttactactgagggctag

SEQ ID NO: 54273 - DNA, 390 bp, Artificial Sequence
  Description of Artificial Sequence: Synthetic coding sequence
atgatgggctcccccgtgtctcacctattggcaggcttttgtgtgtgggtggtgttgggatgggttggagggtctgtgccgaacctggggcctgctgaacaggagcagaatcactaccttgcacagctgttcgggctttacggtgaaaatggaactctgacggcaggtggactggccagacttctgcactcactgggactcgggcgagtgcaggggctacgactgggccagcacgggcctctcacaggcagagccgctagcccagcggctgataactccacgcaccgtccccagaatcctgagctgagtgtcgatgtctgggccggaatgcctctagggccatctggctggggagatcttgaggagtcaaaggcccctcaccttccatag

SEQ ID NO: 54274 - DNA, 471 bp, Artificial Sequence
  Description of Artificial Sequence: Synthetic coding sequence
atgatgggttctccagttagccacctactggctggcttctgtgtctgggtagttctgggctgggtgggcggttccgtgcctaatctgggcccagcagagcaggagcaaaaccactacctggctcagctgttcggtctttacggagagaacggcactctcactgccggtgggctcgcacgcctgctgcactccctgggactaggaagggtccagggtctgcgtctggggcagcatggcccactgaccgggagagctgcttcccccgcagccgacaactccacccaccggccacagaaccccgagctgtccgtcgacgtatgggctggcatgccattgggacctagtggatggggagatcttgaggaaagcaaggcccctcacttaccgaggggcccagccccatccggactagatctgctccatcggttgctcctgctggaccactcactggcggaccaccttaacgaatag

SEQ ID NO: 54275 - DNA, 372 bp, Artificial Sequence
  Description of Artificial Sequence: Synthetic coding sequence
atgatgggctccccagtttcacaccttcttgctggcttctgcgtgtgggtcgttctcggctgggtggggggatccgtgcctaatctcggcccagccgagcaagagcagaaccattatctggcgcagctttttggcctttacggggaaaatgggacgctcaccgccggagggttggccaggttattgcactcccttgggctgggcagagtgcaggggctgaggctgggtcagcacggtcctctgaccgggagggctgctagccccgcagcagacaacagtacacaccggccacaaaaccctgaactatccgtcgatgtctgggcgggaatgcccctaggaccttctggatggggggatctagaggagtcttag

SEQ ID NO: 54276 - DNA, 381 bp, Artificial Sequence
  Description of Artificial Sequence: Synthetic coding sequence
atgatggggagccctgtttctcatctactggcagggttctgtgtgtgggtggtcctgggttgggtgggtggatctgtgccgaacctcggtccagcagagcaagagcagaaccactatttagctcagctgttcggtctttacggcgaaaatggcaccttgaccgccggaggactggcccgtttattacactccttaggactcggtagagtccagggactgcgccttggccagcatggacccttgaccggcagggccgcaagtccagcggctgataactctactcatagaccgcaaaatccagagttaagcgtggacgtgtgggctggcatgccgctgggacccagcgggtggggcgatctcgaggaatccaaggccccttag

SEQ ID NO: 54277 - DNA, 1623 bp, Artificial Sequence
  Description of Artificial Sequence: Synthetic coding sequence
atgatgggcagcccagtgagccacctattagctggattttgtgtgtgggtcgtgcttggatgggtcggcggatcagttcctaatttgggtcctgcagaacaggagcagaatcattacctcgcacagctcttcggcctgtacggtgagaatggaacactgaccgctgggggtctagctcgtctgctgcattccctgggcttggggcgtgtccagggtctgcgcctaggccagcacgggcctttgacaggcagagcagcctctccggctgccgataacagcacccatagaccccagaatcctgaactaagtgtcgatgtgtgggccggaatgcctttagggccttctggctggggagatctggaggagagtaaggcccctcacctaccacgcggtccggctccatccggcctggacttgctccatcggttattgttgctggatcactctctcgccgaccacctaaacgaagactgtctcaatggctcacaactgctagtgaactttggcctcagtcctgcggcacctttgactccacgccagttcgccctgctgtgtccagctctgctgtatcagatcgacagcagagtgtgcatcggtgcccctgcgccagccccaccaggcgacttgttgagcgcgctcctacagagcgctctggctgtcctcctgctgtcattgccatctcctttatctctcctgcttctgcgccttctgggaccgaggctgctgaggcccttattggggttcttgggggctctggcagtagggactctttgtggagacgcgctactccacctgctgcctcacgctcaagagggcagacatgcaggacccggagggctgcccgaaaaggacctggggccaggtctgagcgtcctaggaggtctgtttttgctgttcgtcctagagaatatgctggggttactgcgacatcgcggtctgcgaccccgatgctgcaggagaaaaagacgtaaccttgaaacgcgcaatttagatccagagaatggtagcggaatggccttacagccactgcaagccgcacccgagcctggggctcagggacagagggagaaaaactcacaacacccacctgctctggcacccccagggcaccagggccacagccacggccatcagggcggtaccgacattacatggatggttttgctgggcgatgggcttcataacctgactgacggcctggccattggtgcagcatttagtgacggtttcagctcaggactgagcacaactctcgccgtcttctgtcacgagttgccccacgaactgggggattttgccatgctcctgcagtcaggtctgtcctttcggagactgttgttgctcagcctggtgtctggggctctcggccttgggggagccgtccttggagtgggtttgagtttaggcccagttcctctgacaccatgggtgttcggtgtgaccgcaggagtgtttctctatgtggccttagtcgatatgttgcccgctctcttgcggccacctgagcccctgcctactcctcacgttctgctacaaggtctgggactacttcttggtggcggtttgatgctagctatcaccctcctcgaagaaagactattgcccgttactacggagggatag

SEQ ID NO: 54278 - DNA, 699 bp, Artificial Sequence
  Description of Artificial Sequence: Synthetic coding sequence
atggacgatttcatcagcatcagtctgttgagtctcgccatgctggttggatgttatgtagctggcatcatccccctggccgttaacttctcagaggaaagattgaaactggttaccgtcctgggcgctggcttgctttgtggtactgctctggctgtcatcgtcccagagggcgtgcatgccctctacgaagacatcctggagggcaagcatcaccaggcctctgaaactcacaatgtaattgcgtctgataaggcagctgaaaagtctgttgtccatgagcacgaacattcacacgatcacactcagcttcatgcttacattggtgtgagccttgtcctcggatttgtgtttatgctacttgtcgatcaaatcggaaactcacatgttcacagcactgacgaccccgaggccgctcgtagcagcaatagtaagatcaccacaacccttggattggttgttcatgccgctgctgacggggtggccctcggcgctgccgcttcaacatctcagacgagcgtccagcttattgtatttgttgccataatgctgcacaaggcacctgctgcgtttgggcttgtcagcttcctgatgcacgcaggattagagcggaataggatcaggaaacacctgctcgtcttcgccctggctgccccagtgatgagtatggtgacataccttgggctctcaaaggattag

SEQ ID NO: 54279 - DNA, 2496 bp, Artificial Sequence
  Description of Artificial Sequence: Synthetic coding sequence
atgaaggtccatatgcacacaaagttttgcttgatctgtctcctgacctttatattccatcattgtaatcattgtcacgaggagcacgaccatgggccagaagctctacacagacagcataggggtatgactgagttggaaccatccaagtttagtaaacaggctgcggagaacgagaaaaagtattatatagagaagttatttgaacgctatggagaaaatggccgattaagtttcttcggtctggagaagttactgacaaatctcgggctgggggagaggaaagtagtcgaaattaatcacgaggatctggggcacgatcacgtatcccacctcgatatcttggctgtgcaggagggaaagcatttccactcccataaccaccagcattcacacaatcacctcaactccgagaatcagacagtgacatctgtgtcgaccaaacgcaatcacaaatgtgatcctgaaaaggagaccgtggaggtctctgttaagtccgacgacaaacatatgcacgaccacaaccaccgtcttagacaccaccaccggcttcaccaccatctggatcacaataacacccaccatttccacaacgattcaataaccccctccgaacggggtgagccctctaacgagccctcgacagagactaacaaaacgcaggagcagagtgacgtgaagttgccaaagggcaaaagaaaaaaaaaaggacgtaaatctaatgaaaactccgaggtcatcacccctggctttccgccaaatcatgaccaaggcgagcaatacgagcacaacagggttcacaaacctgatagagtccacaaccccggtcactcccatgttcatctgcctgaacggaatggccatgatccgggacgcggacatcaagatctggaccccgacaacgagggggagttacggcacactaggaaaagggaagctccccacgtgaagaacaacgccatcatctctctccgcaaagatctaaatgaagacgaccaccaccacgagtgtctcaacgtcactcagttgctgaagtattacgggcacggggcaaacagcccaatctctaccgacttgttcacctacctgtgccctgccctcctgtaccaaatagattcacggctgtgcattgagcactttgataagcttcttgtggaggacattaacaaagataagaatcttgtgcccgaggacgaagccaatatcggtgcatccgcctggatatgcgggatcatatctattacagtgatctctctgctgagtctgcttggcgttatcctggtaccaatcattaatcagggatgcttcaagttcctgctgacattcctggtagccctggccgtcggtacaatgagtggtgatgccctacttcatcttctgccccacagccaaggcggacacgatcacagtcatcagcacgcccatgggcacggtcatagccacggtcacgagtctaacaagtttctcgaagagtatgacgccgtcctgaagggactcgttgctctgggaggcatctatctgcttttcataattgagcactgtatacgaatgttcaagcattacaaacagcaacggggaaaacaaaagtggtttatgaaacaaaatactgaagagagcaccatcggtagaaaattgagcgatcacaaactgaacaatactcccgattctgattggctgcagctgaagccactcgctggtacagacgacagtgtggtgtcagaagaccgtttgaacgagactgagctgacagacctagaaggacagcaagaatccccgccaaagaactatttgtgtattgaagaggagaaaataatagaccactcccactccgacggcctacacaccatacatgaacacgatctacacgcagcggctcacaaccaccatggggaaaacaaaacagtgttacggaagcacaatcatcagtggcaccacaaacacagccaccactctcacggcccttgtcattctggttccgacctgaaagaaaccggtattgccaacatcgcgtggatggtaatcatgggcgacggtatccacaacttttctgacggattagccattggtgcggcttttagtgcgggtctcacaggcggtataagtacaagtatcgcagtgttttgccacgagctgccccatgagctaggagactttgcagtcctccttaaagccggaatgactgtgaaacaggccatcgtgtataatctgttgtcggccatgatggcctacatcgggatgctgatcggtacagcagtcgggcaatacgccaacaacattaccctttggatcttcgccgtaaccgctggaatgtttctatatgtggctctggtggacatgctgcctgaaatgctacatggcgacggtgacaatgaggaacatggtttctgtcctgttggtcagtttatcctgcagaatctaggtctattgttcgggttcgccatcatgctggtgattgcactctacgaagacaagattgtatttgacatccagttctag

SEQ ID NO: 54280 - DNA, 2496 bp, Artificial Sequence
  Description of Artificial Sequence: Synthetic coding sequence
atgaaagtgcatatgcatacgaaattctgcctgatctgtttactgaccttcatctttcatcattgtaatcactgccatgaagagcacgaccacgggcctgaggccctgcaccgccagcacagagggatgactgagctcgagccatctaagttttcaaagcaagccgctgaaaacgagaagaagtactatattgaaaagctgtttgagcgctacggcgaaaacgggagattgagcttcttcggtctggagaagctgcttactaacctcggactgggcgagcgcaaagtggtggagatcaatcacgaagatcttggtcatgaccacgtgtcccacctggacattcttgcagtgcaggaaggaaagcacttccactcacacaaccatcagcacagccataatcacctaaacagtgagaaccagaccgttacttctgtttccaccaagcgcaaccataaatgtgatcctgagaaagagacagtagaagtgtccgtgaaaagcgatgacaaacatatgcatgaccacaaccataggctgagacaccaccatcgtctgcatcaccatctcgatcataacaatacccatcactttcacaatgattccatcactccctccgaaagaggtgagccgagcaatgagccgagcactgaaactaacaagacacaggaacagtctgatgtgaagctccccaaagggaagcggaaaaagaaggggaggaaatctaatgagaacagtgaggtgatcacaccagggttccctcctaatcacgatcagggtgagcagtacgagcacaacagagtacacaaaccagaccgtgtgcataatccagggcactcccacgtgcacctgccggagcgcaacggacacgaccccggaagggggcatcaagacttagacccagacaacgagggtgaactgcgccacacgcgaaagagggaagctccccacgtgaagaataatgcaataatttcacttaggaaggacttgaatgaagacgatcatcaccatgagtgcctcaacgttactcagctattgaaatattacgggcatggtgccaattcgccgatctcaacggacctctttacctacttatgtcctgctctgctgtaccagatagattctcgcctctgtatagaacacttcgataaactccttgttgaagatattaacaaagacaagaatctcgttccggaagatgaagcaaacattggggctagcgcatggatttgtggaataattagtataaccgttatcagtttgctctccttgctcggggtaattctggtgcctatcattaaccaaggatgcttcaagttcttgctcaccttcctcgtcgccctcgctgtcggaactatgtccggcgatgcactgctgcacttgctccctcattcacagggcggacacgaccattctcatcaacacgcccacgggcacggccacagccatggccacgaatccaataagttcttggaggagtatgatgctgtccttaagggtttggtggcattaggaggaatctacttgcttttcataattgagcattgtattcgcatgttcaaacactataaacaacagcgagggaagcaaaagtggtttatgaagcagaacacggaggagtctacaatcggacgaaaattaagcgaccataagctgaataacactccagacagtgattggttgcagctcaagcccctggctgggacagacgacagcgttgtgagcgaagatcgtctaaacgaaacagaacttaccgacctggagggtcagcaggagtccccccctaagaactacttatgtattgaggaggagaaaatcattgatcactcgcactccgacggactgcacaccatccacgaacatgacctacacgcggcagcgcacaatcaccacggcgaaaacaaaacagtgctaagaaaacacaatcatcagtggcaccacaaacactctcatcacagtcacgggccttgccatagcggctcagacctaaaggagactggaattgctaatatcgcctggatggtaatcatgggcgatggcattcataacttctctgacggactggctattggtgccgcttttagtgctggactgactggcggtatatcaacttctattgccgtcttttgccacgaacttccccatgaactgggcgattttgccgtactgctaaaggctggaatgacggtgaagcaggcaattgtgtacaatcttctgagtgctatgatggcttacattggcatgttgatcggcaccgcggttggacaatacgctaataacatcacattatggatcttcgctgtgactgccggtatgtttctgtacgtggcactcgtcgacatgctgccagaaatgctgcatggggacggagacaacgaggaacatggtttctgccccgtcggacagttcatattgcaaaatctgggcttactctttggctttgccattatgcttgtgattgcactgtacgaggataagattgtgttcgacatacagttttag

SEQ ID NO: 54281 - DNA, 117 bp, Artificial Sequence
  Description of Artificial Sequence: Synthetic coding sequence
atgaaagtccacatgcacactaagttttgtctgatctgtctgttgacatttatattccatcactgcaatcactgccacgaagagcacgaccacggcccagaggccctgcatcgttag

SEQ ID NO: 54282 - DNA, 393 bp, Artificial Sequence
  Description of Artificial Sequence: Synthetic coding sequence
atgaaagttcatatgcacactaagttctgtctcatttgtctcctaacctttatcttccaccactgtaatcactgccatgaggaacacgatcatggcccagaagccctacacagacagcatcgtgggatgactgaacttgagccaagcaaattcagtaaacaagctgccgagaacgagaaaaaatattatatcgagaagctgttcgagcgttacggcgagaacggacgcctgtcgttcttcgggttagaaaaactgctgacaaacctggggttgggggaacggaaggttgtcgagatcaatcacgaggatttgggacatgatcacgtcagccatctggacatcctcgcagttcaggaaggcaagcactttcactctcacaaccaccaacactag

SEQ ID NO: 54283 - DNA, 381 bp, Artificial Sequence
  Description of Artificial Sequence: Synthetic coding sequence
atgaaagttcatatgcatactaagttctgtctgatctgtttgctcacatttattttccaccattgcaaccattgtcacgaggagcatgatcacggccctgaagctctgcatcgtcagcacagaggaatgacagaactcgaaccctcaaaattttcaaagcaggccgctgagaatgaaaaaaagtactacatagagaagctgtttgagcggtacggagagaacgggaggctgtcattttttgggcttgagaaattactcactaatctggggctgggagagcgcaaggtcgtggaaataaatcacgaggacctaggacacgaccacgtgtctcatctcgatatcttggccgttcaggaaggaaagcactttcattctcattag

SEQ ID NO: 54284 - DNA, 1146 bp, Artificial Sequence
  Description of Artificial Sequence: Synthetic coding sequence
atgtccggggatgcactccttcatctgctccctcatagccaggggggacacgaccattcccaccagcacgcccacggacacggccattcacatgggcacgaaagtaacaaattccttgaggaatacgatgcagtgttgaagggtctcgtagcactgggcggaatataccttctttttatcatcgagcactgtattcggatgttcaagcattacaaacaacagcgaggaaaacagaaatggttcatgaaacagaacacagaggagtcaaccattggcagaaagctttctgatcacaagctgaataacacaccggatagcgactggctacagctgaagccactggccggtactgacgatagcgtcgtctcagaggataggctcaacgaaactgagctcacggatcttgagggccagcaagaatccccaccgaaaaattacctgtgcattgaggaggagaaaatcatcgaccacagccacagtgatggactgcacacaatacatgagcatgatttacacgccgcagcgcacaatcaccacggagagaataagaccgtacttaggaagcacaatcaccagtggcaccacaagcatagccaccactctcacggtccttgccattccggtagcgaccttaaggagactggcatcgccaatatcgcatggatggtcatcatgggcgatggaatccataatttttctgacgggttggccatcggagcggcattctccgctggtctcaccgggggaatctcaacgtcaattgcggtcttctgtcacgagttaccccatgaactgggggattttgcagttctgctcaaagctggtatgactgttaaacaggcaattgtgtacaacctcttgtccgccatgatggcttacatcggcatgctgattggcacagccgtggggcagtatgctaacaacattacactctggatcttcgcagtcaccgccggtatgttcctgtacgtagctcttgtggacatgctgccagagatgttgcacggggatggtgacaatgaggaacatggattctgtccagtcgggcagtttatcttgcagaacctgggcttattgtttgggtttgccatcatgctggtcatcgcgctgtatgaggataagattgtgttcgatatccagttttag

SEQ ID NO: 54285 - DNA, 2076 bp, Artificial Sequence
  Description of Artificial Sequence: Synthetic coding sequence
atgtgcttccgaacaaaactgagtgtgtcttgggtcccactcttcctgctgctatctcgcgttttttctacagaaacagataagccgagcgcccaggacagccgttcccgcggaagtagcgggcagcccgctgaccttctgcaagtgctgagtgcgggagaccacccccctcataatcacagtagaagtcttattaagaccctgctggaaaaaaccggatgcccccgtagaagaaacgggatgcagggcgactgtaacctctgctttgaaccagatgccctgctgcttattgcaggcggtaatttcgaagaccaacttcgggaggaggtggtgcagcgcgtcagccttttgctgctttactacatcatccaccaggaggagatatgctctagtaagttgaatatgtccaacaaggaatacaagttctacctgcactcactgttgtcccttaggcaggatgaggactcgagctttctctcacagaacgaaacagaggacatacttgcctttacccggcagtacttcgatacctcgcaatcgcagtgtatggagactaagaccctgcagaaaaagtcagggatcgttagcagcgagggcgcaaatgagtcaacactgccccagttagccgctatgatcatcactctcagtcttcagggagtttgcttgggacagggaaatcttccatccccagattattttacagaatacattttctcctctctgaataggacaaacaccctgcggttatccgaattggatcagctgcttaataccttgtggaccaggtcgacctgtattaaaaacgaaaagatccatcagtttcagcgaaagcagaataatattatcacccacgaccaagactattcgaacttctcctccagtatggaaaaagagagcgaggatgggccagtctcctgggaccagacctgtttctccgccagacagctggtggaaattttcctgcagaagggtctgtcactgatctccaaagaggacttcaaacagatgtcacccggtataattcagcagctcctgtcttgcagctgtcacctccccaaagaccaacaagctaaactgcccccaacaaccttggagaaatacggctactccacagttgctgttaccttgcttacattggggagtatgttgggcacggccttggtcctgttccacagctgtgaggaaaattaccggcttatactccagctgttcgtggggttagccgtcggtacactctcgggggacgccctgttgcatttaatcccgcaggttctgggattacataagcaagaagccccagagtttggccatttccacgaatctaaagggcacatatggaagctcatgggtctaatcgggggtatccatggctttttcttaatagaaaagtgctttattctgttggtttcccccaacgacaaacagggtctcagtctggtgaacgggcacgtggggcatagtcaccacttagccttgaattcagagctgagtgatcaggcaggtcggggtaagagcgccagcaccattcaactgaaatctcccgaagattctcaagcagctgagatgccaatcgggtcaatgacagccagtaatcgtaaatgcaaagccatttctctcctggccatcatgattctggtaggcgactctctgcacaacttcgcagatggtctggcaattggcgcagcgttctcctcctctagtgaaagtggtgttacaaccactattgccatcctgtgtcacgaaatcccacatgagatgggagactttgccgtcctactttcctcaggactttccatgaaaacagctatcctcatgaactttattagcagccttacggcgttcatgggtctttacataggcctttccgtgagcgctgatccgtgcgtgcaagactggatcttcacagtcacagctggaatgtttctgtacctctccctagttgagatgttgccagagatgactcacgttcaaacacagagaccatggatgatgttccttttacaaaattttggtctcatccttggctggctttcgctgctgctgctcgctatctatgagcagaatataaaaatctag

SEQ ID NO: 54286 - DNA, 2073 bp, Artificial Sequence
  Description of Artificial Sequence: Synthetic coding sequence
atgtgttttcgcaccaaactgtccgtcagctgggtgcccctttttctactgctgtctcgcgttttctccactgaaacagacaagccatctgcgcaggatagtcgcagtcgaggctcgtccggccaaccagcggacctgttacaggtgctctccgctggcgaccaccctccacataaccatagtcggagcctcattaaaactctcctagagaaaacggggtgccccaggagacggaacgggatgcagggcgactgcaacctttgcttcgagccagatgctctgttacttatcgcgggtggcaactttgaagatcaactgagggaggaagtagtgcagcgagtgtctctattacttctgtactacattatccatcaggaagaaatctgctcctctaagctgaatatgtccaacaaggaatataaattttacctccatagcctgctttccctgagacaggatgaagacagtagttttctgtctcagaatgagaccgaggacattctcgcctttacaaggcaatatttcgacacttcccagagtcaatgcatggaaaccaaaacgctccagaaaaagtcagggattgtgtccagtgaaggggctaacgagagcacgctgccacaacttgccgcaatgattatcactctgtcgttgcaaggcgtctgtctcgggcagggaaatcttccctcccctgattacttcacagagtacatcttctccagccttaacaggactaacactctgcgcctcagtgaactggatcagcttctgaacacattgtggacccggtcaacctgcatcaaaaatgagaagatacaccaatttcagaggaaacaaaataatatcatcacccacgaccaggattattccaacttttcttctagcatggaaaaagagtcggaagatgggcctgtgagctgggaccagacctgcttttctgcccgacagctggtagagatattcctccagaagggcctgagtctgatttctaaagaggatttcaagcaaatgagccctggaattattcaacagctccttagctgctcctgccacctgcctaaagaccagcaggccaagcttcctcctaccaccttagagaaatatggatattccactgttgcggttacgttattgaccctgggatctatgttgggtaccgctctcgtgctgtttcactcttgcgaagagaactaccggttgatattgcagctgtttgtgggcctggccgtggggactctttcgggcgacgcgcttttacacctaattcctcaggtactgggtctgcacaaacaagaggcacccgaatttggtcacttccatgaatctaaggggcacatctggaagctgatgggacttatcggtggcattcacgggttttttttaatcgagaaatgttttattctactggtcagtcctaacgacaaaggcctgtctctggtgaatggccatgtcggtcactcccatcatcttgcattaaattctgagctgtccgatcaggcagggagaggaaagtctgccagcaccatccagctgaagtctcctgaggactctcaggcagccgaaatgcctatcgggagcatgacagccagcaatcggaagtgtaaagccattagccttctagcgatcatgattctggttggagactcactccacaattttgcggacgggctggccattggcgcagccttttcctctagctccgaaagcggtgtcactacgacaattgcgatcttgtgccatgagattccccacgagatgggtgattttgccgtcctcctgtcctctggattgtccatgaaaacagccatcctcatgaacttcatatcaagcctgacagctttcatggggctatacattggcttgagtgtcagtgccgacccttgtgtgcaagattggatcttcaccgtcacagcagggatgtttctttatctgagcctggtcgagatgctaccagaaatgacccacgtgcagactcagcggccttggatgatgtttttgttacaaaactttggcctcatcctcggctggttgagcttgctccttctggccatctacgaacaaaacatcaaaatctag

SEQ ID NO: 54287 - DNA, 1965 bp, Artificial Sequence
  Description of Artificial Sequence: Synthetic coding sequence
atgtgtttccgtacaaaactctctgtcagctgggttccacttttcctcctcttgtctagggtgttctccaccgaaaccgacaaaccttctgcccaagattcgaggagccgagggtcttccggccagcctgctgatttattgcaggtgttatcagcaggagatcaccctcctcataaccacagccggagtctaattaaaaccctgctcgaaaagaccggatgcccgcgtaggaggaacgggatgcagggcgactgtaacctgtgtttcgagcccgacgccctgctgctgatcgcaggcggtaatttcgaagatcaactgcgcgaggaggtggtgcagagagtttctctcctgctcctgtactatataatccaccaagaggagatctgcagctcgaagctgaatatgtcaaacaaggaatacaagttttatctccactcactgctctctctgcgtcaagatgaggatagcagctttctgtctcagaatgaaactgaggacattctcgctttcaccaggcagtatttcgacacaagccagagccagtgtatggagactaagaccctccaaaagaaatccggaatagtgtcatccgaaggcgcaaacgaatcaaccttgcctcaactcgctgcgatgattattacactgtcactgcagggagtctgtctaggccagggcaacctcccgagccccgactacttcaccgaatacatcttctcaagcttgaaccgcacgaacactcttcgcctctccgagcttgaccagctactcaataccctgtggacccgctcgacttgtattaaaaacgaaaagatccatcagtttcaaaggaaacagaacaatatcattacgcatgaccaggactactcaaacttttcctcctcaatggaaaaagagtcagaggacgggcctgttagctgggaccagacttgtttcagtgcaagacagctcgtagaaatctttctccagaaaggccttagtttaatttcgaaggaggattttaaacagatgagtcccggtatcatccaacaactgctgtcctgtagctgccaccttcccaaggaccaacaagcgaagctcccgccaaccaccctggagaaatacggttatagtactgttgcggttacactactgacgctgggatccatgcttggcaccgctctagtgctgtttcattcctgcgaagagaattatcgactgatccttcagctgtttgtcggcttagccgtgggaacgttgtcaggggacgcactcttacacttaattcctcaggttctgggcctgcacaaacaggaagcgcctgagtttgggcacttccacgaatctaaagggcatatttggaaattgatggggttaataggcggaattcatggattctttctgattgagaagtgcttcattctcctagtgagccccaacgacaagaagtctcctgaggactctcaggccgctgaaatgccgataggatcaatgactgcatcgaatcgcaagtgtaaggccatctcactgttggccatcatgatcctggtgggcgattcgctgcacaatttcgcagatggcctggctatcggcgcagcattctcttcctcctcggaatctggagtgaccaccacaatcgctattctgtgccacgagatacctcacgaaatgggcgactttgcagtgctgctttcatcaggtctttctatgaagaccgcaatcctcatgaatttcattagctcattgacagcattcatggggctgtatatagggctgtccgtatctgctgatccttgcgttcaagattggatcttcacggtcacggccggaatgttcctgtatctgtccctcgtcgaaatgttgcctgaaatgacacacgtccagacgcagcggccatggatgatgttcttactgcagaatttcggactgatcctgggttggctttctcttctgctgctcgccatatatgagcaaaatattaagatttag

SEQ ID NO: 54288 - DNA, 1836 bp, Artificial Sequence
  Description of Artificial Sequence: Synthetic coding sequence
atgcaaggggactgtaatctctgttttgagcccgatgcgctgctgctgatcgctggtggcaacttcgaggaccaactccgggaagaagtagttcaacgcgtcagcctgctccttctgtattatattatccaccaggaggaaatctgctcctccaagctgaatatgagtaacaaggagtacaagttttatctgcacagcttactttccttgcggcaggacgaggattcttcattccttagccagaatgagaccgaggacatcctggccttcactcgacagtatttcgatacctctcagagccagtgtatggaaacaaaaacgctccagaagaagtccggaattgtgtccagcgaaggtgcaaatgaaagcaccctgccccagctggcagctatgataatcacacttagtttgcagggcgtatgtctgggccagggtaatctcccctctccggactatttcacggaatacatattctcttcgctcaatcgaacaaacactctgagactgtcagaacttgatcagctgcttaacaccttgtggacccgatccacgtgtatcaagaatgaaaaaattcaccagtttcagagaaagcagaataacatcatcacccacgatcaagactattccaatttttcttcaagcatggagaaagaatctgaagatggccctgtctcatgggatcagacttgtttttccgccaggcaacttgttgaaatcttcttacaaaaaggcttatcgctaatctctaaggaagactttaagcaaatgagccccggtataatacagcagctattgagctgctcgtgccaccttcccaaggaccagcaggctaaacttcctcctaccacgctcgagaagtatggttactcaaccgtagcagtgactctgctcactctgggatccatgctcggtacagcccttgtcctgttccacagttgcgaggaaaattacaggctgattctgcagttgttcgttggtctggccgtgggtacgctgagtggagatgccctactgcatttaatcccacaggtgctcgggctgcacaagcaagaggctcctgaatttggccatttccacgaaagtaagggccacatttggaaattgatggggctgattggtgggatccacggattctttctgatcgaaaagtgcttcattcttcttgtgtccccaaacgataagcaggggctgtcactggttaatggccatgttggccatagccaccacctggcgctgaatagcgagctgagtgaccaagctgggaggggcaagagtgcctcaacaatacagctgaagagtcctgaggacagccaagcggcagagatgcctatcggtagtatgacggcgagcaaccggaagtgtaaagccatttctctcctagccatcatgatactagtgggcgacagcctgcacaatttcgcagacggattagctattggcgctgctttctcttccagtagtgaatctggggtcactaccaccatcgccatcctctgtcacgagattccccatgagatgggggattttgctgtcttgctaagttcaggtctaagtatgaagaccgccattctgatgaacttcatcagctccctcaccgcttttatgggcctgtacataggactctcagtgagcgcggacccctgcgtgcaggactggatcttcacagttaccgcgggtatgttcctctacctgtcactggtagaaatgctccccgaaatgactcatgtgcagacacaacgcccatggatgatgttccttctgcagaattttggcctgatcctggggtggctttctcttctgctgctggccatttacgagcaaaacattaagatatag

SEQ ID NO: 54289 - DNA, 1674 bp, Artificial Sequence
  Description of Artificial Sequence: Synthetic coding sequence
atgtccaacaaggaatacaagttctaccttcattccctcctctctttgagacaggatgaagatagcagtttcctgagccagaacgagaccgaagacatacttgcctttacccgtcagtacttcgatacatcacagagccagtgtatggaaacaaaaacactgcaaaagaagtctggtatcgtgagcagtgagggcgctaacgaatcaacactgccccagctggcggcaatgataataacactgtccctccagggcgtctgtctggggcaaggcaacctgcctagccccgactattttacagagtatatattttcgtctctgaaccgaacaaacaccctgcggctctccgagcttgatcagctcctgaacaccctatggaccagaagtacatgcataaagaacgaaaagatccaccaattccaacggaaacaaaataacataatcactcacgaccaggactactctaactttagctcctcaatggaaaaggaatccgaagacggccctgtttcctgggatcaaacttgcttcagcgcccgacaacttgtggaaatattcctgcagaaaggcctctcactgataagcaaggaggactttaagcagatgagccctggtattatccaacagctgttgagctgctcttgccacttgcccaaagatcagcaggcgaaactgccgcctaccacgctggagaaatatgggtacagcacggtcgccgttacacttttgaccctcggatctatgcttggcacagctctggtgttgtttcactcctgtgaggaaaattaccgactgattctacagcttttcgtgggactcgcagtaggaaccctgtcaggggacgctttgctccatctgatcccccaggttttgggcctacacaagcaggaagccccagaattcgggcacttccacgagtctaagggacacatctggaaactaatgggtcttattggcggtattcacgggttttttctcatagaaaagtgtttcatcttgctggtaagtccgaacgacaagcaaggtttgtctctggtgaatggtcatgtggggcatagccatcatttggcgttgaactcagagctcagcgatcaggcgggtagagggaagtctgcctcaaccattcagctgaagagccctgaggattcgcaagcagccgagatgcccattggtagtatgactgcttctaatcgtaagtgtaaggctatttccctactggccattatgatcctcgtgggtgatagcctgcataatttcgccgatgggctagctataggtgcggcattttcatccagttcagagagcggcgtaaccaccaccatcgcaatcctttgccacgaaataccgcatgagatgggtgattttgcagtgctgctgtcttctggcctcagcatgaaaaccgctatcctcatgaattttatcagcagcctgaccgcattcatgggtttatatattggtcttagcgtttccgcggacccttgtgttcaggattggatctttacggtgactgccggaatgtttctctatctcagcctggtggaaatgctgccggagatgacgcatgtgcagacccagcgaccatggatgatgtttttgctacaaaactttggtctaatccttggatggctctcactgcttctgctagctatttacgagcagaacattaaaatttag

SEQ ID NO: 54290 - DNA, 1446 bp, Artificial Sequence
  Description of Artificial Sequence: Synthetic coding sequence
atgaagctgctgctgctgcaccccgctttccagagctgcttgctgcttaccctgctggggctctggcgtaccacacccgaggctcacgctagtagtctgggagcacctgccatcagcgccgcttcctttctccaggacctgattcataggtatggagagggagactcgctgactctacagcaactgaaggccctactgaaccatctcgacgttggcgtgggacggggaaacgtaacccagcacgtgcaagggcatcgcaacctcagcacatgtttctcctctggcgacctgtttacagcccataacttttcagaacagtcccgtatcggtagctctgaactgcaggagttctgtccgacaatccttcagcaactggatagtcgcgcttgcacttcagaaaatcaggagaatgaagaaaatgaacagaccgaggagggcaggccgagcgctgtggaggtgtggggatacggcctattgtgcgttacggtgatcagtctttgcagcctgctgggagcaagcgtagtgccctttatgaagaaaacattctacaagcggctgctcctgtactttatcgccctggccattggcactctgtactcaaacgccttgttccagctgattcccgaagcttttgggttcaaccctttagaagattattacgtctctaagagcgccgtcgtgttcggagggttctacttatttttcttcactgaaaagatattgaagattctgcttaagcagaagaatgagcatcaccatggacacagccactacgctagcgagtccctgcccagcaaaaaggatcaagaggagggagttatggaaaaattgcaaaatggggatctggaccacatgattccacagcactgtagtagcgaactggacggcaaagccccaatggttgacgaaaaggttatagtgggatccctgtccgtgcaggatctgcaggcatcccagagtgcttgctattggctgaagggcgttaggtactctgatatcgggacactggcttggatgatcacgttaagcgatgggttgcacaactttatcgacggattagccatcggcgcttccttcactgtatccgtgttccaaggtatatcaactagcgttgccattctgtgcgaggagttccctcacgagttgggagattttgtcatcctactgaatgctggcatgagcatccagcaggctcttttcttcaattttctcagtgcttgctgctgctacctggggttagcatttgggattctggcaggaagtcactttagcgccaattggatctttgctctggctgggggaatgtttctctacattagtcttgccgatatgatggaattttgcagcgttgcccaggcaggggtgcagtggtgtcacttgtcatccctccaaccccttcctctaggtctgaagcggctcagctgtctgtctctgccctcaaattag

SEQ ID NO: 54291 - DNA, 1479 bp, Artificial Sequence
  Description of Artificial Sequence: Synthetic coding sequence
atgaagttgctcctgctccatccggcttttcagtcatgtctgctccttactctcctggggctgtggcgcacaacccccgaagcgcatgcctccagtctcggcgctcccgcaatcagcgccgctagttttctgcaggacttgattcatcgttacggcgaaggcgattcccttaccctccagcagttgaaagctctactgaaccacctggatgtgggcgtagggcgtggaaacgttactcagcatgtgcagggccacaggaatttaagtacttgcttcagcagcggagatctgttcactgcccacaacttctccgagcagtccagaatcggttccagtgaactgcaggaattctgtccaactattctgcagcagctggattccagggcctgcactagcgagaatcaggagaacgaagagaacgaacagaccgaggagggacgcccaagcgcggtggaggtctggggttatggcttgttgtgtgttactgtgatctcactgtgctcactcttgggtgcctctgtcgtgcctttcatgaaaaagaccttctataaaagattgcttctgtattttattgctctggcaattgggaccctgtatagtaatgcgctgtttcaactcattccagaagctttcggttttaatcccttggaagactattacgtgagtaagagtgctgtcgtgttcggaggcttctatctttttttcttcaccgaaaaaatactgaagatcctcctgaaacaaaaaaacgagcaccaccacggtcactctcactacgcttcggagtctctacccagtaaaaaggaccaggaggagggggtgatggaaaagttacagaatggcgacctggatcacatgatcccccaacactgcagctccgaactcgatgggaaggcccctatggtagatgagaaagtcatcgttggcagtctgagcgttcaggacctacaagcttctcaatcggcttgttattggctgaaaggagtgaggtactcagacatagggaccctggcttggatgatcacactgtctgacgggctgcataattttatagacggcctcgctatcggcgcttcctttacagttagcgttttccagggtatttcaacttcggtcgccatcctatgcgaggaatttccacatgagctaggcgacttcgtgatccttttgaatgccggtatgagcatacagcaggctttattcttcaacttcctgtcagcttgctgctgttacttgggtcttgcctttggaatattggcaggctctcactttagcgctaattggatttttgcgctggcagggggaatgttcctctacatatcactggctgatatgttccccgaaatgaacgaagtatgtcaggaggatgaacgaaagggtagtatactgattccatttatcattcagaacttagggttgctgaccggtttcaccattatggtcgtgctgaccatgtacagcggccagatccaaatagggtag

SEQ ID NO: 54292 - DNA, 1479 bp, Artificial Sequence
  Description of Artificial Sequence: Synthetic coding sequence
atgaagctcctgctgctgcacccggcatttcagtcctgcctgctactgacattgctcgggttgtggcggacaacacccgaagctcatgcctccagtctgggggcaccagcgatcagtgccgcaagtttcctgcaggacttgatccaccggtacggcgagggggattctctgacactacagcagctaaaagctctgcttaatcacttggatgtgggcgtggggcgaggaaacgtcacccagcacgtacagggacaccgtaatctgagtacctgcttttcttctggggacttgttcactgcccataacttctctgagcaatctcgcatcggaagtagtgagctgcaggagttctgccccaccatcctgcagcagctggattcgagagcctgtacttccgagaaccaggagaacgaggagaacgagcagacagaagaagggcgaccttccgccgtggaggtgtgggggttcggctttttgtcagtgtctctgattaacctcgcctctttactgggcgtgctcgtcctgccgtgtaccgagaaggctttcttctctcgggtcctcacttactttatcgcgttatcgatcggtacactcctctcgaacgccctgttccagctcatccccgaggccttcgggtttaaccccctcgaggactattatgtgtccaagtcggccgtggtgttcgggggattctatctctttttcttcactgagaaaatcctgaagatactcctaaaacagaagaacgaacatcaccatggccattctcactacgcctctgaatctctgccttccaagaaggatcaggaggagggagtcatggaaaagctgcaaaatggtgatctggaccatatgattccacagcattgttcaagtgagctcgatggtaaggcacctatggtagacgagaaggtcatagtcggttctttgtccgtccaagacctccaggcttcccaatctgcttgctattggctgaagggggttcgatacagtgacattgggactctggcctggatgatcacactaagtgatggtctacacaactttattgacgggctggcaattggagcgtcttttaccgtgtcagtgttccagggaattagcacctcagtcgcaatcctgtgcgaggagttccctcatgagttaggcgactttgtcatcctgctgaacgcagggatgtccattcagcaggctctgttctttaactttcttagtgcatgttgctgctatctggggctcgcgtttggtatcctggcgggatctcactttagtgcgaattggatcttcgccctggccggtggcatgttcttgtacattagcctcgccgacatgtttcccgagatgaacgaggtgtgccaggaggacgagcggaagggctccatccttatcccattcatcattcagaatttgggtctcttgactggttttacaatcatggtagtgctcaccatgtattctggccagatacagatcgggtag

SEQ ID NO: 54293 - DNA, 1479 bp, Artificial Sequence
  Description of Artificial Sequence: Synthetic coding sequence
atgaagcttctcctcttgcatcctgcctttcagtcttgcttgctccttactctgcttggcctctggagaaccacacccgaggctcacgcgagtagcctgggggcacccgcaatatcagccgcttcctttctccaagaccttatccatcggtacggggagggtgactctctgaccctgcagcagttgaaagcactgctgaatcacttggacgtgggagtgggtagaggcaatgtcactcaacatgtacagggacaccgaaacctttctacatgtttcagctcaggcgacctattcacggcgcataactttagcgaacagtccaggattggcagttctgagctgcaggaattctgcccaacgatactccagcagctcgacagccgggcttgcacctcagaaaatcaagaaaacgaggaaaacgagcaaactgaggaaggaaggccaagcgcagtggaggtgtggggatatggcttgctctgtgtcacagttatatctctgtgtagcttgctgggggcttccgtcgtgccgttcatgaaaaagacattttacaaacgactgcttttatacttcattgcgctggcaattggtaccctttattctaatgctctctttcagctcattccagaggcattcggcttcaacccactggaagactactatgtgtcgaagagtgcagtggtcttcggcggattttacttgtttttctttacggagaagatccttaagatcctgctgaaacaaaaaaacgagcaccaccacggccacagccactatgcttcagagtcactgccaagcaagaaagatcaggaggagggggttatggagaagctgcagaacggggatctggaccatatgattccccagcactgctcatccgagctcgacggaaaagcaccgatggtagatgaaaaagtgattgtggggagcctctcagtgcaggacctgcaggccagccagtccgcttgttactggctgaaaggtgtacggtattctgatatcgggacactggcatggatgatcaccctgagtgatggcttgcataactttatcgacggtttggccatcggcgcatctttcacggtgtctgttttccagggcatcagcacttcagtggcaatcctttgtgaggaatttcctcatgaattgggcgattttgtgatacttctcaatgccggtatgtctatacagcaggccctattcttcaactttctgtctgcctgctgctgttacctggggctggcctttggcatcctggcaggctcacatttctccgctaactggatcttcgccttagcgggtggtatgtttctgtatatctccctggcagatatgtttcccgaaatgaacgaagtttgccaggaggacgagcggaaaggaagcatccttattcccttcatcatccagaacctggggctgcttaccggctttactattatggtagtcctgaccatgtacagcggccagatccagattgggtag

SEQ ID NO: 54294 - DNA, 1383 bp, Artificial Sequence
  Description of Artificial Sequence: Synthetic coding sequence
atggcgccagggagggccgtggcgggactgctgctcctggccgctgccggactcggtggtgttgcagagggtcccggtctcgcattttcggaggacgtgctgtcagtgttcggcgctaatctgtcacttagtgcagctcagctgcagcacttgctggagcagatgggcgcagcctctcgcgtcggggttccagaacccggacaactgcacttcaaccagtgcctcactgccgaagagatcttcagccttcatggattttccaacgccacccagatcacctcctcgaagttcagtgtgatttgccctgctgtgctccaacagcttaatttccatccatgcgaggaccgccctaaacacaaaacaagaccctctcacagcgaagtgtgggggtatggctttctgtcggtcactatcattaacctcgctagtcttctagggttgatcctgactcctcttatcaagaaatcatactttccgaagatactgacattttttgtcggcctggccattggcacactgttcagtaacgcaattttccaattgatccctgaggcctttggttttgatccaaaggtagactcttacgtggaaaaggcagtggccgtgtttggaggcttctaccttctgtttttctttgaacgtatgctgaagatgctgctgaagacatacggacagaacgggcacacccactttgggaatgataattttggccctcaggagaaaactcatcagcctaaagcactgcccgctataaatggcgtgacctgttacgctaatccagcagtgactgaagccaacgggcacatccatttcgacaatgtctccgtggtgtctttacaggatgggaagaaagagccatcgagctgcacgtgcctaaaagggcctaagttatcggaaatcggcacaatcgcttggatgattactctctgcgatgctttacataactttatcgatggactggccatcggcgcttcatgtacattatctttgctgcaggggctctctacctccatcgcgatcctgtgcgaagaattccctcatgagctgggggacttcgtcatattattaaacgcaggcatgtctactaggcaggccctgttgttcaactttctctcagcctgtagctgttacgttggcctggcatttggaattctggtgggcaacaatttcgctcccaacatcatctttgcgctggcgggaggaatgttcttgtacattagcctcgccgatatgttcccagaaatgaacgatatgctgagggagaaagtgactgggcgtaagactgacttcacattcttcatgattcagaacgcaggaatgctcactgggttcactgccattttgttaattacactatacgcaggtgaaattgagctggagtag

SEQ ID NO: 54295 - DNA, 1383 bp, Artificial Sequence
  Description of Artificial Sequence: Synthetic coding sequence
atggcccctggaagggctgtcgcaggcctactgctcctggccgcagcaggcctgggaggcgtcgccgagggacccggtctggcgttctccgaagacgttctgtccgtctttggcgcaaacctgtctctgagcgctgcacagctacaacacttactcgagcagatgggagcagcatcgcgtgtgggcgtcccagagcctgggcaactgcactttaatcagtgtttaaccgccgaggaaattttttctttacatggtttttcaaacgcaacacagatcacctctagcaagttctctgtgatctgccctgccgtcttacaacagctgaattttcacccgtgtgaagatcgtcctaagcataaaactcgaccgtcgcatagtgaagtgtggggttatggattcctctccgtgactataattaacctagccagcctcctaggcctgatcctgaccccgctaatcaagaagagctatttccctaaaattctgacattcttcgtgggcctcgcaattggaactcttttcagtaacgcgatctttcagctgatccctgaggcgttcggcttcgaccctaaagtagacagctatgtggagaaggccgtggcagtgttcggcggtttctatcttctttttttttttgaacggatgctaaagatgctgctcaagacctacggacagaatggccacacccacttcggcaatgacaactttggaccccaggaaaagactcatcagcctaaggccctgcctgctattaacggagttacttgctatgccaatccagctgttacagaagctaacggtcacatccattttgacaatgtgagtgtagtatcactgcaggacggaaagaaggagccctccagttgtacctgtttaaagggacccaagctgtcagagatcggaactattgcatggatgattaccttgtgtgatgctctgcacaacttcattgatggccttgccatcggagcctcatgcaccctgtctctgctgcagggactgtcaactagtattgccattctatgtgaagagtttccacacgagctgggagacttcgtcattctgctgaatgcgggtatgtctacgcgacaagccctgctctttaattttctttctgcctgctcctgctatgtgggcctggcattcggcatcctggtaggcaataactttgcccctaacatcattttcgccctggccggtggcatgttcttgtatataagtctcgcggacatgtttccagaaatgaacgacatgctgcgtgaaaaggtgaccgggcgaaagacggatttcaccttcttcatgattcagaacgctggcatgcttacaggattcaccgccatcctcctgatcaccctctacgcaggcgagattgaactggagtag

SEQ ID NO: 54296 - DNA, 1335 bp, Artificial Sequence
  Description of Artificial Sequence: Synthetic coding sequence
atggctccaggaagagcagtggctggcctgctacttttggccgctgcgggattagggggagtcgctgagggacctggccttgctttcagcgaagacgtcctatcagtattcggagctaacctttccctatctgccgcacaactgcaacacctattggagcagatgggcgcagcatcccgcgtgggtgtgccggaaccagggcagcttcacttcaatcaatgcttgactgcggaagagatctttagtctgcatggcttcagcaatgcaacccaaattacctctagcaaattcagtgtcatctgccccgcagtgctgcagcagctgaatttccatccctgcgaggatcgcccaaaacacaagacaagacccagccattctgaggtgtggggctatggcttcctctctgtgacaatcataaacctcgctagcctgctggggcttattctgactcccctcattaaaaagagctacttcccaaagatccttaccttttttgtgggactcgccattgggacactgttcagcaatgcaattttccagcttatcccagaggcatttggattcgatcccaaggttgattcctacgttgaaaaggctgttgccgtcttcggcggattctatctgttgttcttctttgagagaatgctaaagatgcttctgaagacatatggccagaacgggcacacccattttgggaacgacaacttcggtcctcaagagaaaacccatcagccgaaggcgctgcccgctattaatggggtgacctgttacgccaaccccgcagttacagaggctaatggacatatccatttcgataacgtctctgtggtctccctccaggacgggaagaaagaaccttctagctgtacttgtcttaagggacccaagctgtctgagatcggaacaatcgcctggatgataactttgtgcgatgccctgcacaacttcattgacggcctggcgatcggagcaagctgcacgttatcgctgttgcaaggtttgtccacatcaatcgccatcctctgcgaggagttcccccacgagctgggggactttgtgatattgttgaacgccggtatgagcacacgtcaggcactactctttaactttctctcagcctgcagctgctacgtaggtctcgcgttcgggatcctggtgggtaataatttcgctcccaacataatctttgctctggccggaggtatgttcttatatatttctctggccgacatgttccctgaaatgaatgacatgcttagagagaagattattaagtgggcaaccgacgatataaagagccaattacacctcctctggatttacactgcgcgttag

SEQ ID NO: 54297 - DNA, 924 bp, Artificial Sequence
  Description of Artificial Sequence: Synthetic coding sequence
atggatgactttattagcataagcctgttatcattggctatgctggtcggatgttacgtagccggaatcatccctctggctgtgaacttctccgaagagagacttaagctggtcacagtgttaggggcaggcctgctgtgtgggaccgccctagcagttatcgtaccggagggggtgcacgctttatacgaagacatactggagggcaaacatcaccaagcgtctgaaacccacaacgtaatcgcatcagataaggccgcagaaaagtctgtggtgcatgagcacgagcattcacacgatcacacccagttgcacgcttacattggggtcagtctcgtgctggggtttgtgtttatgttactcgtcgatcagatcggtaactcccatgtgcattctacagatgaccccgaagcagccaggtcatcaaatagtaaaattactactactctgggcctggtggtccatgcagcagccgacggggtcgccctcggagcggcagccagtacgtcccaaacttcagtacagctcatagtttttgtggccattatgcttcacaaagccccagctgccttcggcctggtgagcttcctgatgcatgcgggtctagagaggaaccgcatccgaaagcatctcctcgtattcgctctggccgcaccggtgatgtcaatggtgacctaccttggtctcagcaagtcttctaaagaagcactttccgaggtgaacgccacaggagtcgctatgctgttctctgccggaacttttctctacgtggcaaccgtgcacgtgctgccagaagtgggcggaatcggacactctcataaacctgatgcaacaggcggacggggtctgtctcgcctggaagtggctgcactggtcctggggtgtctaattccacttatactcagcgttggccatcagcattag

SEQ ID NO: 54298 - DNA, 924 bp, Artificial Sequence
  Description of Artificial Sequence: Synthetic coding sequence
atggatgatttcatttcaatatctttactgtctctggcaatgctcgtgggttgttacgtggccggaataatcccactagctgtgaacttcagcgaagaacggttgaagctggttaccgtgttgggcgctggcctgttgtgcggcacagccttggccgtgattgtccccgagggtgttcacgctctgtatgaagacatactcgagggcaagcatcaccaggcttccgaaacacataatgtgatcgcaagtgacaaggcagcagaaaagtctgttgtgcacgagcacgaacactcccatgatcatacccagcttcatgcgtacatcggagtgagccttgttctggggttcgtgtttatgttattagtcgaccagatcggaaattctcatgttcacagcactgacgaccctgaggccgcaaggagctctaattccaaaatcaccactaccttgggattggtcgttcatgccgcagccgacggtgtggctcttggggcagcggctagtacgagccaaacgagcgtccaactgattgtgttcgtcgcaattatgctgcacaaagcacccgcagcatttggcctcgtgtccttcctgatgcacgctggactggagagaaaccggattcgcaaacacttgttagtgttcgctttggctgcacccgtaatgtctatggttacatacctaggcctgtctaaatcctccaaggaagcattaagcgaagtcaacgctaccggggtggctatgctattctccgcagggacattcctgtacgtggctacagtgcacgtgctgccggaggtggggggaatcggtcatagccacaagcctgatgcaaccggcggacgaggcctgagtaggcttgaggtggctgccctggtcctggggtgtctgattcccctgatcctttccgtcggacaccagcattag

SEQ ID NO: 54299 - DNA, 2691 bp, Artificial Sequence
  Description of Artificial Sequence: Synthetic coding sequence
atggagatgaagttgccgggtcaggaggggtttgaggcctcaagcgccccacgcaacatcccgtcaggcgaacttgattctaacccggatcccggtaccggaccaagtcctgacggcccttctgatacagaatcaaaggaactaggcgtgcctaaagaccctctcctctttatccagttaaacgagctactcggatggccacaagcgttagagtggcgcgagacagggaggtgggtgctgtttgaagagaaactggaggttgctgcagggagatggagtgctccccatgtacctaccctggccctgcctagtttacaaaaactgcgatccctgctcgccgagggcctcgtgctactggattgtcctgctcaatcactcctcgagcttgttgagcaggtcacccgcgtagaatctctgtctcccgaactgcgcggacagctccaagccctgctgctgcagcggccacagcactataaccaaactactggtaccagaccgtgctggggaagcactcacccaagaaaagcctcagacaacgaggaagcacccctgagagaacaatgccagaaccccctcaggcaaaagctcccaccaggtgcggaggctggtaccgtgctggccggagagcttggttttcttgctcaacccctaggcgcattcgtcaggctacgaaacccagtggtcctgggaagcttaactgaagtctccctgccttcgaggttcttttgtttgctgctgggtccctgcatgctggggaaaggctaccatgaaatggggagggccgctgcggtccttctgagcgatcctcagttccaatggtcagtgagacgggcttccaatttacatgatctgctcgctgctctggatgcattcctggaagaagtcactgtgcttccccctggacggtgggatccaacagccagaataccacctccaaagtgtctgccctcccagcataagagactcccctcacagcagcgcgagatacgtggtccagcagttcctcgactcacatcagctgaagatcgccatcggcacggccctcacgctcactccccggagctgcagagaactggcagacttttcgggggactaattcaggacgttagacgtaaagtgccctggtatcctagtgatttcttggacgctctccatctgcagtgtttcagtgctgtcctgtacatctacctcgcgacagtgactaatgccatcacgttcgggggactgctgggtgacgcaaccgatggggcacagggagtgttggagtcatttttgggcaccgcagtcgccggagctgccttttgtctgatggcagggcagcctctgaccatcctttcaagcactgggcctgtactggtcttcgaacgcctgctgttcagcttcagccgggattacagtctcgattatctgccatttcggctctgggtgggtatttgggtggccactttttgcctggtgctggttgccaccgaggcctccgtgctggtcaggtactttacgcggtttaccgaagagggtttctgtgccctgatttctctcatcttcatctacgatgcagtaggcaaaatgttgaatcttacccacacatatcctatccagaaaccaggcagttccgcctatggctgtctatgccagtatcccggacctgggggtaacgagtctcagtggatcaggacacgacctaaggatagggatgacatcgtgtccatggtgcggaaaggattgtccgatttctccagtgtgctcgctattctgcttggctgtggtctcgatgcatttctgggtctggctactccaaagctgatggttcccagggagttcaaaccaactctccccggaaggggctggctggtgtctcctttcggagccaacccttggtggtggagtgttgcagcagcactgcctgctcttttgctgtccattctgatattcatggatcagcagataacagctgttattcttaatagaatggagtaccgcctgcaaaagggagcgggatttcacctggacctgttctgcgttgcagtgctcatgttacttaccagtgctctgggactaccctggtacgtctccgccaccgtgattagtctcgcacacatggactcgttgcgcagggagagccgggcttgcgcccctggcgagcggcctaactttctggggattagggaacaaagactgaccggactcgtggtgtttatcctgaccggggctagcattttcttggcacccgtgctcaaattcatccctatgccagttctatatggaatcttcctctacatgggagtagcagccctctcctctatccagttcacaaatcgggtgaaactgctgctgatgcccgcaaaacaccagccagaccttctgttactgcgtcatgtgcctctgacaagggttcacctgttcacagccattcagctagcctgcctgggcctgttatggattattaagagcacccccgcagctattatttttcccctcatgctgttaggcctcgtcggcgtgcggaaagcactggaaagggtcttctctccccaggagctgctctggctcgatgagcttatgccagaggaggagaggagcatccccgaaaagggtcttgagccagaacacagcttctctggtagcgacagcgaagactcagagctgatgtaccagccaaaagctcctgagatcaacatatccgtcaattag

SEQ ID NO: 54300 - DNA, 3780 bp, Artificial Sequence
  Description of Artificial Sequence: Synthetic coding sequence
atggctaacggcgtgatccctcccccaggaggtgccagtccattacctcaagttcgggtgcctctggaagagccacctctctcacctgacgtggaagaagaggatgacgatttaggcaaaaccctcgccgtgagcagatttggagacctgatctcaaagcccccagcttgggaccctgagaaaccttctaggtcttactctgaaagagactttgagttccacaggcatacctcgcatcacacacaccacccgctcagtgcgcgtcttccacctccccataaactgagacgcctgcctcctacttcggccaggcatactcgacgaaagcggaaaaaggagaagacctcagctccgccttcagaaggaacgccccctattcaggaagagggcggagctggagtcgatgaagaagaggaggaagaggaagaggaggagggcgagagcgaagcagagcctgtcgagcctccccactctggaactccacagaaggctaaattcagtataggatcggacgaggacgactctccgggtctccctggaagagccgcagttacaaagccattgccctctgtgggccctcacactgataagtccccgcagcattcgtcgcggccatgcagcgaactacgggacggggacgggacaacggacttggccctttcttccccacgattgctatgctgtctcccaagctccccgagtccaagagcgagggcctcacgactagctggagaaaagtcgcgcccatggagtccatccgcgtcctatgatctccgcgagcggctgtgtccaggcagtgccctgggtaacccaggaggccctgagcagcaagttccaacagacgaggctgaggcccagatgctgggatccgctgatctggatgacatgaagtcacacagactggaggacaaccctggggttaggcggcacctcgtgaagaaaccctcccggacacagggcggacggggtagcccttcaggcttagctccgatcctccgcagaaaaaagaagaaaaagaaactggatcgaaggccccacgaggtcttcgttgaactaaatgagttgatgctcgatcggtcccaggaaccccactggcgagagactgcaagatggataaaattcgaggaagacgtggaggaggagacagagagatgggggaaacctcacgttgcctctctgtctttcagatcactgttggaactgagaaggaccattgcccacggggctgctctgttagatcttgagcagacaacactgccaggaatcgctcaccttgtggttgaaaccatgatcgtcagcgaccaaattcgacctgaagatagagccagcgtcttaaggaccctgcttttaaaacatagccaccccaatgatgacaaagactccggattcttcccaagaaaccccagctccagtagtatgaacagcgtgctcgggaatcaccaccccaccccatcccatggcccagacggtgccgtgcctaccatggcagacgacctgggcgagccagcgccactctggccacatgaccccgacgccaaggagaagccactgcacatgcctgggggagacggccatcggggaaagtcactgaagctcctggagaaaatccctgaagatgccgaggcaacggttgtgcttgtcggctgcgtaccttttcttgagcagcctgccgcagcttttgtgcggctgaacgaagcagtgcttctggagagcgtgctggaagttcccgttcctgtccggttcctgttcgtgatgctggggccttcacataccagcacagattaccatgagttggggagaagcatcgccacactaatgtccgataagctattccacgaggccgcttaccaggcagacgaccggcaggacctcctaagtgctatcagtgaattcctggacggcagcatcgtcattcctccctcagaagttgagggtagagatttgctgcgaagcgtcgcagcttttcagcgggagctgctccgcaaacgccgagaaagggagcagaccaaagtagagatgaccacgaggggcggatataccgcccctggaaaggagctcagcctggaattggggggtagtgaagcaacgcctgaggacgacccacttcttcgtaccgggtccgtcttcgggggactagtgcgagacgtccgcagacggtacccccattacccctccgacctgcgggacgccctgcatagtcaatgcgtcgccgctgtgctgttcatatattttgctgccctctctcccgcaattaccttcggaggtctgctgggcgaaaaaacggaaggcctgatgggtgtgagcgaactcatagtgagtacagccgtcctgggtgtgctgttctcactgctcggggctcagcccctgctcgttgtgggtttctctggcccactactcgttttcgaggaagcattctttaagttttgtagggcacaggacctcgaatatcttaccggccgtgtctgggtgggactctggctggtcgtgttcgtgttggccctcgtggccgctgaggggtcatttttagtgcggtacatcagcccatttacacaggaaatcttcgccttcctgatctcactgatcttcatttacgaaacattctataagctatacaaggttttcaccgagcatccccttctgcctttttatccgccagaaggagcgctcgaaggaagtcttgacgctggcctggaacctaatggtagtgctttgcccccaacagagggtccacctagtcctagaaaccagccgaataccgccctgctcagtcttatcctgatgctgggaacattttttatcgctttcttccttcggaaatttagaaacagtcggttcctcggaggcaaagctagaaggataataggagatttcggtatacctatctccattctggtcatggtcttggtagactactccattaccgacacttatacccagaagctgactgtccccaccggactgtccgtcacctcacctgataagcggagctggtttattccccctcttggctcggctcgtccatttccaccttggatgatggtcgctgctgcggtcccagctttgctagtactgatcctgatctttatggaaacacagatcactgctctcatcgtgagtcagaaggctagaagattactgaagggctctggtttccacctagatcttctgttgattggttcactcgggggtttgtgcgggctatttggactaccatggctaacggcggctacggtgcgtagcgttacccacgtcaatgcccttacagtcatgcgaacagccatagcccctggcgataagccccagatacaggaggtgagagagcaaagggtgactggagtgctaattgctagtctggtcggactgtcaattgtgatgggagccgtgttacgacgaatcccattggctgtgctttttgggatcttcctgtatatgggcgtgaccagcctgtccggaattcagctcagccagcgcctgctcttgatactgatgccagcaaagcatcaccctgaacagccctatgtcaccaaggtgaagacttggcggatgcacctgttcacctgcatacagctcgggtgcatcgctctgctctgggtcgtcaagtctaccgcagcctcactggcgttcccatttctgctattgctgacagtccccttgagacattgcttgctgccacgcctgttccaagacagagaactgcaagcattggacagcgaggacgccgagccaaacttcgacgaagatggtcaagacgagtataacgagctgcatatgccggtatag

SEQ ID NO: 54301 - DNA, 3699 bp, Artificial Sequence
  Description of Artificial Sequence: Synthetic coding sequence
atggcaaatggcgtgattcctccgccaggaggcgcaagtcctttgccccaggtgcgagtcccactggaagagccacccctgagcccagatgtggaggaggaggacgacgacctggggaagaccctcgccgtgtccaggtttggcgatctcatctcaaaacctcccgcatgggatcccgaaaaacccagccgaagttattccgagagggattttgaatttcatcgtcatacatcacaccatacccaccacccgctgtctgcgagactgcctccccctcataagctcaggaggctgcccccaacgtccgctcgccacacacggagaaaacggaaaaaggaaaaaacatccgcaccaccttccgagggcactcccccaatacaagaggagggaggtgccggagtggacgaagaggaggaggaagaagaagaggaggagggcgaatctgaggccgaaccagtggagccaccccattccggcacgcctcagaaggccaagttctcaatcggctccgacgaagacgactccccaggcttgccaggcagagccgctgtgactaaacccctgccatcggtggggccacacaccgacaagtcaccgcagcatagttcttcttccccgtctccgagggccagagcaagtaggctcgctggggagaaaagcagaccttggagcccatccgcgagttatgacttgcgtgagagactgtgtcccggaagtgccttgggcaatccaggaggcccagagcaacaggtgcccaccgacgaagcagaggcacagatgttagggtctgccgacctcgatgacatgaagagccaccgcttggaggataatcctggggtgcgtcgtcatttagtcaaaaaaccctcacgcacccagggtggccgtggatcaccatctggcctggcacccatcctgcgtagaaaaaagaagaaaaaaaagctcgacaggcgcccacatgaagtgtttgtcgagttaaacgagctgatgcttgataggagccaggaaccacactggcgtgagaccgccaggtggattaaattcgaggaagatgtggaagaggagaccgagcgttggggcaaaccccacgttgcttccctctcatttcggagtcttttggagctgagacgtactattgcacatggggctgccctcttggatctggagcagaccacccttcctggaattgcgcatctggtggtcgaaacaatgatcgtatctgatcagattaggccagaggaccgagcctccgtgctgcgcaccttgctcctgaagcattcacacccgaacgatgacaaggacagtggattcttcccaagaaacccatctagctcttcaatgaactccgtgctggggaatcatcaccccaccccctctcacgggcctgatggtgcggtgccgactatggcagatgacctcggggaacctgcgcctctgtggccccacgaccccgatgcaaaggaaaaaccgctacacatgccgggaggcgacggacaccgcggtaagagtctcaagttgctggaaaagatccccgaggacgctgaagctactgtggtcctggtgggctgtgtaccttttcttgagcaaccagccgcagctttcgtgcgtctgaacgaggccgtgttgctggagtcggtgttggaggttccggtccctgtaaggttcttattcgtgatgttaggtccatctcataccagcacagattaccatgagcttggacgctccatcgctacactgatgagcgataaacttttccatgaggctgcttatcaggcggacgacaggcaggatttgttaagcgccatatcagaattcctagacgggtccattgtcatacccccatctgaggtggagggcagggatctcctccgctccgtcgccgcttttcagcgagaactactgagaaagagacgagagcgagagcagactaaagtcgagatgactactagaggaggctacacggcgcctggtaaagaactaagcctcgaactgggcggaagcgaggccactcccgaagatgacccgctgttgaggaccggctcggtatttggcggactggtccgggacgtaagaagaagatacccacattacccatctgacttacgggatgctctgcactcacagtgtgtcgccgctgtcctgtttatttattttgcagccctctccccagctatcaccttcggaggcctgctgggagagaagacagaggggctgatgggtgtgtccgagctcatcgtctccactgccgttcttggagtgttgtttagcctgttaggggctcagccccttttagtagtcgggttttcagggcctcttctggtgttcgaggaggcatttttcaaattttgtagggcccaggacctcgaatacttaacgggaagagtgtgggtgggcctatggttggtcgtcttcgttctggccctggtcgcggcagagggttcattccttgtgaggtatattagtcctttcacacaagagattttcgcttttctcatttcccttatcttcatctacgagacgttctacaagctgtataaagtgttcactgagcatccactcttgcccttttatcctcctgagggcgcactggaggggagcctcgacgcagggctggaacccaatggtagcgcacttccaccaaccgagggccctccgagccccaggaatcagcccaataccgcgctcttgtccctgatcctcatgcttggcaccttcttcattgcttttttcctccgaaaattccgaaactcacgttttcttgggggtaaggcaaggcggattattggcgattttgggattccaatttccatcttggtcatggtattagtggattattctatcacagatacctacactcagaaactgaccgttcctaccggtcttagcgttacgagccccgacaagcgctcctggtttatccctccgctgggaagcgctagacccttccccccatggatgatggtggcagccgctgtgccagcccttctggtcttaatactgatcttcatggagacgcagatcacagctctgatagtcagccagaaagcgagacggttgctcaaagggtccggctttcacctcgacttactcctaatcggatccctggggggattgtgcgggcttttcggactcccctggcttaccgccgcaacagtgcgctccgtaacccacgtaaatgctctcaccgtcatgcgaacggcgatagcacctggagacaaaccacagattcaggaggtgagggagcaaagagtaactggagtgctgatagcaagcttggtcggccttagcattgtgatgggggcagtgctgcggcgaatcccgctggccgtcttattcgggattttcctgtatatgggcgtaacctcactgtcaggtatccagctcagtcagagattgttgctgatcttgatgccagcaaaacaccacccggagcagccatatgtgactaaagtcaagacctggcgcatgcacctgtttacttgtattcagctgggttgtatcgccttgctgtgggtcgtgaagtctactgctgcctccttggcctttccttttctcctgctgttgaccgtgcccctccgccattgcctgctgcccaggcttttccaggaccgtgagctgcaggcacttgactcagaggatgctgagccaaattttgatgaagatggccaggacgagtacaacgagctgcacatgcctgtgtag

SEQ ID NO: 54302 - DNA, 1203 bp, Artificial Sequence
  Description of Artificial Sequence: Synthetic coding sequence
atgggtgttagtgagctgattgtctccactgcagtgcttggggtgctctttagccttttgggtgctcagcctctgttggtggtcgggttttccgggcctttactagtgtttgaagaagctttctttaaattttgccgcgcacaggatctggagtatcttaccggaagagtttgggttggtttatggttggttgtgttcgtgctggccctggttgccgcagaaggctcgtttttggtgcggtatatcagtccctttacacaggagatttttgctttcttgatctccctgatatttatttatgagactttctacaagctgtataaagtattcacagaacacccgttactacctttctatcccccagagcccggtggggtccccggttgctggtcgggtgctaagtggcagttaccaccaactgagggaccacctagccctcgtaaccagccaaatacagcacttctgtccctcatcctgatgctcggaactttctttatagccttcttcctgcgaaaatttcggaacagcagattcctgggaggcaaggcacgcaggatcataggcgactttgggatccctatatcaatccttgtaatggtcctggtagattactcaataactgacacatatacacagaagctgacggtgcccaccggactctccgtcacatcaccagataagaggagctggttcataccaccactggggagtgccagaccattccccccttggatgatggtcgcggctgccgttcccgctctccttgtgttgattctcatcttcatggagacccagattacagcgctgatcgtgagccagaaggctcggaggcttctgaagggaagtggatttcaccttgatctactgttgatcggatcgttgggtggcctctgtggcctgtttggattgccctggctgacagctgctacagtgagaagcgtaacacatgtgaacgccttgactgtgatgagaacagcgattgctccgggagataagccccagatccaggaggtccgggaacagcgcgtgactggcgtactgatagcttctctcgtggggctatccatcgttatgggagctgtcctgagacgcattcctttagccgtactttttggtatctttttgtacatgggtgtgacatctctgtcaggcatccaattaagccagcgcctgttgctgattctcatgccagctaagcactag

SEQ ID NO: 54303 - DNA, 3699 bp, Artificial Sequence
  Description of Artificial Sequence: Synthetic coding sequence
atggccaacggcgtgatccccccacctgggggagcctctcctctgccgcaagtcagagttcctttggaagagccccctctgagccccgatgtggaggaagaagatgatgacctgggcaaaaccctggctgtctcacgctttggcgatctgatatcgaagccccctgcttgggaccccgaaaaaccatctagatcctacagcgagagagactttgagttccatcgacatacatcacatcatacccatcaccctctaagcgcgagactgccaccccctcacaaactcaggagattgccccctacctccgctaggcacacgcggaggaagcgtaagaaagagaaaaccagcgcccctcctagcgaaggaacacccccaatccaggaggagggcggtgccggagtggatgaggaagaggaggaagaggaggaggaggaaggagagagcgaggccgaacccgtggaacccccacattcgggcaccccacagaaagcaaagtttagcataggttcggatgaggatgattcacctgggttgcccggtcgggctgccgtcacaaagccacttccctcagttggccctcataccgataagtccccacaacattccagctcctctccaagccccagagcccgagcttcgcgcctggccggagagaaatcaaggccatggtccccttctgccagctacgaccttagggagagactctgtcccggatcggcactgggaaatccaggaggcccagaacagcaggtgccaaccgacgaagccgaggcccagatgttggggtctgctgatctagatgacatgaaaagccatcggctagaggacaaccctggtgtgagacgccacctggtgaagaagccaagccgtacccaaggcggtagaggcagtccaagcggcctcgctccgattcttaggcgtaagaagaagaaaaagaaactggatcgacggccacacgaggtgttcgtcgagctgaatgaacttatgttagaccgatcgcaggagcctcattggcgggagacagcccgatggatcaaattcgaagaggatgtggaagaggaaacagagcgctggggcaaaccccatgtggccagtctctcattcaggtccctcttggaattacgcaggaccatagcacatggcgcagccctcttggacctggaacaaacgaccctgccaggaatcgcccatctggttgtggaaacaatgattgtctccgatcagatcaggccggaagatcgcgcttccgtcctgaggacgctgctgttgaaacactcccacccaaacgacgacaaagacagcggattctttccccgaaatccttcttcttcgtccatgaattccgtgctcggtaaccaccaccccacaccaagccacggacccgacggagccgttcctactatggccgacgacctcggcgaaccagcgcctctgtggccgcacgacccagacgccaaggaaaagcctctccatatgccaggaggagatggccacagaggtaaaagtttaaaattgttggaaaaaattcctgaagatgctgaggcaacagtggtgctggtcgggtgcgtgccgttccttgagcagcctgccgcagcttttgtgcggctcaacgaggctgttctgctcgaatctgtgctggaggtgcccgtcccggtgcgtttcctttttgtaatgttgggcccaagccatacaagcactgactatcacgaactcgggaggtccatagctactcttatgagtgacaaattattccatgaggccgcttaccaggctgacgatcgccaagacctgctgtctgcaatatcagaattcctagacggatcgattgtgatccctccatcagaagttgaggggagggacctgctgaggtcggttgccgcattccagcgggagttgttacggaaacggagggaaagagaacaaacaaaggtggaaatgaccaccagaggaggctataccgcaccaggtaaggagctatccctcgagctgggcggatcagaagctacgccggaagatgaccctctgctgcggacaggaagtgtgtttggtggtctggtgcgcgatgtcaggagaagatacccgcattaccccagcgaccttcgggacgccctgcactcccagtgtgttgccgctgtgctcttcatatacttcgcagcccttagtcccgcaataacttttgggggtctgcttggtgagaagaccgaaggcctgatgggtgtatctgagcttatcgtctcgaccgctgtgttaggggttctgttctccctgttaggagcccagcccctgctggtggtcgggtttagcggcccattactggtgttcgaggaggctttttttaaattctgtcgagcacaagatttagaatatctcaccggaagggtgtgggtgggcctgtggttggtcgtattcgtgctggctctggtggcggcagagggaagtttcttggtcagatacatcagcccatttacacaggaaatattcgcctttttgatttccctcatcttcatctatgagacgttttacaaactttacaaggtttttacggagcatccactgttacctttttatcccccagaaggggctctcgaagggagccttgatgccggactggagcctaatggcagcgcactcccgcctactgaaggtcccccatcccccaggaatcagccgaatacggccttgctgtcactgatcctgatgcttgggactttctttattgccttttttctgcgtaagtttcggaattccaggttcctggggggtaaggcccgaaggataatcggagatttcggaatccctatatctatactggtgatggtccttgtcgactattctattacggacacctatactcagaagttgacagtccctaccggactaagtgtcacttcccctgacaaacggagctggtttataccgcctctggggtcagccagacccttccccccttggatgatggtggctgctgctgtgcctgccttactcgttctgatcctgatatttatggaaacacagattacggccttaatcgtctcccagaaagcacgtaggctcctgaaggggagcgggttccacttagacctgttactgattggatctcttggagggctctgcggtcttttcggcctgccctggcttacagccgcaaccgtacgaagtgtgacgcatgtgaacgctcttacagtgatgcgaacagctattgcaccaggcgacaagccccagatccaggaggtccgcgagcagagagtcaccggggttttgatcgcatccctggtcggactttccatcgtgatgggcgcagtgctgcgcagaattcctttggccgttttattcggaattttcttgtacatgggagtaactagcctgagcggaatccagctctcgcagcgccttctgctgatactcatgcctgcaaaacaccatcccgagcaaccttatgtcaccaaagtgaagacttggcgcatgcatctgtttacctgtattcaactgggctgtattgccttgttgtgggtggtgaaatctacggcggctagtctcgcctttcccttcctgttgctactgaccgtgcctttaagacactgtctcctaccaagactcttccaggacagagagctacaagctctggacagcgaggacgcggagcccaactttgacgaggatggccaagacgaatacaatgagctccatatgcccgtctag

SEQ ID NO: 54304 - DNA, 3699 bp, Artificial Sequence
  Description of Artificial Sequence: Synthetic coding sequence
atggccaacggcgtgattcccccacccggaggagcatctccactgccccaggtgcgcgtacccctggaagagcctcctctgtccccagacgttgaagaggaggacgatgatcttgggaaaactcttgccgtctcgaggtttggtgacctcatttcaaaacctcccgcttgggacccagaaaagccttccagatcctactccgagcgtgactttgaattccataggcacacatcgcatcacacacaccaccctctctctgcgcgactccctcccccacacaagctgaggcgactccctcctacctcagcgagacataccaggcgtaagagaaagaaggaaaagaccagcgctcctcccagcgagggaactccacccattcaggaggaaggtggggcaggtgtggatgaggaagaagaggaagaagaggaagaagagggagagtccgaggccgaacccgtggaaccgccacactcagggaccccccagaaggccaaattttcaataggatcagacgaagatgactctcctggcctgcctggaagagccgctgttacaaagcctctccccagtgtgggcccacacaccgacaagagcccccagcatagctcttcatctccatccccccgagccagggcctctaggctagctggtgagaagagccgcccttggtcaccaagtgctagctacgaccttcgcgagcgcctatgtcctggcagcgccctggggaatcccggaggcccagagcagcaggtgcctacggacgaagccgaggcacagatgctggggtccgcagatttagatgacatgaaatctcaccggctggaggataaccctggagtccgtaggcatttggtgaaaaaaccaagtcgcacacaagggggacgtgggagcccgtcagggctggcaccaatcctgcggaggaagaagaagaagaaaaaattggacaggaggccacacgaagtctttgtggaactgaatgaacttatgctcgacaggtcacaggagcctcactggagggagaccgctcggtggattaagtttgaagaagacgtcgaggaagagaccgaacgctggggaaagccacacgtagcatctctgtctttcagatctttgctagagcttcggcgaaccatcgcccacggagctgcactgctggatctggagcagacgaccctccccggaatcgcacatcttgtggtcgagacgatgatcgtgtccgatcagattcgcccagaggatcgcgctagtgtcttgcgcactctcttgttgaagcactcgcatcccaacgatgataaagactctggcttcttccccagaaacccgtccagttcgtccatgaattccgtactaggaaaccaccacccgacgcctagccacggcccagatggcgcagtgccaaccatggcagacgacttaggcgaacccgctcctctttggccacacgatccggatgccaaggaaaaacccctgcacatgcccggtggggatgggcaccgcggaaaatccctgaagttactggagaaaatacccgaggatgcagaggccaccgttgtcctggttggatgcgtcccgttcctggagcagcctgctgctgcatttgttcggctgaacgaagcagttttattagagtcagtcctggaagtcccggtccctgtccgtttcctattcgtaatgctgggaccttcccatacatctactgattaccacgaactgggaaggagcatagctacccttatgtctgataaattgttccacgaggctgcctatcaggcagatgatagacaggatctgctcagcgcaatctctgaattccttgatggatctattgtaataccaccttccgaggttgagggcagggatctgcttcggagcgtggcggcttttcagcgggaactgttgaggaaacgccgagaaagggaacagactaaggtggagatgaccactcgtggcggttacaccgctcccggtaaagaactgagcctggaattggggggatctgaggccacgcctgaggacgatccacttctgcgcactggaagcgtttttggcggattggtgcgggacgtgcgtcgacgctacccccattatccctccgatctgagggatgcccttcacagccagtgcgtggccgctgtgctctttatctactttgcagccctgtcaccagccatcaccttcggaggtctgctcggtgagaagaccgagggcctgatgggggtttcagaactgattgtgtccactgctgtcctgggggtcttgtttagtctgttaggagcacaacctctgttggtggtcggctttagcggaccactgctagtcttcgaagaggctttttttaagttttgcagggcgcaggacctagaatacctcacgggacgcgtttgggtgggcctgtggcttgtggtcttcgttctggctttagttgcagcagaagggagctttttggtgcgctatatctctccgttcacacaggaaatctttgcattcctcatatctttaatttttatatacgagacattctacaagctctataaggtattcaccgagcacccactcctgcctttctacccacccgagggtgccctggagggcagcctcgatgcagggttagagcctaacggcagcgccctgccaccgacagaaggtccgccatctcctaggaatcaaccaaatacagcattgctttcgctgatccttatgctggggacattcttcattgctttctttctacgaaagtttcgcaactcacggtttcttggcggtaaagcaagacggataatcggtgattttggtatccccatttccatcctggttatggttctggtggattattcgattacagacacttatacacagaagctcacagtccccacgggactgagcgttacctcacctgacaagagaagctggttcatccccccattggggtcagccaggccgttccccccttggatgatggtggctgcggcagtgcccgctctgttggtactcattctaattttcatggagacacagattacagcgctgattgtttctcagaaagcaaggcgcctacttaaagggtccggattccacttggacctcctgctaattggctccctggggggactgtgcggcctgttcggcctcccctggctgactgccgcaactgtgcgtagcgtgacgcacgttaacgccttgaccgtgatgcgaacagcaattgccccaggcgacaaacctcagatccaggaggtcagagaacaacgcgtcaccggagtcctcatagcatccctggtgggactgagcatcgtcatgggggctgtgctcagaaggatcccgttggccgtgctatttggaatctttctctacatgggagtgacctcactatccggaatccaactctcacagaggcttctactcatcctcatgccggcaaagcaccatccagaacaaccctacgtgactaaggtcaagacatggagaatgcacttgttcacttgtattcagctcggctgcatcgcgctattatgggttgtcaagtccactgctgcaagcctggcctttccttttctcctgctgctgactgtgccgctcaggcattgccttctgccgcgactcttccaggatagggagctgcaggcactcgacagcgaggatgctgaaccgaactttgatgaagacggtcaggacgaatacaatgaacttcatatgccggtctag

SEQ ID NO: 54305 - DNA, 3780 bp, Artificial Sequence
  Description of Artificial Sequence: Synthetic coding sequence
atggcaaacggcgttatccccccaccaggcggagcgagcccactcccccaagtcagggtgcctctggaggaacccccacttagccccgacgtcgaggaggaagatgatgacctggggaagaccctcgcggttagtcggtttggggatttgatcagtaagccaccggcttgggaccctgagaaaccatcgagaagctatagcgaacgagactttgaatttcaccgccacacatcacaccacacacaccacccactctccgcaaggctgcccccacctcacaaactaaggaggcttcccccaacctctgccaggcacacgcggaggaagcgaaagaaagagaagacttccgctccaccttccgagggcacacctcccatccaggaggaaggaggcgcaggcgtcgacgaggaggaagaggaggaggaagaggaggagggagaaagtgaagccgaacctgtcgagccccctcattcaggtacaccccagaaagccaagtttagcataggttccgacgaggacgattcaccgggactcccaggaagggcggctgtcaccaagcccctgccaagcgtggggcctcacacggataagagtcctcagcactcatcccggccatgctctgaattacgcgacggcgacggcaccacagatctggcgttgagcagtcctcgcttactttgctgcttgccatcctccccctcacccagggccagagcgtcacgcttggccggtgaaaagtcgcgaccttggtccccctcagccagctatgatctgagggaacgtctgtgccccggaagtgccctgggcaatccaggcggaccagaacaacaagtgccaaccgacgaggcagaggcccagatgttaggtagcgcagatctggacgatatgaagtcccaccggctggaggataaccctggtgtgcgcaggcatttggtcaaaaaaccctcgagaacacagggaggacgcggttccccaagcggccttgcccctattttgaggcggaagaagaagaagaaaaaacttgataggcgaccccatgaagtgtttgtagaactcaatgagctgatgctggacagatctcaggagccgcactggcgcgaaaccgcaaggtggataaaattcgaagaggacgtagaggaagaaactgagcgctgggggaagccacacgttgcaagtctgtcgttccggagtctcctcgagctgagacggaccatcgcacacggggctgctctcctggatctcgaacagactaccctgcccggaatcgcgcacctcgttgtggaaacaatgatcgtgagcgatcaaataaggccagaagaccgcgcttcggtgctgcggaccttattgcttaaacactcacatcccaacgatgacaaagattccggctttttcccccgaaacccctcttcttcctcaatgaatagtgtgctgggaaaccaccatccaacaccttctcacggccctgatggcgctgtgccaaccatggctgacgatttaggggaaccggcacccctgtggccacacgatcctgacgcaaaagaaaaacctctgcacatgcctggaggagacggacaccgtggtaagagtctgaagctcctcgaaaagatccccgaagatgctgaggcaacagttgtgctggtcgggtgcgtgcccttcctggaacaaccagccgctgcttttgtccgacttaacgaagccgtgctcctagagtctgtgctggaggttcctgttccagtgcgttttctgttcgttatgcttggacctagtcatactagtactgattaccacgagctgggccgatctatagcaaccttaatgtctgacaaattgtttcatgaagctgcctatcaagcagatgaccgtcaggatttgctgtctgcgatctcagaatttctagacggctcgatcgtgattccacccagcgaggtagagggcagggatcttttgaggagcgtagccgctttccagcgcgaattgctgaggaagcggagagaacgtgaacagaccaaagtcgagatgaccacccgcggaggttatactgcaccgggtaaagaactttcgctggagctcgggggaagcgaagccaccccagaggacgacccattactgcggactggctctgttttcgggggactggtccgtgacgtgcgacggagatatccacattaccccagtgacctgcgcgatgctctgcattctcagtgcgtagctgcagtgttatttatttacttcgccgctctttccccggctattacattcggaggcctgctcggtgaaaaaaccgaagggctgatgggtgtgtccgaactgattgtgtctacagccgtgctgggagtattatttagtctgctgggcgcacaaccgttgctagtagtgggcttcagtgggcctctgttggtattcgaagaagcttttttcaagttctgcagagcccaggacctggaatacttgaccgggagggtctgggtgggattgtggttagtcgtattcgtcctggccctagtggccgctgagggctcttttctggtgaggtacatcagcccctttacccaagagatttttgcctttttgatatctctgatttttatttacgaaaccttttacaagctgtacaaggtattcactgagcaccccttactccccttctacccccctgagggagcactggagggctcactggacgcaggcctggagcctaacgggtctgcgttgccgccaaccgaaggaccaccgtctcccagaaaccagcctaatacagccttactctctttgattcttatgctggggaccttctttatagccttcttcttacgaaaattccgcaattctcgcttcctgggtggtaaggccagacgcatcattggcgactttggcattcccatctccattttagtaatggtactcgtcgactattccattaccgatacctatactcagaagctaaccgttcctacgggcctgtctgtcacctcccctgataagcgttcatggtttattcctcctctcgggtccgccaggcccttcccaccgtggatgatggtagccgcagcagtgccagccctcttagttttgatattgatcttcatggagacacagataaccgcactaattgtcagccagaaagccaggcgacttttaaaaggcagcggctttcatctcgacctgctgctgatcggctctcttgggggactgtgcggactgtttggtctgccgtggctcacggctgccactgtgcgaagcgtcactcacgtgaatgcactgacagtaatgcggacagcgattgcaccaggagataaacctcagattcaggaggtgcgagagcagagagtcacgggggttctcatcgctagcctggttgggctgagcattgtaatgggtgccgtactgcgcaggattccgctcgcagtgctatttggaatcttcctgtacatgggcgtgacctctctctccggcatccagctttcacagcgattgcttttgattctgatgcccgcaaaacaccatcccgagcagccttacgtgactaaggtgaagacctggaggatgcatctattcacctgtatccagcttgggtgcatcgctctcttatgggtagtgaagagcactgcagcttccttagcctttccctttctcctgctgctgaccgttcccctgcggcactgcttgttgcctcggctttttcaggaccgcgagctgcaggcactggactctgaggatgccgagccaaatttcgatgaggacgggcaggacgagtataacgagctgcacatgcctgtctag

SEQ ID NO: 54306 - DNA, 684 bp, Artificial Sequence
  Description of Artificial Sequence: Synthetic coding sequence
atgacatccccactggaaaaggatccggagcccaacggtgctttgagcccagggccaggtgacactaactcgtgggggttcggacgcgatccagcacctagcccacgtgacagcctggcgccagaagacctggaaatgtttgtactggacttcgaggacggggacctctgggagtccatccggggtcagctggggcctatggccggaccacctacctgtcaccgcctggaggataatcccggagtgaggcgccacctggttaaaaagccttcccggacacaggggggaaggggaagtcccagcggcctggcaccgattctgcggaggaaaaagaagaagaagaagttggacaggcgccctcatgaggttttcgtggagctgaatgagctgatgcttgacaggtcacaggagccacattggcgggagacggccaggtggatcaagtttgaggaagatgtcgaggaggagacagagaggtggggcaagccccacgttgcttctctctcatttcgctccttgttggagctgcgcagaaccatcgcccatggcgcagctttgctggacctcgagcaaactactcttccaggtatcgcccaccttgttgtggagacaatgatcgtctcagatcagattagacccgaggatagggcttccgtcctgcgtaccttgcttttgaagcactag

SEQ ID NO: 54307 - DNA, 627 bp, Artificial Sequence
  Description of Artificial Sequence: Synthetic coding sequence
atgaaactcttgcctagcgtggtgttaaagcttttcctggccgcagtcttgtccgccctcgtgactggtgaaagtcttgaacgcctgcggcgaggactagccgcaggcacctcaaacccggaccctcccactgtgagcactgaccaactccttccattgggcggtggcagggataggaaggtgcgagacctgcaggaggctgatcttgacttacttagggtcaccctgtcctctaaacctcaggccctggcaacgccgaacaaagaagagcacgggaagagaaagaagaaaggcaaaggtctagggaagaagcgggatccatgcctgcgcaagtacaaggacttctgtattcacggcgaatgcaagtacgtgaaagaactgagggccccttcatgcatatgtcaccctgggtatcacggggaacgctgtcacggtctgagcctgccagttgagaaccgcctgtatacctacgaccacacaactattttagcggtggtagctgtggtgctctcctcagtttgcctgctcgtgatcgtgggtctgctgatgttccgctatcaccgtagaggtggttacgacgtggaaaacgaggaaaaagtaaaactcggcatgaccaattcccattag

SEQ ID NO: 54308 - DNA, 2838 bp, Artificial Sequence
  Description of Artificial Sequence: Synthetic coding sequence
atggaaatgaagctgcccggacaggaggggttcgaagctagcagcgcgccaaggaacattccatcaggggaacttgatagcaatccagatcccggaacaggacccagccccgacggtccatccgatacggaaagcaaagaattgggagtccccaaggaccccctcctcttcatacaattaaatgaactgcttggatggccacaggcgctggaatggagagagaccgggaggtgggtgctctttgaggaaaaattggaagtggcagccggaagatggagtgcgcctcatgtaccaactctggccttaccttctttgcagaaactccggtcgctgctagcggaaggacttgttctgctcgattgtccagcccagagcctgctagagttggtggaacaggtgacccgagtagaatctctgagccccgaactcaggggacagctgcaggcccttctactccagcgcccacagcactacaatcagactaccggcacaagaccgtgttggggaagtactcaccccaggaaagcatctgacaacgaggaggcgcctctccgggaacagtgccagaaccctctgcgccagaaattgccaccaggcgcagaagcaggcaccgtgttagctggtgagttgggtttcctcgcgcagcctctcggggctttcgtgcggctgaggaacccggttgtgctgggcagtttgaccgaggtgtctctgccctcacgttttttttgcctcctcttggggccatgcatgctgggcaaaggttaccacgagatggggcgagccgcagcggtgcttctgtcggatcctcagttccagtggtcagtgagacgggcatccaacctgcatgatctattggcagcgctagacgcttttctggaagaagtcactgtcctgcctccaggtaggtgggaccctaccgctagaatcccccctcccaaatgcctgccatcgcagcacaagcgactgcctagccagcagagggagattaggggccctgctgtgccacggcttacatccgctgaggaccgacatagacacggtccacacgctcacagccctgagcttcagcgtaccggcagaaaagttccatggtatccatctgattttctggacgctctccacctacagtgttttagcgcagttttatatatctatctggccactgttaccaacgctattaccttcggaggactcctgggcgatgccactgacggggctcagggcgtacttgagagcttcctcggtacagctgtggccggagcagcattctgtctgatggccggtcagcccctgacaatcctatcttctactgggcctgtgctggtattcgagcgcctgttattttccttttcacgggactacagcctggattatctgccattccgcctgtgggtaggcatttgggtggcgacgttctgccttgtgcttgtggcgactgaagctagtgtgctcgtgcgttacttcacccggtttaccgaggaggggttctgcgctttaataagtctcatcttcatttacgacgccgtcggtaagatgctcaacctgacgcacacgtatcctattcagaagccgggatcgtctgcatatggatgtttgtgccaataccccggaccgggaggcaatgagtcacagtggattaggacgcgcccaaaagaccgggacgacatagacctagggcttattaacgcctctctactgcccccaccagaatgcaccaggcagggcggacatccccgagggccaggctgtcacactgtccctgatatcgctttcttttctctactgcttttcttaacctccttcttctttgctatggccctcaaatgcgtgaagacctctcggttcttcccctcagtcgtaaggaagggtttgtctgatttctcttccgtgctagccattcttctcgggtgtggactcgatgccttcctggggctggctacgcctaaattgatggtaccacgtgagttcaagccaaccctgcctgggaggggctggctggtgtccccattcggagccaacccttggtggtggagtgtggcagctgctttgccagctctgctgctttccattctaatcttcatggaccaacagatcactgctgtgatattgaaccggatggagtaccgcctgcaaaagggcgctggattccacctcgatctattctgcgtggcggtgctgatgctcctgacatcagccctcggcttgccttggtatgtaagcgctaccgttatttccctggcgcacatggacagcctcaggcgcgagtcccgggcttgcgctcctggcgagaggcccaattttttaggcattagggagcagaggctgaccggccttgtggtgttcatactgacgggggcttccatctttctggccccagtgcttaagttcattcccatgccagttctatacgggatatttctttatatgggggttgccgctctgtcgtctatccaatttacaaaccgtgttaagctgttactgatgccagctaaacaccagcccgatcttctccttctcaggcacgtgccactgacacgagtgcacttattcaccgccatccagctggcttgcttgggactgttgtggatcatcaagagtaccccagcggctatcatctttcctctgatgctcttgggcctggtaggcgttcggaaggcccttgagcgtgttttctctcctcaggaacttctttggctggatgagctgatgccggaggaagaaaggtccatcccagaaaagggcttggagcccgagcacagcttttctggtagtgattccgaggattccgagttgatgtaccaacccaaggcgccagagattaatatctctgtcaactag

SEQ ID NO: 54309 - DNA, 2880 bp, Artificial Sequence
  Description of Artificial Sequence: Synthetic coding sequence
atggagatgaaactgcctggtcaagagggctttgaggcctcttccgcccctagaaatattccaagtggcgaactggatagcaatccagaccccggtaccggaccttccccggacggcccttctgatacggagagcaaagaacttggagtgcccaaagatccacttctcttcattcagttgaacgagctgctgggatggccacaggcgcttgagtggcgcgagacaggacgctgggtgctgttcgaagagaaactcgaggtcgcggctgggagatggtccgcgcctcacgtgcctaccctggctctgccctcactccaaaagttacgcagcctcctcgcggagggactcgttttgctggactgcccagctcagtctctcctggagctggtagagcaggttacccgcgttgagtctttgagcccggaattacgaggccagctccaagccttattgttgcaaagaccgcagcactacaatcaaactactggtaccagaccttgctggggatccactcaccctcggaaagctagtgataatgaggaggctcctctgagggagcagtgtcaaaaccctcttagacagaagcttccaccgggagcagaggctgggaccgtcttggcgggtgaactagggtttctcgcccagccacttggcgcatttgttcgcttgagaaatccggtcgtgctcgggtctcttactgaggtttccctcccaagtaggttcttctgtttgcttctaggcccatgcatgctggggaagggttaccatgaaatgggcagggccgcagctgttctgctatctgacccccagttccagtggtccgtacgcagggcatcgaacctgcacgatctgctggccgcactggatgctttcctggaggaagttactgttctcccccctgggaggtgggaccctacagctcgaataccaccaccaaagtgcctacctagtcagcacaaacgcttgccctcgcagcaaagggaaatccgcggtcccgcagtgcctaggcttacatctgccgaagatcggcatcgtcacgggcctcatgcgcacagtcccgaactgcagagaaccggccgtttgttcggcggactaatccaagacgtgaggcggaaggtcccctggtatccatctgactttcttgacgccctccacctgcagtgtttcagtgccgtgctttacatctacctggctaccgtcacaaacgcaattaccttcggtggcttgctgggagacgccacggacggtgcacagggtgtgcttgagtctttcctggggacagccgtagctggcgctgccttctgtctcatggctggccaaccattaacaatccttagttccacaggtcctgtgttggtatttgaacgacttctattcagcttttctcgagactacagtctggattacctaccgtttagactgtgggtggggatctgggtagcaaccttttgtctggtgttggtcgccactgaggcctctgtcctagttcgatactttaccagattcactgaggagggattttgtgcccttatttccctcatttttatctatgacgcagtcgggaagatgctgaatctgacacacacatacccaattcagaagcccggttcttcagcgtacgggtgcttgtgtcagtacccaggccctggaggtaacgaaagccagtggattaggactcgcccaaaagatcgcgacgacattgtgtccatggatcttggtctgatcaacgcaagcttattaccgcctccagaatgcacccgacaggggggtcatcccagaggcccaggttgtcacactgtacctgacatcgcattcttctccctgttgttatttctgacgtctttcttcttcgccatggctttgaagtgcgtgaagacgtctaggttctttcctagcgtcgtgcgaaaaggtttgtcagactttagtagcgtgctagccatcctccttgggtgcgggctggacgcctttttagggctcgccacgccgaagttaatggtgcccagggaattcaagccgaccttgccaggaagaggatggttggtgagcccattcggggcaaatccgtggtggtggtctgtcgctgctgccctccctgctctcctgctgtcgatcctaattttcatggatcagcagattacagcagtgattctgaaccgcatggaatacaggctacagaagggagctggtttccacctggatctgttctgcgttgctgttttgatgcttttgacttcggccttgggcttaccttggtacgtgtctgctacagtcatctctcttgcgcacatggattccctgagacgggagagtagagcctgcgcaccaggggaacgacctaactttttgggcatcagagaacagcgccttactgggctggtcgtctttatcttaactggtgcctccattttcctcgcaccggtgctgaagttcatccctatgcccgttctgtacgggatctttttatacatgggggtggctgccttgagctctattcagtttacaaacagggtcaagctgctattgatgcctgccaagcatcagcccgacctgttactgcttagacacgtgccgctcacacgtgtccacctctttactgcaattcaacttgcttgcctcggattactgtggattatcaagtcaaccccagccgctattatatttcctctcatgctcctggggctggtcggtgttagaaaggctctcgaacgtgtcttctctccacaggagctcctctggctagacgagctgatgccggaggaagagcggtcgattcctgagaaaggccttgagcccgagcactctttttctgggtccgactctgaggactctgagctcatgtaccagcctaaggcccctgagattaacatctctgtgaattag

SEQ ID NO: 54310 - DNA, 2952 bp, Artificial Sequence
  Description of Artificial Sequence: Synthetic coding sequence
atggaaatgaaactcccaggtcaggaagggttcgaggcctcttccgctcctcgcaatataccaagcggcgaattggacagcaatccggaccccggaaccggaccatctcctgatggtccatcagacaccgaatctaaggagctaggagttccaaaggatcctcttctgtttattcaactgaacgagctcctgggatggccacaggctttagagtggagggaaaccgggtcaagcagcgcttccctccttctcgatatgggcgagatgccttccatcaccctgtccacccatctacatcataggtgggtcctgttcgaagagaaactggaggtagccgctggacgctggtccgcaccacatgtccctacactagccctcccctcactgcaaaagctacgttctcttctcgctgagggattagtgctgctagattgtccggctcagtcccttcttgagttagtggagcaggttaccagagttgagagcttgtcccccgaactcagaggacaactccaggccttactactccaacgcccacagcactacaatcaaactacaggcacacgcccttgttggggaagcactcaccctcggaaggctagcgataacgaagaggccccactcagagagcagtgccagaacccgctgagacaaaagttgcctcccggtgcagaagcagggaccgtgctggccggagagctggggttcctggcacagcctctgggggcttttgtacgcctacggaatcctgttgtcctaggcagtctgaccgaggtgtccctaccctctaggttcttttgtctcctactgggcccttgcatgctcggcaaaggatatcatgagatgggaagggccgcagccgtcctgctgtctgatccccagtttcaatggagtgtgcgacgggcaagcaacttgcatgaccttctggccgcactggatgccttcctggaagaggtgactgtgcttcccccaggcaggtgggaccctaccgcccgaatccctcccccaaaatgcctgccttcacagcacaagcgcctcccaagccagcagcgagagatcaggggtccagcggtcccaaggttgacaagtgccgaggataggcataggcacgggcctcatgcgcacagtcccgagctgcagagaactggtcgcctctttgggggattaatccaggatgttcgcagaaaagtgccttggtaccctagtgatttcctggacgccctgcatctccagtgtttttcagccgtgctatacatctatttagccaccgtcaccaacgccattaccttcggaggcctgttaggcgatgccaccgatggggctcagggcgtgcttgagagttttttgggcaccgcagtggcaggagcagctttttgcttaatggcaggacagcccctgaccattctctcgagcactggaccagtgttggtgttcgagcgacttctgttctccttttccagagactactccctggactatctcccatttcggctgtgggtcgggatctgggtcgctactttttgcctggtcctggtagccaccgaggcttccgtcctcgttcgttattttacaaggttcacagaagagggattctgtgcattaatctcccttatcttcatatacgatgccgtggggaaaatgctgaacctcacacatacttaccctattcagaagccaggatccagcgcttacggctgtctgtgtcagtatccaggaccaggtggcaacgagtctcagtggatacgcacacgtccaaaagatcgcgatgatatcgtgagcatggatctgggactcattaatgcctccctgctgccccctcccgagtgcacaaggcaagggggtcatcccaggggcccagggtgtcacaccgtcccggatatcgctttcttctccttgcttctgtttctaacatctttcttttttgcaatggcactcaagtgtgtcaagacaagccgctttttcccctcagttgtgagaaagggactttcagatttctcctccgtcttggcaattctgttagggtgcggcctcgacgccttcttaggtcttgccaccccaaaactgatggtacccagggagttcaagcccacccttcccggacgtgggtggctggttagtcccttcggcgctaacccttggtggtggagtgttgcagccgctctgcccgcactcttattatcaattctgatttttatggaccagcaaattacggcagtgattctgaaccgcatggaataccggctccagaagggcgctggcttccatctagatctcttttgtgtggcggtgctaatgctcttgaccagtgctctggggcttccttggtatgtgtcagctaccgtgatcagtctggctcacatggattcacttagaagggagtctcgggcatgtgcccctggagagcggccaaattttttgggtatcagagaacaaagactgactgggctggtcgtctttattttgacaggcgctagcatttttcttgcacctgtgcttaagtttattcccatgcctgtgttgtatggcatcttcctctatatgggagtggccgcactctcttctatccaatttaccaatcgagtcaagctgctgctcatgcctgctaaacatcagcctgatctgctgctactcaggcacgtgcccctgacgagagtccacttgtttacagccatccagctggcttgcctcggtttactctggatcattaaaagcacacccgctgctataatcttcccactgatgctgctgggccttgtcggagtaagaaaagctcttgagcgggttttttctcctcaggagctgttatggctggatgagcttatgcccgaggaggagcgttcaattccagagaaggggctggagccagagcatagtttcagcgggtcggatagtgaagatagcgaactcatgtaccagccaaaagccccagaaataaacatctcagtaaattag

SEQ ID NO: 54311 - DNA, 1476 bp, Artificial Sequence
  Description of Artificial Sequence: Synthetic coding sequence
atggccggacagggactgcccctccatgttgcgactttgcttaccggcttgttggaatgtctcggattcgcgggagtactcttcggctggccaagtcttgtctttgtgtttaagaacgaagattacttcaaagatctctgcgggccagatgcaggcccaattggcaacgcaacaggtcaggctgattgcaaagctcaagatgaacgatttagcctgatatttaccctaggcagttttatgaacaatttcatgacctttccaacaggttatatattcgataggttcaaaactaccgtggctaggctgatcgccatattcttctataccacagccaccttgattatcgcctttacctccgccggatccgcggtactgctgtttttagccatgccaatgctgaccattggaggtatcctctttttgatcacgaatcttcaaataggaaacctgtttggtcagcacagatccacaatcatcaccctatacaatggtgctttcgattcttcatctgccgtgttcttaattattaagctgctgtacgaaaagggtatcagcctgagggcgtctttcatattcatcagcgtgtgcagtacatggcacgtggccagaacttttctgctgatgccccgtggccacataccttacccattaccaccaaactactcatacgggttatgtcctgggaacggcactaccaaggaagagaaggagacagctgagcacgagaacagggagctgcaaagcaaagagtttctttccgccaaggaagagacccctggggctgggcagaagcaggaactgaggtcattctggagttacgctttttcaaggagattcgcctggcacctagtctggctctctgtgattcaactttggcactacctgttcattgggacgctaaactctctgctcaccaatatggcaggtggcgatatggccagagtgagcacctacaccaacgcttttgccttcacccagttcggggtgttatgcgcgccttggaacggattactcatggatcggttaaaacaaaagtaccagaaagaggccagaaaaaccgggtcttccacactcgcagtcgccctctgcagcacagtcccatcccttgctctcacctctttgctctgcctcggctttgccctctgtgcctccgttccaatcctgccactgcagtacctgacgtttatcctccaagtcatttcaaggtcttttctgtatggctcaaatgcagccttcctcaccctggccttcccctccgagcactttgggaagctgtttgggctcgtcatggccctgtctgccgtcgtgtctctgttgcaattccccattttcacactgatcaagggaagtctgcagaatgatcccttctatgtgaatgtgatgtttatgctggcaattttgcttacgttttttcacccttttttggtatatagagaatgcaggacttggaaagagagtcctagcgcaatcgcatag

SEQ ID NO: 54312 - DNA, 1476 bp, Artificial Sequence
  Description of Artificial Sequence: Synthetic coding sequence
atggccggtcaaggcctgccacttcatgttgcgacactgctgacgggattgctcgagtgcctggggtttgctggcgttctttttgggtggccgagccttgtcttcgtgttcaaaaatgaggactacttcaaagatctttgtggccctgacgccggtccaataggcaacgctacgggccaggcagattgcaaggcccaggacgagcgatttagtctcatctttaccctgggaagttttatgaataatttcatgacattccccacaggctacatttttgaccgattcaaaactaccgtggcacggctcatcgctattttcttttatactaccgcaacactaataattgctttcacctctgctggctccgccgtgttgctcttcttggctatgcccatgctgactattggcggaatcctattcctcatcaccaacttacaaataggcaacctgttcgggcaacatagaagtactattatcacactgtataatggtgcctttgactcctcttcagccgtgttcttgatcatcaaactcctgtatgagaagggtatcagcctccgagcttctttcatctttatatccgtctgcagtacctggcatgttgcgcgtacctttctgttaatgccacgcggtcacatcccatatcccctgcctcctaactacagttatggcctctgtccgggtaacgggaccactaaggaggagaaagagacagctgagcatgaaaaccgtgaactgcagagcaaagaattcctgtcggcaaaagaggaaacccccggagctggacagaagcaggaattacgttctttttggagctacgcattcagcaggcggtttgcctggcatctcgtctggctctccgtgattcagctctggcattatctcttcatcggcaccttgaactctcttttaacgaacatggcgggtggggatatggcccgagtgtctacctacacaaatgcctttgcttttactcaattcggtgtcctgtgcgcaccttggaacggcttgctgatggataggttgaagcagaaataccagaaagaagctcgcaagacaggcagttccactttagctgtggccctgtgctctaccgtgccctcgctagccctcacttctcttctgtgtctcggattcgctctctgcgcctcagttccaatcttgcctctgcagtacctcacctttatcctccaggtcatcagtcgatctttcctgtacggtagcaacgccgcatttctcacactggcgtttccaagcgagcatttcggaaaactgttcgggctggtaatggccttgtccgccgtcgtctcactactccagttccccatatttaccttaatcaaggggagtctccagaacgacccattctacgtgaacgtgatgttcatgttagccattttactaaccttcttccaccccttcctcgtttacagggagtgcaggacatggaaggaatctccttctgccattgcgtag

SEQ ID NO: 54313 - DNA, 1476 bp, Artificial Sequence
  Description of Artificial Sequence: Synthetic coding sequence
atggctggacaggggttacccctgcatgtggccaccttgctgactgggctgctcgaatgccttgggttcgcaggggtgctttttgggtggccttccctggtattcgtttttaagaatgaagattacttcaaggacctgtgtgggccagacgccggtcctatcggtaacgccacaggacaggcagattgcaaggcacaagatgagagattcagcttgatcttcactttggggagctttatgaacaattttatgacattcccgaccggttatattttcgatcgctttaagacaacagttgctcgcttgatagcaatctttttctataccaccgcaacgctgataattgcttttacctccgcgggttcagctgtcttgttgttcctcgccatgccaatgcttactataggagggatcttattcttgataactaatctgcagattgggaatctcttcgggcagcacaggagtacaattattactctttataacggggcattcgactccagtagcgcagtctttttgataataaaactcctgtacgaaaagggaatcagtctcagagcatcctttatctttatctctgtatgcagcacttggcatgtggcaagaacttttctcctcatgccacgcggtcatataccctatccactcccaccgaactattcctatggtctgtgtccaggcaacggtacaacaaaggaggaaaaggaaaccgcagagcacgagaatcgcgagcttcaatcgaaagagtttctctccgccaaagaagagaccccgggagccggacagaagcaggagcttagatcgttttggagttatgccttcagccggcgttttgcgtggcacctggtctggcttagcgttatacagctgtggcattacctttttatcgggactttgaactcactgctgaccaacatggccggaggcgacatggcaagagtctctacatacaccaacgccttcgcgtttacgcagttcggagtgctgtgcgccccttggaatggtctccttatggatcgactgaagcagaagtaccagaaggaggctaggaaaacaggatcaagtaccttagcagtcgccctctgctcaacagttccttcactggccctgacgagtctgctgtgtcttgggttcgccctgtgcgcttcagttcccatcttacccttgcagtatttaacgttcattctgcaagttatttcgcggagctttctgtacgggtccaatgcagcctttctgaccctagccttcccatctgaacacttcggaaaattgttcggcttggtcatggctttgtcggctgtcgtgtccctgttacagtttcccatcttcacactgatcaaggggtcactccagaatgaccccttttatgtgaatgtgatgttcatgttagccatcctgcttaccttcttccatccattcttagtctacagggagtgccgaacgtggaaggaaagcccgagcgctatcgcttag

SEQ ID NO: 54314 - DNA, 309 bp, Artificial Sequence
  Description of Artificial Sequence: Synthetic coding sequence
atggccggtcagggcctgcccctccacgtggcaacattgctcacaggactgcttgagtgtcttggttttgccggagtgttgtttggttggcctagtttagtgtttgtgtttaagaatgaggactacttcaaggacttatgcggtcctgacgcgggtcctattggcaacgctaccggacaagctgattgcaaagcgcaggatgaacgattcagcctgatctttactctcggctcattcatgaacaacttcatgacttttcctacaggctatatctttgatcgattcaagactaccgtggcacggctctag

SEQ ID NO: 54315 - DNA, 510 bp, Artificial Sequence
  Description of Artificial Sequence: Synthetic coding sequence
atggctgggcaaggattacccctgcacgttgcaacacttctgacaggtttattggaatgcctcggatttgccggagtgttgtttggctggccttccttggtgttcgtgtttaagaacgaagactattttaaagatctgtgtggacctgatgccggtccgatcgggaatgcaaccggccaggcagactgcaaggcgcaggacgagcggttctctttaatctttacactcggatcttttatgaacaacttcatgacttttcctaccgggtacatcttcgaccgattcaagaccacggtggctcggctgattgctatctttttctacacaaccgcaaccttgattatcgcatttactagcgcagggtctgcggtgttattattcctggcaatgcccatgcttaccattggcggtatcctgtttctgatcacaaaccttcagattggcaacctgtttggacagcaccgctctaccattatcacgctgtacaacggggcattcgattcttcatag

SEQ ID NO: 54316 - DNA, 195 bp, Artificial Sequence
  Description of Artificial Sequence: Synthetic coding sequence
atggccggtcagggcctccctctccacgtggcaactttactgaccggcttgctcgagtgcctgggctttgccggagtcttgtttggatggccttccttggtttttgtttttaagaatgaagactattttaaggatctgtgcggtccagatgctggacccatcgggaatgccacaggccaggccggacgactatag

SEQ ID NO: 54317 - DNA, 447 bp, Artificial Sequence
  Description of Artificial Sequence: Synthetic coding sequence
atggcgggacaggggttgcctctccatgtagcgacactcttgaccggcctcttagagtgccttggattcgccggagtgctcttcgggtggccttctttagtctttgtgtttaagaacgaggattatttcaaggacctttgcggacccgacgcaggccctatcggcaatgccactggtcaggctgactgcaaggcgcaggacgaacgttttagcctgatattcactctggggtcttttatgaacaatttcatgacgttccctactggttacatattcgatcgatttaagacaacagtggctcgattgatcgcaattttcttctataccaccgccacactgatcattgcctttacttcagcagggtctgctgttctcctgtttcttgcgatgcccatgctaaccatcggcggtattcttttcctcatcaccaatctgcagattggatag

SEQ ID NO: 54318 - DNA, 360 bp, Artificial Sequence
  Description of Artificial Sequence: Synthetic coding sequence
atggctgggcaaggactcccacttcacgtagcaaccttgctcaccggattgcttgagtgcttaggatttgcgggagtcctcttcggatggccatcccttgtgttcgtctttaaaaatgaggactattttaaggatctgtgcgggcctgacgctggacccattggaaacgccaccggacaggcagactgtaaagcacaagatgaacggttctcactgatctttacccttggaagctttatgaataactttatgacatttccaacaggctatatttttgataggttcaagacgaccgtggccagactgatcgcaattttcttctacaccaccgctacacttatcattgcattcacctcctag

SEQ ID NO: 54319 - DNA, 1476 bp, Artificial Sequence
  Description of Artificial Sequence: Synthetic coding sequence
atggccggtcaaggacttccactccacgtcgccaccctcctaacagggctcctggaatgtttgggtttcgcaggagtactgttcggttggccttctctcgtctttgttttcaaaaacgaggactacttcaaagatctctgtgggcctgacgcgggacctatagggaacgccacaggccaggccgactgtaaggcacaggacgagagattctccctcatttttaccctgggttcctttatgaataatttcatgacctttccgaccggctatatatttgatcgcttcaaaacaaccgtggctaggctgatagcaatttttttttatacaaccgcgaccctgattatagccttcacatctgctggatctgccgtactgctcttcctagccatgccaatgctgaccatcggtggtattctgttcctgattacgaacctccagattggaaacttgtttgggcagcacaggtcaaccattataactctatataatggtgcgtttgacagttctagcgctgtatttctcattattaagctgctctatgaaaagggaatctctctccgtgcctcctttatcttcatcagcgtttgctccacttggcacgtggcccgaactttcctgctgatgccccgtggccacattccctaccctctcccccctaactatagctacggcctgtgccccggaaatggaaccacaaaggaggagaaagagacagccgagcatgaaaatagggaactccagagcaaggaatttctatccgcgaaagaagaaacgcctggagccggacagaagcaagaactcagaagtttttggagctacgctttttcacgccgttttgcgtggcacctggtgtggctgtcagtcattcagctgtggcactacctgttcattggtaccttgaacagtttgcttactaatatggccggaggcgacatggcaagagtgtccacatatacaaatgcctttgcattcacccagttcggtgtcttatgtgcaccatggaacggattgcttatggataggctgaagcagaagtaccagaaggaggctagaaaaactggcagcagcacactggccgtggccctgtgctccacagtaccatcgttagctctgacttcccttttgtgtctcggctttgctctgtgcgcctccgtccctattctcccgctacaatacctaaccttcatacttcaggtaatctcacgctccttcctgtacggctctaacgccgctttcctcacgctggcattccctagcgaacatttcggcaagctatttggcctcgtcatggcactgtcagcagtggttagcctactgcagtttcctattttcacactaataaagggtagcctacagaacgatcctttctatgtgaatgttatgtttatgcttgctatcctgctcacattttttcacccttttttggtttatcgcgaatgcaggacatggaaagaatccccgtcggccattgcatag

SEQ ID NO: 54320 - DNA, 69 bp, Artificial Sequence
  Description of Artificial Sequence: Synthetic coding sequence
atggccggtcaggggctgccccttcacgtcgcaacgttgctcaccggtctcctggaatgtttgggatag

SEQ ID NO: 54321 - DNA, 996 bp, Artificial Sequence
  Description of Artificial Sequence: Synthetic coding sequence
atggcgggacagggccttccgctgcacgtggcgaccctgctcactgggctactggagtgcctgggcttcgcaggagtcctgttcggatggcctagtttggtttttgtatttaaaaatgaagactatttcaaggacctgtgtggcccagacgcaggacctataggtaacgctacaggacaggccgattgcaaggcccaggatgagagattttctctgatatttactctcgggtcgtttatgaataactttatgaccttcccaacaggatacatctttgatcggtttaaaaccaccgttgccaggttgatcgccatttttttctataccacagcaaccctcattatcgctttcaccagcgctgggtcagcagttctgcttttccttgcaatgcccatgctgaccattggcggaattctcttcctgattacaaacctgcaaatcgggaacctgtttggtcaacacagaagtaccattataacactctacaacggggcatttgactcatcctctgcagtgtttttgataatcaagttactatatgagaaaggcatttctttgcgcgcttcattcatatttattagtgtctgtagtacctggcatgtcgccagaacttttctgctcatgcctcgcggacacattccttaccccttgcccccaaactattcctacgggctctgtcccggtaacggcactacgaaggaagagaaggagacagccgagcatgagaatcgcgagctgcagtctaaggaattcctctctgcaaaagaggagacgcccggagcaggacaaaaacaagagcttcgatcattctggagttatgccttttcacggcgattcgcctggcacctggtctggctcagtgttatccagctctggcattacctgttcattggcacattgaactctctgctgaccaacatggcaggcggtgatatggccagggtctcaacatacactaatgccttcgccttcacccagttcggcgtgctgtgttag

SEQ ID NO: 54322 - DNA, 135 bp, Artificial Sequence
  Description of Artificial Sequence: Synthetic coding sequence
atggcaggccaggggctaccccttcatgtagcaacacttcttactggactgcttgagtgcctaggctttgcaggagtcctgttcggatggccttctctggtgtttgtttttaagaacgaagattacttcaaatag

SEQ ID NO: 54323 - DNA, 9 bp, Artificial Sequence
  Description of Artificial Sequence: Synthetic coding sequence
atggcgtag

SEQ ID NO: 54324 - DNA, 297 bp, Artificial Sequence
  Description of Artificial Sequence: Synthetic coding sequence
atggccggtcagggccttcctttgcacgtggcgactctgctgactggactgctggaatgtctgggcttcgctggggtgctgtttggctggccatcacttgtgtttgtcttcaagaacgaggattactttaaagatctttgcggcccagatgctggaccaattggtaacgcgactggacaagccgactgtaaggcgcaggatgagagattcagtctcatctttaccctgggttcttttatgaataattttatgacgttccctactggctatattttcgaccggtttaaaaccacatag

SEQ ID NO: 54325 - DNA, 237 bp, Artificial Sequence
  Description of Artificial Sequence: Synthetic coding sequence
atggccggtcaaggcttgcccttgcacgtggcaaccctgctgaccggattgctcgaatgtcttggctttgccggagttctgttcgggtggccttcgctagtgttcgtattcaaaaacgaagactacttcaaggatttatgtgggcctgacgcgggtcccatcgggaacgccacaggacaagctgattgcaaagcacaggatgagcgcttcagcttaatttttaccctcggtagttag

SEQ ID NO: 54326 - DNA, 324 bp, Artificial Sequence
  Description of Artificial Sequence: Synthetic coding sequence
atggcgggacaggggttgccgttacatgtggccaccctgctcacaggattgctggagtgcctgggattcgcaggcgtgctcttcgggtggccttccctggtatttgtcttcaagaacgaggattatttcaaggacctttgcggacctgacgctggcccaattgggaacgctacaggtcaggccgattgcaaagcacaggatgaaaggttttctttgatctttaccttaggctcttttatgaataattttatgacctttcctaccgggtatattttcgacagattcaagaccactgtggctcgccttattgccatctttttttag

SEQ ID NO: 54327 - DNA, 333 bp, Artificial Sequence
  Description of Artificial Sequence: Synthetic coding sequence
atggctggccagggccttcctctgcatgtagctacactcctgacagggctcctggagtgtctgggtttcgccggagttctttttggatggcctagcctcgtcttcgtgttcaagaacgaggattactttaaagacctgtgcggacccgacgccggtccaatcggcaatgccaccggccaggcagattgcaaagctcaggacgaacgcttctctctgatcttcaccctgggtagcttcatgaataactttatgacctttccgaccggctacattttcgacaggtttaagactaccgtcgcacgtctcattgcgatctttttttacactacctag

SEQ ID NO: 54328 - DNA, 1758 bp, Artificial Sequence
  Description of Artificial Sequence: Synthetic coding sequence
atgcattgcctgggagccgagtatctggtatttatcatgggatactctgtggtggccggagccgctggtcggcttttattcggatatgattccttcggcaatatgtgcggaaagaagaattccccagtagaaggtgcgcctctcagtgggcaggatatgacactaaaaaagcatgtgttctttatgaacagctgcaatcttgaggtgaaaggaagtttcttatgcgtgtatagcctaaattcttttaattatacacacagtccaaaggcagatagtctgtgcccacggcttcccgtaccgccttctaaaagcttccccttattcaacagatgcgtcccacaaacgccggaatgctatagtctatttgccagcgtactgatcaatgacgtggataccttacacaggattcttagtggaattatgtctggcagggatacgattctaggtttgtgtatcctggccctcgctctgtcattggccatgatgttcacattcaggttcatcaccaccctgctcgtgcacatctttatatctttggtaatcctgggcttactgttcgtttgcggcgttctctggtggctctactacgactataccaacgacctgagcatagagctagatacagagcgcgagaatatgaaatgtgtgttggggttcgctattgtgtcaacggggatcacagctgtgctgctggtcctgatatttgtgctgagaaaaagaattaaattgaccgttgagctgtttcagatcaccaataaagccatcagctccgccccttttctgctgtttcagcccctgtggacctttgccatactgatttttttttgggtcctgtgggtggcagtcttactgagcctgggaaccgcaggtgcagcacaggttatggaaggaggacaggttgagtacaaaccgctgtcagggataagatatatgtggtcatatcatttaatcggcctgatttggacctccgagttcatccttgcatgccagcagatgactatcgcaggagccgttgtcacctgctattttaacagaagtaagaacgacccacctgatcatcctattttgtcctctctctccatcctgttcttctatcatcaagggaccgtcgtgaagggctcgtttctcatctccgtggtgaggatcccgagaatcattgtgatgtacatgcagaacgcattgaaagagcagcagcacggagcgctgtctcgctacctgttcaggtgctgttactgttgcttttggtgtcttgataagtatttactgcacctgaatcagaatgcatacaccacaacagcaatcaacggcactgatttttgcacatccgctaaggacgcgtttaaaattctgtcaaagaatagttcgcatttcacgagcatcaactgctttggggattttatcatcttcctgggtaaagtcctcgtcgtgtgttttaccgtgttcggcggactgatggcttttaactacaacagggcttttcaagtttgggccgtgccgctgctcttggtcgctttcttcgcttacctggtcgcccactcattcctgagcgtgtttgagactgtactggatgcactctttctgtgtttcgctgtcgaccttgagacaaatgatggaagcagcgaaaagccttactttatggaccaggagttcttgtcatttgtcaagcgttctaacaaactgaataacgctagagcccagcaggacaaacatagcttgcggaacgaagaaggaactgagctgcaggccattgtgcggtag

SEQ ID NO: 54329 - DNA, 1863 bp, Artificial Sequence
  Description of Artificial Sequence: Synthetic coding sequence
atgcattgcctgggcgcagagtatcttgttagtgcggaaggggcaccacgtcaacgggaatggcgcccacagatctatcggaagtgcacggatacagcctggctgtttttattttttttgttctggactggacttgtgttcatcatgggctactcggtagtggccggagccgcagggaggcttctgttcggctatgattcttttggaaacatgtgcggaaagaaaaactccccagtagagggagcacccctgtcagggcaggacatgacgctgaaaaaacatgtgttcttcatgaactcctgcaatctggaggtgaaggggtcttttctatgtgtgtacagcctgaactcctttaactacacgcactcaccaaaggccgattccctatgccccaggcttccagtgccaccctctaagtccttcccattgttcaacagatgcgtgccacagacaccagagtgttacagcctgttcgcatcggtcctaatcaatgacgtggatacactccatagaatcctctcaggcattatgtccggcagggatactattctcggactgtgtatcctcgctctcgctctgtcactggcaatgatgttcactttccggtttatcaccaccttgttggtacacatttttataagcctggtaatactagggctcctgtttgtgtgcggagttctttggtggctgtactacgattataccaacgatctgtctatagagctcgataccgagcgggaaaatatgaagtgcgtgctcggcttcgccatcgtttccacggggattaccgccgtgttgctggttctcatatttgttttacggaaacggataaaacttaccgtggagctgttccagatcacaaacaaagcaatcagctctgcaccatttctcttgttccaacctctgtggaccttcgcaatcctgatcttcttttgggtgctgtgggtggcggtcctcctgtccctcgggaccgcaggcgcagcccaggtcatggagggaggccaggtggaatataaaccactatcagggatacggtatatgtggagctatcacctcattggactgatctggacctccgagtttattctggcttgtcagcagatgacgattgccggagcagtcgtgacctgttacttcaaccgcagcaaaaacgatccacctgaccatcccatcctgtccagcttaagcatccttttcttctatcatcagggcaccgtggtgaagggaagtttcctgatctcagtggtcagaatacctaggattatcgtcatgtatatgcagaacgccttgaaggagcaacatggcgcattatcaagatatctcttccgctgctgctactgctgcttctggtgcctggacaaatacttattgcacctgaatcagaacgcttatacaacgacggccattaatgggaccgacttctgcacttctgccaaggacgcgttcaagatactctcgaaaaactcctctcactttacatcgatcaattgcttcggtgacttcatcatattccttggaaaagttctcgtggtatgtttcacagtcttcgggggactcatggcatttaactacaacagggcatttcaggtttgggcagtgccacttctgttagtagccttttttgcctatttagtagcccattcctttttgtcagtgtttgagaccgtgctagatgccctgtttctgtgtttcgcggttgatctcgaaaccaacgatgggtcaagcgaaaaaccatactttatggaccaggaatttctctccttcgtcaagcgaagcaacaagctgaacaacgccagagctcagcaagataagcactcacttaggaatgaggaaggaaccgagctccaggctatcgttcggtag

SEQ ID NO: 54330 - DNA, 1962 bp, Artificial Sequence
  Description of Artificial Sequence: Synthetic coding sequence
atgcattgtctcggggcagagtatttagtgtctgcggaaggagcaccacgccagagagaatggcgtcctcagatatacagaaagtgtaccgacactgcttggctgtttcttttttttctcttctggaccggcctggtcttcatcatgggttatagtgttgtggccggagccgcagggagactgctttttggatacgacagcttcggaaacatgtgcggtaagaagaattcccctgtggaaggcgcacccctaagcggacaggacatgaccctgaaaaagcacgtgttcttcatgaatagctgtaaccttgaagtgaaagggacacagcttaatcgcatggctctatgcgtctcgaattgcccagaagaacagttggactctctagaggaagtgcagtttttcgcaaatacatccggatcgttcttatgtgtgtattctctgaactcttttaactacacgcacagccccaaagccgattctctgtgcccacgcttgcctgtaccaccatcaaagtctttccccctttttaaccgctgcgtgccacagaccccggaatgttactctttgtttgcctccgtcctcatcaacgatgtggataccctccatcgcatcctctccggtataatgagcggtcgggacacaatcctagggttgtgcattctggcgctcgcactgtctttggctatgatgtttacctttcggtttataactacactcctggtacacatttttattagcctggtgattcttggcctcttgtttgtctgcggcgttctgtggtggctctactacgattatacaaacgatctctcgatcgaactggatactgaacgcgagaacatgaagtgtgtgttgggatttgccattgtttccactggcataacggctgtactcctagtcctcattttcgtacttagaaaaaggataaagttgaccgtagagctgtttcagatcactaataaagccatctcctcagcgccattcctgctgtttcagcctctttggaccttcgctattctgattttcttttgggttctgtgggtcgccgttctgctgtccttggggactgccggtgcggcacaagtcatggaagggggacaggtagagtacaagccactcagcggcattaggtatatgtggtcatatcatttgataggactgatctggaccagcgagtttatccttgcctgtcaacagatgacaattgcaggggctgtggtgacatgctacttcaaccgatcaaagaacgatccgccagaccacccgatactgtcatcgctgtctatcctgtttttctaccaccaaggtacggttgtcaaggggtcattcttaatttccgtggtacgaatcccacgcatcatagtcatgtatatgcaaaacgccctaaaagagcagcagcatggagcattgagcagatacctcttccgctgttgctattgctgtttttggtgcctggacaagtatctactccacctgaaccaaaatgcctataccaccaccgccataaacggaaccgatttctgtacaagtgcaaaagacgcgtttaagatcctaagtaagaactcctcacactttacctccattaattgttttggcgatttcatcatattcctgggtaaagttctggtggtctgcttcacagtctttgggggtctcatggcctttaattacaacagggcttttcaagtttgggcagtcccactcttgctggtcgcgttttttgcctacctggtcgcgcactcatttctcagtgtgtttgagactgtgctggacgccttgtttctgtgtttcgccgtggatctcgagactaatgacgggtcaagtgagaaaccatattttatggatcaggagtttctttcatttgtaaagcgatccaataagctgaacaacgccagggcccagcaagacaaacacagtctgagaaacgaagaaggaaccgagctccaggcaatcgttagatag

SEQ ID NO: 54331 - DNA, 492 bp, Artificial Sequence
  Description of Artificial Sequence: Synthetic coding sequence
atgggctactctgtagttgcaggtgctgccggtcgattactatttggatacgactcttttggtaacatgtgtggcaaaaaaaactcccccgtggagggcgctcccttatctggccaggacatgaccctcaaaaaacacgttttcttcatgaattcttgcaatctggaggttaaagggacgcagttaaacagaatggctttgtgtgtgagcaactgtcctgaagagcagctggatagtttagaagaggtgcagtttttcgccaatacatccgggtctttcctttgcgtgtactctctgaattcattcaactacacccattctcctaaggccgattcactgtgtccgagactgcccgtgcctccaagcaaaagttttcccctgttcaaccggtgtgtgccgcagaccccggagtgttatagtctgttcgcttcagtactgatcaacgacgtggacacgctccacagaatacttagcggcataatgtctgggtag

SEQ ID NO: 54332 - DNA, 1854 bp, Artificial Sequence
  Description of Artificial Sequence: Synthetic coding sequence
atgcattgcctgggagcagagtatctggtgttcattatgggctacagtgtcgtggccggagctgctggacggctgttgtttggctacgattcttttggcaatatgtgtggtaagaaaaacagtccagtcgaaggagccccactgtccgggcaggatatgacactgaagaaacacgtgttctttatgaatagttgtaatttggaagtgaaaggaacacagctcaataggatggccctctgcgtatctaactgcccagaagagcagctggacagtttggaggaagtgcagttcttcgccaatacttcagggtctttcctatgtgtctattccctgaatagttttaattacacccatagcccaaaagccgactcattatgcccccgactgcccgtacccccatccaaatcatttcctctgttcaaccggtgcgtcccacaaactcccgaatgttactcactcttcgcctcagtcttaattaacgacgtcgacacactgcatagaattctgtcagggatcatgagcggcagagacacaattcttggcctctgcatactagccctcgcactctctctcgccatgatgttcacttttcgcttcattacaacactattggtgcacatcttcatttcgctggtcatcctggggctgttattcgtgtgtggagtgctgtggtggttgtactacgattacacgaatgacctctcgatcgagctggatactgaacgggaaaacatgaagtgtgtccttggttttgcaatcgtcagtaccgggatcaccgcggtgctcctggtgctgattttcgtgcttcgaaaaagaatcaagctcacagtagagttattccagatcaccaacaaggccatttctagtgcgccattcctgctgtttcagcccctgtggaccttcgctattctaattttcttttgggtgctgtgggtggctgtactcctgtcacttggaactgcaggtgcagcacaggttatggaaggcggtcaagtcgaatacaagccactgagtggcatacgctacatgtggtcttaccatctcatagggctgatttggacttcggagttcatactggcttgtcaacagatgacaatagcgggagctgttgtgacatgctatttcaaccgcagcaagaacgacccgcctgaccatcccatcctctcgtcactcagcattttgtttttttatcaccagggtacagtggttaaaggcagtttcctgatttctgtcgtgcgtattccaaggatcattgtcatgtacatgcagaatgccctaaaagagcaacagcacggagccctgtcccggtatctgtttagatgctgctactgctgcttctggtgcctggataaatatctgctacacctgaatcagaacgcgtacactacaaccgctattaacgggacagatttctgcacatccgctaaagatgccttcaagatattgtccaagaattcaagtcatttcacaagcatcaactgtttcggcgactttataatctttctgggcaaggtgttagtggtttgctttaccgtgtttgggggactgatggcatttaattacaaccgcgctttccaggtttgggcagttccactgctccttgtagctttcttcgcctatctcgtggcccatagtttcctatctgtcttcgagacagtgctggatgccctcttcctgtgctttgcagtcgacttggagacaaatgacgggtcgagcgaaaaaccttacttcatggatcaagaatttttgtccttcgttaaaagaagtaataaactgaacaatgctcgtgcgcagcaagataagcactccctgagaaacgaggagggtaccgaactgcaggcaatcgtccggtag

SEQ ID NO: 54333 - DNA, 1818 bp, Artificial Sequence
  Description of Artificial Sequence: Synthetic coding sequence
atgggatatagtgtcgtcgcaggcgcagcaggtagactgctatttggttatgatagttttggcaatatgtgtgggaagaaaaattcgcccgtggagggcgctcctctctccgggcaggatatgaccctcaagaagcacgttttttttatgaattcgtgcaacctcgaggtgaaggggacccagctgaaccgtatggctctgtgcgttagcaattgtccagaagaacagctggactctctggaggaggtgcaatttttcgcgaacacaagcggcagcttcctatgcgtgtatagcctgaactcgtttaactacacacacagtcccaaggcagactccctgtgccctcgcctcccagttcccccatccaagtcttttccgcttttcaacagatgcgtgccacaaacaccagagtgctatagcctcttcgcctctgtgcttattaatgatgtagataccctccatcgaattttgagtggtatcatgagcgggcgagatacaatcttaggcctttgtatcctggctctcgcactgtccctagcgatgatgttcacttttcgcttcattacaaccctgcttgtgcacattttcataagcttagtcattctggggctcctgtttgtctgtggcgtgctctggtggctatattatgattatacaaatgatctttccatcgagctagatactgaaagagagaatatgaagtgcgtgctggggttcgcaatagtttctacaggcattactgccgtgcttctggtactaatttttgtgcttcgaaagcgcatcaaattgacagtcgagctattccaaatcaccaacaaagcgatctcttctgcgccttttttgctcttccaacccctgtggacctttgccattctaatctttttctgggtcctgtgggtagccgtgcttttaagcttaggcactgctggtgctgctcaggttatggagggaggtcaggtggagtacaaaccgctcagcggtatcaggtacatgtggtcctatcatctcatcggcctgatctggactagtgagttcatcttggcctgccagcagatgacaattgccggagccgtcgttacatgctactttaaccggtccaaaaatgacccaccagaccatccgattctgagctccttgagcattcttttcttctaccatcaaggtactgttgtgaaggggtcttttctcatctctgttgtcagaatccccagaattattgtgatgtatatgcagaatgctctcaaggagcagcagcacggggctctatcacgttatctgtttcgatgctgctactgctgtttttggtgcctggacaagtacctgcttcatctcaatcagaacgcatacacaacaaccgcaattaatggtacagacttctgcacttccgccaaggacgcctttaagatcctcagtaagaattcgtctcacttcacatcaataaactgtttcggcgactttattatctttctggggaaggtattagtggtctgcttcaccgtcttcggcggtctgatggcatttaactacaacagggccttccaggtgtgggccgtgccactgctgttggttgccttcttcgcctacctcgtggcccactcttttctgagcgttttcgaaactgtactggatgctttgtttctgtgtttcgcggtcgaccttgagaccaacgatggttcttccgaaaaaccctactttatggatcaggaatttctgtcatttgtgaaaagaagcaataaactgaacaacgcaagagcccagcaggacaagcattccctgagaaacgaggaagggactgagctacaggcgatcgttcgctag

SEQ ID NO: 54334 - DNA, 2160 bp, Artificial Sequence
  Description of Artificial Sequence: Synthetic coding sequence
atgaacgataccgagaaacccgcagatactccttctgaagaggaagacttcggggatcccagaacttatgaccctgactttaaggggccagtagccaacaggtcctgtaccgacgtgctctgctgtatgatcttcctgctctgtataattggatacatcgtactgggcctggtggcctgggtccatggggaccctagaagggccgcatatcccaccgacagtcaggggcacttttgtggacaaaaaggcacgccaaatgagaacaagaccatccttttctatttcaacttgctgagatgtacttccccttctgtgctgctgaacctccagtgtcctaccacccagatttgtgtgtcaaaatgtccagagaagttcttgacttatgtggaaatgcagctcttgtacacaaaggacaagtcttactgggaggactaccggcaattctgcaaaaccacagcaaagccagtgaaaagtcttacccagcttttgctggatgacgactgtcctaccgccatcttccctagcaagccattccttcagcgctgttttcccgatttctccaccaaaaacgggaccctgacgatcggttcgaaaatgatgtttcaggacggtaatgggggaactcggtcagtggtcgagctgggaatagcagcaaatggcatcaacaaattactagatgctaagagcttaggcctgaaagtgttcgaggactatgcacggacatggtattggatactcattggcctcactatagctatggttctctcctggatttttctaatcctcttgaggttcatagcgggttgtctgttttgggtcttcatgatcggtgtgatcggcataattgggtatggaatatggcattgctatcaacagtacactaatctgcaagagcgccctagctctgtccttacaatttacgatataggaattcaaacaaatatatccatgtatttcgaattgcagcaaacgtggtttacgttcatgatcatcctgtgtattatcgaagtgatcgtaatcttgatgcttatcttcctgaggaaccggatacgcgtggccataattctgctcaaggagggttcaaaagctattggttatgttcctagcaccctggtgtatccggcacttacttttatactcttgagtatctgtatctgctattgggttgtcacagctgtgttcctggctacttcaggcgtgcctgtctataaggttattgctccaggcggacactgtatccacgagaatcagacctgtgatccagaaatattcaacaccactgaaatcgccaaagcctgccctggggcactgtgtaatttcgctttttacggaggtaagtctctttaccaccagtatatcccaacgtttcacgtctacaatctgtttgtgtttctgtggctgatcaacttcgtcatcgctctgggccaatgtgcactcgcaggggcttttgccacatattactgggcaatgaagaaacctgacgacatacccagataccctttattcaccgctttcggcagagctatacgctaccataccggatcactcgcctttggctcccttattatcgctctgattcaaatgttcaaaatcgtgttagaataccttgatcatagactgaaacggactcagaacacattaagtaagtttctgcaatgttgcctccgttgttgcttttggtgcctggaaaacgcaataaagtttctcaaccggaacgcttatataatgatcgccatttatggccgaaacttctgcagaagtgctaaagacgcatttaaccttttgatgagaaacgttctgaaagtggccgtaacagatgaggtcacatatttcgtactgtttctaggaaagctcctggtcgcagggtctatcggcgtgctcgctttcctgttttttacacagagactccctgttatcgctcaaggacccgcatccctaaactattactgggtgccgctgctcaccgtgatttttggctcctacctcatagctcatggcttcttctcagtgtacgcaatgtgcgtagagaccattttcatctgcttctgtgaagatttggaaagaaatgatggaagcacggagaagccttattttgttactcctaatctgcacggtatcctgatcaaaaagcaactcgttccccagaaacagaaagaatag

SEQ ID NO: 54335 - DNA, 2154 bp, Artificial Sequence
  Description of Artificial Sequence: Synthetic coding sequence
atgaatgatactgagaagcctgccgatactccctccgaagaggaggactttggcgaccctaggacctacgacccagactttaagggcccagtcgccaaccggtcctgcacggacgtcctttgctgcatgatttttctgctttgtattatcggctacatcgtcctggggctggtcgcatgggtgcacggagacccgcgtagagctgcgtacccaacggacagtcaggggcacttttgtggccaaaagggtaccccaaatgagaataagaccatcttattttactttaatctcctccggtgtacatcccctagtgtcttgttgaatctccagtgtcctacgacgcagatctgcgtctccaagtgtcccgaaaaatttctaacatacgttgaaatgcaactactctacacaaaggacaaatcatattgggaggattaccggcagttctgcaaaacaaccgcaaaaccagtgaaaagcctgacacagctgttactggatgacgattgtccaaccgcaatctttccatcaaagcctttcctacagaggtgcttccccgatttctctaccaagaatgggaccttaacaataggttctaaaatgatgttccaggacggcaatggcggaaccaggtccgtagtcgagctggggatagccgcaaacggcattaacaagctgctcgatgcaaaatctttaggtcttaaggtgttcgaagactatgcaaggacatggtactggattttgataggcctcaccattgccatggtacttagctggattttcttgattctgctgaggtttatcgctgggtgcctgttctgggtgttcatgatcggcgtgatcggcataattggctatggtatatggcattgttaccagcagtacacaaacctacaagaaagacccagtagtgtgcttaccatctacgacattggcatacagacaaacatttcgatgtacttcgagctgcagcagacctggttcaccttcatgatcattctgtgcatcattgaagttattgtaatactaatgcttattttcctgaggaacagaatccgcgtggccattattctgctcaaggaaggatccaaagctatcgggtacgtgccctctacactggtgtaccccgctctgacatttatccttcttagcatttgtatatgctactgggtcgtcaccgccgtttttctggcaacatctggtgttcccgtatacaaggtgatcgcgcctggcggacattgcattcacgaaaaccagacatgcgatcctgagatttttaacaccacagagatcgctaaagcttgcccaggcgctctgtgtaattttgcattttacgggggtaaatccctgtatcaccagtatatccccaccttccacgtttataatttattcgtttttttgtggctgattaactttgtgatcgctctgggacaatgtgctctggcaggtgcttttgccacatactattgggccatgaagaaacccgacgacatccctaggtatccactcttcacggcattcgggagagcgatccgctaccacacgggatctttggcttttggttcgttgattatagccttgatccagatgttcaaaatcgtacttgaatatctggatcaccggctgaagaggactcagaacaccctgtctaagttcttacagtgttgcctgcggtgttgcttctggtgcctcgagaacgccattaagttcttaaatcgcaacgcctacattatgatcgctatctatgggaggaacttctgtagatctgccaaggatgccttcaacttgctcatgcgaaacgtgctcaaggtggccgtgacagatgaggtaacatatttcgtcctgtttctgggtaaattgcttgtggcgggaagtatcggtgtgcttgcctttctgtttttcacacagagactccccgtgatcgcacagggaccggcatcattgaactactattgggtgcctctgctgaccgtgatattcggctcatatctgatcgcccacggcttcttcagcgtctacgccatgtgtgtggaaacaatatttatctgcttcctggaagacctggaaaggaatgacgggagtaccgccagaccgtattatgtgtcacaacccctcttaaagattttccaagaggaaaatccccagactcgcaaacagtag

SEQ ID NO: 54336 - DNA, 1770 bp, Artificial Sequence
  Description of Artificial Sequence: Synthetic coding sequence
atgcaactgctctatactaaagataagagttactgggaggattatcgccagttctgcaagaccaccgcaaaacctgttaaatcccttacccagctgttgctagacgatgattgtccgaccgcaatatttccctccaagccattccttcagcggtgctttccagatttcagcactaagaacggtaccctgaccatcgggtccaaaatgatgtttcaagatggtaacggagggacacgttctgtggtggaactagggatcgctgcgaatgggattaacaaactgcttgacgccaaaagtctcgggcttaaagtttttgaagattatgcaaggacatggtattggattttgatcggactgacaatcgcgatggtcttaagctggattttcttaatcctgctgaggtttattgccggttgtctgttctgggtatttatgattggggtgatcgggattatcggatatggtatttggcattgttatcagcaatatactaacctgcaggagcggccttccagtgtgcttactatttatgacatcggaattcagaccaacatttcaatgtacttcgaactgcagcagacatggttcacatttatgatcatactatgcatcattgaggtgatcgtaatcctcatgctaattttcctgagaaacagaatccgggtggcgatcattctactcaaggagggttccaaggctattggatacgtgccgtctaccttggtttatcctgctctgacctttattctgttaagtatttgcatttgttattgggtagtgaccgcagtgttcctggcaacgtcaggagtgcctgtctacaaggtcatcgcacccggagggcactgcattcacgagaatcagacctgcgatccagaaatctttaacaccacagagatcgctaaagcttgtcccggagctctttgtaatttcgcattttacggtgggaaaagcctgtaccaccagtatattcccaccttccatgtctacaacctgttcgtgtttctgtggctcatcaacttcgttattgccctaggacaatgcgcattggctggtgcttttgctacatactactgggcgatgaagaagcctgatgatattccccgttaccccctattcactgcattcggccgtgccatcaggtaccatacagggtcccttgccttcggctccctgataatcgccctgatccagatgtttaagatcgtactggagtacctggaccaccggctgaagcggacccagaacaccttatccaagttcctccagtgttgtctgcggtgttgtttctggtgcctggaaaacgcaattaagttcctcaatcggaatgcatatattatgatagccatctacggcagaaacttttgtaggtccgcaaaagacgccttcaacctattgatgagaaatgtgttgaaggtcgccgttaccgacgaggtgacatacttcgtcctcttcttgggtaagctgctcgtagcgggaagcattggcgtgctggctttcttgttttttacacagaggctcccggtgattgcgcaggggccagcttccctcaactactactgggtccctctgctcactgttatcttcggttcgtacctgatcgcccacggattcttcagcgtgtacgcaatgtgtgtcgaaacaatctttatttgtttctgcgaggacctggaacgcaacgatggatccaccgaaaagccatattttgtcacaccaaatctgcatggcatcctgattaagaagcagctagtgccgcaaaagcaaaaggaatag

SEQ ID NO: 54337 - DNA, 2139 bp, Artificial Sequence
  Description of Artificial Sequence: Synthetic coding sequence
actaaggcaaaaaaaagaccttccaatgcaggtgacccacggacttacgatcctgatttcaaaggccctgtggccaacagaagctgcacagacgtcctgtgttgcatgatcttcttgctgtgcatcattggttatattgtcttaggcttagtcgcttgggtacacggagatcctagacgggctgcttatccaactgactcacaggggcacttttgcggacagaaaggaactcctaacgaaaacaaaactatcctgttttactttaacctgttgcgatgtactagtccgtctgtgctgcttaacctgcagtgtccaacaacacagatatgcgtttctaagtgcccagagaaatttctgacgtacgtcgagatgcaactcctttatactaaggataaatcgtattgggaggactacaggcaattttgcaaaaccactgcgaagcccgtgaagtccctaactcaattgctcttagacgacgactgccccacagctatattcccttccaagccgtttctgcagcggtgttttcctgatttctctactaagaatgggactcttactattggaagcaagatgatgtttcaggatggaaatgggggtacccgtagcgtggtcgagctggggattgccgcaaacgggatcaacaaattgttggacgccaagagtttagggttgaaagtatttgaagactacgcgcgaacgtggtactggatactgataggtctcacaatcgctatggtactaagctggatattcctgatcctccttcggtttatagccggatgtctcttctgggtgtttatgatcggcgtcatcggtatcattgggtatggaatctggcattgttaccagcaatacaccaacctccaggagcgtcccagctctgtccttactatatacgacatcgggatccaaacaaatatcagtatgtatttcgagcttcagcagacttggtttacctttatgatcattctctgcattatcgaagtgattgttattctgatgctgatttttctgagaaatagaattcgcgtcgcgatcatcctgctgaaagagggttccaaggcaatcggttatgtgccatctaccctggtttatccagctcttaccttcatcctactgagcatctgcatttgttactgggtggttaccgcagtattcctggcaacctcgggagtaccagtgtacaaggtaatcgccccaggcggacattgtatccatgagaaccagacttgcgaccccgagattttcaacactacagaaatcgctaaggcttgccctggcgctctgtgtaattttgctttctatggcggaaaaagtctctaccaccaatatattcctactttccatgtgtacaatctgtttgtgttcctctggctcataaacttcgtgatcgcgctggggcagtgtgctctagcaggcgcatttgctacctattactgggccatgaagaagcctgacgatatcccgcgatatcccctgtttacagccttcgggagagccattaggtatcataccgggagccttgccttcgggtcacttatcatagctttgatccagatgtttaagattgttctcgaatatttggaccaccggttgaagagaactcaaaacaccctctcgaaattcctgcaatgctgtctcagatgctgtttctggtgcttggagaacgcaatcaaatttcttaatcgaaatgcctacattatgatcgccatttacggaagaaacttctgtcgttcagcgaaagacgcctttaacttgctgatgcggaacgtcctgaaagttgcggtgaccgacgaagttacgtactttgttctgttcctgggaaaacttttggtggccggatccattggcgtcctggcattcctcttctttacccagaggcttcccgtgatagctcagggaccggcatccctgaactactactgggtgccacttctgactgtcatttttggatcctatcttattgcacacggattcttctccgtctacgctatgtgcgtggagacaatctttatatgtttttgcgaagacttggaacgcaatgacggatccacagagaaaccatattttgtaacccccaacttacacggcatactgattaagaagcagctggtcccccagaagcagaaggaatag

SEQ ID NO: 54338 - DNA, 2271 bp, Artificial Sequence
  Description of Artificial Sequence: Synthetic coding sequence
atgtcgagggtgccccagttcaaaatgcagaaatccccagccttctgtgtggaccttgcaggctcccatcggcctgagctctttttgtttgggcacttagccagccatcttttcctatgtttctttctggagaaaccagcggatacacccagcgaagaggaagactttggggacccgagaacctatgatccggattttaaggggcctgtggcgaacaggtcttgtacggatgtactgtgttgcatgatattcttgctgtgtatcatcggttacattgtgctcggcttagtggcatgggtgcacggggaccccaggagagctgcttatcctaccgattcccaggggcatttctgtggccagaagggtacaccgaacgaaaataagacaatcctgttttactttaacttgctgcgctgcacctcgccgagcgtgctgctgaatctgcagtgtcccaccacacagatctgcgtgtctaagtgtcctgaaaagttcctgacctacgtcgagatgcagctcctgtatactaaagacaagagttattgggaggactatagacaattttgcaagacgaccgccaagccagtgaaatccttaacccagcttctgctggacgacgattgccctacagctattttcccatccaagcccttcctgcagcggtgcttcccagacttctctactaagaatgggaccctgacaattggatcaaaaatgatgtttcaggacggaaatggtggaactagatcagtggtggaattaggcatagcagccaatggtatcaacaagttgctcgatgcaaaaagcctggggctcaaagtgtttgaagattatgcaagaacctggtactggatccttatcgggcttaccatagccatggttttgagctggatctttttgatcctcttacgtttcatagctggctgcctcttctgggtcttcatgattggcgtcatcgggataattggctacggaatctggcactgttaccagcaatacactaacctgcaggagcggccaagtagcgtccttaccatctacgacatagggatccagaccaatatttccatgtacttcgagctccagcagacatggtttacttttatgattatcttatgcattattgaggttatagtcattttgatgctgatcttcctgcgcaatcgcattagggtggcaatcattctgctcaaggaggggtcaaaggcaattggctatgtgccaagcactctcgtgtacccagcactgacgtttattctgctgtcaatttgcatctgttactgggttgtaacagctgtgtttctggccacctctggcgtccccgtctacaaagttatcgcacccggtggacactgtatacacgaaaatcagacatgcgatcccgagatctttaatacaactgagattgctaaagcctgtcctggcgctctctgtaacttcgccttctatggtgggaagagcctctaccatcagtacataccaacattccatgtctacaacctattcgtctttctgtggctcatcaatttcgtgatcgccctgggtcaatgtgcactggctggagcctttgccacctactattgggcaatgaaaaagcccgatgatatccctaggtatccattgtttaccgccttcggtagagcaatccgctaccacactggttccctggccttcggctccctgattatcgcgttaatccagatgtttaaaatcgtgctagagtatctggaccataggctaaagagaacacagaacaccctctctaaattcttgcagtgttgcttgagatgttgtttttggtgcctcgagaatgcaatcaagtttctcaataggaacgcgtacataatgattgcgatttacgggcgaaacttttgtcgaagtgcaaaagatgccttcaacctgctgatgagaaacgtcctgaaggtcgccgtgaccgatgaggtgacatacttcgtgttatttcttggtaaacttcttgtggcagggagcattggcgtactggcattcctgttctttacacagcggctgcctgtgattgcccagggtcctgcaagccttaattattactgggtccccttgctgacagtgatctttgggagctatctcatcgctcatggctttttttctgtgtatgccatgtgcgtcgaaaccatcttcatctgctttctcgaagacctggaacgcaacgatggctcaactgctcgcccttactatgtgtcccaacctctgctcaagatcttccaggaagagaatccccagacacggaagcaatag

SEQ ID NO: 54339 - DNA, 1386 bp, Artificial Sequence
  Description of Artificial Sequence: Synthetic coding sequence
atgaagatcttatttgtggagccagcaatctttctgtcagcttttgcgatgactctgactgggccactgactactcaatatgtgtataggcgaatctgggaagaaactggaaattatacatttagttccgattctaacatcagcgaatgcgagaaaaacaaatccagtcccatcttcgcctttcaagaggaagttcaaaagaaggtcagcagattcaatctacagatggacattagtggccttattcccggactggtgtcaacattcatccttctcagcataagtgatcactacgggaggaagtttcccatgatcctgagctcagtgggcgctctggcgactagcgtatggttatgtctgctgtgctactttgcctttccctttcagttgcttatcgcctctacgtttataggagctttctgtggaaactatacaactttttggggggcatgttttgcgtatattgtcgatcagtgtaaagaacacaaacagaagaccatacgcatagcaatcatcgactttctcctgggcctggtcacgggcttaacgggtttatcctctggttatttcattcgtgaactgggctttgagtggtctttcctgatcattgccgtctcattggccgttaatctgatttatatcctgttcttccttggcgacccagtaaaggaatgctcatcccagaatgtgactatgtcctgctccgagggctttaagaacctgttctataggacctacatgctgttcaaaaacgcaagcggaaagcgcaggttcctgctttgtttactgttatttacagtgatcacctacttctttgtggttattggaatcgccccaatattcatcctgtatgagcttgactcacccctgtgctggaatgaggtgttcattggatatggatccgcgctgggatcagccagtttcttgacatccttcctcgggatttggctgttctcctattgtatggaggatatccacatggcatttatcggcatttttactacaatgactggtatggcgatgactgcttttgccagtaccaccttgatgatgttcctggctcgcgttccatttctgtttaccattgttcccttctcggtccttcggagtatgctgtccaaggtcgtcaggagcaccgagcaaggaaccctgtttgcttgcatcgccttcctggagactctcggcggagtgactgccgtctctactttcaacggaatctactcagcgaccgttgcctggtaccctggcttcactttcttgctgagcgctgggctcctgttgctgccagccatctcgttgtgcgtggtgaaatgtacaagctggaacgaaggatcctatgagctgctcatccaggaagagagctcggaggatgcttcggacaggtag

SEQ ID NO: 54340 - DNA, 1392 bp, Artificial Sequence
  Description of Artificial Sequence: Synthetic coding sequence
atgaagatattgttcgtagagccagccattttcctgagtgctttcgcgatgacactcactggacccttaaccacacagtatgtttatcgcaggatttgggaggaaactggaaactacacgttctcctcagattctaatatctctgagtgcgaaaaaaataagtcttcacctatctttgctttccaggaggaggtgcagaagaaggtgagtaggttcaacctgcaaatggacattagcggcctcattccaggcttggtgtcaacattcatcctgttgtccattagcgaccattacgggagaaagttccccatgatcctgtcctctgtcggcgcattagcaacctctgtgtggctgtgtttgctgtgctacttcgctttccctttccagctgctgatcgcaagcacgtttatcggcgcattctgcggcaactacaccacattctggggtgcatgcttcgcttacatcgtggaccagtgtaaggagcacaaacagaaaacaatccggattgccattatcgatttcctgttgggattagtcactggcctgactggcttaagcagtggctatttcatcagagagcttggctttgagtggtcattcctgattattgcggtctctctggcagtcaacctgatctatatcttgttcttcctgggagacccggtcaaagagtgtagcagccagaatgtcacaatgagttgctccgagggattcaaaaacctgttctatcggacctacatgctgttcaaaaacgctagtggaaagaggcgcttcctgctgtgcctgctgttattcactgtaatcacatacttctttgtggtgattggtattgcccctatctttattctttatgaactggacagtccgctttgctggaatgaggtattcattgggtatgggagcgcactcgggtcggcaagcttcctgacttcattcctgggtatttggctttttagctactgcatggaggacatccacatggcctttatagggatctttacaacaatgaccggcatggccatgactgcattcgcctccacgacattgatgatgttcttagcgagggtgccgttccttttcacaattgtccccttctcggtgctgcgctccatgctcagcaaggtcgtgcgttctaccgaacagggaaccctattcgcatgtattgctttccttgaaactctgggtggggtaactgctgtgagcacattcaacggcatttacagcgcaacagtggcctggtaccctggattcacctttctcctgagcgccggtttgctgctgttaccagctatctccctgtgcgtcgtaaaatgcacaagctggaacgaaggaagctatgagctgctgattcaggaagagtcgtccgaagatgcatcagaccgggcatgttag

SEQ ID NO: 54341 - DNA, 453 bp, Artificial Sequence
  Description of Artificial Sequence: Synthetic coding sequence
atggctccatctagactgcagctgggcctccgggcagcttacagcggcatcagctcagtcgcaggcttctctatatttctcgtgtggaccgtggtttataggcaaccgggtaccgccgcaatgggagggttagcaggcgtactggctctgtgggtcctggtgacccatgtcatgtacatgcaggactattggcggacttggctgaagggcttgagaggcttcttctttgtaggggtcctgttctctgctgtgtccattgcggctttttgtacttttctcgtgctcgctatcactcgccatcagtctctgactgaccctacaagctactatctcagctcggtatggtccttcatttctttcaagtgggcctttttgctgtctctacccaagtgctgggactataggtgcgagccgccttgcccggcttggatctgtttcctttcaacgcagtag

SEQ ID NO: 54342 - DNA, 441 bp, Artificial Sequence
  Description of Artificial Sequence: Synthetic coding sequence
atggccccttccagattacagctcggattacgggcagcatacagcggcatcagcagtgtcgccggattctcaatcttcctggtgtggacggtcgtgtatcggcagccgggtaccgccgctatgggcggacttgcaggagtgctggccctgtgggtgctggtgacacacgtcatgtacatgcaagattactggcggacttggctcaagggattgaggggttttttctttgtgggtgtcctgttctctgccgtctcgatcgccgcattttgcacattccttgtgctggccataacccgacaccagtccctcacagaccctacatcctactacttgagctctgtctggtcttttataagttttaaatgggctttcctactcagcctctacgctcatagataccgcgcagactttgcagatatctcaattctttccgacttctag

SEQ ID NO: 54343 - DNA, 270 bp, Artificial Sequence
  Description of Artificial Sequence: Synthetic coding sequence
atgtatatgcaggactactggcggacttggctgaaaggcctgcgcggattcttcttcgtgggggtgttgttctcggcagtgagtatcgccgcattttgcacattcctggtgctggccatcactagacaccaaagcttaacagatcccacctcctactatctgtccagcgtgtggagtttcatctcttttaagtgggcctttctcctctcgttgtacgctcacagatacagagccgatttcgctgacatctcaattctgagcgacttttag

SEQ ID NO: 54344 - DNA, 270 bp, Artificial Sequence
  Description of Artificial Sequence: Synthetic coding sequence
atgtatatgcaagattattggcggacctggttgaaaggcctgcgcggtttcttttttgttggggtactgttttctgccgttagtatcgccgcattttgcactttccttgtgctcgctatcacacgtcatcagtccttaaccgacccaacttcatattacttgtcgtcagtctggtcttttattagcttcaaatgggcctttcttctgagcttatacgctcataggtatagggccgattttgctgacatatccatcctgtccgacttctag

SEQ ID NO: 54345 - DNA, 111 bp, Artificial Sequence
  Description of Artificial Sequence: Synthetic coding sequence
atgtatatgcaagactattggcgaacgtggctgaaggggctgagaggcttcttttttgttggcgtcttatttagcgccgtttccatagccgctttctgcacatttctctag

SEQ ID NO: 54346 - DNA, 51 bp, Artificial Sequence
  Description of Artificial Sequence: Synthetic coding sequence
atgtatatgcaggactactggcggacttggctcaaagggctgcggggatag

SEQ ID NO: 54347 - DNA, 1743 bp, Artificial Sequence
  Description of Artificial Sequence: Synthetic coding sequence
atggcctttcatgtggaggggttaatcgctataattgttttctacttactgattctcctggtcggaatctgggcggcttggaggaccaaaaattccggatctgccgaagaacggagcgaggcgattattgttggaggacgggatatcggcttgctggtcggcggattcaccatgacggcaacttgggtggggggtggctacatcaatggcaccgctgaagccgtgtatgtgcccggatacggtcttgcctgggcgcaagctcccatcggatactccttgtccctgattctaggaggcctgttcttcgcgaagccaatgcgctcaaaagggtacgtgaccatgctggatccttttcagcagatttacggaaaaaggatggggggtctgctgttcattcctgcgctgatgggtgaaatgttctgggccgctgccatcttctccgcactcggagccacaatctcggtcatcatcgatgtggatatgcacatctcagtgataatatcagctctaatcgccaccctatacactctggtaggcggtctgtactcagtagcatacacagacgttgtgcagctgttttgcatattcgtgggcctttggattagcgtgccctttgctctaagtcatcccgctgtggccgatattggatttactgctgtccacgcaaagtaccagaagccatggttagggaccgtggactccagcgaggtgtactcctggctcgacagcttcctcctgcttatgctcgggggtataccgtggcaagcttacttccagagagtcctgagctcctcaagcgcaacgtatgcacaggttctttccttccttgctgcattcggttgtcttgttatggccatcccggctatcttgatcggggctatcggtgcttcaacagactggaaccaaaccgcttatgggctgcctgaccctaagactacagaagaagccgacatgatattgcccattgtgttgcagtacctgtgccctgtgtacatttcattctttggcttgggtgccgtttccgcagccgtgatgtcctccgctgactcttctattctgtcagccagttccatgttcgcacggaatatctaccagctgtctttccggcagaacgcgagcgacaaggaaatcgtgtgggtaatgcgcattactgtcttcgtgttcggtgcctccgccactgccatggccctgctgaccaaaaccgtttacggtctctggtatctgagttctgatctcgtttatatcgtgatcttccctcagctcctctgcgtgctgttcgtaaaaggcaccaatacatatggcgcagtggccggttatgtgtctggcctgttcctacggatcaccggaggggaaccatacttgtatctgcagccacttatcttctatccaggctattatccggatgataacggcatttacaatcagaagttcccattcaagaccctcgcaatggtcacgtcttttctgactaacatttgtatctcctacttagcaaagtacctttttgaaagcgggacactgcctcccaagctggacgtctttgatgctgtggtggcacggcatagcgaggagaatatggacaagacaatcctggttaagaatgagaatatcaagttagacgagcttgctctggtaaaaccgcgacagtctatgacactttcatctaccttcaccaacaaggaggccttcctcgacgtcgacagcagtccagagggctccggtaccgaagacaacctgcagtag

SEQ ID NO: 54348 - DNA, 1743 bp, Artificial Sequence
  Description of Artificial Sequence: Synthetic coding sequence
atggcctttcacgtcgaggggctcattgctattatcgtgttctatctgttgatactgcttgtcggcatttgggctgcgtggaggacgaaaaacagcggctccgccgaggaaaggtccgaggctatcatcgtaggagggagagacatcggtttgctggtgggcggattcacaatgactgcaacgtgggttggaggcggatacattaatggcactgccgaagctgtgtatgttcccggatatggactggcttgggctcaggctccaatcggatactcactatctctgattcttggtggtctctttttcgccaagcctatgagatcaaagggctacgtcacgatgttagatcctttccagcaaatatacggtaaaagaatggggggtttgctgtttattcctgctcttatgggcgagatgttctgggccgctgccatcttcagcgccctaggcgctacaattagcgtgataattgacgtggacatgcacatctcggtaatcatatccgcactgatcgcgacgctgtacactctcgtgggtggactttactctgtggcatataccgacgttgtacagctgttctgcatcttcgtgggcctgtggatcagtgtcccctttgcactgagtcatccagcagtggcggacattgggttcaccgccgtacatgctaaataccagaaaccctggttgggcaccgtcgactcttccgaagtctattcttggttggacagctttcttctgttaatgctgggaggcataccatggcaggcctattttcagcgtgtgctctcctctagttcagcaacatatgcacaggtcctgtcattcctggcagcattcggatgccttgtgatggccattcctgctattttaataggcgcaatcggcgcttctaccgattggaaccaaacagcctatggcctgccagacccgaaaacaaccgaggaggccgacatgatcctaccgatcgtgctgcagtatctgtgtcctgtgtacatttctttttttggcttgggggctgtgagcgccgcagtaatgagcagcgcggatagttccatcctttcagctagctccatgtttgccagaaatatttaccaactcagcttccgccaaaacgctagcgacaaggaaattgtctgggtgatgcgcattactgtatttgtcttcggagcaagcgctacagcgatggccctgcttacaaagactgtgtatggcctctggtaccttagctcggatctggtatatatcgtgatctttccgcagctgctctgtgttctgtttgtgaagggcactaacacgtacggcgcagtggcgggttatgtgtctggattatttctgcgcattactggaggggagccctatctttatctgcagccactcatattttatcctggatattacccggatgacaacggcatctataatcagaagttccctttcaaaaccctggctatggttacttcttttctcaccaacatctgcatctcttatctggccaagtatctgtttgaatctgggaccctccctcctaagcttgacgtattcgacgccgtggtggctagacactctgaagagaatatggataagactatattagtgaaaaacgagaatataaaactggatgagctggcacttgttaaaccgagacagtccatgaccctgtcaagcacctttacaaacaaagaggcctttctggacgtagactcctctcccgaaggcagtggcactgaagataacctgcaatag

SEQ ID NO: 54349 - DNA, 1428 bp, Artificial Sequence
  Description of Artificial Sequence: Synthetic coding sequence
atgcggagcaaaggatatgtgactatgcttgaccccttccaacaaatctatggaaagcggatgggcggactactgttcatcccagccctgatgggcgaaatgttctgggccgcagctatattttccgccttaggcgcaactatcagcgttatcatcgacgtggacatgcatatttcggttatcatcagtgcattgattgccacactgtatacattggtcgggggtctgtactctgttgcatacactgacgtggtgcagctgttctgtatcttcgtgggcctatggatctccgtgccatttgccctgtcccacccagccgtggctgatatcgggttcacagccgtccacgctaagtatcagaaaccctggctggggacagtggattcaagcgaggtatactcgtggctagactcctttttgctgctcatgttaggtggaattccttggcaagcatactttcagagagtactatcctctagcagtgcaacgtacgcacaagtccttagcttcctggcagctttcgggtgtttggtgatggccatccccgctatactcataggagccatcggtgcctccaccgattggaatcagacagcgtatggtctacctgatccaaaaaccaccgaggaagcagatatgatccttcctatcgtgttgcaatatctctgtcccgtgtacatctccttctttgggttaggtgccgtatccgctgcagtgatgtcgtctgccgattcttcaatcctgagcgcatctagtatgttcgcgagaaacatttaccagctctccttccggcaaaacgcgtccgataaggagatcgtgtgggtgatgcgtattacagtgtttgtgttcggagcctcggccacagctatggctcttttgacaaaaacggtctacggtttgtggtacctgtcgagtgatttagtgtacattgtcatcttcccccagcttttgtgcgtccttttcgtgaagggaacaaacacctacggggctgttgccggttacgtctccgggttattcctccgcatcacaggaggagagccttacttatatctgcagccactgattttctatccaggatattatcccgatgataacggtatctataaccagaagtttcccttcaagactttggccatggtaacctcttttctcacaaacatatgtatttcgtaccttgccaagtatctgttcgaatccggaacattacctcccaaactcgacgttttcgatgccgttgttgctagacactcggaagaaaacatggataaaactattctggtaaaaaacgaaaacataaagttagatgagctggcgttagtcaaaccgcgacaatctatgaccctctcctctacttttacaaacaaggaggcgtttctcgacgtagatagcagtcccgagggttctggcacagaagacaatttacagtag

SEQ ID NO: 54350 - DNA, 1980 bp, Artificial Sequence
  Description of Artificial Sequence: Synthetic coding sequence
atggcttcaacggtgtcgccatcgaccatcgctgagacaccagaaccaccaccactgtctgaccatattcggaatgcagctgacatctcagttatagtgatttacttcctggtggttatggcggtaggcctgtgggccatgctgaaaacaaatcggggtactatcggtggtttctttttagccggtcgggatatggcctggtggcctatgggagccagcttatttgcctcaaatatcgggtcgaatcactatgtagggctggctggcaccggagccgcatccggagtggccactgtcacattcgaatggacaagctccgtgatgctgctcatcctgggatggatcttcgtgccaatttacataaagagtggagttatgaccatgccagaatacttaaaaaagcgattcggcggtgaacggcttcaagtctacctgagcatcttatctctgtttatttgcgtggttctgctgatctctgccgacatctttgccggagcaatcttcattaagctcgctttgggcctggacctgtatcttgcaatatttatactgctggccatgacagctgtgtacactaccaccgggggtcttgcatcggtgatctacactgacacgctccagaccatcatcatgctgatcggatcattcattcttatgggatttgcattcaacgaggtggggggttacgaaagcttcaccgaaaagtatgtgaacgctactccatccgttgtggagggcgacaacctgaccatttcggcatcttgctacacgccccgagccgactcatttcacatctttcgggacgctgtgactggggatataccctggccaggaatcatctttggcatgcctattacggccctatggtactggtgcactaaccaggtgatcgtgcagagatgtctatgcggtaaggatatgtctcacgtgaaagcagcctgcattatgtgcgcctatcttaagctgctgcccatgtttttgatggttatgcccggaatgatctctaggatcctgtacactgacatggtggcatgtgtggtgccctcagagtgtgttaaacactgcggtgtggacgtgggatgcacgaactacgcctacccaaccatggtgctcgaactgatgccacagggcctccggggacttatgctttctgtcatgcttgcttccctgatgtcctcacttacctccatattcaactctgctagcacgctgtttacaattgacctctacaccaaaatgcgcaagcaagcctcagagaaggaactgctcatcgccggtcgcatcttcgtgctgctgcttacagtcgtgagcatagtttgggtgcccctcgttcaagtgtctcaaaacgggcagctgatccattacaccgagtctatttcaagctatcttggtcccccaattgctgcggttttcgtactcgccatattctgcaagcgcgtgaacgagcaaggtgctttttgggggcttatggtgggacttgccatggggctgattaggatgatcacagaatttgcctatggaacaggctcgtgtctggcgccatccaactgtcccaaaatcatatgtggtgtgcactatctctactttagtatcgtgctattcttcgggagtatgctggtgaccctaggaatatctttgttgactaaacctataccggacgtgcacttatacagactgtgctgggtgttgcggaattctacggaggaacgcattgacatcgatgcagaagaaaaaagtcaagaagagacagatgacggcgtggaggaggactacccggagaaaagccgtggatgcctgaagaaggcgtatgacctgttttgcggtctgcagaagggcccaaagctgaccaaggaggaagaagaagctctgtcgaaaaaactgaccgatacctcggagcggccaagctggaggacgattgtgaatatcaacgcaatcctcctattagccgtggtggttttcatccacggatattatgcgtag

SEQ ID NO: 54351 - DNA, 1836 bp, Artificial Sequence
  Description of Artificial Sequence: Synthetic coding sequence
atggtgtggtggccggttggggctagcctgttcgcttcaaacgtgggcagtgggcatttcatcggtcttgctggctccggtgctgccaccggcatttccgtgagcgcttatgagctcaatggactgtttagtgtgctaatgctcgcgtggatcttcctacccatctacatcgccggacaagtgactaccatgccagaatatcttaggaagcggtttggcggaatcaggatcccaataatccttgccgtgctctacctcttcatttatatttttaccaagatctctgtagacatgtatgccggtgcaattttcatacagcagagtctgcacctcgacttgtacttagctatcgtgggattgctggctattacagcagtctacacagtcgccggaggactggctgccgtgatttataccgacgccctccaaactctgatcatgttgatcggcgctctcaccttgatggggtacagctttgctgctgttggcggaatggaggggctgaaggaaaagtatttcctggccctggcttcgaaccgttcagagaattccagttgcgggttgcccagagaagacgcctttcacatcttcagggatccgctaacctcagatttaccttggccaggcgtcctatttggcatgtctatccctagtctctggtactggtgcactgatcaggtaatagtccagaggacactcgccgcaaagaatctctcccatgctaaaggcggtgccttgatggcagcttatctcaaggtcctgcctctgtttataatggtctttcccggtatggtaagcagaatactatttccagaccaggtggcttgcgcagatccagagatttgtcaaaagatttgtagcaacccgtcagggtgttcagatattgcctacccgaaattagtcctggagcttttgccgacaggtcttcggggactaatgatggcagtgatggtagcagccctaatgagcagcttgactagcattttcaatagcgcttcgactatcttcactatggacctttggaatcacctgaggcctagggccagtgagaaggagctgatgatcgtcggacgcgttttcgtgctgctccttgttttagttagtatcctgtggattccggtggttcaggctagccagggagggcagctgtttatttatatacagtcaatttcttcctacctccagccccctgtcgcagtcgtatttatcatgggatgcttttggaagcggaccaacgaaaagggcgctttttggggcctgatctcaggcctcttgctgggcctggtgcggttggtactcgatttcatctacgtacagcccaggtgcgatcagcctgacgaacgtccggtgctggtgaaaagcatccactacttatattttagtatgatccttagcactgtaactctaattaccgtgtcaaccgtgtcttggtttacagaaccgcctagcaaggaaatggtttcccacctgacttggttcacacgccacgatcccgtggtccagaaggaacaagcgccacccgcagcacctctctcactcaccctgtcccagaacgggatgccagaggcttcttcatcaagcagcgtccaattcgaaatggttcaagagaacacctccaagacccacagctgtgacatgactcccaaacagagtaaggtcgttaaggccatactgtggctatgcggcattcaggaaaagggtaaagaagaattaccggctcgtgctgaagctattattgtgtccctagaagaaaacccgctagtcaaaacccttctggatgttaatctgatattttgcgtgagttgcgccatcttcatctggggctattttgcatag

SEQ ID NO: 54352 - DNA, 1701 bp, Artificial Sequence
  Description of Artificial Sequence: Synthetic coding sequence
atgacgtggtggcctattggggcatccctgttcgcttcatccgagggttctggccttttcatcggtctggccggttccggggctgcagggggtctggcagttgccggatttgagtggaacgctacttatgtgctgttagcacttgcctgggtattcgttccaatatatatctcgtctgaaatcgtcacactgcctgaatatatccagaaaaggtatggcggtcagaggatccggatgtatctgtcagtgctgagtctactgttatcagtctttactaaaatcagtctggatctctacgcgggtgcccttttcgtgcacatatgtcttgggtggaatttctaccttagtacaatactgaccctggggatcaccgccctgtatacaatagccgcatttgatcagattggaggatatggtcaactggaggccgcatatgctcaggctatcccatctagaactatcgccaacactacatgccatttgcctaggactgatgcaatgcacatgttccgcgatcctcacactggggacctaccatggaccggcatgacatttggcttaacaattatggccacctggtattggtgtaccgatcaggtaatcgtacagagatcactcagcgctcgagatcttaatcatgccaaggcaggctctatcctcgcaagttacctgaaaatgctgccaatggggctgataattatgccagggatgatctccagggccttgttccctggcgctcacgtctatgaggaaaggcaccaagtctctgtgtctaggacagacgacgtgggttgcgttgtaccttcagaatgcctgcgggcttgcggcgcagaggtgggatgttccaatatcgcgtaccccaaacttgtgatggaactgatgcctatcggccttcggggactcatgattgctgtgatgctcgcggcactcatgtcctctctaacaagtatattcaactcctccagtaccctctttaccatggatatctggcggcgtttacgcccacgctccggcgagcgcgaattgttgcttgttgggcgaaccggaatcccgtcaacacctccagccccacagagtcgtttatcatttctcctgccggagacgccccctctagaaagatatcttctgggtttagtggtcatggacttgtggcttgtgatcgtggcattaattggggtgtcagttgcctggatcccagtgctccaagactctaatagtggccaactttttatttatatgcaaagcgtgacatccagtctggcaccccctgtcacggcagtcttcgttttgggggtgttttggcgcagagctaacgagcagggagccttctggggactgattgctgggctggtggtaggggctacgcgtctggttctggaattcctgaatccagctccaccgtgcggggagccggataccaggcctgccgtgctgggttctatacactacctccactttgccgttgctctctttgctctttctggagcagtggtggtcgccggatccctgctgacccctccccctcagagcgtccagatagaaaatttgacttggtggaccctggctcaggacgttcccctgggaactaaggcaggagatgggcagacaccgcagaagcacgccttttgggccagggtatgtggatttaacgccatcctgctcatgtgtgtgaatattttcttctacgcgtatttcgcctag

SEQ ID NO: 54353 - DNA, 1701 bp, Artificial Sequence
  Description of Artificial Sequence: Synthetic coding sequence
atgacttggtggccgatcggcgcatccttgtttgcctcctctgagggcagtggactgttcattgggcttgccggttctggggctgcaggcggactcgctgtcgcgggatttgaatggaacgccacctacgttcttctcgccttagcttgggtcttcgttccaatatacattagcagtgagatcgtcactctcccagagtacattcagaagcgctacggtggccagaggatcaggatgtacctctctgtgttgtcccttctgctgagtgtctttacaaaaatatctctggacttatatgctggggcattgttcgtacacatctgcctgggatggaatttctacctctccaccatcctgaccctgggcattaccgccttatacacaatagcagcgttcgatcagataggcggttacggccaactggaggccgcatatgcccaggctattccaagcagaactatcgccaacacgacatgccatctgccccgaacggatgctatgcacatgtttcgggacccacataccggggaccttccttggactgggatgacatttggccttacgatcatggcaacttggtattggtgcaccgatcaggtgattgttcagagatctctgagcgctagagatctgaatcatgcaaaagccggaagtatactggcttcctacttgaagatgctgcccatgggacttatcattatgccgggtatgattagccgggctctgttccccggtgcccatgtgtacgaagaacggcaccaagtaagcgtgagtaggactgacgatgtcggatgcgtcgtccccagcgagtgcctccgtgcctgcggggctgaggtggggtgtagtaacattgcatatcctaagctcgttatggagttaatgcccatcggactaaggggcctgatgattgcggtcatgttagcagcgttgatgtcaagcctgacttcaatcttcaattccagcagcactttattcactatggatatctggcgcagactgcgcccacgctccggggaacgcgagctgctcttagtagggcgaaccggcattccctccaccccacctgcaccacagtctagactaagcttcctgctgcctgagacaccccctttggagcggtacctattgggcctcgtggtgatggatctctggctggtgatcgtggccttgatcggagtctcagtggcttggatcccagttctgcaggattcaaactccggtcagttgtttatctacatgcagtcagttaccagcagcctcgctccacccgttacagccgtttttgttcttggtgtgttttggcgcagagcgaacgagcagggtgccttctggggattgatcgctgggttggtggtaggcgcaacaaggttggtattggagtttctaaatcctgcgcctccctgcggtgaacccgacacgcggcctgccgtgctcggaagcattcattacctccacttcgccgtcgccctatttgctttgtcaggagccgtcgtggtggcgggatctctcttgacaccacctccccagagcgtacagatcgagaacctcacttggtggacactcgcacaggacgttcccctgggaactaaggcgggtgatggacaaaccccacagaaacatgctttctgggcacgggtgtgtggtttcaatgccattctgctcatgtgcgttaatatatttttttatgcgtatttcgcctag

SEQ ID NO: 54354 - DNA, 1710 bp, Artificial Sequence
  Description of Artificial Sequence: Synthetic coding sequence
atggctgcaaatagcacatcagacctgcacacacctgggacgcaactgagcgttgccgacatcattgtgatcaccgtgtatttcgccctgaacgtggccgtcggcatctggagttcttgtcgcgcatctagaaacactgtgaatggttattttttagccggaagggatatgacctggtggcctattggagcgtcacttttcgcctcaagtgaagggtctggattatttattgggcttgcgggttccggcgcagcgggtgggctggccgtcgctggattcgagtggaatgcaacctatgtgcttttagctctggcgtgggtgtttgttcctatatacatctcgagtgaaattgtgacactaccggaatatattcagaagagatatggtggtcagagaattcgcatgtacctgtcagtcttgtccctgctgctgagcgttttcaccaaaatttcgctggatctctacgcgggagctctgtttgtgcacatctgcctcggctggaatttctatctgtctactatcttgacactggggatcaccgccctctacacgattgccgcttttgaccagatcggcggttatggccagttagaggcggcatacgcgcaggccataccttcccgcaccatagcaaacactacctgtcacctcccaagaacagacgccatgcacatgttcagagatcctcataccggtgaccttccatggacaggtatgacgttcgggcttaccatcatggctacatggtactggtgcaccgaccaggtaatcgtgcagaggtccctgagcgcccgagatctgaaccacgcaaaggccggaagcatactcgcttcttacttaaagatgctcccaatggggttgatcattatgcccggaatgatatcccgtgccctgtttcccgacgacgtcggctgtgttgttccttccgagtgcctccgcgcttgcggcgctgaggtgggatgtagcaacatagcataccccaagctggtcatggagttgatgcctattggactgcgcggactaatgatcgccgtcatgctggccgctctgatgtcatccctgacctctatctttaacagtagcagcacgttattcaccatggatatatggaggcgactccggcctcggtccggggagcgcgagcttcttctcgtgggtcggttggtgatcgtggcattaatcggggtatcagtggcatggataccagtgctccaggatagcaattccggacagttattcatatacatgcaatccgtgaccagctccttggctccacccgtgactgccgtgttcgtcctgggcgtcttctggagaagagctaatgagcagggagccttctggggtctgattgcaggccttgtcgtaggggcaacgcggctggtgctggagtttcttaaccccgcaccaccttgcggagagccagatactcgtcccgctgtactggggtctatccactatctgcacttcgccgtcgcgctctttgccctttcgggtgctgtggtagtggctggctctctgcttacacctcctccccagagtgtgcagattgagaacctaacatggtggacgttggcccaggatgttcctctcggcaccaaagcaggggacggtcaaacaccgcagaaacacgctttttgggctcgcgtttgcggctttaatgctatccttctgatgtgtgtcaacatctttttctacgcatattttgcctag

SEQ ID NO: 54355 - DNA, 1791 bp, Artificial Sequence
  Description of Artificial Sequence: Synthetic coding sequence
atggccgcaaattctacatccgacttacatactcctgggacgcagctgagtgtggctgatattattgtgataactgtgtatttcgcccttaacgtcgcagtgggaatctggagtagctgccgcgcttctcgcaatacagttaatggatactttttagcagggagagacatgacatggtggcccatcggtgcatcccttttcgcctcttctgagggaagtggactttttatcggtctggccggatccggagccgctggcggactggcagtggctggattcgagtggaacgccacttacgtcctgctggctttggcatgggtcttcgtgcccatatacatcagctcggagattgtcacactgccagaatatatacagaagagatacggaggtcagagaatccggatgtatctcagcgtgttgtcactgctgctttcagtgttcactaaaatcagcctggatctctacgcgggagctctgtttgtccatatctgcttggggtggaacttctatctgtccacaatactaactttggggattaccgccttatatactatagctggtgggctggccgctgttatctacactgatgcacttcaaaccctcatcatggttgtgggggctgttattctgacaattaaggcattcgatcaaattggaggatatgggcaactcgaagcagcatacgcccaggccattcccagcaggacaattgctaatactacatgccacttaccaaggaccgacgcaatgcatatgttcagggatccccatacaggcgacctaccctggaccggaatgacgttcggtttgacgatcatggcaacctggtattggtgcaccgaccaagtgatcgtccagaggtccctgagtgcgagggatctcaaccacgcgaaagcgggttccattctggcgagctacctgaagatgctccccatggggctgatcataatgcctggaatgataagccgtgcactcttcccagatgacgtcgggtgtgttgttccttctgagtgcttacgggcatgcggcgctgaggtgggatgcagcaacattgcttatccaaagctggtcatggaacttatgcctatcggattaagaggccttatgattgccgtaatgcttgctgcactgatgtccagcttgacatcaatcttcaactcttcttcaacccttttcaccatggatatttggcgacgtctgaggcctcggtctggcgagcgagaactgctgcttgtggggcgtctggtcattgttgcgttgatcggcgtaagtgttgcatggataccggtgctgcaagacagcaactccggacaactcttcatttacatgcaaagcgttacctcgagcttagcgcctccagtgactgcagtttttgtgcttggtgttttctggcggagggctaacgagcaaggcgctttttggggactgatagccggactggtggtgggcgctacaaggctggtcctggaattcctgaatccagcccctccttgtggggaacctgacacaaggccagccgtgctgggaagtatccactatcttcacttcgccgttgcactgttcgcactgtctggcgctgtcgtggtggccggatccctgctgacccccccacctcagagcgttcaaattgaaaatcttacatggtggacactggcacaggacgtgcctttgggcactaaggcgggtgatggacaaacacctcagaagcatgctttctgggcccgagtgtgtggttttaatgctattttgcttatgtgtgttaacatcttcttctatgcctacttcgcgtag

SEQ ID NO: 54356 - DNA, 1839 bp, Artificial Sequence
  Description of Artificial Sequence: Synthetic coding sequence
atggcggctaattccacttcggatttgcacactccagggacccagttgtctgtggccgatatcattgtgataaccgtttacttcgccctgaatgtggcagtaggaatctggtccagctgccgcgcttctcgcaacacagtgaatggatactttcttgctggcagggacatgacctggtggcccataggcgcttccttgttcgctagttccgagggaagcgggttgtttataggactggccggatcaggcgctgctggcggtctagctgtagcagggttcgaatggaatgcaacgtatgtgctgctggccctcgcctgggtgttcgttcccatatacatatccagcgaaattgtcaccctccctgagtatatccagaagcgctatggagggcaaagaattaggatgtatctgtctgttctgtcactgctgctgtcagtttttacaaaaattagcctagacctgtacgcaggagcactgttcgttcacatttgtcttggttggaatttctacctgtcgaccattcttactctgggtattacggctctttatactattgcaggcggtcttgcagccgttatctacacggatgctctccaaactctgatcatggtggtgggggcagtgatactaaccatcaaagcgtttgaccagatcgggggatatggacagttggaagcagcttacgcccaggccattccctcgaggaccatcgctaacacaacctgccatctgccaaggacagacgccatgcacatgtttagagacccccacaccggagaccttccatggaccgggatgacttttggcctcactatcatggcaacatggtactggtgtaccgatcaggtgattgttcagcgctcactttccgcaagggatcttaaccacgcgaaagcagggtcaattctggcttcctacctcaagatgctgcccatgggactgatcataatgcccggtatgatctcacgcgctctattcccaggcgctcatgtttacgaagagaggcaccaggtgtcagtatcacgaaccgacgacgtcggctgtgtagtaccaagcgagtgcctgcgggcttgtggggcagaggtgggctgctccaacattgcttatcccaaactcgtgatggagttgatgcctatcgggctccggggtctgatgattgctgtgatgctcgccgctctaatgtcctcccttaccagcattttcaactcaagcagcactctcttcacaatggacatctggcgacgccttagacctcggagcggggaacgtgagctcttactggtgggaaggctggtgatcgtcgcactgataggagtttcagtcgcctggatccccgtgctacaggatagtaattctgggcagcttttcatatacatgcaatccgtgacgtcttcactcgcccctccggtcaccgcggtgtttgtgctgggcgtgttctggaggcgcgctaatgagcagggtgcattttgggggctcattgcagggctggtggtgggagccacccgccttgtgctggaattcttgaatcccgcaccaccttgcggcgagcccgacactcgcccagccgtcctggggtccatccattacctgcacttcgcggtcgcactctttgccctgtccggtgccgtcgtggttgccggaagtctgctgaccccacctcctcaatctgtgcaaatagaaaatctcacctggtggacactggcacaggacgtgccgctgggcaccaaagcgggtgatgggcaaaccccccagaagcacgccttctgggcccgagtgtgtggttttaatgccattctcctgatgtgtgttaacatttttttttacgcatattttgcatag

SEQ ID NO: 54357 - DNA, 1683 bp, Artificial Sequence
  Description of Artificial Sequence: Synthetic coding sequence
atggccgcaaattctacaagcgacctccatacaccaggcactcagctatcggtagccgatatcatcgtgatcacagtgtactttgccctcaacgttgctgtcggtatttggagcagttgccgcgctagccgcaatacggttaacggatattttttagccggaagagacatgacctggtggcccatcggagccagcctgttcgctagcagcgaaggaagtggtctgtttatcgggctggctgggtcaggagccgctggagggctggccgttgccggattcgaatggaacgccacctacgtgctgctggcccttgcctgggtgtttgtcccgatctatatctcttcagaaattgttaccctccctgaatacattcagaagcgatacggaggacagagaattaggatgtatctgtctgtactgtccctgctgctcagcgtatttaccaaaatctctctggacctctatgctggcgcactgtttgtacacatctgtctgggctggaatttttacttatccaccattttaaccctaggaattaccgcactttacaccattgctgggggactcgccgctgttatctatacggatgcgctccagaccctgataatggtggtgggggctgttatcctcacaattaaggcgttcgaccagattggcggatatggtcagctggaagccgcatatgcacaggcaattccctcccggacaatcgccaatacgacttgccaccttccgcgaaccgatgccatgcatatgtttcgcgacccccacactggtgacctgccatggacagggatgactttcggactgaccatcatggcaacatggtactggtgtactgatcaagtcattgttcagcgaagtctgtcggccagggatctgaatcatgctaaggctggatcaatcctggcatcctacttgaagatgttgcctatgggtctgatcatcatgcccggaatgatcagccgagccctgtttcccggtcttagagggctgatgatcgcagttatgctggccgctctgatgtcttccctaaccagcatcttcaatagttccagcacactatttacaatggacatatggcggcgtctgcgcccaagatccggagagcgcgagcttctattagtggggcgtctcgtaattgtggctctcattggcgtgtcagttgcttggatccccgtgctgcaagactccaattctggccagctatttatctatatgcagtctgtgacctccagcctggcaccccctgtgacggcagtgtttgtactcggggtgttttggcggcgagccaacgaacaaggcgctttttggggtctgatcgccggtctcgtggtgggcgcaacccggctggtgctggagttcctgaaccccgctccaccctgcggagaaccggatactagacccgctgttctgggatccatccactaccttcatttcgcagtggccctcttcgctctgtctggagccgtagtggtggctggttcactgttgacaccgcctccccagtccgtacagattgaaaacctcacttggtggacacttgcccaggatgtccctctggggactaaagctggggatggtcaaacgcctcagaagcatgcgttctgggcaagagtctgtggatttaacgccattctcctaatgtgtgtaaatattttcttctacgcatactttgcttag

SEQ ID NO: 54358 - DNA, 2028 bp, Artificial Sequence
  Description of Artificial Sequence: Synthetic coding sequence
atggagagtgggacgtcatcgcctcagcccccacagctagatcctttagacgcctttccacagaagggcttggagcccggagacatagccgtgctagtgctgtattttcttttcgttctggctgtagggttatggagcacggtcaagactaagcgagacaccgttaaaggctacttcctcgctgggggagatatggtttggtggcctgtaggagccagtctgttcgcatctaacgtgggctctggccacttcatcggactcgccggaagcggagctgcaaccggcataagtgtgagtgcatacgagctgaatggcctgttctcggttttaatgcttgcttggatctttctcccaatctatatcgctggacaggttactactatgccagagtatctgcgcaagcggttcggagggatcaggattcccatcatcctggcggtgctgtatctgttcatttacatctttaccaaaatcagcgtcgacatgtatgccggtgctatattcatccagcagagcctacacttggatttatacctggcaatagtcggactactggccattactgcagtttacaccgtagcagggggattagcggctgttatttatacagacgccctgcaaacattaattatgttaatcggtgccctcactctcatggggtactcttttgcagctgtaggcggaatggaaggcctcaaggaaaagtactttttggcattggcttccaatcggtccgagaatagttcttgcggcctgcccagagaagatgctttccatatttttcgggacccccttacatccgatttgccttggccaggcgttttgtttgggatgagcatcccatccttgtggtactggtgtactgaccaggttatcgtgcagcggacactcgctgcaaaaaatctgagtcatgccaagggcggagctctcatggccgcttatctgaaagtgctccccctcttcattatggtgttcccagggatggtctcccgcattctgtttccagatcaggtagcatgtgcagaccctgagatctgtcaaaagatctgtagtaatccgtcaggctgcagcgatattgcatacccgaagctcgtgctagaactgctgccaacgggactgcggggactaatgatggcagtgatggttgctgccctcatgtccagcctgacgtcaattttcaattcagcttcaaccattttcacaatggacttgtggaaccatttgaggcccagggcctcagagaaagaattgatgattgtcggccgagttttcgttctactcttggttttagtcagcatcctgtggattcctgtcgtgcaggcctcacagggtgggcagttgtttatctatatccagagtatctcctcctatctccagccccctgtcgcagtagttttcattatgggctgcttttggaaaagaaccaacgagaagggagctttttggggcctgatctcgggtttactgctgggattggtgcgcttggttctggacttcatttatgtgcagccacggtgcgaccagcctgacgagcgcccagtccttgtcaagtccatccactacttatacttctctatgatattgtccaccgtgacgttgatcacagtgagcacagtatcttggtttacagagcctccgtctaaggagatggtctcccacctgacatggtttacaagacatgacccagtcgtgcagaaggagcaggccccaccagcagcacccctgtcgctgacactgtctcagaacggtatgccggaagcaagttccagcagctctgtgcagttcgaaatggtccaggaaaacaccagtaaaacacactcctgcgacatgacccccaagcaaagcaaggtggttaaggctatcctatggctgtgtggcatccaggaaaagggaaaggaggagcttcctgcacgcgctgaggcaatcatcgtcagcctggaggagaaccctctggttaagacactgctggacgttaacctcatcttctgcgtgtcctgtgccatttttatctggggatattttgcctag

SEQ ID NO: 54359 - DNA, 1923 bp, Artificial Sequence
  Description of Artificial Sequence: Synthetic coding sequence
atggaaagtggtactagctctccccaaccaccacagctggaccccctcgacgctttccctcaaaagggtctggagcctggcgatattgccgtgctcgttctctactttcttttcgtactggctgtggggctgtggtccacagtgaagactaagcgcgatactgtcaaaggatacttcctcgccggaggcgatatggtgtggtggccagtaggcgcatctctcttcgccagtaatgttgggtccggtcacttcatcggcctcgctggatccggtgcagccacggggatttccgtgtccgcctatgagttaaacggcctgttcagtgtacttatgctcgcttggatcttcctccctatctatattgccggacaagttgatatgtacgctggggctatctttattcagcaaagtttgcacttggatctgtacttggccatcgtagggctccttgccattacagccgtgtatacggtggccggtgggttagccgcagtaatctacacagatgctctgcagacactgattatgctgatcggagccctgacactgatggggtacagttttgccgcagtcgggggaatggaagggttaaaagagaaatattttttagcgctcgccagtaatcggtctgaaaattcaagctgtgggttacctcgagaagatgcatttcatatcttcagggaccccctgacatccgatctgccctggcctggtgttctgttcggaatgtctatcccttccctttggtactggtgtaccgatcaagttatcgtccagcgtaccctggccgctaagaatctttcccacgccaagggaggtgcattgatggccgcttatctaaaggtgctgcctttgttcattatggtttttcctggcatggtttctagaatattatttccagatcaggtggcctgcgcagatccagaaatctgccaaaagatctgttcaaaccccagcggctgctccgacatcgcctatccaaagctggtgctcgaactgcttccaaccggtctcagagggcttatgatggctgtgatggtggcagctctgatgagttctttaacctctatttttaattctgcaagtactatttttaccatggacctttggaaccacctcagaccaagagcctcagagaaagagctaatgatcgtgggaagagtgttcgtcctgctgctagtgctcgtgtccatactctggattcctgtggttcaagctagccaaggtggacagcttttcatttacattcagagtatcagctcgtatctccagcctccagttgccgtagtgttcatcatgggatgtttttggaagagaaccaacgagaagggagctttttggggactaatctctggccttcttttgggcctcgtccgtcttgtacttgactttatttacgtgcagccgaggtgtgatcaacctgacgagagacctgtgctggtaaagagtattcactatctatacttctccatgattttatctacagtaaccctgatcacagtgtccaccgtctcgtggttcaccgaacccccttctaaagagatggtgtctcacctgacttggtttactaggcatgaccctgtggttcaaaaagaacaagctccacccgcagcgcctttgagtcttaccctctcacagaatgggatgcctgaggccagctcatcctccagcgtacagtttgagatggtccaggaaaacacatcaaagacacactcatgtgacatgactccgaagcagtccaaggtggtgaaagctattctgtggttgtgtggaatccaagaaaagggcaaggaagaactgccagccagggctgaagccattatcgtgtccctggaagagaatcccctggtaaaaacactccttgacgtgaatctgattttctgtgtatcctgtgctatctttatttggggatattttgcatag

SEQ ID NO: 54360 - DNA, 1560 bp, Artificial Sequence
  Description of Artificial Sequence: Synthetic coding sequence
atggtgtggtggcctgttggcgcttctctgttcgcttcaaatgtcggatccggacactttattggcctcgccggaagcggcgcagccacaggtatcagcgtctccgcctacgaactaaatggcttattctccgtccttatgttggcctggatctttctgcccatttacatagccggtcaggtgaccacaatgcccgagtacctgcggaagaggtttggcggtattcgtatcccaatcatcctcgctgtgctgtacctttttatttacatattcacgaagatttctgtggatatgtatgccggagccatttttatacaacagtccttgcacctggacctgtacctggccatagtgggcctcctggctattacggctgtgtacaccgtcgcaggagggctggcagccgtgatctatacggatgcactccagacactgatcatgctgattggagcgttaacgcttatgggctacagcgactgtcccgctgactcagggtgtcaggaaccagtcccttgccagagacgttgcagtgacggatgcatccctgagggcgcagctcctctgcacaatggcgtgccgtgggacggccagccccatcccttgcctagatccagcggtctttgtcgctcacgggaccttcccgaagatctgcagcagcccctaagactttttgggcacagggtttcccaaacccgcgctgggacgccagcccactcggcttccacgatcttcactatggatttgtggaaccacctgaggcctagggccagcgaaaaagaactgatgatcgtgggacgcgtgtttgtcctcctcctggtcctggtgagcattctctggattcccgtggtgcaggcaagccagggcggacaattattcatctacatccagtccatctcttcttacctacagcccccagttgctgtggtatttatcatggggtgtttctggaaaagaaccaacgagaagggggctttttggggcctgatctccggcctgttgctgggattggtcagactggttttagattttatatatgttcagcccaggtgtgaccagcctgatgagaggccggttctggtgaagtccatccattatctatacttttctatgatactgagcacagttacccttattaccgtaagcaccgtgtcatggttcacagagccaccctccaaggagatggtgtcccacctaacatggttcacacggcatgaccctgtggtacagaaagagcaggctcctccggctgcccctcttagtctcacactgtcacagaatgggatgccagaagcaagctcctcctctagcgtgcagtttgaaatggtgcaggaaaatacttcgaagacgcacagctgcgatatgaccccaaagcagtccaaggtcgtcaaagcaatcctgtggctatgtggaatccaggagaaaggcaaggaagaattgcctgccagagcagaagcaataatcgttagtctggaggaaaatccactggtgaagaccctgctggacgtgaacttgatcttctgcgttagttgtgccatctttatctggggttattttgcatag

SEQ ID NO: 54361 - DNA, 1836 bp, Artificial Sequence
  Description of Artificial Sequence: Synthetic coding sequence
atggtgtggtggccagtgggggctagcctcttcgcaagtaacgtggggtcaggacattttattggactggccggaagtggggctgccacgggcataagcgtatccgcatacgagctcaacggactcttctccgtcctcatgcttgcttggattttcttgccgatatatattgcagggcaagtcactaccatgcccgagtacctccgcaaacgctttggcggaatacgcattcccattattctggctgtgctatatttgttcatttatattttcaccaaaatcagtgtggatatgtacgctggggctatatttatccagcagagcttgcacctagacctttacttggccattgtcggcttactcgctatcaccgccgtgtacaccgtggccggagggttggcggctgtcatctataccgatgctttgcagaccctgatcatgctgattggggctcttacactgatgggctattccttcgccgcagtgggtggcatggaaggactgaaagagaaatactttcttgccctcgcatccaaccggtccgaaaactcatcctgcggcctccctcgtgaggacgcatttcatattttcagagaccctctcacaagcgatttgccctggcctggggtacttttcggcatgagtattccatccctctggtattggtgcactgatcaggttattgtgcagcgcaccctggcggcaaaaaatctgagccatgcaaaggggggtgccctaatggcggcttacttaaaggtactgcctctgttcattatggttttcccgggtatggtctcacgaatcctgttccccgatcaggttgcttgcgcagaccccgaaatttgccagaaaatctgcagcaatcctagcgggtgcagcgacatcgcctatccgaaactggtgctggagttactgcccacagggttacgcggtcttatgatggcggtcatggtagctgccctcatgagttctttgacctctattttcaatagcgcctccaccatttttacaatggacctgtggaaccatcttagacctagggcgtctgagaaggaactgatgatagtaggtagggttttcgtccttctgctcgtgctcgtaagcatcctctggattcctgtggtacaggcctcacagggcggacagctgtttatttacatccagtcgatatcgtcctacctccagcctccagttgcagtggtcttcataatgggatgcttctggaaacgtacaaatgagaaaggcgcattctgggggctcattagcggactgctgctgggactggtgcggcttgttctggacttcatctacgtgcaacccagatgcgatcagcctgacgagcggcctgtgctcgtgaagtctatacactacctttacttcagtatgatcttgagcacagtgacactgatcacagtcagtacagtgtcttggtttaccgagccccctagtaaggagatggtttcccacctgacctggtttacacgtcatgaccctgtggtgcagaaagaacaggcacctcctgcagcaccactgagcctaacactgtcacagaacggaatgccagaagcaagctcttctagcagtgttcagttcgaaatggtgcaggagaacacctccaagacacattcgtgcgacatgacaccaaaacagtcgaaggtagttaaggccatattgtggctctgcggaattcaagagaaagggaaggaagagttgcctgcccgagccgaagcaataatcgtgtccctagaagaaaatccacttgtaaaaacgctgctagacgtcaatttgattttttgtgtgtcgtgtgccatcttcatttggggttactttgcctag

SEQ ID NO: 54362 - DNA, 1818 bp, Artificial Sequence
  Description of Artificial Sequence: Synthetic coding sequence
atggagagtggaacgagttccccccagcctccgcagctggacccacttgatgccttcccacagaaaggcctggagcctggtgatattgcagtgctcgtgctatatttcctgttcgtcctggcagtgggcctgtggtccacagtgaagacaaaacgagatacagtgaaagggtatttccttgctggcggagacatggtctggtggccgggtctcttctctgtgctcatgctggcatggattttcctgccgatatatatcgctggtcaggtagacatgtatgcgggagcaatcttcatccaacagagtttgcacctggatctttatctagccatagtgggtctacttgcaattacagccgtgtatacggtcgcgggagggctggctgcagtcatctatactgatgccctccaaactttgattatgcttatcggcgcactgaccctgatggggtattccttcgctgctgttggtggcatggaggggctgaaggagaagtattttttggcgctcgcatctaaccgcagtgagaattcttcctgtggtcttccaagagaggatgccttccacattttccgcgatcccttgacaagcgatctaccctggccaggggtgctgtttggaatgtctatacccagcctgtggtactggtgtacggaccaggtgatagtccagcggacgctcgccgctaagaacctgtcgcatgccaaaggtggcgcattgatggcagcctacttgaaggtgttgcccctcttcattatggtgttcccagggatggtcagtcggattttgtttccagaccaggtagcatgcgctgaccccgagatatgccagaagatatgtagtaatccaagcggttgtagcgatatcgcttacccaaaactcgtgctcgagctgttacccactggattaaggggcctgatgatggcggttatggtggccgctctgatgagttctctgacatccatctttaacagtgcctccacaatcttcaccatggacctgtggaaccacctgagaccgagggcgagcgaaaaagagctgatgattgtaggaagagtcttcgtgctactgctggtgctggtcagcatactctggatccccgtcgtccaggcgtcgcagggcggacaactgttcatttacatccagagtatcagctcttaccttcaaccaccagttgccgtggttttcattatgggctgcttttggaaaaggacgaacgaaaagggtgcgttctggggacttatctctggactgctcctcggcctggtacgccttgtgctggacttcatctatgtgcaacccaggtgcgaccaaccggacgagaggccagttcttgtgaagagtatccactacctgtattttagtatgatcctctcaacagtgacgctcataaccgtgtcaacagtcagctggtttactgagccgccttcaaaggaaatggtatcccatctgacatggtttaccagacacgaccctgtggtacaaaaagaacaagctcccccagccgctcctttgagtttgaccctgagtcagaacggcatgcccgaagcctcctcgtcctcttctgtacagttcgagatggtccaggaaaacacaagcaagacccactcttgcgacatgacacctaaacagtcaaaagtcgttaaggccatcttgtggttatgcggtatacaggagaagggaaaggaggagctacccgctcgcgcagaggccatcatcgtgagcctcgaagagaatcctctcgtgaaaaccctgctcgacgtgaacctgattttctgtgtaagctgtgctatcttcatctgggggtattttgcctag

SEQ ID NO: 54363 - DNA, 2121 bp, Artificial Sequence
  Description of Artificial Sequence: Synthetic coding sequence
atgagtaaggagctggccgctatgggtcccggtgcatctggtgatggcgtgcgcaccgagactgcccctcacattgcattggacagtcgggtcggcctgcacgcatacgatatttccgttgtagtgatctactttgtcttcgttattgccgtcggtatttggtcatctatcagggcaagtaggggaacgatcggagggtattttctcgcaggaaggagtatgtcctggtggcctatcggcgctagcctcatgagctctaatgtgggcagtggtctgttcatcggactcgccggaaccggtgctgccggaggcctggccgttggtggtttcgaatggaacatgcgaaagagtagatctggtggtgacaggggtattcatccacgtagtcacgggagaaccggagtacgctcccaggctacctggttgctgctcgctctcggatgggtctttgtgcctgtctacattgctgctggggtcgtaaccatgccacagtatttgaagaagcgctttggcggacagcgcatccaggtgtacatgtcagtgcttagccttatactgtatatctttactaagatttcaaccgatatcttttccggtgccctgtttatccagatggcgctgggatggaatctgtacctttccaccggcattctgctggtggtgaccgccgtctacaccatcgccggtgggctcatggctgttatttacaccgacgccctccagactgtcatcatggtgggcggagctctcgtgcttatgttcctgggattccaggatgtaggctggtatcctggtctggaacagagataccgacaggctattccaaatgtgacagtgccaaatacaacttgtcacctccccaggcctgacgctttccatattcttcgtgatcctgtcagtggggacattccctggcccggtctcattttcggcttgacagtgctcgccacttggtgctggtgtactgatcaggtgattgtccagagatctctgagcgccaagtctctttcccacgccaaggggggttccgtgctgggcggatatctgaagatcctccccatgttcttcattgtgatgcccggaatgatctcccgggctttattccctgacgaggttgggtgtgtggatcccgacgtgtgccagagaatatgcggagccagggtgggatgcagtaatatcgcttatcccaagctggtgatggctttaatgcccgttggtctgcgcggtctgatgatagcagtgatcatggctgcgctcatgagcagtcttacaagcattttcaattcctccagcaccctgtttacaattgatgtgtggcaacgctttcgcaggaagtccacagaacaagagctgatggtggtcggtagagtttttgtcgtatttctggtagtgatctcaattctctggatccctatcatacagtctagcaacagcgggcagctctttgactatatccaagcggtgacttcctatctggcaccaccaattacagccttatttctgctagcaatattctgcaaaagagtgactgagcccggtgccttttggggcctggtgttcgggttgggcgttggtctgctgcggatgattctggaattttcttacccagcacccgcttgcggagaagtggacagacgtcccgctgttctgaaggatttccattatctttactttgcaatcttgctgtgtgggttgacagcaatagtgattgtaatcgtctctctgtgcactaccccaatccctgaagagcagcttacgcggctgacctggtggacccggaactgtcctctcagtgagctggagaaagaggcccatgagtctacccccgagatttcggaacggccagcaggcgaatgccctgctggcggaggcgcagcagagaactcctcgctcgggcaggagcagccggaggccccttccagatcgtgggggaaactgctgtggtcttggttttgcggtctgtctggaactcctgagcaggccctttctcccgcagagaaagcagccctagaacagaagctgacatccattgaagaagaaccactgtggcgccacgtgtgcaacatcaacgcagtccttctgttggctataaatatttttctgtggggctacttcgcttag

SEQ ID NO: 54364 - DNA, 501 bp, Artificial Sequence
  Description of Artificial Sequence: Synthetic coding sequence
atgggccctggtgccagcggggatggcgtacggactgaaacagccccacacatcgcgcttgatagcagggtgggactccacgcatacgatatcagcgtagtggtcatctacttcgtctttgtgattgccgtcggcatctggtctagtatccgagcatctagaggtacaatcggcggatattttctggcaggcagatcaatgagttggtggcccattggtgcaagtctcatgagctctaacgtcggttcagggctcttcatcggccttgcaggcacgggggcagcgggtggactggcggtggggggatttgagtggaacgccacatggctgctgctagctctggggtgggtcttcgtgccagtgtatattgctgccggagttgtgaccatgcctcaatatctgaaaaagaggttcgggggtcaaagaattcaagtatacatgtccgttctttccctgattctttatatcttcacaaagatttcaggatcctgctggtggtag

SEQ ID NO: 54365 - DNA, 2046 bp, Artificial Sequence
  Description of Artificial Sequence: Synthetic coding sequence
atgtctaaggagcttgccgcaatgggccctggcgcttccggggacggagtacggacagagacggcccctcatattgctctggactcacgtgttggactgcacgcgtacgatatttctgtcgttgtaatctatttcgtgtttgtaatagctgtgggaatatggtcgtctatccgggcttctcgcggaactattggaggatacttcctagccggaaggagtatgagctggtggccaattggcgctagcctgatgtcttcaaacgtgggctccgggctgttcatcggattagcaggaacaggcgctgccggaggcctggctgttggtggtttcgaatggaacgcaacctggctcttacttgcactgggatgggtgttcgtgcctgtgtacatcgctgccggtgtggttaccatgccacagtacctgaagaaaaggtttggtggccagcgcatccaggtctatatgagcgtgctttcactgatcctgtatatattcacaaaaatctcaaccgacatttttagcggcgctttgttcatccagatggcacttggctggaacctgtaccttagcactggtatcttgctagtcgtgacagcagtatatactatcgccggaggcctgatggccgtgatttacacagatgccttgcagacggtgataatggtaggaggggctttagtgttgatgtttctgggctttcaggacgtgggttggtacccaggcctagagcagcgatatcgccaggccatcccaaacgtgactgttcctaataccacctgtcatctgccgagacccgatgcttttcacatcctccgagaccctgtgtctggggatatcccctggccaggtctgatcttcgggctcaccgtgctggccacctggtgctggtgcaccgaccaagttattgtacagagatctttatccgccaaatccttaagtcacgctaagggcggatcagtgctgggtggatacctgaagatacttccgatgttctttattgtgatgccagggatgatttctcgggctttgttcccagatgaggtgggctgtgtcgatccagacgtgtgccagagaatctgcggtgctcgcgtgggctgctcaaatatcgcctacccaaagctggtgatggctcttatgccagtgggtctgcgaggtcttatgatcgccgtgataatggctgcccttatgtcaagcctcacgtccatcttcaactcttcatcgaccttgttcactattgacgtatggcaaagatttcgtcgcaaaagtactgagcaggaactgatggtagtcggcagggttttcgtagtgtttctggtggtcatttctattctctggatacctatcatccagagttctaattcgggccagttgttcgactatattcaggccgtcacgtcatatctcgcccctcccataacagcgctttttctgttagctatcttctgtaagcgagtgactgaacccggagccttttggggattggtgtttgggttaggcgtggggctactgagaatgatcctggaattttcttaccccgctccggcttgtggggaggtagaccgcagacctgctgtgctgaaggattttcactacttatactttgccatactcctgtgcggcctgactgctattgttattgtaatcgtctcgctttgcacaactcccatccccgaggaacagctcacccgtctgacatggtggacaaggaattgcccactctcagagctcgagaaggaagcgcatgaatccacgccagagatttctgaacgaccagctggggagtgtcccgctggcggaggagccgctgagaactccagcctggggcaggagcagccggaggccccaagtcgaagttggggaaagcttttatggtcatggttctgcggcttgagtggtacccctgagcaggctttatcgcccgcagagaaggcagccctcgagcagaagttgacatcaatagaagaggaacctctctggcggcacgtatgcaatattaacgctgtgctgctcctggccatcaacatctttctgtgggggtactttgcttag

SEQ ID NO: 54366 - DNA, 522 bp, Artificial Sequence
  Description of Artificial Sequence: Synthetic coding sequence
tagagcaaggagctggcagccatggggccaggtgcctctggtgacggagtgcgaacggagacggcccctcacattgcccttgactcgagagtgggtctacatgcatatgacatcagtgtcgttgtgatttacttcgtatttgtaatcgctgtgggcatctggtccagcatccgagcatcgagaggcacaattggcggatactttcttgccggacggtctatgtcgtggtggccaatcggagcttccttgatgagcagcaacgtggggtcaggtttatttatcggcctggcgggaaccggtgctgccggtggactagctgtgggcggtttcgaatggaacgcaacatggctgttgcttgccctgggttgggtgttcgttcctgtgtatatcgcggctggcgtggtgaccatgccacaatacttaaagaaaagattcggtggccagcgcattcaagtctacatgagtgtgcttagcctaatcctgtacatcttcacaaagattagtgggtcatgctggtggtag

SEQ ID NO: 54367 - DNA, 1908 bp, Artificial Sequence
  Description of Artificial Sequence: Synthetic coding sequence
atgtcagtgggtgtctcaacgagcgcccctctgtcaccgacctctggtacgtctgtgggcatgtccaccttcagtatcatggattatgtggtattcgtgctgctgctggttttgagtttagccatcgggctttatcacgcttgcagaggatgggggcgtcacacagtaggggagctgctcatggctgaccggaagatgggctgcctccccgtcgctctctctctgctcgccaccttccaaagtgccgtcgcgatactgggggtccccagcgaaatctatcgattcggtacccaatattggtttctgggttgttgctatttcctgggtcttctcattcccgcacacatctttatccccgtattttacaggctccatctgactagcgcttacgaatatctggagctccggtttaacaagaccgtgcgcgtatgtgggacggtgactttcatatttcagatggttatttatatgggcgtggtcctttacgccccttctttggccctgaacgcagttacagggttcgacctctggctcagcgtgctagccttggggatagtttgcactgtgtacacagcccttgggggtctgaaagccgtaatatggacggatgtgtttcagactctggtcatgtttctcggacagttggctgttattattgttggttcggccaaagttggcggattaggcagagtgtgggcagtcgcgtcccagcatggtcgcatcagtggttttgagctagatccggaccccttcgtaagacacaccttctggactcttgccttcggcggtgtgttcatgatgctctcactttacggagttaatcaggctcaggtgcagaggtacttgtctagccggactgaaaaggctgccgtactaagctgttacgcagttttcccatttcaacaagtcagtctttgcgtaggctgcctcatcggtctcgttatgtttgcatactatcaagagtatcccatgtccatccaacaggcccaggcagcccctgatcagtttgttctgtattttgtcatggatctgttgaagggcctgcctgggctgccgggactgttcattgcgtgccttttctcaggctccctctctactattagctcagccttcaacagcctcgctaccgtaaccatggaagatctgattcgtccctggtttccggaattcagcgaggctcgggcaattatgctctcccggggacttgcattcggatatggattactctgcttaggcatggcctatatctcctctcagatgggtcccgtgctgcaggccgctatctccatttttggcatggtaggcggaccactgctcggcttgttctgtctgggcatgttttttccctgtgcaaaccctcccggtgccgtggtaggacttctggcgggacttgtgatggccttttggatcggcatcggaagtatagtgacaagcatgggctcaagtatgccacccagccccagcaacggaagctcttttagcctgccaaccaatctgacagtggctacagttactaccctgatgccactgaccacctttagtaaaccaaccggactgcagcgtttctacagcctgtcttacctctggtacagcgcccacaacagtacaacggtgatcgtggttggactaatcgtgagcctcctcacaggtcggatgcggggaagaagtctgaatccagccaccatttatccggttctgcccaagctactgtcgctgctgcccctaagttgtcaaaaacggctgcattgccgtagctacggtcaagatcatcttgataccggcctttttccagagaaaccacgaaacggagtgctgggcgacagcagagacaaagaagccatggcactggatggaaccgcgtaccagggcagttcctcaacctgcatacttcaggaaacttctctgtag

SEQ ID NO: 54368 - DNA, 444 bp, Artificial Sequence
  Description of Artificial Sequence: Synthetic coding sequence
atgtctgtgggggtgtccactagcgcccctctgtctccaactagtggcacctccgtaggcatgagcacattttctattatggattatgtggtgttcgtgctcctgttggtactgagtttggccattggcctttaccatgcctgtcgagggtggggacgtcacaccgtaggggagctactgatggccgaccggaagatgggctgtctaccagtagccttatccctcctggcaacatttcagtctgctgtagcaattctgggcgtcccctccgaaatttatcgcttcggcacacagtattggttcctcggctgctgttacttcctggggctcctgattcctgcacacattttcattccagtgttctatcgcctccacttgacgagtgcctacgagtacttagagcttagatttaataaaacggtcagggtttgcgggaccgtgtag

SEQ ID NO: 54369 - DNA, 1908 bp, Artificial Sequence
  Description of Artificial Sequence: Synthetic coding sequence
atgtccgtgggtgtgtcaacatccgcaccccttagccccacgtcaggcacttcagtggggatgagtacattctcaattatggactatgtggtgtttgtgcttctgctggtcctcagtcttgccatcggtttgtaccatgcctgtaggggctggggaaggcatacagtaggagagttgctcatggctgataggaagatgggatgtctgcctgtggcactgagcctactggcaactttccaatccgcagtcgcgattctcggagttccctccgaaatttataggttcgggacacaatactggttcttaggttgttgttactttcttggtctcctaatcccggctcatatcttcattcctgtgttctaccgtctgcacctgacttccgcttatgagtaccttgagctacgctttaataagaccgtgagggtctgtggtaccgtaacatttatttttcagatggtgatttacatgggagttgtgctctatgccccaagcttggctttgaatgctgtgacaggcttcgacctctggctgtccgtgctagccctcggtatcgtttgtacagtgtacaccgccctggggggactgaaagcagtaatctggacagatgtcttccagactctcgtcatgttccttggacagttggctgttattatcgtgggaagtgccaaagtaggaggattaggtcgagtatgggccgttgccagccagcacggtcgtatttccggtttcgagctggatccagatccctttgtgaggcatacattctggaccttggcctttgggggagtgtttatgatgctgagcttgtacggcgtaaaccaagctcaggtgcagcgctaccttagcagccgtactgagaaagccgcagttctgtcttgctacgctgtgttccctttccagcaggtgagtttgtgcgtcggatgtctcataggacttgtcatgtttgcatactaccaggaataccctatgagtatccagcaagctcaagcagcacccgaccagttcgtcctgtactttgtaatggatctcctcaaaggtcttcctggccttcccggtctctttatagcatgcctgttctcaggttctctgagcacaatcagcagcgccttcaacagcctggccactgttaccatggaggatttgatcagaccctggttcccagaatttagcgaggctcgagccatcatgttgtcccggggattagcttttgggtatggtctactgtgcctgggcatggcctacatctcttcacagatgggcccagtcctgcaggccgctataagcatcttcggcatggtgggaggcccactgctgggactcttttgcctgggcatgttcttcccgtgcgccaaccctcctggagctgtggttggcctgcttgctgggctcgttatggccttttggattggaataggctcaattgtaacaagtatgggcagttcaatgcctccatctccaagtaacggaagctccttctctctcccaactaacctgacagttgctactgtgacaactttaatgcccctgacgacattcagcaaaccaaccggactccagagattctactccttgtcttacctatggtattccgctcacaactccacaaccgtgatagtcgttgggctgatcgtgtctctcctgacgggccgaatgagagggcgatctttaaaccctgcaactatttatccagtgctgcccaagctattgtcgttgcttccgctaagctgtcagaagcgcctgcattgccgcagctacggccaagatcacctcgatacaggactcttcccagaaaagcctcggaatggcgtgctaggcgactcacgtgacaaagaagccatggcactcgatgggaccgcgtatcagggcagtagctcaacatgtatacttcaggagacaagcctgtag

SEQ ID NO: 54370 - DNA, 582 bp, Artificial Sequence
  Description of Artificial Sequence: Synthetic coding sequence
atgagcgtaggagtgtcaaccagcgccccactcagtccgactagcggtacctcggtggggatgtccactttttctatcatggactacgtagtgttcgtcttgctattggtgctgtccctggccatcggcctttaccacgcgtgccggggttggggacgtcacaccgtaggggagctcctcatggccgacaggaagatgggctgcctgcctgtagcgctctcactgctagctacctttcagtctgccgtcgccatactcggagtaccctcagaaatttatcggttcgggacacagtactggtttctgggttgctgctactttctcggcctgttgattccagcccacatatttattccagtgttttatcggttgcacctgacatccgcctatgagtatctggagctgcggttcaataaaaccgtccgggtttgcggcacagtcaccttcatctttcaaatggttatctacatgggcgttgtcttgtatgcccctagtctggcgctaaatgccgttactggattcgatctctggctctcagttctggccctcgggatcgtctgtacagtctacacagcgctgtag

SEQ ID NO: 54371 - DNA, 237 bp, Artificial Sequence
  Description of Artificial Sequence: Synthetic coding sequence
atgtcggtcggggtctccaccagcgcgccattgtcccctacatcaggtacctctgtggggatgtctacattttctatcatggattacgtcgtgttcgttctcctccttgtattgagcctggcaattggcctgtaccatgcctgcaggggctggggtcgacacactgtcggggaactgctgatggcagatagaaaaatgggatgtttaccagtggcgctgtccctgttggcgacctag

SEQ ID NO: 54372 - DNA, 348 bp, Artificial Sequence
  Description of Artificial Sequence: Synthetic coding sequence
atgtctgtaggcgtatctacaagtgctcctctaagcccaacaagtggtacgtcagttggtatgtccacattctcaataatggactatgtggtgttcgtgctcctgttagtgctgagtttagcaattggcctgtaccatgcctgtagaggatggggccgacacacggtcggagagctgctaatggcggataggaaaatgggctgcctgcccgtggccctgagcctgcttgccaccttccagtctgctgtcgctatcctgggcgtcccctcagagatttacaggtttggtacacagtactggttcctaggatgctgctatttcctcgggctgctgatacccgcacattag

SEQ ID NO: 54373 - DNA, 180 bp, Artificial Sequence
  Description of Artificial Sequence: Synthetic coding sequence
atgagcgtcggagtcagtacatccgctccattgagccctacctctggaaccagcgtggggatgtctacctttagcatcatggactacgtcgtctttgtactattgcttgtcctctccctagccattgggctatatcatgcatgcagagggtggggaagacataccgtcggagaactgtag

SEQ ID NO: 54374 - DNA, 120 bp, Artificial Sequence
  Description of Artificial Sequence: Synthetic coding sequence
atgagtgtgggagtttcgacaagtgctccgctgagccccacttctgggactagcgttgggatgtcaaccttctctatcatggactacgtcgtgtttgtactgctcctcgtgctgtcgtag

SEQ ID NO: 54375 - DNA, 402 bp, Artificial Sequence
  Description of Artificial Sequence: Synthetic coding sequence
atgagcgtcggggtgtctacgtcagctccgctgagcccaacatcgggcacttccgtgggtatgagcaccttcagcattatggactacgtggtgttcgtacttctcctggtgctatctctagccattggactgtaccatgcctgtcgcggttggggtcggcacaccgttggtgaactgttgatggccgaccgcaagatggggtgtctgccagttgctctttctttgctggccactttccagagtgcagtggcgattctgggggtccctagtgaaatctaccgtttcggaacccagtattggttccttggctgttgctacttcctcggactgctgattcccgctcacatatttatccctgtgttctaccgtctgcatctcacaagtgcctacgaatacctctag

SEQ ID NO: 54376 - DNA, 84 bp, Artificial Sequence
  Description of Artificial Sequence: Synthetic coding sequence
atgtccgtgggtgttagcacatcagcccctctctctcccaccagcggaacgagcgtgggcatgtccactttcagtatcatgtag

SEQ ID NO: 54377 - DNA, 462 bp, Artificial Sequence
  Description of Artificial Sequence: Synthetic coding sequence
atgtcagtcggagtgtctaccagcgctcccctgtcccctacatctgggacaagcgttggaatgtcaactttctcaataatggattatgtggtgtttgttctgcttcttgtgcttagcttggccattggactgtatcatgcttgcaggggctggggacggcataccgtgggagagctgctaatggctgataggaaaatgggctgtctcccggtggccttatccctgctggccacatttcagagcgctgttgcaatcctcggagtaccttcggaaatctatcggttcggtacccagtactggtttctggggtgctgctactttctcggtcttctgattccggcacacatctttattccggtgttctaccgattacacctgacctccgcctacgaataccttgaacttcggttcaacaagacagttcgagtgtgcgggacggtcactttcatctttcagatgtag

SEQ ID NO: 54378 - DNA, 1746 bp, Artificial Sequence
  Description of Artificial Sequence: Synthetic coding sequence
atggagcggcagaaccaatgcatccagtcttggaaaaggcgccgtaagatggctccatggtctggaggaacagggacaacacgctggtcgttatgcaacgtttggcgatttccatacctatgttataagaacgggggaggcgcattttttattccctatctggttttcctttttacctgcgggattccagtgttcttactggagacagcattgggccagtatacaagtcagggtggagtgaccgcctggcgcaaaatctgccccatattcgagggaattggttatgcttctcaaatgatcgtcattctgctcaacgtgtactacatcatcgttctggcctgggccttgttttatctgttttctagcttcacgatcgatctgccctggggcggttgctaccacgaatggaacacagagcactgcatggaatttcagaagactaatggatcgctgaatggcacctcggaaaacgcaaccagccctgtgatcgaattttgggaaagacgagtgctgaagataagcgacggaatccagcacttaggtgccctgagatgggaactggccctatgtctcctgcttgcatgggtcatatgttacttttgcatctggaagggagtgaaaagcactggaaaggttgtctacttcactgccacgttcccttatctgatgttggtggtactgctgatccgtggagtgaccctccctggcgcagcgcaaggcatccaattctacctgtatcccaatctaacccggctgtgggatcctcaagtgtggatggacgccggtacacagattttcttttcgttcgcgatttgtctgggctgtctcaccgctctaggctcctacaataagtaccataacaattgctaccgggattgcattgcactgtgctttttgaactcaggaacctccttcgtggcagggttcgctatttttagcatcctgggcttcatgagccaagaacagggtgttccgatttctgaggtggccgaaagtggacccggtctggctttcattgcatacccacgggcagtggtgatgctacccttctctccactatgggcatgttgtttcttttttatggttgttcttctcgggctggattcccagttcgtttgtgtagaaagtctagttaccgctctagtagatatgtatcctcacgtgtttagaaagaagaatcgaagggaagtccttatcttgggtgtttcagtagtctcttttctcgtaggtttgattatgctgacagagggaggcatgtatgtcttccagctctttgattactacgccgcttcaggaatgtgtttgctgtttgtcgccatcttcgagagtctttgtgtggcttgggtctacggagccaagagattttacgataacatagaagatatgattggatatcgcccttggccgctaatcaagtattgttggttgtttcttacacccgctgtgtgcacagccacattccttttctctctcattaaatataccccactcacctacaacaagaagtatacttatccatggtggggagacgccctgggttggctcctggcactgagctccatggtgtgcatcccggcttggagtctgtataggttgggaacactgaagggcccattcagggagcgaattagacaactgatgtgtccagctgaggatttgccccaaagaaaccctgccggaccttctgctcccgctactcctaggacctctctgctgcgcctcaccgaactcgagagccactgttag

SEQ ID NO: 54379 - DNA, 1809 bp, Artificial Sequence
  Description of Artificial Sequence: Synthetic coding sequence
atggatagccgtgtgtcgggcactaccagtaatggcgagactaaacccgtttatcccgtgatggaaaaaaaagaagaagacggcactctggaacgcggacactggaataacaagatggaattcgtgctgtccgtggctggggaaataatcggcctgggaaatgtatggaggtttccatacctgtgctacaaaaacggaggcggagctttcttcattccttatctggtcttccttttcacctgtggaatcccagtgttccttctggagactgcactgggccaatatacgtcgcagggcggagttaccgcatggcgcaaaatctgtccaattttcgaggggatcggctacgcgagtcagatgatcgtgattctgttgaatgtgtactatattatagttctcgcctgggccctgttctatttattcagctccttcacaattgatctgccctggggcggatgttatcacgagtggaatactgaacattgcatggagtttcaaaagacaaatgggtccttgaatggtacctccgagaatgccacttcccctgtgatcgaattttgggagcgcagggtccttaagatatcagatgggatccagcatcttggggctttgcgatgggagctcgcactgtgtctgctgttggcctgggtgatttgctatttctgtatttggaaaggggtcaagtcgactggaaaggtcgtttactttaccgccacgtttccttatttaatgttggtggtgcttctgattcgaggcgtgactctacctggtgcagcccagggaatacagttctatctctatcccaatctgacgagactgtgggatcctcaggtgtggatggacgctggcactcagatattcttctccttcgctatatgtctagggtgtttgactgctttgggttcttataacaagtatcacaataactgctacagagattgcattgccttgtgtttcctgaactcgggtacctccttcgtagccggatttgcaattttttcaatcctcggcttcatgtctcaagaacaaggcgtgccaatttctgaagtagcagaaagtggccctggcctcgctttcatcgcctatccgagagcagtcgtgatgttgccctttagcccactatgggcatgttgtttctttttcatggtcgttctgttaggcttagacagccagttcgtgtgtgtcgaaagtttggtcaccgcattagtcgatatgtacccacacgtgtttcgcaagaagaaccgccgtgaagtgttgatccttggcgtcagtgttgtgtcttttttggtcgggctgatcatgctgacagaagggggaatgtacgtgttccaactattcgactattatgcagcatccgggatgtgccttctgttcgtggccatctttgagtctttgtgcgtggcgtgggtgtacggggcaaagcggttttacgacaatattgaagacatgattggctacagaccctggcccctgattaagtattgttggttatttttgaccccagcagtgtgtacagcaacgttcctattttccctgattaagtatacgccacttacctataataagaaatatacgtacccctggtggggggacgcactgggctggctattggctctgtcgtcaatggtttgcattccagcctggagtctttacaggctcggtaccttgaagggaccctttcgagaaagaattagacagctgatgtgtccggcagaggacctccctcagcgcaatcctgctggcccaagtgcacctgcgacccctaggacatccctcttgcgcctgactgagctggaatcccactgttag

SEQ ID NO: 54380 - DNA, 294 bp, Artificial Sequence
  Description of Artificial Sequence: Synthetic coding sequence
atggattcccgcgtcagcggaactacaagcaatggagaaaccaagcctgtctacccagtgatggaaaagaaagaagaggatggcactctggaacgtggccactggaataacaaaatggagtttgtcctgagtgtagcaggagaaataattggtttgggtaacgtgtggagattcccctacctttgctacaagaatggaggcggagaaatgcgcgctctggttccaccgcatccactgctcgaaggcggatattttcatctcctgcatttaagaccactgtggggggttccttag

SEQ ID NO: 54381 - DNA, 1533 bp, Artificial Sequence
  Description of Artificial Sequence: Synthetic coding sequence
atggacagtcgtgtgtcaggcactacatccaacggggagacgaaacctgtgtatcctgtgatggagaagaaagaggaagacggcaccttggaacgaggacattggaacaataaaatggagtttgtcctgtctgtagcaggcgaaattattggactgggcaacgtttggagatttccatatttatgctacaagaacggcggagagcattgtatggagttccagaagacgaacggaagcttaaatgggacctcagagaacgcaacttcccccgtcatcgagttctgggaaaggcgggtcttgaaaatctccgatgggattcaacatctcggtgccctgcggtgggaactggccctgtgcctactgttagcctgggtgatctgctacttttgcatctggaaaggcgttaagtctaccggcaaggtcgtgtattttactgccacatttccctacctcatgctggtggtgctcctaatccggggagtcactcttccaggcgctgcccagggcatccagttctacctgtaccccaatctcactcggttatgggacccacaggtctggatggacgcaggcacacaaatttttttctcatttgccatctgcctcggatgcctaacggccctggggtcatataataaataccacaacaactgctatagagactgtattgctctctgttttctcaattcagggacaagtttcgtcgccggatttgccatattttccatactcggattcatgtcacaggaacagggagtgcccatctctgaagtggccgagagcggcccaggcctggcttttatcgcctaccctcgggctgtagtcatgctgcctttttccccgctgtgggcttgttgtttcttcttcatggtggtgctgcttggtctggatagccagttcgtctgtgttgagagcctggttacagctctggtggacatgtacccccacgtgtttcgcaaaaagaaccggagggaggtgcttattctgggtgtgtccgtggtctccttcctggtggggctcattatgctgactgaggggggaatgtatgtgttccagctgtttgactattacgccgcaagtggcatgtgcttactatttgtggctatcttcgagtcgttatgcgtggcctgggtctacggggctaagcgcttctatgacaacatcgaggatatgattggctaccggccttggccactcattaagtactgctggcttttcttaactcccgctgtgtgcacagcaacatttctctttagtttgatcaaatacactcctcttacttacaacaagaagtatacttacccctggtggggtgatgctctcggctggctgctcgctctatcttcaatggtctgcattcccgcttggagcctgtacaggctgggaacactgaagggaccgttcagggaaagaattaggcagcttatgtgtcctgctgaagacctcccacaaagaaatcccgcaggccctagtgcgcctgccacccccaggacttctctgctgagacttacagagttagagagtcattgctag

SEQ ID NO: 54382 - DNA, 2193 bp, Artificial Sequence
  Description of Artificial Sequence: Synthetic coding sequence
atgcctaaaaactccaaggtggttaagcgggagctggatgatgacgtgaccgagtccgtaaaagacttactgtcaaacgaggatgccgctgacgatgcatttaagactagtgaactgattgtcgatggtcaggaagaaaaggacacagatgtagaagaaggctcggaggtcgaggatgagaggccagcctggaactccaaactgcaatacattctagcccaagtaggtttctctgtaggcctggggaatgtatggcgctttccttacctctgtcagaagaacggcggaggtgcttatctgttgccgtacttgatccttctgatggtgatcggaatcccacttttcttcttggagctttcagtggggcagagaattcggaggggaagcataggagtgtggaactacatctctccaaagctcgggggaatcggattcgcgtcttgcgtggtgtgttacttcgtggcactgtactacaacgtgatcattggctggtcactgttctacttctcgcaatcttttcagcagcccctcccctgggatcaatgtcctctagtgaaaaatgcaagccatacattcgtagagccagagtgcgagcagagttcagcaaccacctactactggtaccgagaagccctcaacattagcagctctatttctgagtctgggggactgaactggaagatgacaatctgcctcctggccgcttgggttatggtttgcctggctatgataaagggcatccagtctagcgggaagattatctacttctcaagtctattcccatatgtggtactcatctgctttcttatcagggcatttctcttgaatggctcaatcgatggtatccggcatatgtttactcctaagctggaaatcatgctggagcccaaagtgtggagggaggctgctacacaggtgttttttgccctgggcctcggattcggtggcgtgatcgctttttctagctataacaaaagagacaacaactgccatttcgacgctgtgctagtttcctttataaatttctttacttcggtcctcgccacacttgtggtgtttgccgtgctggggtttaaggccaacgtgatcaacgagaaatgtattacacagaacagtgaaacaatcatgaagttcttgaaaatgggcaatatcagccaggacattatcccccaccatatcaatttatctaccgtgacagctgaagattaccacctcgtgtatgacattattcagaaagtgaaagaagaggagttcccagcattacacttgaactcttgcaaaatagaggaagagctcaacaaggccgtccagggtactgggcttgctttcatcgctttcactgaagcaatgactcatttcccggcttcacccttctggtctgttatgttctttctcatgctggtgaacctaggtctggggtcaatgttcggaactattgagggcattgtgacgcccatcgtggatacgtttaaagtgaggaaagagatacttaccgtgatatgctgtctcctagccttctgcattggcctaatttttgtgcagaggtctggtaactactttgtaaccatgttcgatgactactccgccacactgccgcttctcattgtggtgatcctggagaacattgccgtctgcttcgtctacggtatagacaaattcatggaagacctgaaagacatgctgggattcgccccttcccgttattattactatatgtggaagtacatcagcccattaatgttgctgtctctcctgatagcctctgttgttaacatgggcctttctcctccaggttacaacgcgtggattgaagacaaggcatcagaggagttcctcagttatccaacctgggggctcgtggtctgcgttagcctggtggtctttgctatcctgcctgtgccagtggtttttattgtcaggcgttttaacctcatcgatgattcaagcggaaacttggcaagcgtcacttataagaggggcagggtgctaaaagagcctgttaacttggagggcgatgacacaagcctgattcacggcaagatcccctctgagatgccatcacccaatttcgggaagaacatttacagaaagcaatccgggagtcctacactagatacggcccctaatgggaggtatggcatcggatatctcatggcggacatcatgcctgatatgccagagagcgacttatag

SEQ ID NO: 54383 - DNA, 750 bp, Artificial Sequence
  Description of Artificial Sequence: Synthetic coding sequence
atgttcaccccaaaattggaaatcatgctcgaaccgaaggtgtggcgggaagccgcaacccaggtgttttttgccttggggcttggatttgggggagtcatcgccttttcctcttacaataaacgagataataattgccactttgatgcagtcctggtctcatttatcaatttcttcacatccgtgttagcaactctcgtcgtgttcgctgtgctggggttcaaggctaacgtcatcaatgaaaaatgtatcactcagaactcagagactattatgaaatttcttaagatgggaaatatatctcaggatattatccctcatcacattaatctgtccacagtgaccgccgaggactatcatctggtgtacgatatcatccagaaggtgaaggaggaggaattccctgccctccatttaaattcatgcaagatagaggaggaactgaataaggccgtgcaaggcactggcctcgcctttattgcatttacagaagcgatgacacattttccagcgagcccattttggtccgtcatgttcttcctgatgctagttaatctcggacttgggtcaatgtttggaactattgaagggatcgtgacacccatcgtggacacattcaaggttcgcaaagaaattctgacagtgatctgctgcctgcttgcattctgcattgggctaatcctctgtaatgccctcgagataactctgctgcagtgtcttatgatcatcctcctgcactgcctctgttag

SEQ ID NO: 54384 - DNA, 870 bp, Artificial Sequence
  Description of Artificial Sequence: Synthetic coding sequence
atgccaaagaacagcaaggtagtgaagagggagctggatgacgacgtcacagaaagcgtgaaagacctgttgtctaatgaagacgctgcagatgatgcgtttaagacatctgaattaattgttgacggccaggaagagaaggacacagacgtggaagagggtagtgaggttgaagatgaacgccctgcttggaattcgaaactgcaatacatcctggcccaggtaggcttcagcgttgggctgggaaatgtctggaggttcccttatctctgccagaagaacggtggcggagcctacttgctgccctatctcattctcctaatggtaattggaattccgcttttctttctagagctctcggtggggcaacgtatccgaagaggatcgataggcgtctggaattatatctcacccaagctcggcggaatcggcttcgcttcgtgcgtagtgtgctacttcgtggccctgtattacaacgtgatcattggatggagcttgttttacttcagccagtctttccagcagccactgccctgggaccaatgcccattggtgaagaacgcaagccacacatttgtcgagcccgagtgcgagcagagttctgccactacctattattggtaccgcgaagcgctcaacatttcttcttccatctctgaaagcggtggccttaattggaagatgacaatctgtctcttggccgcatgggtcatggtgtgcctggccatgatcaagggaatccagtcgtctggaaaagtatctatgttggaaccatttcttattctgttaattacaattagcggttttatccctctttcaaactcagtcaccgatttctgtggccaaatcactcacaataccagcttttag

SEQ ID NO: 54385 - DNA, 291 bp, Artificial Sequence
  Description of Artificial Sequence: Synthetic coding sequence
atgcctaaaaatagtaaggtggtaaaaagggaattggatgacgatgtcaccgagtccgtcaaagatctgctctctaatgaagatgccgcagacgatgcatttaagactagtgaactaatcgtggacgggcaggaagaaaaagacaccgacgtcgaagagggctctgaggttgaggatgagaggccagcttggaattccaagctgcagtacatcctggcgcaagtgggattcagcgtgggccttgggaatgtgtggagatttccatacttatgtcaaaagaatggcggttag

SEQ ID NO: 54386 - DNA, 1872 bp, Artificial Sequence
  Description of Artificial Sequence: Synthetic coding sequence
atggttatcgggattcccctgttctttttggagttgtccgtaggccagcgtattcgcaggggctccattggagtctggaactatatcagtcctaaattaggcggaatcggtttcgcctcttgcgtggtctgttacttcgtggccctctactacaacgtgattattggctggtccctgttttacttttcacaatcttttcaacagccgctcccctgggatcagtgtcctctggtgaagaatgcctcccacacatttgttgaacctgaatgtgaacaatcgtcagccacaacctactactggtatcgggaggcactgaatataagctcctcaatttcggagtcaggtgggctgaactggaaaatgaccatctgtctccttgccgcttgggtgatggtttgcctagccatgattaaaggaatacagagttcaggtaaaattatttactttagttccctctttccttacgtggttctgatttgtttcttgattcgtgcgttcttgcttaacggcagcatcgatggcatccgccacatgtttacccccaagctagagataatgctggagcctaaagtgtggagggaggccgctacccaagtattcttcgcacttggactgggcttcggcggagtgatagccttttcgagctataataagcgagataataactgtcacttcgacgccgtgctggtctccttcattaatttcttcaccagtgtgctggccacacttgtggtctttgccgttctgggtttcaaagcaaatgttattaatgagaaatgtatcacacagaacagcgagacaatcatgaaattccttaaaatgggaaacatctcacaggatataatcccccaccacatcaacctgtcgactgtcaccgccgaggactatcatctggtgtacgatatcattcagaaggtcaaggaagaggaattcccagccctccacctgaactcctgcaagatcgaggaggaactgaacaaggctgtgcaaggtaccggcctggcatttattgcttttactgaggccatgactcacttcccagcctctccattctggtccgtgatgtttttcctgatgcttgtaaacctgggtctgggatccatgtttgggaccatcgagggtatcgtgactcccattgtcgatacttttaaggtacgtaaagaaatactgacagtcatctgttgcttactagccttctgtattggcctcattttcgtccaaaggtccggtaattatttcgtgacaatgttcgacgattattctgccacgctccctttgcttattgtggtcattctggaaaacatcgccgtgtgctttgtgtacggcatagataagttcatggaagacctcaaagacatgttgggattcgctccttctaggtactattactatatgtggaaatacatctctccgcttatgctgcttagcctcctcatagcctcggtagtgaacatgggactttcccctccagggtacaacgcgtggatcgaggataaagcctctgaggaattcctgtcctatcctacctggggactggttgtatgtgtatctctggtggtcttcgcaattttacccgtgcccgtggtgtttatcgtgcgcagatttaatctgattgatgatagttctgggaacctcgcttccgtgacctataagcgcggaagagtactgaaggagcctgtgaatctagagggggacgatacctccctgatccacggcaagattccgtcagagatgcctagtccaaatttcggtaagaacatttatcgaaagcagtcagggagcccaacccttgacaccgcacccaatggcaggtacggaatcggatacttaatggcggatattatgccagatatgcccgaatccgatctgtag

SEQ ID NO: 54387 - DNA, 2211 bp, Artificial Sequence
  Description of Artificial Sequence: Synthetic coding sequence
atgaagaccgaagcccagccctcaaccagtctgttggcgaatacatcttggaccgggaccgtgattagtgattctgtgcccggaagccagacatgggaagacaagggcagtcttactaggagtgcgactagctggacatcagaagcccaggtaagtgcggcacgggtggcagaagcccaggccaggacgtcgcaaccaaaacagataagcgtactggaagccttgaccgcttctgccctgaaccagaagccaacacacgagaaggtgcaaatgaccgaaaagaaagagagcgaagtcctgctcgctcgccctttctggtcttccaagactgagtatattctagcgcaggtaggctttagcatgaagccttcatgcctgtggcgatttgcctatctttggctgaacagtggtggctgttcctttgctgcgatttacatcttcatgctgttcttagtcggcgtcccattgctcttcttggagatggccgcaggccagtctatgagacaggggggaatgggtgtctggaaaatcatcgctccatggattgggggagtcgggtactcatcatttatggtctgctttattttagggctctatttcaacgtggtgaacagttggatcatcttttacatgtcccagtcttttcagttcccagtgccatgggaaaaatgccccctaaccatgaactccagcggattcgatccagaatgcgaaagaacaacacccagcatttatttttggtatcagcaggccctgaaggcctctgaccggatcgaagacggcggaagtccagtgtattcactggtgttgcctttcttcctttgctggtgcctggtcggagcttttatgatcaacggtctgaagagcacaggcaaggtgatctacgtgctggtgttactcccctgttttattatcgtgggtttttttattcgaacactccttcttgaaggcgctaagttcgggctccagcagttggtagtggccaagatctccgatgtgtacaatatgtccgtgtggtcactcgcaggaggacaggttctttctaatacaggaatcggactcggatctgtggccagcttggcaagctatatgcctcaatccaataattgtctgtctgacgccttcttggtgagcgtgattaacctgttgacgcttctcgtattcacatcatttaacttctgcgtcctgggattctgggccactgtgatcacccacaggtgctgcgagcgaaacgctgaaatcctgttgaagctgatcaatctaggaaagttgccaccagacgctaagcccccagttaatctactttataatcctaccagtatttacaacgcttggctgtcggggttgccccagcatataaaatctatggtgctgcgggaagttaccgaatgtaacatagaaacccagtttctgaaggccagcgaggggcctaaattcgccttcctctcattcgtggaggctatgtcattccttccgccatccgtcttttggtcatttatcttctttcttatgctccttgctatgggattgtcaagtgcaattggcataatgcaggggattattaccccactccaggacacattttcatttttccggaaacacacaaagcttctgattgtgggagtcttccttctgatgttcgtgtgcgggctctttttcacacgaccatcagggagctattttatcagacttctgagtgattactggattgtatttcctatcattgtggtggttgtgttcgagactatggctgtttcttgggcttatggagccaggcggtttctggccgacctgaccatactcctcggccatcccatcagcccaatctttggctggctgtggcctcacctgtgtccggtggttctactcattattttcgtgaccatgatggtacatctgtgcatgaaaccaattacttatatgtcatgggacagctctaccagtaaagaagttctccgaccttatcccccatgggcattactgttgatgatcacactattcgctatcgtcatcctcccaatccctgcgtatttcgtctactgcagaattcacaggatacctttcaggcccaagtcaggggatggacccatgaccgcatctacatccctgccgctttctcaccagctgaccccatccaaggaagtacagaaggaagagattcttcaggtggacgaaacaaaatatccctcaacctgcaatgtaacttcctag

SEQ ID NO: 54388 - DNA, 1980 bp, Artificial Sequence
  Description of Artificial Sequence: Synthetic coding sequence
atgaagacagaggcgcagccctctacttctctgctggcaaacacaagttggaccggaaccgtgatctctgattctgttcctggaagccagacctgggaagataagggttcactaacccgtagtgcgacatcctggacctccgaggcacaggtcagcgctgctcgcgtcgctgaagctcaggccagaacgtcacagcccaaacagatctccgtgttggaagcactgaccgccagtgcactgaatcagaaaccgacccacgaaaaagtgcaaatgacagaaaagaaggagtcagaggtactccttgctcgtcccttctggagcagcaagaccgaatacattctggctcaggtcggtttctccatgaagccctcttgcctttggaggttcgcttatctctggctcaattctggaggttgtagttttgcggctatctatatcttcatgctgttcctcgtaggcgtaccgctgctgttcctggagatggcagctggccaatcaatgcgccaaggtgggatgggcgtgtggaagataatcgcaccttggatcgggggagtgggctactcatcttttatggtctgtttcattctgggcttgtattttaacgtcgtgaatagctggattattttctacatgtcccagagtttccaatttcctgttccttgggagaaatgtcccctgactatgaacagctcaggttttgaccccgagtgtgagcggacaaccccgtccatatacttttggtatcaacaggcactgaaggcaagtgaccggattgaagacgggggtagtccagtgtatagcctggttctgcctttcttcttatgttggtgcttggttggcgcttttatgattaacggacttaaatctactgggaaggtgatctacgttttggtactcttgccatgttttatcattgtgggattctttattagaaccctgctgcttgaaggcgctaagtttggcttgcaacagctggtagtcgccaagataagtgatgtatacaatatgtcagtatggtccctggccggtggtcaggtcctctcaaatacgggcatcggactgggaagtgttgcctcactcgcgtcctatatgccacagtccaacaactgtctctcggatgcctttttggtgtccgtaattaacctgctcacactgctggtgttcaccagctttaacttctgtgtgctggggttttgggcaactgtgatcactcaccgctgctgtgaaagaaacgctgagatacttctgaagcttatcaaccttgggaagctcccacctgatgcgaagccccctgtcaatcttttgtacaatcccacaagcatctacaatgcctggctttccgggctgcctcagcacatcaagtcaatggtgctgcgcgaggtaacagaatgcaacattgaaacgcagttcttgaaagcatctgagggtcccaagtttgccttcctgagctttgtcgaggctatgagcttcctccctcccagcgtcttctggtccttcatcttctttctcatgttactggcaatggggttatcctccgcgataggtattatgcagggcatcattaccccactgcaagacacattcagtttcttccggaaacataccaaactcttgattgtcggggtgttcttgcttatgttcgtctgtgggctgtttttcacccgtccttccgggtcctatttcattcgacttctgagcgactactggattgtttttcctataattgtggtggtagtttttgagactatggcagtctcttgggcctatggcgcacgtaggtttcttgccgatcttacaatcctactcgggcatcccatcagccccatctttgggtggctttggccccacctctgtccagtggtgttattgatcatatttgtaaccatgatggtgcacttatgcatgaaaccaataacttatatgtcctgggactcgtctactgtgtctctgccccaggatccggagccactctgggaatag

SEQ ID NO: 54389 - DNA, 2184 bp, Artificial Sequence
  Description of Artificial Sequence: Synthetic coding sequence
atgccaaaaaacagtaaagtaacccagcgcgagcactcttcagagcatgtaaccgaaagcgtcgccgatctgcttgcgctggaggaaccagtggactacaagcagtccgtgttaaacgtggcaggagaggcaggaggtaagcagaaggctgttgaggaggagttggacgctgaagacagaccagcctggaattcgaagctgcagtacattctcgcgcagattggattcagcgtcggcctaggcaatatctggcgttttccgtacctgtgccagaaaaacggtggcggagcctatctggttccatacctcgtcctgcttattataatcggcatccccttatttttcctcgagctggctgtagggcaaagaattcgcagagggagcattggcgtgtggcactacatctgccctcgcttgggaggaatcgggttctccagctgtatagtctgtctgtttgtcggactgtactacaatgtgatcattggatggagtatattctatttcttcaagtcattccagtatccactgccgtggtcagagtgtccagtcgtgcgaaacgggtcggtggcagtggttgaggctgaatgcgaaaagtcaagcgcaaccacatacttttggtatcgtgaagccctggacattagtgacagcattagtgaatctggcggattaaattggaagatgacactctgcctgctggtagcttggtcgattgtgggtatggccgtcgtaaaaggcatacagtcttcgggcaaggtgatgtatttcagcagcctatttccttatgtcgtactcgcctgttttctggtcagagggcttttactgcgcggagcggtggacgggattcttcatatgtttactccaaagcttgacaaaatgctggatcctcaggtgtggagagaggccgctacccaggtgttcttcgccctgggtctgggctttgggggagttattgcattcagctcctacaacaagcaggataacaattgccatttcgacgccgctcttgtctcatttatcaacttcttcacctctgtcttggcaactctggtggtttttgccgtcctgggatttaaagccaacatcatgaatgaaaaatgtgtcgtggagaacgccgaaaaaattctgggctatcttaacacaaatgtactctcaagagacctgatccccccacacgtcaacttctcgcatttaaccacaaaggattacatggagatgtacaatgtcatcatgacggttaaggaggaccagttctctgctcttggacttgacccctgcttgttagaggacgaattagacaaatctgtgcagggtactgggctcgctttcatagcctttaccgaagctatgacccatttccctgcaagccctttctggtctgtaatgttctttttgatgctgatcaacctcggtctcggcagcatgattggcacaatggctggcataaccacgccaatcattgacacgtttaaagtccctaaggagatgttcactgtcggatgctgcgtttttgctttccttgtgggcctcctgttcgtgcagaggagcggtaactattttgtgactatgtttgatgattattctgctacactcccacttaccctgatcgtgatacttgaaaatattgctgttgcctggatctatgggaccaaaaagttcatgcaggaactcaccgaaatgcttggctttaggccataccgtttttatttctacatgtggaaatttgtgagccccctgtgtatggccgtcctgactacagcttccatcatacaactcggggtaacgccaccgggttacagcgcatggatcaaggaggaggctgccgaacgctacctgtactttcccaattgggccatggcactgctgataacacttatcgttgttgccactctccctatacctgtggtgtttgtgctaaggcattttcaccttctctccgacgggtccaacactctgtcggtgagctataaaaagggacgtatgatgaaggatatttctaatttggaggaaaatgatgaaactcggttcatcctgagcaaagtacctagcgaggccccttcaccaatgcctactcatagatcatacctggggcctgggagcacgtcgccgctagagacctcagggaaccccaacggaagatacggctctgggtatctcctggctagtaccccagagtctgagctgtag

SEQ ID NO: 54390 - DNA, 2184 bp, Artificial Sequence
  Description of Artificial Sequence: Synthetic coding sequence
atgccaaagaatagcaaggtcacccagagagaacacagctctgagcacgtaacggagagtgtggccgacttgctggccctcgaggagcccgttgactacaagcagtctgtcctgaacgtggcaggagaggccggaggaaagcagaaagccgtcgaagaggagctcgatgccgaagaccgcccagcatggaatagtaagctgcagtacatcttggcccagataggttttagtgtgggacttggaaacatctggaggttcccctacttgtgtcagaagaatggtggaggtgcgtatctggttccctacctggtcctgctaattatcattggtattcccctcttctttttggaactcgccgtgggacagcggatcagacgcggttcaataggtgtgtggcactatatttgccctagattaggaggcatcggattctcaagctgtattgtgtgtctgtttgtggggctgtattataacgtgatcatcgggtggagcattttttacttcttcaagtcctttcaataccctctgccctggagtgagtgccccgtggttcggaatggatctgtggctgtggtggaagctgaatgcgaaaagagctccgccacaacttacttttggtacagagaggcactcgacatttctgattctatatcagaatcagggggactgaattggaagatgacactttgcctcctagtggcttggagcatagtgggtatggcagtcgttaaaggtatccaaagctctggcaaagtgatgtacttctcaagtctgttcccctacgttgtgctggcctgcttcctggtgcgcggtctgctcctccgcggtgccgtggacggtattctgcatatgttcactcccaaactggacaagatgctcgaccctcaggtttggcgcgaggcagctacccaggtgttcttcgccttggggctaggctttggtggggtgattgcatttagttcatataacaagcaggataacaattgtcactttgacgccgcattggttagtttcattaatttctttacctcagttttggccaccctggttgtgtttgctgttctagggtttaaagctaatataatgaatgaaaaatgcgtggtcgagaatgctgaaaagattttgggatacctgaacaccaatgtgcttagccgggacctcatcccgcctcatgttaatttctcccatctgactacaaaggattatatggagatgtataacgtgatcatgactgtgaaagaggaccaattttcagctctgggtctggatccatgtctccttgaagatgagctggacaagtcagtccagggtacaggcctggcttttatcgccttcacagaagcaatgacccacttccctgcaagccctttttggtcggtgatgtttttcctaatgttaatcaacttaggcctgggctcaatgatcgggacaatggctggcattacaacccccatcattgatacctttaaagtcccgaaagaaatgttcactgtggggtgctgcgtgtttgctttcctcgtcggtttgctcttcgtccagagatcaggcaactatttcgtcacaatgttcgacgactattctgcaactctacctttgacgcttatagttatcctggaaaatatcgctgttgcctggatctatggcaccaaaaaatttatgcaggaacttaccgagatgctgggcttccgcccttacaggttttatttttacatgtggaaattcgtaagcccgctctgtatggcagtgcttacaacggcctccatcatacagctaggggttacacctccaggctactcggcctggattaaagaggaagcagccgagaggtacctgtacttcccaaattgggcaatggccctcctaatcacgttgatagtggtggcaaccctaccaatccccgttgtgttcgtgctgaggcacttccatctgctctcagacgggagcaacaccttatctgtctcttacaaaaaaggcaggatgatgaaggatattagcaatctcgaggagaacgacgagactagatttatcctgtcgaaagtgccttctgaagcaccttcgcctatgcccacacaccgtagctacctcggccctggttcaaccagcccccttgaaacctcaggtaatcctaatggcagatacggaagtggttatctcctggccagcacaccagaaagcgagctgtag

SEQ ID NO: 54391 - DNA, 1506 bp, Artificial Sequence
  Description of Artificial Sequence: Synthetic coding sequence
atggtgcgcaagcccgtggtgagcacaataagtaaaggaggatacctgcagggaaatgtgaacggcagactgccttcacttggtaataaggaacctcctggacaggagaaggtgcaactcaaaagaaaagttacattactgcgcggagttagtatcatcattggcacaatcataggtgcagggatcttcataagccctaagggcgtgctgcagaatactggttcagtcgggatgtcacttacaatctggactgtgtgcggcgtgttgtccttatttggggctctttcctacgcagagcttggaacaacaattaagaaatccggaggccattacacatatatcctcgaggtgttcggtccacttcctgcctttgtgcgggtgtgggttgagctcttaatcataagacccgcagcaactgcagtcatctcactcgccttcggaaggtacatccttgaaccttttttcattcaatgtgagattcctgaactggcgatcaagctgattaccgcagtgggaataaccgttgtgatggtgctcaattcaatgagcgtgtcttggtctgcccgtattcagatcttcctgaccttctgcaagctgacagctatcttgatcatcatcgtgcctggggttatgcagttgataaagggccaaacccagaacttcaaggacgccttctccggcagagattcaagtattactaggctgccgttggccttttactatggtatgtacgcatatgccggatggttctatctcaatttcgtgaccgaggaggtggaaaatccggaaaagactattcccctggcaatctgcatcagcatggcaatcgtcaccattggctatgtgctgacgaatgttgcctactttactacaattaacgcagaggagcttctgctgtcaaacgctgttgctgtcaccttctccgagcgactcctgggcaattttagcctggctgtgcctatttttgtggccttaagttgtttcggctccatgaacggtggcgtcttcgctgtatctcggctgttctacgtagcctcccgggagggccatttaccagaaatattgtctatgattcacgttaggaagcacacgccccttccagcagtcattgtattgcatccgctcacaatgatcatgttgttctctggtgacttagactcccttttgaacttcctgtcttttgcgagatggctgttcatcgggctggctgtggccggtctcatttacctgcggtataagtgtcctgacatgcaccgcccatttaaagtccccttattcataccggcactgtttagcttcacctgccttttcatggtggccctctcactgtacagcgacccattcagcactgggattggctttgtcatcacgctgacaggcgtgccagcttactacctcttcatcatttgggacaagaagccacgttggtttaggattatgagcgagaagatcacacgtacgttacagatcatcctggaggtcgttcccgaggaggacaaactgtag

SEQ ID NO: 54392 - DNA, 1413 bp, Artificial Sequence
  Description of Artificial Sequence: Synthetic coding sequence
atggacaggggcgagaagattcagctgaagcgcgtattcgggtactggtggggcacttcttttctgctaatcaacattatcggtgcaggcatctttgtgagccccaaaggagtgttggcatatagctgtatgaacgttggagtgtccctgtgtgtttgggcgggttgcgccattcttgccatgactagcacgctgtgctccgcagagatcagtatcagcttcccatgttccggcgctcagtattactttttaaagaggtattttggaagcactgtcgccttcttgaacttgtggacttccctgttcttggggagtggagtggtcgccggtcaggctctgttgctcgcagagtatagtatacaacccttttttccgagttgtagcgtgcctaagttaccgaagaagtgcctcgctctcgcaatgctgtggatagtaggcatcctcaccagtaggggcgttaaggaagtgacctggttgcagatcgcatctagtgtgttaaaagtgtccattctttctttcatctctctgaccggtgtcgtgtttctcattcggggaaagaaggagaacgtggagaggttccagaatgcctttgacgctgaactccctgatatttcgcatctgatacaagctatcttccagggctacttcgcatatagtggtggagcctgctttacgctcatcgcaggcgagctgaaaaagcccaggaccaccatccccaagtgcattttcaccgcactgcctcttgtcacagtagtttacctgctcgtgaatataagctacctgacagtccttacccccagggagatcctctcgtcagatgcagtggccattacgtgggccgatcgcgctttcccatccctcgcatggattatgccatttgcgatcagtacttcactgttctccaacctgttgatatcgatatttaaatccagtcgcccaatctatttggcctctcaggaggggcagctcccattgctgttcaatacccttaactcccacagttccccgttcacagccgtgctgctacttgtcacattgggttccctggccattattctgacctccctgatcgacttgatcaactatatcttcttcaccggttctttatggagtatactactgatgatcggtattctgcgccgtcggtatcaggaacctaacctgtctatcccttataaagtgtttctgtctttcccactcgccacaatcgtgatcgacgtgggcctggtcgtcattcccttggtgaaatcccccaacgtacactacgtctatgtgttgctcttagtgctgtccggtcttcttttctacattccattaatacattttaagattagacttgcctggttcgagaagatgacgtgttatctccaactcctcttcaacatttgtttgccagatgtcagcgaggagtag

SEQ ID NO: 54393 - DNA, 1302 bp, Artificial Sequence
  Description of Artificial Sequence: Synthetic coding sequence
atggacaggggagaaaaaattcaactcaaacgagttttcggatattggtgggggacctctttcctactgatcaacatcatcggggctggcatctttgtgtctcccaagggtgtgctggcttacagttgtatgaacgtgggagttagcctctgtgtgtgggccggttgcgccatactcgcaatgacatctacactgtgttctgcggagatctcaatcagcttcccctgctcaggggcacagtactatttcctcaagcgatactttgggagcacggtcgcgtttctcaacttgtggacttccttgttccttggctctggggtggtagcgggtcaggccttgttgctggccgaatattcaatacaacccttcttcccctcctgtagtgtgccaaagctgcccaaaaagtgcttagccctggcaatgctgtggatcgtgggaattctgacttcacggggagtgaaggaagtgacttggcttcagattgccagctcagtgctgaaggtgtcaattttgtccttcatttcccttacaggcgttgtgtttttgattagaggcaagaaagaaaacgtcgagcgctttcagaacgccttcgacgctgaacttccagatatctcccatctcatccaggccatatttcagggctatttcgcttactcaggtgagctgaagaagccgcgtacaactattccaaagtgcattttcacagccctgcccctggtcaccgtcgtctacttgctggtcaacatatcctacctgacggttctgactccgagggagattctctcttcggacgccgtcgccataacctgggctgacagagctttcccttctctcgcttggattatgccatttgccatttcaaccagtctgttctctaatctcctcatctcaatattcaaatccagccgaccaatatatctcgcttctcaggaagggcagctccccttgttgtttaataccctgaacagtcacagctctccgtttaccgcagtacttctactggtgaccctaggatcgcttgccatcatacttacaagcttaatagaccttatcaactacatcttcttcaccggatctctgtggagtattcttctgatgatcggcattcttcgtagacgataccaggaacccaacctctccatcccttacaaaagcctcattcttgtcgtgcaagctggggaggctggcgttcagtggcacgatttaggacttctccagcctcttctgcccggatttaaaaggttcagctgtctgagtctgccatcttcatgggactatcgatgtttttgccatttccactag

SEQ ID NO: 54394 - DNA, 1860 bp, Artificial Sequence
  Description of Artificial Sequence: Synthetic coding sequence
atgccgtggcaggcctttcgaagattcgggcagaagctggtgcggaggcgcaccctggaatccggaatggcagaaaccaggttggcaaggtgtctgagcaccctggatctggtggcattaggggtcggctcaaccttgggcgctggcgtgtacgtgctagcaggtgaagtagctaaggataaagctggcccttctattgtgatctgtttcctcgtcgcagccctcagctctgtactggctggactgtgttacgccgaatttggggcacgcgtgcccaggtcaggttcagcctatctttactcatatgtcacagttggagagctctgggctttcacaaccgggtggaatttgattttatcctatgttatcggaaccgcgtcagttgcgagagcttggtcctcagcgttcgataatctgatcggcaatcacatcagtaagacgctccagggaagtatcgcccttcacgtcccccatgtgctagcggagtatcccgacttcttcgcactgggactcgtccttcttctcacaggcctgctcgccctgggggctagtgaaagtgcgctcgtgacaaaggtcttcactggggtcaatctgctcgtgctgggcttcgtgatgatctctggcttcgtcaaaggcgacgttcacaattggaagctaactgaagaggactacgaactcgcaatggccgaactgaacgatacgtatagtctcggcccactcggctcaggtggttttgttccttttggctttgaggggattctgcgaggggcagccacttgcttctacgcttttgtcggatttgactgcatcgccaccaccggggaggaggcccagaacccacaacgatctattccaatgggaatcgtgatctctctcagcgtctgctttctcgcttattttgccgtgagctctgcattaacgcttatgatgccttactaccaattgcagccagagtccccgctgcccgaggcattcttgtatattggatgggccccagcccgatacgtagtggccgtgggctctctgtgcgcccttagcactagcctgctgggatccatgttcccaatgcccagagtgatctatgctatggccgaggatgggctcctttttcgcgtgttggccagaattcataccggcactagaactccaattattgcaacagttgtgagcgggatcatcgcagcctttatggctttcctgtttaaactgactgacctggtggatctgatgagtattggcacactcctggcatattcccttgttagcatttgcgtgctaatcctcagatatcagccagaccaggagaccaaaacaggcgaggaggtggaactacaggaggaggcgattacaactgagtccgagaagttaacgctgtgggggcttttttttcctctgaactcaattcccacgccgctctcaggccagattgtgtacgtctgctcttctctgctggccgtcctgctgactgcgctctgccttgttctagctcagtggtcagtgccactgctgtccggagacctgctgtggaccgccgtcgtcgtactactcctgctacttatcattggtataatcgtggtaatctggcggcagccccagtccagtactcccctccatttcaaggttccagccctgccattgctaccactcatgtcaatctttgtaaacatataccttatgatgcagatgacggcgggtacatgggctaggtttggcgtctggatgctgatagggttcgccatctactttggctatggaatccaacacagtctagaagaaattaaatctaatcaacctagtcgaaaatcacgagcgaagacggtggatttagatcctgggaccctgtacgttcactccgtatag

SEQ ID NO: 54395 - DNA, 1860 bp, Artificial Sequence
  Description of Artificial Sequence: Synthetic coding sequence
atgccgtggcaggcctttcgcagatttggacagaagctggtgcgcagaaggacactggaatctggtatggccgagacaagacttgcccgttgcttgtccacacttgatcttgtggctctgggtgtgggctcaactcttggtgccggagtttacgtgcttgccggagaagtggccaaggataaggcaggcccatccatcgttatctgttttctcgtcgccgcactctcgagcgtgctggccggattatgctatgcagagtttggcgctcgagtcccgagaagtggaagtgcctacctgtattcatatgttaccgttggcgaactatgggccttcactaccggctggaacctgattttgagttacgtgattggcacggcatccgtggcacgcgcttggagcagcgcctttgacaatctgatcggtaaccatatttctaagacgctgcaaggaagcatcgcactgcacgtacctcatgtcttggccgagtatccagatttcttcgcccttggtctcgtgctgctattaacaggcttactcgccctcggcgctagcgaaagcgcacttgtgacaaaggtattcacgggggtgaacctactggtgcttggctttgtgatgatctctggtttcgtcaagggcgatgtgcacaattggaagctgactgaagaggactacgagcttgccatggccgaattaaacgacacatattctctgggcccactgggatccgggggttttgttcctttcggctttgaggggattctgcgtggggcagcgacctgcttctatgctttcgtaggctttgactgcatcgccactaccggtgaggaagcccagaacccacagcgatcaatcccgatgggcatagtgatctctctttctgtctgctttctggcttattttgcagtgtcatcagccttgacactcatgatgccctactaccagctccagccagagagccctctaccggaggcctttctgtatatcggatgggccccagctagatacgtggtagccgtgggaagtctgtgtgccttatctacttcactccttgggtcaatgttccccatgcctagggtgatctatgccatggctgaagatggcctgctgttcagagtattggctcgcattcataccggcacaagaacccccattatcgctaccgtggtgagtgggatcatcgcggcattcatggcgtttctgtttaagctcactgatctggtcgatctcatgtccatcggcaccttgctggcttatagcctggtgtctatttgcgtgctgatcctgaggtaccagcccgatcaggagaccaagaccggggaagaggtggagctgcaggaggaagctatcaccaccgagtcagagaagctcacgttgtggggcctttttttccctcttaatagcattcctacgcctctgagcggacagatagtctacgtttgttcctccctgttagccgtactactgaccgcactgtgtttggttctcgcccagtggtctgtaccactactatccggcgatctcctgtggacagcggtcgtggtgctgttgctgctgttgatcatcggaatcatcgtagtaatttggagacaacctcagtccagcactcccctgcacttcaaagttcccgcactccccctccttcctctgatgagcatcttcgtgaatatctatcttatgatgcaaatgacggctgggacgtgggccagatttggagtctggatgctgatcgggtttgctatttactttgggtatgggatccagcactctctcgaagagattaagagcaaccagccctctaggaagagcagggctaagactgtggatctagatccaggaaccctgtatgtgcatagcgtgtag

SEQ ID NO: 54396 - DNA, 1572 bp, Artificial Sequence
  Description of Artificial Sequence: Synthetic coding sequence
atggcaggtcacactcaacagccatccgggaggggaaacccacgtcctgccccaagcccttctcctgtcccgggtacagtgcctggtgcttccgagcgggttgcactgaagaaggagataggcctgctgagcgcctgtacaattataattggcaatatcatcgggagtgggatctttattagccccaaaggagtgctggagcactctggaagtgtagggttggccctgtttgtatgggttctgggcggtggggtcaccgcacttggttccttgtgctacgccgaactgggggtcgcaattcccaagtccggcggtgactatgcttatgtgacagaaatttttggcggtctggcaggctttttgctcttgtggtctgctgttctgattatgtacccgacaagcctggctgtgatctctatgaccttctctaactatgtccttcaaccagttttccccaattgcattcctccaactactgcctcccgggtgctctcaatggcttgtctgatgctcctgacgtgggttaattccagctctgtccgctgggcaacccgcatacaggacatgtttaccggaggaaaactgcttgcactgagtctcattatcggagtgggactgctccagatattccagggccatttcgaagagttgcgccctagtaacgccttcgccttttggatgacaccatctgtgggccatttagccctggctttcctacaagggagcttcgcgttctcgggctggaacttcctgaactatgtgacagaggaaatggttgatgctcggaaaaacctgccgcgtgcgatcttcatctcaattccactggtcacatttgtgtatacctttacaaacattgcatacttcacagcaatgtcgccccaggagctccttagctccaatgccgtcgccgtgacttttggcgaaaaattactgggatacttcagctgggttatgccagtgtcagtggcactctcgaccttcggagggataaatggctatttgtttacatactccagactttgcttctctggtgccagagagggccatctgccttcacttctcgccatgatccacgtgaggcactgtacccctataccagcgctcctggtttgctgcggagcaacggccgttattatgctagtcggggacacttatactctcatcaactacgtctcctttatcaattacctttgttacggtgtaactatattgggtctgctgctgttgcggtggagacgccctgcactgcatcgccctatcaaggtgaacctcctcattccagtcgcatatttggtcttctgggcctttctgcttgttttctctttcatcagtgagccaatggtctgtggcgtgggcgttatcataatactgaccggagtgcctattttctttctcggagtgttctggcgtagtaaaccaaagtgcgtgcatcgactcaccgaaagcatgacccattgggggcaagaactatgttttgtggtctatccacaggatgcacctgaagaagaggagaacggaccatgtcctccaagtcttttgcccgctactgataagcctagcaaaccccagtag

SEQ ID NO: 54397 - DNA, 1080 bp, Artificial Sequence
  Description of Artificial Sequence: Synthetic coding sequence
atggcccctaacggaactgcttctagtttttgcctcgactctaccgcgtgcaaaatcaccatcactgtggttctcgctgttcttatcctgatcaccgtcgccggtaacgtggtggtatgtctagcggtgggtctcaatagacgactgcgaaatttaacgaactgttttatagtgtccctggctatcacagacctgttgctcggattactggtgctgcctttctccgccatttatcagctgtcctgcaaatggtcttttgggaaagtcttctgcaacatctacaccagcctggacgtcatgctgtgcaccgcatccattctcaaccttttcatgataagcttagaccggtactgcgccgtgatggaccctctgcgctaccctgtgctcgtaactcccgtgagggtggcaataagcctggttctcatctgggttatctccataactctttcttttctctcgatccatttaggctggaattctaggaacgagacgtcgaaaggcaaccataccacctcgaaatgcaaggtgcaagttaatgaagtatacgggctagtggacgggctggttactttctacctacctctgctgattatgtgtatcacatattaccgaatcttcaaagtggccagagaccaggctaagcggatcaatcatatcagtagttggaaggccgcaaccataagggaacacaaggccaccgtcactctggccgcagtgatgggtgcatttattatatgttggttcccttattttacagccttcgtatacaggggcttgcgtggcgacgacgccataaatgaagtcctggaagcaatcgtgctttggctcgggtacgccaactccgctctgaatcctattttgtacgccgctctgaaccgagactttaggaccggttaccagcagctcttctgttgcaggctggccaatagaaattctcataagacatctcttcggtcaaacgctagtcagttgagccgcacacagtcaagagaaccgagacagcaggaggagaagcccctaaaacttcaagtgtggagcgggactgaggtgaccgctccacagggtgcaaccgaccgctag

SEQ ID NO: 54398 - DNA, 1296 bp, Artificial Sequence
  Description of Artificial Sequence: Synthetic coding sequence
atgagcgttaacgtcaatcgctctgtatctgaccaattctaccgctataagatgccaaggctcatcgccaaggttgaaggcaaaggaaacggcattaagaccgtgatcgtgaatatggtggacgtcgctaaggcattaaatcggccacctacttatcccaccaagtactttggttgcgaactgggagcccagactcaatttgatgtgaagaatgatcgctatattgtgaatggcagccatgaagcaaacaagctacaggacatgctggacggcttcattaagaagtttgtgctgtgtccagagtgtgagaatcctgaaacagacttacatgtgaatccgaaaaaacagaccattgggaactcctgtaaggcgtgcggctaccgcggaatgttagacactcaccacaaactgtgcacattcatcttgaagaaccctcctgagaacagtgactcagggacaggcaagaaggagaaggagaaaaagaaccggaagggaaaggataaagagaatggctcagtaagctcgtcagagaccccaccccctccacccccaccaaatgagatcaacccacctcctcatacaatggaagaggaggaggacgatgactggggtgaggataccactgaggaagcccagcggcgacgcatggatgagattagcgaccacgccaaagtgctgacacttagcgacgaccttgaacggactattgaggagagagtaaatattcttttcgactttgtcaagaagaagaaagaggaaggcgttatcgactcaagcgacaaggagatcgtggcagaagcggagcgcctcgatgttaaagctatgggaccacttgtgctgactgaggtgctgtttaacgagaagattagggagcagatcaagaagtaccgtcggcattttctccgcttctgccataacaacaaaaaggctcaaagatatctcctccatgggcttgagtgcgtagttgccatgcaccaggcccagctgattagcaagattcctcacatcctgaaggagatgtacgacgctgatctgctggaggaagaagttataatttcttggtcagagaaagccagcaagaagtatgtgtccaaggagcttgcgaaagagatcagagtcaaagctgagccctttattaaatggctgaaggaagccgaggaagagtcctctggtggcgaggaggaggatgaagacgaaaacatcgaagtcgtctactcaaaggctgcctccgtacccaaagtggaaacggtgaagtccgataacaaagatgatgatattgacattgatgccatttag

SEQ ID NO: 54399 - DNA, 2766 bp, Artificial Sequence
  Description of Artificial Sequence: Synthetic coding sequence
atggcatggctgcggctccagcccctgacgtcagcttttctgcattttggcctagttaccttcgtgctgtttctgaatggcctacgggcagaagcagggggttccggggatgtcccaagcactggccagaataacgagagctgctctggtagctctgactgtaaggagggcgttattttacccatctggtaccccgagaacccctccttgggcgataaaatcgcccgtgtcattgtgtattttgtggctctgatctacatgtttttgggtgtgtccattattgctgacagatttatggcctctattgaagtgatcacctctcaggaaagggaggtgaccattaagaagccgaatggggagacgtcaaccacaacaatccgggtgtggaacgagactgttagtaacctgactctgatggccctgggcagctcagctccagagatccttctgagtttgatcgaggtatgtggacatggatttattgctggtgatctagggcctagcacaatcgtcggatcagctgctttcaatatgtttatcataatcggaatttgcgtttacgttatccctgatggtgagacgcgcaaaattaaacacctgcgtgtgtttttcattaccgcggcttggtctatttttgcctacatctggctctatatgatcttggcggttttctcccctggcgtcgtgcaggtttgggagggtttacttacattgttcttctttcctgtgtgtgtgctgctcgcctgggtcgcagataaaaggttactgttttataagtacatgcataagaaataccgaaccgacaagcatcggggtataatcatcgagacggagggggatcaccccaaagggattgagatggacggcaaaatgatgaattcacatttcctcgatggcaatctcgtgcccctggaaggcaaggaagtggacgaatccaggcgcgagatgataaggatcctcaaggacctgaagcagaagcacccagaaaaagatcttgaccaactcgtcgaaatggcgaattactatgccctatctcaccagcagaagtctcgcgctttctacagaatccaggccaccagaatgatgaccggggcaggtaacatcctgaaaaagcacgccgctgagcaggccaaaaaggcaagtagtatgtcagaagtgcataccgatgagcctgaggatttcattagtaaggtgttttttgacccatgttcttaccagtgtcttgaaaactgtggcgctgtgttgctaactgtagtcaggaaaggcggtgatatgagtaaaaccatgtatgtcgactataaaaccgaggacgggtctgctaacgcaggggcagattacgagtttactgagggaactgtcgtgctaaaacccggagaaacacaaaaggagttttcagttgggatcatcgatgatgatattttcgaagaagatgaacattttttcgtgaggttatcaaacgtgagaattgaagaggaacaaccagaagaggggatgcccccagccatattcaactccctgccattgccaagggctgttctggcctctccatgcgttgctacagtcactatcctggatgatgaccacgccggaatcttcactttcgagtgcgacaccatacacgtgagcgaatccatcggcgtgatggaagtaaaagtactgcggactagcggcgcaagggggactgttattgtgcccttcaggacagttgagggcaccgccaaaggcggaggggaagattttgaggacacttacggtgagctcgaattcaagaatgacgaaaccgtcaagaccatacgggtcaagatcgttgatgaggaagaatacgagcggcaagagaacttcttcattgctctcggcgaacccaagtggatggagcggggaatcagcgatgtaaccgatcggaagctgactatggaggaggaagaagccaaaagaattgccgagatgggtaagccggtccttggcgaacatcccaaattggaggttatcattgaagaaagttacgagttcaagaccacggtggacaaactaattaaaaaaaccaacctggccctggtggttgggacacattcgtggagggatcagtttatggaggcgataaccgtgtcagctgctggagatgaggacgaagacgagagtggggaggagcggttgcccagctgctttgactacgtgatgcatttcctgaccgtgttctggaaagttctgttcgcgtgcgtgccccctactgaatattgtcacgggtgggcctgctttgctgtgagtatcctaatcatcggcatgctgacagcaatcataggtgatttggccagccatttcggatgtaccatcggccttaaagactcggttaccgctgttgtgtttgtagcattcggtacgtctgtgcccgatacctttgccagtaaggccgcagccctgcaagacgtgtacgcagatgcgagcatcggaaatgtgaccgggtccaatgctgtaaatgttttcctgggaattggcctagcgtggagtgtagccgctatctactgggcactgcaaggccaagaatttcatgtgtctgcaggcacgttggcttttagcgtaactctcttcacaatctttgcattcgtatgcattagcgtactgctatatcgcaggcggccacatctgggtggagagctgggcggacccaggggatgtaaactggcaaccacctggctcttcgtctcactgtggttactgtatattctttttgctactctcgaagcttattgctacattaaaggcttttag

SEQ ID NO: 54400 - DNA, 2778 bp, Artificial Sequence
  Description of Artificial Sequence: Synthetic coding sequence
atggcctggctgcggctccaacctttaaccagcgcttttctgcacttcgggttggtaacttttgtgctgttcctgaatggcctgcgagcggaggctggaggatccggagacgtgccttcaacgggccaaaacaatgagtcctgctctggaagctcagattgtaaagagggcgtgatcctgcctatatggtacccggagaacccaagccttggtgataaaattgctcgggtgattgtgtatttcgtcgccttgatttacatgttcctgggggtgtcaattattgccgatcgttttatggcctccattgaagtcatcacctcccaagagagggaggttacgatcaaaaaacctaatggtgaaacttcaacaaccaccatcagagtctggaacgaaaccgtgtcaaacttaacccttatggccctgggcagctctgccccagagattctcttgtcgctgatagaggtgtgcggccatggctttattgccggtgatctgggcccaagtactattgtaggctctgccgcttttaacatgttcatcattatcggcatctgcgtgtatgttataccagacggggaaacacgcaaaatcaagcacctgagagttttctttatcaccgccgcttggagcatcttcgcctatatttggctatatatgattcttgccgtattctctccgggagtggtgcaggtatgggaaggcctgctgacactatttttctttcccgtgtgtgtgcttctggcctgggtcgcggataagcgcctactgttctacaagtacatgcacaagaagtaccgcaccgacaaacaccggggtattatcatagagaccgaaggagatcaccccaaaggtatcgagatggatggaaagatgatgaatagccacttcctagacgggaatttggtgcctcttgaaggcaaagaagtcgatgagtctcggagagagatgattcgcattctcaaagatttgaagcagaaacatcctgaaaaggatttggatcagctggtcgaaatggccaattattatgcgttgtcacatcagcagaaatccagagctttttatcgcatacaagccacccgcatgatgacgggggcaggaaacatcctgaaaaaacatgctgctgaacaggccaagaaagcatcctctatgagcgaagttcacacagatgaaccagaggatttcatcagtaaagtgttcttcgatccctgcagttaccaatgtctggaaaattgtggtgcagtgctcctcaccgtagttcggaagggaggtgacatgagcaagactatgtatgtagattataaaacagaggacggcagcgctaacgccggtgccgactatgagtttacagaaggcaccgtagtgcttaagccaggggaaactcagaaggaattctccgtgggaatcattgacgatgatatctttgaagaggatgaacatttcttcgtaaggctctccaatgttcgaatagaagaggagcagcccgaagaaggtatgcctccagcgatctttaactccctgcctctgccaagggccgttctcgccagtccctgtgtggctacagtaactatcctcgacgacgaccatgctggcattttcacatttgagtgtgacaccatacatgttagcgaaagcataggtgtgatggaggtaaaagtgttgcgaacgtctggagcgaggggaactgttattgtaccctttcgtacggtggagggcacagccaaggggggaggcgaagattttgaggacacttacggcgagctggaattcaaaaacgacgagactgtgaaaaccattcatatcaaggtgatcgatgatgaggcatacgagaaaaacaaaaactactttattgaaatgatggggcctaggatggtggacatgtcatttcagaaggccctgctcctctcaccagatcggaagctgacaatggaagaggaagaagctaaacggattgccgaaatgggaaagcctgtactaggcgaacatccaaaactggaggtgattatcgaagagagttacgaattcaaaacaacggtagataaactgatcaagaagacgaatcttgctcttgtggttggcacacactcatggcgtgatcagtttatggaggcaattaccgtgtccgctgccggagatgaggacgaggacgaatcgggtgaggagaggcttccctcctgctttgattacgtcatgcattttctgaccgtattctggaaggtcctcttcgcctgcgtgcccccaacagagtactgtcatggctgggcctgttttgccgtcagtattctgatcatcggtatgcttaccgcaatcatcggagatctggcgtctcattttggttgcaccatcggcctgaaagactccgtgacagcagtggttttcgtggctttcggtacttcggttcctgacaccttcgcctctaaagcagcggctctgcaggacgtgtatgccgatgcctcgatcggcaacgtcacaggctctaacgccgtgaacgtgttcctcggaatcggtttagcatggtcagtggccgctatttactgggctctccaggggcaagagttccatgtcagcgccggtacattggccttctccgtcaccctgtttacaatctttgcattcgtgtgcataagcgtgctgctttatagaaggcgacctcatctggggggtgaattaggagggccaagagggtgtaagctcgccacgacctggctgttcgtgtcattgtggttactgtacatactgttcgccacactggaggcgtactgctatatcaaagggttttag

SEQ ID NO: 54401 - DNA, 2784 bp, Artificial Sequence
  Description of Artificial Sequence: Synthetic coding sequence
atggcttggctgcgactgcaacccctgacctccgcctttctgcatttcggcctggtgactttcgtgctttttctgaatgggctaagggccgaggcaggcggtagtggggacgttcctagcacaggacagaacaatgaatcgtgttccggctcgtctgattgcaaggagggagtgattctgcctatatggtatccagagaatccttccctgggagacaaaatcgcaagggtcattgtctattttgttgctctgatttacatgttcctgggcgtgagtataatcgcggataggttcatggcaagcatcgaggtgattacatcccaagaaagagaggtcacaattaagaagcctaatggcgagacttctacaaccaccattagagtctggaacgagacagtgtctaacctgacactgatggccctggggagctctgccccagaaattttactctccctgatagaggtttgcggacacggatttattgccggagatctggggccatccacaattgtcgggagcgctgctttcaatatgttcatcattatcggcatatgcgtttacgtgattccggatggcgaaacgcgcaagatcaagcatctgcgcgtctttttcatcacagccgcttggtccatttttgcttatatttggctgtatatgattttggctgttttctctcctggagtcgtacaggtctgggagggcttactgacactcttcttcttccctgtctgtgtacttctggcatgggtcgctgataaaagacttctgttttataagtatatgcataaaaaatatcgaactgacaaacaccgtggaatcatcatcgagactgagggcgatcaccctaagggaatagagatggacgggaagatgatgaattcacattttctcgacggcaacctggttcctcttgagggaaaggaagtggacgaaagtcgtcgggagatgatccggattcttaaggatcttaaacagaaacatccggaaaaagacctggaccagcttgtcgaaatggccaattactacgctctgagccaccagcagaaatctcgtgcattctaccgcatacaagccacccggatgatgacgggcgcaggtaacattctgaagaagcacgccgctgaacaagccaagaaagcgagttctatgagcgaggtgcacaccgacgaacctgaagactttatctcaaaagtcttttttgatccttgttcctaccagtgtctggagaactgcggtgctgtcctactgaccgtggtgagaaaaggcggagacatgtcaaagactatgtatgtcgattacaagactgaagatggaagcgccaatgcaggtgctgattatgaatttacggagggcaccgttgtgctgaagcccggtgagactcagaaggagttctcagtgggcattatcgatgatgacatattcgaggaggacgagcacttttttgtgcgcctgtctaacgtgcggatcgaggaagaacagccagaggagggcatgccgccagctatctttaattccctgcctctcccacgggctgtgctggcctctccgtgcgtcgcaaccgtgacaatcctcgacgacgaccacgctggaatttttacctttgaatgcgacaccatccatgtgtctgaatccatcggagtgatggaagtgaaggttcttcgaacatccggcgctaggggcacggtgatagtacccttccgaacggtggagggcaccgcaaaggggggaggcgaagattttgaagacacctacggcgaattggaattcaagaatgacgaaaccgtgaaaacgatcagagtgaagatcgttgacgaagaggagtacgaacggcaagagaactttttcatcgctttgggcgagcccaagtggatggaacgcggaattagcgccctcctcctgtcgccagacgttactgatcgtaaactcaccatggaagaagaggaggcaaagaggattgccgaaatgggcaagcctgtactcggcgaacatccaaagttggaggtgatcattgaggagtcctacgaattcaaaaccacggtggataaattgatcaagaaaaccaatctggccctggttgtggggacacacagctggcgggaccagtttatggaggccattacagtgagcgccgcaggcgatgaggacgaagatgaaagcggcgaggagagactgccaagttgttttgactacgtgatgcattttctgactgtattctggaaggtgctctttgcgtgtgtgcctcctaccgaatattgccatggttgggcgtgtttcgcagtaagtatcctcataatcggaatgctcaccgccatcatcggggatctggcttcacattttggctgcacgatcgggctgaaggactccgtgactgccgttgtcttcgtggcctttggcacttctgttccagacacattcgctagcaaagcagctgccctgcaagacgtgtacgcagacgcatcaattggtaatgtgaccggcagcaacgcggttaatgtattcctggggataggactggcctggtccgtggctgccatctattgggcattgcagggacaggaatttcatgtcagtgctgggaccctcgccttcagcgtgaccctgttcactatttttgctttcgtgtgtatctctgtgcttttgtaccgtcgaaggccacatcttggaggcgagctggggggtccccgtgggtgcaagctcgccaccacttggctcttcgtttcattgtggctgctctatatactgtttgctaccctggaggcctattgttatatcaaaggattttag

SEQ ID NO: 54402 - DNA, 855 bp, Artificial Sequence
  Description of Artificial Sequence: Synthetic coding sequence
atggaggaggaagaggccaaacgcattgccgagatggggaagcccgtcctaggcgaacacccaaagttagaagtcattatagaagaaagctacgaattcaagacaaccgtggacaaactgatcaagaaaactaacttagctttagtcgtggggacgcatagctggagggaccagtttatggaagctatcacagtctccgccgcaggggacgaggatgaagacgaatcaggcgaggaacggctacctagttgcttcgactacgttatgcacttcctcaccgtgttttggaaggtgcttttcgcatgcgtgcctcccactgagtactgtcacgggtgggcatgttttgccgtcagcatactcattattggcatgctcaccgccattatcggcgatttggcctcccatttcggctgcacgatcggtctgaaggattccgtgacagcagtcgtgtttgtagcttttggcacatcggtccccgatacttttgctagcaaggctgcagctctccaggacgtgtacgccgacgcctccatcggtaacgtgacaggctctaacgctgtcaatgtattcctcggcatcggcctggcatggtctgttgccgctatctactgggccctccagggccaagagttccacgttagcgctgggaccttggccttcagcgtaacattgtttacaatcttcgcttttgtgtgcatcagtgtgcttctctataggcggaggccccaccttggaggagagttggggggaccccgtggttgtaagctggcaacgacctggctgttcgtgagcctatggctcctttacattctcttcgcaacgttggaagcttactgttacataaaaggtttctag

SEQ ID NO: 54403 - DNA, 1863 bp, Artificial Sequence
  Description of Artificial Sequence: Synthetic coding sequence
atggcgtggctccgcctacaacccctaactagcgcctttctgcactttggccttgtgacattcgtgctgttccttaacggattgcgggctgaggctggaggaagcggagacgtgccctccactgggcaaaataatgagtcttgctctgggtcttccgactgcaaagaaggagtgatactacccatttggtaccccgaaaacccttcactgggcgataagatcgccagggtgatcgtttatttcgtggctctcatttacatgttcttgggcgtcagcattatagctgatcgcttcatggccagcatcgaagtgatcacttcccaagaaagagaggtcacaattaaaaaacccaatggtgagacttccacaaccaccattcgagtgtggaacgagacagtgtccaatcttacgctgatggctctcggatcaagcgcacctgaaatattgctgagcttaattgaggtctgtgggcatgggttcatcgccggtgatctgggacctagcacgatagttgggtctgcggcatttaacatgttcattatcattggaatctgcgtctacgtcatcccagacggcgaaactagaaagattaaacatctccgagtgttttttattacagctgcatggagtatcttcgcatacatctggctttacatgatactggcagtcttttctccaggagtggtccaggtgtgggaagggctcctcactctcttcttttttccggtttgtgttctcctggcctgggtagctgataagaggctcctgttctataagtacatgcacaaaaaatacagaacggacaaacatagaggtatcataatagagacggagggtgatcatcccaagggcatcgagatggacggaaagatgatgaacagccatttcctagatggaaacctggtccccctcgagggcaaggaggtggatgagtcccgacgcgaaatgattcgcatcctaaaggatctgaagcagaagcaccctgagaaagacctggaccagctcgtagagatggcgaactactacgcactctctcatcaacaaaagtcccgggctttctaccgcatccaagctacacggatgatgactggagctggcaatatcctaaagaagcacgctgccgagcaggcgaagaaggcctctagcatgtctgaagtgcacactgacgaaccggaggacttcatcagtaaggtctttttcgatccttgttcataccagtgcctcgaaaactgtggggctgtgcttctgacagttgtgagaaaagggggtgatatgtccaaaacaatgtatgtggattataaaacggaagacggctccgccaatgcaggggctgattatgagttcaccgaaggcactgtggtattgaaacctggggagacccagaaggagttcagtgtggggatcatcgatgatgacatctttgaggaagacgaacacttctttgtgcggctgagcaacgtgcggatagaggaagaacagcccgaagaggggatgccacctgccatattcaattctctacctttacctcgtgcggtcttggctagcccctgtgtcgcaaccgtgaccatacttgatgacgatcacgcaggcattttcacattcgagtgcgacaccattcatgtgtcggagtcgatcggggtgatggaggtgaaagttttacgcacttccggagccaggggaacggtgatagttccttttagaactgttgaaggaaccgctaagggaggcggagaggacttcgaggacacatatggtgagctggaattcaaaaatgacgagacagtgtgcgacaggcaggaggcggactatggtcgcaggggtggccaggaagactctcgtgacggcaaggcttctatcggctag

SEQ ID NO: 54404 - DNA, 2778 bp, Artificial Sequence
  Description of Artificial Sequence: Synthetic coding sequence
atggcctggctacgcctgcagccgcttactagcgcatttctccacttcggccttgttactttcgtgttgttcctcaacggtctaagggctgaagccggaggctctggggatgtgcccagtacgggccagaacaacgagtcttgttcaggatcctccgactgcaaggagggagtgatcctccctatttggtatcccgaaaatcccagccttggcgacaaaatcgccagggtgatagtctatttcgtcgctctgatttatatgttccttggggtaagcattatcgctgataggttcatggcgtccatcgaggtgattacctcccaggagagagaggtcactataaaaaagcctaatggagagacgtctacaacgaccatccgggtgtggaatgagactgtttccaacctgaccctgatggctctgggctcatcagccccagagattcttctctccctcatagaagtgtgtggccacgggttcatagcaggtgacctggggccatccactatcgttggcagcgctgcgttcaacatgttcatcattataggcatctgtgtctatgtgatccccgacggcgaaacccggaagataaaacacctgagggtattcttcattaccgctgcctggagcattttcgcatacatttggctctacatgattctggccgtgtttagtccgggagtggtgcaggtatgggaagggttactgactctgttttttttcccagtctgtgttttactggcctgggtggccgacaagagacttctgttttataaatatatgcataagaagtatcgtactgacaaacatagaggcatcatcattgaaactgaaggcgatcacccaaagggcatcgagatggatggcaagatgatgaactcacattttttagacggaaacctcgtccctctggaggggaaagaggtggacgaatcgagaagagagatgattcgcatcctgaaagacttgaagcagaaacatccagagaaggacttagatcagctggtggaaatggctaattattatgccctgagtcaccagcagaaatccagagcattttacaggattcaggctacacgcatgatgactggcgctgggaacatactgaaaaagcatgccgcagagcaggctaagaaagcttccagcatgtcggaggtgcacaccgacgaacccgaagactttatcagcaaagttttttttgatccgtgctcctatcagtgcctagagaattgtggagcagtgctcctgacagtggtccgcaagggtggcgacatgagcaaaacaatgtatgttgactacaaaaccgaggatggctccgctaacgctggcgcagactatgagttcactgaaggcacggtggtgttgaagcccggagagacccagaaagagttttcggtgggaattatcgacgacgacattttcgaggaggatgagcactttttcgtgcgactctctaatgtgcgcattgaggaggagcagccagaggagggtatgcctcctgctatattcaatagcctacctttgcccagagccgtgctggcttccccttgcgtcgctaccgtcactatcctcgacgacgaccatgcgggtatctttacattcgaatgtgacacaattcacgtcagcgaaagcatcggagtaatggaggtgaaagtcctccgaactagtggagcgcgaggaaccgtgattgtgcccttccggactgtggaaggaacagccaaaggtggaggggaggatttcgaggacacctacggcgaactggaatttaagaacgacgagacagtaaaaaccattcacattaaggttatcgacgacgaggcgtacgaaaaaaacaagaattacttcatcgaaatgatgggaccacggatggtggatatgtcattccagaaagccctgcttttgtccccagacaggaaactaactatggaagaggaggaggcaaagcggatcgccgaaatgggcaagcccgtcctcggggaacaccctaagctcgaggttatcatcgaagagtcatatgagttcaaaacaacagtggataaattaatcaaaaagacaaacttagccctggtggtgggcacccattcctggcgggaccagtttatggaagcgatcaccgtgtcagctgcaggcgatgaggacgaagatgagagcggcgaagaacgtctgccaagttgctttgattacgttatgcatttccttaccgtattctggaaggtcttgttcgcatgtgtgccacccacggagtattgccacggttgggcctgtttcgctgtctctatcctaattattggaatgctgactgccattatcggagatcttgccagccattttggctgcactatcgggttaaaagattcagtgactgctgttgtattcgttgcctttgggactagcgtgcctgacacatttgcgtcaaaggctgctgctctccaagacgtgtatgcagacgctagtataggcaacgtgacaggatctaacgccgttaacgtctttcttggtattggcctggcctggtcagtcgcagccatctattgggctttgcaggggcaagaattccatgtgtctgccggtacgctcgcctttagtgttaccctgttcacgatcttcgcatttgtgtgcatctcagtgctgctgtaccggcgacgccctcacctgggcggtgagctcggcggacctcgtggatgcaagctggccactacctggctatttgtgtccctttggctcctttatattctattcgcaaccttagaggcctactgctacatcaaggggttctag

SEQ ID NO: 54405 - DNA, 2775 bp, Artificial Sequence
  Description of Artificial Sequence: Synthetic coding sequence
atggcatggctgagactgcaacctttgactagcgcttttctacatttcgggctggtgacttttgtcctctttctcaatggcctgagagccgaagccggagggtccggcgacgtgccatccaccggtcagaataatgagtcctgctcagggagctctgattgcaaggagggcgtaatccttccgatctggtacccagagaacccctcccttggggataagattgcccgtgtgatagtgtatttcgtggcgctcatctacatgtttctgggagtgtctatcatagctgatcggtttatggctagcatcgaagtgataactagccaggagagagaggtgacaattaagaaacccaacggcgagacaagcactacaactattcgcgtgtggaacgaaacagtctctaatctgacccttatggcactggggagcagcgccccagaaatcctgctctccttgatcgaagtttgcggacatggctttattgcaggcgacctcggaccctctactatagtaggttccgctgccttcaacatgttcatcattatcggtatatgtgtgtatgtgattcctgatggagagacccgaaaaatcaagcatctcagggtattctttatcacagccgcatggagcatattcgcatatatctggctttacatgatcctggcagtattcagccccggagtagtccaagtttgggaaggactcttgactcttttcttctttcccgtatgcgtgcttctggcctgggtggccgataaaaggctgctcttctacaagtacatgcataaaaagtatcgcaccgataagcacaggggaataattatcgaaacagaaggcgaccatccgaaaggcatcgagatggatgggaagatgatgaatagtcactttttggatggcaatttggtccctctggagggaaaggaagtggatgaaagcagacgcgagatgatcagaatcctgaaggacctcaaacagaaacaccctgaaaaggatcttgatcaactggtggaaatggcgaattattacgccctgtctcaccagcagaagtctcgcgcattctacagaatccaagctacaagaatgatgaccggggcaggcaatatcttgaagaaacacgcagcagagcaggccaagaaggcttccagcatgagcgaggtgcatactgatgagcctgaagatttcattagcaaagtgttttttgatccctgctcataccagtgccttgaaaactgtggtgcggtattactgaccgtcgtgagaaaagggggagatatgtccaaaaccatgtatgtggactacaagaccgaggacggctcggcaaatgcaggagctgattacgagttcaccgaggggacagtggtcctgaaaccaggagagacccagaaagagttttcagtggggatcattgatgatgacatttttgaggaagacgaacacttcttcgtgaggctgagtaacgtgcgcatcgaagaggagcagcctgaggaggggatgccccctgcaatattcaattcccttcctcttcctagagccgttctggcgtcaccctgcgtagccacagtgaccatactcgatgatgatcacgcgggaatcttcacattcgaatgcgacacaattcatgtgtcagaatctatcggcgtcatggaggtgaaagtgttgcggacatcgggggctcgaggcactgtaattgtgcccttccgtacagtggaggggaccgcgaaaggaggcggagaggacttcgaggacacttatggggaattagaatttaaaaacgacgagaccgtgaagaccataagggtgaaaattgtcgatgaagaagaatatgagcgccaagaaaacttctttattgcccttggggagccaaagtggatggagcgcggtatctccgcccttctgctgagcccagatagaaagctgaccatggaggaggaagaagccaagaggattgctgagatgggtaagcctgtcctgggtgaacaccccaagctggaggttataatcgaagaatcctacgagtttaaaaccaccgtcgataaactcatcaagaaaaccaatcttgctctggttgtcgggacccatagttggagggaccagtttatggaagcaatcacagtgagtgccgcaggcgatgaggatgaagacgaatcaggagaagagagactgccctcttgtttcgactatgttatgcactttttgactgtcttctggaaggtgctgttcgcctgtgtccccccaacagagtattgtcatggatgggcatgtttcgctgtcagcattcttattatcggaatgctgaccgcaattatcggagatctggcgagccattttggctgtacaatcggattgaaggatagcgtgactgccgtggtgtttgtggcatttgggacgagtgttccagacacatttgcctccaaagcagccgctttgcaggacgtttatgccgatgcatcaatcggcaacgtaacggggtcaaatgctgttaacgtgtttttagggatcggcctggcctggtctgtggcagctatttactgggcactgcagggccaggagtttcatgtgtccgccggtacactcgccttctcggtgacactcttcactatcttcgctttcgtgtgtatttctgtgcttttgtaccggagaagaccacatcttgggggagaactgggaggccctaggggatgcaaactcgccactacctggttattcgtcagcctgtggctgctgtacatcctcttcgctacgctcgaggcctactgctatatcaaaggattctag

SEQ ID NO: 54406 - DNA, 3375 bp, Artificial Sequence
  Description of Artificial Sequence: Synthetic coding sequence
atgtcatcatatttttgggctcagaatgagtcaaaccgtcctgacctgttgtgcggccagccggctgactatctggtggaagagaaacatttcactacacttgtctgcttcatcgttgttctggggggactgttgaagatgtgcctaaagaattgtgaggtcattgtactgactatcctgtcactgtctggtttcgtgatcggacatatggcatataattctgtggaggtgcaccagatcgtgtacccgctcttgcgaactagctcattctctctatactcctacttcagcccgctgatcatttttatggtagctctggacgtggagttctacacacttaaaaaaatgttttggcaagtgctgctcactgggctcatttccttctctacagcttccatcatcatcggctatgtcgttattaaattcaacaaggattcatgggatttgcaaagttgcctgttgttctcaatcaccctggggatcatcgatccactacgtagcgtgaatagcttgaagaccatcggcatctcaaaaatctacattgacctgataaggggggagagtctgattatctgttccatcgcctccatctttttcggaaacttccggggaaatcgcatccacttttctattttccgggatttacacgtaggtatcgagttaagctacgacatcttgggcagcataatcttcggttactggtgcgcaaagatcatccagtgcattctggccgatgtgttcagtaacatgcttactaacatcatcctgtgcttttccatggtctatatgacattctacatagtagaattcctagggatgtcagggacattggcccttgctgccgtggggcttaatcttgatagtctgacctttaaaccgaagatcgagctggtgattaccaaatttctccgaatattttcctcagtgtacgagcacctcatctatgctttcttcggcatcgtcattggctgcggtgagctgtcccattacgaatttcatacaattccattcatctttattctcttcacaacggttaacctggttcgactcctgactatcctcctggtgtcacctatcctgatgcacagcaattacgaatataactggcggtggggcgtggttatcacctggagcggtattaagggtgtatttaacctactctgggctccagacgtctacaacctcgccgagaggaaagtggaagtacctcagatgtttatcctctacgtccaagtgatttctctgctgaccatgggtatcaattcatatgtgatgactcagagcgccagaaagctggacctgtgcgtccttagtctacccaggcaaatgatactgcaaaacgccacacagcacatccaagagattgttcagaacaccatcacgttgttcaaaactgaaaaaatcctgactaatgtgaattggactctggtggaggataaaacacgtattgaatacatccccttttctcacgtgtcccacaatgacatgaagaccgaaagcacaaccgacgaggccctgatggaagaggcacgtttacacgtcgcagcaattcagatgtcctccttcgagaaacagcgtaataatggtattctggagatcgaagcagctaggatcttgatcggagccgcaaaatgttactacagtattcagggcaaattcatgtccatctacgatgtcagcacctacatgcgcaccagatcttggctgatcaaattcaaaaacgtcctcaccttcttagagtattgcatcgaaaaaattcacttcattccacccgaatcaaataccttccttactttcatctttcatattgttttctctgaagagtttgagtacaccgggcagatcatcaatctgatctacatctaccctatgatcatccacctctggcctatggcaaggggactgaatgtgagcgctttgatttccattaactactattttatgtttctatacgttctggagtcaaccctgaagattataatactcaaacgcaagtatttccagcagtgttggaatacgttggagttcttcatcctggttattggaataattgatatcttttgtgtgtattttgtaaagcttcgccctgataacttggctttaatacagctcactgtgattatgggatatctgcgcattatccgattcctgcctttatttaagattatcgtcccaattttaatcagaatcgcggacgtacaaattaaaaagaggttatctttgatgtatagcattacaaagggatacatcaagtcccaagaagacgctaagttattgattaagcagatcgccgtgtgtgagagcatctatcagaaactttgtgagatccttgagacgaataagcaggacgccgtgaaggaacttgtactgatggaacacgagggaagggacgttgtcatagcgctgaaaaccaaacaggcaatccgtaatgttatcgccaaagcgctcaagaatcttactttcctgtgcagtcgcggaatcatcgacaagcacgaagtgattgaaataaacaaagtcctcctcaagaagcttaaagctctgaacaacttccctaaagccatcccacctcctactcctgatatttacctccataatattatttggctggaggggaaggatgtcttgatcgactttttcaaggagagagcgaaactggcgtgttttgattcaggggacaccatctgcaagggcggtgagatgccacagggcatttatctgattatcagtggtatggccattctccacagtctgtctccgacattcgggatcgagtcaaaccaaaggtgcgatagaggcagccgcgacatgttcacggaattttgtactactggggatataattggggagctctcttgtctgctgaagagggaaatagagtacaccgttatatgcgagacttctctgcaagcctgctttatttcactggaagatctctacgagggattcgatgccttttggccttctttggaatataagatctggctcaaattggcactctcaactgcatatcagtatttcgagtcctcccttatcgacgaggacctgagatttcagaactgtgtgatgttcaaccaggcatacgtcgagacactgagttcttactccgatatgattatcgataacatgaccatgaagtttgttattatcgtgtacgggagtgtgatcgacactaagaccgaagagccgtattttgctccatgcataatacccaccacttgcgagcaggtgcagggtacatccgacctgtcgaaattacttatcatccaagcttcagagctgacacagagaaactcaaacactaacgttatggcctccgtcaacaccgtgtttgagcagcccggaaagaatattaacggacggcagaagatgtcctag

SEQ ID NO: 54407 - DNA, 1353 bp, Artificial Sequence
  Description of Artificial Sequence: Synthetic coding sequence
atggtggccctggatgttgaattctacaccctaaaaaagatgttctggcaggttctattgactggtctcatcagttttagcacagcctctattatcatcggatatgtggtcatcaagtttaataaagactcctgggatcttcagtcatgtctgttattttctattactctgggcataatagatcccctgcgttcggtaaactctctgaagactatcggtatttcaaaaatctatattgatctaatcagaggggagtcactcattatttgcagcattgcctccatattttttggcaatttccggggtaaccgcatccacttcagtatctttagagacttacatgtgggaattgaactgagctacgacatcttgggatccataattttcggctattggtgcgcaaagattatccagtgtattctggcagacgtgtttagtaatatgttaacaaacatcatcctctgtttttctatggtatatatgacattttacatagtcgaatttttgggcatgtcaggaacattggccttggctgctgtcggtctgaatcttgattccctcacctttaagcctaagatcgaattagtgattaccaaatttcttcggattttttcatccgtctatgaacaccttatctacgccttcttcgggattgtgatcggctgcggggaactctctcactacgagttccatacaattccatttatattcatccttttcaccacagtgaatttagttcgtctgctaacaattctgcttgtgagtcccattctcatgcacagtaattatgaatataattggcggtggggagttgtgattacatggtcagggataaagggtgtatttaacctcctgtgggccccagatgtttataacttagctgaacgaaaggtcgaggtaccccagatgttcattctttacgtgcaggttatttcactcctcacaatggggattaactcttacgtgatgactcagtctgccagaaagctggatctgtgcgtcctttctctgcctcggcagatgatcctacagaatgcaactcagcacatacaggagatagtgcagaatactatcacgctgttcaaaaccgaaaaaattctcaccaacgtgaattggacactggtcgaggataagactaggattgaatatattcccttctctcatgtgtcacacaatgatatgaagacagagagcaccacagatgaggcgctgatggaagaggctcggctgcacgttgcagcaattcagatgtcgagcttcgaaaagcaacgaaacaacggaatcttagaaatcgaggcagcacggattttaataggggctgccaaatgttattactcgatacagggcaagtag

SEQ ID NO: 54408 - DNA, 1548 bp, Artificial Sequence
  Description of Artificial Sequence: Synthetic coding sequence
atgcataccacggaatctaaaaatgagcatctggaggatgagaattttcagacatcaaccactcctcagagcctcatcgatcctaacaacaccgcgcaagaagaaaccaaaaccgtgttaagtgatactgaggaaattaaaccccagaccaagaaggagacatatatttcctgtccactgaggggagtactcaacgtgatcattactaacggagtcatccttttcgtcatttggtgcatgacctggtcaattctcggatccgaggcgctgccaggcggtaacctgtttggcctttttataatcttctacagcgctatcattggtggtaagatcctccagttgatcagaattcccctggtccccccactccctccgctgttgggtatgctcctggctgggtttacaatccggaacgtgccatttatcaacgagcatgttcatgttcctaatacgtggtcctccatactccggtctatcgctctgaccattattctgatcagagccggtcttggcctggacccccaggctttacgtcacctcaaagtggtctgcttcagactggctgtgggcccttgtctaatggaagcatcagccgcagcagtgtttagccacttcatcatgaaatttccttggcagtgggcatttctcctcgggtttgtgcttggggctgtgtcacctgcagtcgtggtcccatatatgatggtattacaggaaaatggctatggagttgaggagggaatccctacgctgctaatggccgcatccagcatggatgacatcctggcaataacgggattcaacacttgtctgtcgatagtgtttagttcaggtggcatactgaacaacgcaatcgcaagtatccgcaacgtgtgcatttcactgctggcaggcattgtactcggcttcttcgtgaggtatttcccctctgaggatcagaaaaagctgaccctgaaacggggatttctggtgttgacaatgtgtgtcagcgccgtgctcggtagccagcgtatcggactgcacggttcaggcggattatgtaccctggtgctgagtttcattgcgggaaccaagtggagccaggaaaaaatgaaagtgcagaaaatcattaccacagtgtgggatattttccagccacttctgttcggtctggtgggggcagaggtaagtgtgagctcccttgagagcaacattgttggtatctcagtcgctacgctatccctcgcactttgcgtgaggatcctaaccacgtacctgcttatgtgctttgctgggttctcttttaaagaaaagattttcatagcattggcttggatgccaaaggccactgtgcaggccgtgttggggccacttgctctggagaccgctcgggtcagtgccccacacctcgagccttatgcaaaagacgtgatgactgtcgcctttctggccatcctcattacagcgcctaacggggcacttctgatgggaatactggggcctaagatgctcacacgccactatgacccatcaaaaattaagctccagctctccacccttgagcaccattag

SEQ ID NO: 54409 - DNA, 1428 bp, Artificial Sequence
  Description of Artificial Sequence: Synthetic coding sequence
atgcacacaactgaaagcaagaacgagcacctcgaggacgaaaattttcagacttcaacaaccccccagtctcttatcgaccccaacaacaccgcacaggaagaaactaagaccgtcctgtccgacaccgaggaaattaaaccccagaccaaaaaggagacctacatatcctgccccctgaggggcgtcctgaacgttatcattacgaacggcgtcattctgtttgtgatttggtgcatgacctggagtatccttgggtccgaagccttgccagggggtaatctatttggcctgttcattatattctacagcgccattatcgggggaaagatcctgcagctgatacgtatcccactggtgccccctctacccccactacttggcatgcttctcgcagggtttacaatcagaaatgtgccattcattaatgagcacgttcacgttcccaacacatggtcttccattcttagatctatcgctctgaccattattctgatccgagcaggattgggattggatcctcaggctctgcgacacctgaaggtggtatgttttcggctcgcggtcgggccatgccttatggaggcttccgctgcagccgtattctcgcactttattatgaagtttccctggcaatgggccttcctcctgggtttcgtactgggcgcagtgagccccgctgtggtcgtcccttatatgatggtcctccaggaaaacggttacggggtagaagaaggaatccccactctcctgatggcagcatcttcaatggatgatatactggctatcacaggatttaacacttgcctcagcatcgtgtttagttccgggggtatcctgaacaacgccatcgcttccatcaggaatgtgtgtatctctctcttagccggtattgttctgggctttttcgtgaggtattttccaagcgaagatcagaagaaactcacgttaaagaggggcttcttagtcttaacgatgtgcgtgagcgccgtgctgggcagtcagcgaatcgggttgcacgggagtggcggactgtgcactcttgttctgtcttttatcgcgggtaccaagtggtcccaggaaaagatgaaggtgcagaaaatcataacaaccgtttgggatatcttccagcccttgctctttgggctggtgggcgcagaggtaagtgtcagcagccttgagagcaacattgtgggcatctccgtggctaccttgtctcttgcactgtgtgtccggatcctcaccacatacctcctgatgtgttttgctggcttttcatttaaagaaaagatcttcattgccctcgcgtggatgcctaaggccactgtgcagattaaccaggccatcttgctgctctttctgttgagggaggagtggaccaactgtaaagttgccaagaagtgtgagtacactaaggagagacagtag

SEQ ID NO: 54410 - DNA, 663 bp, Artificial Sequence
  Description of Artificial Sequence: Synthetic coding sequence
atgcacacgaccgaatctaagaatgaacacctcgaggatgagaattttcagacttctacaacaccgcagtctctaattgatcccaataataccgcacaggaagagacaaagactgtcctttctgacaccgaagaaatcaaaccccagactaagaaggagacttacatatcctgccctctcagaggcgttctgaacgtgatcataaccaacggtgtcattctctttgtcatctggtgtatgacctggtctatcctcgggtctgaggcactacctgggggaaatcttttcggtctgtttattatcttttactccgccattatcgggggtaagatcctgcaactgatccggatcccgctcgtccctccactaccacctctactgggcatgctgttggctggttttacaattcgcaacgttccatttatcaacgagcatgtgcacgtccctaatacatggagctcgatccttaggtctatcgccctcaccattatacttattcgggcaggacttggactcgacccgcaggcactgcgacatctgaaggtggtgtgttttcgattagccgtcgggccttgcctcatggaagcttcagctgccgcagtgttttcgcacttcattatgaaattcccgtggcaatgggcttttcttctgggattattttag

SEQ ID NO: 54411 - DNA, 153 bp, Artificial Sequence
  Description of Artificial Sequence: Synthetic coding sequence
atgcataccaccgagagcaagaacgaacatctggaggacgaaaatttccagacatcgacgactccacagagcctcattgatcccaataacactgcccaggaggagaccaagaccgtacttagtgacacagaggaaatcaaaccacagacctag

SEQ ID NO: 54412 - DNA, 1365 bp, Artificial Sequence
  Description of Artificial Sequence: Synthetic coding sequence
atgggggacgaagacaaacggatcacttatgaagactcagaacctagtacaggaatgaattacaccccatccatgcatcaagaggcccaggaagagacagtcatgaagctgaaaggcattgatgctaatgagccaactgagggctctatccttctgaagtcttcagaaaaaaagctccaggaaacaccaaccgaagcaaaccacgttcagagacttcggcagatgctcgcctgtccaccccacggccttcttgaccgggtcatcaccaatgtgacgatcattgtcctactctgggccgttgtgtggtctataacgggctctgaatgcttacccggaggaaatctgtttggaataatcatcctcttttattgcgcaatcatcggcggaaaactgctcggcctcatcaaactcccaacccttccacctctgccttctcttcttgggatgctgcttgcaggtttcctgataagaaacatcccggtgatcaatgataacgtgcaaatcaagcacaaatggagctcaagcttacgaagcatcgccttgtcaattatccttgtacgggctggcttgggccttgactctaaggcactcaagaaactgaaaggagtgtgcgtgagattgagcatgggtccgtgcattgttgaagcctgtacctccgccttattggcgcattacctgctaggacttccatggcagtggggatttattctgggtttcgttcttggtgccgtgagtcctgccgtggtagttccttcaatgctgctgctgcagggtggtggatacggagttgaaaagggcgtgcctacgctcctgatggccgcaggttccttcgacgatatcttggccatcactggattcaatacttgtctgggcattgcattcagcactgggtccactgtgtttaatgttctgagaggagttctggaagtcgttattggcgtcgcaacaggtagcgtgctgggatttttcatccagtatttcccctcccgcgatcaggacaagttggtgtgcaagcggacgtttttggtactgggcctaagcgttctggccgtcttctcctctgttcacttcgggttccctgggagtggtggcctctgcactctggtcatggccttcctggccggaatggggtggaccagcgagaaagcagaagtcgagaagataatagcggtagcctgggatatttttcagcctctgctgttcggactgattggtgccgaggtctcgatcgctagcttaaggccggaaaccgtcggaagtgccgattctattactgggaacttcgggaccgagcgacccaaactccttggtccaccttccacccaactccggttccatttcttccacatacaactgtctacttag

SEQ ID NO: 54413 - DNA, 1614 bp, Artificial Sequence
  Description of Artificial Sequence: Synthetic coding sequence
atgggggacgaggacaaacgcatcacctacgaagacagcgaacctagcaccggtatgaactatacaccctccatgcatcaggaggctcaagaggagacagtcatgaagcttaaaggaatcgacgctaatgagcctaccgaaggtagtattcttctcaagtcttcagaaaagaagctgcaggaaacccccactgaggctaatcacgtgcaaagactgagacaaatgctagcatgtccaccccacggactgttggatcgtgttataactaacgtaaccattatcgttcttctgtgggccgtcgtgtggtctatcactgggtcagagtgcctgcctggcggaaatctcttcggtatcattatccttttttattgtgcgattatcggcggaaaacttctagggttgatcaagctccccaccctgcccccactgccttccctgctcgggatgctgctggctgggtttcttattcgaaatattccggtcattaacgataacgtgcagattaagcacaagtggtcctctagcttacgttcaattgcattgagcattatactggtcagagctggactcggtcttgatagtaaagcacttaagaaactgaaaggggtctgcgtccggctgtccatgggaccgtgtattgtggaagcatgcacttccgcactgctcgcgcattacttgctggggctgccctggcagtggggatttattctcggattcgtcctgggagctgtcagccctgcggtcgttgtaccgagcatgctcctgctgcagggcggtggctatggcgttgagaagggcgttcccaccctcctgatggccgcagggtcgttcgatgatatactggcgattactggatttaacacgtgtctgggcatcgccttctccaccggatctacggtgtttaatgtcttgagaggcgtacttgaggtggttattggagtagctacgggctccgtgttgggattttttatccagtatttcccgagccgagatcaagataaactggtttgcaaacgtacttttctggtgctggggctgtccgtactggcggtgttctcctccgtacacttcgggttccctggatcaggaggactttgtaccctggtgatggcgttcctcgcgggtatgggatggacctctgagaaggccgaggttgaaaagatcatagccgtcgcatgggatatttttcagccgctgctttttggactcattggcgcagaggtatcaatcgcctccctgcgcccagaaaccgtcggcttgtgtgtcgcaacagtgggtatcgccgtgttgattcgtatcttaacgacatttctgatggtgtgcttcgcgggatttaatctcaaagaaaagatttttattagcttcgcatggcttcctaaggctactgttcaagccgctatcggatctgtagccctcgacacagcccgtagtcacggtgagaagcagcttgaggactatggcatggatgtcttgaccgttgcctttctgtcaatccttataacggctccaattgggtccttgctgataggcctgctggggccacggctgctccagaaggtagagcatcagaataaggatgaggaggtccagggcgaaaccagcgtgcaggtgtag

SEQ ID NO: 54414 - DNA, 1614 bp, Artificial Sequence
  Description of Artificial Sequence: Synthetic coding sequence
atgggagatgaagataagaggattacatatgaggactctgaacccagcaccggcatgaattacacaccatcaatgcaccaggaagcgcaggaggagactgtgatgaagctcaaaggcatcgacgctaatgagccaacagaaggctctatcttgctgaagtctagcgaaaaaaaactgcaggagacaccgaccgaggccaatcacgtacagcggctacggcagatgctggcctgtcccccacacgggctcctcgatcgcgtgattacaaatgttactattatagtgttgctctgggccgtggtctggtcaattacaggctccgagtgtctgcccggaggcaatttattcggcatcattatcctgttttactgcgcaatcattggagggaagctattgggtctcatcaaacttcccactctcccccctcttccttcactcctcggcatgctgttggccggttttctcataagaaacatcccggtgatcaatgacaatgtacagatcaagcataagtggtccagctccctacgtagcatagccctgtcaataatcctcgttcgcgcagggctgggtctggacagcaaagcactgaagaagcttaaaggcgtatgcgttcgtctgtctatgggaccttgtatcgtggaggcttgcacatccgctctgcttgctcattaccttctcggactcccgtggcaatgggggttcattctcgggtttgtgttaggcgctgtgagcccagccgtcgtggtgcccagtatgctgctgctgcaggggggtggatacggcgtcgagaaaggagtgcctactctcctgatggccgcaggcagctttgatgacattctcgctatcactggatttaatacgtgtttgggcatagcctttagcaccggaagtacagtgtttaatgtacttagaggagtgctggaggttgtcattggggtggcaactggatcagtcctggggttctttatccagtatttcccctcacgggaccaggacaagctggtctgcaagaggacttttctggtgttggggctatcagtccttgcagtattttccagtgtgcactttggatttcccggatctggcggactgtgtactcttgttatggcatttctggcaggaatgggatggacgtcagagaaggctgaggtggagaagatcatcgcagtggcttgggacatctttcagccacttctatttggtcttattggggcagaggtgtcgattgcgtcgctgaggccagaaacagtgggactctgtgtggcaaccgttgggatagctgtattgatcagaatccttactacctttctcatggtgtgctttgctggctttaacctgaaagaaaagattttcatctcctttgcgtggctgcccaaggctaccgtgcaggctgcaattggatcagttgctcttgataccgcgcgttctcacggggagaaacagcttgaggactacgggatggacgtcctgaccgtcgctttcctgagtatcttgataactgcacccatcgggagcctgttgatcggccttctgggccctagattgttgcagaaggtggaacatcagaacaaggatgaggaggttcagggagaaacaagcgtacaggtgtag

SEQ ID NO: 54415 - DNA, 1254 bp, Artificial Sequence
  Description of Artificial Sequence: Synthetic coding sequence
atgggcgatgaggacaagagaatcacatatgaggacagcgaaccctccaccgggatgaactataccccctctatgcatcaagaagcccaagaggaaaccgtcatgaagctcaaggggatcgacgccaatgagcccaccgaaggatccattttattaaaaagttccgagaagaagcttcaagagacaccaacagaagcaaatcacgtacagcgcctgcgtcagatgctggcttgtccccctcacgggttactagatcgcgtgatcacaaacggcatgctgcttgccggattcctcattcgtaacatccctgtcatcaatgacaatgtacagatcaagcataagtggtctagctccctccgatccattgccttgtctatcatactggttcgcgctggactgggccttgattccaaagcacttaagaaactgaaaggagtgtgcgtcaggctgtctatggggccatgtatcgtcgaagcatgtactagcgccctcctagctcactacctgctgggcctgccctggcaatggggctttattctggggttcgttcttggggctgtgtcccccgcagtggtggtaccctccatgctgctcttgcagggaggtggctatggtgttgagaagggagtcccaacccttttgatggccgctggttcctttgatgatatacttgcgataacagggtttaatacttgtctgggcattgcctttagcaccgggtccactgtgttcaacgtattgcgcggagtgctggaggtcgttataggcgtggccaccggttcagtgttaggatttttcatccagtacttcccgtcccgggatcaggataagctcgtctgtaaacgtacttttctggtgctcggccttagcgtcctggcagtctttagcagcgtgcattttggattcccgggatcaggcggtctgtgtacactcgtgatggcgttcttggctggcatgggctggacatctgagaaagccgaggttgagaaaatcatcgccgtagcctgggacatctttcagcctctcctgttcggactgatcggggcagaggtgtccatcgccagtctccgtcccgagactgtcggatgtaaccgaatctgcgggttcggccattccaaggttacttggcgcgagaccatacggcgtctctggaacggatgtgtcgacagtgggatattcgtccacccccaccacagccccaattggaaatccgcctactggttcacagggccacaggcctccgctgagtcttag

SEQ ID NO: 54416 - DNA, 1443 bp, Artificial Sequence
  Description of Artificial Sequence: Synthetic coding sequence
atgggtgatgaggataagcgtattacttacgaagattctgagccaagtacgggcatgaactacactcccagtatgcaccaggaagcccaggaagagacagtgatgaagctgaagggaattgatgctaacgagccgactgaagggtctattctgctcaagtctagtgagaaaaagctgcaagagacccccaccgaagcgaatcacgtgcagagattacgtcagatgttagcatgtccaccacacggccttctggaccgcgtgattaccaacggaatgctcctagctggcttccttatacgtaatattccagtcataaacgataacgtccaaatcaagcataagtggtccagcagtctgagaagcatcgccttatctatcatccttgttcgcgcaggcctcggactggacagtaaagcacttaagaagctcaagggcgtctgcgtgcggttgtccatggggccatgcatcgttgaagcctgcaccagcgcactgctcgctcactacttgttaggcttgccctggcagtggggcttcatcctgggattcgtgctcggggctgtgtcccctgcagtggtggtgccctccatgttactcctgcagggcggaggatacggggtcgaaaagggcgtgcctacactactcatggcagctggctcattcgatgacattcttgcaatcacaggcttcaatacctgtttaggtatagccttttcgacaggaagcaccgttttcaatgtgttgcgaggggtgttggaagtagtgattggagtagccaccgggtccgttctcgggtttttcatccagtatttcccctctcgagatcaggataagctggtctgcaagcgcacctttctcgtgttaggactgagtgttttagcagtttttagtagcgtgcattttgggtttccagggagcgggggactgtgtaccctggtcatggcatttctagccggtatggggtggacctctgagaaagctgaggtggaaaaaatcatcgcagtggcctgggacatatttcagcctctgctgttcggactgatcggcgctgaggtgagtatcgcctccctgcgcccagaaaccgtgggcctatgtgtcgccacagttggaatagccgtactgatcaggattctcaccacctttttaatggtgtgcttcgcgggattcaacctgaaagagaaaatcttcatatctttcgcatggctccctaaagcaacagtgcaagccgcaatagggtccgtcgcactggataccgccaggtctcacggtgagaagcagctggaggattatggcatggatgtcctaaccgtggcctttctcagtatcttgataacggcgcctattgggtcattgcttatagggttgctaggaccaaggttgctgcagaaggtcgagcatcagaataaagacgaagaagtgcagggcgaaaccagcgtccaggtgtag

SEQ ID NO: 54417 - DNA, 432 bp, Artificial Sequence
  Description of Artificial Sequence: Synthetic coding sequence
atgggagatgaggacaaacggatcacatatgaggattccgaaccaagcaccgggatgaactacacaccctctatgcatcaggaggcccaggaggagaccgtcatgaagctgaagggcatcgacgctaacgaaccaacagagggttcgattctcctaaaatcgagcgaaaagaagctgcaggaaactccaacggaggcaaaccacgttcagcgcttacgacagatgcttgcttgcccccctcacggactgcttgatagagttattactaatgtgacaataatagtgctcctttgggccgtggtttggagtataaccgggtcagagtgcctgccaggcggaaatttgtttggaattatcatacttttttattgcgccataatcggagggaaattacttggactgattaaattgcccactctgccacccctgtag

SEQ ID NO: 54418 - DNA, 2064 bp, Artificial Sequence
  Description of Artificial Sequence: Synthetic coding sequence
atggacgaaggcactggcctgcagccaggggctggagaacagctggaagcccctgccacggcggaagccgtgcaagaaaggtgcgaacctgagacactgaggagcaaatccctgccggtgctctcctcagctagctgcaggccatccttgtctcctacttctggagatgccaatcccgcatttggctgcgtggacagcagtggacatcaggaactgaaacagggcccaaaccccctagcaccgagtcccagtgccccttcgacatcagccggtttaggggactgcaaccatcgggtggatctgagcaaaaccttctcggttagcagtgcactcgccatgctccaggaaagacggtgcctctacgtggtcctgacggatagccggtgtttcttagtgtgcatgtgtttcctgactttcatccaagccctgatggtgtcgggatacttatcgtcagtaatcaccacaattgaacggcgatattctttgaagtcttcagagagtgggctccttgtgagctgttttgatataggcaacctcgtggtcgttgtcttcgtgtcctatttcgggggaagagggcgtagaccgctgtggctggccgtaggtggcctgctgattgcattcggtgcagccctgtttgccctgccacacttcatcagcccgccataccaaattcaggaacttaacgctagcgcacccaacgatggactttgccaagggggaaacagcacagcgacactggagcctccagcctgccccaaggattcaggcggtaataaccactgggtgtatgtggcactcttcatctgcgcacaaatccttattggaatgggtagcacccccatttatacccttggccctacatatctggacgacaatgtgaaaaaggaaaactcctcgttgtatctggctattatgtacgtaatgggcgcactaggcccagcggtgggctatctcctgggaggattacttattggtttttatgtggaccctaggaaccccgtccacttagatcagaatgatccacggttcatagggaactggtggtctggttttctgctctgcgctatcgccatgttccttgtcatcttccccatgttcacctttccaaagaagctgcccccaaggcacaaaaaaaagaaaaaaaaaaagttcagtgtagatgccgtctcagatgatgatgtgctgaaagagaagtcaaacaactcagaacaagccgataaaaaggtctcctcgatggggttcggaaaagatgtcagagatctgcccagggccgctgtgaggattctgtctaatatgactttcttgtttgtttccctgtcttatactgcggaatcggcgatcgtcacagccttcattactttcattccgaaattcatcgagagtcagttcggcatccccgcttctaatgcgagtatttataccggcgtgattatcgtgccttcagccggagtggggattgtgctgggaggatacattatcaagaagctgaaacttggggctagagaaagcgctaagttggcaatgatatgctccggtgtgagcctgctctgcttctcaaccctgtttatcgtcggctgcgaatccataaatctcggtggcatcaacatcccgtacactaccgggccttcccttaccatgcctcatcgcaacctgactggaagttgcaacgtgaattgcggatgcaaaatccacgagtacgagcctgtgtgtgggtccgatggcatcacctactttaacccctgtctggcaggatgtgtgaattctggtaatctgtcaacaggcatccgtaattatacagaatgcacatgcgtgcagagtcggcaagttatcacaccacctactgtagggcagcgcagccaacttcgggtagttatcgtgaagacctatcttaatgagaatggatacgctgtaagtggtaaatgcaaaagaacctgcaacaccctgatcccatttcttgtgttcttgtttatcgtgacttttatcaccgcttgcgcccagccctctgcaattatagtgaccttgtcgattcactcatattctaacctgctctggagttcgcattag

SEQ ID NO: 54419 - DNA, 2013 bp, Artificial Sequence
  Description of Artificial Sequence: Synthetic coding sequence
atgggcgaaactgagaagcggatcgaaactcatagaattcgttgtctctcgaagctgaaaatgttccttctcgcaataacctgtgcattcgttagtaaaacgctgagcggcagctacatgaactcaatgctgacccaaatcgaacgccagtttaatattcccactagtctcgtgggttttattaatggttctttcgagatagggaatttgctgctgataattttcgtatcctatttcggaactaaacttcaccgcccaatcatgattggcattggatgtgtggtcatgggactgggatgcttcctcaaatctctgccccactttctgatgaatcaatatgagtacgaaagtactgtctctgtatccgggaacctgagctcaaattcctttctgtgtatggaaaatggaacccagattttgaggcccacgcaggatccatcggaatgcacgaaagaagtgaaatccctcatgtgggtttacgtcctagtggggaacatagttagaggtatgggagagactccgatattacctttgggtatctcctacattgaggatttcgcaaaattcgagaattcaccactgtacattggcctcgtcgagaccggggcaatcattggacctctgatcgggctgctgctagcctcgttttgtgctaatgtgtacgttgacaccggattcgtaaatactgatgacctaatcatcacgccaacagacactcggtgggtgggagcttggtggttcggatttctcatctgcgcaggggtgaatgtcttaacagcaattcccttctttttcctccccaatacgcttcccaaggagggattagagacaaatgccgatattatcaagaacgaaaacgaggacaagcaaaaggaagaagtgaagaaagagaagtacggaataaccaaagactttctccctttcatgaagtctctgtcttgtaatccgatttacatgctgttcatcctggtgagcgtaatccagttcaacgcctttgtgaacatgatatcctttatgccaaagtacctcgagcagcagtatggcataagctcttccgatgcgattttcctgatggggatatataacctaccacctatctgtatcgggtatataattggcggtctcataatgaaaaagtttaagattacagtgaagcaggcggctcacatcggctgttggctttccctgttggagtacctgctatatttcctgtccttcctcatgacatgtgaaaattcctcagtcgtgggaataaacacgtcctacgagggtattccacaggacctgtatgtcgagaatgacattttcgcagattgcaatgtcgattgtaattgtccatcgaagatttgggaccccgtctgcggcaataacggcctcagctatctgagcgcctgtttagccggttgtgaaaccagtatcggcaccggcatcaatatggtatttcaaaactgcagctgtattcagactagtggaaactcaagcgcagtgttaggtctgtgcgataagggccctgattgtagccttatgctgcagtactttctgatactctcagcaatgagttcatttatatactctctcgccgctattcctggctatatggtacttctccgatgcatgaaatccgaggaaaagtctctgggcgtggggttgcataccttctgcaccagagtgttcgccggaatacccgctccaatatacttcggcgctctaatggatagcacctgcctgcactggggcacacttaaatgcggggaatccggcgcatgccgcatctacgattccactaccttccgatacatttaccttgggctgcctgccgctctacgaggatcctcattcgtccctgccctaataattctgatcctgctgaggaaatgtcacctcccaggggagaacgcctcctccggtaccgagctgatagagactaaagtgaaagggaaggaaaatgagtgcaaagatatttatcaaaagtctactgtactaaaagatgatgagctgaagactaagttatag

SEQ ID NO: 54420 - DNA, 1740 bp, Artificial Sequence
  Description of Artificial Sequence: Synthetic coding sequence
atgtttcttacaaagaactgcaagcaggagcaggagcgtgtcgagtctgctaagatgttcctgcttgctattacctgcgcctttgtgtctaaaaccctttctggaagctacatgaactctatgcttactcagatcgagaggcagtttaatatccctacttccttggtaggtttcattaacgggtcttttgagatcggaaatctcctgctgataatcttcgtaagttattttggcacgaaacttcaccggccaattatgattggcataggatgtgtggtaatgggactaggctgttttttgaagagtctgccacacttcttaatgaaccaatatgaatatgagtccactgtaagcgtttcgggcaatttgtctagcaattcttttttgtgcatggagaatgggacccagatcctgagacctacgcaggacccttctgagtgtactaaggaggtgaagtcgttgatgtgggtctatgtccttgtcggcaatatcgtccgcggaatgggcgagacccctatcctccccctcggcatctcttacatcgaagattttgccaagtttgaaaactcccccctctatatcggcctggtcgagaccggtgcgataataggtcccctgataggcctcctgctggcgagcttctgcgccaatgtgtacgtcgataccgggtttgtgaatactgacgatctcatcatcactcccacagacacccgctgggtcggtgcctggtggtttggattcttgatatgcgccggtgtgaacgtgctgacagctatcccttttttttttctccctaacactctccctaaggaaggcctggaaactaatgcggacataatcaagaatgaaaatgaggacaaacagaaagaagaggtcaaaaaagagaagtatggcatcactaaagatttcctaccttttatgaaatcactgagctgtaatcctatctatatgttattcattcttgtgtccgtgattcagttcaatgcgtttgttaacatgatttcattcatgcccaaatatctggagcaacaatacggcatctcctcttccgatgctatctttttgatgggcatttataatctcccacccatctgcattggctatattattggcggtctgatcatgaagaagtttaagatcaccgtgaaacaggctgctcatatcggatgttggcttagtcttttggagtacctcctgtacttcctctcattcctgatgacctgcgaaaatagctctgtggtcggcataaacacgagctatgagggaattccccaggacctttacgtggagaacgacatatttgctgattgtaacgtcgactgcaattgtccatccaaaatatgggacccagtgtgtggaaacaacgggttgtcctaccttagtgcttgtctggccggatgcgaaacttccattgggacaggtataaacatggttttccaaaactgtagttgtattcagaccagcggcaatagttctgccgtgcttggcttgtgtgataaaggtcccgattgcagtctgatgttacaatactttctcattctgtccgctatgtcctcattcatctacagcctggccgctattcccggatatatggttctgctccgttgtatgaagagcgaggaaaaatcactcggggtgggactgcatacattctgcaccagagtgttcgggaagaacagctacttttttccgcaccccattaggacgattttgctgttattgttcttcatcacactttag

SEQ ID NO: 54421 - DNA, 42 bp, Artificial Sequence
  Description of Artificial Sequence: Synthetic coding sequence
atgggcgaaaccgagaaaaggatcgagactcaccgcatttag

SEQ ID NO: 54422 - DNA, 156 bp, Artificial Sequence
  Description of Artificial Sequence: Synthetic coding sequence
atgggcgagactgagaaaagaatcgagacccacagaattcgatgcttgagcaaacttaaaatgtttttgctggccataacgtgtgctttcgtgagcaaaaccctgagtggtagctacatgaactccatgttgacccaaatcgagaggcagttctag

SEQ ID NO: 54423 - DNA, 300 bp, Artificial Sequence
  Description of Artificial Sequence: Synthetic coding sequence
atgggggagacagaaaagcgaattgagacccaccgtatccgatgtttgtctaaactgaaaatgtttcttttggcaattacttgcgcctttgtctctaagaccctttcaggatcctatatgaactcgatgctgacccagatcgagcggcagttcaacattccaacatctctggttgggttcatcaatggttcttttgaaatcggcaacctcctcctgataatcttcgtgagctacttcggaaccaaactgcaccggcctatcatgattggtatcgggtgcgtggtgatggggttaggttag

SEQ ID NO: 54424 - DNA, 444 bp, Artificial Sequence
  Description of Artificial Sequence: Synthetic coding sequence
atgggcgaaaccgagaaaaggatcgagacacataggattcgttgtctgtcaaaactgaagatgttcctcttagccatcacctgtgcttttgtttcaaagacactctccggctcttatatgaatagcatgctcacgcagatagagagacaattcaatattcctaccagcctcgtcgggttcatcaatggcagttttgaaattggcaaccttctgttaattatttttgtctcgtattttgggactaaactgcacaggcccattatgatcggaattggctgcgtcgttatggggttgggctgcttcctaaagtcactgcctcactttttgatgaatcagtacgagtatgaaagtactgtctcggtgagcgggaatctctcctctaatagcttcctctgcatggaaaatgggacccagatccttcgacccactcaggatccatcctag

SEQ ID NO: 54425 - DNA, 9 bp, Artificial Sequence
  Description of Artificial Sequence: Synthetic coding sequence
atgggatag

SEQ ID NO: 54426 - DNA, 267 bp, Artificial Sequence
  Description of Artificial Sequence: Synthetic coding sequence
atgggagagaccgaaaaaagaatagagactcacagaatcaggtgcctgagcaagctcaagatgttcttacttgccatcacttgtgccttcgtcagcaagacactgagcgggtcctacatgaactccatgctgacccaaattgagcgacagtttaacattccaacctccctggtcggatttatcaatgggagtttcgagatcgggaacttgctgctgattatctttgtgtcttattttggtacaaagctacaccgcccaattatgtag

SEQ ID NO: 54427 - DNA, 276 bp, Artificial Sequence
  Description of Artificial Sequence: Synthetic coding sequence
atgggagagacagagaagcgaattgagacccatcgcatcaggtgtctgtcaaagctgaagatgtttctcctggcaatcacttgcgcctttgtgtctaaaaccttaagcggatcttacatgaattccatgttaacccagatagagcgccagtttaacattccaacaagtctggtggggttcatcaacggctctttcgaaattggcaacctcttgctgattatttttgtgagctactttgggactaagttacaccggccaatcatgatcggcatctag

SEQ ID NO: 54428 - DNA, 2013 bp, Artificial Sequence
  Description of Artificial Sequence: Synthetic coding sequence
atgggagagaccgaaaaacgaattgagacccacagaatacgatgcctgtccaaactcaagatgttcttactcgccattacatgcgcttttgtaagcaaaaccctatctggctcctacatgaatagcatgcttacccagattgagcggcaattcaacatacctacctccctcgtgggctttattaacggatcgtttgagatcggtaatctgctactgatcatttttgtgtcatattttggcactaagctgcaccgcccaattatgatcggaatagggtgtgtcgttatgggcttagggtgtttcctgaaaagccttccccacttcctgatgaaccagtatgaatatgaaagcacagttagcgtgtctgggaacttgtcctccaattcctttctgtgtatggaaaatggtacccagatcctcagacctacccaggatccatcagaatgtacgaaagaggttaagtccctgatgtgggtttatgtcctagtgggcaacatagtccggggaatgggcgagaccccaattctgcctctgggcatcagctacattgaagactttgccaaatttgagaattcccccctgtacatcggactggtggagactggagccatcattggacctctaattggccttctcttggcatcattttgtgcaaatgtgtacgtcgacacgggtttcgtcaacactgatgacctcataattactcccacagatactcgatgggttggtgcgtggtggttcggcttcctcatctgcgccggtgttaacgtgctgaccgcaattccctttttctttttgcctaacaccctgcctaaggagggactagagacaaacgcggatattatcaaaaacgagaatgaagacaagcaaaaagaagaggtcaaaaaggaaaaatatggcattacaaaggactttctgcctttcatgaagtcccttagctgcaatcctatatatatgctcttcatccttgtttccgtgatccagttcaacgccttcgtaaatatgatttcttttatgccaaagtacttagaacagcagtacggaattagcagctccgacgctatttttcttatgggtatctacaatctgcccccaatctgcattggttacatcatcggtggcttgattatgaaaaaattcaagatcactgtcaaacaggctgcacatataggttgctggctatccttacttgaatacctactgtacttcctctccttcctcatgacttgtgaaaatagctctgttgtgggaattaatacgtcatatgagggaatacctcaggatctgtatgtggagaacgacattttcgccgattgtaacgtcgattgcaattgtcccagtaagatttgggacccagtatgcgggaacaacggactctcctatctgtctgcctgcctggctggctgtgaaacaagcatcggaaccggaatcaatatggtgtttcaaaactgcagctgcatccaaacttccggcaatagttcagcggtgctggggctatgtgacaaaggtccggactgctcgctgatgctccagtactttctgatcttatctgcaatgtctagcttcatctatagtttagcagcaatccccggttatatggttctgctgcgctgtatgaagtccgaagagaagagtctgggcgtaggtttacatactttctgtacaagggtttttgctgggatacccgcaccgatctattttggggctcttatggacagcacatgtctccactggggaactctcaagtgcggcgaatccggcgcttgcaggatatatgatagcaccacattcagatatatatatctggggctgccagccgctttaaggggcagctcctttgtccccgcactcatcatactgatactgctgagaaagtgccacctgcccggagagaacgcatcttccggcacagagctcatcgaaacaaaggtcaagggcaaagaaaacgagtgcaaggatatttaccaaaagagcactgtactcaaggacgacgagctaaagacaaaactttag

SEQ ID NO: 54429 - DNA, 414 bp, Artificial Sequence
  Description of Artificial Sequence: Synthetic coding sequence
atgggggagacggagaaacgcatagaaactcaccggatccgatgcttatctaaactgaagatgttcttactggcgatcacctgtgctttcgtctccaagaccctgagcggaagttatatgaactctatgctaactcagatagaaagacaattcaatataccaacctcgctggtcggctttataaacggctcattcgagatcggcaatctcctactaatcattttcgtctcctacttcggcaccaagttgcatcgcccaatcatgattggtatcggttgcgtggtaatgggtctgggttgcttcctcaagagcctgcctcactttttgatgaatcagtacgagtacgaatctacagtctctgtgtcaggtaatctctcatctaattcctttctttgcatggagaatggaacctag

SEQ ID NO: 54430 - DNA, 1617 bp, Artificial Sequence
  Description of Artificial Sequence: Synthetic coding sequence
atggaaaacggcacacagattttgcgaccaacacaggatccgagtgagtgcacaaaagaagtcaaatccctgatgtgggtgtacgtgttggtgggcaacatcgtaagaggcatgggcgaaactcctattctgcctctgggaattagctacatcgaggactttgccaagttcgaaaactctccactgtatataggattggtggagaccggtgccataatcggccctctgatcgggttgctgcttgccagcttttgcgcaaacgtctatgtggacaccggcttcgtaaataccgacgacctcatcataactcccactgatactcggtgggttggtgcttggtggtttggatttctaatttgtgccggagtgaacgtactgactgctatccccttcttctttttgccgaatacattgcctaaagaaggtctcgagacaaatgccgacattattaaaaatgagaatgaggacaagcagaaggaagaagtcaagaaggagaagtatggcattaccaaggatttcttgcctttcatgaaaagtctgtcatgcaacccaatatacatgctgtttatactcgtgtctgtaattcagtttaatgcattcgtgaatatgatctcttttatgcccaaatacttggagcagcaatacgggattagcagttcagacgccatatttctgatgggcatttacaacctacccccaatttgcatcgggtacattatcggagggctgattatgaaaaagttcaagatcacagtgaagcaggcagcccatatcggttgttggctgtcactgctggaatatcttctctatttcctgagctttctgatgacatgtgagaacagttctgtcgtgggaattaacacaagttacgaaggcattccacaggacttatatgttgagaatgacatcttcgctgattgtaacgttgactgcaactgcccaagtaagatttgggatcccgtttgtgggaataacggactgtcttacttaagtgcatgtttggccggttgtgagacctcaatcggcaccggtattaacatggtgtttcagaattgctcgtgcatccagacctccggcaatagctccgccgtcctggggctttgtgataaaggacccgattgttctctgatgctccagtattttttgattctgtcagcgatgtcaagcttcatctacagcctcgcagcaatcccagggtatatggtgctgttaaggtgcatgaagagcgaggagaagtctctgggggttggtcttcatacattttgcacccgagtcttcgcaggcatccctgctcctatctacttcggagcactgatggattctacatgtctacactggggcaccctgaaatgtggcgaatcgggagcttgccgaatctacgatagcactactttccggtacatctaccttggactgccagcagctttacggggaagctcctttgttcctgctcttatcattctgatcttgctgcgaaagtgtcatctgcctggagagaacgcatctagtggcacggaactcattgaaactaaggtaaagggcaaggagaacgagtgcaaggacatctaccaaaagagtacagtgctaaaggatgatgaactgaaaacgaaactgtag

SEQ ID NO: 54431 - DNA, 1617 bp, Artificial Sequence
  Description of Artificial Sequence: Synthetic coding sequence
atggagaacgggacacagatcctgaggcctacccaagatcctagcgagtgcacaaaagaagtgaagtcgctgatgtgggtatatgtcctggtggggaacatcgtgaggggcatgggcgagacccctattcttcccctggggatctcatacatcgaggacttcgctaagttcgagaatagccccctttatattggactggtcgaaaccggggcaatcattggccctctgatcgggctcctcctggcttcattttgcgctaacgtgtatgtagacacagggttcgtcaatacggacgatttgattatcacccccactgatacgcggtgggtcggagcttggtggttcggctttctcatatgtgccggagttaacgttctaaccgccatcccgtttttcttcctgccaaatacacttcccaaagaaggtctcgaaacgaatgcagatattatcaagaacgaaaacgaagataaacagaaagaggaggtgaaaaaagagaaatacggaatcaccaaggattttctgccctttatgaagtcgctatcttgcaatccaatctacatgttattcatcctggtatcagtaatacaatttaacgcctttgtgaacatgatctccttcatgcccaaatatctggaacagcagtatggaatatcctcctcagatgcaatcttcctgatgggcatctacaacctgcctcctatctgcattggttatattattggcggtctcattatgaaaaagttcaagatcaccgtaaagcaggccgctcatataggctgttggttaagtttgcttgagtacctgctgtattttctctccttcctcatgacctgtgaaaactcctccgttgttggaatcaatacatcttatgaggggatcccccaggatctgtacgtagagaacgacatatttgccgactgcaacgtggactgtaattgtccatcaaagatctgggatcccgtgtgtggcaataatggactctcatatttgagtgcatgtttagctggctgcgagacttcaatcggtaccgggatcaacatggtcttccagaactgctcctgtattcagaccagcggcaacagtagcgccgtgctcggcctttgtgataaaggcccagattgttcattaatgctacagtactttttaatcctgtctgccatgagttcttttatttattccctggccgcaattcccggatacatggttctgctgcggtgtatgaagtcagaagagaagtctctcggtgttggattacacaccttctgcaccagagtgttcgcgggtatacctgccccaatttacttcggagccctgatggacagcacctgtttacactgggggacgcttaaatgcggggaaagcggcgcttgtcgaatttacgactcaacgacctttcgatatatctacctgggacttcctgccgctctacggggatcctccttcgtgcccgctctcatcatcctgattctgcttcgcaagtgtcacctgcccggtgagaacgcttcatctggtacagagttgattgagacaaaagtaaagggtaaagagaacgaatgcaaagacatataccagaaaagcacagtactgaaggacgacgaattgaaaactaagttatag

SEQ ID NO: 54432 - DNA, 1704 bp, Artificial Sequence
  Description of Artificial Sequence: Synthetic coding sequence
atgggcctgctccccaagctgggcgctagccaaggcagcgatacctccacctctcgggcaggacggtgtgcacgctcagtttttggcaatattaaagtgtttgttctttgccagggacttctgcaattgtgccagctcctgtactctgcctactttaagagtagcctcactactattgagaagcgctttggtctgtcttcctctagtagcggccttatatccagtctgaacgagatcagcaacgccatactgattatctttgtgtcttattttgggagtcgcgtgcatcggcctaggctcattggcatcggcggtctgttcctggctgccggagcatttatcttgactctccctcacttcctttctgagccctaccaatatactctggcctcaacagcaatcttgttcgccatctccgtgtttggaccagcgttcggatacttgcttggctccgtaatgctgcaaattttcgtggattacggacgggttaacaccgcagccgtcaatctagttccaggtgaccccaggtggatcggcgcatggtggctgggacttctgatcagctctgcacttctggtgctgacctctttccctttctttttctttcctcgagccatgcctatcggcgctaagagggcgcctgctaccgcagacgaggcacgcaagctggaagaggcaaaaagtcgaggctctctcgtggatttcattaagaggttcccttgcatcttcctccgcctactgatgaattctctctttgttctggtggtgctcgctcaatgcaccttttcctcagtcatcgcagggctgagtacctttttgaacaaattcctcgagaaacagtatgggacaagtgccgcttacgcaaatttcctgatcggtgccgtaaatctgccggcagcagccttaggaatgctgttcgggggaatactgatgaaaaggtttgttttcagcctgcaggccattcccaggatcgcaactacaattatcaccatttccatgattttgtgcgtgcccctgttcttcatgggttgctctaccccaacggtggcagaggtctacccgccatctacgagctccagcatacacccacagagccctgcctgccgaagagattgctcttgccctgacagtatattccatcccgtttgcggtgataatggcatcgagtatctgagcccttgccacgccggttgcagtaacattaacatgtcctccgccacatctaaacagcttatttacctcaactgtagttgtgtgacagggggatccgcttccgccaaaacgggatcatgccctgtgccttgtgcacatttcctgttacccgcaatctttctgatatctttcgtctccctcattgcctgcataagtcacaaccctttgtacatgatggtgctacgggtcgtgaaccaggaggagaagagcttcgccattggcgtccagttccttctgatgcggctgctcgcttggctgcccagtccagccctatatggtctaactatcgatcactcttgcatccggtggaactcgctttgcctcgggcgtagaggggcatgtgcctactatgacaatgatgctctgagagacagatatttaggtctgcaaatggggtataaagcgttgggaatgctcctactgtgttttatctcttggagagtgaagaaaaataaagaatataatgttcaaaaagcagcgggtctcatatag

SEQ ID NO: 54433 - DNA, 2130 bp, Artificial Sequence
  Description of Artificial Sequence: Synthetic coding sequence
atgggcccaagaattggacctgccggagaagtgccacaagttcctgataaggagaccaaggcgactatgggcaccgaaaatacccccggaggaaaggccagtcccgatcctcaggatgtgagaccgagcgtgttccacaacataaagctgttcgtgctttgccacagtcttctccaactggcacaactgatgatcagtggatatttaaaaagcagcattagcacagtggaaaagcggtttggcctgagtagtcagacgtcggggttactggcatcttttaacgaggtagggaatacagcccttattgtttttgttagttattttggcagccgcgtgcacagacctagaatgataggatacggcgctattctggtggctttagctggcctactcatgaccctcccacacttcatttcggagccttacagatatgataacacctccccagaagacatgccccaggattttaaagcttctctatgcttgcctacaacctctgctcctgcttccgccccatcaaacggaaattgttcttcgtatacagagacccagcatctgagtgtggtgggcattatgttcgtagctcagaccctgttaggcgtggggggagttccaattcagccgttcggtatttcctacatcgatgacttcgcccacaactctaactcaccgctgtacctgggaattctcttcgcagttaccatgatgggccctggcctcgcgttcggtctcggctccctcatgttgcggctttatgttgacataaatcaaatgccagaaggcggtatcagcctgaccattaaggatcctcgctgggtcggcgcttggtggttgggatttctaatcgcggctggcgcagtcgcgctggctgctataccatacttttttttccctaaagagatgccgaaggaaaagagggaactccagttccggaggaaagttctggccgtcaccgacagccctgccaggaagggaaaggattctcccagcaaacaatcaccaggcgagtctacaaagaagcaggacgggcttgtgcaaattgcaccaaacctgaccgtcatccagttcataaaggtgttcccgagagttctgctgcagacattaagacatcctatattcctattagtggttctcagccaggtgtgtctgagctccatggcagccggaatggcaatatttctgcccaaattcctggagagacagttcagcatcaccgcatcctacgcaaacctgttgataggctgcctgtcatttcctagcgtaatcgtcggaatcgtggtggggggtgtgctggttaaaaggctgcatctaggacccgttgggtgtggcgctttatgtctgttgggtatgttgctctgcctcttcttttcacttccactgtttttcattggctgtagctcacaccagattgcaggaataacacaccagacaagcgcacatccaggacttgagttgtccccaagctgtatggaagcctgtagctgtcccctggacggatttaaccctgtatgtgaccccagcacccgggtggagtacataacaccatgtcatgcaggttgttcctcttgggtcgttcaggacgccctcgacaacagccaggttttctacacaaactgtagctgcgttgttgagggcaacccagtgctcgctggctcctgcgactctacatgcagtcatctcgtggtgccttttttacttttagtgagtctgggaagtgcattagcatgccttacgcatacaccttccttcatgctcatactaaggggcgtgaaaaaagaagacaaaactctcgctgttggcattcaatttatgttcctcagaatcctagcatggatgccctcaccggttattcatggcagcgcgatagatactacatgtgtccattgggcacttagttgtggtcggagagctgtttgccgctattacaataatgatctcctaaggaaccggtttatagggctacagttcttctttaagactggctcagtgatctgttttgctctggtgctggccgtgctaagacagcaggacaaagaagctagaactaaggaaagtagaagcagcccggctgtcgaacagcagttactagtgtccggtccaggaaagaaacccgaggatagtagagtgtag

SEQ ID NO: 54434 - DNA, 1449 bp, Artificial Sequence
  Description of Artificial Sequence: Synthetic coding sequence
atgatcggctacggcgcaatcctagtcgccctcgccggtctgttaatgacactgcctcacttcataagcgagccctatcgttacgataataccagcccaggaggcatatcgttgaccatcaaagatcctcgctgggttggggcttggtggctgggcttcctgattgccgcaggcgctgtggctcttgccgctataccatattttttttttcccaaggagatgccaaaggaaaaaagggagctgcagtttcggaggaaagtgctcgcagtcactgacagtccggctcgcaagggaaaggatagcccctcaaagcaatcccccggagaaagcactaagaaacaggatgggctggtgcagattgctccgaatcttacagtaattcaatttatcaaggtcttccctcgtgtccttttgcagaccttgcgacacccaatttttttgctggtggtcctgagtcaggtgtgcctgagttccatggccgctggtatggccatttttttgcctaagttccttgaaaggcagttttctatcacagccagttatgctaaccttctcatcgggtgccttagctttccaagcgtgatcgtaggaatcgtggttggaggggtcctggtgaagagactgcacctgggacctgttggctgcggggctctgtgcctgcttggtatgctgctatgtttgttcttttctttacccttgttcttcatagggtgctcgagtcatcagattgcgggaattacccaccaaactagtgcccatcccggactggaattatcaccgagctgcatggaggcttgttcctgtcccctcgacggcttcaaccccgtctgcgatccctctactcgcgtggaatacataaccccgtgccacgctggctgttcatcctgggtcgtgcaggacgcgctggacaatagtcaggtgttctacaccaattgttcctgcgtggtggagggaaaccctgtgctggctggatcctgcgattcaacttgctcccacctggtggtacctttcctgctgctggtgtcgctgggtagcgccttagcctgcctgacccacaccccctcatttatgctgatcctgaggggtgtcaaaaaagaagacaagactttggcggtaggaatccagttcatgtttctgaggatcctggcctggatgccttcccctgtgatacacggtagtgcgatagacacaacttgtgtgcattgggccctcagctgcggtcgacgtgccgtctgccgctactacaataatgacttactccgaaacagatttattggactccagttcttcttcaaaaccggctccgtgatctgttttgctctcgtactcgcagtgctgaggcagcaggacaaggaggctcggaccaaggaaagccggtcttcccctgccgtcgagcagcagcttctcgtcagcggcccaggcaaaaaacctgaagatagtcgggtctag

SEQ ID NO: 54435 - DNA, 2064 bp, Artificial Sequence
  Description of Artificial Sequence: Synthetic coding sequence
atggggaccgaaaatacaccgggaggtaaagcttcgccagatcctcaggacgtcaggccgagcgtgttccataacatcaagctgtttgtcctttgtcattccttattgcagctggctcagttgatgatctctggctacctgaaatcatctatctccacagtcgaaaagaggtttggtctgtctagtcagacaagcggactcttagcatccttcaatgaggttggtaacaccgcgctaatcgtattcgtgtcttacttcggatcacgcgtgcatcgccctcggatgataggctacggcgcaattctggtagcactcgcaggcctgctgatgacactgcctcacttcatttctgagccataccgctacgataatacatcgcccgaggatatgccgcaagattttaaggcgagcttgtgcctccctacgacctccgcccctgcttcggcaccctccaatggaaactgctccagttataccgagacccagcacctgtctgtagtcgggattatgtttgtggcgcaaaccctgctcggtgtcgggggagtgcctattcaacctttcgggattagctacatcgatgactttgcccacaactcaaattctcccctgtacctgggcattctgtttgccgtgactatgatgggccctggccttgctttcggtctgggcagtctgatgttgcgcctgtatgttgatataaatcaaatgcctgaaggtggcatatctctgactattaaggaccctaggtgggtcggggcttggtggctgggcttcctgattgcggctggagcagtcgccctagccgctatcccctacttcttcttcccaaaagaaatgcccaaagagaagcgggagttacagttccggcgaaaggttctggcagttactgactcacccgctagaaaggggaaagacagcccgtccaaacagagccctggcgagagcactaagaagcaggacggactcgtacagatcgccccaaatctaactgtgatccaattcattaaggtattcccaagagtgcttcttcagaccctcaggcacccgatcttcttgctggtcgtactcagtcaggtgtgcttgagcagtatggcggcaggaatggctatcttcttacctaaatttttagaacggcagtttagcatcacggcctcttacgcgaatttgctgattggatgcctgtcctttccaagtgtcatcgtgggtatcgtggtcgggggagtgctggtaaagagacttcatctgggaccagtgggctgcggcgcattgtgcctcctcggcatgcttctatgtctctttttttctctgcctctcttctttatcggttgctcatctcatcagattgcaggaatcacacaccagacgagcgcccaccccggtcttgaattatcaccatcctgcatggaagcttgtagctgccctctggatggctttaaccctgtgtgcgatccgtcgactcgagtagagtacatcacaccttgccacgccggatgcagttcctgggttgttcaggacgcacttgataactctcaagtgttctataccaactgctcatgtgtggtggaaggcaatccagttctagcgggatcgtgcgacagcacatgcagccacctggtagtgcctttcttgttgctagtctctcttgggagtgcactggcgtgtctcacccacaccccttccttcatgctcatcctacggggagtcaagaaggaagacaaaactttggctgttggaattcaattcatgttcttacgaatcctggcgtggatgccctcccctgtgatccacgggtccgcaatcgacaccacttgcgtgcactgggcactgagttgtgggagacgagccgtctgtaggtattacaacaatgacctgcttcgcaatagatttatcgggctgcagttcttcttcaagacaggctccgttatatgcttcgccctggtgctggccgtgctgcggcaacaggacaaggaagcgagaacaaaggaatcaaggagctccccagcagtggagcagcagctgctcgtgtcggggccaggaaagaaaccagaagacagtcgagtgtag

SEQ ID NO: 54436 - DNA, 1449 bp, Artificial Sequence
  Description of Artificial Sequence: Synthetic coding sequence
atgatagggtatggagctattctggtcgctttagcgggtcttctgatgacgctgccacactttatcagcgagccttatagatacgataacacctccccaggcggtattagcctgactattaaggacccccgatgggttggcgcatggtggttaggctttttgatcgcagcaggcgcagtggcactggcagcaatcccatactttttcttcccgaaagagatgccaaaagaaaagcgcgaattgcagttcagacggaaagtgctcgccgtaactgattctcctgccaggaaagggaaggatagtccttccaaacagtcacctggagaatcaaccaagaaacaagatggcctcgtccagatagcccctaacctcacggtcatacaatttattaaagtctttccaagggtgctgctgcagacactaaggcacccaatcttcctactcgttgtgctgtctcaggtgtgtctctcaagcatggcagctggtatggctatcttcctgcctaagttcttagagaggcagtttagtatcaccgcgtcttacgctaatctcttaataggttgtctgtcctttccttccgtgatcgtgggtatcgtggtaggcggagtcttggtgaagcgacttcatctggggccagtgggttgcggcgcactatgcctgctggggatgttattatgcctttttttctccttaccactgttttttatcggctgctcttcccaccagatcgctggcatcactcaccagacctcggcccatccgggtctggagctgtcccctagctgtatggaggcctgctcctgccctctcgacggatttaatccagtgtgtgacccttccaccagggtggagtatatcacgccatgccacgctgggtgctcgagttgggttgttcaggatgctttggacaacagtcaagtgttttatacaaattgctcatgtgttgtggaagggaatccagtcttagccggatcatgcgattccacctgcagtcacctagtcgtaccatttttattgcttgtctcacttggcagcgccctggcttgtctaacacacacccccagttttatgctgatcctgcggggtgtcaaaaaagaggataagactctcgctgtggggatccagttcatgttcctcaggatcctcgcctggatgcctagtccagtcatccatggatccgccattgacacaacatgcgtgcattgggctttatcttgcgggcgtagagctgtgtgccgttattacaacaacgatctgctccgaaaccggttcatagggcttcagtttttcttcaaaactggatctgttatctgtttcgcccttgtgctcgccgtgttgagacaacaggataaagaggcaagaacgaaagagtctcgttctagccccgcagttgaacagcagctgctcgtgtccgggccagggaagaagccagaggactccagagtgtag

SEQ ID NO: 54437 - DNA, 1698 bp, Artificial Sequence
  Description of Artificial Sequence: Synthetic coding sequence
atgggtcccagaattgaggacatgcctcaggacttcaaggcatctctttgcctgcccactacttccgctccagcctccgcgccaagtaacggaaactgcagctcatacactgagacacagcacctgtccgtcgtcggcattatgttcgtggcccagacattattgggggtgggaggagtgccaatccagccattcggcatcagttatatcgacgacttcgcgcacaattctaactctccattgtacttggggatcctatttgcagtcactatgatggggcctggattggcctttggcctgggttcactgatgttgcgtttatatgtcgatatcaatcagatgccagagggaggtatttctcttacaatcaaggatccacgctgggtcggcgcatggtggttgggattcctgatcgccgcaggcgcagtggcgctggccgctattccttatttttttttccctaaggagatgcctaaggagaagcgcgagctgcagttcaggcggaaggttctagccgtgactgactctcctgccagaaagggtaaagactctcccagcaagcagtccccaggtgagtctacaaaaaaacaagatggcctggttcagatcgccccaaatctaaccgttatacaatttattaaggtgttccccagggtgctcctgcagacattgaggcacccaatctttctgctggtggttctttcccaagtctgtctgtccagcatggctgcgggaatggccattttcctgcccaagtttctggaacgacagttcagcattaccgcatcatacgccaatttactcatcggttgtctatccttcccaagcgtcatcgttgggatcgtggtgggcggtgtgctggtgaagaggctccaccttgggcctgttggctgcggcgctctgtgtttgctcggaatgctcctgtgcctattcttcagtctgccactcttctttatcggatgttcctctcatcagattgccggaatcactcaccagacttccgcacatccgggtctggagctgtcacctagctgcatggaggcatgcagctgcccactggacggcttcaatcccgtctgtgaccccagtacacgggtggaatacattactccctgccacgccggatgttcttcctgggtcgtgcaagatgctctggacaatagccaggttttttacactaattgttcctgcgttgtagaaggtaacccagtgttggcaggcagctgcgactctacctgttctcacctggtggtcccctttttacttctcgtttcactcgggtctgccttggcctgcctgacccatactccttcattcatgcttattctccgaggggtgaagaaggaagacaaaacactcgcagtcggaattcagttcatgtttctccggattcttgcgtggatgcctagcccagtgatccacggtagtgctatcgatacgacctgcgtgcattgggcactcagctgtgggcgaagagcagtgtgtcgatattacaataatgatctgttgcgaaacaggttcattgggctgcaattttttttcaagacgggttctgtgatctgcttcgccctggtcctcgctgtgctcaggcagcaagataaggaagccagaactaaggaaagccgttcctcccccgcagtcgagcagcagttgctggttagtggaccgggaaaaaagccagaagatagtagagtgtag

SEQ ID NO: 54438 - DNA, 135 bp, Artificial Sequence
  Description of Artificial Sequence: Synthetic coding sequence
atgggcacagagaatacccctgggggaaaggcctcaccagacccacaggacgtccgtcctagtgtctttcacaatatcaaactttttgtactctgccacagcctcctacagcttgctcagctgatgattagctag

SEQ ID NO: 54439 - DNA, 453 bp, Artificial Sequence
  Description of Artificial Sequence: Synthetic coding sequence
atgggcactgagaatacgcccggaggcaaagccagccccgaccctcaggatgtaagaccttccgtttttcacaacatcaaactatttgtcctgtgtcacagcttacttcagttggcgcagctcatgatctccggttatttgaaatctagtatctccactgtcgagaagcgtttcggcctcagtagccaaacatctggattgctcgcctcctttaatgaggtggggaataccgcgctaattgtctttgtgtcatattttggatccagggttcacaggcctagaatgatcggctatggggctattttggttgccctcgctggcttactgatgacgctcccccacttcatcagtgagccatatagatacgataacacaagtcccgaggacatgccccaggacttcaaagcctccctctgcctgcccacgacgagcgccccagcgagcgctccctag

SEQ ID NO: 54440 - DNA, 135 bp, Artificial Sequence
  Description of Artificial Sequence: Synthetic coding sequence
atgggtaccgagaacacgccagggggtaaagcttcgccagatccgcaggatgtcaggcctagcgtgtttcataatattaaactctttgtcctgtgccatagcctcctgcagctggcccagttgatgatctcctag

SEQ ID NO: 54441 - DNA, 264 bp, Artificial Sequence
  Description of Artificial Sequence: Synthetic coding sequence
atgggaacagagaacacccctggagggaaagcgagtcccgacccgcaggatgtgcggccatccgtatttcataatatcaagctgtttgtcttatgccatagcttgctgcagttggcccagctcatgattagcggctacttgaaatcgtctatcagcacggttgagaagcgtttcggcctctccagccagactagcgggctgctggcgtcctttaacgaggttgggaacacagctctcatcgtattcgttagctacttcggttag

SEQ ID NO: 54442 - DNA, 1782 bp, Artificial Sequence
  Description of Artificial Sequence: Synthetic coding sequence
atgatcggctatggtgccatcctggtagcactagccggactcctgatgaccctcccgcattttatctccgaaccgtataggtacgataatacatcccctgaggacatgccacaagatttcaaagctagcctctgtttgccaaccacaagtgccccagcctccgctccgagcaacggaaattgttccagctacaccgagacccagcatttatcagtcgtggggatcatgttcgtggctcagacgctgctgggcgtcggcggagtccccatccagccctttggcataagctatatcgacgattttgcccacaatagtaactctccgctgtacctgggcatcctctttgcagtgacaatgatgggaccgggacttgcattcgggctgggaagtctgatgttgcgcttgtacgtggacatcaaccagatgccagagggaggtatttccttaaccattaaagatcctcgatgggtgggggcttggtggctgggtttcttgatcgccgctggcgctgtggcacttgctgctatcccatacttctttttccctaaagagatgcccaaagaaaaacgggaactgcagttccgccgtaaggtgcttgccgttaccgacagccccgctcgcaagggcaaggacagtccatccaagcaatctcccggtgagagcacaaagaaacaggatgggctcgtgcagatagctcccaacctcacagtgatacaattcatcaaggtcttccccagggtactgctccagaccctgcgtcatcccatattccttctcgtggtccttagccaagtgtgtttatccagcatggctgctggaatggcaattttccttcccaagtttttagagcgccagttcagtataaccgcatcttatgccaacctactcatcggctgtctgtcgttcccaagcgtaatcgtgggcatcgtggtgggtggagtgttggtcaagcgccttcatctcggtcctgtaggatgcggggcactgtgcctgctgggaatgcttttgtgtttgttcttctcactgcccctgttctttatcggatgctcatcacatcaaatcgcagggatcacgcaccagacgtctgcccatcccggattggagctgtccccgtcctgcatggaggcgtgctcttgcccgctcgatggttttaaccccgtgtgtgacccttctactcgagttgaatacatcactccatgccacgcgggttgcagtagttgggtagtccaggacgcactcgataatagccaggtattctatacgaactgctcttgcgtggtagaagggaaccccgtgctggcaggtagctgtgactccacatgctcacatcttgtcgtgcctttcttgctgcttgtatcactcggaagcgctttggcctgcctcacccataccccttctttcatgttgattttgcggggtgtgaaaaaggaggacaaaaccctggctgtgggcatccaatttatgtttctgcggatcctcgcctggatgcccagcccagtaattcacggcagcgctattgacactacgtgtgtacattgggcgctgagttgcggccgaagggcggtgtgcaggtactataataatgatctgctgcgcaaccgttttatcggcctccagtttttttttaagacaggtagcgttatttgctttgctcttgtgctggcggttcttcgccagcaggataaggaggccaggactaaagagtcgcgatcttcacctgccgtggagcagcagctgctagtctctggtcccggtaagaagcccgaggattcgagggtgtag

SEQ ID NO: 54443 - DNA, 135 bp, Artificial Sequence
  Description of Artificial Sequence: Synthetic coding sequence
atgggaacagagaacaccccaggcggtaaagccagccctgatccacaggatgtacggcctagtgtgtttcacaatattaaacttttcgtgctgtgccattcactgctccagctggcccagctcatgatatcctag

SEQ ID NO: 54444 - DNA, 384 bp, Artificial Sequence
  Description of Artificial Sequence: Synthetic coding sequence
atgggcacagagaacactccaggcggtaaagcctctccagacccacaagacgtgaggccctccgtgtttcacaatatcaagctcttcgtgctgtgccactcgttgttacagctggcccagctgatgatttccggttacttgaagtcctctatttccacagtcgaaaagcggtttggactatccagtcagacaagcggactattggccagcttcaatgaggttggcaacacagccctcatcgtgttcgtctcctattttggctccagagtgcatagaccaagaatgattggatatggggctatcctggtggccctggcaggattacttatgactttgccccacttcatctcagagccgtacaggtatgacaatacgagcccttag

SEQ ID NO: 54445 - DNA, 2175 bp, Artificial Sequence
  Description of Artificial Sequence: Synthetic coding sequence
atgaaaagtgccaaaggcattgagaatcttgctttcgttccatcctctcccgatatcctgaggcggctttcagcatcccccagtcagatagaggtttcggcgctttcctctgacccccagagggagaacagccaaccccaggagttgcagaagccccaggagccacaaaaaagcccagaacctagcctacccagtgcgcctccaaacgtgtccgaagagaaactacgcagcctatccctcagcgagtttgaagaggggagctatggatggagaaacttccacccacagtgtctgcaacgttgcaacacaccagggggatttctactgcactactgtttgcttgctgtgacccagggcatagtggtgaatggcctcgtgaatatcagcatcagtaccgtggagaagagatatgagatgaaaagttccctgactggcctgatcagttcatcctatgatatcagtttttgtctgctgtcattgttcgtgagtttcttcggcgaaaggggacacaagccgagatggctggcatttgccgcattcatgatcggccttggtgctctagtattcagtctcccccagttcttctcaggggaatacaaactcggaagcctcttcgaggacacctgtgtgactaccaggaattccacatcatgtacatcttccactagcagcctgagtaactacctttatgtatttattctcggacaactgctcctgggcgcaggtggcactccactgtacactctagggacagcgtttctagatgactcagtgccgacccacaagtcctcactctatatcggaactgggtatgccatgtcaatactaggcccagccatcggctacgtcctgggaggacagctgcttacaatctacatcgatgtcgctatgggggagtctaccgatgtgaccgaagatgaccctaggtggctgggtgcctggtggatcgggttccttctgagttggatcttcgcatggagcttgatcatccctttttcttgtttccctaaacatctgccaggtacggcagagatccaagccggtaagactagtcaagcccatcagtccaattccaacgctgacgtaaaattcggcaagtcaatcaaagacttccccgcagcgcttaaaaacctgatgaagaacgcagtgtttatgtgccttgtcctgagtacaagctcggaggctttgatcacaaccggcttcgccacctttcttcccaagtttatcgaaaaccagtttggactgacaagttctttcgcagctacactggggggtgccgtgttgatcccaggtgctgctctgggccaaattttaggaggatttctcgtctctaagtttcgcatgacctgcaagaacactatgaagtttgctctcttcacaagcggagtggcgttaactctgagctttgtgtttatgtatgccaagtgtgaaaacgaacccttcgccggtgtgagtgagtcatacaacgggactggggaactgggtaacctgatcgcaccctgcaatgccaactgtaactgttcccgctcttactactatcctgtgtgcggcgacggtgtgcagtacttttcaccctgttttgcgggatgctctaatcctgttgctcatcgaaagcctaaggtctactacaattgctcatgcatcgagcgaaaaacagagattacaagcaccgctgaaaccttcgggttcgaagctaaagcgggaaagtgtgaaacacactgtgctaagttgccaatatttctctgtatctttttcatagttatcatttttactttcatggcgggtacgcctatcacggtctccatcttacgctgcgtcaaccacaggcagcggagcctggctctaggaattcaatttatggtgctgcgactccttgggaccattcccggacctatcatcttcggtttcacaatagatagcacttgcattttgtgggacatcaacgattgtggaatcaagggagcatgctggatatatgacaatattaaaatggcacacatgctggtggccatttctgtgacatgcaaggtgatcacgatgttctttaacggttttgccatcttcctgtacaagcctcccccaagtgctacagacgtgtccttccacaaagagaacgctgtggtgactaacgtactggcggagcaggatctgaacaaaattgtgaaggagggatag

SEQ ID NO: 54446 - DNA, 2547 bp, Artificial Sequence
  Description of Artificial Sequence: Synthetic coding sequence
atggacgagggaaccggattacagcccggagcgggagaacagctggaagccccagctacagccgaggcagtgcaggagagatgcgaacctgaaacactgaggagtaaatctcttccagtgcttagtagtgcctcttgtcggccatctttgtcacccaccagtggcgacgccaaccccgcattcggctgtgttgacagtagtggacaccaggagctcaagcagggtccaaaccctcttgctcctagcccgtcagctccaagcaccagtgctgggcttggagactgcaaccacagggtcgacctgtctaagaccttcagtgtatcgagcgctttggcaatgcttcaggagagacgatgtctgtatgtagtcttgactgactccagatgttttctggtttgtatgtgctttctgacctttatccaagccctgatggtctcagggtatttatctagcgtgatcaccactattgagcgtcgctattcactgaaatcctctgaaagtggcctcctggtttcctgttttgatataggaaacctcgtcgttgtggtgttcgtgagctatttcggaggcaggggacggcgacccctctggctagctgtaggtgggctgctgattgcatttggcgctgcactgtttgcccttccacactttataagccctccatatcagatccaggagttgaacgccagcgcccctaacgatggcctgtgtcaggggggtaattctactgccacccttgagccgccagcctgtccaaaggacagtggcggtaacaatcactgggtgtacgtggcactgtttatctgtgcccaaatacttatcggaatggggtcaacacctatctatacactggggccaacctacctggatgacaacgtcaaaaaagaaaattctagcctgtatcttgccataatgtacgtcatgggtgccctcgggcctgcagtcgggtatctccttggcggactgctgattgggttctacgtggatcccagaaatccagtacatcttgaccagaatgacccccgattcatcgggaattggtggagcggcttcttgctgtgtgcaatcgctatgtttcttgtaattttcccaatgtttaccttccccaagaaactcccgccaaggcataaaaagaagaaaaaaaagaagttcagcgttgatgctgtaagcgatgatgacgtcctgaaggagaaatccaataacagcgaacaggccgataaaaaggtgtcatcaatgggcttcgggaaagatgttagagatcttccaagggctgccgtcagaatcctctcaaatatgacgttcttgtttgtgtctctgtcttacacagccgagtcagctattgtgacagctttcattacatttattcctaaattcatcgagagtcagttcggcattccggcttccaacgcatctatctacacaggcgtgatcatcgttccctccgctggcgtgggcatagtcctgggcggatacattatcaagaaattgaaattaggggctagagaatctgcaaaactcgctatgatttgctctggagtatccctgctttgtttctctaccctcttcatcgtggggtgtgaaagcattaacctaggcggtatcaatattccctatacgaccggtccaagtctgaccatgccgcacaggaatctgactggttcctgcaatgttaactgtggatgcaaaattcacgagtacgagcctgtctgcggaagcgatggcatcacttactttaatccctgccttgccggttgcgtcaacagtggcaacctgtcaaccggtatccgcaattatacggagtgcacatgcgtgcaaagcaggcaagtgatcacacccccaaccgtcggccagagaagccaattgagggtcgtaatagtcaagacctacctgaatgagaacggctacgctgtctcaggaaagtgtaagcggacctgtaatactctcattcctttcctggttttcttgtttatagtcacctttattactgcgtgcgcccagccgtcagccataatcgtcactttaaggtcggtggaggatgaagaacggccatttgcactaggcatgcagtttgtacttctgagaaccctcgcctatatcccaacgcccatatattttggggcagtaattgacacaacttgcatgctgtggcaacaggagtgtggggtgcaaggatcctgttgggagtacaatgtgacctctttccggttcgtgtactttggcctggcagccggattaaaattcgtcggttttatttttatttttctcgcatggtatagcattaagtataaggaagatggacttcagaggcggagacagcgcgagttcccgttatccacagtgagtgaacgggtgggccatccagataacgctaggacacgctcctgtcccgcattttccacacagggtgaatttcacgaggaaactggcttgcagaagggaattcagtgtgctgctcaaacttaccccggaccgttccccgaagcaatttcgtcaagtgccgatcccggactcgaggaatctcccgctgccttagagcccccttcttag

SEQ ID NO: 54447 - DNA, 2382 bp, Artificial Sequence
  Description of Artificial Sequence: Synthetic coding sequence
atggatgagggcaccggcctgcagccaggggcaggggagcagctggaagctcccgctaccgctgaggcagtccaggagagatgtgagccggagaccctgagatccaagtccctgcccgtactatcctcagcctcatgtcggcctagtctctccccaacttcgggcgacgccaacccagcctttggatgtgtcgactcttcggggcatcaggaacttaagcagggacccaatcctctcgcaccttctccaagtgcaccgtctacatcagcgggtctcggtgactgcaatcatcgagtcgacctgagcaagacgttcagcgtcagttcggctctagccatgctgcaggaaagaaggtgtctatacgtagtcctaactgacagccggtgctttctggtgtgcatgtgtttcctcacctttatccaggctctcatggtttctggttacttatctagcgtgattacaaccattgagagaaggtattctcttaagtcaagtgagtcaggactgcttgtttcttgttttgacattggcaatctagtcgtcgtggtgttcgtgtcctatttcggaggaagaggcagaagaccactctggctcgctgtcggaggtctccttattgctttcggagctgctctgttcgctttgccacattttatctcccctccctaccaaattcaggagctaaacgcgagcgccccaaatgacggcctgtgtcagggtgggaattctactgcaaccctcgaaccgccagcttgccctaaagattcaggagggaacaaccactgggtttacgtggctctgttcatatgcgcccagattcttatcggcatgggcagtactcccatatatacgctgggtcccacttatttagacgataacgttaaaaaggagaattctagcctgtatctggcaataatgtatgtcatgggcgcactgggcccagcagtcggatatctgctgggcggacttctgatcggcttttatgttgacccaagaaaccctgtccatctggaccaaaatgaccctagatttatcggcaattggtggagtggcttcctcttatgcgcaattgccatgttcttggtcatttttccaatgttcacgttcccaaaaaagctcccaccacggcacaagaaaaaaaaaaagaaaaaatttagtgttgacgcagttagcgacgatgatgttcttaaggaaaaaagtaacaatagtgagcaggccgacaagaaagtgagtagcatgggattcggcaaagatgtgcgcggagtgataatcgtgccttctgcgggagtgggaatcgtgctgggcggatatattatcaagaagttgaagctcggagctagagaaagcgccaaactggccatgatctgttccggagtgagcctgctgtgtttttctacactattcatcgtgggctgtgagtccatcaacctcgggggtataaacattccttacactacggggccttccctgacaatgccccatcggaatctcactgggtcctgtaatgtcaattgtgggtgcaaaattcacgagtatgagccagtgtgtggatcggatggcattacctactttaacccttgccttgctgggtgtgtgaatagtggcaacctttctacggggatcaggaactataccgaatgcacatgtgtccagagtcggcaggtcattaccccgccaactgtcggccagcggtcccaattgcgtgtcgtgattgtgaagacctacctgaacgaaaatgggtacgcggtcagcggcaagtgcaaaaggacatgcaatacccttatcccattcctcgtcttcctgtttatcgttacttttataactgcctgtgcccaaccatctgccattattgtcaccctccggagcgtcgaggacgaagagcggccatttgcgttaggcatgcagtttgttctcctgagaaccctagcatatatcccaaccccaatttattttggggcagtaattgacaccacctgtatgctgtggcagcaggaatgcggcgtgcaggggtcgtgctgggagtataacgtaacatccttccgcttcgtttactttggcctggcggcaggactaaagtttgttggatttatttttatcttcctggcatggtactcaatcaagtacaaagaagacggcttgcagaggcgtcgacagcgcgaattcccactgtctacagtgagcgagcgggttggacaccctgataatgcaaggactcggagctgtcccgctttctctactcagggcgaattccacgaggagacaggactccagaaagggattcagtgcgccgctcagacatacccaggccctttcccggaggcaatctctagttcagccgaccctggactggaagaaagccccgctgccttggaacctcctagttag

SEQ ID NO: 54448 - DNA, 606 bp, Artificial Sequence
  Description of Artificial Sequence: Synthetic coding sequence
atgttcccggagcagcaaaaagaggaattcgtgtcagtctgggtgagagatccaaggatacagaaggaggatttctggcattcctatatcgattatgagatctgtattcacaccaattcaatgtgctttaccatgaaaacttcctgcgtcagaagacgctacagagagttcgtttggctcagacagcggttacagagcaacgctttgctggtgcaattgcccgaattaccatcgaagaacctgttcttcaatatgaacaatcgccagcatgtcgaccaacgcagacaggggttggaggacttcctgaggaaagtgttacagaatgctctgctgctgtctgattcttccctacacctcttcctgcaaagtcacctgaactccgaggatatagaggcctgtgtgagtggtcagaccaagtattccgtggaagaggccattcataaatttgcgttaatgaatcggagattccccgaagaggacgaggagggaaagaaggaaaacgatattgactatgatagtgaaagctccagctctggcttaggacatagcagcgacgatagctcttcacacggctgcaaggtgaacactgcacctcaggaaagttag

SEQ ID NO: 54449 - DNA, 606 bp, Artificial Sequence
  Description of Artificial Sequence: Synthetic coding sequence
atgtttcccgaacagcagaaagaagagttcgtctctgtctgggtgagggacccgcgtatccagaaagaggatttctggcacagctacattgattacgaaatctgcatacatactaactctatgtgcttcactatgaagacatcctgcgtccggagaaggtaccgggaatttgtgtggctgaggcagagactgcagtcaaacgctctcctcgtgcagttgccagagctgccctccaagaatctcttttttaacatgaataatcgtcaacacgttgaccagaggcggcagggcctagaagacttccttagaaaggtgttgcaaaatgcacttctgctctcagatagctccctgcacctgttccttcagtcacacctcaacagtgaagacattgaggcttgcgtctcgggacagactaagtattcggttgaggaggccatacacaaattcgccctcatgaaccggagattccctgaagaggatgaggagggaaagaaggagaacgacattgattatgattcagaatcaagcagctcagggctgggacactcttctgacgactcatcatcccatgggtgcaaggtcaacactgccccacaagaatcctag

SEQ ID NO: 54450 - DNA, 684 bp, Artificial Sequence
  Description of Artificial Sequence: Synthetic coding sequence
atgattctgatggagggtatcggatgtatgcggcactcttctctcacacgccagccgaagctcccctacaggtcactggcatccgcgcgagggggattgcaagagttcgtcagcgtgtgggtccgtgatccacggattcaaaaagaggatttctggcactcatacattgactacgagatctgcattcataccaactccatgtgtttcacaatgaaaacaagctgtgtgagacgcagataccgggaatttgtctggcttcgccagagattgcaaagcaatgctcttctggtgcaactgccggagttaccttcgaaaaacctgtttttcaatatgaacaaccgacagcacgtggaccagagaagacaggggctggaggatttcctgcgcaaagtgctgcagaatgccttgctcctatccgactcatccttgcacctcttcctgcagtctcacctgaatagcgaagacattgaagcttgtgtttctggacaaacgaaatattctgttgaggaagcaattcataaatttgctctgatgaataggagattccccgaagaagacgaagaggggaagaaggagaacgacattgattacgactctgagagtagctcttccggccttggccacagctccgacgacagctcgagccatggctgtaaggtgaacaccgcaccgcaggagtcttag

SEQ ID NO: 54451 - DNA, 354 bp, Artificial Sequence
  Description of Artificial Sequence: Synthetic coding sequence
atgaataataggcagcacgttgatcagagacgccagggtctggaagatttcctccgcaaggttcttcaaaacgctctcctcttatcggatagctccctgcacctgttcttgcagtcccaccttaactccgaggatatcgaggcgtgtgtgagcggacaaacaaagtactcagtcgaggaggctatccacaagtttgctttaatgaaccgacgcttccctgaggaggatgaggaaggcaaaaaagagaatgatatcgattacgatagcgagtctagctcttcaggtctcggtcatagcagtgacgattcaagcagtcatgggtgcaaagttaacactgcgcctcaggagtcctag

SEQ ID NO: 54452 - DNA, 2841 bp, Artificial Sequence
  Description of Artificial Sequence: Synthetic coding sequence
atggtgccttgggtccggaccatgggacaaaaactcaaacaacggctgagactagatgttggaagagagatttgtcggcagtatcccctgttttgttttttgttactatgtttgagcgcagccagtctgctgctgaacagatacattcatattctgatgatcttttggagcttcgttgccggagtggtcactttctactgttctttgggtcctgatagcttactgccaaatatcttttttaccattaagtacaaacctaaacagcttggcctgcaggaactgttccctcagggacacagctgcgccgtgtgcggcaaggttaaatgcaagaggcaccgaccctccctgctccttgagaactaccagccctggctggatctgaaaatcagctccaaagtagacgccagtctctcagaggtcttggaactggtgctggaaaacttcgtgtatccttggtaccgggacgtaactgacgatgaatcttttgtagatgagctgagaattaccctaagattctttgcaagcgtgcttatccgtcgaattcacaaagtggacataccttctatcattacgaagaagctgctgaaagctgcgatgaagcacatcgaggttatcgtaaaagcccgacagaaggtgaaaaacaccgaatttctgcaacaggccgcactcgaagagtacggaccggagttgcacgtcgcgctgagaagccgaagggacgagctgcattacttaagaaagctgactgagctgcttttcccctatatcctgcccccaaaggcgactgactgtcgcagtctgaccctattaataagagaaattttatccggctcagtgtttctgccatcgctggacttccttgctgacccagacactgtgaaccacctacttatcatctttattgacgattccccccctgagaaggccactgagcccgcttcaccgttagttccctttctacagaaattcgccgagcccaggaacaaaaaacccagcgtactgaagctggagctgaagcaaatccgcgaacagcaagacctgctgtttcgttttatgaacttcctgaaacaggaaggtgctgtacacgtgcttcagttctgcctgaccgtggaagagttcaatgaccgcatcttgagaccagaactgagcaacgatgagatgctgagcctacacgaggaacttcaaaaaatctataaaacctattgcctggatgagagtattgataagattaggtttgatccctttattgttgaagagatccagcggatagcggagggcccttacattgatgtcgtgaagttgcagaccatgcggtgtctcttcgaagcctatgagcacgtcctcagtctgctggagaacgtgttcacaccaatgttctgccattcggatgagtattttcggcaacttttgcgcggtgcagaatcacccacccggaactccaaacttaatcgcggaagcctcagtctggacgacttccgcaacacacagaaacggggtgagagcttcggaatatccaggatcggctctaaaatcaagggcgtgtttaaaagcaccaccatggagggagcaatgctgcccaactacggggttgcggagggcgaggatgatttcattgaggaaggcattgtagtaatggaagacgattctccagtggaagcggtttcaaccccgaacacaccacgaaacctcgctgcttggaagatttcaatcccatacgtcgactttttcgaggatccttcgtccgagcgaaaggagaagaaagagcgaatcccagtgttctgcattgacgtcgagcgaaatgaccgccgagctgttggacacgagcctgaacactggtccgtatacagaagatatcttgagttctacgtactcgagagtaaattaacggagttccacggtgccttcccagatgcacaacttccttctaagcgcatcatcggacctaagaattacgagttcctcaagagcaagcgtgaggaatttcaggaatatttacagaaactgctccagcacccggaattgagcaactcccagctgctggctgactttctgtctccgaatggaggcgagacccagtttcttgataaaatactgcccgatgtcaatctgggcaaaattattaagtctgtgcccggaaagctgatgaaagagaaggggcagcatttggaaccattcattatgaactttatcaattcttgcgagtcaccaaaaccaaaaccttctagaccagaactaaccatcctctcacccacgagtgagaataacaagaaattatttaacgacctgttcaaaaacaacgcaaacagagccgagaataccgaacgaaaacagaaccagaactatttcatggaagtgatgacagtcgagggggtgtatgactatctgatgtacgtgggcagagtggtgttccaagttccagattggctgcaccatttgcttatgggaacgagaattctgtttaaaaataccctagaaatgtataccgactactacctgcagtgtaaactggagcagcttttccaggagcacagactagttagtctcatcaccctgctgcgtgacgcaatcttttgtgagaataccgaacctcgctccctgcaggacaagcagaagggggctaagcagacctttgaagaaatgatgaactacatccctgacttgctggtgaagtgcattggtgaggaaaccaagtatgaatcaattcgcctgctctttgacggtctgcagcagccagtactaaataagcagctgacatatgtattactcgacatagtcatccaggaactgtttcctgaactgaacaaagtgcagaaggaggtgacctccgtgaccagttggatgtag

SEQ ID NO: 54453 - DNA, 2682 bp, Artificial Sequence
  Description of Artificial Sequence: Synthetic coding sequence
atggtgccatgggtccgcactatgggccagaaactgaagcagagacttaggcttgatgtaggcagagagatttgccggcagtaccccctgttttgttttctgcttttgtgtctcagcgccgctagcttactcctgaatcgctacatacatattctcatgattttctggtcctttgtcgcgggagtcgttacgttctactgctcactcggccctgactctctcttacccaacatcttctttaccattaagtacaaaccgaagcagctgggcctccaggagttgttccctcagggacacagttgtgccgtgtgcggcaaagtgaagtgcaagcgccaccgcccatcactgcttctggaaaattaccagccctggttagacctaaagatctcgagtaaggttgatgcatcactgtccgaagtggacattccttctatcatcaccaagaagcttttgaaagccgcaatgaaacatattgaggtgatcgtgaaagcacgtcaaaaggtgaagaacacagaattcctgcagcaggctgctctggaagaatacggcccagagctgcatgtcgcactgcgctctcgtcgggacgagctccactacctgcgcaaacttacagagttgctattcccatacatcttgccacccaaagcgacagattgtcggtcgctcacgctactgatccgggagatcttgagcggctccgtgtttctgccttcgctcgatttccttgcagatcccgatacagttaaccatctgctgatcatttttattgacgactcaccacctgagaaagcaactgagccagccagtccactggtcccttttttgcagaagttcgccgaaccaaggaacaaaaaaccttcggtgctgaaactagagctgaagcagattcgagagcagcaggatctcctgttccgcttcatgaacttcctgaaacaagagggagccgtgcatgttctgcaattttgtctgaccgtggaggagtttaatgaccggatcctgagacccgagctcagcaatgatgagatgctgtctctccacgaagagcttcagaagatctataaaacatactgcctggacgaaagcatcgacaagatacgctttgacccctttatagtcgaggagattcagcgtattgctgaaggaccgtacattgatgtagtaaaacttcagaccatgagatgcctttttgaggcctatgaacacgtgctgtcgcttctggagaatgtgttcacccccatgttttgccattcagacgagtacttccgacagctcctgcgaggcgcagagagcccaacaagaaactctaagctgaaccggaacacccaaaaaagaggcgagtctttcggtatctcacggattggttccaagatcaaaggcgttttcaagtcaactacaatggagggagctatgcttcccaattatggggtggctgaaggcgaggacgactttatcgaggagggaattgtggtgatggaagacgacagtcctgtggaagcagtgtccacccccaacacaccacggaaccttgctgcctggaagatcagtattccctacgtggacttcttcgaggacccctcctccgaaagaaaggagaaaaaggaacgtataccagtgttttgcattgatgtggagagaaacgatcgacgagccgtaggccatgaacccgagcactggtctgtctacaggcggtacctggagttctatgtgctggagagtaaactgacagagtttcacggagcattcccagacgcccagttacccagcaagcgcataatcggtcctaagaattatgaattcctcaagtccaagagagaggagtttcaagagtatctccaaaagctgctccagcaccctgagctcagcaacagccaactgttggctgattttctgtcaccaaatggaggcgagacacagtttctcgacaagattctgcccgacgtgaacttgggaaaaataataaagtcagtgccaggtaagctgatgaaggagaagggccaacatcttgagccttttattatgaattttatcaactcatgtgagagcccgaaaccaaagcctagtcgtcccgaacttacaatactgagtcccacgagtgaaaacaacaaaaaactcttcaacgatctcttcaagaataatgcaaaccgggcagagaatacagaaagaaagcagaaccagaattactttatggaagtcatgacggtagagggggtctacgactacctgatgtatgttggacgggtcgttttccaggtgcctgattggctacatcacctgctcatggggacaaggattctgttcaaaaataccttagagatgtacacagattactatctacaatgcaaattagaacaactgtttcaggagcacaggctggtgtctttgatcaccctcctacgcgatgcgattttctgtgagaacacagagccacgctcactccaggacaaacagaagggtgctaagcagaccttcgaagaaatgatgaactacatacctgacctcttggtgaaatgtatcggagaagaaaccaaatatgagagtatcaggctcctgtttgacggtcttcagcagcccgtattaaataagcagctgacatacgtgttgctggatattgtcatacaggagctgttccccgagctgaacaaagtgcagaaggaggtgacctccgttacctcctggatgtag

SEQ ID NO: 54454 - DNA, 2814 bp, Artificial Sequence
  Description of Artificial Sequence: Synthetic coding sequence
atggttccttgggtgcgtaccatggggcaaaaactgaaacaacggctgagactggacgttggccgtgaaatctgtcggcaatatcctctcttttgcttcctcctgctctgtctgtccgccgcatcactgctcctcaacagatacatacacatacttatgattttttggtcgtttgtcgctggggtcgtgactttctattgtagcttggggcctgattctctactgccaaatatcttttttacaattaaatacaagcccaagcaactgggtttgcaggagctgttcccgcagggccattcttgcgcagtgtgcggaaaggtgaaatgcaagaggcatagaccatctctactgctcgagaattatcagccttggctggacttaaagatttcctccaaagtggacgcaagcttgagcgaggttctagaactggtgcttgaaaatttcgtgtatccctggtatcgggatgtgacagatgacgagagctttgtagatgagctgcggattacacttcggttctttgcgagtgtgctcattaggcggatccacaaggtcgacattccatctatcatcacaaagaagttgctgaaagcagccatgaagcatattgaggtgatagtgaaggctcgccaaaaggttaagaacaccgaattcttacagcaagccgcacttgaggaatacggccctgagctccatgttgccctcagaagtaggagagacgaactgcattacctgcgcaagctaacagagctgctctttccttacatccttccacctaaagcaactgattgccgctcgttaactttactgattagagaaattctgtcagggagcgtgttcctcccctcccttgactttttagccgaccctgatacggttaaccacctgctaattatcttcatcgacgactctccacctgaaaaagcaactgaacctgctagccctctggtgccgtttctccaaaaatttgcagagcctcgcaataagaagccaagcgtattgaagctggagctgaaacagatccgagagcagcaagaccttcttttccgtttcatgaactttctaaaacaggagggagccgttcatgtgcttcaattttgtctcaccgttgaagagtttaacgatagaatcctcaggccagagctctccaatgacgaaatgctgtctctccacgaagagctgcagaagatttacaagacctattgtttggatgagagcatcgacaagatcaggtttgaccccttcattgtggaagagatccagcgcattgccgaggggccatatatagatgtggtgaaactgcaaacaatgcggtgcctgttcgaagcttacgagcacgtactgtctctgttagaaaacgtgtttacacccatgttttgccattctgacgagtacttcagacagctgctccggggtgcggagtcacccacaaggaacagcaagttaaacaggaacacccagaaaaggggggaatcctttggcatctcaaggataggatcaaaaatcaagggggtttttaagtccaccaccatggagggggctatgctaccgaattacggagttgccgaaggggaagatgacttcattgaggaaggtatagtggtgatggaagacgacagtcctgtggaggctgttagtactccaaatactccacgtaaccttgccgcttggaaaatctcaatcccttatgttgatttttttgaagatcctagctctgaaaggaaagaaaagaaggagcgaatacccgtgttctgtatcgacgtggagagaaacgatcgacgagcggtaggacatgaacctgaacactggagcgtataccgcagatacctcgaattctatgtccttgagagtaagctgaccgaatttcacggagccttccccgatgctcagctcccctcaaaaagaatcatcgggccaaagaattacgagttcctgaagagcaagcgggaggagttccaagaatacctgcagaaactgcttcagcatccagagttgtctaatagccagctcttggcagattttctcagtcccaatggcggagaaacacagttcctggataagattctgcctgacgtgaacctggggaaaattatcaagagtgtcccagggaaactgatgaaagagaaagggcagcacctcgagccttttatcatgaatttcattaactcttgtgaaagccctaagcccaaaccctcacggcctgagctgaccattctttcgcccaccagcgaaaataataaaaagttattcaacgatctattcaagaataatgccaaccgggcagaaaacacagaacgcaaacagaatcagaattacttcatggaagtaatgacggtagagggcgtgtacgattatctcatgtacgtcggcagggtggttttccaggttccggattggctgcaccacctgttaatgggaacccgcatcctgttcaaaaacaccctggagatgtataccgattactatctgcagtgtaagctggagcaactgtttcaagagcacaggctggtaagcctcatcactcttttaagggatgccatcttttgcgagaatacggaaccaaggtcgctacaagataagcaaaaaggagccaaacagacattcgaggagatgatgaactatatccccgatctgcttgtgaaatgtattggggaggagactaaatatgagtcaatccgattgttgtttgatggtctccagcaaccagtgctgaacaaacagctcacctacgtgttgctggatatagttatccaggagctgttccccgaacttaataaggtgcaaaaagaagtgacgtccgtgacatcatggatgtag

SEQ ID NO: 54455 - DNA, 1047 bp, Artificial Sequence
  Description of Artificial Sequence: Synthetic coding sequence
atggaggacgacagcccggtagaagcagtctcaactcctaacacgcccagaaaccttgctgcctggaagattagcattccgtatgtagatttcttcgaggaccctagctcggaacgcaaggaaaagaaagagcggatccctgtgttctgtatcgacgtggagcgtaacgatcggagggctgtggggcatgagcccgagcattggtccgtgtaccggcgatatctcgagttctacgtgcttgaaagcaaattgaccgagtttcacggcgcattcccggacgctcagcttccctctaaaagaataataggtcctaagaattatgagttcctgaagagtaagagggaggagttccaggaatacttgcaaaagcttctacagcatcccgagctgagtaactcacagctgttagccgatttcctcagccccaacgggggagagactcagttccttgataagattcttcccgatgttaatctgggaaaaattatcaagtcggtccctggaaaactgatgaaagaaaagggccaacacctcgagccttttattatgaattttattaacagctgtgagagtccaaaacctaaaccttctcgaccagagctgacgatcctctcgcccacatctgaaaataacaagaaactgttcaatgacttgtttaagaacaacgcaaaccgagctgaaaacacagaacggaagcagaaccagaactactttatggaagtgatgacagtcgaaggagtgtacgattatctcatgtatgtggacgcaatcttttgcgagaataccgaaccacggagccttcaagacaaacagaagggtgctaaacagacctttgaggagatgatgaactacatccctgatttgctggtcaagtgtattggagaagagaccaagtatgagagcattcggctgctgtttgacggactgcagcaacccgtgctgaacaagcagctgacatacgtactgttagacatcgtgatccaggagcttttccctgagctgaacaaggtccagaaagaggtgacaagcgtcacctcttggatgtag

SEQ ID NO: 54456 - DNA, 2685 bp, Artificial Sequence
  Description of Artificial Sequence: Synthetic coding sequence
atgattttctggtctttcgttgctggtgtggtgaccttttactgtagccttggtcccgacagtctcctgcccaacattttcttcaccatcaagtacaagccaaagcagctcggactgcaggagctgtttccgcagggacatagctgtgctgtgtgtggaaaggtcaagtgcaagcgtcatcgcccttcactgctgctggagaactaccaaccatggcttgacctgaagatttcaagcaaagtggacgccagtctgtcagaggtgctggagctggttcttgaaaacttcgtatatccatggtatcgtgatgtcaccgatgatgaatcttttgttgatgagctgaggattactctccgatttttcgcatcggtcctgattcgtcgaatccacaaggtggacataccgagcattataacgaaaaaactcctgaaagccgcaatgaagcatattgaagttatcgtcaaagccaggcagaaggtgaaaaacactgaattcctgcagcaggccgcacttgaggaatacggtcctgaacttcatgtggccctgaggtctcgcagagacgaactgcactatttgaggaaactcaccgaactgctgtttccttacatccttcccccaaaagcaacagactgccgtagcctgacccttctgattagggagattctctctggcagcgtcttcctgccctcgttagactttttagctgaccctgataccgtcaatcatctcctgattatctttattgacgactcgccaccagagaaggccactgaacctgccagccccctcgtcccctttctccagaaatttgccgagccgaggaacaagaagccaagcgtgctgaagctggaactcaaacagattagagaacagcaggatctgctgttccgctttatgaacttcctgaagcaagagggcgcagtccatgtgttgcagttttgcctcacagtcgaggagttcaacgacagaatcctacggccagagttgagcaacgacgagatgcttagcctacacgaagagttacagaagatttataagacatactgtcttgacgaaagcatcgacaaaatcagattcgacccgtttattgtcgaggaaatacagcgtatcgccgagggtccatacattgatgtggtcaagctgcagacaatgcggtgcctatttgaggcctacgagcatgtgctttccttactggaaaacgtcttcacaccgatgttttgccacagcgatgaatatttcaggcaactactccgaggggctgagagtcccactcggaacagtaaacttaatcgcggaagtttaagcctcgatgactttcggaacacccagaagcgcggtgaatcttttggcatcagtaggattggtagtaagatcaagggggtctttaagtctaccactatggagggtgccatgcttcctaactacggagttgcagagggggaggacgattttattgaggagggcatagttgtaatggaagatgattcaccagtcgaagcggtaagcacaccaaacactccacgtaacctcgcagcctggaagatcagcatcccttacgttgacttctttgaggacccaagctctgagagaaaagagaagaaggagcgcattcctgtgttctgtattgatgtggagaggaacgatagaagggccgtaggacatgaaccagagcactggtcagtgtaccgcagatatctggaattttatgtcctcgagtcaaagctaaccgaatttcacggcgcattccccgacgcacagttgccttccaagcggattatcggcccaaaaaattatgaattcttgaagtccaagcgggaagaatttcaagaatatctccagaaacttcttcagcaccccgaattaagtaactcgcagctgctagccgattttctttccccaaatggtggcgagactcagtttctggacaagatcctgccagacgtcaacctagggaagattattaaaagtgtgcctggtaagctgatgaaagagaaaggccagcatctggaaccctttatcatgaattttatcaactcgtgcgagtcgcctaaacctaagccctcgaggcccgaactcacgatcctctctccaaccagcgagaataacaagaaactgtttaatgacctctttaaaaataatgcgaaccgcgcagagaatacagagcgcaagcagaatcaaaactacttcatggaagttatgaccgtagaaggagtctacgactatttgatgtacgtgggacgcgttgtgttccaggtgcccgattggctgcaccatttgctcatgggtaccaggattttgttcaagaacactttggaaatgtacaccgattattacctacagtgtaagcttgaacagctgttccaggagcatcgactggtctccttgatcacacttctgagagacgccatcttctgcgagaacacggagcctagaagcctgcaagacaaacagaagggggcaaagcagacattcgaggaaatgatgaactacataccggatcttttggtcaagtgtattggcgaggagaccaaatacgaaagcataaggctcctgtttgatggcctgcagcagcccgtccttaataagcaactcacgtacgtgctgctagacattgtcattcaggagctcttccctgagcttaacaaggtccagaaggaagttacctctgtcacctcatggatgtag

SEQ ID NO: 54457 - DNA, 1035 bp, Artificial Sequence
  Description of Artificial Sequence: Synthetic coding sequence
atggctactccatacgtccccgtccccatgccaatcgggaattctgcctcttcattcacaacaaaccgtaaccaaagatcttcaagctttgggagtgtgagcacttcctccaattcgagcaagggacagttggaggacagtaacatggggaatttcaagcagaccagcgtgcccgatcagatggacaacacttcgagtgtgtgctcgtccccccttatcagaacgaaattcactgggaccgcctcttcaatagagtactccaccaggccaagagatacagaggaacagaaccccgaaaccgtgaattgggaagatagacctagtaccccgactatattggggtatgaggtgatggaagaacgtgctaaattcacagtatacaaaatcctcgtgaagaagacaccagaggagagttgggtggtctttcgaagatacactgactttagccgactgaacgacaagctaaaagagatgttccctgggtttcggctggcgctccccccaaagaggtggtttaaagataattacaacgccgactttttggaggatcgccagctgggcctccaggcttttctgcagaacttggtagcccacaaggacatagctaactgcctggccgtccgggagtttttatgtctcgatgatccccctggccctttcgactcccttgaggaatctcgggctttctgtgagacgttggaggagactaactatcgcctccagaaagagctactggaaaagcaaaaggagatggaatctctgaaaaaacttctctccgaaaagcagttacatatcgacacgctggagaatcgcattcgtacgctcagccttgagcccgaagaatcactcgatgtgtctgaaacagagggcgagcaaatactcaaagtcgagagctctgccctggaagttgaccaggacgtgttagatgaggagtcccgcgcagacaataagccatgcttgtcatttagcgagcctgagaatgccgtctctgagattgaagtcgcagaagtggcatacgacgccgaggaggattag

SEQ ID NO: 54458 - DNA, 948 bp, Artificial Sequence
  Description of Artificial Sequence: Synthetic coding sequence
atggctaccccttacgttcctgttcccatgcccattggcaattccgctagcagctttactactaatagaaaccagaggagctcttcctttgggagcgtgagtacatctagcaactcttccaaagggcaattagaagactctaacatggggaattttaaacagaccagcgtcccagaccaaatggacaacacaagctcagtctgctcctcccccctgatccgaacaaagttcaccggcacagctagcagcatagagtacagcactcgcccaagggataccgaagaacagaaccctgagaccgtgaattgggaggacagaccatcaacaccaaccatactgggttatgaggtgatggaggagcgagcgaaatttactttgaaagagatgttccctggattccgactcgcactgcctccgaaacggtggttcaaggataactacaacgcagattttctggaagaccggcaactaggtctacaagccttcctgcaaaatttggttgcacataaggacatcgccaactgccttgctgtacgggagttcctgtgtctggatgatcctcctggacccttcgactccctcgaagagagtcgcgctttctgcgagaccctggaggaaaccaactatcgcctacaaaaggagcttctggagaaacagaaggagatggagagtttgaagaagctgctgtcggagaagcagctacacattgatactttggagaatcggattcgcacactatccctggagcccgaggagagcctggacgtgtcagaaaccgaaggcgaacagattcttaaggttgagtccagcgcactggaggtggaccaggacgtgctcgacgaggagagtagagctgataataagccatgtttgtcattctctgaacccgagaacgccgtgtctgagatagaagttgcagaagttgcttatgatgccgaggaagactag

SEQ ID NO: 54459 - DNA, 1035 bp, Artificial Sequence
  Description of Artificial Sequence: Synthetic coding sequence
atggctaccccttacgtaccagtcccaatgcctataggcaacagcgcttcaagcttcacaactaacagaaatcagcgctctagctcttttggttctgtaagtacatctagcaacagctctaagggccagctggaagatagtaacatggggaacttcaagcagaccagtgtgcccgatcagatggataacacgtcatccgtctgtagcagccccctgattaggaccaaatttacggggaccgcaagtagcatcgagtattcaactaggccacgcgacactgaagagcagaatcccgagacggtcaattgggaggatagaccatctacaccaaccatcttgggatacgaggtaatggaggaacgggctaagtttactgtctacaagattctcgtcaagaagacccctgaggagagttgggtagtgttcaggcgttacacagatttttcccggctcaacgacaagttgaaggagatgtttcccggatttcgtctcgctcttcctccaaaacgttggtttaaggacaactataacgcggacttcctggaggacaggcaactcggcctccaggcattcctgcagaaccttgtggcccataaggacatcgctaattgtctggctgtgagagagttcctctgcctggatgaccctcctgggccattcgattcccttgaggagagtagagccttctgtgagaccctcgaggagacaaattatcgcctgcagaaggagctgctggaaaaacagaaggagatggaatcccttaaaaaattgctgtcagaaaagcaactccacatcgacaccttggaaaatagaatcagaaccctgtcattggagccagaggagtctctagatgtaagcgagactgaaggagagcaaattctgaaagtagagagtagtgccttggaggtcgatcaggacgtgctagatgaggaatcacgtgccgacaataaaccctgtctttctttcagcgagcccgaaaatgccgtttccgaaatcgaggtcgcagaagtggcctacgatgccgaagaggactag

SEQ ID NO: 54460 - DNA, 255 bp, Artificial Sequence
  Description of Artificial Sequence: Synthetic coding sequence
atggctaccccatacgtgcctgttcctatgccaatcggaaattcggcgagcagctttaccacaaaccggaaccagcggagttcaagttttggatccgtatctaccagctctaattcgtcaaagggtcaactggaagacagtaacatgggcaacttcaagcagacctctgtccctgatcagatggacaatacatcttccgtgtgttcttcgcccctcatccgcacaaagttcactgggaccgccagcagcatttag

SEQ ID NO: 54461 - DNA, 279 bp, Artificial Sequence
  Description of Artificial Sequence: Synthetic coding sequence
atggccaccccctatgtacccgttcctatgcccattggcaacagtgcatccagtttcacaaccaatagaaatcaacgcagcagcagctttgggtcagtgtcgacaagtagcaacagctcaaagggccagctggaagattctaacatgggcaatttcaaacagacttcagttcctgaccagatggataataccagtagcgtctgttcctctcctcttattcgtacgaagtttaccggtacagccagcagcatcgaatattccacaagaccacgggattag

SEQ ID NO: 54462 - DNA, 111 bp, Artificial Sequence
  Description of Artificial Sequence: Synthetic coding sequence
atggcgacgccttatgtccccgtgcctatgcctattggcaacagcgcctctagcttcacaactaataggaaccagcgctctagttctttcggctctgtgagtacctcctag

SEQ ID NO: 54463 - DNA, 612 bp, Artificial Sequence
  Description of Artificial Sequence: Synthetic coding sequence
atggcgactccctatgttcctgtgcctatgcccataggtaatagcgcatcaagctttaccacaaaccgaaaccagaggagctcctccttcggctccgtgtccacgagtagtaacagctctaagggccagctggaagacagcaacatggggaacttcaagcagaccagtgtgccagatcagatggacaatactagtagcgtttgtagttcacccctaatcagaaccaagttcactggaacggcaagttctatagagtattcaacaagaccgagggatacagaggagcagaatcccgaaacagtgaattgggaggaccgcccatccacccccacaattctcggttacgaggtcatggaggagcgcgcaaagtttactgtctacaagattttagtaaaaaagacccccgaggaaagctgggtcgtgttccggcgttatactgacttttctcggcttaacgataagctcaaggagatgtttcccggttttcgcctggctctgcctcctaagcggtggtttaaggataattacaatgctgatttcttggaagatcgacaactaggtctccaggcatttttgcaaaacctcgtagcgcataaagatatcgccaactag

SEQ ID NO: 54464 - DNA, 1887 bp, Artificial Sequence
  Description of Artificial Sequence: Synthetic coding sequence
atggctcttcgtgctcgggctctgtacgatttcagaagtgaaaatcccggtgagatcagcctcagagagcatgaggtactttcactctgtagcgaacaggacattgagggatggctggaaggtgtgaatagcagaggggataggggactctttcctgctagttacgtccaggtcataagggcccctgaaccaggccctgccggtgatggcggaccaggggcaccagccagatacgcaaacgtcccgccaggaggctttgagccactccccgtggcccctccggcttccttcaagcccccacctgatgccttccaggctctgctccagcctcaacaggcccctcctccttcgacgtttcagcccccaggtgccggattcccctatggtggcggagccttgcagccgagtcctcagcaattgtacggtggttatcaggcgtcccaggggtccgatgacgactgggatgacgaatgggacgacagttctactgtagcggatgaacccggagccctgggcagtggcgcatacccggacctggacggctcgtctagcgcaggggtcggcgctgcaggcagataccgcctttccaccagatccgacctgagcctggggagcagaggtggctccgtgcccccacagcaccacccttcaggccctaagtctagcgccaccgtgtctcgcaacctcaaccggtttagcacatttgtgaagagcggaggcgaagcattcgttctcggggaggcttctgggtttgtgaaagacggagataagctgtgtgtggtcctggggccatacgggcctgaatggcaggagaacccttacccttttcagtgcacaatagatgacccaacaaaacagactaagtttaagggcatgaagtcctacatttcctataagctggtgcccacccacacccaggtgcctgttcacagaagatacaagcacttcgattggctgtatgcaagactcgctgagaagttccctgtaatcagcgtgcctcacctcccagagaaacaggcaacgggaaggtttgaagaggacttcatctccaagaggcgcaaaggcctaatctggtggatgaaccacatggcctcccatccggttcttgcccagtgcgacgtttttcaacacttcctgacctgcccatcgtcgacagatgaaaaagcttggaaacagggaaaacgcaaggcggaaaaagatgaaatggttggggcaaatttcttcctgacattgagcacccccccagcggcagctctggacttgcaggaagtcgagtctaaaattgacgggtttaaatgctttaccaagaagatggatgatagtgcccttcagctgaaccatacggccaatgagtttgcacggaaacaggtgaccggttttaagaaagagtatcagaaagtggggcagagctttcgtggcctgtcacaggcgttcgaactagaccagcaagccttcagcgtaggtctgaaccaggctatcgcttttaccggagatgcctacgatgccatcggggaactgttcgcggaacagcctcggcaggatctggatcctgtgatggatctgcttgccctctaccaaggccacctggccaactttcccgacattatccacgtccagaagggcaaggcatggcctctggagcaggtaatttggtccgtactttgccgactgaagggagccacacttacagctgttcccttgtgggttagtgagagctatagcacaggggaagaagcatcccgggacgtagacgcctgggtgttcagcctagaatgtaaactagactgttctaccggctcttttctgttggagtatcttgctttgggaaacgagtactctttcagcaaggtacaaagggtacctctgatgacagtcctgtctttctag

SEQ ID NO: 54465 - DNA, 1776 bp, Artificial Sequence
  Description of Artificial Sequence: Synthetic coding sequence
atggctcttcgtgcccgtgcattatatgacttccggtccgaaaatcccggtgagatatctcttcgcgagcacgaagtgctgtcgctgtgcagcgaacaggacatcgagggctggctggagggcgtcaactcccgcggagatcggggactcttcccggcaagttatgtgcaggtgatcagagcgcctgaaccgggacctgcaggcgacggaggacctggggctccagccagatacgcgaacgtcccaccagggggtttcgaacctcttccagtggccccacccgcatcgttcaagcctccacctgacgcatttcaggctcttctgcagccccagcaagctcctccgccttcaacgttccagcccccaggagccggattcccctatggcggtggggctctgcagcccagtccccagcaattatatggaggataccaggcttcccagggatccgacgatgattgggacgatgaatgggatgactcatcgacagtggcggacgaacccggtgctctcggaagtggggcttatcccgacctggatggatcctcatccgcaggtgtgggagctgcaggccgttaccgcctgtccactcgaagtgacctttcactgggttctaggggcggtagcgtccctcctcagcaccacccatccgggcctaagtcatccgcgacagtgagcaggaatctcaacagattttctaccttcgtgaagtcaggcggagaggccttcgtcctgggggaggcatcaggcttcgtcaaagatggtgacaaactgtgcgtcgttctcggcccttatggacctgagtggcaagaaaacccttacccgttccagtgcaccattgatgatcccaccaagcaaaccaagtttaagggaatgaaaagctacataagttataagttggtccctacccacacgcaggtgcctgtacaccggcgatataagcactttgactggctgtatgctcggctcgctgagaagttcccggtcatctctgtccctcacttgcctgaaaagcaggccaccggacgctttgaagaagacttcatcagtaagaggagaaaggggcttatctggtggatgaatcacatggcaagccatcccgtcttagcccagtgcgatgtgtttcagcactttctgacatgccccagctctacagacgaaaaagcgtggaaacagggcaagcgcaaagccgaaaaggacgaaatggtcggggcaaacttcttcctgacgctgtctactccccctgctgcagctctcgacctacaggaggtcgaaagtaaaatcgatggtttcaagtgctttacaaagaagatggacgactctgcgctacaactgaaccacacggcgaatgaattcgccagaaaacaggttaccggtttcaaaaaagagtaccagaaggtcgggcagagcttcagaggactttcccaggcctttgagcttgatcagcaggccttcagtgttgggcttaaccaggcaatcgcctttacaggagacgcatacgacgcgatcggcgaattatttgctgaacagcctaggcaggacctggacccagtgatggatctgcttgctctctaccagggtcacctcgctaacttccccgacataatccacgtgcagaaagggaaggcatggcccctggaacaagtgatttggtctgtcctgtgccgcctgaagggtgcgactcttaccgcggtcccactttgggttagcgaatcttacagcactggcgaggaggcctcccgggacgtggatgcctgggttttttccctggagtag

SEQ ID NO: 54466 - DNA, 1875 bp, Artificial Sequence
  Description of Artificial Sequence: Synthetic coding sequence
atggccctacgcgcacgagcgctgtacgactttaggagtgagaaccccggagaaatctcactaagggagcatgaggtgctcagcctgtgcagtgagcaggacatcgaggggtggctggaaggcgtaaattcccggggagacagggggctgttccccgcaagttacgttcaagttatccgggctcctgaaccgggtcctgccggtgacggcggacctggcgctcccgcaaggtatgccaacgtcccaccgggaggtttcgaaccgctgcccgtagccccacccgcatcgtttaagccaccgccagacgcgttccaagctctgctccagcctcagcaggctcctcccccttcgacgtttcaaccaccaggtgctggcttcccgtatgggggtggcgcactgcagcccagcccgcaacagttgtacggcggataccaggcctcacaagggagtgatgacgactgggacgacgaatgggacgactccagtactgtggccgatgaaccgggagcactagggtctggggcttatccggatctggacgggtcgtcgtcagcaggggtgggcgcagccggtagataccggctgtccactcgatccgatcttagcctggggtctcgcggaggttccgtacctccccagcaccacccaagcggaccgaagtcatctgctaccgtgtcccggaacctgaaccgattcagcacgtttgtgaaatcaggcggtgaagcgtttgtgttaggtgaagctagtggatttgtcaaggacggcgacaagttgtgcgtggtactgggaccgtatggcccagagtggcaggaaaacccgtaccctttccagtgcacaatagatgatcccactaagcaaaccaagttcaaaggtatgaagtcctacatttcctataagctggtccctacccacacacaggtgcccgtgcaccggagatacaagcattttgactggctgtatgcacgtctggccgagaagttcccagttatcagtgttccccatcttcctgagaagcaagcaacaggacggtttgaagaggacttcatttccaagcgcaggaaaggactgatatggtggatgaatcacatggcaagtcaccctgtgctggcacagtgcgatgtgtttcagcatttcctgacctgtcccagctctaccgatgaaaaggcctggaagcagggcaaaagaaaggccgagaaggacgaaatggttggagctaatttttttctgactctcagtacccctccagctgccgctctggatctgcaggaggtggaaagcaaaatcgacggtttcaaatgttttactaagaagatggatgactcagcactccagctcaaccacaccgccaacgagttcgcacggaaacaagtgaccgggttcaagaaggaatatcagaaggtaggacagtcctttcggggactgagccaagctttcgaactggaccaacaggcttttagtgtgggcttaaaccaggccatcgcttttacaggcgatgcctatgacgcgataggtgagttgtttgccgagcaacccagacaggacctggatccggtgatggacctcttggccctgtaccaaggacacctcgccaattttcctgacatcattcacgtgcagaagggagccctgacgaaagtcaaggaatcacgaagacatgtcgaggaaggaaagatggaagttcagaaggctgatggcattcaggaccggtgcaacacaatttccttcgccactctcgccgaaattcatcattttcaccagattcgtgtaagggactttaaaagtcagatgcaacattttcttcaacagcagatcatcttcttccagaaagtgacccagaagctggaggaggctctacataaatacgattctgtgtag

SEQ ID NO: 54467 - DNA, 2979 bp, Artificial Sequence
  Description of Artificial Sequence: Synthetic coding sequence
atgaagaccgagactgtccctccgtttcaggaaacacccgctggatcaagttgccacttaaataatctgttgtcctcgaggaagttaatggccgtaggggtgctgctgggctggttactggtgatacacttgttggtgaatgtctggctcctgtgtctgctgagcgctttgctcgtggttctcggagggtggctgggtagctcccttgctggcgtggcgagcggcaggttacacctggaacgattcattcctctagccacctgccctccatgcccggaggctgaacgccaactggagcgggagatcaataggaccatacagatgatcattcgtgatttcgtcttgtcttggtatagatctgtgtcccaggagccagccttcgaggaggagatggaggccgctatgaagggtctcgttcaggaactgcgcagacgaatgtccgtaatggattctcacgccgttgcacagtccgtgctgacactgtgtggttgccatctgcaaagttatatccaggccaaggaagcgaccgcaggcaagaatgggcctgtggagccgagccacctttgggaagcctattgcagggccacagctccacacccagccgtacactcaccttctgccgaggtcacatatacgcgcggagtggtcaaccttctactgcagggtcttgtccccaagccacacctggaaaccagaacaggaaggcacgtagttgttgagctcatcacttgcaatgtgatcttgccactgatctcccgcctgtccgacccggattggatccacttagttctagtggggatcttcagcaaagcaagagaccctgctccgtgtccagcttccgcccctgaacagcctagtgtcccaacttcattgccactgatcgccgaggttgagcaactccccgaggggcgagcttccccagtggcagctcccgtgtttctctcctatagtgaacccgaaggttccgccggaccgagtcccgaagttgaggaagggcatgaggcggtggaaggcgatctcggcggtatgtgcgaggagaggaaagtcgggaataactctagtcacttccttcagcccaatgtgcgcggaccactcttcctgtgtgaggattctgagctcgagtcacctctgtctgagctcggaaaagaaaccattatgctaatgactcctgggtctttcctgagcgaccggattcaagatgctctctgtgctctcgagagttcccaggcactggagccaaaggacggggaagcctctgaaggggctgaggctgaagagggtcctggcaccgaaacagaaacaggtctgcccgtatcaacacttaactcctgcccggaaattcatatcgacaccgccgataaagaaattgagcagggtgatgttaccgccagcgtgactgcgcttctcgaaggcccagaaaagacttgcccgagtagaccgagttgcctggaaaaagacttgactaacgacgtgagtagtctggaccccacacttcccccagtcctgctgtcgagttccccacccggtccccttagctctgccacctttagctttgagcctctcagttcccccgatggtccggtgatcatccagaatcttagaatcaccggaacgattaccgcgagagagcattctggcactggcttccatccctataccctgtatactgtgaaatacgaaacagcactcgacggagagaattcctccgggctccagcagctagcttatcacaccgtaaatagaagatacagagaattccttaatctccagacccgtcttgaggaaaaacccgacctgcgaaaattcataaagaacgttaaggggcctaagaaactttttcccgacctgccccttggaaacatggactctgatcgcgttgaagccagaaagagcctcctcgagtctttcctgaagcagctgtgtgccatccccgaaattgcaaacagcgaggaagtccaggagtttctggccctaaacacagacgctcgcattgctttcgttaaaaaacctttcatggtgtcccgaattgataagatggtagtttccgcaatagtggacacccttaaaactgccttcccgaggagcgagccgcaaagcccaacggaagagctgtcagaagcagagaccgagagcaagccacagacagaaggaaaaaaggcttctaaaagccgcctgcggtttagttcatccaaaattagtccggctctgagcgtaacagaagcacaggacaaaatactttactgcttgcaagagggtaacgtggagagtgagactttgagtatgagtgctatggagtccttcatcgagaagcagacaaagttgctggaaatgcagccaacaaaggcacctgagaaagacccagaacagcctcccaaagggagggtggacagttgtgtgtccgatgcagcagtgcccgcacaagatccaagcaatagcgaccctggaactgaaaccgaattagcggacactgccttggatcttctgctgctgcttttaacggagcaatggaagtggctgtgtaccgagaacatgcagaagtttctgaggctaatctttggcactctggtccagaggtggctcgaggttcaagtcgccaatttaacgagtcctcagcgctgggtccaatacctgctcctgttgcaagagtccatttggcccggtggcgtgctccctaaatttcccaggcccgtgcggacccaggagcagaagctcgctgctgagaagcaggctctccagtccctcatgggcgtgctccccgatctggtcgtggagatcctcggggtcaataaatgtaggctgtcctggggccttgtcttagagtctctccagcaacctttgattaatcgccacctaatttactgtctgggagacattatcttagagttcctcgatctatcagcgtcggttgaagaaagtgctgccactacatcagcaagcgacactcccggtaacagcaagaggatgggcgtcagcagctag

SEQ ID NO: 54468 - DNA, 1308 bp, Artificial Sequence
  Description of Artificial Sequence: Synthetic coding sequence
atgtacgaaaccgctctggacggagagaattcaagtggactgcagcaactcgcctatcatactgtcaatagaaggtaccgtgagttcttgaacctccagactaggctagaggagaagccagatcttcggaagttcataaagaatgtcaagggccctaagaagttgtttcccgatctgcctttgggcaacatggactccgacagagttgaggcgagaaaatcactcctggaatcatttttgaaacagctctgcgctattccagagatcgccaattccgaagaagtgcaggagttcctggcgcttaataccgacgcacgcatcgcttttgttaagaaaccctttatggtgagtagaattgacaaaatggtagtgtctgctatcgtagacaccctaaaaaccgccttcccacggagcgagcctcagagccccaccgaggagctgtccgaggcagagactgaaagcaaaccccaaactgagggtaagaaggcgagcaagagccgcctgcgattctcttcttcaaagatttccccggctctgtccgtcaccgaagcgcaggataaaattttgtattgccttcaggaaggcaacgtagaatccgaaaccttgtcgatgtctgccatggaaagttttattgaaaagcagaccaaactcctggaaatgcagcccacgaaggctcccgaaaaggaccccgagcagccacccaaagggcgagtggactcctgcgtgtccgatgcagcagtcccagcccaggacccgtcaaatagcgatccgggtaccgagaccgaactggccgatacagcgttagacctgttactgttgctcctgaccgaacaatggaaatggctttgtactgagaatatgcagaaattcctgcgacttatcttcggaacactcgtccagcggtggttggaggttcaggtcgcaaacctcaccagcccacagcgatgggtacaatatctcctgctgcttcaagagtcaatctggccaggaggcgttttgccaaagtttcctaggcccgtgcggactcaggaacagaagctagccgctgagaagcaggccctgcagagcttaatgggtgtgctacccgatctggtggtggaaatactgggagtgaataagtgtcgcctaagctggggactagtgttggagtcattgcaacaacccctaattaataggcatttaatctattgtttaggcgacataatattggagttcctggatctctccgcaagcgtggaggagagtgccgcaaccacgtccgcctctgataccccagggaactccaagaggatgggagtgtccagctag

SEQ ID NO: 54469 - DNA, 699 bp, Artificial Sequence
  Description of Artificial Sequence: Synthetic coding sequence
atgtcggccatggagagcttcatcgaaaagcagacaaaacttttggagatgcagccaaccaaggctcccgagaaagatcccgaacagccccctaagggcagagtggatagctgcgtgtccgatgcagccgtccccgctcaagaccccagcaattcggatccaggcaccgaaacagaactcgcggacacggccctggatttattgctcttactcctgaccgagcagtggaagtggctgtgcactgagaatatgcagaaatttttgagactgatctttgggacgctggtgcaaagatggttggaggtgcaggttgccaatctgacttccccccaaagatgggtgcagtacctactcctgttgcaggaatccatctggcctggaggcgtactcccgaagtttcccaggccggttcggacacaggaacaaaaactggcagctgagaaacaagctctgcagtcactgatgggggttctgccagacctggttgtggagatcctgggggttaacaagtgtcgattgtcatggggactcgtgttagagtcactgcagcagccactgattaacaggcatctgatctattgcttgggcgatatcatcctcgagtttctggacctgtcagcgtctgtcgaagagagtgccgcaaccacatctgctagcgatacaccaggaaacagtaagagaatgggcgttagctcatag

SEQ ID NO: 54470 - DNA, 582 bp, Artificial Sequence
  Description of Artificial Sequence: Synthetic coding sequence
atgctggaagtgcacatcccctcagtcggcccagaggctgagggccctcgacagagtcccgagaaatcccatatggtttttcgggtcgaagtactgtgtagcggccgtagacacaccgtccccaggaggtattcggaattccacgcactacacaagagaataaaaaagctctacaaagtgcctgatttcccctctaaaagactgcccaactggaggaccagaggcctagaacagcggcgacagggactggaggcctatatccaaggaattctctatctcaaccaggaggttccgaaggaacttctggagttcctgagactcagacactttccaactgacccaaaagcctccaactgggggacactgcgagagttcctgcctggtgacagtagttcccagcagcatcagcgcccagtcttaagcttccatgtggacccctacgtctgtaacccatctcctgagtctctgcccaacgtggtggtgaatggggttctgcaggggttgtatagtttcagcattagcccagacaaggcccaacctaaggcggcttgccaccctgcaccactgccccctatgccctag

SEQ ID NO: 54471 - DNA, 525 bp, Artificial Sequence
  Description of Artificial Sequence: Synthetic coding sequence
atgctggaggtgcatattccttctgtggggcctgaggccgagggaccacggcagtctccggaaaagagtcatatgataaagaaactgtacaaggtgccagatttcccaagcaagcgacttcccaactggagaacacggggtctcgagcagcggaggcagggcctcgaggcttacatacaggggatcttgtatttaaatcaggaagttccaaaggaacttctggaatttctccggctcagacacttccccaccgaccccaaggctagcaactggggcactctacgtgaatttctgcctggtgactccagcagtcaacagcaccaacgtcccgtgttaagttttcacgtggacccatatgtatgtaacccaagtccgggtgaggaggttccccgatatggcgcaacaggactcggctgtggcctctgcatttcaaggctgttaggtccatccgactccatctccttcctgctccccacctccggcgctaccacgagctgcagctgtccattggagcctgctctgtag

SEQ ID NO: 54472 - DNA, 510 bp, Artificial Sequence
  Description of Artificial Sequence: Synthetic coding sequence
atggaggtatatataccatccttcagatatgaagaaagtgatctggagcgcggatacacggttttcaagattgaggttctgatgaatgggcgtaaacacttcgtggagaagcgctattcggagtttcatgcattgcataaaaagctaaaaaaatgtattaaaactccggagatcccgagtaagcacgtacgcaattgggtccctaaggtcttagaacagcggaggcaggggctcgagacttacttacaggcggtaatactggagaacgaagaattgcccaagctctttcttgacttcctcaacgtacgccatctgcccagtctccctaaagctgagagctgcggttcatttgacgagactgaatctgaggagtcttctaaactgtcacatcagcctgtattgctgtttctgagggacccttacgtgctacctgccgcaagtgactttcccaacgttgtgattgagggcgtccttcacggcatcttctatccacacttgcaacctcggtag

SEQ ID NO: 54473 - DNA, 480 bp, Artificial Sequence
  Description of Artificial Sequence: Synthetic coding sequence
atggaggtgtacattccaagctttcgatacgaagagagtgacctagagcggggatacaccgtctttaagatagaggtccttatgaatgggcgtaagcactttgttgagaaacgctactctgaattccacgccctccacaagaaactcaaaaagtgtatcaagacccccgagattcctagtaagcatgtaaggaactgggtcccaaaagtactcgaacagcggaggcagggactggaaacttaccttcaagctgtgatcctcgaaaacgaagagcttccgaaactgttcctggacttcctgaatgtacgccacctgcctagtctgcccaaagctgagtcttgtggatctttcgatgaaacggagtccgaagagtcatcaaaactgagtcatcagcccgtcctgctgtttttaagagacccctacgtcctcccagctgctagcgggaaccaaacctgtcaccttctgactgcattgtactag

SEQ ID NO: 54474 - DNA, 480 bp, Artificial Sequence
  Description of Artificial Sequence: Synthetic coding sequence
atggaagtttatattccctcgtttaggtatgaggaaagcgatcttgagagaggttacaccgtcttcaaaattgaggtgctcatgaatgggagaaagcactttgtggaaaagaggtactccgagttccatgccctgcacaaaaagctcaaaaagtgtattaagacgcccgagatcccctcaaagcatgtgcgcaactgggttccaaaggtcttagaacagcgcagacaaggcttggaaacctacctgcaggccgtgatcctggagaacgaagaactgcccaaattattcctggacttcctgaatgtgcgccacctgcccagtctgcctaaggccgaatcttgcgggtcattcgacgagaccgaaagtgaagagtctagcaagctgagccaccagcccgtgctcctgttcttaagagacccatacgtgctgccggctgcaagtgggaatcagacctgccacctgttgacagcactgtattag

SEQ ID NO: 54475 - DNA, 1086 bp, Artificial Sequence
  Description of Artificial Sequence: Synthetic coding sequence
atgcgcaacttgaacattaaggacgtgtctaagctcaaggatgagattatcctgatcgagaaagaacggaccgatcttcagctgcacatggccagaaccgattggtggtgcgagaatttgggcatgtggaaggcctctattacctcaggggaagtgaccgaggaaaatggagagcagttgccctgttacttcgtgatggtatccctccaggaggtggggggtgtagagaccaaaaattggaccgtacccaggagattgagtgaatttcagaatttgcatagaaagctgtccgaatgtgtgcctagcctcaaaaaagttcagctgcctagcctgagcaaacttcctttcaagtcaatcgaccagaaatttatggagaagtctaaaaatcagctcaataaattccttcagaatcttctgagtgatgagcgcctgtgtcagtcagaggctctatatgccttcctcagccccagcccggactacttaaaggtgattgatgtacaggggaagaagaacagcttctcattatcaagcttcctcgagagactgccccgtgatttcttctcacatcaagaggaggagaccgaggaggactctgatctgtccgattatggggatgacgtggatggcaggaaagacgccctggccgaaccgtgcttcatgcttatcggggaaatcttcgaactcagaggcatgttcaaatgggtccgcagaaccttgattgctctggtgcaagtaacctttgggaggacaatcaacaaacagatccgggacacagtgagctggatcttttctgagcagatgttggtatattatattaacattttcagggacgctttttggccaaacggcaaactggcccctcctaccactatcaggtctaaagagcaaagccaggagactaagcagcgcgctcagcagaaactgctggaaaatatccccgatatgctgcagtctcttgtaggtcagcaaaatgcgaggcatggaataattaagattttcaacgctctgcaggaaacgagagccaataagcacctgttgtatggaacttctacaaatactctgctctctcctagggaccatgattag

SEQ ID NO: 54476 - DNA, 2523 bp, Artificial Sequence
  Description of Artificial Sequence: Synthetic coding sequence
atggataaggcactcaaggaggtttttgactattcttatcgcgattatatcttatcctggtacggaaacctgtctagggacgagggtcagctgtaccaccttcttttggaagacttttgggagatcgccagacaactccatcacagactgtctcacgtggacgtagtcaaagtcgtgtgtaatgatgtggtcagaactctccttacacacttctgtgatctcaaggctgctaatgctcgtcacgaagaacaacccaggcctttcgtgcttcatgcatgcctccgaaactctgatgacgaggtgcgttttctccagacctgctcccgggttttggtgttttgtctcctcccatccaaagacgtacagtctctgagtctgagaatcatgctggctgagattctgacaaccaaagtgttgaagccagtcgttgaactgcttagtaatcccgactacatcaaccagatgttacttgcacagctcgcgtaccgagagcagatgaacgagcatcacaaacgcgcatacacttacgcaccgtcgtacgaggatttcataaagctgatcaacagcaattccgacgttgagtttttgaaacagctgcgctatcagattgtggtggagataattcaagccactacaatctcttccttcccccaactgaagcgccacaaggggaaagaaaccgctgcaatgaaggccgatcttctaagagcacggaatatgaagaggtatattaatcagcttactgttgcgaaaaagcaatgcgaaaagagaataaggatactaggaggcccagcctatgaccaacaggaggatggcgcacttgatgagggcgaagggcctcaaagtcagaaaatccttcagttcgaggatatcctcgctaataccttttacagagagcattttgggatgtacatggaacgcatggacaaacgcgcattgatttccttttgggaatctgtcgagcacctgaagaacgccaacaaaaatgagatcccacagctcgtcggagaaatttatcagaactttttcgtggaatcgaaggaaattagcgtggaaaagtctctgtataaggaaattcagcagtgcctggtggggaacaaaggcatcgaggtcttttataaaatccaggaagatgtgtacgaaaccctgaaggatcgatactatccttcttttatagtgtctgatctgtatgagaagctgctgatcaaagaggaagagaagcacgcttctcagatgatatccaacaaggatgaaatgggtccccgagatgaggccggtgaggaggctgttgatgacggcaccaatcagattaatgagcaggccagcttcgcagtcaataagttgcgggagctgaatgagaagttagaatataagcggcaggcactgaatagtatccagaacgccccaaagcctgacaagaaaatcgtaagtaagcttaaggatgaaataattctgatcgaaaaggagagaaccgacctgcagttacacatggctagaaccgactggtggtgcgaaaatttgggaatgtggaaagctagcatcacttctggggaggtgactgaagagaatggtgagcagttgccctgttatttcgtgatggttagcctccaggaagtaggaggagtcgaaaccaagaattggacagttcccaggagacttagcgagttccaaaacctgcacagaaagctgagcgaatgtgtgcccagtctaaaaaaagtacagttaccgtctctctctaagctcccctttaaatcaattgaccagaaattcatggagaagagtaagaaccagttaaacaagttccttcagaacctcctgagtgatgagcgactctgccaatccgaagccctttatgctttcctttctccctcgcccgattacctgaaagttatcgacgtccagggaaagaagaattccttttccctgtcttcctttttagaaaggctcccgcgtgattttttttcccaccaggaagaggaaaccgaggaggattcagatctctccgactatggagatgatgttgatgggagaaaagacgcactggctgagccctgttttatgctcatcggcgagatctttgaacttcgtggaatgtttaaatgggttcgcaggaccctcattgccttagtacaggtgacttttgggagaaccattaataaacagatcagggacaccgtttcttggatttttagcgagcagatgctggtctactacataaatatttttagggatgccttttggcccaatggaaaattggccccacccaccactatccggtccaaggaacagtcccaggaaacaaaacaacgagcccaacagaagctgttggagaatatccccgacatgttgcagagtctggtgggccagcagaatgcacgccacggtataatcaaaatcttcaatgctctccaagagacccgcgcaaataaacacctgctgtatgctctcatggagctactcctcatcgagctgtgccccgaactgagggtgcacctggatcagttgaaggctggacaggtttag

SEQ ID NO: 54477 - DNA, 2523 bp, Artificial Sequence
  Description of Artificial Sequence: Synthetic coding sequence
atggacaaggccctgaaggaggtattcgattattcgtatcgggattacatactttcttggtacggcaatctgagcagggacgagggccagctttaccacctgcttctagaagatttttgggaaattgctcgtcagcttcaccatcgtctgtcccacgtcgatgtagtgaaggtcgtctgtaatgacgtggtgcggaccctgctgacacacttttgtgatctgaaggcagccaacgcgaggcatgaggaacagcccagacctttcgtgctgcacgcctgccttagaaatagcgacgacgaggtacggtttctgcaaacttgtagccgggtcctggtgttttgtctcctcccatctaaagatgtgcagtccctctccctaagaatcatgctagctgagatcttaacgaccaaggtcctgaagcccgttgtagagcttctgtcaaacccagactatattaaccagatgttactggcccagttagcttacagagaacaaatgaacgaacaccacaaaagagcgtacacatatgctccctcctacgaagatttcatcaagcttatcaactcaaactcagacgtagagttcttaaaacagcttcgctaccagatagtggtggagattatccaggctacaactataagctccttcccgcagttgaagcggcacaaaggaaaggaaacagcagctatgaaggccgacctgcttcgcgcaagaaacatgaaacggtacatcaatcagctcactgtggccaaaaagcaatgcgagaagagaatacgcatactcgggggtccagcttatgaccagcaggaagacggcgctctggacgaaggcgagggtcctcagtcccagaagatcctgcagtttgaggacatactggccaacaccttttaccgcgagcactttgggatgtacatggaacgaatggacaagcgggcattgatttccttctgggagtcggtggagcaccttaagaacgcaaataagaacgagattcctcagttggttggagaaatttatcaaaattttttcgttgagagtaaagagatttctgtcgagaaaagcctgtacaaggaaattcagcagtgcttggtgggcaataagggaattgaagtgttctacaagatccaggaggatgtctacgaaaccttgaaggatagatactatccaagttttatcgtgtctgacctgtatgaaaaattgctgatcaaagaagaagagaaacacgcgagtcaaatgataagcaacaaggatgagatgggacccagagacgaggcaggcgaagaggctgtcgatgatgggaccaaccaaattaacgaacaggcgtctttcgctgtgaacaagttacgggagttaaacgagaaactggagtacaaacggcaagctttaaactctattcagaatgccccaaaacccgacaagaagatagttagcaagctaaaggacgagatcatcctcatcgaaaaagaacgaaccgacttgcagctccacatggctaggaccgactggtggtgtgagaacttaggcatgtggaaggctagtatcacctcaggagaggttacagaggagaatggggaacagctcccatgctattttgtgatggtctctctacaagaggtgggtggggtagaaactaagaattggaccgtgcccagacgactgtcagaattccagaacctgcacaggaaactgtccgaatgcgtaccttcactgaagaaagtccagctgccctccctcagtaagctgccttttaagtccatcgatcagaagttcatggaaaagtctaagaaccagctgaataagttccttcaaaacctgctatctgatgagcggctatgtcaaagcgaagcgttgtatgcattcctcagtcccagccccgactaccttaaagtaatcgacgtacagggaaaaaagaatagcttctctctgtcttcctttctggaacggctgccgagggattttttcagccatcaggaagaggagactgaggaagacagtgatctgtcagactacggcgatgacgtggatggacgcaaggacgccctcgccgaaccctgttttatgctcattggcgagatttttgaattgagaggaatgttcaagtgggtgcgccgtacattgatagcattggtccaggtgactttcggacgtaccatcaataaacagatccgggatacagtgagttggatcttttctgaacagatgctagtgtactacatcaacatcttcagggacgctttttggcccaatggaaaacttgccccacccaccacaatccggtctaaagaacaaagtcaggaaacaaaacagagggctcaacaaaagctgttggagaacatacctgacatgcttcagagtcttgtgggtcagcaaaatgctcggcatggcataataaagatttttaacgctttgcaggagacacgtgcgaataaacacttgctgtatgccttgatggagctgttactgatcgagctttgtccggagctgcgggtgcacctggatcagcttaaggccggtcaggtttag

SEQ ID NO: 54478 - DNA, 1356 bp, Artificial Sequence
  Description of Artificial Sequence: Synthetic coding sequence
atggagggggagagaagggctagccaagccccttcatccggcctgccagctggcggagccaatggggagtctcccggaggaggagcgcctttcccgggatcaagcggctctagcgcccttctccaggccgaggtcctggacttagatgaggatgaggacgacctggaggtgtttagcaaagatgccagtctgatggatatgaactccttttcgccaatgatgccgacaagcccgctgagtatgatcaaccagatcaaatttgaagacgaaccagatcttaaggatttgttcatcaccgtcgatgagcccgaatctcatgtcaccactattgaaactttcattacttacagaattattaccaaaacttcaaggggagagttcgacagttccgagttcgaagtccggagaagataccaggactttttgtggttgaaaggcaagctcgaagaagcacaccccacactgatcatccctccccttccggagaagttcatagtgaaggggatggtggaacgcttcaatgacgatttcattgaaactcggagaaaagccctacataagttcctcaatagaatcgccgatcatccgacactgacgttcaatgaagatttcaagatctttctcactgcccaagcatgggagttatcgtcccacaagaagcagggcccaggcctcctgtcccggatggggcaaacagtacgggctgtggcaagttcaatgaggggggtgaagaacagaccggaggaatttatggagatgaataactttattgaacttttttcccagaagattaacttgatagataagatctcacaacgcatttacaaagaggagcgcgagtactttgatgagatgaaagaatacggccctatccatatcctttggtccgcaagcgaagaggacttggttgacaccctgaaggacgtagcaagctgtatcgaccgatgctgcaaagccactgagaaacgcatgagcggtctttctgaggccctgttacccgtcgtgcacgagtatgtcctgtactccgagatgctgatgggcgtgatgaagcggcgagaccaaatacaggccgagctcgacagcaaggtcgaagtgttaacatacaagaaggctgacactgacctgctccctgaggaaattggaaaattagaggataaggtcgagtgtgcaaataacgcccttaaggccgactgggaaaggtggaagcagaatatgcagaacgatatcaaactggccttcacagacatggctgaggaaaatatccattattacgagcagtgcctagccacatgggagtctttcctcacatctcagaccaatctgcacctggaggaagctagcgaggacaagccctag

SEQ ID NO: 54479 - DNA, 1011 bp, Artificial Sequence
  Description of Artificial Sequence: Synthetic coding sequence
atggatatgaatagtttctctccaatgatgccaacctccccacttagtatgatcaatcagatcaagtttgaggatgagccagatctcaaagatctttttataacagtggatgagcccgaatcgcatgttacgacgatcgagacattcatcacatatagaatcatcacaaaaacctctaggggtgagtttgacagttccgaatttgaagtgcgacgaagataccaggatttcctttggctgaaaggcaagttggaggaagctcaccctaccttgattattccccctctacccgaaaaattcattgtcaaaggcatggtggaacggtttaacgacgattttatcgaaaccagaagaaaggcccttcacaagttcctgaatagaatcgccgaccacccaacactgacctttaatgaagacttcaagatcttcctgaccgcccaagcttgggagttgagctcacacaagaaacagggacctggactgttgtcccgaatgggacagactgtgagagccgtagctagctccatgaggggtgttaaaaaccgtccagaggagtttatggagatgaacaacttcatcgagttattctcccagaagataaatctgatcgataagatcagccagcggatttacaaggaggaaagagaatatttcgacgaaatgaaagagtacgggccaatccatatcctctggtcagcaagcgaagaggaccttgtagacaccttgaaggatgtggccagctgtattgaccgctgctgtaaggccaccgaaaaacggatgtctgggttgtccgaggctcttcttccggttgtacacgagtacgtcctgtactctgagatgctcatgggagtgatgaaacgtcgagatcaaatccaggctgagctggacagcaaggtagaggtactgacctacaaaaaagctgacactgacctctgtttggcgacttgggagtcctttctcacgagtcagaccaacctgcatctggaagaagccagcgaggataaaccatag

SEQ ID NO: 54480 - DNA, 1191 bp, Artificial Sequence
  Description of Artificial Sequence: Synthetic coding sequence
atggagggcgaacgacgggcaagtcaggcgccttcttctggcttaccagccggaggagccaatggagaaagccctgggggaggcgctccatttcccggaagttccggaagcagcgccttgctgcaagccgaggtgttggacctggacgaagatgaggacgatctcgaggttttctctaaggatgctagtctcatggatatgaactccttctccccaatgatgccaacaagtcctttgagcatgattaatcagatcaaatttgaggatgagccagatctgaaagatctatttatcaccgttgatgaaccagagtcgcatgttaccaccattgaaacatttattacatatagaatcatcacaaaaacgtctcgcggagaattcgacagcagcgaattcgaggtgcgcaggagataccaagacttcctctggttgaagggtaaactggaggaagctcatcctactcttatcattcctgagctgagctcccacaaaaagcaaggtcctgggctgctttctaggatgggccagacggtccgggctgtcgcctcctctatgcgaggagttaagaacagaccagaagaatttatggaaatgaacaactttatcgagctcttctctcaaaagatcaacctgatcgataagatatcccaaaggatatataaggaagagagggagtactttgatgagatgaaagagtatggacccatccacatactatggagcgcatccgaggaggatctggtggatacgttgaaggacgttgcctcatgtatcgatagatgttgtaaggcaactgagaagcgaatgagtggattgtcagaagcccttctgcctgtcgtgcacgagtacgtgttgtattctgaaatgcttatgggtgtcatgaaacgacgggatcaaatccaggccgagctcgactccaaggttgaggtcttgacttacaagaaagccgataccgacctgttaccagaggagatcggtaaactggaggacaaagttgagtgtgccaataacgcactcaaggctgactgggagaggtggaaacagaatatgcagaatgatatcaaactggcattcaccgacatggcagaagaaaacattcattactatgagcagtgcctcgccacatgggagtcctttcttacttcacagacgaacctgcacttggaagaagcgtccgaagacaagccttag

SEQ ID NO: 54481 - DNA, 1509 bp, Artificial Sequence
  Description of Artificial Sequence: Synthetic coding sequence
atggacttgatccccaatctggccgtggaaacatggctgctcctagcggtctccctggtgctcctgtatctgtatggcactcgtacacatggtttgttcaaacgactggggattccaggacccacacctctccctctgctggggaacgttctctcctataggcagggcctgtggaaattcgacaccgagtgctataaaaagtatggaaaaatgtggggcacctacgaagggcagctgccagttctagcaattacagatccagatgtcattaggaccgtgttggtgaaagagtgttattccgtttttactaatcggagaagcttggggccagttgggtttatgaaatcagccataagtctggcagaggatgaggagtggaaacggattagaagtctgctcagccccacatttacatcagggaaattaaaagagatgttccctataatcgcacagtatggagacgttctggtgcggaaccttcgtcgagaagcggagaaagggaagcccgtgacgctgaaagatattttcggcgcttattcaatggacgtcataaccggcacttctttcggagtgaatattgatagtctgaataacccacaggatcccttcgtggaaagtaccaagaagtttcttaaatttgggtttctggacccccttttcctgtccataattttgttcccttttttaacccctgtctttgaggccctgaatgtcagtctgttccccaaggataccataaacttcctgtcaaagagcgtcaaccgaatgaagaagagtcgactaaacgacaaacagaaacatcgcctcgactttctgcagctgatgatcgactctcagaatagtaaggaaaccgagagccataaggccctctcagacctggagctggcagcccagagcataatctttatttttgccggttacgaaacaacctcttccgtccttagttttaccttatatgagctggccacgcaccctgacgtgcagcagaaacttcagaaggaaatagacgcagtcctgcccaataaagctccccctacatacgacgctgtggtccagatggaatacctcgatatggtggtcaatgaaacattgcgcctgtttcctgtagctataaggctggagaggacgtgcaaaaaagacgtggagatcaacggagtatttatccccaagggatcaatggtggtgatacccacgtacgctctgcaccacgatcctaaatactggacagagcccgaagaattcaggccagaacggttctccaaaaagaaagacagtatagatccttacatatatactcctttcggcactggacctcggaattgcattggaatgagattcgccctaatgaatatgaagcttgcactgatccgtgttctccagaatttttctttcaagccttgcaaggagacacagatccctttgaagcttgacacacagggactactgcagcctgagaaacccatagttttaaaagtggattctcgagacggcaccctctctggcgagtag

SEQ ID NO: 54482 - DNA, 129 bp, Artificial Sequence
  Description of Artificial Sequence: Synthetic coding sequence
atgcagatgcctcagggcaaccctctcttattgagccacacactgcaggagctacttgctcgagacacagtacaggttgagctgataccagaaaaaaagggcttgtttctgaagcacgtcgaatactag

SEQ ID NO: 54483 - DNA, 531 bp, Artificial Sequence
  Description of Artificial Sequence: Synthetic coding sequence
atgcagatgccacagggcaacccacttctgctctcccacacactacaggagctcctagctagggataccgtgcaagtggagctgatcccagaaaaaaagggtctttttttgaagcacgtggagtatgaggtgagctctcagagattcaaatcaagcgtgtacagaagatacaacgacttcgtggtgtttcaggagatgctcctgcacaaattcccctacagaatggtgccagcactcccaccgaaaaggatgctgggagctgacagggagtttattgaagctaggaggagggccctgaaacgttttgtcaacctcgtcgcgcgacaccccctgttttcggaggatgtggtgctcaaactgttcttaagcttcagcggatccgacgtgcaaaataaactgaaggagtccgcccagtgtgtgggtgatgaattcctgaactgcaagctggctactagagccaaagatttcctgcccgctgatatacaagctcagttcgccattagccgagagctcattaggaacatctactag

SEQ ID NO: 54484 - DNA, 600 bp, Artificial Sequence
  Description of Artificial Sequence: Synthetic coding sequence
atgcatcgcggaacacaggagggggctatggccagtcgactgctccacaggttaaggcatgcactggcgggtgacggacctggagaggctgcagcatcccccgaggcggagcagtttcctgagagcagcgagctcgaggacgatgacgcagagggactgtcctctaggttaagcggtacattgagttttacgtccgcagaagacgatgaggacgatgaagacgaggatgatgaagaggccggtccggaccagctgccattaggtgatgggacttctggcgaagacgcagaaaggtcccctccccctgatggacaatggggcagccagttgctggctaggcagctgcaggacttctggaagaagtcgaggaacaccctcgcgcctcagaggctgctgtttgaggtgaccagcgcgaacgtggtaaaggaccccccatcaaagtacgtcctgtataccctggcggtgatcggtcctggacccccagattgccagcctgcacagattagcaggcgatattctgatttcgagagactgcatcgcaacctgcagaggcagttccgcggaccgatggcagcaatcagtttccctcagtcacactag

SEQ ID NO: 54485 - DNA, 453 bp, Artificial Sequence
  Description of Artificial Sequence: Synthetic coding sequence
atggcctcacgtctgctccatcgcttgaggcacgccttggctggcgatgggcctggtgaagctgccgctagcccagaagcagagcagtttccagaatcttctgagctggaggatgacgacgccgaggggctgagctccaggctgtccggcactctgagttttacttctgccgaagacgacgaggacgacgaagacgaggatgatgaggaggcgggtcccgatcagctgccgttaggtgacgggacatccggagaagacgccgagaggtcgccaccccctgacgggcagtggggatctcagctgctggccagacagctacaggacttctggaagaaatcccgcaatacattggcccctcagcgtctcctttttgaggtaacaagtgccaatgtcgtgaaagaccccccaagcaagtatgtgaccccaacactgtctagcacaccgagtccctag

SEQ ID NO: 54486 - DNA, 477 bp, Artificial Sequence
  Description of Artificial Sequence: Synthetic coding sequence
atgcatcgcggtacccaggagggggctatggcaagcaggctcttgcaccgtttacggcatgctctagccggagacggacctggcgaggccgcagcctcacctgaagcagagcagtttccagaaagcagtgagttagaagatgatgacgcagaaggactgtcctcccggctgtcgggcactctgtcttttacatccgctgaagatgacgaggacgatgaggatgaggacgacgaagaggccggacccgaccaactacccctcggagatggaacttccggcgaggacgctgaacggtctcctcctccagatggccagtggggttcacagctgttagccaggcagttgcaggacttttggaagaaaagccgtaataccctcgcaccccagcgtctcctctttgaagtaacttccgctaacgttgtgaaggatccaccttctaagtacgtcaccaacctgagttcgaccccatctccctag

SEQ ID NO: 54487 - DNA, 1122 bp, Artificial Sequence
  Description of Artificial Sequence: Synthetic coding sequence
atgcatcggggaacacaggagggggcaatggcttcgagactactccatcggttacggcacgctctcgctggcgatggtcccggagaggcagcagcaagtccagaggcagagcaatttcctgagagctccgagttggaggacgatgatgcggagggtctgtcatctagattgagtgggactctgtctttcacatcagctgaagatgacgaggatgatgaagacgaggatgatgaggaagctggccctgatcaactgcctctgggtgacgggaccagtggcgaggatgccgagagaagccctcctcctgatggtcagtggggatcacaactgctcgcacggcagcttcaggatttctggaaaaaatctcggaacactcttgcgcctcaaagactgctatttgaagtgacaagcgcaaatgtggtgaaggatccaccatcaaagtacgtactatacactctggcagttatcgggcctggacctccggactgtcagccggcacagatttcaagacgttacagtgactttgaacgtcttcaccgtaacctacagcgccagttccgtggacccatggccgctatttcttttcctaggaaacgtttgagaagaaatttcacagcagaaactatcgctcggcgttcacgcgcttttgagcagttcttagggcaccttcaagctgtaccagagttgaggcacgccccagatctccaggacttctttgtgttacctgaactgcggcgtgcccagtcactgacatgtaccggcctgtatagagaggcactagccctttgggccaatgcttggcagctgcaggcccagctcggcaccccttctggacccgatcgccctcttctcacgctggctggtctggccgtgtgtcatcaagaattagaagacccaggcgaagcacgagcctgttgcgagaaggcactgcagctgctaggagacaaaagtctccaccccctactggctccctttttagaagctcacgtgagactttcctggaggcttggcctagataagaggcaaagtgaggcaaggctccaggccctacaagaagcagggctgacacctaccccccctccttcgctgaaggagcttcttattaaggaggtgctcgactag

SEQ ID NO: 54488 - DNA, 294 bp, Artificial Sequence
  Description of Artificial Sequence: Synthetic coding sequence
atggacaagcaatcttccgccggtggggtcaagcgttcagtcccatgcgatagcaacgaagccaacgaaatgatgccagaaacaagctccggttactctgaccctcagcctgctccaaagaaattaaaaacatccgaatcctccaccatactagtcgttcgctacagacggaacttcaaaagaacatcgcccgaggagctggtcaatgaccatgcccgtaagaatcggattaatccacttcagatggaagaagaggaattcatggaaataatggtcgagatccctgccaaatag

SEQ ID NO: 54489 - DNA, 3771 bp, Artificial Sequence
  Description of Artificial Sequence: Synthetic coding sequence
atggatcggcctctttcttcaagcgcagaagctgaggaggagctagaatggcaggtagcaagccgcagacgaaaggcctgggcaaaatgtaggtcgtcctggcaggcttccgagacagaggacctgtcaacagaagcgacgacacaggacgaggaggaggacgaggaggaagatctgcccggtgctcagctgcctgctgcaggaggcagggggaacgttcccaatgaaaaaatagcaatctggcttaaagactgtcggacccctctgggtgcaagcctggacgaacagtcctcgtcaacactgaaaggtgtgctggtccggaacggcggaagctttgaagatgacttgtcactgggagcagaggcaaatcatctgcatgagagtgatgcccagatcgaaaattgtaataatatcctggctaaagaaagaagattgcaattccaccagaagggacggagtatgaatagtacaggatctggaaaatccagcggcaccgtaagcagcgtttccgaacttctggagctctatgaggaggaccccgaagagattctgtataaccttgggtttgggagggacgagccggatatcgcctctaagataccctcccgattctttaactctagttcttttgctaagggcatcgacattaaggtgtttcttagcgctcagatgcagaggatggaggtcgagaatccaaattacgccctgacaagccggttcagacagatcgaggtcctcacaacagtggccaacgccttctcatctttatatagccaagtcagtgggacccccctgcagcggatcgggagtatgtctagcgtaacaagcaataaggaaaccgatcctccaccccctctgactcggagcaatacagccaacaggctgatgaaaacactgagcaagctaaatctgtgtgttgataagactgagaagggagagtcctccagtcccagtcctagtgccgaaaaaggtaagatattgaatgtgtctgtcatcgaagaaagtggaaacaagaacgaccagaagtctcagaaaatcatgaaaaagaaagagagcagcagtatgctggccaccgtgaaagaagaggtgtccggatccagcgccgcagtgaccgagaatgcagatagtgataggataagcgatgaagccaattccaactttaatcagggcactgagaacgaacagagcaaagagacgcagtctcacgagagcaagttgggggaagaaagcgggattgtcgagagcaaactggactctgattttaacatctctagtcatagcgagctcgagaattcttcagagctcaagagcgtgcacattagtacaccagaaaaggagccgtgtgccccacttacaattcccagcattcgtaatatcatgacccagcagaaagatagcttcgagatggaggaggtacagtccacagagggggaagctccccacgtaccagctacctaccagctcggactgacaaagagcaagcgggatcacttattgagaaccgccagccagcactccgatagtagcggctttgccgaggatagcaccgactgcttatctctgaatcacttgcaagtgcaggagagtctgcaggccatggggagctccgcagactcttgcgattccgagactacagtgacttccctcggagaggatctggcgacccccaccgcacaggaccagccctattttaatgagtctgaggaagagagtcttgtgcctctgcagaagggcttagaaaaggccgctgcggtggcagataaaaggaaaagtggcagtcaagacttcccccaatgcaacaccattgagaacaccggcacgaaacagtccacctgtagcccaggggaccatatcatagagattactgaggtagaagaagacctattcccagcagagactgttgagcttctccgggaggcctccgctgaatccgatgttggtaaaagctcagagtctgaattcacccagtatacaacccaccacatattgaaatcattagccagcatcgaagccaagtgtagtgatatgtcatctgagaacactacagggcctccaagcagcatggatagggtgaacacagctttgcagcgcgctcagatgaaagtgtgttccctatcaaaccagaggatgggaagatccctgctgaagtcaaaagacctgcttaagcagcgttacctcttcgctaaggccggttacccacttagaaggagtcagagtctgccaactacactgctgagcccggttcgcgtggtgtcctccgttaacgtgcggctgtctcctgggaaagaaacaaggtgctccccaccgtccttcacctacaagtatacccccgaggaggaacaagaactggagaagcgcgtgatggagcacgatgggcagtctttggtgaaatcaacaatctttatttccccgagctccgtaaagaaagaagaggctccacagtccgaagcccctagagtggaagagtgccatcatgggagaaccccaacgtgctctaggctggctccgcctcctatgagtcagtcaacatgcagtctgcacagtatccactctgagtggcaggaacgcccactgtgtgagcacactagaacgctctcaacgcatagcgtgcctaacatttcgggtgcaacatgttcagcatttgcaagcccgtttgggtgcccctactcacatagacacgccacatatccttaccgagtctgctccgtcaacccaccttcagctatcgagatgcagttgaggagagtgctgcacgatatccgtaacagcctccaaaatctatctcagtaccccatgatgagagggcctgaccccgctgctgcgccttatagcactcagaaatcaagcgtactgcccttgtacgaaaacacattccaggaactacaagttatgagacggtccctgaacctgttccgtacccagatgatggatctagagttggcaatgctcagacagcagacaatggtctaccaccatatgaccgaagaggagaggttcgaagtagaccagctccagggacttcgcaacagtgtgcggatggagctgcaagaccttgagttgcagctcgaagagcgcctgctcgggctagaagaacagctccgggctgtgcgcatgcccagtccgttcaggtcctcagcactgatgggcatgtgcggatctaggagcgcggacaacttgtcctgtccaagccccctcaatgtgatggagcctgtaacggaactcatgcaggaacagtcctacctgaagtccgaactgggccttggacttggcgagatgggctttgaaatccccccaggcgagagctcagaatctgtgtttagccaagccacttctgagtctagctccgtctgtagtggaccctcccacgctaacagaagaaccggtgtgccgagtactgcgtctgtcgggaaaagtaaaacaccactggtcgccaggaagaaggtattccgggcttctgttgccctgacaccgacagcgccatcccgcacgggtagtgtgcagactcctccagatctggaatcttctgaggaagttgatgcagctgagggggcacccgaggtggttgggccaaagtctgaggtagaggaaggacacgggaaactcccgagtatgccagctgctgaagagatgcacaaaaacgtggagcaagatgaactccagcaggtgatcagagaggtagggatggaccctatcagttgcgtgattctcgaactgtccatgatctgtacgggaggtggcgtgatttgtgctctggaggatacttgttgttag

SEQ ID NO: 54490 - DNA, 3255 bp, Artificial Sequence
  Description of Artificial Sequence: Synthetic coding sequence
atgaattctacaggctcagggaaatctagtggcactgttagttcggtcagcgagctgctggagctgtacgaggaggaccctgaggagattctttataacctgggtttcggtagggacgagcccgatatcgctagcaaaatccctagccgattcttcaactcaagctcttttgctaaggggatcgatatcaaggtgtttttgagcgcccagatgcagaggatggaggtggagaaccctaactatgctttgacatcccgtttccgacagatagaagtgctcacaacagtggccaatgccttctcctctttgtattctcaggtttcaggaacacccttgcagcgaattgggagcatgtcttctgtgacatccaataaggaaactgatccccctccacccctcactcggtccaatactgccaaccggctgatgaagactctctctaagcttaatctctgtgtggataagaccgaaaaaggagagagtagctccccgtccccctccgcggagaagggcaaaattttgaatgtgtctgtcattgaagagtctggcaacaagaacgaccagaagtcccagaaaatcatgaagaagaaggaaagcagttcaatgctcgctaccgtcaaggaggaggtctctggaagtagcgccgctgtgacagaaaacgcagactcagaccggatatctgacgaggctaatagtaatttcaaccagggaacagaaaatgagcagtctaaggaaacacagtcccacgaatccaagttaggcgaggaatctggtatagtagaatctaagctggacagtgattttaatatctccagccatagtgagctggaaaactctagtgagctgaagtccgtacatatcagcactccagagaaggaaccgtgcgccccactcaccattccctctataagaaacatcatgacacagcagaaggactctttcgagatggaggaagtacagagtaccgagggcgaagcaccccacgtccctgctacatatcaactgggactgacgaagagtaaacgggaccatctcctgaggaccgcaagccagcactctgattccagtggcttcgccgaagactcaacggactgtttaagtcttaatcacctgcaggtccaggagtccctgcaagccatgggctccagcgctgatagttgcgattccgagacaactgtgacctctcttggcgaagatcttgccacacccaccgcgcaggaccagccgtactttaatgagagcgaggaggagtcattagttccccttcagaagggactggaaaaagccgctgccgtcgcagacaagcgtaaatcaggcagccaagacttcccacagtgcaataccatcgagaacacgggaaccaagcagtcaacatgcagccccggagatcatatcatcgagatcaccgaagtagaggaggatctcttccccgcagaaaccgtagaactgttgagagaggcgtctgccgaatctgacgtcggcaagagtagcgaatctgagtttacacagtacacaactcaccacattctaaagtcactggccagtattgaagccaagtgctccgatatgagcagtgaaaataccacagggcctccatcctcgatggaccgggtaaacaccgctcttcaacgcgcacaaatgaaagtctgcagtctgagcaaccagaggatggggagatctttattaaagagtaaagatctgctgaagcaaagatacctcttcgcaaaggccggatatcccttaaggagatctcagtccctgcccacaaccctactgtccccagtgagagtcgtaagcagtgtcaacgtgcggctgtctcctggtaaggagacaaggtgctctcctccaagcttcacttacaagtacacgccagaggaagagcaggagctagagaagagggtgatggaacatgacgggcagagtctggtcaagtcaactatttttatctctccatcttcggttaagaaagaagaagcccctcagagtgaagcaccaagggtagaggaatgtcaccacggacgtaccccgacctgttctcgattagcaccaccacctatgagccagagcacctgttctctccactctatacattcagaatggcaagaacggcctctctgcgagcatacccggaccctgtcaacccattcagtgccaaacataagcggagccacctgctccgcctttgcctcccctttcggatgcccctacagccatcgacacgccacttacccctaccgcgtgtgctcagtgaatcccccttctgcgatcgaaatgcagctgagaagggttcttcacgacattagaaatagtttacagaatctgagtcagtatcccatgatgcgaggtcctgatccagcagctgccccttactcgactcaaaaatcatcggtacttcccctgtatgaaaatacatttcaggaactgcaggtgatgagacgtagccttaacctttttcgcacccaaatgatggacttagaattggctatgcttcgacagcagaccatggtgtaccaccacatgactgaagaagagcgctttgaagtcgaccaattacaggggctgcgcaactctgtacgcatggagctgcaggacctggagcttcagctggaagagaggctgttgggccttgaagaacagctccgcgctgtccgcatgcccagcccctttcgctcttctgctctcatggtgactgagctcatgcaggaacagtcctacctgaaatcagagctgggcctagggttaggcgaaatgggcttcgaaattccacccggagagtctagcgagtcagtgttttctcaggccacctcggagtcctctagtgtttgtagcggaccatctcatgctaatcgacgaacgggggtgccatctacagcgtcagtaggaaaatcgaagaccccgttggtcgcacgtaaaaaggtgtttcgcgctagtgtggccctaacccctacagcgccaagcagaaccggtagcgtgcagacacctccagacctggagagcagtgaggaggtggacgcagcagaaggggcacctgaggtggtcggcccaaaatccgaggtggaggaggggcacggcaaactcccctcaatgcctgccgctgaagaaatgcacaaaaacgttgagcaggacgagctccaacaagtgattagagaaattaaagagtcgatcgttggcgagattagaagggagatcgtaagcggcctcttggccgctgtaagttcaagcaaggcatctaattctaagcaggattaccactag

SEQ ID NO: 54491 - DNA, 3780 bp, Artificial Sequence
  Description of Artificial Sequence: Synthetic coding sequence
atggatcgaccactgtccagcagcgccgaagccgaagaagaattagaatggcaggtcgccagcaggcgccgtaaggcgtgggccaagtgccggagctcctggcaggccagcgaaaccgaggacctgtcaacagaagctacaacccaagacgaagaggaagatgaagaggaggatttgcccggtgcccagctgcccgcagccggaggtcgcggtaacgtacccaacgagaagatcgccatctggttgaaggattgtcggacacccctgggcgcatcactcgatgagcaatctagctccaccctcaagggggtgctcgtacgcaacggcggatctttcgaggatgacctgagcctgggggctgaggctaaccacctgcacgagtccgatgcccagatagaaaactgtaacaacatcctggctaaggagagacggctgcagttccatcagaagggcaggtcgatgaacagtaccggctcgggtaagtcctcgggcaccgtgtcctctgtgagtgaacttctggaattgtatgaggaagatcccgaagagatactgtataacttgggatttggcagagacgagccagacattgcttcgaagatcccctctcgcttcttcaactccagtagcttcgccaaaggtatagacataaaggtattcttgagcgcccaaatgcaacgtatggaagtggagaatcccaactatgcgctgaccagtaggtttaggcagatagaggtactgactactgttgccaacgcctttagctccttgtactcacaggtctctgggactccactacagagaattggctcaatgtcctctgttacgtcaaacaaggaaacggatcccccaccacctcttacccggtccaacaccgcaaaccggttgatgaagaccttgtccaaacttaacttgtgcgtcgacaagactgagaaaggcgagtcaagctcacctagtcccagtgccgagaagggaaaaatcctgaacgtgagcgtcattgaagagagtgggaataagaatgatcagaaaagccagaagatcatgaagaagaaagaatcaagttcaatgctggctacagtgaaagaggaagtcagtgggtctagtgctgcagtgaccgagaatgccgacagcgaccgcatatcagatgaagcaaacagcaactttaaccagggcacagagaacgagcagtcaaaggagactcagtcccatgagagcaaattaggagaagagtcaggaatagtggaatccaaactggattctgacttcaacatttcctcacattcggagctcgaaaattctagcgagttgaagtccgtgcacattagtacacccgagaaggagccctgtgcacctctgactattccctccatcaggaatatcatgactcaacaaaaggattcatttgagatggaggaggtgcagagcacagaaggcgaggcccctcacgtgcccgctacctaccaattgggactgaccaaatctaagcgtgatcaccttctgcgtacagccagtcagcacagtgactccagtggttttgcggaagactcaacagactgtctgagccttaatcatctacaagtccaggaaagcctgcaagctatggggtcctccgcagattcttgtgattccgagactacggtgaccagcctcggggaagatctcgccacaccaaccgctcaggaccagccatatttcaatgagagcgaggaagaatctctggtcccccttcagaagggccttgaaaaagccgcagcggtagcagataagcggaaatctggcagtcaggatttccctcagtgcaataccatcgagaatactgggaccaagcagtccacgtgttcgcctggcgatcacattattgaaattactgaggttgaggaagatctgttcccagctgaaactgtggagttgctgagagaagcatccgcggagtccgatgtcgggaaatcttctgaatcagagttcacccagtacaccacgcaccatattttgaaatccctcgcatcaattgaagcaaaatgctctgacatgagtagtgagaacacgactggacccccttcttctatggaccgggtcaataccgcccttcaaagggcgcaaatgaaagtttgttctctcagcaaccaacggatgggtcgttctcttcttaaatcgaaggatcttctcaaacagcgttacctcttcgccaaggcgggatacccactgcgtcgatcacagagtctgcccacgacccttctgtctccagttcgcgtcgtgtcctcagtaaatgtgagactgagtccgggaaaagagactcggtgctcccctccaagcttcacttataaatacactccggaggaggaacaggaactcgaaaaacgcgttatggaacacgatgggcaatctctggtaaagagtaccatattcatctcgcctagcagcgtgaagaaagaggaggccccacagagcgaagcacccagggttgaggagtgtcaccacggaagaacgccaacctgttctaggctggctcctccaccaatgagtcagtcaacttgctccttacatagtatccatagcgagtggcaggagcggcctctctgtgagcacacgcggacgctaagcacccactcagtgcccaatatctccggagctacctgcagcgcattcgcctctccatttgggtgtccatactcccacagacacgccacctatccttaccgagtctgttccgtgaaccctccatcggctattgagatgcagctaagacgcgtcttgcatgatatccggaatagcttgcagaatttgtcacaataccctatgatgagggggcctgaccccgcagccgctccctattccacccaaaagtcaagcgtgttaccactctacgagaacacatttcaggaactgcaggttatgagaaggagtttgaatttgttcagaacgcagatgatggatctcgagctcgccatgctgcgccagcagactatggtgtaccaccacatgacggaggaagaacggtttgaagtggaccagcttcagggtttacgtaactccgtgagaatggagcttcaggacctcgagctccaactcgaggagcgacttttgggcctggaggagcagttgcgagctgtgagaatgcctagtccattccggagctctgccttgatgggcatgtgtggatcccggtcagccgataatctatcatgtccatcgccactgaacgtgatggagcctgttaccgaactgatgcaggaacagtcctatctgaaatctgaactgggcctgggactgggcgaaatgggttttgaaatacccccaggcgagtcatctgagtccgtcttttcgcaagcaacaagcgagtcatcgtcagtgtgttctgggcctagtcatgcaaaccgacggacaggggtcccttccaccgctagtgtgggaaagtcaaagacccctctggtggcccgaaagaaggtctttcgggcatcagtagccttgactccaacagctccctcccgaaccggttctgtgcagaccccaccagaccttgagagttccgaggaggtggacgctgccgaaggggctcctgaagtcgtgggacctaagtccgaagtggaagaagggcatggcaaattgcctagcatgcctgccgctgaggaaatgcacaaaaacgtcgaacaggatgaactgcagcaggtgatccgggagataaaggagtcaatcgtgggtgaaatccgcagggaaattgtgtccgggctgctggctgctgtgagcagctccaaagcgtccaatagtaaacaagactaccactag

SEQ ID NO: 54492 - DNA, 519 bp, Artificial Sequence
  Description of Artificial Sequence: Synthetic coding sequence
atgcccgtaggggcaggactgccaactagcctaacgtccccaccctctaccgaagcacccaagtcatcattgctacgcaagcagacccaacccccaaaaaaacagtctagtccagctgtgcatcttcgatgtacaatggatcccgttatgatgaccgtttcacccccaccagcccatcggcaccgcaggcgagggagtccaactcgctgcgcccattgccctgtagcctgggcccctgacaccgatgacgagaagccacatcagtatccagcgatctgctcatatcactgggatgtgccggaggattgggaggggtttcagcacacccagggaacctgggttccttggtcccaggacgctcccgaatctccgcctcagacaatacgatttcaacctggcaggcagtcagaaaccccaagcaagaagaaaaaaaagaagaaaaaaaaacgaaatatcggcgctcctctgaagagatacctgactgttaccagtcagctgagtgttacttctctcttatag

SEQ ID NO: 54493 - DNA, 930 bp, Artificial Sequence
  Description of Artificial Sequence: Synthetic coding sequence
atggccatggtcgaacggccaagaccagaatgggcctcttaccataattgcaactcaaacagttgccaagatctgggcaacagcgtgctgttgctcctggggctgattatctgcatcaatatatccattaacatcgtgacactgctctggagccgtttcaggggggtgctgtatcaggttttccacgatacgatctgtgaaaaggaggctccgaagagcagcctcctgagaaagcaaacacagccacctaaaaaacagagctctccagccgtgcacttacggtgtaccatggatcccgttatgatgaccgtgtctccaccacccgctcatcgacacagaagacgtggctcccccacacggtgtgcccactgtcccgtggcgtgggctcctgatacggatgacgagaaacctcatcagtaccccgctatctgctcttatcactgggatgtccctgaggactgggagggattccaacacacacagggcacctgggtgccatggagccaagacgcacctgagtccccacctcagaccattaggttccagcctacggtcgaggagcgccctttaaaaactggcatatggtctgagctcgggctgagagcgtatgtctaccctgtgaatcctccccctccatctcccgaagctcccagccacaagaacggaggcgaaggggcagtccccgaggccgaggctgcacagtaccagcccgtacctgctccaaccctcggtccagccgtgataccagagtttagcagacatagatcatcgggcagaatcgtttatgatgcgagagatatgcggaggcgactgcgggagcttactagggaagtcgaggccctgtcagggtgttaccctctggcctccggttcttccacagcggaagaaacctctaaaaactgggtgtatcgcagcctcacgggccgatag

SEQ ID NO: 54494 - DNA, 987 bp, Artificial Sequence
  Description of Artificial Sequence: Synthetic coding sequence
atggctagccgctgctccgaaccttatcctgaggtctctcgcataccaacggtcagggggtgtaacggttctcttagcggggctctgagctgttgcgaagacagtgccaggggaagtgggccacccaaggcgcctacggtggctgaaggccctagttcgtgcctccgccgaaatgttatcagcgagagggagagaagaaaaagaatgagcctttcttgcgaacgcctccgggctcttctgccacaattcgacggacggagagaagacatggcatcagtgctggagatgtccgtccagttcctgaggctcgcttcagcacttggccctagtcaggagcaacatgctatcctcgcgtcttccaaggaaatgtggcactctctccaggaggacgtgctccagctgaccctgagtagtcaaatccaggccggtgtgccagacccagggaccggtgcctcgagtggaacaagaactcccgatgtgaaagcctttctcgaatccccgtggagcctggatcctgcctctgcttcaccggagcccgtcccccatatactggcctcgtctcggcagtgggatcctgcctcatgcacaagccttggcactgataaatgtgaggctctgctgggactgtgccaggtgcgaggcggattgccgccattttcggagccctccagtctggtcccgtggccccctggccgatcacttcccaaggcggtcaggccccctctatcatggcccccatttagccagcagcagacattgcctgtgatgagtggggaggcacttgggtggctcgggcaggctggccctttagccatgggggctgcaccactgggagagcccgctaaagaggaccctatgctggctcaggaggccggatctgctctgggctcagacgtggacgacgggacaagctttctcctgacagcaggccctagctcatggcccggagagtgggggccaggtttccgggctggccctcccgcttag

SEQ ID NO: 54495 - DNA, 1164 bp, Artificial Sequence
  Description of Artificial Sequence: Synthetic coding sequence
atggcttcacgttgcagtgagccctaccctgaggtgagccgaatacctaccgtcagaggctgtaacggttccctcagcggggctctgtcttgctgcgaagactcagctaggggcagcggtccccctaaagctccgacagtagcggaaggtccctcatcctgtctgcgccgtaacgttatttccgagcgggagcgccgaaagaggatgtccctctcttgcgagcgactgagagctctgctaccccagttcgatgggcgaagggaggatatggctagcgtcttggaaatgagcgtgcagtttctcagactggcctccgcactgggcccttcccaggaacagcacgccatccttgcatcatccaaggaaatgtggcacagccttcaggaggacgtgctgcagctgacgctcagtagccagattcaggctggcgttcctgacccagggaccggagcctcatcagggactaggacccctgatgtgaaggctttcctggagagtccatggtctctcgatcccgcttcagccagtccagaacccgtgcctcacatccttgcatcaagcaggcagtgggatcccgcttcctgcacgtccctcggcacagataaatgtgaggccttattggggctgtgccaggtaaggggaggacttccacctttctcagagcccagcagcctggtgccctggccccctggcaggagcctgcccaaagcagtccgcccaccgctttcctggcctcctttctcccaacagcaaaccctccctgttatgtctggagaggcgctcggttggctcgggcaggcgggtccactagctatgggcgctgcccctctgggcgagcctgcaaaggaggaccccatgctcgcccaagaggctggaagtgcactagggtctgatgtggacgacggcacttccttcctgctaacagctggaccttcatcctggcccggaagcttggaaggaagaggaggaagtggcccagcctgggctcccgcagagagttcgcctttggacgtgggggaaccaggattcttgggcgacccagaacttggcagccaggagcttcaggactcgcctttggagccttggggcttggacgtcgactgcgcgggactagccctgaaggatgaagtggaaagcatattcccggattttttcgcctgttag

SEQ ID NO: 54496 - DNA, 684 bp, Artificial Sequence
  Description of Artificial Sequence: Synthetic coding sequence
atgtcttactttcggacccctcagactcatcctggacccttgccgagcggacagggtggggcagcatcgcctgggctttctctcggcctgtgctctccagtcgagcccgtcgtggtggcatctgggggaaccggtcctctgtctcagaaagcggaacaggttgccccagcagcccaagcttggggacctgctttggccatgcctcaggccagaggatgcccaggcggaacatcttgggagacgttgagaaaagaatattcgcgtaattgccacaagttccctcatgtgcgtcaactggaatcacttggatgggataatggctatagtagaagccgggcacctgatttggggggaccaagcaggccaagaccgctcatgctgtgcgggttgagccctcgcgtattacccgtcccgtctgaggcagttggaaaagaggcctccagtcagcccgacatctgcattctgacgctggctatgatgatagcgggaatccccactgtcccagttcccggagttagagaagaagaccttatttgggcagcccaggcctttatgatggcccatccagaacccgaaggagccgtggagggcgcacgttgggagcaggctcacgcacacaccgcttccggaaagatgcccctcgtgagatctaagcgaggacagccccctggcagttgcctgtag

SEQ ID NO: 54497 - DNA, 765 bp, Artificial Sequence
  Description of Artificial Sequence: Synthetic coding sequence
atgcccattaaacctgtaggttggatttgtgggcaggtgctaaagaatttctcgggcaggatcgagggcatccagaaggccatcatggatctcgttgatgagttcaaggatgagttcccaacgatattacggctgtctcagtcaaatcagaagcgcgagcctgcacagaagacatcaaagattcggatggccattgcactcgctaaaataaatcgtgctaccctgatcagagggttaaacagtatttcacgaagcagtaagtctgttgctaagttgctgcacccgcagctggcatgtagactgctggagctgcgtgacatttctggccgactgctcagggaggtgaacgcccctaggcagccgctatataacatccaggtcagaaaaggctcactctttgagatcattagttttccagcaaagacggctctgacatcaattatttacgcgtcttacgcagccctcatctatttggcggtgtgcgtgaatgcggtgctgaaaaaagtgaaaaacattttccaggaagaggaaagcatccgccagaatcgcgaagaaagcgaaaattgtcggaaggcattttcagaacccgtgctgtctgaaccaatgtttgccgagggggagataaaagccaagccgtaccgttccctgcctgaaaagccagacatctctgattatcccaagctcttggccaataagcagtcaaacaacatccaggtcctccactcagtgtttgatcagtctgccgagatgaacgaacagatctag

SEQ ID NO: 54498 - DNA, 765 bp, Artificial Sequence
  Description of Artificial Sequence: Synthetic coding sequence
atgcccattaaacctgtagggtggatctgcggtcaagtccttaaaaatttttccgggaggattgagggaatccagaaagctatcatggatctcgttgatgaatttaaggacgaattccccaccatcctccggttatctcagtccaatcagaagagggagcccgctcaaaaaaccagtaagatcaggatggctatagccctggccaagatcaatagagccactctcattagaggtctgaacagcatctctcgcagtagtaagagcgtggcgaagctcttacacccccagttagcttgtaggcttctggaacttagggatatttcgggaagactgcttcgcgaagtcaatgcgcctagacaacccctttataatattcaagtccgaaaaggctccctgtttgagatcatctcctttcctgccaagacggcgttaactagcatcatttacgcaagctatgcagcgctaatctaccttgctgtgtgtgtgaacgccgttttgaagaaggtcaaaaacatcttccaagaagaggagagcatcaggcagaatagagaagaaagtgagaactgccgcaaggcttttagcgaaccagtcttgagcgaacctatgtttgcggagggcgagattaaagcgaaaccttacagatctctgcctgaaaagcccgacattagcgattatccgaagctcctggccaataaacagtccaacaatatacaggtgctgcacagcgtttttgaccagtccgctgagatgaacgaacagatttag

SEQ ID NO: 54499 - DNA, 408 bp, Artificial Sequence
  Description of Artificial Sequence: Synthetic coding sequence
atgcctattaaacccgtcgggtggatttgcgggcaggtgctaaagaatttttcaggcagaatcgaaggcattcagaaagccatcatggacctggtggacgagtttaaagacgagttccctactatcctaaggctctcacaatccaaccagaagagggagcctgcacaaaaaacatctaagattcgaatggctattgccctcgccaagataaaccgcgctactttaattcggggtctaaatagcatctccagatcttcgaagtcagtcgccaagctgctgcatccacagctggcttgtagattgctagagctgagggacatatcagggagattactgagggaggtcaacgcgcctcggcagcctctctacaatatccaggagaagaaaatgggccttcagctgtcgtag

SEQ ID NO: 54500 - DNA, 1272 bp, Artificial Sequence
  Description of Artificial Sequence: Synthetic coding sequence
atgaagccgaacttctctttacggctgcgcatctttaatctcaattgctggggcattccatacctgagcaagcatcgggcagatcgcatgagaagactgggcgatttccttaaccaggagagcttcgatttggcgctgctcgaagaggtgtggagtgagcaggactttcaatatcttcggcagaagctttcgccaacataccctgctgcccaccacttcagaagtggcatcatcgggagtggtctgtgcgtctttagcaagcatccaatccaggagcttacgcagcacatttacactctaaatggttacccctatatgattcaccatggagattggttttcaggcaaggccgtgggcctgcttgtcctccatttgtctggaatggtgctcaacgcctacgtgactcatctccacgcagaatacaatcggcagaaagatatttatctcgcccacagggtggctcaagcatgggagctggcccagtttatacaccacacctctaagaaggccgacgttgtgctcctctgcggggatcttaacatgcaccctgaagacctgggctgctgcctgctcaaggaatggaccggacttcacgacgcctatctggagacccgggatttcaagggatcagaggagggtaatactatggttcctaagaactgctacgtgtcacagcaggagttgaaaccgttcccgtttggcgtccgcatcgactacgttttgtataaggcggtgtccggattctacattagctgcaaaagtttcgagacaaccacaggctttgatccacaccgcggaactcccctcagtgatcacgaagccttaatggccacactctttgtgcggcacagtcctccccagcagaacccttccagcacacacggtcctgctgagcggagtccgctcatgtgcgtgctgaaggaggcctggaccgagctgggactggggatggcccaggccagatggtgggcaacttttgccagctacgtcataggacttgggctgctcctgctagcccttctgtgtgtactggccgctgggggtggagctggcgaggctgcaattctgttatggactcctagtgtggggctggtactgtgggcaggagccttctacctattccatgttcaggaagtcaatgggctctacagggctcaggccgaactccagcatgtgctggggagagcaagagaagcacaggacttggggcctgaacctcagccagccctcctgctgggtcaacaggaaggtgataggacgaaggaacagtag

SEQ ID NO: 54501 - DNA, 846 bp, Artificial Sequence
  Description of Artificial Sequence: Synthetic coding sequence
atgcctgtgcagctcaccactgcgcttagagtggtcggtacatctctgttcgccctggctgttctgggaggaattcttgcagcctatgtgaccgggtatcagttcatccacaccgagaaacactacctctctttcggtctgtacggcgctattctcggactgcacctgctgatccagagcctgttcgccttcctcgaacatcgtaggatgcgtcgagccggtcaggccctcaagctgccatctcccaggagggggtctgtggcactgtgtatcgcggcttatcaggaagatcctgactatctaaggaaatgtttgagatccgcacagcggattagcttccccgaccttaaggttgtcatggtcgttgacggaaatcgtcaagaggatgcctacatgctcgatatctttcacgaggtattgggaggaactgagcaagctggcttttttgtatggcggtctaatttccatgaagccggagagggggaaaccgaagcctcgctccaggagggcatggatcgtgtgagggacgtagtgcgggcatccaccttttcctgtattatgcaaaaatggggcggaaagcgagaggtgatgtatactgccttcaaagctttgggggatagcgtggactatatacaggtttgcgacagcgataccgtgctcgaccccgcttgtaccatagaaatgttgcgagtgttggaggaagacccccaggttgggggagtcggtggcgatgtccaaccccctggtaagggtatggccgtcgaagatgatcaggttcaagccgctcaggttcgagccaccgaggcctggtcagtgcatcagcgacatgtctcccgtgaacagtag

SEQ ID NO: 54502 - DNA, 2175 bp, Artificial Sequence
  Description of Artificial Sequence: Synthetic coding sequence
atggccggaaggaagcacttctggcaaccccgttggtgccccaggtggctggagccaccacttctgaccggagctagggaaagctgtggcgttcaacatagggacggaatctcacggccttggggcccagtgaaggcttcgatacaagagtgtatcctccctgattctcctctataccacaataaagtccagtttaccccaaccggcggactaggccttaacttggcgctcaaccctttcgagtactacatttttttttttgccctgtccctcatcacccagaaacctctgcctgtgagtctgcacgtccgcactagtgattgtgcctactttatcctggtcgatcggtatttgtcttggtttctgccaaccgagggatcagtgccgccacccttgtcgtcatccccaggagggaccagccccagcccaccgccacggacgcccgctattcctttcgccagctacggactgcatcacacttccttactgaagagacatatatcacatcaaaccagcgtaaacgcggacccagcgtcccacgaaatctggaggagcgagaccctattacaggtctttgtcgagatgtggctccatcattacagtctggagatgtatcaaaaaatgcaaagcccccatgctaaggagagtttcacgcctaccgaggagcacgtcttggtagtcaggctcttactgaaacatcttcacgccttcgccaattcccttaaacccgagcaggcttctcccagtgctcattcccatgccacctcgcctctggaggagtttaaaagggccgctgtacctcggttcgtccagcaaaaattgtacttgttccttcagcactgttttggccattggcccctggacgccagcttccgagctgtactcgaaatgtggctgtcctacctgcagccctggcggtacgccccagacaagcaagccccaggttctgactcacagcccaggtgcgtgtccgaaaagtgggctcccttcgtgcaggaaaatcttcttatgtacaccaaactatttgtgggattcctgaacagagcacttagaactgatcttgtttcgcccaagcacgctctgatggtctttcgcgtggcaaaggtgttcgcgcagccaaatctggcagagatgatccagaagggagaacagttattcctggaacccgagcttgtcattcctcatcgacagcatcggttattcactgcgccaacttttacaggtagcttcttatcgccttggccaccagctgttactgacgccagcttcaaagttaaatctcacgtgtactccctggaaggccaagattgcaagtatacaccaatgttcggacctgaagccagaacccttgtgctcaggcttgcccagctgatcacccaagccaaacataccgccaaatctatctctgatcagtgcgcagagtcccctgccggacatagctttctgagttggctgggcttcagcagcatggatacaaatggctcatacaccgctaacgatctcgatgagatgggtcaggactccgtacggaagaccgatgagtacctagaaaaggctctggagtacctcagacagattttccgactgagtgaggcccaactgagacaattcactctggctctcggaaccacccaggacgaaaatggcaaaaagcaactgcctgactgtatcgtgggggaagatgggctcatcctcaccccactcggcagatatcaaataattaatggacttagacgcttcgagattgaatatcagggcgatcctgaactgcagcctattagaagttatgagatagcaagtctggtcagaacactttttcgcctctcaagcgcaattaatcaccgcttcgcaggccagatggcagccctttgttctcgggatgatttcttggggagtttttgccggtatcacctcacagagcccggtctggcctctcgccacctcctaagcccagttgggaggcgccaggtggccggacacacacgtggtcctcggctgagcctccgctttctaggaagctatcgcacactggtgagtctgctcctcgcattttttgtggctagcctcttctgcgtcgggcctctgccctgcaccctgttgctgactctgggatatgtgctgtatgcaagtgcaatgacacttctaactgagcgcggaaaactacaccagccttag

SEQ ID NO: 54503 - DNA, 2514 bp, Artificial Sequence
  Description of Artificial Sequence: Synthetic coding sequence
atgaccaccttcggggctgtggctgagtggcgactccctagcctcagacgagccactctgtggataccacagtggttcgctaagaaggccattttcaactctcctctcgaggccgcaatggcattccctcatctccaacagccctccttcctgctcgccagcctgaaggctgatagcattaacaagccctttgctcagcagtgccaggacttagtgaaggtgatcgaagacttccccgcaaaagagctgcacactatcttcccttggctggtggagtcaatcttcggatctctggacggagtgctcgtgggttggaatctccgctgcctgcagggaagagtgaatcccgtggagtactctatcgtgatggagtttctggatccagggggacctatgatgaagttggtgtacaagctgcaagcagaagattataaatttgacttccccgtgagctatctgcccggtcctgtgaaagccagcatccaagaatgcatcttacctgacagtcccctgtaccacaacaaagtacagttcacccctaccgggggactcggactcaacctggccctgaaccctttcgagtattacatatttttcttcgctctgtcgttaattacacaaaaacccttgcccgtgtcactgcacgtgcgaactagcgattgtgcatacttcattctcgtcgataggtacttgagctggttcttaccaaccgagggctcagtgccacccccactcagttcctctccgggaggtactagtccaagcccacctccgcgtaccccagccatccctttcgcaagctatggtttgcatcatactagcctgctgaagcggcacatttctcaccagacatccgtcaatgccgatcctgcttcacatgagatctggcgtagcgagaccttgctgcaggtttttgttgaaatgtggctacatcactattctctcgaaatgtaccagaaaatgcaatcccctcatgcaaaagagagcttcacccctacagaagagcatgttctggtcgtgcgtttacttctgaagcatctccacgccttcgcaaactccttaaagcccgaacaagcttctccctcagctcactctcacgctacctctcccctcgaggaatttaagcgggctgccgtccccaggtttgtgcaacagaagctttacctttttctacagcattgcttcggccactggcctttggacgcttccttccgagcagtcctggagatgtggctgtcctatctgcagccctggcggtatgcaccagacaagcaggcaccaggcagcgacagccagccgaggtgtgtttccgaaaagtgggcacccttcgttcaagagaacctgttgatgtatacgaaattgtttgtcggtttcctgaatcgcgctcttcgcaccgatctggtaagtcccaaacatgctttaatggttttcagggtcgcgaaggtgtttgctcaacccaaccttgcggaaatgattcaaaaaggcgaacaactctttctcgaacctgagctggtgatcccacacaggcagcacaggctgttcaccgcccctaccttcaccggatcattcctgtccccctggccccctgctgtgactgacgctagcttcaaggtgaagtcacacgtgtattccctggaaggccaggactgcaagtatacaccaatgtttggtcctgaggccagaactctcgtacttaggttagcccagcttataactcaggcaaagcacaccgctaagtccatctcagatcagtgcgccgagtcccctgccggacacagctttctaagttggctgggtttcagcagtatggatacgaacggcagctacacggcgaatgatctagatgaaatggggcaggactcagtcagaaagaccgacgagtacctggaaaaggccctagaatatctgaggcagatcttccgattgtctgaggcacagttgaggcagttcactttggctctgggcacaacgcaggatgagaacggaaaaaagcaactgcctgactgcattgtaggcgaagacggtttaatcctgacgcctctcggcagatatcagatcattaacggtttgcgacgcttcgagatagaataccaaggtgacccggagctacagccaattagatcctacgagatagcgagcctcgtgaggaccctttttagactgtcgagcgccatcaatcatcggtttgcaggccagatggcggcattgtgctctcgcgatgattttttgggatcgttctgtcgataccacctgacagaaccaggcctcgcatctaggcatttgctgtcccctgtggggaggaggcaggtggccggacatacacgaggccctcggctgagtctgcgtttcctcggatcttaccggaccttagtgtcactcctgctggccttcttcgtggctagtctcttttgtgtaggccctttaccctgcaccctgctcctgaccctcggatacgtgctgtatgcttctgccatgaccctgctgacagagcggggaaaattgcaccagccttag

SEQ ID NO: 54504 - DNA, 2601 bp, Artificial Sequence
  Description of Artificial Sequence: Synthetic coding sequence
atgactacttttggcgctgtagctgagtggcgcctcccctcacttcgacgagctacattgtggatcccgcagtggtttgccaaaaaagccatttttaacagccctctcgaagccgctatggcattcccccacttacagcagccatcctttctgctggctagccttaaggccgattctataaacaaaccatttgctcagcagtgtcaggacctcgttaaggtgatagaggattttcccgctaaggagctgcacactatattcccatggcttgtggagtccatcttcggcagcctggatggcgtgctggtgggctggaacttacgatgcttgcagggtcgagtgaaccccgtggaatattctatagtgatggagttcctggatcctggcggaccgatgatgaaactagtctataaacttcaggcagaagactacaagtttgacttccccgtatcgtacctcccaggccctgtgaaggcaagcatccaggaatgcatattacctgactcccctctgtatcacaacaaggtgcagtttacaccgactggaggtcttggactgaacctggctctgaacccgttcgagtactatattttctttttcgccctgtctctcattacacagaaacccctccctgtgagtctgcacgtgcgcacttcggactgtgcctattttatcttagtagaccggtatctctcttggttcctgccgactgagggatcggtgcccccacccctttcttccagccccggaggcacttctcctagccctcccccacgaacgcctgctatcccgtttgccagctatggccttcatcataccagcctactcaaacgacatatctctcaccagacgtccgtgaacgctgaccccgctagtcacgagatctggcgctctgagacactcctgcaggtcttcgtggaaatgtggttacaccattatagtctggagatgtaccagaagatgcagtccccacacgctaagctggaggtgctacactacagattatccgtttcatccgcgctatactcccccgctcaaccctctctccaggcactgcacgcctaccaggagagctttacacctacagaggagcacgtgctagtggtcagacttctcctgaaacatttacacgcttttgcgaattctttgaaacctgagcaggccagtccgtctgcccattcacacgcaactagccccctagaggaatttaagcgggctgcggtgccaagatttgtccaacagaaactctatctgtttctgcagcattgcttcggacactggccactggacgcctcttttcgcgcagtcttagaaatgtggctgtcgtatctgcagccttggaggtacgccccagataagcaggctcctggcagtgattcacaaccgagatgtgtctctgagaagtgggctcctttcgtgcaggagaaccttttgatgtacaccaaactgttcgtcggttttttgaatcgagctctaaggactgatttagttagtcccaagcatgcgcttatggtatttcgagttgctaaagtgtttgctcagcctaatctcgccgaaatgattcagaagggtgagcagctattcctggagcccgagctggtaatacctcacagacagcaccgccttttcaccgcccctacattcaccgggtcattcctgtcaccttggccacctgcagttactgacgcctctttcaaagtgaagtcccacgtgtacagcctggagggacaggattgcaagtatactcctatgttcggccctgaggctcgaactctagtcctgcgactggcgcagctcattactcaggctaagcacactgccaaaagcatatcggatcagtgcgccgagagcccagccggacatagcttcctgagttggcttggcttcagcagcatggacaccaacggatcatatactgctaacgatctagacgagatgggacaggattcggtccgcaagaccgatgagtatttggaaaaggctcttgaatacctgcgccagatttttagattatccgaggcccagcttaggcagtttaccctggcactggggactactcaggatgaaaacggaaagaagcagctgcctgactgcatcgtcggcgaggatggattgatactgacgcctctgggtagataccaaatcatcaacggccttaggcgattcgagatcgaataccagggcgaccccgaattgcagccaattcggtcatacgagattgcctctttggtgagaactctcttccggctgtccagcgctattaatcaccgattcgccggacagatggccgcactgtgctctcgcgacgatttcctgggatccttttgtaggtaccacttaaccgaacctggcctggcttcgcggcatctgctttcgccggtcgggaggcgtcaggtggccggacacacacgcggaccacgcctgagcctgcggttcctgggaagttacaggaccctcgtgtctcttctcctggcttttttcgtcgctagccttttttgtgtggggcctctgccctgcaccctcctccttactcttgggtacgtattgtacgcctctgcaatgactctcctgaccgagaggggtaagctccatcaaccatag

SEQ ID NO: 54505 - DNA, 1509 bp, Artificial Sequence
  Description of Artificial Sequence: Synthetic coding sequence
atgcagactccaccacccactcgcagtggaggtcaaaaactttgcagtcggttcctgctcaagtgtggttttattactatcccatggcggtgcatcaaaaaatgctcccccttgatgcccagggccgctgtgcctcgcttcgtccagcagaaactgtacctgttcctacagcactgctttggccactggcccttggatgcttccttcagagccgtccttgagatgtggctttcttacctgcaaccttggcgctacgcaccagacaagcaggctcccggaagcgactctcaaccccgttgcgtgtcggagaaatgggctccgttcgtgcaggagaacctcttgatgtatactaagcttttcgtgggcttcctcaaccgggcacttcgaaccgatctagtcagtcccaaacatgcactaatggtattcagggtagcaaaggtcttcgcccagcccaacctagccgagatgatccagaaaggagagcagctgttcctggagccggagctcgttatccctcatcggcaacatcgccttttcacagcgccaacttttacaggtagtttcctcagcccgtggcctccagccgtaactgacgcttcatttaaagttaaatcccacgtgtattcactggaagggcaagactgtaaatacacccctatgtttggacctgaagctcgcactctggtgttaaggcttgcccagctgataactcaggctaaacacacagcgaaaagtataagcgaccagtgtgccgagtcgcccgcaggtcattcatttctatcttggttaggcttctcttctatggacacaaacggtagttataccgcaaacgatctcgatgagatgggacaggatagtgtccggaaaacagatgaatatctcgaaaaggccctggaatacctgcgacagatctttagattatctgaggctcagctgagacaatttacactcgccctggggaccacccaggacgagaacggaaaaaagcagctgcctgactgtattgtcggggaggatggcctgattctgacaccccttggtcgctaccagatcatcaatgggctgagaaggtttgagattgagtaccagggtgatccggaactgcaacccatacgctcctacgagatcgcgtcactcgtgcgtacgctctttcggctgagctccgcgatcaaccaccgcttcgccggtcagatggcagccctctgcagtcgagacgactttctaggatccttttgccgatatcatctcacggagcctggactagcatcccggcatttgctgagtcctgtgggacgtcggcaggtggcagggcatactcgcggaccccgattatctctacggttcctgggctcataccgcactttggtctccctgttgctcgccttctttgtggcctccctgttttgcgtgggtcctctcccttgtacattgcttctaacccttggttatgtgctgtacgcatcagcaatgacactgctgacagaacgtgggaaactgcaccagccctag

SEQ ID NO: 54506 - DNA, 2295 bp, Artificial Sequence
  Description of Artificial Sequence: Synthetic coding sequence
atgacaacctttggtgccgttgccgagtggagattgcccagcctgcgtagggccaccctttggattccgcagtggttcgcaaaaaaagctatcttcaattctcctctcgaagcagctatggcctttccacacctacagcagccctcattcctgctcgccagcttgaaggccgattctatcaacaaaccgtttgcgcagcaatgccaggatttggttaaggttatagaagacttccccgctaaaggcccagttaaagcctctatccaggagtgtatactgccagacagccccctctatcacaataaagtgcagttcactccaaccggaggtttgggactgaatttggccctaaatccctttgagtactacatcttcttttttgcgttgtccctcatcacacaaaagccacttcccgtgtcacttcatgtgagaacctctgattgtgcgtatttcatcctagtcgatagatacctgagttggttccttccaaccgagggttctgttcctcctccactttcgtcctccccgggagggactagccccagtccccctccccgaactccagctattccctttgcttcctatggtctgcaccacacctctctcttaaaacggcacatctcccaccagactagtgtgaacgccgatccagctagccacgagatttggcgatcagagacactgctccaagtatttgtggagatgtggctgcatcactattcccttgagatgtaccagaagatgcagagccctcacgcaaaggagtccttcacccctacggaagaacacgtactagtggtacgcctcctgctgaagcatctgcacgcctttgcgaattcgttgaagcccgagcaggcatcccctagcgcacactcccacgcaacaagccctttagaggagtttaaaagggctgcggtccccaggttcgtgcaacagaaactgtatcttttcctccagcactgctttgggcattggccactggacgccagtttcagagcggtgctggagatgtggctcagttatctgcaaccatggcgatacgcgccagacaaacaagctcccggatccgatagccagccaaggtgcgtttccgagaagtgggcccctttcgtgcaggagaacttgctgatgtacaccaagttgtttgtcggcttcctgaatcgtgcccttcggacggacctcgtaagccccaaacatgcactgatggtgttcagagtggccaaagtcttcgcccagccgaatcttgcggagatgatccagaagggagaacagcttttcctcgaaccagagttggtgatcccacaccgtcagcataggctctttacagccccaacattcactggatcctttctttctccttggccaccggctgtgaccgatgcatcttttaaagtaaaatctcacgtgtactctctagaggggcaggactgcaagtatacaccaatgtttggaccagaagcccgaactcttgttttgagattggcccagctgattactcaggccaaacacactgccaaatcgataagtgatcaatgcgccgagtcaccagccggacactccttcctgtcttggttggggtttagctcgatggacaccaatggatcatataccgctaatgatcttgatgagatggggcaggactccgttcggaagactgatgagtacctggagaaggcactggagtacctgcggcagatcttccggctctccgaggcacagctcaggcagtttacccttgccctcggcaccacccaagacgagaatggcaagaaacaactgcccgactgtatcgtgggagaagatggactgatccttacacctctgggaagataccaaattatcaacggtctccgccgttttgaaatcgaatatcagggtgatcccgaattgcagcccattaggtcttacgagatcgccagcctggtgcggaccctattccgactctcctcagccattaaccaccgtttcgccggacagatggcagctctttgttctcgggatgacttcttaggctccttctgtcgctatcacttgacagaaccgggtcttgcttcgcgccaccttctctccccagtgggcagacgccaggtggcaggtcacacaaggggtcctcggctttccctgcggttcctgggtagctatcgcaccctcgtcagcttgttactggccttcttcgtcgctagtctgttttgtgttgggcctctcccctgtaccttgttgctcactctgggatacgtcctgtatgctagtgccatgacgctgctcacagaacggggaaaattacatcagccatag

SEQ ID NO: 54507 - DNA, 1593 bp, Artificial Sequence
  Description of Artificial Sequence: Synthetic coding sequence
atgtggcttcaccactattctctcgagatgtaccaaaaaatgcagtcaccccacgccaaagagagttttactcccactgaggagcatgtgcttgtggtaagactgctgctgaagcatctgcacgcgtttgctaattcacttaaacctgagcaagcatctccttctgctcatagtcatgcgacctctccactagaggagttcaaacgtgccgcagttcccaggttcgtgcaacagaaactatatttattccttcagcattgttttgggcattggcccctggatgctagcttcagagctgtgttggagatgtggcttagctacctccagccatggcgctacgcgccagataagcaggcccctggctccgactctcagccccgatgtgttagtgagaagtgggcgccttttgtccaggaaaacttattgatgtacactaagctgttcgtaggattcctgaatagggctctgaggaccgatctggtatctcctaagcatgccctgatggtcttcagagtcgccaaggttttcgcccagcccaatttggcggaaatgattcagaagggcgaacagttgtttctggagcccgagctggtgatcccacacaggcaacatcgactgttcaccgcccctacttttactgggtccttcttaagtccatggccccctgctgtcaccgacgcctcttttaaggtaaaatcacacgtctactcactggaaggacaagattgcaagtacacccctatgttcggcccagaagcacgaacacttgtccttaggcttgcacaactgatcacccaggcaaaacacaccgccaagtcgatttcagaccagtgtgccgaaagtccagctggtcactctttcctatcttggctcggcttctcaagtatggatacaaatggcagctacacggctaacgacctggacgagatgggccaagactcagtccgtaaaacagacgagtacttagagaaagctttggaatatttacgccaaattttccgactctcagaagcccagcttaggcaatttactctcgctctcggcaccacccaggacgagaatgggaagaagcagctgcccgattgtatagtgggagaagacgggctcattctgacaccgcttggacgataccagattataaacggtctccgccgatttgaaattgagtaccagggggatccagagctgcagccaatccgatcttatgagatagccagtctggtgagaacattgttccgcctctcctcagcgatcaatcatagatttgccggacaaatggccgcactctgttccagggatgatttcctcgggtccttctgcagatatcacctgaccgaacccggactggcatctagacatctgctgagcccagtgggcaggcgccaggtggcgggacacacacgaggcccacgactgagcctgaggttcctcgggtcctaccgcacactggtgtccctcctgctggctttcttcgtggctagtctgttctgcgtggggcctctcccttgtacacttcttcttaccttggggtacgttttatacgccagcgccatgacactcctgaccgaaagggggaagttgcaccaaccatag

SEQ ID NO: 54508 - DNA, 1824 bp, Artificial Sequence
  Description of Artificial Sequence: Synthetic coding sequence
atgcagacgcctcctcctactagatccgggggacagaaactgtgctccagattcctcctgaaatgcgggttcattacaatcccttggcggtgcataaaaaagtgttcgcccctgatgccttcttggcgcttttgtaccaccgacagtgtgtcaccagcgccaagcactgcccctcctaaccctgccagtcggccttcaactcctactaaatccctgggcaaccgcggatctgatgctagagggttttactgggccgaattcagtagcgggtgcgtccaagacgaagagcaggagtctttcacgcctactgaggagcacgtacttgttgtccggctgttgttaaaacacctgcacgcatttgcgaatagcctaaagcccgagcaggcatctccctcagcccatagccacgcgaccagccctttggaagagtttaagcgagcagctgtgccaaggttcgtccagcagaagctgtatttgttcttgcaacactgctttgggcattggcccctggacgcctctttccgtgccgttctcgagatgtggctgtcctatctgcagccttggcgctacgccccagataaacaagccccaggttccgatagccaaccacgatgcgtctccgagaagtgggctccttttgtgcaggaaaacctgcttatgtataccaagctgtttgtgggtttcctgaatagagcactgagaaccgatcttgtgtcccccaagcacgcactcatggtgttcagagtcgcgaaagttttcgcgcagcccaatctcgccgagatgattcagaagggcgagcagttgttcctggaacccgaactggtgatcccgcatcgacagcacaggctgttcaccgccccaacgttcacaggatcctttctgtccccatggccgcctgcagtcaccgacgcttcttttaaagttaaatcccacgtgtattctctggaaggccaggattgtaagtatacaccgatgttcggaccggaagctcgtaccctggtcctgcgtttagcacagcttatcactcaagctaaacacacggctaaaagcatatccgaccagtgcgctgagagtcctgcaggccacagttttttgtcctggctgggcttttcaagcatggacacgaacggtagctataccgccaatgatctggacgaaatgggccaggattctgtgcgcaaaaccgacgagtacttggagaaggccttggaatacttacggcagatctttcgactgtcagaggctcagctcaggcagttcactctcgctctgggaactactcaggacgagaacgggaagaagcagctgccggactgcattgtgggcgaagatggactcatacttacccccttgggcagatatcagattattaatgggttgcgacggttcgagatcgaatatcagggcgacccagagcttcaacctatacgaagttatgaaatagctagcctggtacggaccttgttccgcctaagttcagccatcaatcatcggtttgccggacagatggccgctctgtgcagtagagatgatttcttaggaagtttctgccggtatcatctgaccgagcctggactggcgtccagacatctgctctccccagtcggtaggcgccaggtggccggacacacacggggaccacgcctgtccctgcgcttcctgggcagctaccgaactcttgtgtcgctgctgctcgccttcttcgtggcatccctgttttgcgtgggccctcttccttgtacacttctgctgacactaggctacgtgctgtatgcctccgctatgacactgctgacagaacgcggtaaactgcaccaaccttag

SEQ ID NO: 54509 - DNA, 1848 bp, Artificial Sequence
  Description of Artificial Sequence: Synthetic coding sequence
atgaccaccttcggcgctgtcgccgaatggcgtctaccctcactaaggagagcaaccctctggataccacagtggtttgctaaaaaggctatttttaattcacctctggaagccgcaatggctttcccccatctacaacagcctagtttcctgcttgcttccctgaaggcagattccattaataagccttttgctcagcaatgtcaggacctggtaaaagttatagaagacttcccagccaaggtattcgtcgaaatgtggctacaccactattctcttgagatgtaccagaagatgcagtctccccacgcaaaagagagctttaccccaacagaggaacacgtactcgttgtccgccttctgttgaaacatctccatgcgtttgctaactcactcaagcctgagcaggctagcccttcagcccacagccatgcgacatcccctttggaggagtttaagcgggctgccgtacctcgatttgtccaacagaagctgtacctgttcctccaacactgtttcggtcattggccattggacgcttcctttcgcgctgtgctggaaatgtggctttcttacctacagccatggcgctacgcaccggataagcaggctcccggatctgattcgcagccacgatgtgtgagcgagaaatgggccccttttgtccaggaaaacctgctgatgtacaccaagctgttcgtcggttttctaaacagggctctcaggacagatctggtcagccctaagcacgccctgatggtatttcgtgtggcaaaggtttttgcacagccgaatctcgctgagatgattcagaagggggaacaattgtttctggagcctgaactggtcataccacaccgccagcatcgcctcttcaccgcccctacctttaccggcagctttctctcgccttggcctcctgcggtaaccgacgcttctttcaaggtgaagtcccatgtttatagtctggaagggcaggactgtaaatatacccctatgttcggaccagaagcccgtacactggttctgcgcctggcccagcttataacccaggcgaaacacaccgctaagagcatttccgatcaatgtgcggagtcgccagctggtcattccttcttgagttggctcggattcagtagcatggacaccaatggctcgtacacagccaatgacctggatgagatgggacaggattcagtccgaaaaaccgacgagtacctggagaaagctctggagtacctcaggcaaatcttcaggttgtccgaagcgcaactgaggcagtttaccctggctttggggaccacccaggacgagaatgggaaaaaacagctgcctgattgcatcgtcggcgaggacggactgatcttgactcccctgggcagatatcaaatcattaacggcttacgacgctttgaaatcgaataccagggcgatccagagctccagcctattagaagctatgaaatagcatctcttgtgcgcaccctgtttcggctcagttcagccataaaccacaggtttgctgggcaaatggccgctctgtgttctagggacgatttcttaggctcattctgccgctaccacttgactgaacctggacttgccagcagacacctgctgagcccagtcgggaggcgacaggtagccggacatacccggggacccagactatccctccgcttccttggaagctacaggaccctggtctccctgctgttggcattcttcgtggcgtcgttattttgcgtgggccctctgccttgcacactcttactgaccctgggttatgtgctctacgcttctgcaatgacactcctcactgaacggggaaagcttcaccagccctag

SEQ ID NO: 54510 - DNA, 609 bp, Artificial Sequence
  Description of Artificial Sequence: Synthetic coding sequence
atactggaggtttactctactaaggccaagaattatgtcaatggacattgcacaaagtacgagccatggcaactgatcgcgtggagtgttgtgtggacattactgatcgtttggggttatgaattcgtgtttcaaccggaaagcctttggtccagatttaagaagaaatgttttaaactgactcgcaaaatgccaataatcggccgaaagattcaggacaaactcaacaaaaccaaggacgatatctccaagaacatgagcttccttaaggtggacaaagaatacgtcaaggctctgccatctcaaggcctgtcttcttcagcagttttagagaagcttaaggagtactcatcgatggacgccttttggcaggagggtcgcgctagcggcactgtgtattctggggaggagaaactgactgagctgctcgttaaggcctacggggacttcgcatggtctaaccctcttcacccagacattttccctggtctgcggaagatcgaggcagagattgtccgcattgcctgcagtctttttaacggtgggcctgattcgtgtggatgtgaagcactttttctgttctgtttttcaaatatgctagctccctag

SEQ ID NO: 54511 - DNA, 1707 bp, Artificial Sequence
  Description of Artificial Sequence: Synthetic coding sequence
atgccttctacggaccttctcatgctgaaggctttcgagccatatctggagattcttgaagtgtactccacgaaagccaagaactatgtcaacggtcactgtaccaagtatgagccttggcaattgattgcctggagcgtggtgtggaccctcttaatcgtgtggggatatgaatttgtgtttcagccagaatctctgtggagtcgctttaaaaaaaagtgctttaagttgacacgaaagatgccaataatcggacggaagatacaggacaaacttaataaaacaaaagacgacatttcaaagaatatgagctttctgaaggtcgataaagagtacgtcaaggccctgccctctcagggcttatcctcctctgctgttctggagaaacttaaggagtacagcagcatggatgcattctggcaggaaggccgtgcctccgggactgtctactccggagaggagaaactaacagaactccttgtcaaagcttacggagacttcgcctggtctaatcccctgcacccggatatcttccctgggctcaggaaaatcgaagccgagattgtacgcattgcttgcagcttgtttaatggcggacctgattcttgcggatgcgtcacatctgggggaactgagagcatcctgatggcatgcaaggcctaccgtgacctagcttttgagaaggggattaaaacccccgagatagttgctccccagtcagcccatgcggcattcaataaggccgcaagctactttggcatgaagattgtgcgtgtaccccttactaagatgatggaagtcgatgtgcgggcaatgcgtagagccatatccagaaacacagccatgctcgtgtgtagcacgccacagttccctcatggggtgatcgatccggtgcccgaggtcgcgaagcttgccgtgaaatataagatcccactacatgtggatgcttgtctcgggggattcctgattgtgttcatggagaaggccggataccccctcgagcacccgttcgattttcgggtgaagggagtgacctctatctctgccgacacgcataagtacgggtatgctcctaagggatcctctctagtcctgtattccgacaagaagtaccgtaactaccagtttttcgtagacacggattggcaaggcggtatttacgccagtcctacgatagctggatcccgacctggtggtatctccgcagcttgttgggcggcattgatgcactttggcgagaatggttatgtcgaagcaactaagcagattatcaaaactgcccgattcttgaagtcagagctggagaacatcaaaggtatcttcgtgtttggcaacccacagctatcagtgatcgctttggggtcaagagatttcgatatctaccggctcagtaacctgatgactgctaaaggttggaacctgaatcagctacagtttcctccctctattcatttctgcattacactccttcatgcgaggaaaagagtcgcaatacagtttctgaaggacattagagagagtgttacccagattatgaagaacccaaaggccaagacgactggtatgggcgcaatttatgggatggcacagactacagttgaccgcaacatggtggcggaactttcatctgtttttctagacagcctgtatagcacagataccgtcactcagggctctcagatgaacggttcgcctaagccccattag

SEQ ID NO: 54512 - DNA, 408 bp, Artificial Sequence
  Description of Artificial Sequence: Synthetic coding sequence
tagattcaggataagctgaataagacaaaggacgatattagtaaaaatatgagctttctcaaagtcgataaagaatatgtgaaggctcttccatcccagggactctccagctccgccgtgctggaaaagctgaaggagtacagcagcatggacgcattctggcaggagggcagggcatcagggacagtttatagcggggaagaaaagctgacagaactgcttgtcaaagcgtatggcgacttcgcctggtccaaccccctgcaccctgatatctttcccggtctgcggaagatcgaagccgagatcgtccgcatagcctgttcactcttcaacgggggtcctgactcttgtgggtgtgtttcaatttgcaagggccatcctattgccctgtttttcagactgaaatag

SEQ ID NO: 54513 - DNA, 1638 bp, Artificial Sequence
  Description of Artificial Sequence: Synthetic coding sequence
atggaaactgagttatgtgccgctcatctaccgacagagagcgatgccccaaaccattaccaagcagtgtgtcgggctttattcgccgaaactatggagctgcatacttttttgaccaagatcaagagcgccaaggagaacctgaaaaaaattcaggaaatggagaagagtgacgaatctagtactgacctcgaagagctcaagaacgccgattgggccagattttgggtacaagttatgcgcgatcttagaaatggggtaaagctgaagaaggtccaggaaaggcaatacaaccccttgcccatagagtatcagctcacaccctacgaaatgcttatggacgatattcgttgtaaaaggtacacgctacggaaagtcatggtcaacggcgatatcccacctcggctgaagaagagcgctcacgagatcattttggacttcattcggagcagaccccctctgaatcccgtgtcagcgaggaagctgaagcccaccccgccaaggccacgctcgctgcacgagcgaattttggaggagatcaaagctgagagaaaactccgcccagtgagccccgaggagatccgcagatctagattagacgtgacgacaccagagtctactaagaatctggtcgaaagtagtatggtaaacggcggtttgaccagtcagaccaaagaaaacggactctcgactagccagcaggtccccgctcagcgtaagaagcttttgagagcacccaccctggctgagctggattcttcagaaagcgaagaagaaactctccacaagtctacgagttcctcttccgtgagcccctccttcccggaggagcctgtgcttgaggccgtaagcacccggaaaaaacccccaaaattcctacctatctccagtacgccgcagcctgaacgtaggcagcctcctcagcgccgacactctattgaaaaggagaccccaaccaatgtcagacagtttttgcccccttctcgacagtcttcccgcagtctagaagagttctgttatccagtggaatgcctggctctgacagttgaagaggtgatgcacatcaggcaggtgttggtaaaagccgagctcgagaaatatcagcaatataaagatatctacacagccttgaagaaagggaaactgtgtttctgctgccggactaggcgcttcagtttctttacatggtcctatacatgccagttctgtaaacggcctgtgtgttcacagtgctgtaagaagatgcgcttgccttccaagccttattccacacttcctattttttctctcgggccatcggcgctgcaaaggggcgaatcctctatgcgctcagaaaaaccgtcaaccgcgcatcacaggccactaagatctattgccagattcagcagcaagagcaaaagtatggataagagcgacgaggagctccagtttccgaaggaactgatggaggactggtcaactatggaggtttgtgttgattgcaagaagttcataagtgagatcattagtagttcaagacggtccttagtgctggcaaataagagggccaggctgaagcggaaaacccagtctttctatatgagttcccccggtccgagcgagtattgtcctagtgagagaaccatcagcgaaatttag

SEQ ID NO: 54514 - DNA, 1377 bp, Artificial Sequence
  Description of Artificial Sequence: Synthetic coding sequence
atggccaacaccgtggaagccgatgggtctaacgacgaaggctacgaagctgctgaagagggcttgggtgacgaggatgaaaaaagaaagatttcggctattagatcatatcgtgatgtaatgaagctttgtgccgctcatctgcccacagagagcgatgcccctaaccattaccaggcggtatgtcgagcgctgttcgccgagactatggagctgcatactttcttgaccaaaattaaaagtgccaaggagaacctgaaaaaaattcaggagatggaaaagagtgatgagtcttccactgatctggaagagttgaaaaatgcagactgggcaagattttgggtccaagtgatgagggatttgcgaaacggcgtgaaactgaaaaaagttcaggaaaggcagtacaatcctctccccattgagtaccagctgaccccttacgaaatgcttatggacgatatacggtgcaagcgctatactctgagaaaagtgatggtcaacggcgatatccctcctagattaaagaaatccgctcacgaaatcattctggattttattcgctcgcggcctcccctgaatccagtgagtgcgaggaaactcaaacctaccccacctcgaccgcgatctttgcacgagaggattctcgaagaaattaaagctgaacggaaacttcggcctgttagccctgaagaaatccgtcggtcacggttggatgttaccacacctgaaagtaccaaaaacctcgtcgagtcaagcatggtgaatgggggtcttacaagccagacgaaagaaaacggattaagcacatctcaacaagtgcccgcacagagaaaaaaactgttaagggctccaacactggcagaactcgatagttccgaatcagaggaggagactctgcacaagagtacaagctccagcagtgtcagcccatcttttcccgaagagcctgtcctggaggctgtcagcactcggaaaaagcctccaaaattccttcccatcagtagtactccacagcctgaaaggcggcaaccacctcagcgacgccactctatagagaaggaaactcctactaacgtgaggcagttcctccccccatctaggcagtcatctcgttccctggaggaattttgctacccggtcgagtgccttgcactgaccgtggaagaggtgatgcatatcaggcaggtgttagtcaaggctgagctcgaaaaatatcaacagtataaagatatttacactgctctcaaaaagggaaagctctgcttttgctgtcggactcgaagattttcattttttacatggtcctacacatgtcagttctgtaaaagcgactgtctgtttaatggaactgctcattgtcagttttatctagggtag

SEQ ID NO: 54515 - DNA, 2271 bp, Artificial Sequence
  Description of Artificial Sequence: Synthetic coding sequence
atggcacaagcagctggaccagcgggtgggggagaaccacgcacagaggctgtgggaggcgaaggcccaagagagccgggagccgcagggggagcagccggtggctctagagacgcactcagcctcgaagaaatactccggctgtataatcagccaattaacgaggaacaggcctgggcagtctgctatcagtgctgcgggtccctgagggctgcggctaggcgccgtcagcccagacatagagttcggagcgcagcccagatccgcgtttggagagacggcgcagtgacactggcccctgcagcggacgacgcaggagaaccacccccagtcgcgggtaaactcggttactcacaatgcatggaaactgaggtaattgaatccctgggtataattatctataaagcacttgactacggtcttaaggagaatgaagagagggagctgagcccgcctctggagcaactgattgatcacatggctaatacagtagaggctgacggttccaacgatgaaggctacgaagccgctgaggaaggtctcggggacgaggatgagaagagaaagattagcgctattcggagctaccgcgatgtgatgaagctgtgtgccgcacacttacctaccgaatctgatgctccaaatcactatcaggcggtgtgtcgggcattgttcgccgagactatggagttacatacctttctgacaaaaatcaagtctgcaaaagaaaatttaaagaaaattcaggagatggagaaaagcgacgaaagttcgaccgacctggaagagctgaaaaacgccgattgggccagattctgggtccaggtcatgcgcgatctgagaaacggggtcaagctgaaaaaggtgcaggagcgccagtataaccctctgccaatcgaataccaattaaccccgtatgagatgttaatggacgacatccggtgcaagagatacactctgcggaaagtcatggtgaatggcgatataccaccacgactgaagaaaagcgcgcatgagataatactggattttataaggagccgtcctccactcaaccccgtgagcgcaagaaaactcaagcccacacccccacgtcctcgttccctccatgaacgcatcctcgaggaaatcaaggcagagcggaagctgagacctgtgtctcctgaggagatacggagaagcagattggcaatgaggcctctttccatgagttacagcttcgacctgtctgacgttaccacccccgagtccaccaaaaacctggtcgaatcaagtatggtgaacggcggactgactagccagacgaaagaaaatggcttgtctactagtcagcaggtgcctgcccagcggaaaaaacttctgcgtgcccctacgctggccgaactcgactcctccgaatctgaagaggaaaccctccataagtctaccagctcctcgagcgtcagtccaagctttcctgaggaacctgtattagaggctgttagcactaggaaaaagccgccaaagtttctgccaatttcttccacaccccagcctgagcggagacagccaccacagcgaagacatagtatagagaaggagactcctacaaacgtgagacagtttttgcctccgtctcggcagtcatctaggagccttgaagaattttgttatcccgtagaatgcctggcgttaacagtagaagaggtaatgcacattaggcaggttcttgtcaaagctgagctcgagaagtaccagcaatacaaggatatttacactgctctcaagaaggggaagctgtgcttctgctgcagaactagacggttttccttctttacgtggtcttatacctgccagttctgtaaacggcctgtttgcagtcagtgttgtaagaaaatgcgactgccctcaaaaccttacagcaccctgcccatcttctccttgggaccctccgctttacagcgcggtgagagcagcatgcggtctgagaagccatctaccgctcatcaccgcccactccggagcatagcacgatttagcagtaagtccaagagtatggataagagtgacgaagaacttcagttccctaaggaactcatggaggattggagcacaatggaagtttgcgtggattgcaagaagttcatcagtgaaattatcagttccagccggaggtcgttggtgctagccaacaaaagagcccgtttaaaacgcaaaacccagtctttttacatgagtagcccaggcccttccgaatattgtccgtccgagaggacgatttccgaaatctag

SEQ ID NO: 54516 - DNA, 2229 bp, Artificial Sequence
  Description of Artificial Sequence: Synthetic coding sequence
atggcgcaggccgcagggcctgccggaggtggtgagcccaggaccgaggccgtgggaggtgaagggcctcgcgagcccggagcagccggtggcgctgcaggaggctcccgagacgcgttatcgctagaggagattctgaggctgtacaaccagccgattaatgaggagcaggcttgggcagtgtgttatcagtgctgtggatctctacgcgcagccgcacgccgaaggcagcctaggcaccgggttcgaagtgctgcacagatcagagtttggagagatggagcagttactcttgcgccagccgcagatgatgccggagaaccgccacccgttgctgggaaacttggctattcccaatgcatggagactgaggtgatcgaatccctgggcatcattatttacaaagccctcgattatggattgaaggaaaacgaagagagggagctttcacctccgttggaacagcttattgaccatatggcaaatacagtcgaagccgatgggagcaatgatgaaggatatgaggcagcggaggaaggcttgggagatgaggacgagaagcgaaaaatatccgccattcgctcatatagggatgtcatgaaactctgcgcggctcatttacccaccgagtctgacgcccctaaccactaccaggcagtttgtcgcgctttgtttgcagagaccatggagcttcacacctttcttactaagatcaaatccgctaaggaaaacttgaagaagatccaagaaatggaaaaaagcgatgagtccagcacggatctcgaggaactaaaaaatgcagactgggctcggttctgggtgcaagtgatgcgcgacctgagaaacggggtgaagttaaaaaaggttcaggagcgacagtacaatccactaccaatcgaataccaattgactccgtacgagatgctgatggatgacatcaggtgtaagaggtatacattgcgcaaagtgatggtgaacggggacattcctccaagactgaagaagtctgcccacgaaatcatcctggactttatccgttctcgccctcctctgaacccagtgtccgctagaaaactcaagccaacaccacctcggccacggagtctgcacgagcggattttagaagagattaaggcagaaaggaaacttcgacccgtgtccccagaggagatccgcaggagcagactggatgttaccacacccgagtccacgaagaatttagtggagtcctcaatggtcaatggtgggctgacctctcagactaaggagaacggtctgtcaacatctcagcaagtcccggcacagcggaagaagcttctccgcgcaccaactctggccgagttagattcctctgaatcggaagaggagacactgcacaagagtacatccagtagttctgtttccccctccttccctgaggaacctgtgctggaggccgttagcacacgaaagaagcctcctaaatttctgcctatttcaagcaccccacagcccgagcgacgacagccccctcagcgcagacacagcatagagaaggaaacacccactaatgtaaggcagttcctgccacctagtcgccagagcagccggagcctcgaggaattctgctaccccgtggaatgcctcgcgctgaccgttgaagaggtaatgcatattaggcaggtcctggtcaaagctgaactcgagaaataccagcagtataaagatatttataccgctcttaaaaaggggaagctttgcttctgctgcaggacaaggagattttctttctttacttggtcctacacttgccagttttgcaaaagacccgtgtgctcacaatgctgcaagaaaatgcggttgccaagcaagccctactctactctacccatcttttccctgggaccaagcgcactgcagagaggcgagtctagcatgcggtcagagaagccctctactgcccaccatagacctctcagatccatagcgagattttccagtaagagcaagagtatggacaaaagcgacgaggagctccaattcccaaaggagctgatggaggattggagcactatggaggtctgtgtggattgcaagaagtttatctccgaaattatctctagcagcaggaggagtctagtcctggcaaacaaaagagctagactgaaacgcaagacgcagagcttctatatgtcttccccaggtcctagcgagtattgtccatctgagcgaacaatcagcgaaatctag

SEQ ID NO: 54517 - DNA, 1869 bp, Artificial Sequence
  Description of Artificial Sequence: Synthetic coding sequence
atggaaaccgaagtcattgaaagtctgggcataattatctataaggctcttgactatggtctcaaggaaaatgaggagagagagctgagtccaccactggaacagctgatagatcacatggcgaatactgtggaggctgacggcagtaatgacgagggttatgaagcagcggaggagggccttggtgatgaggacgagaagaggaaaatttcggccatacggtcttacagagacgtcatgaagctgtgtgcggcacatcttccaactgagagcgatgcacccaatcactatcaagcagtatgcagagccctcttcgccgaaacaatggagctgcacactttcctcactaaaatcaagtctgccaaggagaacctgaagaagattcaggagatggagaaaagcgatgagagcagcactgatttggaagaactgaagaacgctgactgggcccgattctgggtccaggtgatgagagacctgcgcaacggcgtgaaactgaaaaaggtgcaagaaagacagtataaccctttacccatcgaataccaactgacaccgtacgaaatgctgatggatgatattagatgcaagcgatacacactcaggaaggttatggtgaacggtgatatccctcccaggctcaagaagtccgcgcacgaaatcattctggacttcatcagatccagaccccctctcaaccccgttagtgccagaaagcttaagcccacacccccacgtccaagaagtctgcatgagaggatactagaagagatcaaagcggagcgcaaactgcgtcccgtatctcccgaagaaatccgcagatctcggttggacgtcactacccctgagtctacgaagaacctcgtggaatcatccatggtcaacggtggactgacgagccagaccaaggaaaacggtttgagcacaagccagcaagtccccgctcagagaaagaagctgctgagggcgcctacactggctgagctggatagtagcgaatcagaagaggagacccttcacaagagtactagctcctccagcgtatccccttctttcccagaggaacctgtgctggaggccgtttcaactagaaagaagccccctaaatttttgcctatctcatccacacctcagccagagcgcaggcagcccccacagaggcggcattcaatcgagaaagaaactcccacaaatgtccgacaatttctccccccaagtcgccaaagctcccgttccctggaagaattctgctatcctgtggagtgcttagcattgactgtcgaggaagtgatgcatattcggcaggtgcttgtgaaagccgagctggagaaataccagcagtacaaggatatttacactgcactgaagaaggggaagctgtgcttctgttgtagaaccaggcgcttcagtttcttcacctggagctatacttgtcaattttgcaaacggcctgtgtgctctcagtgctgtaagaagatgcgcctacccagcaagccctattcaactctaccaattttctcacttgggcctagcgcactgcagcgcggagaaagtagtatgagaagcgagaaaccaagtaccgctcaccaccgcccattgcgatccatagcacgcttctcttctaagtcgaaatccatggataaatctgacgaagaactgcagtttcccaaggaactgatggaagattggtccacgatggaagtctgcgtggattgtaaaaagtttataagcgaaatcatttccagcagccgtcgatcactagtgttagccaacaaacgcgcaagactcaaaagaaagactcagtctttttatatgtcatccccaggaccctcagaatactgcccaagtgaacgcaccattagcgaaatatag

SEQ ID NO: 54518 - DNA, 624 bp, Artificial Sequence
  Description of Artificial Sequence: Synthetic coding sequence
atggccctcctgttcgcgagaagtctccggctctgccgttggggagcgaagcgtctgggagtggctagcactgaggcccagagaggtgttagctttaagttagaggaaaaaaccgctcactcttctctggcgctgttccgtgacgacatgggggtgaagtacggcctggttgggttggagcctaccaaagttgccctcaatgtggagcgattccgggaatgggctgtggtgttagcagacaccgcggttacttccggtcgacattattgggaagtgacggtaaaacgatctcagcagttccggatcggggtcgctgatgtcgacatgtctcgagattcttgcattggcgtagacgaccgaagctgggtgtttacgtatgcacagaggaaatggtataccatgttagccaatgaaaaggcaccggtggagggaatcggacagcctgagaaggtggggcttcttctggagtacgaagcccagaagctgagtctcgtcgatgtgtcacaggtgagcgtcgtacacacactccagaccgattttagaggtcctgtggtccccgcttttgcactttgggacggcgaattactaacccactcaggactcgaagtgccagaggggctctag

SEQ ID NO: 54519 - DNA, 390 bp, Artificial Sequence
  Description of Artificial Sequence: Synthetic coding sequence
atgtggtcagcatctgggtcaggccgacactactgggaagtgaccgttaagcggtcacagcaattcagaatcggcgtggccgacgtagacatgagccgcgactcctgcatcggcgtcgacgatcggtcctgggtgtttacctacgcccagcgtaaatggtacacaatgctggctaatgagaaggcaccagtggagggcattggacaaccagaaaaagttggcctgttgctcgagtacgaggcccagaagttgtctttggtggacgtttctcaagttagcgtggtccacaccctgcaaaccgactttcgcggtccagtggtacctgccttcgcgttgtgggatggcgaactgctgacacacagcggcctggaggttccagaaggcctctag

SEQ ID NO: 54520 - DNA, 1257 bp, Artificial Sequence
  Description of Artificial Sequence: Synthetic coding sequence
atgcgcaccaaggcggcaggctgtgctgagcggcgacctctccaaccgcgaactgaggcggcagctgcccctgccggtcgtgcgatgccctcagagtatacttatgtgaaactgaggtccgactgtagcaggccctcacttcagtggtatactcgagcgcagagcaagatgcgccgtccatcccttctgctgaaggatatccttaaatgcaccttactggtgttcggggtctggatcctctacatactcaaactcaattacacaaccgaagagtgtgacatgaaaaagatgcattatgttgaccctgatcatgtgaagagagcccaaaaatacgcccagcaggtcctccaaaaggagtgtaggcctaagttcgcaaaaaccagcatggcacttctgttcgagcacaggtactcagtggaccttttaccgttcgtccagaaagcacctaaagactctgaagccgagagcaagtacgatccaccttttggattcaggaaattcagcagcaaagtgcagaccctgctggagttgctccctgagcacgacctgcccgaacatttgaaagccaagacttgccgcaggtgcgttgtgatcggtagcggtgggatactccatggtttagagttggggcatacactgaaccagtttgatgttgttatccggctcaatagcgcacccgtggagggatactccgaacatgttggaaacaagacaaccatcagaatgacctaccccgagggggcacctctgtccgacctggaatactacagcaacgacctctttgtagcggtactcttcaagagcgttgacttcaactggcttcaggccatggttaagaaggagaccctgccattttgggtgaggctcttcttctggaagcaggtggccgaaaagattcccttgcaacctaaacacttcagaattcttaaccctgtgattattaaggagacagcatttgacattctgcagtactccgagcctcagtcccgattctgggggcgtgacaagaacgttccaacaatcggagtgatcgcagtcgtcctggctacccatctgtgtgacgaagtcagtctcgccggtttcgggtatgatctgaatcaaccccgtacccctctgcattacttcgatagccaatgtatggctgcaatgaatttccaaacaatgcataatgtgacaactgaaactaaattcctactgaaattagttaaagaaggcgtggtaaaagacctgagtggcggtatcgacagggaattctag

SEQ ID NO: 54521 - DNA, 372 bp, Artificial Sequence
  Description of Artificial Sequence: Synthetic coding sequence
atgtatgaaattgctgccccaaacgtggctttcatgacgctgcggtccatgtgcaatactagcaagatggtcacatgtgcaaaaattttcttttactttttggttttcttttcactgagccagaatgtccccacaattggagtgattgccgtagtcctggcaacacatctgtgtgatgaggtttctctggcagggttcgggtatgacttgaaccagcctcggacccctctgcattattttgactcccaatgcatggcagcaatgaatttccagacaatgcacaacgtaacgaccgagacaaaatttctcctaaaattggtaaaggaaggggtagtcaaagacctcagcgggggaattgacagggagttctag

SEQ ID NO: 54522 - DNA, 1173 bp, Artificial Sequence
  Description of Artificial Sequence: Synthetic coding sequence
atgccctcagagtacacctatgtcaaactcagatcggattgctcccggccatctttgcagtggtatactagggcgcagtccaagatgagacgtccctcactgcttctgaaggatattttgaaatgcacactgcttgtctttggtgtatggatactgtatatactgaagttaaattatacgactgaggagtgtgatatgaagaaaatgcactacgtcgacccagatcatgtcaaacgggcacagaaatacgctcagcaagtcctccagaaagaatgcagaccaaagttcgccaaaactagcatggccttacttttcgagcatcgctactccgtcgatctcctgccttttgtgcaaaaagcgcctaaagactcagaagccgaatcaaagtacgaccccccatttgggttcaggaagtttagttcgaaagttcagacgctgctggagctcctgccagagcacgatctccctgagcacctgaaggccaaaacctgccgcagatgtgtagtgattggttcaggcggtattctccacggcttagagctcgggcacacactgaatcagttcgacgttgtgatccgtcttaacagtgctccagtggaagggtatagcgagcatgtgggtaataagaccactattcggatgacctaccccgagggcgcacccctttccgatctggaatattatagcaacgacttgttcgtggcagtgttgttcaagtctgtggacttcaattggttacaggctatggttaagaaggagactctccctttttgggttagactctttttttggaagcaggtggccgaaaaaattcccctgcagcccaaacactttcgaatcctgaatcccgtgattattaaggaaacagctttcgatatcctgcaatacagcgagccacagagccgcttttggggccgagataagaatgtgccaaccatcggagtgatcgcagtcgttctcgctacacatctctgtgacgaggtgagccttgccggattcggttacgaccttaaccagccaagaacgccactccactactttgatagtcagtgcatggctgcaatgaactttcagactatgcacaatgtcactactgagacgaagttcctgcttaagcttgtgaaggagggtgtggttaaggacttaagcggcggaattgatagggagttctag

SEQ ID NO: 54523 - DNA, 1188 bp, Artificial Sequence
  Description of Artificial Sequence: Synthetic coding sequence
atggctagcgtcccgatgcctagtgaatatacatatgtgaagcttaggtccgattgcagtcgcccatctcttcagtggtatacccgcgcacagagtaaaatgaggagaccctccctgctgttaaaggatatcctgaagtgcacattactggtgttcggcgtctggatcctctatatactgaagctcaactacaccacagaagaatgtgacatgaaaaagatgcattatgtggaccctgaccacgtgaagagggctcagaagtatgcgcaacaggtactccaaaaggagtgccggccaaagttcgccaagaccagtatggctctgctgtttgaacaccgctattcagttgacctgttgcctttcgttcagaaggcccctaaggacagtgaggcagaatctaagtacgacccacccttcgggtttcgaaagttcagtagcaaagtccagacattactcgagcttctgcccgagcatgatttgccggagcacctgaaggcaaaaacgtgcagacgctgcgttgtgattggatctggcggtatacttcacgggctagaactcgggcacacgctgaatcagtttgacgtggtgattcggctcaacagtgcacctgtggaaggttactctgagcacgtgggcaataagaccaccattcggatgacataccctgagggagcgccactctctgatctggagtattactcaaacgaccttttcgtcgctgtgctgtttaaaagcgtagattttaactggctccaggcaatggtcaagaaagagacactcccattctgggtaagactcttcttttggaagcaagttgccgaaaagatccctctgcagcctaagcactttaggatactgaacccagtgatcattaaggagactgcatttgatatcctccagtacagtgaaccacagagtcgtttctggggaagggacaagaatgtcccgacgattggggttatagccgtggtacttgctacccacttgtgtgacgaggtgagtttggcgggattcggctatgatctgaatcagccacgtacgcctctgcattatttcgattctcagtgcatggcggctatgaattttcagaccatgcacaatgtcacaactgaaacaaagttcctgctgaaattggtgaaagaaggagtggtgaaagacctcagtggcggtatagatagggagttctag

SEQ ID NO: 54524 - DNA, 420 bp, Artificial Sequence
  Description of Artificial Sequence: Synthetic coding sequence
atgcccagcgaatatacgtacgtcaagctacgctctgattgcagtcgccctagcttacagtggtatacccgagcacaatccaagatgcggcgaccctccctgcttctcaaagatattctgaagtgcactttgctggtcttcggcgtttggatcctctacatactcaaactgaattatacgaccgaggagtgcgatatgaaaaagatgcattatgtcgatccagatcatgtgaagagggcacagaagtacgctcagcaggtgctgcagaaagaatgccggcctaagttcgcgaagacttccatggctctgctttttgaacatcggtactctgtagatttgctgccgtttgtgcaaaaagcccctaaagatagcgaagcggaatcaaaatatgatcctcccttcgggtttcggaagttttag

SEQ ID NO: 54525 - DNA, 663 bp, Artificial Sequence
  Description of Artificial Sequence: Synthetic coding sequence
atgagaaccaaggccgctggctgcgctgagcggaggcctcttcagccaagaactgaagccgcagcagccccagcagggcgtgcgatgccttcagagtatacctacgtcaagttgcggtctgactgctcccgcccatccctgcagtggtacacgcgtgcccaaagtaagatgagacgaccaagccttctgctcaaggacattttgaagtgtaccctccttgtgttcggtgtgtggatactttacatcctgaagttgaactatacaaccgaggaatgtgatatgaagaagatgcactatgtggacccggatcacgttaagaccctcagcccatgcgggtggcactgcgtgcagctgatcatggccagatggactcagccattactccatcgcctactttccgactcagccgatcttcaccgagccttcaaaggctcccgagctcttcccgctgaggctttcagcgagccaaggcaccaacaccttcagacagagtcttttcttagtttggtgttactccccgcattccaggcctttctgggatatctaagagccccagagggggctgctttggccttaaggcatttcctactgtcatgcgagctgtgggcctcaagtggcggaggcagggaacagctgaaacagatgccagtgcaattgacttag

SEQ ID NO: 54526 - DNA, 1803 bp, Artificial Sequence
  Description of Artificial Sequence: Synthetic coding sequence
atgcgctcatgcctttggcggtgccggcacttgagccaaggagtgcagtggtctctactgctcgcagttctcgtgttttttctattcgccctgccttcattcattaaggaacctcagactaaaccctcccggcaccagaggaccgaaaacataaaggagcgctctctgcagagcctcgccaagccaaagtcccaggccccaacgcgcgcaagaaggactacaatttacgccgagcctgtgccagaaaataatgccctcaatactcagacacagccaaaggcccataccaccggcgaccgcggaaaagaggccaatcaggctccccctgaggagcaggataaagtgccccatacagctcagagagccgcttggaaaagccccgaaaaagagaaaacaatggtgaacacactctcccctcgtggccaagatgccggaatggcttccggacggaccgaagcacaaagctggaagtctcaggacaccaaaaccacacaagggaatggcggacagactaggaaacttactgcatctaggacggtctccgaaaaacatcaaggtaaagctgcaacgaccgcaaaaaccctgataccgaaatctcagcaccggatgctggcccctacaggagctgtatctacacggacccggcaaaagggagtcacaacagcggtgattccccctaaagaaaaaaaaccccaggccaccccccctccggctccctttcaatcccctaccactcagcggaaccaacgtctcaaggcagcaaatttcaaatctgagccgagatgggactttgaagaaaagtactcttttgaaatagggggactgcagactacgtgcccggattctgtgaagattaaggccagcaagagtctctggcttcagaagctgtttctgcctaaccttacactgtttctagatagtagacattttaaccaatctgagtgggacagactggaacacttcgcccctcctttcgggtttatggaactgaactacagcctggttcagaaagttgttacccggttcccccctgtcccccaacagcaactgctcttggccagcttaccagcaggcagtttgcggtgtattacatgcgctgtggtgggcaacggcggtatccttaacaactcccacatgggacaggagatagactcccacgattacgtcttccgcctgtcaggagccctgattaaagggtatgaacaggatgtaggcacacgaactagtttctatgggttcactgccttttcccttactcagagcctccttattttaggcaatcgcggattcaagaatgtgcctctgggtaaggatgtgagatacttgcacttcctggaaggcacccgtgattatgagtggctcgaggccctactcatgaatcagaccgtcatgtccaaaaatctattttggtttcggcatagaccacaagaagcattcagagaggctctgcatatggacagatacctactcctgcaccctgacttcctacgatatatgaaaaacaggttcctgagaagtaagacactcgacggtgcccattggcggatctatcggccaaccacgggcgctctgctcctcctgacagcactgcagttatgtgatcaggtgagtgcgtatggctttattactgaggggcatgagaggtttagtgaccactactacgacacaagctggaaaaggttaatcttttacattaatcatgattttaaacttgagcgcgaagtgtggaagagactccacgacgagggcataatacgtctgtaccaaaggccaggcccaggaactgccaaagccaaaaactag

SEQ ID NO: 54527 - DNA, 1416 bp, Artificial Sequence
  Description of Artificial Sequence: Synthetic coding sequence
atgaggtcatgtctgtggcgctgccgacatctctcccagggagtacagtggagcctgttgctcgcagtgctggttttctttcttttcgctctacccagcttcatcaaagaaccgcagaccaaaccatctagacaccagcgaacagagaacatcaaggagagatcccttcagagcctggcaaaacccaagagtcaggcccctacgcgtgccaggaggacaacaatctacgccgaacccgttcctgagaacaatgctctaaatacgcaaacacaacctaaagcgcataccactggcgatcgaggtaaggaagcgaaccaggcccctcctgaggaacaggacaaggttccacatactgcccaaagggcggcttggaagtcaccagagaaggagaagaccatggttaatacactatcaccgaggggccaagacgccggtatggcatcaggacgtacagaggcccaaagctggaaatcacaggatacaaagactacacaaggcaacggcggtcagacacgcaaactgaccgcctctagaaccgtgtcagagaagcaccagggtaaagctgccactactgcaaaaactttaatccccaaatcacaacaccggatgctggccccaaccggagctgtttcgactcggacgcgccagaagggggtcacgactgctgtgattccacccaaggagaaaaaaccacaggcaacaccaccgccagccccttttcagtcacctacgacacagagaaatcagcggctgaaagccgctaactttaagtcggagcccaggtgggatttcgaggagaagtattcttttgaaatcggaggtctccagactacatgccccgactccgtgaaaattaaggctagtaagtctctatggctgcaaaaactatttctgccaaacctgactttgtttcttgactccagacattttaaccagtccgagtgggaccggctggagcacttcgctcccccttttgggttcatggaattgaattacagcctagtgcagaaggtagttacccgcttcccaccggtaccgcagcagcagctgttgctcgctagcctcccagcagggtccctcaggtgtataacctgtgctgtggtgggaaatggagggattctcaacaattcgcacatggggcaggagattgattcccatgattacgtttttcggctgagtggagcccttattaaaggatacgagcaggacgtaggcacacgaacatccttctatggctttacagctttctcactgacgcaatcattgctcattctcggcaatcgaggcttcaagaacgtgcccctggggaaggcgcagactcccggttccttctccggctcccccgctcacggacaggtccccgtggcagctccacgtctgagcccaattcacgaagagcaagtgagtgaagtatag

SEQ ID NO: 54528 - DNA, 2238 bp, Artificial Sequence
  Description of Artificial Sequence: Synthetic coding sequence
atgggcgttccttttttctcttccctgagatgcatggttgacttaggcccatgctgggcagggggtcttacagccgaaatgaagctactgctagccctggcaggtttgctggcaatcttagctactcctcagccttctgagggagccgcaccagcggtcctgggggaggtggatacctccttagtgctatcatcaatggaagaagctaagcaactcgtggataaagcctataaagagcggagggagagcattaagcagcgtctgcgcagtggatctgccagccctatggagctactaagctatttcaagcagcccgtcgcggcaactagaacagctgtacgcgctgccgactacttgcacgtagctttggatcttctagagcgtaaactccgcagtctgtggagaaggccattcaacgtgaccgacgtgctaactcctgcccaactgaacgttctgagtaagagcagcggctgcgcataccaggacgtgggggtcacctgccccgagcaggacaagtaccggaccattactggcatgtgcaataatcggcgttccccaacacttggagcctcaaaccgggcttttgtccgttggctccccgctgaatatgaggatggcttctcacttccttacggctggacccctggcgttaagcggaatgggtttcctgtagcattagcacgcgcagtttcaaatgaaatagtcagattccctacagaccagttgacgccagatcaagagcgatcattaatgtttatgcaatggggtcaattactggatcatgacctagactttacacccgagccagctgcccgagcttctttcgtcacgggcgtgaattgtgaaacttcgtgcgttcaacagcccccatgctttcctctcaaaatccccccaaatgatcctcgcatcaaaaaccaggctgattgcatccccttctttcggtcatgcccagcctgtcccggatcaaatattactatccgcaaccaaatcaatgctctgacctctttcgtagacgcgtcaatggtatacgggagcgaggaacctctggcccgaaatttgcggaacatgagcaaccaactgggattactcgcagtgaaccagcgatttcaggacaatgggagggccctgctgccattcgataacctgcacgatgatccgtgcctcctgacaaacagaagcgctcggatcccttgctttctcgcaggcgacacccgctcttccgagatgcctgagctaacctccatgcacacacttctgctccgagagcataataggctggccaccgagttgaaaagcctgaatcctaggtgggacggggagcggctgtaccaggaggctcgaaagatcgtgggcgctatggtccagattatcacctatagggactacctgccacttgtacttgggcctacggccatgcggaaatatctgccgacctacagaagctacaatgacagtgttgaccctagaatcgctaacgtgttcaccaacgcctttcgttacgggcatactttgatccagccctttatgttccgccttgacaaccgttaccaaccaatggaacctaatccacgtgttccactgagccgggtgtttttcgcttcttggcgggtggtgttggaggggggtattgaccctatcctccgagggctcatggcaacacccgctaagttaaatcgccagaatcagattgcagtggatgagatccgcgaaagacttttcgagcaggtgatgaggatcggccttgacctgccagcacttaacatgcagaggtcaagagaccacggattgcccggttacaacgcctggagacgcttttgcggtctaccccagcccgagacagtaggtcagctgggcaccgtgctgagaaatctgaagctcgcccgaaagctaatggaacagtatgggacccccaacaatattgacatctggatgggtggtgtctcagagcccctgaagcgcaagggcagggtaggtccactcctggcttgcattatcggtacccagttcaggaaacttagggacggtgatagattttggtgggaaaatgagggcgtgttcagcatgcagcaaagacaggctttggctcaaatcagcctccctcggatcatctgtgataacacaggaattactacagtatccaagaataacatctttatgtctaactcctaccccagggatttcgtcaattgcagtacactacctgctctcaacctcgcatcatggagagaggcctcttag

SEQ ID NO: 54529 - DNA, 918 bp, Artificial Sequence
  Description of Artificial Sequence: Synthetic coding sequence
atggcatgcatcttaaaacggaaaagtgtcatcgccgtcagtttcatcgctgcgttcttattccttttggtggtgcgcctggttaatgaggttaattttccgttattgctcaactgttttgggcagcccggaactaagtggatacctttctcttacacttatcgaaggcccctgcgcacccactacggatacattaatgtgaagactcaggaacctttacaactggactgtgacctgtgcgccatcgtttccaattccgggcaaatggtgggccagaaggtggggaatgaaatagataggtctagttgcatctggcgcatgaacaatgctccaactaagggatacgaagaagatgtggggagaatgacaatgatacgcgtcgttagccacactagtgtgcccctgctgctgaagaaccccgactatttcttcaaggaggccaacactactatatacgtgatttggggcccatttcggaacatgcgcaaggacggtaatggtatcgtctacaacatgctcaagaagacagtgggtatttatccgaatgcacaaatctacgtcaccaccgaaaaacgaatgtcctactgcgacggcgtgtttaagaaggagacagggaaggatcgtgtgcagagtggcagttacttgtcgaccggttggttcacattccttctggcgatggacgcttgttacgggattcacgtgtacgggatgatcaacgacacatattgcaaaacagagggctacagaaaggtcccttaccactattacgaacagggaagggatgagtgcgacgaatactttctgcacgaacatgccccatatgggggtcacagatttattactgagaagaaagtgtttgcgaaatgggcgaagaaacacaggatcattttcacacacccaaattggacgctgagttag

SEQ ID NO: 54530 - DNA, 915 bp, Artificial Sequence
  Description of Artificial Sequence: Synthetic coding sequence
gtgtgcataagaaagcgtaaaagtgtaatagctgtgtcattcattgcagcattcctatttctattagtcgttcggctagttaacgaggtgaactttcccctactcctgaactgttttgggcaacccggaaccaagtggattccgttctcatatacctatcggaggccactgcggacgcactatgggtacattaacgtgaagactcaggaacccctgcagctggactgtgatctatgcgccatcgtgtcaaactccggccagatggtgggacagaaagtgggaaatgagattgacagatcttcctgcatttggagaatgaacaacgctcccaccaaaggctatgaagaggacgtaggacgcatgaccatgatacgggtcgtgtcccatacctcagtgcctctgctgttgaagaatcccgattatttctttaaggaagccaataccacaatttacgtgatttgggggccatttcggaacatgcgcaaagacggcaatggtattgtttacaacatgctaaaaaaaacagtcgggatctaccctaacgcccagatttacgtgacaaccgaaaaacggatgtcctactgtgatggagtgttcaagaaagaaacgggtaaggacagggtgcagtccggatcatacctttccactggttggttcacctttctgctggccatggatgcatgttacggtattcacgtgtatggcatgattaacgatacttactgcaaaactgaaggataccggaaggtcccttaccattactatgagcaggggcgagacgagtgtgacgagtattttctgcatgaacatgcaccatatggcggacataggtttatcactgaaaaaaaagtctttgccaagtgggctaagaagcatcgaattatttttacgcacccaaactggaccttaagttag

SEQ ID NO: 54531 - DNA, 633 bp, Artificial Sequence
  Description of Artificial Sequence: Synthetic coding sequence
atggcctgcattttaaaggtgactacatggatcgcagtgtccttcatagccgcttttctcttcctgctagtggtcagactggttaacgaggtgaatttcccacttctgcttaattgttttggccagccgggaaccaaatggatcccattcagttatacgtatcggagacctttgcggacacattacgggtatatcaacgtgaaaacacaggaaccccttcaactggattgcgacctttgtgccattgtctctaactctgggcagatggttggccagaaagtagggaacgagattgacagatcttcttgcatctggaggatgaacaatgctcctaccaagggttatgaggaggacgtcgggagaatgactatgatcagggtggtcagtcatacatccgtccccctgctgctcaagaacccagattatttttttaaggaggccaatacaaccatctacgtgatttggggaccattccggaatatgcgaaaagatggtaatggtattgtttacaacatgctcaagaagacagtgggcatctaccccaacgcccaaatttatgtgaccaccgagaagaggatgagttactgcgatggagtctttaaaaaagaaacgggcaaagactctacagaatag

SEQ ID NO: 54532 - DNA, 612 bp, Artificial Sequence
  Description of Artificial Sequence: Synthetic coding sequence
ttcagcatttttcagccactacagcttgactgcgacctgtgtgcgatagtctccaattcgggacagatggtcggtcaaaaggtgggcaacgagatcgatagatcttcctgcatctggagaatgaataatgcccctaccaaggggtacgaggaggacgtggggagaatgacgatgatccgggtggtgtcccacacaagcgtaccactcttactaaagaatccagactatttttttaaggaagccaacacgacaatatatgtcatttgggggcctttccgaaacatgcgcaaagatggaaatggcatcgtctacaacatgcttaaaaagaccgtgggcatctatccaaatgcccaaatctacgtgacaacggagaagcgtatgtcctactgtgatggtgtctttaagaaagagacggggaaggacagaaccgagggttaccgcaaagttccataccattattatgaacagggcagggacgaatgcgatgagtactttctgcatgaacacgccccatatggcggacataggtttataaccgagaagaaagtgttcgcgaagtgggctaaaaagcatcggattatcttcacccaccccaattggaccttatcatag

SEQ ID NO: 54533 - DNA, 909 bp, Artificial Sequence
  Description of Artificial Sequence: Synthetic coding sequence
atgaaggccccaggtcgtctggtgctgatcattctctgcagcgtggttttctccgcagtgtatatccttctgtgttgttgggcgggactaccactctgcctggccacttgcctggaccaccactttccaactggtagcaggccaacagtgcctgggccactgcacttcagcggatatagctcagtaccagacggtaagcctttagtccgggaaccatgtcggtcctgcgccgtggtgagttcttctggacagatgctcgggtcaggcttgggcgcagaaatcgactcagccgagtgtgtctttaggatgaatcaggctcctaccgtcggcttcgaggcagatgtcggacagcggtcaacactccgtgtggtcagccacacaagcgtgccgctgctgctgcggaattacagccactacttccaaaaggcacgagacaccctgtatatggtttggggacaagggaggcatatggatcgagtactgggcggacggacctaccgcacacttctacagctgacaagaatgtacccgggtctccaagtttatacattcaccgagcgcatgatggcctattgtgaccagatctttcaagacgaaaccggcaaaaacaggcgacaatccggatcttttcttagtacggggtggtttacaatgattctcgctcttgagctatgtgaagaaatcgtcgtttatggcatggtatcggactcttattgccgtgaaaaatcccacccctcagtgccataccattatttcgagaagggtagacttgatgagtgccaaatgtatcttgctcacgagcaggcccctcgaagcgcccaccgatttataaccgagaaggctgtcttctcccgctgggccaaaaagagacctattgtctttgcccacccgtcttggagaactgaatag

SEQ ID NO: 54534 - DNA, 657 bp, Artificial Sequence
  Description of Artificial Sequence: Synthetic coding sequence
atgctggggtcaggtctcggagccgagatcgattcagcggagtgcgtgtttcggatgaaccaggcccctaccgtgggctttgaggccgacgtgggacaacgaagcactctgcgagtcgtcagtcatacatcggtcccactactccttcgcaactattcgcactacttccagaaagctcgcgacacgctgtatatggtgtggggccaggggcgtcacatggatagagtcctcgggggaagaacgtacaggactctcctgcagctaacaagaatgtacccaggactgcaggtgtacacgttcaccgaaaggatgatggcctactgcgaccaaatttttcaggatgaaactggcaagaatagacgacaaagtggatcatttttaagtactggttggtttacaatgattttagctcttgaactgtgtgaagaaatcgtagtgtacggtatggttagtgatagttattgcagggaaaagagccatccctctgttccctatcactattttgagaaggggcgacttgatgaatgtcaaatgtacttggctcacgaacaagcgcctagatctgctcatcggtttattacagagaaggccgtatttagcaggtgggccaaaaaaaggccaattgtattcgctcaccctagttggcgcacagagtag

SEQ ID NO: 54535 - DNA, 606 bp, Artificial Sequence
  Description of Artificial Sequence: Synthetic coding sequence
atgctgggttctggacttggcgctgaaatagactctgcagaatgcgtgttcagaatgaatcaggccccaacggtgggtttcgaagccgacgtgggccagcggtcaacccttagggtcgtgtcgcacacatctgtgcctctgcttctcaggaattacagtcactacttccagaaggcccgagatacgctgtacatggtatggggccaaggaaggcatatggatagggtgttaggcggaagaacttaccggacactgctccagttgacacgcatgtaccctggcctccaggtgtacacctttaccgaacggatgatggcctactgcgaccagatcttccaggatgagaccgggaaaaaccggagacagagtgggtcttttctgtccaccgggtggtttacgatgatcctggctctagaactatgcgaagaaattgttgtttatggcatggtgtctgattcctactgcagagaaaagagtcatccgagtgtcccctaccactattttgagaaagggagactggacgagtgccagatgtatctggcccatgagcaggctcctaggtctgctcatcgatttattaccgaaaaggccgtgttctcccgctag

SEQ ID NO: 54536 - DNA, 657 bp, Artificial Sequence
  Description of Artificial Sequence: Synthetic coding sequence
atgctgggctccggattaggcgctgaaatcgactcagcggagtgcgtcttccggatgaatcaggcacccacagttggattcgaagctgatgttggacagcggtctaccctgagagttgtgtcgcatacctccgtccctctcctgcttcggaactactcgcactacttccagaaagctagggacacattgtatatggtttgggggcaggggaggcacatggacagggtgctgggcggtaggacttacagaacacttctccagcttacccgtatgtatccagggttacaggtgtacaccttcaccgaacgcatgatggcttattgtgaccagatcttccaggatgaaacgggcaagaatcggcgtcaaagtggctccttcctatccaccggatggttcactatgattctagctctcgaactgtgtgaggagatagttgtgtatggaatggtttctgactcttactgccgggagaagtcacatccttcagtcccatatcattattttgaaaagggacggctggatgagtgccaaatgtatctcgctcatgaacaggcccctagatctgcccatcgcttcatcaccgagaaggccgtcttctcccgttgggcaaaaaaaagaccgattgtgttcgcgcacccttcttggaggacagagtag

SEQ ID NO: 54537 - DNA, 1002 bp, Artificial Sequence
  Description of Artificial Sequence: Synthetic coding sequence
atggcgtgctcgaggcccccatcacagtgcgagcccacctcgctccccccaggtccaccagccggacggagacacctgccactatcccgccgtcgtagggagatgagttcaaacaaggagcagcggtcggccgtattcgttattctcttcgccctgattacaatccttattttatactcttcaaattccgccaatgaggttttccactacggatccctgaggggacggagccgcaggcccgtgaatctgaagaagtggagcattacagacgggtatgtgcccatcttggggaacaagacattgccatccagatgccatcagtgcgttattgtatcatcatcatcgcacctactggggacgaaactgggaccagaaatcgagagggcagagtgtacaatccgcatgaacgacgctccaaccaccgggtactccgctgacgtggggaataaaaccacctatagagtagtggctcacagcagcgtgtttcgggttcttcgcagaccccaggagttcgtcaatcgcacaccagaaactgtctttattttttggggtcctccttcaaagatgcagaaaccccaagggtccttagtgcgagtcatacaacgcgctggactggtcttcccaaatatggaagcatatgcagtatcgcctggtaggatgagacagtttgacgatctgttcagaggagaaaccggtaaggatcgcgagaagtcccactcctggttatccacagggtggtttactatggtgatcgccgtggaattatgcgaccatgtccatgtgtacgggatggtgcctcctaattactgctcccagcgccctagactccaaagaatgccataccactattacgaacccaaggggccagacgagtgcgtaacttatatccaaaatgagcatagccgcaaaggaaatcatcaccgctttattaccgagaagcgggtgttttcatcttgggctcagctgtatggaattacatttagccacccctcatggacctag

SEQ ID NO: 54538 - DNA, 900 bp, Artificial Sequence
  Description of Artificial Sequence: Synthetic coding sequence
atgtcaagcaataaagaacagcgcagcgcggtattcgtgattcttttcgcgttgattaccattctgatactttatagctctaactctgctaacgaagtcttccactacggctccctccggggtcggtctcgaagaccagtgaacctcaagaagtggagcattacagacggctatgtccccatattgggtaacaaaaccctgccaagccgttgtcaccagtgtgtgatcgtgagctcctcatctcacctgctggggactaagttggggcctgaaattgagagagcagagtgcaccatccgaatgaatgacgccccaactactggctactcagcggatgttggtaacaaaacaacttaccgtgtggtggcacatagtagcgtgtttagggtgctgcggcgaccccaagaatttgtgaacagaacccctgaaactgttttcatattttggggcccaccttcaaaaatgcagaagccacaggggagtctggttcgcgtcatccagagggcgggacttgtgtttcccaacatggaagcatatgcagtatcgcccggtaggatgcgccaatttgacgatctctttcgaggcgaaaccggaaaagatagagagaagtcacattcgtggctgtccactggctggtttacaatggtcatcgcggtggaactctgcgaccatgtgcatgtgtatggaatggtccctccaaactattgctcacagaggccgcgactgcaacggatgccttatcattactatgaacccaagggccctgacgagtgtgttacttatatccagaatgagcattccaggaaaggcaaccaccaccgctttataaccgagaagcgagtgttttcatcgtgggcacaactgtacggtattacgttctcccatccgagctggacatag

SEQ ID NO: 54539 - DNA, 1125 bp, Artificial Sequence
  Description of Artificial Sequence: Synthetic coding sequence
atggcctgcagtcgtcctccgtctcagtgcgagcccacctctctacccccaggcccaccagccggacgaaggcacttacccctgtcccgtaggcggagagagatgagcagcaacaaggaacaacgcagtgccgtgtttgtcatactattcgcattgatcactatattgatcctgtactcttcaaactcggctaacgaggtctttcattacggttccctgcggggtagatcacgcaggcctgtgaatctgaaaaagtggagcattaccgatgggtacgtcccaattcttggtaataagacgctgccgtctcgatgccaccagtgcgtcatcgtttcctcatcttcacatctcctcggaacgaaactggggcctgagatcgagcgcgcagaatgcactatcaggatgaatgatgccccaacaaccgggtattccgcggacgtcggcaacaagacaacctatcgagtggtggcacactccagcgtgtttcgcgtcttgcgaagacctcaggagttcgtgaaccgaacccctgagaccgtctttatcttctggggccctccaagcaaaatgcagaaacctcagggcagtctggtgcgagtcatacagagagccggattggtgtttcccaatatggaagcatatgcggtcagccccggaagaatgcgtcagtttgacgacctcttcaggggagaaactggtaaggaccgagagaagagccattcctggctttccaccggatggttcactatggtgatagctgtagaactgtgtgatcacgtccatgtctacgggatggtccccccaaattactgtagtggcccagcttcctccgcttgtcccacaaccactactagccctcgcggacgaacaaatgtctcccccacttcgagaatgtctactgtggcccgtgctacgacaacagctagctccccacgcaagggatctagccacagagggccatcctgcatggcaagcccctcacctactccccctggtcctcgccctcccagcctttgggatttaagaagagtccgtggcgaagcagcatccgcacagcctctcggacaagggccatcaagcggtcagagcaggctggccggagtcagcccgtctcagagcggtccatag

SEQ ID NO: 54540 - DNA, 900 bp, Artificial Sequence
  Description of Artificial Sequence: Synthetic coding sequence
atgtctagtaacaaggagcaacgatcggccgtgttcgtgatcttgtttgcactgattaccatcctcattctgtattcatccaacagcgccaatgaagtgttccattacgggtccttacgcggaaggagccggaggccagtaaacctaaagaaatggagcatcactgacggctacgttcccattttgggtaataaaaccctgcctagtagatgccaccagtgcgtgattgtgagcagctctagccacctcctggggacaaagctcgggcctgagattgagcgggcagagtgcaccatacgaatgaacgatgcgccaacaaccggctatagtgccgacgtgggaaataagactacctatcgagttgtggcacattctagtgtcttccgggtactcagacgaccacaggaatttgttaacagaacacccgagacggtctttatcttctggggccctccaagcaagatgcaaaaaccccagggaagtctagtcagggtcattcagagggcaggactggttttcccgaatatggaggcctatgctgtatcacccggacgcatgcggcagttcgacgatctcttccggggagagaccggaaaagatagagaaaaatctcatagctggctctccacgggctggtttacgatggtgatcgcggtggagttatgtgaccatgttcacgtttacggaatggtgcctcctaattactgtagtcagcgaccgaggttacaacgaatgccgtaccattactatgaaccgaagggaccagatgaatgcgtgacctacatccagaacgaacatagccgcaaagggaaccaccatcggttcatcacagagaagagggtattttcgagctgggcccagctgtatggcataacattctctcacccctcgtggacgtag

SEQ ID NO: 54541 - DNA, 1002 bp, Artificial Sequence
  Description of Artificial Sequence: Synthetic coding sequence
atggcctgcagccggcctccttcacagtgcgaaccgacatccctcccccctggcccacctgcgggacggaggcacctcccgttatccagaagacgccgagagatgtctagtaataaggagcaaagatccgctgtctttgtgatcctctttgccctaattacgatcctcatcctgtactcgagcaatagtgctaacgaggtattccactacggctcattacggggaagaagtaggcgaccagtgaacttgaagaaatggagcatcacggatggatacgtgcccatcttaggtaataaaactttaccaagcaggtgtcaccagtgcgtgattgttagtagctcaagccacctgcttggcacgaaactcggcccagagatagaacgcgctgaatgcacaattcgtatgaatgatgcccctactaccgggtactctgccgacgtcgggaataagactacttaccgcgtagtcgcacatagcagtgttttcagggtgttgcgcaggcctcaggaattcgtgaatcggactcccgaaactgtcttcattttctgggggccacctagcaaaatgcagaaaccacaggggagcctcgtacgcgtgatccaacgtgccggactggtctttccgaatatggaagcttatgcggtgagcccaggtaggatgcgacaatttgatgacttgtttcggggagaaaccggtaaggacagggagaagtcccattcttggctttccactgggtggttcacgatggttatagccgtggaattgtgcgatcatgtgcatgtctatggaatggtgcctcccaactactgctcccagcggccaagactccaacggatgccctatcactactacgagcccaaaggtcccgatgagtgcgtcacctatatccagaacgagcactcacgcaagggaaatcatcatagattcatcacagaaaaaagggtcttcagtagctgggcccagctgtatggtattacatttagccacccaagctggacctag

SEQ ID NO: 54542 - DNA, 603 bp, Artificial Sequence
  Description of Artificial Sequence: Synthetic coding sequence
atgtcttccaacaaggagcagcgaagcgccgtctttgtgattctcttcgccctaatcactatactgatcctgtattcgagtaattcagctaatgaagtcttccactatgggtctctccgtggaagatcacgccgaccagtgaacttaaaaaaatggtccatcacagacggttatgtgcccattctcgggaacaaaactctcccctcgaggtgccaccaatgcgtcattgtcagttcaagctctcacttgctcggaaccaagcttgggccagagattgaaagggctgaatgtaccatccggatgaatgacgcacctactaccggttattcagccgacgtgggtaacaagaccacctatagggtggtcgcacattcttccgtcttcagggtgctccgacggccacaggagttcgtgaatcgaacccccgaaacggtgttcattttctggggaccccctagtaaaatgcagaagccacagggttccctagttagggtgatacagagggcaggactggtgttccccaatatggaagcttacgccgtgagtccaggacgaatgcggcagtttgatgacctgtttcgtggagaaacggggaaagactag

SEQ ID NO: 54543 - DNA, 402 bp, Artificial Sequence
  Description of Artificial Sequence: Synthetic coding sequence
atgaggagctctataaccgctccatgcggagccgtggccgcagacctctccacctcccgctccggagcttcgctgactgctatgtcaccgttttccgctacacgcgagaaatctcatagctggctgtctacaggctggtttaccatggtaatcgccgtagaactgtgcgatcatgtgcacgtatatgggatggtgccgcctaactattgctcacagcgaccccgactgcagaggatgccgtaccattactatgagcctaagggacccgatgagtgcgtgacctacatccagaatgaacactctcgaaagggaaatcaccacaggtttataaccgaaaaacgggtatttagtagctgggcccagctctatggcattactttcagtcatccatcctggacctag

SEQ ID NO: 54544 - DNA, 1590 bp, Artificial Sequence
  Description of Artificial Sequence: Synthetic coding sequence
atgaagccccacctcaagcagtggcggcagcggatgttattcggaatctttgcctgggggttgttattcctgctgatctttatatactttaccgattctaatccagccgagcctgtcccatcttctctgtcttttcttgagactcgccgactgctgcctgttcaagggaagcagcgggcaattatgggcgcagcacatgaaccatctcccccagggggtcttgacgctagacaggcccttccgagggctcatccagccggatccttccacgccggtcccggtgatctgcagaagtgggcccagagccaggatggctttgaacacaaagagtttttctcttcccaggtgggcaggaagtcgcagtctgccttctaccccgaagacgacgactacttttttgccgcaggccaacctggatggcatagtcacacccaaggaactctgggattcccttcccccggagagcccggacccagagagggcgcatttcccgctgcccaagttcagcgacgcagggtaaaaaaacggcataggcgccaaaggagaagtcatgtactggaggagggggatgatggtgatagactttattccagcatgtctcgcgctttcctctatcgcctgtggaagggcaatgtcagtagcaagatgctgaacccaaggttacagaaagctatgaaggactatctgactgccaacaagcacggagtgagattccgaggcaagagggaggccggactgagccgagcccagctgttgtgccagctgagatcccgagctcgggtgcgtacactggatggcaccgaagcccctttcagcgccttgggttggaggcgactggtgcccgctgtccccctctcacagcttcaccctcgcggattaagaagctgcgcagtcgtaatgagcgcaggtgcaattctcaactctagtctgggagaggagattgactctcacgacgctgtgctacgattcaacagcgccccaactaggggctacgaaaaggatgtgggaaacaaaacaacaattcggatcataaatagccaaatcttgacaaacccttcacaccattttatagattcttccctgtacaaggatgtcatcttggtcgcctgggacccagctccctacagcgccaatctgaatctatggtataagaaacccgactataatctctttacaccctacattcaacacaggcaacgcaaccctaaccaacctttctatattcttcacccaaagttcatctggcagctttgggatatcatccaggagaataccaaagaaaagattcagccaaaccctcctagttctggctttattggcattctaattatgatgtcaatgtgtagggaagttcacgtttacgagtatatccctagcgtgaggcaaaccgaactctgccattaccatgaactatactatgacgccgcatgtactttaggggcttatcaccctctgctctacgagaaacttttggtgcagaggctcaatatgggcacccagggcgaccttcaccgtaaaggcaaagttgtgctgcccggttttcaggcagtccattgcccagccccttcacccgtgattccgcactcctag

SEQ ID NO: 54545 - DNA, 288 bp, Artificial Sequence
  Description of Artificial Sequence: Synthetic coding sequence
taaagcggatttatcggtatcctgattatgatgtctatgtgtcgagaggtgcacgtttatgagtacattcccagcgtcagacagacagagctctgtcattatcacgaactgtactatgatgcagcttgtacactcggtgcctatcatccactgctctacgagaagctgctggttcagcgcctgaacatgggcacccagggcgatctgcacaggaaaggcaaagtcgtgctgcccggatttcaggccgtccactgcccagcacccagtccagtaatcccacacagctag

SEQ ID NO: 54546 - DNA, 1401 bp, Artificial Sequence
  Description of Artificial Sequence: Synthetic coding sequence
atgaaaccacatttaaagcaatggcgtcagaggatgctgttcggcatctttgcctggggattactgttcctgttaatctttatctactttaccgattctaatcctgccgagcccgtgcccagtagcctaagtttcctagaaactcgtcgcttgctccccgtgcagggaaagcaaagggccattatgggagccgcacatgagcctagtccccctggcggactcgatgcaaggcaggccctgccacgagcccatcctgcaggatcctttcatgcagggccaggggacctgcagaagtgggctcagagtcaagacggctttgagcataaggaattcttcagttcacaggtggggcgtaaatctcagagcgctttctaccctgaggacgacgattatttctttgccgctggacaaccaggctggcactctcatacccagggcaccctgggtttcccttctccgggagaacctggtcctcgcgaaggcgctttcccagccgcacaggtccaacggagaagggtaaagaagcggcatcgtagacaaaggagaagtcacgttctggaagagggagacgacggtgatcgactctattcttctatgagccgggctttcctttatagactgtggaaaggaaatgtgtcttccaagatgctgaaccctcggcttcagaaggccatgaaggattatctcacagccaataagcacggtgtgcgctttcggggaaaaagagaggcaggcctttcacgcgctcagctgctatgtcagctccgtagccgagccagggtcagaactctcgatggaacagaggccccattttccgcactaggatggcgtaggctcgtcccagctgtgcctctctcccagttacacccacgcggtctgaggagctgtgcagtggtaatgagcgccggtgccatcctgaactcctcattgggcgaggagattgactcacatgacgccgtgctgaggttcaactctgctcccactcgcggatatgaaaaggacgtgggtaacaaaacaacgatacgcatcatcaattctcagattcttacaaatccatctcaccacttcattgactcctccttgtacaaggacgtgattttggtagcctgggaccccgcaccttattctgcgaatctgaacctctggtacaagaagccagactacaatttgttcacaccctatatccaacaccgccagagaaatcccaatcagcctttttacatccttcatccaaagtttatctggcagctgtgggatattattcaggaaaacacaaaggagaaaatccagccgaacccaccttcctctggcttcatcggctccttcgtaaagattggacacattcgggcatgttccgaaccccgatccagagactgcacacctgcatggacaaccgagtag

SEQ ID NO: 54547 - DNA, 1590 bp, Artificial Sequence
  Description of Artificial Sequence: Synthetic coding sequence
atgaaacctcacttaaaacaatggaggcaaaggatgttgttcggtattttcgcctgggggcttctcttcctgctgatttttatatacttcacggactcgaatccagctgagcccgtcccttcatccctgagtttcctagagacccggaggcttcttcctgtgcagggaaagcagcgtgcgatcatgggcgcagcacatgagcctagtcctccaggaggactggatgccagacaggccttgccacgtgcccatcccgcaggatccttccatgctggccctggcgatttgcagaaatgggctcagtcacaagacggcttcgagcacaaggaatttttttcctcgcaagtgggtcgcaagagtcagtcggccttttacccagaggacgatgattactttttcgcggctggtcaaccagggtggcactcgcatacccagggtacactggggtttccatcgcccggagaacctggtcctagggagggcgcattcccggcagctcaggtccagaggcgacgcgtcaagaagcgccaccgtagacagcggagatctcacgtgctggaagaaggggacgacggcgatagactctatagttccatgtcgcgcgctttcctgtataggctatggaaaggaaacgtgtccagtaagatgcttaacccacgactgcagaaagccatgaaggactatctgacagccaacaagcatggcgtccgtttccgcggaaagcgcgaagccggactctctagagcccagctcctctgtcagttgcggtccagggcccgagtccgcacgttagacggcaccgaggcccctttctccgctctcggatggagacggctggtgcccgctgtaccgctttcccagctgcaccctagggggctgcgtagctgcgccgtggtaatgtctgccggtgcaatcctgaattccagccttggtgaagaaattgattctcatgacgccgtcctccgattcaactccgcccctactagaggatacgagaaagacgtcgggaacaaaacaaccattcgtatcatcaactcccaaatcttaaccaaccctagtcatcatttcatcgattccagtctgtataaagatgtaatcctggtggcttgggacccggctccctattcagctaatctgaatttatggtataaaaagcctgattacaatttgttcacaccatacatccagcatcgccaacggaaccctaaccagcccttctacatccttcatcccaagttcatttggcagctgtgggatataatccaggaaaatacaaaggagaaaattcagccaaatcctcccagcagcggattcattggaattcttatcatgatgagcatgtgtcgcgaggtacacgtatacgagtacatcccaagtgtcagacaaacagaactgtgtcactatcacgagctgtactatgatgccgcttgtacactgggtgcttatcacccactcttgtacgagaaacttttagtacaacggctaaacatgggcacgcagggcgatcttcatagaaagggtaaagtggtgctgcctgggttccaagccgtacattgcccggctccctcacctgtgatcccccactcctag

SEQ ID NO: 54548 - DNA, 108 bp, Artificial Sequence
  Description of Artificial Sequence: Synthetic coding sequence
atgaaacctcacctgaagcaatggcgacaaaggatgctctttggcatcttcgcatgggggctgctcttcctcctgatctttatttactttaccgactccaacccttag

SEQ ID NO: 54549 - DNA, 1071 bp, Artificial Sequence
  Description of Artificial Sequence: Synthetic coding sequence
atgagtccatgcggaagggctaggagacaaactagccgcggagccatggcggtgcttgcgtggaaatttccaaggacccgattaccaatgggtgcgagtgccctctgtgttgtggttctgtgttggctctacatttttcctgtgtatcgcctgcccaacgagaaggagatcgtgcagggagtgctgcaacagggtactgcatggaggaggaaccagaccgccgctagggctttcaggaagcagatggaggactgctgtgatcccgctcacctgtttgcaatgacaaagatgaatagccctatgggaaaaagtatgtggtacgatggtgagtttctctactcctttacaattgataactcaacatatagcctgttcccccaggccactcccttccagttgccccttaagaaatgcgcagtagtcggtaatggcggaattctcaagaaatcaggttgcggcaggcagattgacgaggccaatttcgttatgcggtgcaatctgccccctctctcatccgaatatacaaaagacgtgggctctaagtctcagctcgtgactgccaacccaagcatcattaggcaacgtttccagaatctcctctggagtaggaaaacctttgttgataacatgaagatctacaatcattcatacatctacatgcctgccttctcaatgaaaactgggaccgagcctagcctgcgcgtctattacacattgtctgatgtgggtgcgaaccaaacagtgcttttcgccaacccgaactttcttagatctatcggaaagttctggaagtccagaggcatacacgccaaacggcttagcactggcctctttctggtgtctgcagccctggggctgtgcgaagaggtcgcgatctacggcttctggcccttctctgttaatatgcacgagcagcccatcagccaccattattacgacaacgttctgccattcagtggatttcacgccatgcctgaagagtttctccagctctggtacctgcataagatcggcgcactgcggatgcaactggacccatgtgaagacactagtttacagcctacttcttag

SEQ ID NO: 54550 - DNA, 642 bp, Artificial Sequence
  Description of Artificial Sequence: Synthetic coding sequence
atgacaggctctttctatacacactctcctttaaccattcagctgacactttcctctcacaggtgtaatctgccgcctctatcaagcgaatacaccaaagatgtaggatcaaaaagccagctcgtgactgctaacccgtccatcatacggcaaagattccagaatctactgtggagtcggaaaacattcgtcgacaacatgaagatttataatcactcctacatctatatgccggctttttcaatgaaaacgggtactgaaccctctctgagggtgtattacacactgtccgatgtgggagccaaccagactgtattgttcgctaatccaaatttcctgagaagtatcgggaaattttggaagagcagggggattcacgcaaagcgtttgtccacagggctctttctcgttagtgctgcactgggcttatgtgaagaggtcgccatttacgggttctggccatttagcgtgaatatgcatgagcagcccatctctcaccactattacgacaatgtgcttcccttcagcgggtttcacgcaatgccagaggaattcctacagttgtggtaccttcataagatcggagctttaaggatgcagctcgatccttgcgaggacacatcactccagcccacttcatag

SEQ ID NO: 54551 - DNA, 1128 bp, Artificial Sequence
  Description of Artificial Sequence: Synthetic coding sequence
atgcagttacagtttcgctcttggatgttggctgccctgacactcctggtcgtgtttctgatcttcgctgacatcagcgagattgaagaggaaattggcaacagtggaggtagaggtacaatcaggtccgctgttaactccctgcactcaaaaagtaaccgagctgaagtggtaattaatggatcaagcagtcccgctgtggtagatcggtccaatgagagtatcaaacacaacatccagcccgctagcagtaagtggcgtcacaatcaaaccctgagccttaggatacggaaacagatcttgaagtttctggacgcagagaaggacatctccgtgctgaagggcaccttgaagccaggagatattattcattacatcttcgacagagactcgacaatgaacgttagccaaaatttatatgagctgctgccgaggacctcaccattgaagaataaacatttcggaacctgcgccatcgtgggaaactccggagtgttacttaactcaggatgtggacaggaaatcgatgcacacagcttcgtgataaggtgcaatttggctcccgttcaggagtacgcacgggacgttggcctgaagacggaccttgtcaccatgaacccttccgtgatccagcgggcattcgaggacctcgtcaacgccacatggagggagaagttgcttcagcgactacatagcctcaacgggagtattctctggatcccagctttcatggcacgcggtggaaaggaacgcgtggagtgggttaacgagctgattcttaagcatcacgtcaatgtgcgcaccgcctatccctcactccggttgctccacgcagtgagagggtactggttgactaacaaagtgcatatcaagagaccaacaacaggcctcctgatgtataccctggcaactaggttttgcaagcagatttacctctatggtttttggcccttccccctcgatcagaaccagaaccccgtgaaataccactactatgatagcctgaagtacggttacacttcgcaggcatctccccacacaatgcctttagagttcaaagccctcaagagccttcatgaacaaggtgctctgaagttgactgtcggtcaatgcgacggtgctacatag

SEQ ID NO: 54552 - DNA, 1065 bp, Artificial Sequence
  Description of Artificial Sequence: Synthetic coding sequence
atgcagcttcagtttaggtcatggatgctcgcagcactgaccctcttggtagtgttcttgatcttcgctgacatctctgaaatagaggaagaaatcggagcagaggttgtgatcaacggctccagctctccagccgtcgtcgacagaagtaacgaaagtataaaacacaatatccaacccgctagtagcaagtggcggcataatcagacactttcactgcgaatacgaaagcaaatactcaaatttctggacgccgagaaggatattagcgttttaaaaggaaccttgaaacccggagacatcattcactacatcttcgaccgagacagcactatgaacgtgagtcagaatctgtatgaactattaccaaggacatctccactgaaaaacaagcatttcgggacatgtgccatcgttggaaattcaggcgtgctcctcaattccgggtgtggccaggagatcgacgcccacagctttgtgatccgttgcaacctggccccagtgcaagaatacgccagagatgtcggattgaaaactgacctagtgacaatgaacccttccgttatccagcgagcatttgaggacctggtgaacgccacctggcgcgagaaattgctgcagcgcctgcactccttgaatgggtccattctatggataccagccttcatggcgcgaggaggaaaggagcgtgttgagtgggtcaacgaattaattctgaagcaccacgtcaacgtgaggaccgcttatccatccctgcgccttctccatgctgtacggggatattggcttacaaacaaagtccacattaagcggccaactacaggcctgctaatgtacactctcgctactcggttctgtaaacagatttacctctatggcttctggccattcccactggaccagaatcagaatccagttaaatatcactattacgatagcctgaagtacggctacacttcacaggcctcaccacacaccatgccacttgagttcaaggccttaaagtccttgcacgagcagggcgcattgaaactcactgttggccagtgcgacggagctacttag

SEQ ID NO: 54553 - DNA, 1143 bp, Artificial Sequence
  Description of Artificial Sequence: Synthetic coding sequence
atgagaaactgcaaaatggccagggtcgcctccgtgctggggctggtcatgctatccgtggcactcctgattctgagtctgatttcttatgtttcgttgaagaaagaaaacatattcacgacgccaaaatacgcctcacctggtgctccgagaatgtatatgttccacgccggttttcggagtcagtttgcactcaaatttctagatccttcttttgtgcctataactaactcccttacacaggaactccaggagaagccaagtaagtggaagttcaatcgaacggcctttctgcaccagaggcaggagattctgcaacatgttgatgtgattaagaacttctccctcaccaaaaactcagttaggattggacagctcatgcattatgattatagttcacacaagtacgtattctccatttctaataatttccgaagtctgctgcctgacgtgtcccccatcatgaacaagcattacaatatctgcgccgttgtaggaaactcaggcatactgaccggaagccagtgcgggcaggaaatcgacaagagcgattttgtgttccgctgcaactttgctccgaccgaggcatttcaacgggatgtggggaggaagactaatttaacaaccttcaacccatcgatcctggaaaaatattataacaaccttctcacaattcaagataggaataacttctttttgtctctgaagaaactggatggtgccatcctttggatccccgcatttttcttccacacgagcgccactgtgactcggactttggtagattttttcgtagaacacagaggccaactgaaagtgcagcttgcctggcctggtaacattatgcagcatgtgaaccgctattggaaaaataagcatttgtctccaaaacggctcagtaccgggattcttatgtacactttggcgagcgcaatctgtgaggagatacacctttacggcttttggccttttggttttgatccaaacacaagagaagatctgccatatcactactatgataaaaagggaactaagttcacgacgaaatggcaagagtcccaccagcttcctgccgaatttcagcttctatatcgaatgcacggggaaggcttaaccaagctgacactgagtcactgtgcctag

SEQ ID NO: 54554 - DNA, 1464 bp, Artificial Sequence
  Description of Artificial Sequence: Synthetic coding sequence
gctgggggaagaggccgtaccgccctgagagcccctagtccccgacgcagggcagcaccgccttcatcctgttcagcacccggtcctgctcgaccttgcttgcgcggtcctgccgctctccgcggatcctgtcaaccacagcctcctgccccagtggcctctccacatccacgccctggtcctcctccccctccacacgctagggcccacactcacacacatacgcacactcacacacatactcacatctatacccctgctagttgctggccgttaaatggacccatatccccagtttccctcaatcctgcacaacctggtatgaggaattgcaaaatggcaagggtggcaagtgtactgggtttagtgatgttgtcggtagccttgctcatattatcgctcatctcctatgtttccctgaaaaaggagaacattttcaccacacctaaatatgcctctcctggggcacctaggatgtacatgtttcatgcgggttttaggtcccagttcgctctcaagtttctcgacccctcattcgttcctataacgaactcattgacgcaggaactccaggaaaaacctagtaagtggaaatttaaccgcaccgcttttttacaccagaggcaagaaatcttgcagcacgtagacgttataaagaacttctccttgacaaaaaatagcgtccgcatcggccagctaatgcattatgattactctagtcacaaatacgtcttctccatcagtaataattttaggtccctcctcccggatgtaagtcccattatgaacaagcactataatatatgtgctgttgtaggaaactcaggcatccttacaggatcacaatgcggacaggagattgataagtcagactttgtgttccgctgcaatttcgctccaaccgaagcttttcagcgggatgtggggaggaaaaccaacctgacaacgttcaacccatcaatcctcgagaagtattacaacaatctgttgaccatccaggacagaaacaactttttcctgtcactgaaaaaattagacggcgctatcctgtggattcccgctttttttttccacacaagcgcaacggtgacccgcacactggtagatttttttgttgaacatcggggacagttgaaggtccagctggcctggccaggtaacataatgcaacacgttaaccgctattggaagaataagcaccttagtcccaaacgactcagcaccggaatccttatgtacacattagcctctgctatttgtgaggagattcatttgtacggattctggccattcggctttgatccgaacactagagaagacctgccctaccactattacgataaaaaaggtaccaaatttacaaccaagtggcaggaatctcaccagctccctgccgagttccagctcctgtacagaatgcatggagaggggttgacaaaactcactctctcccattgtgcttag

SEQ ID NO: 54555 - DNA, 405 bp, Artificial Sequence
  Description of Artificial Sequence: Synthetic coding sequence
atgaggatgttactccacctttcactcttagccttaggagccgcttatgtctacgccatcccaacagagatacctacatctgcccttgtgaaggaaacccttgcactgctgtctactcatagaactctgctgatcgcaaatgagactctgcggattccggtgcccgtgcacaagaatcaccaactgtgtaccgaggaaatcttccagggaatcggcactttggaaagtcaaactgtccagggaggcaccgtggagcgactgttcaagaacctctctctgatcaagaaatacatcgatgggcagaagaagaaatgcggagaggaaagacgccgtgttaatcaattcctggactatctgcaggagtttttgggagtgatgaacacagaatggattattgagagctag

SEQ ID NO: 54556 - DNA, 507 bp, Artificial Sequence
  Description of Artificial Sequence: Synthetic coding sequence
atgcgttctatcagaaagcggtggaccatatgtacaatctcattgctattaattttctacaagactaaagagattgccaggactgaagagcatcaggagactcagcttattggggatggggagcttagtctcagtcggtctctggtgaacagtagtgataaaattatacgcaaggcgggaagttcgatttttcagcataacgtcgagggctggaagatcaacagttctttggtactcgaaatacgcaaaaacatcttgagatttctcgacgcagagcgtgacgtctcagtggtgaaatcttctttcaagccaggagatgtcattcattacgttctggacagacgccgaactctgaatatttctcacgatctgcacagccttttgcctgaagtgtctccaatgaaaaaccggaggttcaaaacctgtgctgtcgtggggaatagtgggatcttgttagactccgagtgcggtaaggagatcgatagccataatttcgtgatacgatag

SEQ ID NO: 54557 - DNA, 1131 bp, Artificial Sequence
  Description of Artificial Sequence: Synthetic coding sequence
atgcggtatgcagaccccagcgccaaccgagacctcttagggagtagaacccttctgtttatttttatctgcgcgtttgccctggtcaccttattgcaacagattctgtacggaagaaactatatcaaacggtactttgagttctacgagggtcctttcgagtataattcaacgcgctgcctggagctcagacacgagattctggaggtcaaagtgttatctatggtcaagcagtcagagctgttcgacaggtggaagagtctccagatgtgtaagtgggccatgaatatctcggaggctaaccagttcaaatcaacactgtctaggtgttgcaacgccccagccttcctctttacaacccagaaaaacactcctctgggtactaaactgaagtacgaggtggatacctcaggaatttaccacattaaccaggaaatctttagaatgtttcctaaagatatgccctactatcggtcacaatttaaaaagtgcgccgtagtaggcaacggcggaatcctcaagaactcacgatgcggcagggaaatcaattcggctgacttcgtgtttcgctgcaatttaccgcctatttcggagaaatatactatggacgtgggggtgaaaactgacgtggttaccgtgaacccctcaatcattaccgaacggtttcacaagctcgaaaaatggaggaggcccttttatcgagtccttcaggtgtatgaaaacgccagcgtgctgttgccagcattctataataccagaaataccgacgtctcaattcgggtaaagtacgtacttgacgattttgaatctcctcaggccgtttattattttcacccccaatatctggtcaatgtctcccgttactggctttcactgggcgtgcgagctaaaagaatatctactggccttattctggtgacagccgctcttgaactatgcgaggaagtccacctgttcggtttctgggcctttccaatgaatcctagtggactttacatcacgcatcactactatgataatgtcaaacccagacccggttttcacgctatgcctagcgaaatcttcaatttccttcaccttcattcccggggtatcctgcgtgttcacacgggcacttgcagctgttgctag

SEQ ID NO: 54558 - DNA, 1038 bp, Artificial Sequence
  Description of Artificial Sequence: Synthetic coding sequence
atgaggtatgcagatccttctgctaatcgggatctgctgggaagcagaacgctacttttcatcttcatctgcgcttttgctcttgttacattactgcagcagattctgtacggcaggaattatatcaaaagagtgaaacagagcgaactttttgatcggtggaagagtttgcaaatgtgcaaatgggccatgaatatctctgaagctaatcagtttaaaagcacgttaagtaggtgctgtaatgccccagcctttctgtttactactcagaaaaatacacccttggggacgaaactgaagtatgaggtggacacgagcgggatctaccatattaatcaggagatatttagaatgtttccgaaagacatgccgtattaccgcagtcaattcaagaagtgcgccgtggtgggcaacggaggcattcttaagaacagtcggtgtggacgcgaaattaactctgccgacttcgttttccgttgcaacctgcctccaatttccgagaagtacaccatggatgttggagtgaaaacggatgtcgtcactgtgaaccctagtatcataaccgagcgatttcacaaactagagaagtggcgtaggcccttctatagggttctacaggtttatgagaacgcatctgtccttctccccgctttctataacacgagaaatactgacgtaagtatcagggtgaagtacgtactcgatgatttcgaaagcccacaagcagtgtactactttcacccccagtaccttgtcaacgtatcccggtactggctgtcactgggcgtgcgggctaagcgcatctcaacagggctgatcttggttaccgcagcgctggaactctgtgaagaagtgcacttattcgggttctgggctttccccatgaatccatcagggctctacattacacaccattattacgacaatgtgaaaccccgtccaggctttcacgcaatgcccagcgagatctttaactttcttcacctccacagccggggaatactgcgcgtacatactggcacttgcagttgctgctag

SEQ ID NO: 54559 - DNA, 1239 bp, Artificial Sequence
  Description of Artificial Sequence: Synthetic coding sequence
atgcggtatgccgatcccagcgcaaaccgggatctgttaggcagtagaacactcctgttcatctttatatgcgccttcgccttggtgaccctgttgcagcagattctgtatggccgtaattatatcaaacggggactgcaatttggttggcaatccggtgaccagctgaccaattggaccggcctgtttaacgtgacagatgatcctgcggtgcaatctggaagcgactcaagtagccgctacttcgagttttatgagggcccattcgagtacaactccactcggtgcctcgagcttcgccacgaaatattggaagtaaaggttctgtccatggtgaaacaaagtgagctgttcgatagatggaagtccctgcagatgtgtaaatgggcaatgaacataagcgaagctaatcagttcaagtccaccctttcccgctgctgcaatgccccagcatttctgttcacaacacagaagaatactccattaggtactaaactgaagtacgaagtcgacactagtggcatctatcatataaaccaagagattttccggatgtttccaaaggatatgccttattataggtcccaattcaagaaatgcgccgtggttggtaacgggggtatcctgaagaatagtagatgtggcagggagatcaactcggccgactttgtatttcgatgcaacctgcccccaatatctgagaaatatacaatggatgtaggagtcaaaaccgacgtggtaacggtcaacccatcaataatcaccgaaagattccacaagctggagaaatggagaagacctttctacagagtcctccaggtctacgagaacgcctctgtcctgctgcctgcattctataatacaagaaacacagatgtatcaatccgggtcaagtacgttctggacgatttcgagtccccccaggccgtctattactttcatccgcagtacctggtgaacgtgagtagatattggcttagccttggagtgcgggctaagagaatttccacaggacttatcctggttactgccgcacttgaactgtgcgaggaggttcatctgttcggcttctgggcttttccaatgaaccccagtggcctgtacataacccatcactactacgacaacgtcaaacctaggcctggctttcatgccatgccaagcgagatctttaactttctacacctgcattcccggggaattctccgagtgcacacaggcacctgctcgtgctgctag

SEQ ID NO: 54560 - DNA, 1197 bp, Artificial Sequence
  Description of Artificial Sequence: Synthetic coding sequence
atgaggccgggaggggctctgttggccctgttggcctccctcctgctgctactactcctaagattgttgtggtgtcctgctgatgctcccggacgggctcgcatcctggtagaggaaagtagggaggctacccacggcacaccggcagccctgcgcacgcttagatcacccgcaacagctgtgccgcgtgcaaccaattctacatacctcaacgagaagtcccttcagctgactgagaaatgtaagaacttgcagtacggaattgaatctttctctaataagaccaaaggctattccgagaatgattacctgcagataatcaccgatatccaatcctgtccatggaagcggcaggcagaagagtatgccaacttccgcgctaagttggcttcttgctgcgatgccgttcagaactttgtggtgagtcagaataatacccctgtgggtacgaacatgtcttatgaggtagaaagtaaaaaagaaattcctatcaaaaaaaacatcttccacatgtttcccgtctcacagccgttcgttgactacccctacaatcaatgcgctgttgtcggcaatggaggaattctcaataaatctctatgtggtaccgagatcgacaaaagcgactttgtgttccggtgcaatttgcctcctaccacaggtgatgtgagtaaggacgttggttccaagacgaacttggtcacaatcaatcccagtatcattactctgaaatatggcaacctgaaagagaagaaagccctgtttctggaggacattgcaacctacggagacgccttctttttacttcccgcattttcatttagagccaacaccggcacttctttcaaagtgtactacacccttgaagagtccaaggcaagacagaaagtgttattctttcatcccaagtatctgaaggacttggcgctgttctggagaacgaaaggtgtcacagcatatcgcctgtcaacaggactgatgataactagtgtggctgtcgagctctgcaaaaacgttaagctctacggtttttggccattctcaaagactgttgaggatatccccgtaagccaccactactatgataataaactgccaaaacacgggtttcaccagatgccaaaagagtattctcaaattctccagcttcacatgaagggcattctcaagctgcagttctctaagtgtgaggtcgcatag

SEQ ID NO: 54561 - DNA, 414 bp, Artificial Sequence
  Description of Artificial Sequence: Synthetic coding sequence
atgttccctgtcagccagcccttcgtggattatccttataatcagtgcgccgtggtgggaaacggtgggatcttgaacaaatccctctgtggtactgaaatagacaagtcagactttgtctttcgctgcaacttaccgccaaccacgggcgacgtctccaaggacgtcggctccaagactaatctcgttacaattaatccctccatcattaccctaaaatatggcaatctgaaggaaaagaaagctctctttctcgaggacattgctacttatggagacgcctttttcctgctgcccgcattctccttcagggcgaacaccggaaccagtttcaaggtttactatactctggaagagtctaaggccaggcagaagtgcaagaccaagcgcaagacgataaactcaatactctag

SEQ ID NO: 54562 - DNA, 387 bp, Artificial Sequence
  Description of Artificial Sequence: Synthetic coding sequence
taatacccatacaatcagtgtgctgtagtaggcaatgggggaattctgaataagtccctgtgcggcactgagatcgataaatctgattttgtgtttcgctgcaatctgccgcctacgacaggcgatgtgtcgaaagatgttgggagcaaaaccaatctggttacgatcaatccgtccattattaccctcaagtatggaaatctcaaggaaaaaaaagccctttttttggaggatatcgccacatacggcgatgcctttttcctgctaccagctttttctttccgcgctaacactggaaccagttttaaggtgtactacaccctggaggagagcaaggcccgacagaaatgcaagaccaagaggaagaccatcaactccatactttag

SEQ ID NO: 54563 - DNA, 7712 bp, Artificial Sequence
  Description of Artificial Sequence: Synthetic coding sequence
atggccggaccacggggactcctgcctttatgtcttttggctttttgtttagctggcttcagctttgtccgtggccaggttctgttcaaaggctgcgacgtcaaaacaacttttgtcacccacgtaccttgtaccagctgtgccgcaattaagaaacagacgtgcccttccggatggctacgggagttgccggatcagatcacccaggattgccggtacgaggtacaactggggggatcaatggtttccatgagcgggtgtaggagaaaatgccggaaacaagtcgtccagaaggcgtgctgtcccggatactggggatccaggtgccacgagtgcccagggggagccgaaactccgtgtaacggccatggaacctgcctcgatggcatggatcgcaacggtacctgtgtctgccaggaaaactttagaggcagtgcctgccaggagtgtcaagaccctaatcggttcggcccagactgccagagcgtttgttcgtgcgtgcatggggtgtgtaaccatggcccacggggagacggcagttgtctgtgcttcgcgggatataccggccctcactgtgatcaggaactgcctgtgtgtcaagagctacggtgtccccagaatactcagtgctctgctgaagctccctcctgccggtgtctgccaggatatacacaacagggttctgagtgtcgggcacctaacccatgctggcccagcccttgtagcttgctggcacagtgcagcgtgtccccaaaggggcaagcacagtgccactgcccagagaattaccacggcgacgggatggtttgcttgcccaaggatccatgcaccgataacctgggaggctgtccatccaacagcactctctgtgtctatcaaaaaccgggacaggctttttgtacttgcaggcctggattagtgtccataaacagcaacgccagcgcaggctgcttcgctttctgcagtccatttagttgcgatcgatccgcaacctgtcaggtcacagccgatggaaagacctcttgcgtttgcagggagagcgaggttggggacggcagagcttgttatgggcacctcctgcatgaggtgcagaaggcaactcagacaggtagggtgttccttcagctaagagttgccgtggctatgatggaccaggggtgtcgggagattttgacgactgctggaccatttacagtgctagtgccctctgtgtcatccttctcatcccgcacaatgaacgcaagtctagcgcagcaactttgcaggcagcacattatcgcaggtcagcacatcctagaagacacgagaacgcagcagactagaaggtggtggaccttggctggccaggaaattactgtgaccttcaaccagttcaccaagtactcgtacaaatataaggatcaacctcagcagacatttaatatttacaaagctaacaatattgccgctaacggcgtcttccacgtagtgacggggctgaggtggcaagctccttctggcactcccggtgacccgaaaagaacaatcggccaaatcttagcatctacagaggccttttcccggttcgagacaattttagagaattgcggcctaccctccattttggatgggccaggccctttcacagtcttcgctcctagtaacgaggcagtcgattctcttagggacgggagactcatttacctattcaccgcgggactgagtaagcttcaggagctggttcgctaccacatttacaatcacggacagttaactgtggagaagctcatcagcaaaggcagaatccttacaatggccaaccaggtgcttgctgtcaatatttccgaggagggcagaattctgctcgggccagagggcgtgcctctgcagcgtgtcgatgtgatggctgcaaacggcgtcatccacatgctggacggcattttgttaccccctactattttgcctatactgccaaagcattgttcagaggagcaacataaaattgttgccggttcctgcgtggactgccaagctctgaatacgagtacttgcccgcctaactcagttaagctcgacatcttcccaaaggagtgtgtgtacatacacgaccctacagggctcaatgtgctgaaaaagggatgtgccagttactgcaaccagaccatcatggagcagggctgctgcaagggattcttcgggccagactgcacccagtgcccaggcggattttccaatccctgttacggtaagggcaactgttcagatgggattcagggaaatggagcctgcctgtgtttcccagattacaagggaattgcttgtcacatatgttcgaacccgaacaaacacggggagcagtgccaggaggattgtggctgtgtgcacggcctgtgcgacaatcggcctggatctggaggggtctgtcagcagggaacctgcgctccagggttctccgggaggttctgcaacgagagtatgggcgactgcggaccaacaggtctagcgcagcactgccaccttcatgccaggtgtgtttcacaggagggagttgctcgctgtcggtgcctcgacggcttcgagggagacggattctcatgtacaccttcaaatccatgttcacaccccgaccgcggaggctgcagtgaaaacgctgagtgcgtccccggatctttggggactcatcactgcacctgccataagggctggtccggggacggaagggtgtgtgtggcaatcgatgaatgtgagctcgatatgcgaggtggctgtcatactgacgctctctgcagctacgtcggacctggtcagtcccggtgcacttgcaagctgggattcgctggcgacgggtatcagtgcagcccgattgatccatgtagggccggtaatggcggatgtcatggcctcgcaacgtgtagagctgtcgggggaggacaaagggtatgtacctgtcccccaggcttcgggggtgatgggttttcttgctatggtgatattttcagggagcttgaggccaacgcgcatttttccatcttctaccaatggcttaagtctgccggtatcaccttacctgccgataggagagtgaccgcactagtgccatctgaggccgctgtaagacagctgtctccagaggaccgcgctttttggttacagccccgaacattgcccaatctagtgcgggctcattttttacagggcgctctctttgaggaggaactggcgagactcggcggtcaagaggtggccacgcttaaccctacaactcggtgggaaatacgtaatatctccggtcgggtgtgggtgcaaaacgcttctgtggacgttgcagacttactggcaacaaatggtgtgttacacattctctcacaggtgttgctaccgcctagaggcgatgtaccagggggtcaggggctgctgcaacagctcgatttggtgcctgcttttagcctgtttagggagctgctccagcatcacggtctcgtcccacagatagaggctgccaccgcttacaccatcttcgtgcctactaatcgcagtttggaagcccaaggcaattcgtcacaccttgacgccgacaccgtccgacaccacgtggtcctaggggaagccctgagtatggagacactcaggaagggcggtcaccggaacagcttgctcggcccagcacattggatcgtattctataaccatagtgggcaaccagaagtcaaccatgtgccattggaaggcccaatgttggaagcacctggcagaagtctcatcggcttgagcggcgttctgactgtaggctcgtctcggtgccttcattcacacgcagaggcgctgagggaaaagtgtgtgaactgcacaagaagatttagatgcacacaaggattccagctgcaagacacacctcggaaaagctgtgtctaccggagcggattcagcttttcaaggggctgcagctacacatgtgctaaaaagatccaagttccagattgttgcccgggtttcttcggcaccttgtgtgaaccttgtcccggtggcctgggcggagtctgctccggccacggacaatgtcaagatcgctttctgggctctggagaatgtcattgtcatgagggttttcacggcaccgcctgtgaggtctgtgaactgggacgatatggacctaattgcacgggtgtgtgtgactgtgcacatgggctctgccaggaggggctccagggggacgggtcatgcgtctgtaatgtcggatggcaggggctgcgctgcgatcagaagataacttcaccacagtgccccaggaagtgtgacccgaacgcaaactgtgtgcaagacagcgcaggtgcgagtacctgcgcatgcgctgctggctattcaggaaacggcatcttctgctctgaagtggacccttgtgcacatggtcacggtgggtgctctccccatgcgaattgcacgaaggtggctcccggacagagaacgtgtacctgtcaagatggctatatgggtgatggcgagctctgccaggagatcaacagctgtctaattcatcatggtggttgccacatccatgctgagtgcatccccacaggcccacagcaggtgagctgcagttgcagagaggggtatagcggcgatggcatccggacttgtgagctgctggatccttgcagtaagaataatgggggatgtagcccctatgcaacctgcaaaagtacaggagacggccagagaacctgcacgtgtgatacagcacacactgtaggcgatggcctgacatgcagagcacgagtcggcctagaattactccgtgataagcatgcctcctttttctcccttcgacttttggaatacaaagaactcaagggagatggtccatttaccattttcgtcccccacgcagacctcatgagtaatctcagtcaggatgagctcgctaggatacgcgcacatcgccagctggtatttcgataccacgtggtcggatgtcggcgtctaagatccgaggatctgttggagcagggctacgcaacggccctttccggccacccattacgtttctccgaaagagagggcagtatttacttaaatgatttcgcccgtgtcgtttcttcagatcacgaggcagtgaacggaatattacacttcatagatcgcgtcctgctgcctcccgaggcactccattgggaacccgatgatgcccctatccccaggaggaatgttacagccgcagcccaggggtttggttacaaaatctttagtggtctcttaaaggtcgccggactgctgccactcctgcgcgaggcgagccatcggccttttaccatgctttggccaacagacgccgcattccgtgccttgcctcctgaccgccaggcctggttataccatgaggatcaccgcgataagttggctgccattcttcgtggacatatgatccgaaatgtggaggcactcgcgagcgatcttccgaatctggggccactcagaacgatgcacggtaccccaatcagctttagttgcagtaggaccagggcaggggaactgatggtaggagaggacgacgcccgaatagttcagaggcatctgccctttgaagggggtctcgcatatggaattgaccaactgttggagcctccaggacttggagccagatgtgatcatttcgagacccgtcctcttaggttgaacacatgttccatctgtggactcgagccaccttgtcctgaggggagccaggaacaggggtccccagaggcttgctggaggttctatccaaagttctggaccagtccaccactgcactcactcggacttcggtctgtgtgggtgcatcctagcctgtggggtagacctcaggggcttggacgaggatgtcaccgcaattgtgtaacgactacttggaagccatcctgttgcccgggtcactacggaagcgagtgccaagcctgtcctgggggtccttctagcccctgttctgatcgtggcgtgtgtatggatgggatgagtgggtctggtcagtgtctttgtcgctccgggttcgccggaacggcctgcgaactatgtgctcctggagccttcgggcctcattgccaagcatgtcgctgtaccgtccacggccgatgcgacgaaggactgggtggcagtgggtcctgtttttgtgatgagggctggactgggccaagatgtgaggtacagctcgagctgcagcctgtttgcaccccgccatgcgcacccgaggctgtgtgcagagccggaaacagttgtgaatgttcactggggtacgaaggcgatgggcgagtctgtacagtagccgacctctgtcaggatgggcacggcggttgttccgagcacgccaattgttcacaggtggggaccatggttacctgcacttgtttgccagactacgaaggcgatggctggtcgtgccgcgctcgcaatccatgtacagatggccacaggggtggatgcagtgagcacgccaattgtctcagcaccggactgaatactcgcagatgcgagtgtcacgccggttacgtgggcgacggtctgcagtgcctggaagagtccgagcctcccgtcgaccggtgcttgggtcagccccctccctgtcatagcgacgctatgtgtactgaccttcactttcaggagaaacgcgctggagtgttccatctgcaggcgacttccggtccttatgggttgaatttttctgaagcagaagccgcttgtgaggctcagggggcagtgcttgcctccttcccccagctgtccgccgcacagcagctcggctttcatctgtgtctcatgggctggttggctaacggttccacagcgcatccagtcgtcttccctgttgccgattgtgggaatggccgtgtcggaatcgtcagcttaggggcaaggaaaaacctttctgagagatgggacgcgtattgtttccgggtgcaagacgtagcatgtagatgtcggaatggcttcgtgggagatggaattagcacctgcaatggcaagcttctggacgtgctggctgccacagctaatttctccactttctatggaatgctcctaggttatgcgaatgcgacccagcgtggtctcgatttcctggacttcctggatgatgaactgacatataaaaccctgttcgttccggtgaatgaagggttcgtagataatatgacattgtccgggcctgacctagagctgcacgcttccaacgccaccctcttgagtgctaatgctagtcagggaaaactgctcccggcacatagcggcctgagtttgatcatttccgacgccggacctgataacagcagctgggctccggttgcaccagggacagtagttgtgtcccgtatcatcgtttgggatatcatggcgtttaatgggatcatacatgcacttgcgagcccactcctagctcccccacagccgcaggcagtgcttgctcctgaggccccacccgtagccgcaggcgtcggcgcagtcctggcagccggagctctcttgggactggtggccggagccctttatctgcgagccagaggcaagcctatgggattcggattctctgcttttcaggctgaagatgatgccgatgacgacttcagcccctggcaagaggggaccaatcctactctggtgtccgtcccaaatccagtgtttggctccgacacgttttgtgaacctttcgatgattcgctcctggaggaagattttccagatacccagcgcattctaactgtcaaata

SEQ ID NO: 54564 - DNA, 3003 bp, Artificial Sequence
  Description of Artificial Sequence: Synthetic coding sequence
atgggccgaagaaccctgtttattggatgccagccaaaatgcgtccgcaccgtaataactagggagtgctgtgcaggcttttttgggcctcagtgccaaccatgtcctgggaacgcccaaaacgtctgttttgggaatggaatctgcctcgacggcgtaaacgggaccggtgtgtgcgagtgcggagaggggttttcgggaacagcttgcgagacttgtactgagggcaagtacggcatacactgtgaccaggcttgtagctgtgtccatggcagatgcaatcagggcccattaggagatggctcatgcgattgtgacgtgggatggaggggcgtgcattgcgacaatgcgacaaccgaagacaattgtaacgggacatgtcatactagcgccaattgtctgacaaactctgacggaactgcctcttgtaagtgtgccgctggatttcaggggaatggcactatttgcactgccataaacgcctgtgagattagtaatggaggctgcagtgcaaaagctgattgcaagcgaacaactcccggacggcgagtctgcacttgtaaagctgggtataccggtgatggcatcgtttgtttggagatcaacccatgtctcgaaaaccatggaggttgcgataaaaacgccgagtgtacccagaccgggcctaaccaggcagcatgcaactgtttgcctgcttacacgggggacggaaaggtatgcaccttaattaatgtgtgtcttaccaagaacggcggttgcagtgaatttgccatttgcaaccacaccgggcaagtcgaacgtacttgcacctgcaagccgaactacattggcgatggattcacctgtcgaggaagcatctaccaagagctgcccaagaaccctaaaacctcacagtatttttttcagttacaggagcatttcgtcaaggacctcgtgggaccaggcccttttacagtattcgcccctctgtctgctgcttttgacgaagaggctagggtcaaagattgggacaaatacggcctgatgcctcaggtgcttcgctatcacgtggtcgcctgccaccagctgctgctcgaaaacctgaaactgataagcaatgccacaagcctgcagggcgagccgattgtcatctctgtgagccagagcacagtctacatcaacaataaagcaaagattattagttccgacattatttcaactaatgggatcgtgcatatcatagataaattgctctcgccaaagaacctcctaatcactcccaaggataactccggcaggatcctccagaatctcaccacactggccacaaataatggctacattaagttttccaatctgattcaggactcaggcctgctgtccgtgattactgaccctatccacacccccgtcacactcttctggccaaccgaccaggcccttcatgccctgccagccgagcagcaggactttctctttaaccaggacaacaaggacaaactcaaggagtacctaaaattccacgttattagggatgccaaggtgctggcagtggatctgcccacttcaacagcatggaaaacactccaggggtcagagctttcggtcaaatgtggcgctggcagggatattggggatctgtttctgaacggacaaacttgcaggatcgtccagcgagaactcctgtttgacttgggggtggcctacgggatcgactgtctgcttattgaccccactttgggcggacggtgtgatacctttactaccttcgacgcttctggggagtgcggcagttgtgtcaacactcccagttgtcctaggtggtcaaaaccaaagggcgtaaagcaaaagtgcctttacaacctgcccttcaagcgtaatctggagggctgccgtgagcggtgctccctcgtcattcagatcccacgctgctgtaaaggctatttcggcagagattgccaagcttgccctggcggacctgatgccccatgcaataatcggggtgtctgtctcgaccagtactctgcgaccggcgaatgtaagtgcaatacaggtttcaacggaacggcctgtgaaatgtgctggcctgggagattcgggccagattgtttaccctgcggctgttctgaccatgggcagtgcgatgatggcattacaggctccggccagtgtctctgtgagacgggttggaccgggccttcttgcgacacccaagccgtcctccctgcagtgtgtacccctccatgctctgcgcatgccacttgtaaggaaaacaacacctgcgaatgcaatctggactatgagggggatggcataacgtgtaccgtggtcgacttctgtaaacaggataatggcggatgcgcaaaggtcgctcgttgctcccagaaggggactaaggtctcctgtagctgtcagaaaggttataaaggggatggccactcctgcactgaaatcgatccatgcgccgatggccttaacggcggatgtcatgaacacgccacctgcaagatgacagggcctggcaagcataaatgtgagtgtaaatcacactacgttggggacgggctcaactgcgaacccgagcagcttccgatcgataggtgtttacaagacaacgggcagtgtcacgccgacgccaagtgtgtggacctgcacttccaggacacaacagtcggcgtgttccacctgcggagccccctggggcaatataagcttacatttgataaagctcgagaggcttgcgcgaatgaggccgcaacgatggccacttacaaccagttaagctacgcgcagaaggcaaaataccacctctgcagcgccggttggctggagactggcagagtagcatatcccacagcctttgccagccagaactgcgggtcaggcgtggttggcatcgtggattacggccctcggcctaacaagagcgaaatgtgggacgttttttgttatcgcatgaaaggctcggctggattgttccagcagctgtcttcccgcccatgcataagtcgaactcccgactag

SEQ ID NO: 54565 - DNA, 7655 bp, Artificial Sequence
  Description of Artificial Sequence: Synthetic coding sequence
atgatgctgcaacacttggtgattttttgcttggggttggtggtgcagaacttctgctccccagcagagaccacaggtcaggccaggcggtgtgatagaaaatccctgttgaccattaggacagagtgtaggagctgcgccctgaacctcggggtgaagtgtcctgacggttacaccatgattacatcagggagcgtgggagtcagagactgtaggtatacattcgaggtacgcacatatagtctgtctctccctggttgcagacacatttgtcggaaagactacctgcagccccgatgctgtcctggaagatgggggccagactgcattgaatgtccgggaggagcaggatctccatgtaatgggcgaggaagctgtgcggagggtatggaggggaatggcacatgcagttgccaagagggtttcggtgggaccgcttgcgaaacatgcgctgatgacaatctcttcgggccatcttgtagttcagtttgtaattgcgttcacggcgtctgtaatagcggccttgatggagatggcacgtgtgagtgctatagcgcctacactggtccaaaatgtgacaaacccatccctgagtgcgctgccttgctatgtcctgagaattcacgatgtagtcccagtacagaggacgagaacaagctggaatgtaaatgcctgcccaactacaggggcgatggaaagtactgcgaccctattaatccttgcctgagaaagatttgccatccacatgctcactgcacttaccttggtccgaatcggcattcttgtacatgccaggaggggtatcggggtgacggccaggtgtgtttgcctgttgacccatgccagatcaatttcggaaactgtccgacaaaatcaactgtgtgcaagtacgacggccctggtcaatcacattgtgaatgcaaagagcactatcagaacttcgtacccggtgtgggatgcagcatgactgatatctgcaagtctgacaatccttgtcaccgtaacgcaaactgtacaacagtggctcctggcaggactgagtgtatctgccagaagggctacgtcggagacgggctgacgtgttacggaaatatcatggaaagactgcgtgagctgaatacagagcctcgtggcaagtggcaggggcgattgactagcttcatttcccttctggacaaggcgtacgcctggcccctgagcaagcttggacccttcaccgtgctcttgcccacggacaaaggcctcaaggggttcaacgtcaatgaactcctcgtggataacaaagcagcccagtatttcgtgaagttacatatcatcgcaggccaaatgaacatcgaatacatgaataacactgacatgttctacaccttgacaggaaagtccggagaaattttcaattccgacaaggacaaccagatcaagctgaagctacatggaggcaagaagaaggtgaaaattatccagggagacattatcgcaagtaacggattgcttcacattttagatcgcgctatggataagctggaacctacttttgagagtaataatgaacagacaatcatgaccatgctgcagcccaggtactcaaaattccgcagtctgctggaggagactaatctcggccatgccctggatgaagacggggtggggggtccctacacaatatttgtaccaaacaatgaagccctgaacaatatgaaggacggcacgctggactacctcctgagtccagagggcagtaggaaactcctggagctggttcgctatcacatcgttcctttcactcagctggaagtcgcaacgctgatctccacacctcatatccggtctatggccaaccaattaattcagtttaacactactgataatgggcaaattctggcgaacgacgtggccatggaggagattgagataaccgccaagaacggaaggatctataccctgactggagtgctgattcccccttcaatcgtcccaattctccctcataggtgtgacgaaacaaagcgcgaaatgaaactcggaacctgtgtaagctgcagtctcgtttattggtcacggtgtcccgctaacagcgagcccaccgctctgtttacgcatcgatgtgtgtacagcggacggtttgggtcattgaagtccggatgtgcgagatattgtaacgccacagtgaaaatcccgaagtgctgtaaggggttctatggaccggattgcaatcagtgccccggtggattttccaatccctgtagtgggaacgggcagtgtgccgactctttaggcggtaatggaacctgcatatgtgaggaaggcttccaggggtctcagtgccagttttgctcagaccccaacaaatacgggcctagatgtaataaaaagtgtctgtgcgttcacgggacctgcaacaaccgcatagactcagacggcgcttgtttgactgggacttgtcgggacggaagtgccggacgcctgtgtgataagcagacttcggcttgtgggccttacgttcagttttgccacatccacgctacatgcgagtattcaaatgggacagcatcgtgtatctgtaaggccggatacgaaggagatgggactctgtgctcagagatggacccttgcaccggcttgactccaggtgggtgctcacgcaacgccgagtgtatcaagactggcactggaacccacacatgtgtgtgtcaacagggctggacaggaaacggaagggattgtagcgaaatcaataattgcctacttccctccgccggtggatgccatgacaacgcaagctgcctctacgtgggtcccggacaaaatgagtgcgaatgtaagaagggatttaggggtaacggcatcgattgcgagccaataacgtcatgtctggaacaaacaggcaaatgtcatccattagcttcatgccagtccaccagtagtggcgtatggagctgcgtgtgccaagaaggatatgaaggcgacggattcctgtgttatggtaatgccgcagtggaactgagtttcctgagcgaagccgctatctttaaccgttggatcaacaacgcgagtcttcagccaacgttgtctgctacttctaatctgactgttttggtacccagtcagcaggcaaccgaggacatggatcaggatgagaagtctttctggttaagccagtcaaacataccagctcttataaaataccacatgctcttagggacttatcgcgtggccgacttgcagacgctgtcctcatcagacatgctggccacctctttgcaaggcaactttcttcatcttgctaaagtggacggcaacatcacgatagaaggcgcttctattgtggacggcgataatgcagccaccaacggggtcatacacatcatcaataaggtgttggtccctcagaggagactcacaggatcactcccaaacttgctgatgcgcctggaacagatgcctgactactcaatcttcagaggctacatcattcaatacaatcttgctaacgccatagaggccgctgacgcttacacagtgtttgccccaaataataatgctattgagaattatattagagagaagaaggtgctttcactggaagaggatgtgcttcgctatcatgtggtcctggaggaaaagctgcttaaaaatgatctgcataacggaatgcacagggagaccatgctcggattcagctactttctctcattcttcctccacaatgaccagttatatgtgaatgaggcgccaattaactatactaatgtcgcgaccgacaaaggagtgattcatggcctcggtaaagtgctggagatccagaagaaccgatgtgacaacaacgacaccactattatccgcggacggtgtaggacatgtagttcagagttaacctgcccgttcggaactaagagtctgggaaatgagaaacgccgttgtatttacacaagttactttatggggaggagaaccctgttcatagggtgccagccaaagtgcgtaagaaccgtgattacacgggagtgttgtgcaggtttcttcggcccacaatgtcaaccatgccccggtaatgcccaaaacgtgtgctttggaaatggaatttgcctggacggagtcaatgggactggggtctgcgagtgtggagaaggattttcaggaacagcctgcgaaacttgtaccgaggggaagtatggcatccattgcgaccaggcatgctcgtgcgtacacggcagatgtaaccagggcccattgggcgacggttcgtgtgattgcgacgtgggttggcggggagtccactgtgacaatgctactactgaagataattgtaatggaacctgccacacttcagccaattgcctaacaaacagcgacggcactgcctcctgtaaatgcgctgccggattccagggcaacggaaccatctgtaccgctataaacgcatgcgagattagcaacgggggttgcagtgctaaggcggattgtaagcggaccacaccagggaggcgagtgtgcacctgcaaggcaggttataccggagacggcatagtgtgcctggaaattaacccctgcttggaaaatcatggtgggtgcgataaaaacgcggaatgtacccagacagggccaaatcaggccgcttgtaattgcctgccagcgtacactggggatggaaaggtgtgcacactgattaatgtttgcctgacgaaaaacggaggctgttctgaatttgccatttgcaaccatactggccaggtagaaagaacgtgcacatgcaagccgaattacatcggggatggcttcacttgccgcggatctatatatcaggaactgcctaagaacccaaagaccagtcagtatttttttcagctccaggagcattttgtgaaggacttagtggggcctgggccttttactgtgttcgctcccttaagcgcagcattcgatgaagaagctcgggtgaaggattgggacaaatacgggcttatgcctcaggttctccggtatcatgttgtggcatgtcaccagttgttactggaaaatctcaaattaatttctaatgctactagtcttcagggggagcccatagtcatctcagttagtcaatccactgtttacatcaacaataaagccaaaattatctcatccgacatcatctccactaacggaatagtacacataattgataagcttctgtcaccaaagaatctcctcattacaccgaaggacaacagcgggaggatcctccagaatcttaccactctagcgactaacaatgggtacattaagttctcgaacctcatacaagacagcggtctgctctcagtaataactgatcctatacacactcctgttacgctgttttggcctacggaccaggcactccacgctctgccggcagaacagcaggattttctgtttaaccaggacaataaggataagctcaaagaatatctcaaatttcatgtgatcagagacgccaaggtcttggctgttgatttgccaacctctaccgcatggaagactcttcagggtagcgaactctcagtgaagtgcggagccggtcgagacattggagacctttttctgaatggccagacatgtcgcatcgtgcagcgggagctcttgttcgatctgggtgtggcttacggaattgattgcctcctgatcgatccaaccctgggtggcaggtgcgacacgtttacaaccttcgatgcctctggggaatgcgggtcatgtgtaaacacgccctcatgcccgagatggtcaaagcccaagggagtcaagcagaaatgtctgtataacctccccttcaagcggaatctggagggatgccgggagagatgctctctagtcatccagataccgagatgctgtaagggatactttggccgagactgccaggcctgccctggagggcctgatgcaccctgtaacaataggggggtgtgcctagaccagtatagcgctactggggagtgcaaatgcaacacgggattcaatggcaccgcgtgcgagatgtgttggcctggacgattcggcccagattgcctgccctgcggttgtagcgaccatggtcagtgcgatgacggaatcacggggagcgggcaatgtctgtgcgaaacaggctggacaggcccatcctgtgatactcaggctgtgctcccggctgtgtgtaccccaccgtgcagtgcccatgctacttgtaaagagaataacacgtgcgagtgcaatctggactacgagggagatggcatcacctgtaccgtcgttgacttctgcaaacaggacaacggcggatgtgccaaagtggcgcgttgctcacaaaaaggtacaaaggtgagctgctcatgtcagaagggttataaaggcgacggacactcttgtacagagattgacccctgcgctgacggcttaaatgggggatgtcacgagcatgccacatgtaaaatgaccggcccaggtaaacacaaatgcgaatgtaagtcacattatgtgggagacggactgaattgtgagcccgagcagctccctatcgacaggtgtcttcaggacaatggacaatgtcatgctgacgctaaatgcgtggacctgcacttccaggatacaacagtgggagtgtttcacttgcgctcccctcttggtcagtacaaactgaccttcgacaaagccagggaagcatgtgctaatgaggctgctaccatggccacttacaaccaattatcctatgcccagaaggcaaaatatcacctttgcagtgcagggtggttagagacggggagagtcgcctatcctaccgcctttgcctctcagaactgtggatcgggtgtggtggggatcgttgactacgggccacgcccaaacaaaagtgagatgtgggatgtgttttgttatcgaatgaaagatgtcaactgtacatgcaaagtcggatatgtgggagacggattttcttgcagtgggaaccttctacaggtactaatgtccttcccgtccctgaccaatttcctgaccgaagtgttggcctactcaaactcttcggcgagagggagggctttcctggagcatttgaccgatttaagtatccgtggcactcttttcgtaccgcagaactccggtctcggcgaaaacgagactctctctgggagggatatcgagcaccacctcgccaatgtatccatgttcttttataacgatctcgtgaacgggaccacgttacaaactcggctagggtctaagcttctgataacagccagccaagaccctttacaaccaaccgaaactaggtttgtcgacgggagagctatattgcaatgggatatattcgccagtaatgggataatccacgtcatatctagacccctgaaggcaccgcctgccccagtgacactgacccacactggtttgggcgctggtatcttttttgcgatcatcctggttacaggggctgtggccctcgccgcttattcttacttccgtataaaccgcagaactattggattccaacatttcgagtccgaggaggacatcaatgttgcggctctgggaaaacagcagcctgaaaatatctccaatcctttgtacgaatcaacgacgtctgcaccccctgaaccttcttacgatcctttcactgactctgaagaacgccagctagaaggcaacgatcccttacgaacccttta

SEQ ID NO: 54566 - DNA, 1077 bp, Artificial Sequence
  Description of Artificial Sequence: Synthetic coding sequence
atgggggctgtgtggagcgcgttattggttggaggcggtctcgcaggggctctgttcgtatggctgctgcgagggggtccaggggatacgggaaaagatggcgacgcggaacaggaaaaagatgcaccgcttgggggtgcagcaataccaggaggccaccagagtggttcctcggggctctctccgggtccttctggtcaggagctcgtgacgaagcctgagcatctgcaggagagcaatggccacctcatcagcaaaactaaagacttaggcaaactgcaggctgcgtcctggcggctgcaaaaccccagtcgggaagtttgtgataactcccgggaacacgtgcccagtggccaatttccggatacagaggccccagccactagcgagacgtccaattccagaagctatagtgaagtgtccaggaatgagagcttggaatcccccatgggagaatggggattccagaagggtcaagagatctccgccaaggccgcaacgtgcttcgccgaaaaattgcctagctcaaacttgttaaagaatagagcaaaagaggagatgtctctgagcgatctgaatagtcaggatcgagttgaccacgaggagtgggagatggtgcccaggcattccagttggggggacgtgggggttggtggatccctgaaagcacctgtgttaaacctgaatcaggggatggataacgggcgatccacactggtcgaagcccgtggacaacaagttcatggcaagatggagagggtggcggttatgcccgctggctcacaacaggtgagtgtgaggttccaggtgcattatgttacctctacagacgttcaattcatcgcagttactggcgatcatgaatgtttgggcaggtggaacacctatattccacttcactacaataaggacggcttctggtctcacagtatcttccttcccgctgacactgtagtcgaatggaagttcgtcttggtagagaacggcggagtgactcgttgggaagaatgcagtaataggttcctggagactggacacgaagataaggtcgtgcacgcatggtggggcatccactag

SEQ ID NO: 54567 - DNA, 630 bp, Artificial Sequence
  Description of Artificial Sequence: Synthetic coding sequence
atgggtgaatggggcttccagaaaggccaggagatctctgcgaaggccgcaacctgcttcgctgagaagctgccttcctccaacctgctgaagaatcgtgctaaagaggagatgtccctttccgatctgaacagtcaggatcgggtagatcatgaggagtgggagatggtgccgaggcactcatcctggggggacgtgggagtgggcggatctctcaaagccccagtactgaatttaaaccaaggtatggacaacggccgatccaccttggtggaggcccgagggcaacaggtacacggcaaaatggagcgcgttgccgtgatgcctgccggttcccagcaagtcagtgtcaggttccaggtgcattatgtcacatctaccgatgtgcagttcatcgcagttactggcgaccacgaatgcttaggcaggtggaatacctatattccactgcattataataaagatgggttctggagccactcaatttttctgcccgctgacaccgttgtagaatggaaattcgtgctcgtcgaaaacgggggagtgactcggtgggaggagtgttcaaaccgtttcttagaaactggccatgaagacaaagtcgtacacgcttggtggggcatccactag

SEQ ID NO: 54568 - DNA, 1113 bp, Artificial Sequence
  Description of Artificial Sequence: Synthetic coding sequence
atgctgccacgcagactactcgctgcctggttggcaggcacacgcggaggcggtctgctcgcactgttagcaaaccaatgccgttttgtgaccggtttgagagtgcgcagggctcagcaaattgctcagctgtatggtcgcctttactcagaatcctctagacgcgtgttgctcgggcgactgtggcggaggttacatgggcgtccagggcacgcatcagctctgatggcagccctagccggtgttttcgtctgggatgaggaaaggattcaggaagaggagctccagagaagcatcaatgaaatgaagcgcctagaggaaatgtccaatatgttccagagcagcggggtgcaacaccatccgccagagcccaaagctcagactgaaggcaacgaggatagtgagggaaaagagcagcgatgggaaatggtcatggacaagaaacacttcaagctgtggagaagacctataacagggacccacctgtaccaatatagagtgttcggaacctacaccgatgtgacccctcggcagtttttcaatgtgcagttggataccgaatatagaaaaaaatgggacgcacttgttattaaactcgaagtaatagagcgggatgtagtgtccgggtctgaggtgctgcactgggttacgcattttccttatccaatgtatagccgtgattacgtgtatgtgagacgatacagcgtcgaccaagaaaacaacatgatggtactggtgtcacgcgctgtggagcacccatcagtgcctgagtcgcccgagttcgtgagagtgaggagctacgaaagccaaatggtaatcaggccccacaaatcatttgatgaaaacggttttgactacctgctgacctattcagataatccccagaccgttttccctaggtactgcgtgtcatggatggtgtcgagcgggatgccggacttcctggaaaagctgcacatggctactcttaaagctaaaaacatggaaattaaggtcaaagactacatctccgctaaacctctggagatgtcctcagaagcgaaggccacaagccagagtagcgagcggaagaatgagggctcctgcggacccgcaagaattgaatacgcgtag

SEQ ID NO: 54569 - DNA, 738 bp, Artificial Sequence
  Description of Artificial Sequence: Synthetic coding sequence
atggagagcagaaaggatattactaaccaagaggagatatggaagatgaagccgcgaaggaaccttgaagacaatgactatctgcagacagctcacgctgacgagttcgattgtccgtccgagctgcagcacgcgcaagagctgttcccacagtggcatttaccaataaaaattgcagccgtcatggcttctcttaccttcctgtacactctactgagggaggtgatccacccactggctacctctcatcagcaatatttctataaaattccgatcctggtcattaacaaggttctgcccatggttagcattacccttctggcgcttgtatacctacccggtgtcatcgccgcaatagtgcaagtacataacggcacaaagtacaagaagtttccacattggctagacaaatggatgctaacacgcaagcagttcggcctcctgtctttgttttttgcagtgctccacgccatctataccctgagttacgccatgagaagaagctaccgatacaagttactgaactgggcttaccagcaagtgcaacaaaataaggaggatgcttggattgagcatgatgtttggcgcatggaaatctacgtgagtctcggaatcgtcgggttggccattctcgccctccttgccgtgacctccattcctagcgtgagcgacagccttacgtggagagagtttcactatatacaggtacacggaaggattaactttctgacactatag

SEQ ID NO: 54570 - DNA, 765 bp, Artificial Sequence
  Description of Artificial Sequence: Synthetic coding sequence
atggagtcccggaaggacataaccaaccaggaagagatctggaagatgaaacccaggaggaacctggaggataacgattacctccacgaggacactggagaaacttctatgttaaaacgacccgtccttctgcacttgcagcagacagcccatgctgacgaatttgactgtccaagtgagcttcagcacgctcaggagctcttcccacagtggcatctgccgataaagatcgccgctgttatggcctcgctgacctttctatacaccctgcttagagaagtgattcaccctctagccacaagtcatcagcaatacttttataaaattccaatcttggtcattaacaaggtgctgccaatggtctctattacattgcttgccctggtctacttacccggtgtaatcgccgcaattgtccaagttcataacggtactaaatacaagaagttcccccactggctcgacaaatggatgctcacccggaagcagtttgggttgctgagcttattctttgcggtgctgcatgccatttacactttgtcttatgccatgcggaggtcctatcggtataagctgctaaactgggcgtatcagcaggttcagcagaacaaggaggacgcgtggattgaacatgacgtctggcgcatggaaatctacgtctcattgggcatcgtcgggctggccatcctggctctcttggcagtcacctcaatcccttcagttagcgattctcttacttggcgagagtttcactacatccagtag

SEQ ID NO: 54571 - DNA, 1029 bp, Artificial Sequence
  Description of Artificial Sequence: Synthetic coding sequence
atggagagcaggaaggatattacgaaccaggaggagatttggaaaatgaagcctaggagaaatttggaggataatgattatctccatgaggacaccggcgagacgtccatgctgaaaagacccgtcctgttgcatctgcagcagaccgcacatgccgacgagttcgattgtccctctgaactccaacacgcacaggaattgtttcctcagtggcatctcccaattaagatcgccgctgttatggcttcccttacctttctttacacactgcttcgcgaagtgattcatccactggctacatcacatcaacagtacttctacaaaattcccatcctcgtgatcaataaggttttgcctatggtcagcattacacttctggccctggtctacttaccgggagtgattgctgccatcgtccaagtgcacaacggtaccaagtacaaaaagtttccccactggctggacaaatggatgcttacccgcaagcagtttgggctgctgtcactgttctttgctgtccttcatgctatctacaccctgagctatgcaatgcggaggtcctatcgctacaagctgttgaactgggcatatcagcaggtccaacaaaataaagaagacgcttggatcgagcatgacgtgtggcgcatggaaatttatgtttctcttggcattgtggggttagcgatcctcgctctgttagccgttaccagtattccatctgtttctgatagcctgacatggcgggagtttcattacattcaagcaattctgacaggctcgcttgttgcactttgcaacttccaggcgacaaagctggcaaagacccagcttgtcggaactccaaacttttggcaggagcagcagtgtggtatccattttcctccgccaagtaaaacgcgctcatatatatacttcattttgagcgctgcctcgccttctaagggtaacgtctcatcgcatatgtttcagttgcatctagaaaacctgaacaagaaagacaagttactcctgatcatattccagatctag

SEQ ID NO: 54572 - DNA, 771 bp, Artificial Sequence
  Description of Artificial Sequence: Synthetic coding sequence
atgccaggcccagccaccgacgcaggcaagatccctttctgtgatgccaaggaggaaatccgggcaggattagaatccagcgagggaggaggcggacccgaacgcccaggggctcggggtcagcgacaaaatatcgtatggagaaatgtggtgttaatgtctctactgcacctgggtgctgtatatagtctggtactcatcccaaaggcaaagcctctaaccctgctttgggcctacttctgctttttactggcagctctaggggttactgccggtgcccacagactttggtctcacagatcatatagggctaagcttcctcttagaattttcctcgctgtagccaatagtatggcgtttcagaacgacatatttgagtggtcacgggatcatagggcccatcacaaatactcagagactgatgccgacccccacaacgcccgtagaggctttttcttctcccacatagggtggctgttcgtccgaaagcatcgggatgtgattgaaaaggggagaaagctcgacgttactgatctgctggctgaccccgtagtgaggattcagcgcaacacccaacacattcagaaggagggacgcgctttgaaccaggaagctgcctgcgaaatgctgcgcgaatggcaccaaggccatatcctcaaggtaaccctccctggactccacatcctggccctcttgcatacacattgtaatcattctgagaaatgctgcctcatgctgagggcactaagtgtgtctctggaggtgttctag

SEQ ID NO: 54573 - DNA, 399 bp, Artificial Sequence
  Description of Artificial Sequence: Synthetic coding sequence
atgcccggtcctgccacggacgcagggaaaatcccgttctgcgacgccaaagaggaaatccgggcagggctcgagagttcagagggcggaggtgggcctgaaagacctggcgctagggggcaacgtcaaaatatcgtgtggagaaatgtggtactaatgtccctgctgcatttgggggctgtgtatagtctcgtattgatacccaaggcgaaaccacttaccctgctgtgggcttatttttgcttcttactagcagcactgggagtcaccgcaggagcacatcgactgtggagtcatcggagttaccgagccaagctacctctccggatctttctggccgtcgccaattcaatggccttccaggctgcagcagaagtggttctgacgcaaatgccctag

SEQ ID NO: 54574 - DNA, 993 bp, Artificial Sequence
  Description of Artificial Sequence: Synthetic coding sequence
atgcccggacctgccaccgatgcgggaaagattccattctgtgacgctaaggaggagattcgcgcagggttggaaagctctgaaggcggtggcggaccggaacgccctggagctaggggacagaggcagaatatcgtatggaggaatgtggtgctgatgagcctcctgcatttgggggctgtgtactcgctggtgctcatccctaaggctaaacctttaacacttctgtgggcctatttctgcttcctgcttgccgctcttggcgtcaccgcgggtgcacaccgcctctggtctcacagaagctatcgagctaaactacccttgaggatatttctggcagtcgctaactcaatggcctttcagaacgatatcttcgaatggtccagggaccacagagctcaccataagtactcggagaccgatgctgacccacacaacgcacgacgtgggttctttttcagccacattggctggctgttcgtgaggaaacaccgagatgttatcgaaaaggggagaaagctcgacgtcaccgacctgcttgccgatccagttgtgcgcatccaacggaaatactataaaattagcgtggtcctgatgtgcttcgtcgttcctactctcgtcccttggtacatatggggggagtccctttggaatagctacttcctcgcgtctatccttaggtacacaatatcactcaatatcagctggcttgtgaacagcgcagcccacatgtatggcaatcgaccatacgacaagcatattagtcctaggcagaaccccctggtcgctcttggggctattggagaagggttccataactatcaccatacatttcctttcgactacagcgcctctgaatttggcctgaatttcaatcccacaacttggttcatcgatttcatgtgttggctgggtttggccaccgacaggaagcgcgcaacaaagccgatgatcgaggctagaaaggccagaaccggcgacagtagcgcgtag

SEQ ID NO: 54575 - DNA, 867 bp, Artificial Sequence
  Description of Artificial Sequence: Synthetic coding sequence
atggccgagaagagacatacacgtgactctgaggctcagcggctcccggatagtttcaaggattctccaagcaaggggctcggaccctgcggttggattctggtcgctttctccttcctcttcacagtaatcacatttcctatatctatatggatgtgcataaaaataattaaggagtacgagcgggcaatcatttttagactcggacggatcttacagggaggtgccaagggcccaggcctgttcttcatcctgccatgtaccgactcttttataaaagtggacatgcgtacaatttcattcgatataccgccacaggaaatcttgaccaaggattctgttactattagcgttgatggtgtggtttactatcgcgttcagaatgccaccctcgcagtcgcgaatatcaccaacgccgattccgcaacaaggctcctggcccagacgaccctccgcaacgtgctcggtacaaaaaatctatctcaaatcctctcggatagagaggaaatcgcccacaatatgcagtccaccctcgacgatgctacagacgcttggggcatcaaggttgagagggtcgaaatcaaagacgtgaaattacccgtccagctgcagcgggctatggctgctgaggcagaagcatcacgggaggctagagcaaaagtgatcgcagccgagggggagatgaatgccagtagagcgttgaaggaagctagcatggtgatcaccgaaagccccgctgccctacagctccgatacctgcagacactgaccacaatcgccgcagagaaaaacagtacgattgtcttccctctccccattgatatgctacaaggaataatcggcgctaagcattcacatctcggctag

SEQ ID NO: 54576 - DNA, 372 bp, Artificial Sequence
  Description of Artificial Sequence: Synthetic coding sequence
atggctgaaaaacggcatacacgcgattccgaggcccaacggctgccagattcttttaaggacagcccatccaagggcctaggcccatgtggatggatccttgtagcctttagctttctatttactgtcatcacatttccgatctctatatggatgtgtattaaggttattgccgcagaaggggagatgaacgcttcacgagcccttaaagaggcctctatggtgattacggaatcccccgcagcattgcagcttagatatctccaaacactgactaccattgcggctgagaaaaattccaccatcgtctttccgctgccaattgatatgctccagggcattatcggcgctaagcatagccatctggggtag

SEQ ID NO: 54577 - DNA, 714 bp, Artificial Sequence
  Description of Artificial Sequence: Synthetic coding sequence
atgtgtataaagattattaaagagtacgagcgtgcaatcatattcagattaggtcgaattctgcaaggaggcgctaaaggtccaggcctttttttcatcttgccctgtaccgacagttttatcaaggtggacatgcggactatttcctttgatattccccctcaagagatactgacgaaagatagtgtgactatatctgtggatggcgtggtgtattaccgggtgcagaacgcaaccttagcggtggccaacattaccaacgcagatagcgcaacaaggctgctggcacagacgaccctccggaatgttctgggtaccaagaatttgtctcagatactgtctgatagggaggaaatcgctcacaatatgcagtccacattagacgacgccaccgacgcctggggcatcaaagtagagagggtagagattaaggatgtcaagctcccggtgcaacttcagcgcgcaatggccgcagaagccgaggcctcgcgagaggcaagagcaaaggttattgccgcagaaggtgaaatgaacgcttcaagggcactaaaagaagctagcatggtgatcacagaaagccccgcagcattgcagttgagatatcttcaaactctcaccacaatcgctgccgaaaaaaactctaccatcgtcttcccactcccaatcgatatgctgcagggaataatcggcgctaagcactcccaccttggatag

SEQ ID NO: 54578 - DNA, 3549 bp, Artificial Sequence
  Description of Artificial Sequence: Synthetic coding sequence
atgtgcagtacaaaccctggaaagtgggttacatttgacgatgacccagcagtgcagagttcccaaaaatcaaaaaacttccccctagagaaccagggcgtctgtcgacctaacggcctaaaactgaatctgccaggtctgcgtgaatttcctagcggctcaagttcaaccagctccacgcctctgtcatcgccaattgtggatttctacttctccccgggacccccttccaactcacccttgagtacccccacaaaagactttcctgggttcccgggtattccgaaagctgggacccacgtcctttatccgatacccgaatctagctccgacagcccactcgccatatctgggggagagagctcccttcttcccactcggcctacctgtctcagccacgcactgctgccatccgatcactcctgtacgcacccgactcctaaggtgggactgccggacgaggtgaatccccagcaggcagaatccctggggtttcagagcgacgacttaccccagttccaatattttagggaggactgtgcattctcttcccctttctggaaggatgaggggagcgattcacatttcaccctggaccctcccggttcaaagaagatgtttagcagcaggaataaagaaatgccaatcgatcagaagtccctcaacaagtgcagtcttaattacatctgcgagaagctggaacacctccaaagcgcagagaaccaagactcacttagatccctgtcgatgcactgtttgtgcgctgaggaaaacgccagctcctttgtgcctcacaccctctttaggagtcagcccaaaagcggttggtctttcatgctgcggatccccgaaaagaaaaacatgatgtctagcagacagtgggggcctatattcttgaaagtgcttcccggaggtatcctgcaaatgtactacgaacaaggattggaaaaaccatttaaggagatccaactggacccatactgcagattgtcagaacctaaggtggagaattttagcgtggctgggaaaatccatacagtcaaaatcgagcatgtgtcttataccgaaaaaaggaaatatcattctaaaaccgaagtggtgcacgagcctgacatcgaacagatgctcaagctggggagcacaagctatcatgactttctggattttctgacgacagtggaggaggaactcatgaaactccctgctgtgtccaaacccaagaagaactacgaagagcaggaaatctcactggagattgttgataacttttggggaaaggtgacaaaggagggaaaatttgttgagtcagcagttatcactcaaatttactgtctgtgttttgtgaatgggaatcttgagtgttttctcacactgaacgatcttgagctccccaaacgggacgagtcttactacgagaaggactcggagaagaagggcatcgatatactcgattaccactttcacaagtgcgtcaatgtccaggaatttgagcagtctcgcattattaagttcgtaccgttggatgcatgccggtttgagctgatgcggtttaagaccctgtacaacggtgacaaccttccattctctcttaagtcagtggtggtggtgcagggggcatacgtggagctgcaggcctttgtaaatatggcttcactggcacaacggtcaagctacgcgggaagtctccgatcgtgtgacaacatccggatccacttccctgtgccctcccagtggattaaagctctgtggactatgaaccttcaaagacagaagagcctgaaagccaagatgaatcgcagagcgtgcctgggctcactacaggagcttgagtcagagcccgtaatccaggttaccgtcggtagtgccaagtacgaatccgcctatcaggccgtggtgtggaagatcgacagattgcccgacaagaactccagcctggaccacccccattgtctgtcatataaactggagcttgggagcgaccaagagattccatccgactggtacccttttgccaccgtccagttttctgtcccagacacctgcgcctcccgaactgaggttcgcagtctgggtgtagagagcgatgttcagccccagaaacacgtgcagcagagggcatgttacaatattcagccaaaactttatcgcagcgttatagaggacgtcatcgagggcgtaagaaatttatttgccgaagagggaattgaggagcaggttctgaaggatctcaagcagctgtgggagacaaaggttcttcagtcgaaagccaccgaggacttttttagaaattccatccagtcacctcttttcaccctgcagctgccccactctttacatcagacattacaatcgagtacagcctccctagtgattcccgctggacgaactctgcctagtttcacgaccgcggagctgggaacatctaattcctctgcaaactttaccttcccaggatatccgatacatgtccccgctggagtcactctgcagaccgtatcgggccatttgtataaggtgaacgtgcccataatggtaacagagacctccggcagagcgggaatcctgcagcatcccatccagcaggtgtttcagcagctcggtcagccctcagttatccagacaagcgtcccgcaactgaatccctggagtcttcaagccaccacagagaagtcccaacggattgagaccgtccttcagcaacctgccattttgccaagtggtcctgttgataggaagcacctggagaacgcaactagcgatattctcgtatcccctggcaatgagcacaaaatcgtccctgaggctctcttatgtcaccaagaaagctcccactatatttcactgcccggagttgttttctcaccacaagtatcccagaccaattcgaatgttgaaagcgttcttagcggaagcgcctcaatggcacagaacctccacgatgaatctctctctactagtccccacggcgctctccaccagcacgtaactgacatccagctgcatatcctgaaaaacagaatgtacggttgcgattcagtgaaacagcccaggaatattgaggagccctctaacatacccgtcagcgagaaagacagcaatagccaggtggatctaagcattcgggtcacagatgacgacataggggagatcatccaagtggacggcagcggggacacctcctcgaacgaggaaatcggctccaccagggatgcagacgagaatgagttcctgggcaacatagacggcggtgacttaaaagtgccagaggaagaagccgattccatctcgaatgaagactccgcaacaaatagcagcgataacgaagaccctcaggtaaatatagtggaagaagaccccctgaatagcggcgacgatgtgtccgagcaggacgttcccgacttatttgacacggataacgttatcgtgtgtcagtacgacaagatccacagatcaaaaaataaatggaagttctatctgaaagatggagtgatgtgctttggagggagggattacgtgttcgcaaaggccatcggcgacgctgagtggtag

SEQ ID NO: 54579 - DNA, 1434 bp, Artificial Sequence
  Description of Artificial Sequence: Synthetic coding sequence
gcatgtctttttctgatccctaaactctacagaagtgtaatcgaggatgtgattgagggcgtgaggaatctgttcgctgaagaggggattgaggagcaggtgctaaaagatctgaaacagctgtgggagactaaggtgctgcagtcaaaggccacagaagacttcttcagaaatagcattcagagccccctgttcacattgcagctgccccactcccttcaccagactctccaatcttctaccgcatctctagtgatcccggctgggagaacactgccttcattcactacggccgaattagggaccagtaatagctcagccaattttacattcccaggataccctatccacgtgcccgcaggcgtaacactccagacagtcagcggccacttatacaaggtgaatgttccaataatggtcaccgaaacctccggccgtgccggtattcttcaacacccaattcagcaggtcttccagcagctgggacagccaagcgtcatccagacctccgtgccgcagttgaacccatggagcctccaagccaccactgagaagagccagaggatagagacagtgctccagcaacctgccattctacctagcggtccagtggatcggaaacaccttgagaacgccacctctgacattctggtatcacctggcaatgagcataagattgtgcctgaagctcttctctgtcaccaagaaagtagccactacatctcgctccccggagtggtattcagcccccaggtgagccagacaaatagtaatgtggaaagtgtcttgagcggatccgccagcatggcgcagaacctgcacgacgagagcctcagcaccagtccccacggtgccctccaccagcacgtgacagatatacagctccatattttgaaaaaccggatgtacgggtgcgactcggtcaaacagcccaggaacatcgaggagccatctaatatacctgtgtcagagaaggattctaatagtcaggtggacttgtctattagagtgacagatgatgacattggggagatcatacaggtcgatggctctggagatacatcatccaatgaggagataggctctactagagacgccgacgagaatgagttcctgggtaacattgacggcggtgacctgaaggtgcccgaggaagaggccgattcaatctccaatgaggattccgcaactaactcttcggacaatgaggatccacaggtgaatatagtcgaagaggatcccctcaatagcggagatgacgtgagcgagcaggatgtgcccgacctgtttgacaccgacaacgttattgtttgccagtatgataagatccaccgctccaagaataagtggaaattttaccttaaggacggggtaatgtgttttggaggacgcgactatgttttcgccaaagctataggggatgcagaatggtag

SEQ ID NO: 54580 - DNA, 3408 bp, Artificial Sequence
  Description of Artificial Sequence: Synthetic coding sequence
atgtgctcaacaaatcccggaaagtgggttaccttcgatgatgacccagctgtccagagctcccaaaaatcaaagaacttcccactggaaaaccagggggtctgtcgtcctaatggcctgaaactgaatcttccaggcttgcgagaatttcctagcgggtctagttccacgtcaagcacgccactgtcgtcacccattgtggacttctacttcagcccgggtccaccgagtaactccccactatctacgccaacgaaggactttcccggtttcccgggaattcccaaagcgggaacccatgtcctttatcccatacctgagagcagctctgatagccccctggcgattagcgggggagaatcatccctgcttcccacacgcccaacatgcctctcccatgctctgctgccctctgatcacagttgtacccatcccaccccgaaggtgggactgccagatgaggtgaatccccaacaggccgagagtctaggcttccagtccgatgatttgcctcagtttcagtacttccgggaggattgtgcctttagtagtcctttttggaaagatgagggctcagatagccattttactttggaccctcccggttctaagaagatgttcagctctagaaataaagaaatgcccatcgatcagaagtccctgaataagtgttccctgaactacatatgcgaaaagttagaacacctacagtccgccgaaaaccaggatagcctgaggagcctgtcgatgcactgtctgtgcgcagaagagaatgcctcatccttcgtgccacacacattgttcagaagccagcctaaatctggatggagttttatgctgcggattcccgagaagaagaacatgatgtctagcaggcagtggggacctatcttcttaaaggtcctacccggaggtattctccagatgtactacgaacagggactcgaaaagccgtttaaggaaatccagctggacccatactgcagactgagtgagccaaaagttgaaaatttttcggtggccggtaaaattcataccgttaagatcgaacacgtttcctacactgagaagagaaagtaccacagcaagacggaggtggtgcacgaacctgacattgaacagatgctaaagttgggcagtacaagttaccacgactttttggacttccttacaaccgttgaggaggagttgatgaagcttcccgcagtgtcgaaacctaaaaaaaactacgaggagcaggaaattagtctggagatagttgacaatttttggggaaaggtgaccaaggaaggcaaatttgtcgagagtgcagtgataactcagatctattgtttgtgctttgtgaatgggaacctcgagtgtttcctcacccttaacgacttggaactgcctaagagagacgagtcgtattacgagaaagactctgagaaaaaaggcattgacattctagactatcattttcacaagtgcgttaatgtacaggagtttgaacagtccagaattatcaaatttgtccctttggatgcttgcaggtttgagctgatgagattcaagacactgtacaacggggataacttgccgttcagcttgaagagcgttgtggtagtacaaggagcttatgtcgaattgcaggctttcgtcaatatggctagccttgctcagcgctcatcttacgccggttctctgcgatcatgcgacaatataagaattcactttcccgtgccctcgcagtggattaaagcattgtggacaatgaacctgcagcggcagaagtccctcaaagcaaaaatgaacaggcgtgcctgcctggggtcactgcaggagctggagtcggagcctgtgatacaggtgaccgtcggctccgctaaatatgaaagcgcataccaggcggtggtctggaagatagaccggctgccagataaaaattcaagccttgatcacccccattgtctgagctacaaactggagctaggtagcgatcaagaaattccaagtgactggtacccttttgcgactgtgcagtttagtgtgcctgacacttgcgcctcacgtactgaagttagatcactaggggtggaatcagacgtccagcctcaaaaacacgtgcagcagcgggcatgttacaacatccaaccgaaattataccggagcgtgattgaagacgttattgagggagtccggaatctgttcgccgaggaaggaatagaagaacaggtcctaaaggacctaaaacagctgtgggaaacgaaagtgctgcagtccaaggcaaccgaggactttttcagaaattcaattcaaagtccactctttactttacaattgcctcatagtctccaccagacattacagtcaagcaccggccacctgtacaaagttaacgtcccaatcatggtcacagagacatccggcagagcaggtattctgcaacatcccatacagcaggtgtttcagcaactaggccaacccagtgtcatccaaacttccgtgccccagctcaacccctggtcactgcaggctaccaccgaaaaaagccagagaattgagacagtgctacaacaaccagcaatcttaccaagcggccctgtggatcggaaacacctggagaacgcaacttctgacatactcgtgtcacctggaaatgaacataaaatagtgcccgaggcgctcctgtgccaccaggaatcttctcactatattagcctgcccggtgtggtgttttcccctcaagtttctcagacaaatagcaatgtcgaatcagtcctgtccgggtccgccagcatggcacagaacttgcacgacgaatccttgagtacgagtccgcacggagccctgcatcagcacgtcacagatatacagctgcacatccttaagaaccgcatgtacgggtgcgatagcgtcaagcagcccaggaacatcgaagaaccttccaatattcccgtgtcagaaaaagactctaattcccaggtggacctgagtataagggtcactgacgacgatatcggtgaaatcatccaggtagacggctccggtgatacatccagcaacgaggagatcggatcaaccagagacgcggacgagaacgaattcctggggaacattgatggaggagacttgaaggtccccgaagaggaagccgactccatcagcaatgaggacagcgctaccaactccagcgacaacgaggaccctcaggttaacattgtagaggaggaccctcttaattcgggggatgatgtgtcagaacaggacgtcccagacttgtttgataccgataacgtgattgtctgtcagtacgacaaaatccacaggtctaaaaataagtggaagttctatctgaaggatggcgttatgtgtttcggtggaagggattacgtattcgctaaagctatcggcgatgctgagtggtag

SEQ ID NO: 54581 - DNA, 3549 bp, Artificial Sequence
  Description of Artificial Sequence: Synthetic coding sequence
atgtgcagcactaatccaggaaaatgggtgaccttcgacgatgaccccgcagttcagagttctcagaagagtaagaatttccccctcgagaatcagggagtatgccggcctaacgggctgaaattaaatttaccagggctgagagagtttccatccggttcgagcagcacgtctagtactccgttatccagccctatagtggatttttacttttctcctggtccgccatccaattcgcccttgtccacccccactaaggattttcctggcttccctggcattcctaaggccggaacacacgtgctgtacccaatcccggagtcaagctctgatagccctctagccatttccgggggtgagagctccctgctgcccactagaccgacatgcctgagtcacgccctgttgccctctgaccacagctgtacccaccccactcctaaagtgggattgccagatgaggtcaatccacaacaagctgagagcctgggcttccagtccgacgacctgcctcaatttcagtatttcagggaggattgcgctttcagctctccgttctggaaagacgaagggagcgacagccacttcaccctcgatccccctggctcaaaaaaaatgttttcctcaaggaacaaagaaatgccaatagatcagaagtcactaaataagtgcagtttaaattacatctgcgaaaagctagaacacctccagagcgccgaaaaccaagattcgttacgttccctctccatgcattgtctttgtgccgaagaaaatgcgtcaagctttgttccccatacactgtttaggagccaacctaaatccggctggtccttcatgcttcggattcctgagaaaaagaacatgatgtcgtcccgtcaatggggtcctatctttttgaaggtccttccgggagggatcctgcagatgtactatgaacaaggtctggagaagccttttaaagaaattcagcttgacccatactgccgcttatctgagccaaaagttgagaatttttctgttgccggaaagatacataccgtaaagattgaacatgtgagctatacggaaaaaagaaagtatcattctaagacagaagtagtgcatgaacccgacatcgagcagatgttgaagctcgggtccacttcttaccacgatttcttagacttcctgacaacagtggaagaagagctaatgaagttaccagccgtgagcaagccgaagaaaaactatgaggaacaggaaatcagcctggagatagtggacaatttttggggaaaggtcaccaaagaggggaagttcgtagagagtgctgtcatcacccagatttactgcctttgtttcgtgaatgggaacttagagtgttttttgactctgaacgacctagaactgccaaaaagggacgaatcatattatgaaaaggattccgaaaagaaggggattgatatcctagactaccatttccataagtgtgtgaacgtccaggaatttgagcagtcccgcattatcaagtttgtcccccttgacgcctgtcgctttgagctcatgcgattcaagaccctctacaatggggataatctgcctttttccttgaagtccgtggtggtcgtgcagggagcctatgttgagctgcaggcttttgttaatatggctagtctggcccagagatcaagctacgcgggttccctgcgctcctgtgacaatatccgaatccatttcccagtgccttcgcagtggattaaagccttatggactatgaaccttcagcggcaaaaaagcctgaaggccaagatgaaccgcagagcttgtctaggtagcctgcaagaactggagtccgagccagtcatccaggtgacagtcggatcagccaagtatgaatctgcgtaccaggccgtggtgtggaaaatcgatcgcctgccagacaagaactcctcactggaccacccacattgtctgtcctataagctagaacttggatcagatcaggaaatcccttccgactggtatcctttcgctaccgtacagttcagcgttcctgatacttgtgctagtagaaccgaggttcgatccttaggggtcgagtctgatgtccagccgcagaagcacgtacagcagagagcctgctataacatccaaccgaagctgtatcggtccgtgattgaagacgttattgaaggggtgcggaacctcttcgccgaggaagggatcgaagagcaggtactcaaggatttgaaacagttatgggagacgaaggtcctccagagcaaagcaactgaggactttttcagaaacagtatacagagtccactgtttacactgcaactgccacattcccttcatcaaactctgcagagctccaccgcttcattggtgataccagcagggcgaactctcccctcttttaccacagcagagctcggaaccagcaatagctcggctaatttcacatttcccggttacccaattcacgttcctgccggtgtcactctgcagacagtttccggccatctgtacaaggtgaatgtgcctattatggtcaccgagaccagtggcagggcagggatactccaacaccccatccagcaggtgtttcagcagctagggcagcccagcgtgatccagacctccgtccctcagcttaacccctggagtcttcaagccactaccgagaagtcgcagcgtatcgagactgttctgcagcagcctgccatcctcccatccggcccagtcgatcggaagcacttggagaacgctacaagtgacattctggttagccctggcaacgaacacaaaatcgtgcccgaagccctgctgtgccatcaggagagctcccactacatctcactccctggcgtggtgttctctcctcaagtgagtcagactaattcaaacgtagaaagcgtgctctctggcagcgcctctatggctcaaaatctacatgacgaatcattaagcacctctccacatggcgcactgcaccagcatgtgaccgacattcagctgcacatacttaagaaccgcatgtatggctgtgattcagtgaagcagcccagaaacatcgaagagccaagcaatatacctgtgagcgaaaaggactccaacagccaggtcgacctgagcatcagagtgactgacgatgatatcggagaaataattcaggttgacgggagcggggacacttcttcaaacgaggagatcgggtccactcgagacgcagacgaaaacgaatttctggggaacattgatgggggagacttgaaggtgccagaggaggaggcagactctattagtaacgaggactcagcaactaacagctcagataacgaagacccgcaggtcaacattgtggaggaagatcccttgaatagcggggacgacgtgagcgaacaagatgttcccgatctattcgacactgacaatgtcatcgtgtgccagtacgacaagattcatcggtcaaagaataagtggaagttctacctgaaggacggggtgatgtgcttcggtggtagagattatgtgtttgctaaggctattggagacgcagaatggtag

SEQ ID NO: 54582 - DNA, 3549 bp, Artificial Sequence
  Description of Artificial Sequence: Synthetic coding sequence
atgtgctcgactaacccaggaaaatgggtcaccttcgatgatgatcccgctgttcagtcctctcagaaatcgaagaattttcccctggagaaccagggggtctgtcggcctaatggcctgaaactgaatcttccgggactgcgggagttcccctcaggctcaagctctactagctccactcctcttagttcacctattgtggacttctactttagccctggacccccttcaaattcgccgctgtctactccaaccaaggacttccctggattcccgggtattcccaaagcaggaacccatgtgctttatccgattcctgagagttcttccgattctcctctcgcaattagtggaggggaatcatctttgctccccacgaggccgacgtgtttatcacatgcactgctccctagtgatcacagttgtacccacccaactcccaaagtcgggctgcccgacgaggttaacccacagcaggccgagtctttaggctttcagtccgatgatctgccacagttccagtattttagagaggactgtgccttcagctctcccttttggaaagacgaggggtccgacagtcatttcacgttagacccaccaggatcgaaaaagatgtttagctcacggaataaagagatgccgatcgatcagaaatctctcaataaatgcagtcttaattacatctgcgaaaaactggagcacctgcaaagcgctgaaaaccaggacagtctgcgtagcctaagcatgcactgcctgtgtgcagaagagaatgcatcttctttcgtccctcacacacttttcaggagccagccgaaatctggatggagctttatgctgagaattcccgaaaaaaagaatatgatgtctagcagacagtgggggccaatcttcctcaaggtccttccgggaggtatactgcagatgtattatgagcaaggactcgagaaaccttttaaggagatccaactggatccttattgtcggctgtcagagcctaaggttgagaatttcagcgtcgctggcaaaatccataccgtgaagatagagcatgttagttatacagaaaaacgaaagtatcacagtaaaaccgaagtcgtgcatgagccagacatcgaacagatgctcaagctaggttccacatcctaccatgactttctagatttcttaacgactgttgaagaggaactcatgaaactccctgcggtctctaagccaaaaaagaattacgaggagcaggagatatccctagagattgtggacaatttttggggcaaggtgactaaagagggaaagtttgtcgagagtgctgttattacccagatctactgtctgtgttttgtcaacggcaacctagagtgctttctcactctgaatgaccttgagctccccaaacgcgacgaatcctattacgaaaaagattccgaaaaaaagggtatcgacatactagactaccacttccataaatgcgtgaatgttcaggaattcgaacagtccaggattattaagtttgtgccccttgacgcatgccggtttgaactcatgagattcaagaccttatacaacggggataacctgcccttttctctgaaatctgtggtggtggtgcagggagcttatgtggaactgcaagcctttgtgaatatggccagtctggcccaacgcagttcctatgcagggagtttgcgttcttgcgataacatccggattcatttccccgtaccctcacagtggatcaaggccctgtggaccatgaatctgcagcggcaaaagtcactgaaggctaaaatgaaccgtcgtgcctgccttggttcactgcaggagttagagtccgagccagtgatccaggtaaccgtcgggtctgccaagtatgagagtgcataccaagccgtcgtttggaagattgaccggctccctgacaaaaattctagcttagaccacccacactgcttatcctataaactggagctgggctctgatcaggaaatcccctcagattggtatccattcgccaccgtacagttcagtgtacccgacacctgcgcttcacggaccgaggtgcgatccttgggagtggagtcagatgtgcagcctcagaaacacgtgcagcagcgggcttgctacaacattcaaccaaagctgtaccggtccgtgatcgaggatgtcatcgaaggggtgcggaacctgttcgccgaagaagggatcgaagagcaggttctgaaggacttaaagcagttgtgggaaaccaaggtgctgcagtcgaaggccaccgaggatttttttcggaattctattcagtctcctctcttcacactacagctaccccactctctgcaccagactttacagagttctacagcctccctggtgatcccagccggtcggaccttaccctctttcaccaccgcggagcttgggacctcaaatagcagcgccaactttaccttccccggatatcctattcatgtgcccgcaggagtgactcttcagaccgtttccggccacttgtataaagttaatgtaccaataatggtaaccgagacaagcggcagggccggaattctccagcaccccatacagcaagtctttcaacagttgggtcagccttctgtgatccaaacctccgtaccacaactcaacccctggagcctgcaggcaacgacagaaaaatcccaaagaattgaaactgttctgcagcaaccagctattctaccatccggccctgtggaccgcaaacacttagagaatgcaactagcgatatcctcgtgagtccaggaaacgagcacaaaatcgtgcccgaggccttgctttgtcaccaggagtcgagccactatatctctctccctggggtcgtctttagtcctcaggtttctcagacaaactccaacgttgaatctgtattatccggatctgctagcatggcacagaatctgcacgacgagagtctctccacctctccacatggcgctttacaccagcatgtgaccgatatccaactgcacattctgaagaatcggatgtatggatgtgactctgtcaaacaacctcggaatatagaggagccaagcaacatcccagtctccgaaaaggactcaaacagtcaagtcgacctgtcaattcgggtgacagatgatgatataggagagatcatccaggtggacggctccggggacacatccagcaatgaagagattgggtctacgcgggatgccgatgagaatgaatttcttggaaacattgacggcggtgatctgaaggttccagaagaagaagccgacagcatctccaacgaagacagcgccactaatagcagcgacaacgaggacccccaagtgaacattgtcgaggaggaccccttgaactctggagacgacgtttctgagcaggatgtgccagatctcttcgatactgacaacgtgatcgtttgccagtatgacaaaattcatcggtccaagaataagtggaaattttatctgaaagatggagttatgtgtttcggaggacgggattacgtttttgctaaggccattggcgacgcggaatggtag

SEQ ID NO: 54583 - DNA, 3477 bp, Artificial Sequence
  Description of Artificial Sequence: Synthetic coding sequence
atgtgttcaactaaccctggcaaatgggtgacgttcgatgatgaccccgctgtgcagtcatctcagaagtccaaaaattttccactcgaaaatcagggggtgtgtaggcccaacggactgaaacttaatcttccagggttacgcgagttcccctctggctcttcttctacctcatctacccccctctcatctcctattgtggacttttacttctcacccggacctccctcgaactctccactgagcacaccaaccaaggactttcctggctttcccggaatccccaaagcaggcacccatgtgctgtatccgatacccgagagtagcagcgactcaccactcgcaatcagcggtggtgaatcctcacttctgcctacccggcctacctgcttgagtcatgctctcctgccttcagaccacagctgtacgcatccgacaccaaaggtgggactccccgacgaagtcaacccacagcaagctgaatctctgggtttccaaagtgatgatctgccccagttccagtactttcgagaggactgcgctttctctagcccattctggaaggacgaaggaagtgacagccactttacgttggacccacctggaagcaaaaagatgttctcgtctagaaataaagagatgccgatcgatcaaaaaagtctgaataagtgttcactcaattatatttgcgaaaaacttgaacacctgcagtcggcagagaaccaggattccctccgctccctgtccatgcactgcctttgtgctgaagaaaacgcttccagcttcgtcccacataccctctttaggtctcagcccaaaagtggctggagttttatgctgaggatcccagagaaaaaaaacatgatgtcaagcagacagtggggtcccatttttttgaaggtattgccaggtggaatcctccagatgtattacgaacagggtctggagaagccgttcaaggagatccagttagacccttactgcaggttaagcgagcctaaagttgaaaacttctccgtcgcaggtaagatacacaccgtgaaaatcgaacacgtctcgtacaccgaaaagaggaagtatcattcaaagacagaagtcgtacatgagccggatatcgaacagatgctgaagctaggaagtactagttaccacgattttttagactttctgaccactgtagaagaagagctcatgaagttacctgctgtgtctaagccgaagaaaaattacgaggaacaggagatcagcctggagattgttgataacttttgggggaaagtaacgaaggagggtaagtttgtggagagtgctgttattacgcaaatctactgtctgtgttttgtgaacggaaatctggaatgcttcttgactctgaatgacttggagctgcctaaaagggacgagagttattatgaaaaggacagcgagaaaaaagggattgacattctcgactatcattttcacaagtgcgttaacgttcaggagttcgaacagagccgcattatcaagttcgttccattggacgcctgcagattcgagctgatgcgcttcaaaaccctttataatggagacaacttgcccttcagtcttaagagcgtggtggtggtgcagggggcatacgtggagctgcaggcttttgtgaacatggcttcgttggctcagaggagcagctacgccggaagcctccgatcctgtgataatattcggatccacttccctgtgccatcgcagtggatcaaagctctctggactatgaatcttcagcgacagaagtcactgaaggctaagatgaatcggcgagcatgcctgggatctctccaggagctcgaatctgaaccagttatccaagtcaccgttggaagcgctaaatatgaaagcgcctatcaagccgtggtgtggaaaatcgatagactccccgataagaactcaagcctggatcatcctcactgtctgtcatataaactggagctgggaagtgatcaggagatacccagcgactggtatcctttcgccacggttcagttctccgtgccagacacttgcgcgagtaggacggaagtccgtagcttaggggtggagagtgacgtccagcctcagaagcacgtgcagcaacgtgcttgctataacattcagcctaaactgtatagaagcgtgatcgaggatgtaatcgagggggtaaggaacctttttgcagaggaaggaatcgaggagcaggtcctgaaggacctaaaacagctatgggaaaccaaggttcttcagagcaaggctacagaggacttcttccgcaattctatccagtctccgctgtttacgcttcagctgccccattctctgcaccagaccctgcagtcttccactgctagcctagtaatacccgctggacgtaccttgcctagctttacaaccgccgaactcggaacctctaactctagtgccaacttcaccttccctggctatcctattcacgtgccagcgggtgtgacgctccagaccgtgtctggccatctgtacaaggtgaacgtgcccatcatggtcactgaaacctctggtcgcgctggcattctgcagcacccaattcagcaggtattccaacagctgggacaaccctccgtgatccagacctctgtaccacagttgaacccttggtccctccaggcaaccacagagaaatcgcaacggatcgagactgtccttcaacagccagctatcctcccaagcggtcctgtcgatcgcaagcacctggagaatgcgacctccgacatactggtatctcctggcaacgaacacaagatcgtacccgaagccttactgtgccaccaagaaagtagccactacatctccctgcccggagtggttttttctccgcaggtgagccagactaactcaaacgtcgagtctgttctgtccggttctgcaagtatggcccagaaccttcatgacgaaagtttgagtacttctccccacggagcgctgcatcagcacgttacagatatccagctgcacattctgaagaaccgaatgtatgggtgcgacagcgtgaagcagcctcgaaatatcgaggagcctagcaatatcccagtgtccgagaaagactcaaacagccaagttgatctctctatcagggtaactgacgatgatatcggcgaaatcattcaggtggacggaagtggggacacctctagtaacgaagaaatcggcagtacccgggatgcagacgagaatgagtttctggggaatatagacggcggagatctgaaagtccccgaagaggaggcagattccatctctaatgaggatagcgctaccaattcttctgacaatgaagatccacaggtcaacattgtggaggaagatcctttgaattcaggagacgacgtctctgagcaggacgtccccgatttgttcgacactgataacgtgatcgtatgtcagtatgacaagcaaggagataccagagttcgacacgggcagcagtag

SEQ ID NO: 54584 - DNA, 2208 bp, Artificial Sequence
  Description of Artificial Sequence: Synthetic coding sequence
atgtgctccaccaaccctggaaagtgggtcaccttcgatgatgatccggctgtacagtcctcacaaaagagcaagaacttccccctcgagaatcaaggcgtttgccgtcccaacggtctcaaacttaacttaccaggcctgcgggagtttccgagcggaagttcaagtacgtcctccacaccactgtcctcaccaatagtcgacttttatttttctcctggtcctcctagcaattcccccttaagcacacccaccaaagacttcccaggttttcctggaattccaaaagcgggaacacatgttctgtaccccatacctgaatcctcatctgattcacccctggccattagcgggggagaatcatccctgctgcccactagacccacgtgtctcagtcatgccctgctgccaagtgatcattcctgtacacacccgacgccaaaagtcggtctccccgacgaggttaatccacagcaggccgaatctctcggtttccagtcagacgatctgccccagtttcagtattttcgcgaagactgcgcgttcagctctccattctggaaggatgagggaagtgatagccattttacgctggatcctccagggagcaaaaaaatgttttctagcagaaataaagagatgcccattgaccagaaatcgcttaataaatgctcactaaactacatctgcgagaagttggagcacctccagtccgctgaaaatcaagatagcttgcgttcgctgtctatgcactgcctatgtgctgaggaaaacgcttcctccttcgtgccacacacactctttagatcacaaccaaaaagcggatggtctttcatgctgaggatccctgagaagaagaacatgatgtctagccggcagtggggtcctattttcctgaaggtgctgcccggtggcatattgcagatgtactacgaacagggccttgagaagcctttcaaggaaatccagttggatccatactgtcgattgtcagagccgaaagtggagaatttttcagttgccggaaagatccacaccgtcaagatcgagcacgtgtcctacacggagaagaggaaataccattcaaaaacagaggtggtacatgaaccagatattgaacaaatgctgaaattggggtctaccagttaccacgatttcctggattttcttactactgtcgaggaggagctgatgaaactccctgctgtctctaaacccaaaaagaactacgaagagcaagagattagccttgaaattgtggacaacttctggggaaaggtgacaaaggaaggtaaatttgtggagagcgcagtgatcacacagatctattgtctctgcttcgtgaacgggaaccttgagtgctttcttaccctgaacgatctggagctgccgaaacgagacgagtcttattacgaaaaggacagcgagaaaaagggcattgatatcctcgactaccactttcacaaatgtgtcaacgtgcaggaattcgaacaatctaggattattaaattcgtccctctggacgcttgcagatttgagctcatgcgttttaagactctttacaatggcgataatctgcctttcagtctcaaaagcgtagtagttgtgcaaggggcatacgttgagctgcaggcttttgtgaacatggcctcactggcacaaagaagcagctatgccggatcccttaggagttgcgataatatcagaatccacttcccggtaccttcacagtggatcaaagccttgtggactatgaatttacaacggcagaaatcgcttaaagctaaaatgaatcgtagagcctgccttggttctctccaggaattggagtccgaacctgtgattcaggtgacagtggggtccgctaaatatgagtccgcttaccaggccgttgtctggaagatcgataggttgcccgacaaaaactccagcctcgaccacccccattgcctgagctacaaactggagttgggctctgaccaggaaattccctctgactggtatccatttgctactgtacagttctccgtgcccgacacctgcgcatcccgcacagaggttaggagcctcggggtggagtccgatgtgcagccccagaaacatgttcaacaaagggcttgttataatatccaggtcgagattgaaaagaaatggattaagatcgacggcgaggatccggacaaaatcggtgattgtattactcaatag

SEQ ID NO: 54585 - DNA, 2208 bp, Artificial Sequence
  Description of Artificial Sequence: Synthetic coding sequence
atgtgtagcactaacccagggaaatgggtaacttttgacgatgacccagcagtgcagtcatcacagaagagcaaaaacttccctctcgaaaatcagggggtgtgtaggcctaacggcctaaaactgaatttgcccggtctcagggagtttccctcggggtcctcctccaccagttcaacaccgttgagtagcccaattgtggacttttatttcagccctggacctccctccaactcacccttatcaacccccaccaaggatttccctgggtttccaggaataccaaaggccggaacccacgtgttgtatcccattccagaatcctcttctgattccccgttggccatctctggaggtgagtcatcacttctccccaccaggcccacatgcctgtctcatgctctactgcccagcgaccattcctgtacacacccaacaccaaaagtaggattgcctgatgaggtaaaccctcagcaggccgagtcactggggtttcagagtgatgatttgccacagttccagtacttccgtgaggactgcgccttcagcagccctttctggaaggatgagggctccgacagccacttcacactcgaccccccaggaagtaaaaagatgttttcttcccggaataaagagatgcctatcgaccagaaaagcctcaataagtgttcgctcaattatatctgtgagaagctcgaacacctgcagtcagccgagaatcaggatagtttgaggtcattgtccatgcactgtctgtgcgccgaagagaacgcatcgagcttcgtaccccatacgctgttccggtcacaacctaaaagtggatggagtttcatgctgagaatccccgagaaaaaaaacatgatgagcagccgacagtggggcccaattttcttgaaggtgctcccaggcggtatcttgcaaatgtattacgagcagggtctcgaaaagcctttcaaagagatccagctggacccctattgtaggttgagcgaacccaaggtggagaactttagcgtcgccggaaaaattcataccgtgaagatcgagcatgtgtcttacaccgaaaagcgaaagtaccacagcaaaactgaggtggttcatgaaccggatatagaacaaatgttgaagcttggctccacttcgtatcacgattttctcgattttcttacgactgtcgaggaggagttaatgaagcttccagccgtcagcaaaccaaaaaagaactatgaggaacaggagatcagcctggagattgtggacaacttttggggaaaggtaaccaaggaaggcaaatttgtggagtccgctgtgattacccagatttattgtctttgtttcgtgaatggcaacctggaatgctttctgactcttaatgacctggaactcccaaagcgggatgaatcttactacgagaaggatagcgagaagaagggcatcgatattttggactatcatttccacaagtgtgtcaatgtccaagaattcgagcagagccgcatcataaaattcgtgcctttagacgcttgtcgctttgagctaatgagatttaaaacactgtataacggtgataatctgcctttttcactgaagtctgtggtcgttgtgcagggagcctatgtagagctgcaggctttcgtgaacatggcttcactcgcacagcggtcttcctatgcgggatcactgcgaagctgtgataacatacggattcatttcccggtgcccagccagtggataaaagctctctggaccatgaatctgcagagacagaagagcctgaaggccaaaatgaatcgcagggcgtgcttagggtccctgcaagaactagaatctgaacccgttattcaagtgactgttggatccgcaaaatacgaatccgcataccaggcggtcgtgtggaaaatcgatagactgcccgataaaaactccagcctcgaccacccgcattgcctgagttacaaactggagctaggctccgatcaggagattccaagcgactggtatcctttcgcaacagtgcaattctcagtgcccgacacatgtgcttcccgcacggaggtgcggagtctcggcgtagaaagcgatgtacagccacagaaacacgttcagcagagggcctgttataatatacaggtggaaatcgagaagaaatggatcaagattgatggggaagacccagacaaaattggggactgcatcacacagtag

SEQ ID NO: 54586 - DNA, 2208 bp, Artificial Sequence
  Description of Artificial Sequence: Synthetic coding sequence
atgtgcagtaccaatcctggaaaatgggtgacctttgacgacgatcctgctgtgcagtcaagtcagaagtcaaaaaattttccgctggaaaaccaaggcgtatgtcgcccaaatggtcttaaactgaacctccccggattaagagagttcccaagcggcagttcctccacatctagtactcctctgtcctccccgatcgtggacttctacttctctcctggacctccgagtaatagtcctttgtctacgcctaccaaggatttccccggtttccccggtatccccaaggccggtactcacgtcctgtaccccatcccggagtcaagctccgattcacccctagcaataagtggcggtgaaagtagtctgctgcccacacgaccgacctgtctgagccacgcattacttcctagcgatcattcctgcacccaccctactcccaaggttgggcttccagatgaggtaaaccctcagcaggcagaaagtcttggcttccaatctgacgatttgccccagtttcaatattttagggaagactgcgccttctcaagtccattctggaaggatgaggggtcagactcgcatttcacactggaccctcccggatccaagaaaatgtttagtagccgcaacaaagagatgcccatagatcagaaatcccttaataagtgtagtctgaactacatctgtgagaaactcgagcatctccagtctgccgaaaatcaggattctctcagaagcttgtcaatgcattgcctatgcgctgaggagaacgcatcctcctttgtccctcacacgctgtttagaagccagccaaagagcgggtggtctttcatgctcaggattcccgaaaaaaaaaacatgatgtcatctaggcaatggggtccaatctttctaaaggtgctacccggaggcatcctgcagatgtactacgaacagggtctggagaagccctttaaagagatccagctggatccttactgtcggctgtccgagcctaaagttgagaacttttctgtggccggaaagattcacactgtgaagattgagcatgtgtcgtacaccgaaaagcggaagtatcatagcaaaacggaagtggtccacgaaccagacatcgaacagatgttaaagctcggatcgacctcataccatgatttccttgatttccttacgacagtggaggaagaattaatgaagctccctgcagtgtcgaaaccgaagaaaaattacgaggagcaggagatctccctagagatcgtcgataatttctgggggaaagttacaaaagaaggtaaattcgtggaatctgccgtgataacccagatctattgtctgtgctttgtgaatggcaatctggagtgttttctgacgttaaacgacctggagctccctaaacgagacgaatcatactacgagaaagattccgaaaaaaagggaattgacatattggactaccatttccataaatgtgttaacgtgcaggagttcgaacagtcgagaataatcaaattcgtgcctctggacgcgtgcaggttcgaactaatgaggttcaaaaccctgtacaacggcgataatttacctttcagcttgaagagcgtcgtggtcgtgcagggggcatacgttgagctgcaggcgttcgtaaatatggcctccctcgcccagcgatcctcatacgcaggcagcctgaggtcatgcgataacatacggatccacttccccgttccgtcacagtggattaaagcattgtggaccatgaacctccagcgtcaaaaatctctgaaggctaagatgaacagacgcgcatgtctaggtagcctgcaggaactggagagcgaacctgttatacaagtcacagtcggcagcgcaaagtatgagtcagcttatcaggctgtggtatggaagatcgatagactacctgacaagaatagctccctggatcacccgcattgcctcagctacaaactcgaactcggaagcgaccaggaaattccctcggactggtatcccttcgccaccgtccagttctcagtgcccgacacctgtgcatctcgcacagaggttaggagcctgggagttgaaagtgatgttcaaccacagaaacatgtccagcagagagcctgttacaatatccaggtggaaatcgaaaaaaaatggataaagattgacggtgaggaccccgataagattggagactgtattactcagtag

SEQ ID NO: 54587 - DNA, 2718 bp, Artificial Sequence
  Description of Artificial Sequence: Synthetic coding sequence
atgactacgctcgaccatgtaattgccacccaccagagcgaatgggtcagcttcaatgaagagccaccctttccagctcactcacagggtggaactgaggaacatctgccagggctgtcaagttcacctgaccaatccgaatcctcatcaggcgaaaatcacgtagtggatggaggttcacaggatcactcccacagtgagcaggatgatagcagcgaaaagatgggtctgattagcgaagcagcctctcccccaggctcaccagagcagcctccaccggatctggcctcagccataagtaactgggtccagtttgaggacgatacaccttgggcttcaactagccccccacaccaggaaacggccgaaactgcgttgcccctcacaatgccatgctggacctgcccttcatttgatagtctgggcagatgtcctttaacctctgagagtagctggaccacgcactccgaggatactagcagtccctcttttggttgctcctataccgacctccagctgatcaatgcagaagaacagacttctggccaggccagcggagccgactcaacagacaactcttcaagcctgcaggaagacgaagaggtcgagatggaggcaatctcttggcaggcgagtagtcctgcgatgaacggtcaccccgcaccaccagtcactagcgcacgatttcctagctgggtcacgtttgacgataatgaagtgtcttgtccactgcctcctgtgacatctcctctcaagcccaacaccccaccttccgcttcagtcattccagatgtgccatataactctatggggtctttcaaaaagcgcgatcggccaaagtcaactttgatgaatttttctaaggtgcagaaactggacatcagctcactcaacagaactccgagtgtcaccgaagcttctccatggcgcgctacaaatccatttcttaatgaaaccctgcaggacgttcagccatcacccatcaatcccttctcggcattctttgaggagcaagagaggcggagtcagaattcatcaatctcttctaccacaggcaaatcgcagcgagatagtctgatcgttatttatcaggacgctatctcattcgatgattccagcaagacacagtcccacagcgatgcagtcgaaaagctgaaacaactgcagattgatgaccccgatcattttggcagtgcgaccctaccagatgacgaccccgtcgcctggatcgagttagatgctcaccctcctggaagcgccagatcccaacccagggacggatggcctatgatgttgcggatccctgaaaagaagaacattatgtcttcgcggcattggggccctatttttgttaagcttaccgacaccggatacctccaactctactatgagcaagggctcgagaaacccttcagggagttcaagcttgaaatctgtcacgagattagcgagcctcggctacagaattacgatgagaatgggaggatccactcactgcgaattgatcgcgtgacatacaaagagaaaaagaagtatcaacctaaacccgcagtggcacacactgcagagcgggagcaggtgatcaagctaggcactacgaactacgacgacttcctatcctttattcacgcggttcaggacaggctcatggatcttcccgttctttccatggacttatcgactgtgggactcaactatctggaagaagagattacagtagacgtgagagacgagttctcaggaatagtgtcgaagggggacaatcagatcctgcagcaccacgtcctgactcgaatccacatcctctccttcctatccggattggctgagtgtcgactgggtctcaacgatattttggtaaagggaaacgagattgtgctgcgccaggatatcatgcccacgaccaccaccaagtggatcaagctgcatgaatgcaggtttcacgggtgcgtcgacgaggacgtcttccacaactctcgcgtgatactcttcaaccccttggacgcatgtcggtttgagctgatgagattccgcacagtgtttgccgaaaagaccttgcccttcacgctgaggaccgctacttcagtgaatggtgctgaggttgaagtgcagtcctggctccgtatgagcactggcttttccgccaatcgcgatccactgacgcaggttccgtgtgagaatgtcatgattcggtatcctgtgccctcagagtgggtcaagaactttcgtcgggagtccgttctgggagaaaaaagcctgaaagcaaaagtcaaccggggagcctccttcggctcaacgtccgtatccggcagcgagcctgttatgcgagtgacactcggtaccgcgaaatatgaacacgcttttaacagcatcgtgtggcggattaatagactcccagacaaaaacagcgcaagcggtcatcctcattgtttcttttgtcacctcgagttagggtcagatcgcgaagtgccgtcccgatttgctaatcatgtcaacgtggaattcagtatgcccaccacaagcgccagcaaagcctccgtgcggtcaatttctgtggaggataaaacggatgtgcgtaaatgggtaaattactccgcacattacagttaccaggtcgccttaggctcaatctggctcatgctgcccactccctttgtccaccctacaacactgcccctcctcttcctactggcgatgttgactatgttcgcttggtag

SEQ ID NO: 54588 - DNA, 2799 bp, Artificial Sequence
  Description of Artificial Sequence: Synthetic coding sequence
ggccagcaatgtgaagacgaccagtgcttgtttagtatgactaccctggaccatgtcatcgcgacgcatcagagtgagtgggtgagcttcaatgaagagccaccgttccctgcacattcgcaggggggtactgaagagcacctccccggactgtcttcatctccagaccagtcagagagctccagtggggaaaaccacgtggtagacggcggttcccaggatcacagtcattctgagcaagacgattcgtcggaaaagatgggcctgatctcggaagccgctagccccccaggcagccctgagcagccacctcccgatctggctagtgccatctcgaactgggtgcagttcgaggacgataccccctgggcaagcacatccccacctcaccaggagacggcagagacagccctgccgctgacaatgccctgttggacttgtccgtccttcgactctttaggaaggtgcccgctgacaagtgagagctcatggacaacacattccgaggatacatcaagcccttcatttggctgctcttacaccgacctgcagctgattaacgccgaggaacagacttctggtcaggctagtggagcggatagtacagacaactctagtagtctgcaggaggacgaagaagttgagatggaggctatctcctggcaggcttcatcaccagccatgaacggtcatcctgcccctcccgtcacatccgcacgattcccgagctgggtgacattcgatgacaatgaagtgtcgtgccctcttccacctgtgaccagcccactgaaacctaatacacccccaagcgctagcgtcattcccgacgtaccctacaattccatgggctcattcaagaaacgagacaggcccaaaagtactctgatgaattttagcaaagtgcagaagctcgacatctcctctttaaacaggactcccagcgtgactgaggcttccccatggagggctaccaaccctttcctgaatgaaacgctacaggacgtgcagccttcacctattaaccccttcagcgcctttttcgaagaacaagagagaagatcacaaaacagttccatctcctcgacaaccggtaagtctcagcgggactccctgatcgtgatctatcaggatgctatatcattcgacgactcaagtaagacccagagccactcagacgctgtcgagaaattgaagcagctgcagatagacgaccccgaccacttcggatcagctactctacccgatgatgatccagttgcttggatagaattggacgcacaccctcccggaagtgcccgttcccagcccagggacgggtggccaatgatgttgaggatcccggaaaaaaaaaacattatgagcagcagacactggggccctatctttgtgaaattgacagacaccggctacttgcaactgtattatgagcaaggactcgagaagcctttcagggaattcaagttagaaatatgccacgagatatctgaaccgagactccagaactacgatgagaacgggcgaattcattcgctgcgcattgacagagtgacatacaaggaaaagaaaaaatatcagccaaaaccggcagtggctcacacagccgagagagagcaggttattaagctagggaccactaactacgacgacttccttagtttcatacatgccgtgcaggatcgcctcatggaccttccagtgctgagtatggacctgtcaaccgtcggcctgaattatctggaagaagagatcactgtggacgttcgtgacgaattttctggcatcgttagtaagggcgacaatcagatcttgcagcatcatgtattaacacgaatacacatactgtcatttctctctggcttggcagaatgtcgattgggattaaatgatatccttgtcaagggaaatgaaatagtgctccgccaggacataatgcctacaaccacaacaaagtggatcaaactccacgaatgcaggttccacggatgcgtggatgaggatgtgtttcacaatagtcgagttattttatttaaccctctggacgcttgcagattcgaactcatgagatttagaactgtctttgccgaaaaaactctgcccttcacgttgcgcacggcaacatccgtgaatggggctgaggtggaggtccagagttggctccgtatgtccacagggttctctgccaaccgcgatccactcacccaggtgccttgtgagaatgttatgatacgctacccagtcccatctgaatgggtgaaaaacttccggcgagagagtgtgctgggcgaaaagagcctcaaagcaaaggtgaataggggagcgagtttcggctcaactagtgtcagtggatccgaacctgtgatgcgcgtcacactgggaactgcaaaatacgaacatgctttcaatagcatcgtgtggcgaatcaacaggttgccggacaagaactcagcatccggccatccacactgctttttctgtcacctcgagctaggatctgacagagaggtgccatcacggtttgccaatcacgtgaatgtcgagttcagtatgccaactacttctgcttcaaaagcctcagtgagaagcatctccgtagaagacaaaactgatgttcgcaaatgggttaattactccgcccactattcataccagacgactgaaaccgataacctgcctaaccccttatattgttcctgcttgccgcacacggacctgaagcgcggttctaaaagggtcgtcaagataagatggaacgccagtctagaggtgcctctcgccagtagcatccgaacgatggtgtag

SEQ ID NO: 54589 - DNA, 12 bp, Artificial Sequence
  Description of Artificial Sequence: Synthetic coding sequence
atgacaacctag

SEQ ID NO: 54590 - DNA, 153 bp, Artificial Sequence
  Description of Artificial Sequence: Synthetic coding sequence
atgaccactctcgatcatgtaatcgctacccaccagtccgagtgggtcagcttcaatgaggagccaccatttcccgctcacagccagggtgggaccgaagagcatctcccaggactaagctctagcccagaccaatccgaatcatctagctag

SEQ ID NO: 54591 - DNA, 2763 bp, Artificial Sequence
  Description of Artificial Sequence: Synthetic coding sequence
atgaccacgctggatcacgtgattgccacacaccagagcgagtgggtgtcctttaatgaggagccgcctttccccgcacattcccagggagggactgaagaacatctgccgggtcttagctcaagcccagatcaatcagagtcatccagcggggaaaatcatgtcgtcgacggcggatctcaggaccactcccactctgagcaggacgatagttccgagaaaatgggcctcatttctgaagcggcaagcccgcctggatcccctgagcagcccccaccagatcttgcctccgcaattagcaactgggtccagttcgaggatgacaccccttgggctagcaccagcccgcctcatcaggagacagccgaaactgcgctgccgctcaccatgccctgttggacatgcccctcttttgactccctgggtagatgcccccttacaagtgaatcatcatggaccactcactcagaggatacctcttcacccagcttcggatgttcttatactgatctacagcttattaacgccgaggaacagacatcaggtcaggcgagcggggctgactccactgacaactcttcctccctgcaggaagatgaagaggtggagatggaagccatttcatggcaggcgtcttcgcctgccatgaacggacatcctgctccaccagtgacatcggcacggttccctagttgggtgacttttgacgataatgaagtgtcgtgcccgcttcccccagtgacctcgcccctaaaaccaaatactccaccgagcgcatccgtgattccagatgtcccttataatagcatgggttcgtttaaaaaaagagacaggcctaaatccactctcatgaatttttctaaagtccaaaaactggatatttctagtttgaataggacaccttccgtcaccgaggcatcgccttggcgcgctaccaaccctttcctgaatgagacgctgcaggacgtacagccgtcacctatcaacccttttagcgcgttctttgaggaacaggagaggaggagccagaactcttcgatcagttcgacgacgggaaagtctcagcgggatagcctaattgtcatttatcaggacgccatttcattcgatgattcttccaaaacgcagtcgcactctgacgcggtcgaaaagctcaagcagctgcagattgacgaccctgatcactttggttccgccacccttcccgatgacgacccagtggcctggatcgagctggacgcacatcccccaggtagtgcgcgtagccaaccgagagacgggtggccaatgatgcttcgcatccccgagaaaaaaaacatcatgtctagccgccactggggccctatcttcgtgaaactgaccgataccggatatcttcagctgtattacgagcaagggctggagaagccgtttcgggagttcaagctcgagatctgccacgaaatttcagaaccgagacttcagaactacgatgagaacggcaggattcatagcctacggatcgaccgtgtcacatacaaagagaaaaaaaaatatcagcctaaacctgctgttgcacataccgccgaacgagagcaggttatcaagctgggaaccacgaactatgacgacttccttagctttatccacgcagttcaagaccgccttatggacctgccggtgctctcaatggatctgagtacggttggactaaactacttggaagaggagatcaccgtcgacgtgagagacgaatttagcggaatcgtgtctaagggggacaatcagattctgcagcaccacgtcctcacccggatccatatcctgagtttcttatcaggattggcggagtgccggctggggctcaacgacattctggtgaagggaaatgagatcgtgctcagacaggatatcatgcctacaacaaccaccaagtggatcaaactccacgagtgtagattccatggctgcgtggacgaagatgtattccataattctcgtgtgattctgttcaatcctctggacgcatgtcgcttcgagctgatgcggtttcggactgtgttcgccgagaaaacactcccttttactctgagaacggcaacatcagtcaacggcgcagaggttgaggttcaatcttggcttcgcatgtccacggggtttagtgctaaccgcgaccctctcacacaggtgccttgcgagaacgtaatgatccgctacccagtgccctcagaatgggtaaagaacttccgccgtgaaagcgtgctgggcgagaaaagcctaaaagccaaagtgaacagaggagcctcgtttgggagcacatccgtgtccggttccgagccggttatgcgcgtaaccctgggaactgctaaatacgaacacgctttcaacagcattgtatggagaattaatagactgcccgataagaatagtgcctccggtcaccctcactgctttttctgtcacctggaactcggatcagacagggaagtcccttctcggttcgccaaccacgttaatgtggagtttagcatgcctacgacaagtgctagcaaggcctccgttcgaagcatcagcgtggaagacaagacagatgtgcggaaatgggtaaattactcagcccactactcatatcaaacaaccgagactgacaatctgcccaaccccttgtactgcagttgcttgccgcacaccgacctgaaacggggttcgaagcgggtggtgaagatcagatggaatgcgtccctcgaagtcccgctggcatcatccattagaaccatggtttag

SEQ ID NO: 54592 - DNA, 441 bp, Artificial Sequence
  Description of Artificial Sequence: Synthetic coding sequence
atgtggccggcaccctgctcagtgggcagacttttgattttctttatgtgttcgtcttccgggtacgtcgtgcagggatgtggtccatcgccaggtgcccgaacaacactgggatcaccactcagcctgtggtccatcaaaacgccatctcacatcttctgcaccagacgtgctattaacctgggcttcccgtccccccctctggtgcagttgatattctggtctctgaacgccggtctagatctctacctttgtctgatcagctcttgcgggttttcacaagtgttctggcccgtggaggctttttgcagcttttctctgtctttcttcgccttggcactgtctcataagtttgtcatttgtcgtctggatcagcatatcttttcgggctttacgaagtctcttaagaatcttcccccttgccacagaactgacatttag

SEQ ID NO: 54593 - DNA, 201 bp, Artificial Sequence
  Description of Artificial Sequence: Synthetic coding sequence
atggtggctaagcagcgaattcggatggccaacgaaaagcacagcaaaaacattacccagcggggaaatgtggcaaaaactagccgcaatgctcccgaggaaaaagcgagtgtggggccttggttattagcactgtttattttcgtagtctgcggctccgccattttccagatcattcagagtatccgtatggggatgtag

SEQ ID NO: 54594 - DNA, 201 bp, Artificial Sequence
  Description of Artificial Sequence: Synthetic coding sequence
atggtagccaaacagcgcattcgtatggcaaatgagaagcactccaagaacattacgcaacgaggaaacgtagctaaaacaagcaggaacgctcccgaggaaaaagcttcagtgggaccttggttgttggctctgttcatcttcgtcgtctgtggctctgctatcttccaaattatccagagcatccgaatgggcatgtag

SEQ ID NO: 54595 - DNA, 198 bp, Artificial Sequence
  Description of Artificial Sequence: Synthetic coding sequence
atggtcgccaagcaaaggatacggatggccaacgagaaacactcaaagaacattacacaacgtgggaacgtcgcaaagacactgaggcctcaagaagagaagtatcctgtagggccttggctcttagcattattcgtcttcgttgtatgcggttcagcaatttttcaaattattcagtctataaggatgggcatgtag

SEQ ID NO: 54596 - DNA, 2343 bp, Artificial Sequence
  Description of Artificial Sequence: Synthetic coding sequence
atggacgagcaggctgggccaggagtcttcttctcaaataatcacccaggagccggaggagcaaagggtctcggtcccctcgccgaagccgcagccgcaggggatggagccgctgcagccggtgctgcccgtgcccaatactctctgcccggaatactccacttcttacagcatgagtgggcgagatttgaagtggagagggcccagtgggaagtcgagcgagcagaactgcaggcacaaatcgctttcctgcagggcgagagaaagggccaggagaacttgaaaaaagatcttgtacggaggatcaagatgctggagtacgccctcaagcaggagagggcaaaataccacaaactaaaatacgggacagagctgaatcagggtgatatgaaaccaccgagttacgactcagatgaggggaacgagaccgaggttcagccacagcaaaactcccagttaatgtggaagcagggtcggcaacttctgcggcaatacctgcaggaggttggatacactgacaccattttggatgttaagagcaaacgggtccgcgctctgttgggtttttctagcgacgtgaccgatagggaagacgacaaaaatcaggactctgttgttaacggaactgaagctgaggtaaaggagacagcaatgattgccaagtccgagctgaccgattcagcctccgtgctcgacaactttaagttcctagagtcagccgctgccgacttcagcgacgaagatgaagacgatgacgtggacggtcgagagaaatccgtgatcgatacctccacgattgtgcgcaagaaagccctcccagattcaggtgaagatcgcgacacaaaggaagcgctcaaagagtttgactttcttgtgacatcggaagaaggcgataatgagtcccgctcagctggcgatggcacggattgggagaaagaggatcagtgtctgatgcctgaggcatggaatgttgaccagggagtaataactaaactcaaggaacaatacaaaaaggaacgaaagggtaaaaagggagttaaacggccaaatcggtcaaaactgcaggacatgcttgcaaaccttcgcgatgttgacgaactcccaagcctgcagccgtcagtgggctctccatcacgcccaagctcaagtaggctccccgagcacgagatcaaccgggcagatgaggtcgaggccctgactttccccccttctagtggcaaaagctttatcatgggagcagacgaagcactggaatcagaactggggttaggtgagctggcaggcctcaccgtcgccaatgaggcagattctctcacctatgatattgccaataacaaagacgctctgcgtaagacgtggaatccaaagtttacgcttagatcccactttgacggcattcgcgcactggcgttccaccctattgagcccgtcctgatcacagcaagtgaagaccacaccctgaagatgtggaacctgcagaaaacagcgcctgcaaaaaagagcacttctctagatgtggagcctatatacactttcagagcacacaaaggcccagttctgtgcgtcgtgatgagtagcaatggcgagcagtgctattctgggggtacggatggtctcattcagggctggaataccaccaatcctaatattgacccatatgatagctacgatccctcggtgctcagaggaccattgctgggccataccgacgcagtctggggcttggcctacagcgctgctcaccaacgcttgctgtcatgtagtgctgacggcaccctacgcttgtggaacaccactgaagtcgccccagctctgtccgtgttcaacgatacgaaagaattgggcattcctgcttcagtggacctagtcagttccgacccctcccacatggttgcctcctttagtaaggggtatacatctatcttcaatatggagacccaacagcgcattttgacactcgaaagcaacgtcgacacaaccgcgaactctagttgccagatcaacagagtgatctctcaccccactttacccattagcattactgcccacgaggataggcacattaagttttacgataataacaccggaaaattgatccatagcatggtggcacatttagaggctgttacatcactcgccgtagatccaaacgggctctatctaatgtccggatcccatgactgcagtataagattatggaacctggaaagtaagacttgcatccaggagtttaccgctcatcgcaaaaagtttgaggagagtattcacgacgtggcatttcatccctcaaagtgctatatcgcatccgctggtgctgacgccctcgctaaggtcttcgtgtag

SEQ ID NO: 54597 - DNA, 2196 bp, Artificial Sequence
  Description of Artificial Sequence: Synthetic coding sequence
atggatgaacaggctggcccaggtgtgtttttttccaacaaccaccctggggcaggaggagccaaaggactgggcccactggccggtgcagcacgggctcagtattccttgccagggatactacatttccttcaacacgagtgggcgcgtttcgaagtggagcgcgctcagtgggaggtggaaagggctgagcttcaggctcagattgcgtttctgcaaggagagcgcaagggtcaggagaatctcaaaaaggacctggttcggcgtattaaaatgttggaatacgctctaaaacaggagcgtgctaagtaccacaagctgaagtatgggaccgagctcaaccaaggggacatgaaaccgccaagttacgatagcgacgaaggcaatgagacagaagtgcagccacagcagaattcacagctgatgtggaaacagggtaggcaactgcttcgacagtatctgcaggaggtcggatatacggatacaatcctggacgttaagtctaaaagggttagggctctattgggcttcagtagcgacgtgacagatcgcgaggacgacaagaatcaggatagtgtggtcaatgggacagaggccgaggtgaaagagacggccatgatcgcgaagagcgaactcacagacagcgcatccgtattagacaactttaagttccttgaatcagcagcggcagacttcagtgacgaggatgaggatgatgatgtggacggcagagaaaagtcagtcatcgatacaagtacaattgttcggaagaaggcattaccagattcaggagaagaccgtgatactaaggaggccctgaaagaatttgacttcctggtgacctctgaggaaggcgataacgagagtcgaagcgcaggtgatggcacggactggggtccaaatcgcagcaaactccaggatatgctcgcaaatctgcgtgatgtggacgaacttccctcactacagcccagcgtcgggagcccttcgcgaccaagcagttcccgcttaccggagcacgagattaatcgtgccgacgaagttgaagctcttaccttccctccgagcagcggaaaaagttttatcatgggtgccgatgaagcattggaaagcgagttgggcctgggcgagttggcaggacttaccgtggccaacgaggctgattctctgacttatgacatcgctaacaacaaagatgctctcagaaagacttggaaccccaagtttaccttacggagccactttgacggaataagggccctcgcttttcatcctattgagccagttctcatcactgcatctgaagaccacactttgaaaatgtggaacctgcagaagaccgctccggctaagaaatctaccagcctggacgtagaaccaatatatacatttagggcgcacaaggggccagtgttgtgtgtcgttatgtcctcaaatggcgagcagtgctactccgggggaactgacggcctgattcaggggtggaatactaccaatccaaacattgacccatatgactcatatgacccctctgttcttcgcggaccattactggggcacaccgacgctgtctggggcctggcctattcagctgctcaccagcggcttctgtcttgtagcgcggatggtacactgagattatggaataccactgaggtggccccagccctgagtgtgttcaatgataccaaagaactcgggatccctgcttccgttgacctggtgagctctgatccaagccacatggtggccagtttttcaaaaggttacacatctatctttaacatggagacgcagcagcgcatcctgaccttggaaagcaacgttgacaccaccgcgaattcatcatgtcagatcaatcgggttattagtcatccaaccttgcctatttccataactgctcacgaggatagacacataaagttttacgacaacaacaccgggaagttgattcattccatggtggcccacctggaggctgtaacttctcttgccgttgatcctaacggactctatcttatgtcgggtagtcacgactgttctatcagactttggaacctcgaaagtaaaacatgtatccaggaattcactgcacacaggaaaaagttcgaggaatccatacatgacgtcgctttccacccatcaaagtgttacatcgcaagcgcaggagcagacgctcttgcgaaggtatttgtctag

SEQ ID NO: 54598 - DNA, 2268 bp, Artificial Sequence
  Description of Artificial Sequence: Synthetic coding sequence
agaccaccatggacatctcgcagagtaccagcaagtagtagcgctactacaactcgcgcacagtacagcctgccaggcattctccatttcttgcagcacgagtgggccagatttgaagtagaacgtgcgcagtgggaagtcgaacgtgcggagcttcaggcacagattgccttcctgcaaggggaacgaaaaggccaagagaacctgaagaaggatctggtgagacggattaaaatgctcgagtatgctttgaagcaagaacgggctaagtaccataaactgaagtacggaaccgaacttaaccagggagacatgaaacccccttcatatgattccgacgaaggaaacgagaccgaagtccagccccagcagaattcacagcttatgtggaagcaagggagacaacttctccgacaatacctgcaggaggtcgggtacacggacaccattctggacgtcaaaagcaaaagggtcagagctctcctcgggttctcttcagacgtcactgatcgggaagatgataagaatcaggattctgtagtgaacgggaccgaggctgaggtgaaggaaacggcaatgatcgcaaaatccgagctgacggacagcgcatctgttcttgataactttaaatttctggagtcggccgcagccgacttctcagacgaggatgaggacgacgacgtcgacggaagagaaaaatccgtgattgatactagtactatcgttcgcaagaaggctctgcccgattccggggaggatcgcgataccaaggaagcgctcaaggagttcgactttcttgtgacctccgaggaaggggataacgaaagccgatccgcgggagatggcaccgactgggagaaggaggatcagtgcctcatgcctgaggcctggaacgtggatcagggagtcattacaaagctgaaagaacagtacaagaaggaaaggaaagggaagaaaggggtaaaacgtcccaaccgctccaaactgcaggatatgctggccaacctgcgagatgtggacgagttgccctcattgcagccaagtgtcggctctccaagcaggccatcatcgtcacgtctaccagaacacgaaatcaacagagctgatgaggtcgaagcgctcacatttcctccatcttcagggaagtcgtttattatgggtgccgacgaagccctcgagtccgagctcggacttggagagttagcaggcctgaccgtagcgaatgaagcagacagcctgacctacgacatcgcaaacaataaggacgccctgcggaagacctggaacccaaagtttacgctgcgatctcattttgacgggatacgagctctggcatttcacccaatcgagcctgttttaataacagcatctgaagatcacaccctaaagatgtggaatctgcaaaagactgcaccagctaagaagagcactagtctggacgtagaacctatctacacctttagagcccacaagggccctgtcctgtgcgtcgttatgagctcaaacggcgagcagtgctattccggaggcactgatggtttgattcaaggatggaacaccactaatcctaacatcgacccatacgattcctacgacccatcagtactgcggggaccactcctcggccatactgacgccgtttggggcctggcttactccgccgctcaccaaaggcttctgtcctgctctgcggacggcacattacgactctggaacaccacagaggtggctccagcactcagtgtcttcaatgataccaaggagctcggtatacccgcaagcgtggaccttgtgtccagcgacccctctcacatggttgccagtttttccaaggggtacacctccatcttcaatatggagacccaacaacgcatcttaaccctagaaagtaacgtggacacgactgctaacagttcttgtcagatcaacagagtgatctcacacccaaccttgcctatttccattaccgctcatgaagaccgacatatcaagttttatgacaacaatactggcaagctgattcacagtatggtggcccacttggaggctgtcacaagtttggcagtcgatccaaacggcctctacctaatgtctggtagccatgattgctccattcgcttgtggaatttggaatccaaaacctgtatccaggagtttactgctcaccggaaaaaattcgaggaatcaattcacgatgtagcctttcacccctccaaatgttacatcgcctctgcaggggcagacgcactggccaaggtgttcgtgtag

SEQ ID NO: 54599 - DNA, 2142 bp, Artificial Sequence
  Description of Artificial Sequence: Synthetic coding sequence
atggatgaactggctggtggtggcggaggagggccagggatggccgcaccacccagacagcagcagggacccggaggcaacctggggctaagccctggcggaaacggcgcagcaggcggtggcggtcccccagcatcagaaggagctggacctgctgcaggaccggaactgagtaggccacagcaatataccattcctggcattttgcattatattcaacatgaatgggctcgctttgagatggaacgagcccattgggaggtggaacgggctgaactgcaggcccgaattgcttttttgcagggtgagaggaaaggccaggagaacctgaaaaaagacctggttagaagaatcaaaatgctggagtacgccctgaagcaggaacgggctaaatatcataagttaaagtacggcacagaactgaatcagggcgatctgaagatgcccactttcgagtcagaagagactaaggataccgaggcacccactgctccacagaattcccaacttacctggaagcagggtcgtcaattgttgcggcagtatctgcaggaggtcggttatacagacacgatcctcgatgtaaggagccaacgcgttcgaagcttgctcggactctctaattcggagcccaatggcagtgtggaaaccaaaaacctggagcagatcctgaacggcggagaaagcccaaaacaaaaaggacaggagattaaacggagcagcggggatgtgttagagacgtttaactttctggagaatgctgacgactccgacgaggacgaagaaaatgatatgatagaaggaatcccagagggcaaggacaagcacaggatgaataaacataaaataggaaacgaaggactggctgcagatctcaccgatgatcctgataccgaggaggccctcaaagaatttgacttcctcgtgacagctgaggacggtgagggcgcaggcgaggccaggtcttccggagatggaactgagtgggccgagcctatcacatttccatccggcggaggaaaaagctttataatgggctccgacgatgtccttctcagcgtgctggggctcggcgacttggccgatctcaccgttacaaatgacgctgattattcctatgacctgccagcaaacaaagacgctttcaggaagacctggaacccaaagtacaccctgaggtcacacttcgacggtgtccgcgcactggcctttcatccggttgaaccagtgttggtcaccgcttccgaggaccacacactcaagctgtggaaccttcagaagacagtgcctgcaaagaaatcggccagcttagatgttgagcccatatatacgtttcgagcccacatcggacccgtcctgagtctggcaatttcttctaatggagagcagtgcttttctggagggatcgatgctaccattcagtggtggaacatgccctcacccagcgtggatccctacgacacatatgagcctaatgttctggccggaactttggtgggacacactgatgctgtgtggggattggcttatagtgggattaagaaccaacttttaagttgcagcgctgatggaaccgtacgtctctggaaccctcaggagaaactcccatgcatttgcacctataacggggataagaagcacggcatcccaacctccgtggacttcatcgggtgtgatcctgctcatatggtcaccagttttaacaccggctccgcagtgatatacgacctggagaccagtcagtctctcgtcattcttagttcccaagtggactccggcctgcaatcaaacaaccacatcaatcgcgtggtaagccatcccacacttccagtcaccattacagcgcatgaagaccgacatatcaagttttttgacaataagaccggaaaaatgattcactccatggttgcgcatttggacgccgtgacatcacttgcggttgaccccaatgggatttacctgatgtccggatcgcatgattgttcgataaggctctggaacctcgacagtaagacctgcgtacaggagataacagctcaccgcaagaaactagacgaatcgatctatgacgtggctttccattcttcaaaggcttatattgcttccgcaggtgccgatgctctggccaaagtcttcgtttag

SEQ ID NO: 54600 - DNA, 2394 bp, Artificial Sequence
  Description of Artificial Sequence: Synthetic coding sequence
atggacgagttggcgggaggtggaggaggaggtcccggaatggccgctcctcccaggcaacaacaaggcccaggcggtaatctcggattatcccctggaggcaacggcgctgctggaggtggtgggccaccagcctctgagggagccggtcctgcggcagggcctgaactgagcaggccacagcaatatacaattcccggaatcctgcattacattcagcacgaatgggcaagattcgaaatggagagagctcactgggaggtcgagcgtgcagaactgcaggccagaattgcgttccttcaaggggagcgaaagggccaggaaaacctgaaaaaggatttagtacgccgaatcaagatgctggagtatgctctcaaacaggagcgcgctaaatatcataaactgaagtatggaaccgagctaaaccagggtgatctcaaaatgccaacattcgaatctgaggaaacaaaggacactgaagctccgaccgcccctcagaactcgcagctaacctggaagcaggggagacagctcttacgccaatatcttcaggaggtggggtatacagacaccatcttggacgtacgatcccagagggttcgctctctgctgggtctgtctaacagcgaaccaaacggcagcgtcgagactaagaacctggaacagattctcaacggcggagagagcccaaagcaaaaggggcaggaaattaagcggtcctctggagatgtgctggagaccttcaatttccttgaaaacgccgacgattccgatgaggatgaagagaatgacatgattgagggtatcccagagggcaaagataaacatcggatgaataagcataagattgggaacgagggtctcgccgcagaccttaccgatgatcctgatacggaggaggctctgaaagaattcgattttcttgtgactgccgaggatggtgaaggcgctggtgaggcaagaagcagcggagatggcactgagtgggataaagacgacctgtcccctaccgctgaggtatgggatgtggatcaggggctcatcagtaaactaaaagaacagtacaaaaaagagaggaagggaaaaaaaggggtgaagagggccaatagaaccaaactgtacgatatgatcgcagaccttggggatgatgaacttccccatattcctagcggcatcattaaccagtccaggtccgcctctacacgtatgaccgatcacgaaggagccagggccgaggaagcagaacccataacatttcctagcgggggtggaaaatcctttatcatgggttccgatgacgtcctgctttccgtgcttgggctgggcgatctggctgacctcactgtgaccaatgacgctgactattcctatgacctccccgcaaataaagacgcctttcggaaaacctggaatcctaaatacactttgagaagccatttcgacggagttcgggctctcgctttccaccccgtggaaccagtcctggttacggcctccgaagaccacaccctgaagttgtggaacctacagaagacagtgccggcaaaaaagagcgctagtctcgatgtggagcctatttacacttttagggcccacatcgggcctgtactgtccctcgccatctcatcaaatggcgagcagtgcttctctgggggaattgatgccaccatccaatggtggaatatgccttctccctccgtggacccttacgatacatacgaacccaacgtccttgctggcaccctagtcggacatacggatgctgtctggggcctagcctactccggcatcaaaaatcagttactgtcatgctcggccgacggtacagtccggctgtggaacccccaagagaaactgccctgcatctgtacatataacggagacaaaaaacatgggatccccacatctgtcgacttcattggctgcgatcctgcgcacatggtcactagctttaataccggatctgccgtgatatacgacctggagacaagccagtctctggtcattttgtcctcacaggtggatagcggcctgcagagcaacaatcatattaaccgtgttgtgtctcaccctacactcccggtcacaatcaccgcccacgaagatcgccatatcaagtttttcgacaataagaccgggaaaatgatacatagcatggttgcccacctcgatgccgtgacatctttggcagtagatcctaatggaatctacttgatgagcggaagccacgattgctcgattagactgtggaacctggactctaagacgtgtgttcaggagatcactgcacatcgtaagaagctggatgaatcgatttacgatgtggcctttcatagcagcaaggcctacattgctagtgctggagccgatgccctggcgaaagtgttcgtttag

SEQ ID NO: 54601 - DNA, 2118 bp, Artificial Sequence
  Description of Artificial Sequence: Synthetic coding sequence
atgacaaaattcggatttctgcgcctgagctatgaaaagcaggacaccctgctgaagttattgattctaagtatggcagctgtactctcttttagcacgcgcctcttcgccgttctgcgatttgagtcagtgatccatgagttcgatccatacttcaattacaggactaccagattcctggccgaagaagggttctataagtttcataactggtttgatgatcgggcatggtatcctctcggccgtataatcggagggacaatctaccctggtctcatgattacatcggcagctatttatcacgtgctccacttctttcatatcacaatagatataaggaacgtatgcgtgttcctcgctcccctcttctcctccttcacaactattgtgacctaccacctgaccaaagagctcaaggatgccggagccggtcttctcgccgcagccatgattgccgttgttcctggctatatatctagaagcgtggctgggtcctatgacaatgagggcattgcaatattttgcatgctgctgacttattacatgtggattaaggccgtcaagactggcagtatttgttgggctgcaaagtgtgccttggcgtacttttacatggtgagctcatggggagggtacgtgtttctcatcaatctgatacctttgcatgtgctcgttttgatgctcacaggtcgcttctcacacaggatctacgtggcctactgtaccgtctactgtttagggaccatcttgtctatgcagatctcattcgtcgggtttcagcctgtcctctcatctgagcacatggccgctttcggagtatttggcctttgtcagatccatgcattcgttgattatcttagaagtaagctgaatccgcagcagtttgaagtgctttttaggtctgtcatcagtttggtgggcttcgttctgctcacagtcggagccctgctgatgctgaccggaaagatcagtccctggacaggccgattctactcattactggaccctagttatgccaagaataatattcccatcatcgctagtgtgtccgagcaccagccgaccacctggtcctcatattacttcgatttacagctcttggtgttcatgttccccgtcggtttgtactactgcttttctaatttatctgacgccagaatctttattattatgtatggggtgacatcgatgtacttctcggcagtgatggtgcgcctgatgcttgtactcgcccctgtaatgtgcattttgtccggtataggggtaagccaggtgctttccacttatatgaagaacttagatatctcccgaccagataaaaaaagcaaaaaacagcaggattccacgtaccctatcaagaacgaagtcgctagcggtatgattctggtgatggctttcttcctgataacttacacgttccactccacatgggtgacgagtgaggcctactcctcccctagtattgtattgtctgctcgtggtggcgatggatcgcgaattattttcgatgattttagagaagcgtactattggctgcgacataatacacccgaggatgcgaaggttatgagttggtgggattacggttatcagattaccgccatggcaaacaggactatcctcgttgacaacaacacttggaacaacacacacatttccagagtagggcaggcaatggcttctactgaggaaaaggcctacgagatcatgagggaactggatgtctcatacgttttggtcattttcggtgggctgacaggctattcgagtgacgatataaataaatttttatggatggtccgcatcggcggtagcacagacacagggaagcatatcaaagaaaatgattattacacccctacaggcgagttcagggtcgacagagaagggtctcctgtgttgctcaattgcctgatgtataagatgtgttattatcgattcggacaagtctatactgaggcaaagaggcctccaggattcgacagagtacgtaacgccgagattggcaataaagacttcgagctggatgtcttagaggaggcttataccacagaacactggctggtccggatctacaaagtgaaggacctcgataacagaggcctctctcggacgtag

SEQ ID NO: 54602 - DNA, 2118 bp, Artificial Sequence
  Description of Artificial Sequence: Synthetic coding sequence
atgaccaagtttgggttcttacgcctgtcttatgaaaagcaggatacacttctgaaactcctgatcctgtctatggcagccgtcctgtcgttctcaacgcgactgttcgccgtcctgaggttcgaatccgtaatacatgaattcgatccctattttaactatagaactactcggtttctcgccgaggagggcttctataaattccataattggttcgatgaccgcgcatggtaccctctcggccgtattatcggagggactatctatccagggcttatgatcaccagcgcagccatttatcatgtgctgcacttctttcatatcacaattgatatccggaatgtttgtgtgttcctggcgccactgttttccagcttcacaacaatagtaacataccatcttacaaaggaactgaaggatgctggagctggcctcttggccgcagcaatgattgctgtcgtccctggttatattagtcgcagtgttgccggaagctacgacaacgaggggattgcaatcttctgtatgttactcacttactatatgtggatcaaagcggtaaagactggttcaatctgctgggcagcaaagtgtgcattggcctatttctacatggtgtcttcttggggcggttatgttttcctcatcaacctcatccccctacacgtgctggtcctcatgctgacagggcgattttcacaccggatttacgtagcctactgcaccgtctactgtcttggcacgatcctatctatgcagatctcctttgttggattccaacccgtactgagcagcgaacacatggccgctttcggcgtgttcgggctgtgccagatccatgcgtttgtggattacttgagatccaaacttaacccccagcagttcgaggttctgtttcgcagtgtgataagcctcgtaggattcgtcctactgactgtgggggcactgcttatgcttaccggaaaaattagcccatggacagggagattttattctcttctggaccccagctatgctaagaacaacattcccattatcgcgtccgtgtctgagcatcagccaactacatggtcttcttattacttcgacctccaactgctcgtcttcatgtttccggtgggcctctattactgcttttccaatctatctgacgctcgcatctttatcattatgtatggcgtcacatcaatgtatttctctgctgtgatggtgagactcatgctggtcctggcaccggtgatgtgtatcctcagcggaatcggcgtgtcccaggtgttgagcacttacatgaagaacctcgacatctctagaccagacaagaagtccaaaaagcagcaggattccacttatcccatcaagaacgaagtagcatccggaatgatactggtcatggctttttttctcatcacatacaccttccacagtacctgggtgacaagtgaagcctactctagtccttctattgtgctcagtgctagaggaggggacggatctcgcatcatcttcgacgacttcagagaggcctactactggctgcgccataacaccccagaggatgcaaaagtgatgtcatggtgggattacggctaccagataacagccatggcaaataggactatactagttgataataatacctggaacaacacacatatcagcagagttggccaggccatggcatccactgaggagaaagcctacgagatcatgagagaactcgacgtctcctacgttctcgtgatttttggtggtctgactggctacagttccgatgacatcaacaagttcctttggatggtgagaatcggcggttctactgacactggcaagcatatcaaggaaaacgattattacacaccaacgggcgaatttcgcgtggatcgtgaaggtagtccagtgctgctcaattgcctcatgtacaaaatgtgttattaccggttcggacaggtgtacaccgaggccaaacggcctcccggatttgacagggttaggaacgcagagataggcaataaggactttgagcttgacgttctggaggaggcttacaccaccgaacattggctcgttagaatctacaaagtgaaggacctggacaaccgcggattgtctcggacttag

SEQ ID NO: 54603 - DNA, 2481 bp, Artificial Sequence
  Description of Artificial Sequence: Synthetic coding sequence
atggccgagccttcagcgccagagagtaagcacaagtcgtccctgaattcatctccttggtctggtctgatggcattgggaaattctagacacgggcaccacggtccaggggcacaatgtgcccacaaagccgcaggcggagcggctccacccaagccagcccctgctggactttctggtggcctgagtcaacctgccggatggcagtctttgctttctttcactattctcttccttgcatggcttgctggtttcagcagccggctcttcgccgtgattcgtttcgagagcattattcatgagttcgacccctggttcaattaccggagtactcaccacctggcctctcatggattctatgagttcctaaattggttcgacgagcgagcctggtatcctctgggtaggatcgtgggtggcaccgtctatcctggattgatgataaccgctggccttatacactggatactcaacacactgaacatcacggttcacattcgagatgtctgcgtatttcttgcccctacctttagtggcctgacctcaattagtacatttctgttgacacgcgagctctggaatcagggagccggtctgctggccgcttgtttcatcgctatcgtgcctggatacatatctcggtctgtcgcagggagtttcgataatgaaggcatcgcaatctttgctctacagtttacatattacttatgggtgaaatctgtcaaaactgggtcagtgttctggactatgtgctgctgtttatcatacttctatatggtgagcgcctgggggggatacgttttcattattaatctgatccccctgcacgtattcgttctgctgctgatgcagcggtactccaaaagagtgtacattgcatatagcacgttctacatagtgggcctgatcctttcgatgcagattccattcgtgggctttcagccaatccggacgtcagaacatatggcagctgctggtgtgtttgctctgctgcaagcctatgccttcttgcagtacctccgggataggctaactaagcaggagttccagacgctgttctttctcggtgtgtccttagccgcaggcgctgtttttctatccgttatttacctgacttacactggctatatcgccccttggagcggacgtttctactctctgtgggacaccggatacgcaaagattcatattcctatcatcgcatccgtctccgaacaccagcctacaacctgggtgtcgttttttttcgacctgcacatcctggtgtgcacctttcctgcaggtttgtggttctgcataaagaacataaacgatgaacgggtctttgtggcattatacgctatcagcgcagtatatttcgccggagtgatggtgcggttaatgctcacgttaaccccggtcgtctgtatgctgagcgccatagcgtttagcaacgtattcgagcactaccttggcgacgacatgaagcgggagaatcctccagtcgaggactcttcagatgaggatgacaagcggaatcaaggcaacctctacgataaagccggaaaggtgagaaagcatgcaacagagcaggaaaagactgaagaagggcttggccctaatatcaaaagcatcgttaccatgctaatgcttatgttgttgatgatgttcgccgtgcattgcacctgggtaaccagtaacgcctactccagcccatcagtggtcctggcttcatacaaccatgacgggaccagaaatatcctggacgattttcgagaggcttatttctggctaagacagaatacagatgaacacgctcgggtgatgagctggtgggactacggatatcagatcgcaggcatggccaacaggactacgctggtcgacaacaatacttggaataactcacacatcgcactggtaggcaaagctatgtcatcaaacgagaccgccgcatacaagatcatgcggaccttggatgtggactatgtgctggtgatctttgggggtgtgataggctattctggagacgacataaacaagtttctatggatggtgaggatcgccgagggcgagcatcctaaagatatccgtgagagtgactacttcacaccgcagggcgagttcagagtcgacaaggcaggctcccccaccctgctgaactgtcttatgtacaaaatgtcgtactaccgctttggagaaatgcagctggatttcaggaccccacctggcttcgaccgaacccggaacgccgagataggcaataaggacatcaagttcaagcacttggaggaagccttcacctccgagcactggttggtgaggatctataaggttaaggcacccgataatagggagacactggatcacaaacctagggtgaccaacatcttcccgaagcaaaaatatctgtccaaaaaaactacaaagcgaaaacgaggctatattaaaaataaactggtcttcaagaagggcaaaaaaatcagtaagaagaccgtgtag

SEQ ID NO: 54604 - DNA, 1005 bp, Artificial Sequence
  Description of Artificial Sequence: Synthetic coding sequence
atgctcggtattatggcatggaacgccacctgcaaaaactggttagcagcggaggctgcattggagaagtactacctttcgattttttatggcatcgaatttgtggtgggggtcctaggaaatactattgtggtttatggttatattttcagtctaaagaactggaacagttcaaatatctacctgttcaatctgagtgtaagcgatctggcgttcctgtgtaccctccctatgctgatccgctcatacgctaacggcaactggatctatggggacgttttgtgcatctccaacagatatgtacttcacgccaatctgtacactagtattctgtttctaacctttatctccatcgaccgttacctgattatcaagtatcccttccgcgagcacttgcttcagaaaaaggaattcgccattcttatatcactcgccatatgggtgctcgtgacattggagttgctccctatcctgcctctgatcaatcccgtgattaccgacaacgggactacttgcaacgatttcgcttcatccggagatcccaactataatctgatctactccatgtgtttaacactactgggttttcttatccccttgttcgtgatgtgttttttctactataaaatcgccctgttccttaagcaacggaacagacaggtcgcgactgctctccctctggaaaaaccactgaatctggtcataatggctgtcgtcatattttccgtgctgtttaccccttaccatgtcatgcgtaatgtcagaattgctagcagattagggtcatggaagcaataccagtgtacacaggtcgtgatcaacagcttctacatcgtcacaagaccattggcattcctgaacagcgtgatcaatccggtgttttactttctattgggagatcacttcagggacatgctgatgaaccaactccgccataactttaagtccttaacttcgttctccaggtgggcccatgagctgctgctgtcgttccgagaaaaatag

SEQ ID NO: 54605 - DNA, 1323 bp, Artificial Sequence
  Description of Artificial Sequence: Synthetic coding sequence
atggcttcacccgttgcagcccaggcgggaaaattgctcagggcgctcgcgcttcggccaagatttctggccgcagggagccaggcagtgcagcttaccagccgcaggtggcttaaccttcaggagtatcagagcaagaaactaatgtccgataatggagtccgagtgcaacgcttctttgttgccgacacggctaatgaggccctcgaggccgctaaacggctcaatgccaaggaaatcgtgctaaaggctcaaatactcgccggtggtagaggtaagggcgtcttcaactctgggctgaaaggtggtgtgcacctgacgaaggaccccaacgtggtaggacagcttgccaaacagatgatcggctacaaccttgcaaccaagcagacccctaaagaaggggttaaagtcaataaagttatggtggcggaggctttggatatctctcgcgaaacttacctggcaatcctgatggaccgcagctgtaatgggcctgtcttggtggggagcccccaggggggagtggacattgaggaagtggccgcttcaaatccggagctgatttttaaggaacagattgatatcttcgaggggataaaggacagtcaagctcaacgcatggctgaaaacctcggctttgtgggtccacttaagagccaggctgccgaccaaatcactaaattatataacttgtttctgaagatagacgctacccaggttgaggttaacccttttggggagacacccgagggacaggtggtctgcttcgacgccaagatcaactttgacgacaacgccgagtttcgacagaaagatatctttgctatggacgacaagagcgaaaatgagccaatcgagaacgaggctgccaaatatgatttaaagtatatcggtctcgatggaaatatcgcatgcttcgtgaatggagctgggttggccatggcaacatgcgatattatctttctcaacggcggaaaacctgctaattttcttgacctgggcggaggggtgaaggaagctcaggtctaccaagcatttaagctcctcaccgccgaccccaaggtggaggccatcttggtaaacatcttcgggggtattgttaattgcgccattattgctaatggtattaccaaagcatgtagggagctggaactcaaggtgccgctcgttgttaggctggaaggtacctttatggaaaagaagggcagctacatgcatatcaaacaagagaccggtaacagcaatgagaatattaccggcatacaagaaaacgtcgcccatcaaaacctctctaagtgtgctatttccatcttcctgtgctag

SEQ ID NO: 54606 - DNA, 1299 bp, Artificial Sequence
  Description of Artificial Sequence: Synthetic coding sequence
atggcttcacctgtggccgctcaggcgggtaaattactacgagcattggccctccgaccaaggtttctggctgcgggatcacaagccgtacagctgacctctcggagatggttgaatctgcaggaatatcagtccaaaaagctcatgtcggataacggcgtgagagtgcagaggtttttcgtggccgacaccgccaatgaggccttggaagctgccaaacgtttgaacgctaaagagattgttcttaaggcccaaatcctggcaggtggcaggggtaagggggtcttcaattccggtttaaaggggggagtgcatctcacaaaggatcctaacgtcgttgggcagctggccaaacagatgatcggctacaatctggcaaccaaacaaacacccaaggagggcgttaaggtcaataaagtgatggttgctgaggccctcgatatttcccgcgagacatacctggcaattctaatggatcggtcgtgtaacggccctgtccttgtaggttcccctcagggcggtgtcgatatcgaggaagttgctgcctccaatccagagcttatttttaaggaacagatcgacattttcgaaggaattaaggatagccaggcacagcgtatggcagagaatttgggattcgtgggacccttgaaatctcaggctgctgaccagatcactaaactatacaacctctttctgaagattgacgctacccaagtggaagtgaacccctttggtgaaacgccagaagggcaagtggtgtgcttcgacgccaagattaattttgacgacaatgctgagttccggcagaaggacattttcgcgatggatgacaagagtgagaacgagcccatcgaaaatgaggcggcaaaatacgaccttaaatatatcgggcttgacggcaacattgcttgtttcgtgaacggggcagggctggctatggcaacatgcgacatcatcttcttaaatggaggtaagcctgcgaatttccttgacctgggaggcggagtcaaggaggcacaggtgtaccaagcctttaagctgctgactgccgatcctaaggtggaagccatcttggttaacatcttcggtggaattgttaattgcgcgatcattgccaacggcatcactaaagcttgtcgagagttagagctgaaggttcctcttgtagttagactggagggcacgaacgttcaggaggcacagaagattttgaacaattctggcctgccaatcacgagtgccattgatctagaggatgcagccaagaaggccgtggcaagcgtcgccaaaaagtag

SEQ ID NO: 54607 - DNA, 753 bp, Artificial Sequence
  Description of Artificial Sequence: Synthetic coding sequence
atgtctgataatggcgtccgagtgcagaggttctttgtggccgatacagcaaacgaggctctcgaagccgcaaagcgacttaacgcaaaggagatagtattgaaagcccagattcttgcaggcggtcgcggaaagggcgtgttcaactcgggcctgaagggaggggttcatctgaccaaagacccaaacgtggtgggacaactggccaagcagatgatcggttacaacctggccactaagcaaactcctaaggagggtgtgaaggtgaataaggtgatggtggccgaagcgctcgacatctctcgggagacctacttggctatccttatggatcgatcgtgtaatggacctgtcctcgtaggcagccctcagggaggcgtggacatcgaggaggtagccgctagcaatcccgaactgatctttaaggaacaaattgacatattcgagggaattaaggactcccaggctcagcgcatggctgaaaacctcggatttgtggggccacttaaatctcaggtggaagcgatactcgtgaatatattcgggggaatagtgaactgtgctatcatcgccaacggcattactaaggcttgccgcgagctcgaactaaaagtgcctctggttgttcggttggaaggcaccaatgtccaggaggctcaaaaaatactcaacaatagtggtctgccaattaccagtgcgatcgatctggaagatgcggctaagaaggcagtagccagtgtggctaagaaatag

SEQ ID NO: 54608 - DNA, 642 bp, Artificial Sequence
  Description of Artificial Sequence: Synthetic coding sequence
atgtttgggtggtcctttgtgtttgaggacttcgtgagcgatgaactgcggaataaagccactcagcccatgaagtccgtgctctggtggctccccgtagaaaaggccttctggaggcagccagcaggaccgggatcagggatccgtgaaagactagaacatcccgtgttgcacgtctcctggaacgacgcccgtgcatactgcgcctggaggggaaaaaggctgcccactgaagaagagtgggaatttgcagccaggggcggactcaagggccaagtgtacccatggggaaactggttccagccgaaccggaccaatctttggcagggaaaattcccaaaaggggacaaggccgaggatgggttccacggcgtctctccagttaacgcctttcctgcgcagaataattatggcctgtatgacctcttggggaatgtgtgggaatggaccgcctccccctaccaggccgcagagcaggacatgcgagtcctccggggagccagctggatcgacacagccgatggatcagctaatcatcgcgcaagagtgacgacacggatgggaaacactccagactcagcttctgacaatctcgggtttaggtgcgcagccgatgctggcagacctcccggtgagctatag

SEQ ID NO: 54609 - DNA, 1077 bp, Artificial Sequence
  Description of Artificial Sequence: Synthetic coding sequence
atgcgtgctcacgcacagcggggtaggggttgtacgcgtcgcagtgcggctgtgttgatggccaggcatggcctgccactgctgccattgctgtcgctgctcgtgggtgcatggcttaaattaggtaatggccaggccacaagtatggtgcaattacagggaggcagatttcttatgggcactaattcgcccgacagtcgtgacggggatggacctgtcagagaggcaactgtgaagccttttgctattgacatttttcctgtaaccaacaaggactttagggacttcgtccgagaaaagaagtatcgtacagaagctgagatgttcgggtggagtttcgtgtttgaggacttcgtctctgacgagttgagaaacaaagcgactcagcctatgaaaagcgtgctgtggtggcttccagtggagaaagccttctggcgccagcctgccggtcctgggtccgggatccgggagagactggaacatcctgtcctgcatgtctcttggaacgacgccagggcctattgcgcttggcgtggcaagaggctgccaaccgaagaagaatgggagttcgccgctaggggcggtctgaagggacaggtgtatccctggggtaattggtttcagccgaatcgtaccaatttgtggcagggcaagttccccaaaggcgataaggctgaggatgggtttcacggggtgtcccccgttaatgcattccctgcccagaataactacggatgggccacactgcagatacaaccacagacaacctctgtcagcgccgttctgcagactcaggccggacggcaggggtcatgtaaacagccgggtggcgacaaggagaagagcctcctcggctctttgtcattccccggacatgtggctaattcggcaatcccaagctcccgggcttccgcctctggaaagaacttcccatttccggtctcccaccccagcgtagccggagccagccatcagggcagacgcggactgagcttgctgtgttttggggaaggcgcacagtgcgtgttgactatggctggcggacaggtctttctgctagaggccaaatactactag

SEQ ID NO: 54610 - DNA, 711 bp, Artificial Sequence
  Description of Artificial Sequence: Synthetic coding sequence
atgagggcgcacgcccagaggggaaggggatgtacgcgtcgatctgccgctgtgctgatggcaagacatggtctcccgctcctgcctttgctttcacttctggtgggcgcttggctgaagctgggcaacgggcaggccaccagtatggtccagcttcagggcggtagattcctgatggggacaaattcacccgattccagggacggggacggtcctgtaagggaggccaccgtgaagcctttcgcaatcgacatctttcctgtaaccaataaggacttccgcgatttcgtgagagaaaaaaagtatcgcacagaagctgagatgttcggctggagtttcgtctttgaggactttgtctccgatgaactgcggaataaggccactcagcccatgaagggcaagtttcctaagggcgacaaggccgaggacggttttcatggcgtttctcccgtcaatgcctttcccgctcagaataactatggactttacgacctgctaggtaacgtgtgggagtggacagcaagtccttatcaagccgcagagcaggatatgagggtgttacggggtgctagctggattgacactgctgacggatctgctaaccaccgtgctagagtcaccaccaggatgggaaacacgcccgatagtgcatccgacaaccttggatttcgatgcgcagcagatgccggtcgccctccaggcgaattgtag

SEQ ID NO: 54611 - DNA, 918 bp, Artificial Sequence
  Description of Artificial Sequence: Synthetic coding sequence
atgcgtgctcatgctcagcgcggtcgtggctgcacacgtcggagtgcagcagtgctaatggccagacatggattgcccttgctgcccctgctatcactgctcgtaggcgcttggttgaagctaggtaacggccaagcaactagtatggtccagctgcaagggggtagattcttgatgggcaccaactctcccgacagtcgcgacggtgacggcccagtccgggaagccaccgtgaagccatttgccatagatatatttcccgtgacaaacaaggatttccgggacttcgttagagaaaagaagtaccgcacagaggcagagatgttcgggtggagtttcgtgtttgaggacttcgtatcagacgaattacggaacaaggctacccagcccatgaaacctgctggaccaggctccggtattcgagagcgtctggagcatcctgtcctgcatgtgagctggaatgacgcccgtgcctactgtgcctggcggggaaagcgattacctaccgaagaggagtgggagtttgcagccaggggaggccttaaaggacaggtttatccctggggtaattggttccagcccaatcgaaccaacctctggcaggggaaatttccaaagggtgacaaggcagaggacggattccacggcgtgtcgcctgtgaatgcctttcccgctcaaaacaactacggtctctacgaccttctggggaacgtgtgggaatggacagcgagcccttaccaggccgctgagcaggacatgagggtgctgagaggggcatcttggattgatactgccgacggaagtgccaatcatcgggctcgcgttacgacccgcatggggaatactcccgacagtgctagtgataacttggggtttaggtgcgccgcagatgccggacggccacctggggagctctag

SEQ ID NO: 54612 - DNA, 885 bp, Artificial Sequence
  Description of Artificial Sequence: Synthetic coding sequence
atgagggcccacgcccaacgaggcaggggatgtacacgccgttccgccgcagtcctgatggctcgccacgggctgccgcttctgcccctgctcagtctgctcgtcggggcttggctgaagctcggtaacggacaagccaccagcatggtgcaactgcagggcggtcgcttcctgatgggcacgaactctcctgacagtagagacggcgacggccctgtgcgtgaggctaccgtgaaaccattcgcaatcgatatcttccccgttaccaataaagacttccgttacattcgtgacttcgttcgcgaaaaaaaataccgaacagaagccgaaatgtttggctggtccttcgtctttgaagatttcgtgagcgatgaactgagaaacaaggcaacccaacccatgaaaagtgtcttatggtggctgcccgtagagaaggcattctggaggcagccagcgggaccgggttcgggcataagagaacgactggagcacccagtactgcacgtttcgtggaacgatgccagggcctactgcgcatggaggggcaagaggctccctaccgaggaagagtgggaattcgctgctcgtggtggactgaaaggtcaggtctatccctggggcaattggttccagcctaaccggactaacctgtggcagggtaagtttcccaaaggagataaggccgaagatgggttccacggcgtgtctcctgttaatgcgttcccagcccaaaacaactacggcctgtacgaccttttgggcaatgtgtgggaatggactgccagtccttatcaggctgctgagcaagacatgagagtcctgcgaggcgcttcctggatcgataccgcagatggcagcgctaaccaccgtgccagggtcacctag

SEQ ID NO: 54613 - DNA, 963 bp, Artificial Sequence
  Description of Artificial Sequence: Synthetic coding sequence
atgcgcgcacacgcccagcgcggaaggggctgtacacgcagaagcgctgcagtgctgatggcccgacacggactgccactgctgccactgttgtcactgctggtaggggcatggttaaagctgggcaatggtcaagctacctctatggtgcaacttcaagggggacgatttctgatgggaacaaattcccccgatagccgtgatggagatggaccagtccgggaagcgaccgtcaagccattcgctattgacatcttccccgtgactaacaaagacttcagagatttcgttcgggagaagaaatataggaccgaagcagaaatgttcggctggtcctttgtgtttgaggacttcgtttccgatgagctacggaacaaagccacccaacccatgaagtcggtcctctggtggctgccagtggaaaaagctttttggcgccagccagccggacctggttccgggattcgagagcgcctggagcatcctgtgctccacgtttcttggaacgatgctagagcttactgcgcctggcggggtaagcggttgcctacggaggaagaatgggagttcgccgctcggggagggctaaaaggacaggtttacccctggggaaactggtttcagccaaacaggacaaacctgtggcaaggaaaattcccaaagggcgataaagctgaagacggttttcatggagtttctcccgtcaacgcgtttccagcccagaacaactacggcctgtatgatctccttggaaacgtctgggaatggactgcatcaccctaccaggccgctgaacaggatatgcgcgttttgagaggagcctcctggattgataccgccgacggctcagcgaaccaccgcgctcgcgtcacaacgagaatgggcaatacacctgactctgctagcgataatctgggcttcagatgcgcggctgacgccggacggccacccggagaactgtag

SEQ ID NO: 54614 - DNA, 1821 bp, Artificial Sequence
  Description of Artificial Sequence: Synthetic coding sequence
atggtgcgtggcgctaggcagcctcagcaaccgagatccagacttgcgcctcgcttaacaggcaccgtggagaagccacctagaaagagacgctctcgcacagagttcgcgttaaaagaaattatgtccagcggcggtgcagaggacgacataccacagggagagcggaagactgtgaccgatttttgctacctgctggacaagagcaaacaactgttcaatggactcagggatctcccccaatatggacagaaacagtggcaatcatacttcggaagaaccttcgacgtctatacaaaactctggaagtttcagcagcagcaccgccaggtactagacaatagatatgggctcaagaggtggcagattggagaaattgctagcaagatcgggcaactctactaccactattacctgcggactagcgagacctcatacctcaacgaggccttctctttttattctgctataaggcagagaagctattacagtcaagtgaataaagaggacagacctgagctggttgtgaagaagctgagatactatgccaggttcatagtagtctgtctgttgctaaacaaaatggacgtggttaaagatctggtgaaagagctgtccgacgaaattgaggattacactcatagattcaacactgaggaccaggtcgagtggaatttggtactacaggaggtcgccgcattcatagaagccgacccggtgatggtcttgaatgatgataacactatcgtcattacatctaatcgtctcgctgagacaggagctccgctcctggaacaagggatgattgtaggccagctgagcctggcagatgccttaattattggaaactgcaacaatcaggtgaaatttagcgaactgacagtcgacatgtttcggatgcttcaagctttagagagggagcccatgaacctggcaagccaaatgaataagcctgggatgcaagagagcgccgataaacccacccggagggagaatcctcataaatacctgctatacaaaccaactttttctcagctgtatactttcctggctgcctctttcaaggagttacccgcaaacagcgtgcttcttatttatttgtccgctacaggcgtcttccccactggacggtctgatagcgaagggccatacgactttggaggcgtcctgacaaactccaatagggacattatcaatggggatgccatccataaaagaaaccaatcacacaaagaaatgcattgtctgcacccaggagacctttacccattcaccaggaaaccgttgtttattattgtggactcttccaattcagttgcttacaagaatttcacaaacctgtttggtcagcccctggtatgtcttttaagcccaacagcatatcctaaagctctgcaggatcaatcccagcgcggtagcctgttcactctgttcttgaacaacccactgatggctttcctgtttgtttctggtctgagctcgatgcggcgaggactttgggaaaaatgtcaagagtacctgagaaagataaatagggatatcgcccaactactgacccattccagatctattgatcaggccttcttgcaattttttggcgacgaattcctcagactccttctcacgaggttcatcttttgctccgcaactatgaggatgcataagattttcagagagactaggaactacccagagtcctatccccagctgccaagggacgaaacggtggaaaatccacatctgcagaagcacatccttgaactcgccagtatactagatgttaggaatgtgttctttgagaatacaatcgacgactactag

SEQ ID NO: 54615 - DNA, 1890 bp, Artificial Sequence
  Description of Artificial Sequence: Synthetic coding sequence
atggtacgtggcgctcggcagccacaacaacccagaagccggctggcccctcgcctgacagggactgttgagaaacctccacgaaagcgcagatctagcatcagagggagtggagactcaagccatagccaaagtcaaggagagagatatcagcactttacggaaaagacagagttcgcgctgaaagagattatgtcctctgggggtgccgaagatgacatccctcagggtgagcgaaaaacagtgaccgatttttgctacctactagataagtcgaagcaactgttcaatggtctgcgagacctcccccagtatggccaaaagcagtggcagtcatactttgggaggacctttgacgtgtacactaaactgtggaaattccaacaacaacataggcaggttctcgacaatcgctatgggctcaagcgatggcagatcggcgagattgcgtcaaagattggccaattgtattatcactattatcttcggacttctgagacgtcttacctgaatgaagcatttagtttctactcagccatcaggcagaggagctattactcccaggtgaacaaggaggaccgtcctgagctggttgtgaaaaaattgaggtattacgctagattcatcgtagtgtgcttgctgcttaacaaaatggacgtggtgaaggatctggtgaaggagctcagtgatgagatcgaagactatacacatcgctttaacacggaagatcaggtggagtggaatctggtgctccaggaagtcgcagctttcatagaagctgatccggttatggtactgaacgacgacaatacaattgtcataaccagcaaccgactggctgagacaggggcaccactgctggagcagggcatgatcgtggggcagctaagccttgctgacgccctaataattgggaattgcaataatcaagtcaaattctccgagcttacagtggacatgtttaggatgctgcaggcactggagcgagagcccatgaatctcgccagccagatgaataagcctggcatgcaggaatcagcagataagcctacgaggagagagaatcctcacaaatatctgctttataaaccaacttttagtcaattatacacctttttggcagcaagctttaaggagctgcccgcaaacagcgtactccttatttatctgagtgcaactggggtcttccctacggggcgttctgattccgagggaccctacgatttcggaggcgttctgaccaacagtaatagggacataatcaacggggatgctatacataagcgcaatcagtctcacaaagagatgcactgtctgcaccccggtgatttgtaccccttcaccaggaagccacttttcatcatcgtcgactctagtaacagcgtcgcttataaaaattttacaaacctcttcgggcagcctctggtctgcctcctcagcccaactgcatacccaaaggcactgcaggaccaatcccagagaggatcactgtttacactcttcctgaacaacccgttgatggcctttcttttcgtatcaggcctctcctccatgcgaagggggctgtgggaaaagtgtcaggagtatctacggaagatcaacagggacatagcgcagctcctcactcacagtaggtctattgaccaggcttttctgcagtttttcggggatgagtttctcagacttctactaacgcgcttcatattctgctcggctaccatgagaatgcacaagatttttagggagaccagaaactacccagagtcctacccacagctccctcgcgacgagaccgtggagaatcctcacctgcagaagcatatcttggaacttgcctccatccttgacgttagaaacgtgttcttcgaaaacactatagacgactattag

SEQ ID NO: 54616 - DNA, 1746 bp, Artificial Sequence
  Description of Artificial Sequence: Synthetic coding sequence
atggtctttagaaatgtgggcagaccaccggaagaggaggatgttgaagccgcacctgaaccaggcccatccgagctcctctgcccacgccaccgatgcgcccttgaccccaaagccctgccacccggtctagctttggagcggacctggggacctgctgcaggtcttgaggcccagttggcggcactaggactgggccagccagcagggcctggggtgaagaccgtggggggaggctgttgcccatgtccgtgtcctccacagccaccccctccccagccacagcccccagccgctgcgccacaagctggagaggaccccaccgagacctccgacgccctgctggtgctggagggtttagagtccgaggcagagagtctagaaaccaacagctgtagcgaagaagagctctcctcgcctggcaggggcggtgggggaggcggacgcctcctgctacaaccccctgggcctgaactgcctcccgtgccctttccgctgcaggacctggtgccccttgggcgtctctctagaggagaacagcaacagcaacagcagcaacagcctccccctcccccaccaccaccagggcctttgagacctctcgcgggacccagccgcaagggtagttttaagatccgactctccagattattcagaacgaaaagctgcaacggcggtagcgggggtggagatgggacaggaaaaaggccatcaggcgaactggccgctagcgcagctagtttgacggatatgggcggaagtgccggacgcgaattggacgccggtcgcaaacccaaacttacgcggacacaatcagccttcagcccagttagttttagccccctttttacaggggagaccgtctcgctagtggacgttgatattagtcaacggggactcacatccccacatcccccaacgcccccacctcccccacggcgaagcctgagcttactagacgacatatctggcaccctccctacttcagttcttgtggccccaatgggcagttctttgcagtcttttcccttgccccctcctccccctccccatgcacctgatgcctttccgaggatcgctcctataagagctgccgaatcacttcacagccagcctcctcagcacctccaatgcccgctctatcggccagacagctcaagctttgcagcctcactgcgagagcttgaaaagtgtgggtggtactggggtcctatgaactgggaggatgctgaaatgaagctgaagggtaaacctgacgggagcttcctggtgcgcgattctagcgatcctagatacatcctttctctgtcattcaggagtcagggaatcacacatcatacacggatggaacattacagaggcacgttttccttatggtgccaccccaagttcgaggaccggtgccagtccgtggtggagtttatcaaaagagcaatcatgcactcaaaaaatggtaagtttctgtactttctgaggtccagagtgcctggcctgccacccactcctgtgcagctgctgtaccccgttagtagattctcgaacgtaaagtcactccaacatttatgtagattccggattcgccagttggtacgaatcgaccatatccctgacctgccactccccaaacccctgatcagttatatccgaaagttctactattacgaccctcaagaggaggtttacttatctcttaaggaggcacaactgataagtaagcaaaagcaggaggtggagccctctacttag

SEQ ID NO: 54617 - DNA, 1746 bp, Artificial Sequence
  Description of Artificial Sequence: Synthetic coding sequence
atggttttccgcaacgtgggccgacctcctgaggaggaggatgtcgaagccgctccagaacctggacccagcgagttgctgtgtccgcgtcatcggtgcgcattggatccaaaggcactccctcccggtctcgctttagagagaacctggggccctgctgctggtcttgaagcgcaattagcggcactggggctaggccagcctgctggacctggcgtgaaaaccgtcggaggaggctgctgtccctgcccttgtcctccccagccacccccacctcagcctcagcctcccgcagctgcaccccaggctggcgaagatccgacagagacctctgacgcccttctggttctcgagggcctggagtccgaggccgagtcactagagacaaactcctgcagcgaggaggagctctcatctcctggacgcggaggcggaggaggcggtaggctgctgctccaacctcctggcccagagttaccacctgtcccttttcctctccaggatctggtccccctggggagactgtcgagaggcgagcagcaacagcagcagcagcagcaacccccaccgcctccgccacctcccggacctctgagacccctggcgggaccgagccggaaagggtcgtttaaaattcgccttagccgactcttccgtaccaagagttgcaacgggggaagcgggggaggcgatgggaccggcaaaaggccgtccggggaattagcagcctcagcagcatccctcaccgatatggggggaagcgccggaagggagttggacgccggacgcaagcccaaactcactcggacccaatcagccttctcccccgtgtcgttctctcctctattcactggggagaccgtatccctggtggatgtggacatttcccaaagagggctgacgagtcctcacccaccgaccccacccccacctcccagacggagcctgagtctgcttgatgacatctcgggcaccctgccgacttccgtgctcgtggcgcctatgggaagctcactgcaatcctttccgcttccgcctccaccccctccacacgcacctgatgcctttccaaggattgcgccaattagagccgctgagagcctccactcccagcccccacaacacctgcagtgtcccctttaccggcctgactcgtcttcctttgccgcatccttgcgagagctcgagaaatgtggttggtactgggggccaatgaactgggaggacgccgaaatgaagttgaaaggtaaaccagatggatccttcctggtgcgggatagctctgatcctcgttatatcctcagcctgtctttccggtctcagggaattactcatcatacaaggatggaacattacagaggtactttcagcctctggtgtcatcccaagtttgaagataggtgccagtctgtcgtagagtttattaagcgcgctatcatgcactccaaaaatggcaaatttctgtatttcttacggagcagagtcccgggacttcccccaacacccgtacagctgctgtacccagtgtcgcgctttagcaatgtcaagtccctgcagcacctgtgccggtttcgaatccgccagctagttcgaatcgaccatatacccgacctcccactgccaaaacccctaatctcttacattcgcaagttctactattacgacccccaggaagaagtttacctctctctgaaagaggcacagctgatttccaaacaaaaacaagaggtcgagcctagtacatag

SEQ ID NO: 54618 - DNA, 2169 bp, Artificial Sequence
  Description of Artificial Sequence: Synthetic coding sequence
atgggcagaggtccctgggacgcagggccttcccggcgtctcctgcccctactcctccttcttgggttagcacgaggagccgcaggcgctccaggaccagatggtttagatgtatgtgctacctgtcacgagcatgccacctgtcagcagcgcgaaggtaagaagatttgtatctgtaattacggctttgtaggtaatggacggacgcagtgcgttgacaagaacgagtgccagtttggcgcaacattagtctgcgggaatcacacatcatgtcacaacacgccagggggtttctactgcatatgcctggaaggataccgggctaccaacaacaataagacgttcatccctaacgatggcacattctgtaccgatatagatgagtgcgaggtgagcgggctgtgcaggcacggtgggagatgtgtgaatacacatgggtctttcgagtgttattgtatggacggttacctgccaaggaacggccctgagccctttcatccaaccaccgatgccacatcttgtaccgagatcgattgcggcaccccccctgaggtgcccgacggctatattattggtaattatacctcctcactggggtcacaagtgcgttatgcctgccgggagggcttcttttctgtgcctgaggacacagtcagttcatgtacagggctcggaacttgggaatctccgaaactccactgccaggagattaactgtggcaaccctccagaaatgaggcacgccatactggtcgggaatcactcctccagactcggaggcgttgccaggtatgtgtgccaggaaggcttcgaatcacccggagggaagattacatcagtatgtacagagaagggaacttggcgagagagtacgctcacatgtacagaaattcttaccaaaataaatgacgtttccctctttaacgacacctgtgtgcggtggcagatcaattccaggcgcataaatccaaaaatttcttatgttatcagcattaaaggccaacgtctcgacccaatggagtccgtaagggaagaaacagtgaatctgacaacggatagtaggactcccgaagtgtgcttggctctctatcccggaactaactacacggtgaatatttctaccgctccacctcgcaggtccatgccagccgtgatcggatttcagactgccgaggtggacctgctggaggacgatggatctttcaacatctccatcttcaacgagacctgcctgaagctgaataggagaagcagaaaagttggaagcgagcacatgtaccagttcactgtcctaggtcagagatggtacctcgctaatttcagtcatgctacgtcttttaattttaccacaagagagcaagtccctgtcgtctgtctggatctctatccaacgacagattacacagtgaacgtgaccctcttgagatcacctaaaagacattccgttcagatcaccatcgcaactccgcctgccgtgaagcagaccatctcaaacatttcaggttttaacgagacttgcctgcggtggcggagtatcaagaccgccgacatggaggagatgtatctgttccatatctgggggcagcggtggtaccagaaggagttcgcccaggagatgacattcaacattagttcaagttcacgcgatccggaggtctgtctcgacctgcgaccgggaacaaactacaatgtcagtctgagagcccttagctccgagctgcccgttgtaatcagcctcaccactcagatcaccgaacctcccctgcctgaagtagaattttttacagtacaccggggacctctgcctcggttgcgactgcgcaaggccaaagaaaagaacggaccgatttcaagttatcaggtgctggtgctcccattagccctacaatctaccttctcatgcgattccgagggcgcatcaagcttcttcagtaatgccagtgacgcggacgggtatgtcgctgcggagctgttggctaaggatgtgcccgatgacgcaatggagattcccatcggggaccgcttgtactacggcgaatactacaatgccccacttaagcgcggaagtgattactgcattattttacgtattacatccgaatggaacaagatccgacacagttgttgctgtagatggagggtgcttgattgggtgccctggctactctag

SEQ ID NO: 54619 - DNA, 2274 bp, Artificial Sequence
  Description of Artificial Sequence: Synthetic coding sequence
atggggagaggcccatgggatgctggtccctcacgacgcttgctaccacttctactcctgttagggctggcacggggagctgccggtgctccgggtccagacggtctggacgtgtgcgcaacatgtcatgaacacgccacctgccaacagcgagaaggaaaaaagatatgcatctgcaactacggattcgtgggaaatgggcgaactcagtgtgtggacaagaacgagtgccagtttggagccactcttgtttgtggaaatcacacttcatgccataatacacccggtggcttctactgcatctgtctggagggatatcgagccactaacaataataagacatttattcctaacgacggcacattctgcactgatattgacgagtgcgaggtctctggactttgtagacacggaggtaggtgcgtgaacactcatggtagtttcgaatgttactgtatggatggctatttacctcggaatggccctgagccatttcatcctacaaccgatgctacctcctgtactgaaatcgactgtgggacaccgcctgaggtccccgacggctatattatagggaattatacctcctccttggggagtcaagtccgctacgcctgtcgggagggctttttctccgttcccgaagacactgttagtagctgcacaggattaggcacctgggaaagcccgaagctgcactgtcaggaaattaactgtggcaatcctccagagatgcggcatgccatactggtcgggaatcattctagccgtctcgggggagtggcccgatatgtatgtcaagaagggtttgaaagccctggtgggaaaattacatcagtttgtaccgaaaaggggacttggagggaatctacacttacgtgcaccgagatccttaccaagatcaatgacgtgtctctgttcaatgatacttgcgtccgctggcaaattaacagtcgaagaatcaacccgaagatatcctacgtcattagtattaaaggacagcggctagaccccatggaaagcgtgcgagaggaaaccgtgaacttaaccaccgatagccgcactccagaggtgtgtttggccttatatccgggaaccaactacaccgtgaacatttcaaccgctccccctcgaaggagtatgcctgctgtcatcggtttccagaccgctgaggtggacctccttgaggacgacggaagtttcaacattagcatatttaatgagacatgcttgaaactgaaccgtcggagcagaaaggtggggtctgagcatatgtatcagttcacagtgttgggccagcggtggtaccttgctaacttttctcatgctacttcattcaatttcacaacgcgcgagcaggtgcctgtggtatgcctggacctgtatcccaccacagactacactgtcaacgtcacccttttgaggagccccaaaagacactccgtgcagataactatcgccaccccacctgcggttaaacagacgatatccaatatttctggatttaacgagacatgcctgcgttggcggagcataaagactgcggatatggaggaaatgtacttgttccacatctggggccaaaggtggtatcagaaggagttcgctcaggagatgaccttcaatattagtagctcctccagagatccagaagtgtgcctggatctgcgccctggcacaaattacaatgtttcattaagagctctttcgagtgagcttcctgtggtgatttcgttgacgacccaaattaccgaacctccgctgcccgaggtcgaattcttcaccgtgcatagaggccctctgcccaggcttagactacgtaaagcaaaggagaagaatgggccaatctcctcatatcaggtgctggtgctacctttagccttgcagagcaccttctcctgtgattcggagggtgcttcaagcttctttagcaacgcctccgatgccgacggctatgtagcagccgaactgttagctaaggacgtccctgatgacgccatggagatcccaatcggggaccgcctgtactatggcgagtactataatgctccattgaagcgcggtagcgactactgcattatactccgcatcacctccgaatggaacaaggtgcggagacatagctgtgcagtgtgggctcaggtcaaggagattccctgtaattgtaacttcctacgtcttcacatacatcgggctaatagcggtgacactcagatacgccactcttgctgctgcaggtggagagtgcttgattgggtgccttggctcttgtag

SEQ ID NO: 54620 - DNA, 2244 bp, Artificial Sequence
  Description of Artificial Sequence: Synthetic coding sequence
atgggcaggggtccctgggatgccggacccagcagacgtctgctcccccttctgctgttactggggttggccaggggtgctgctggcgcacccggtcctgacggccttgatgtatgtgctacctgccatgagcacgccacgtgccagcaaagggagggcaaaaagatctgcatttgtaactacggatttgtcggtaatggcagaactcagtgtgttgacaagaatgagtgtcaatttggagcgactctggtttgcggcaaccacactagctgccacaatacacccggtggtttctattgcatctgtttggaggggtaccgcgcaactaataacaacaagacatttataccaaatgatggcacattctgtactgacatcgacgagtgcgaagtgtctggcttatgtaggcacgggggacggtgcgtaaatacccacggttctttcgagtgttattgtatggatgggtatcttcctcgcaacggccctgagcccttccaccccactaccgatgccacctcctgcacagaaattgactgcggcacaccgcctgaggtccccgacgggtatattattggcaactacacctcatcccttgggtcccaggtccgatatgcgtgccgggagggcttcttttcagttcctgaggataccgtctctagctgcaccggccttggtacttgggaatcacctaaattacattgtcaggagataaattgcggtaatccccctgagatgcgtcatgccattctggtgggaaaccatagttcacgcctgggaggtgtagccaggtacgtatgccaggagggttttgaaagccccggagggaaaattaccagcgtgtgcactgagaaaggtacttggcgggaaagtaccttaacatgcacagagatcctcacaaagatcaatgatgtctccctgttcaacgatacctgtgtaagatggcagataaattctagaaggatcaatccaaaaataagctatgtgatctcgatcaagggccaacggcttgatccgatggaatccgtccgcgaagaaacagtcaacctgaccaccgactcccggacccccgaggtttgcctcgctctgtatccaggcacgaattacactgtgaatataagcacagctccacctagaagatccatgcctgccgtgataggatttcagactgccgaggtggatctgttggaagatgatggatcctttaacatctccatattcaatgagacatgtctgaaactgaacagaagatcaaggaaggtgggatccgagcatatgtaccagtttacagtgctcggacagcgctggtaccttgccaactttagccatgcaacttcctttaattttactacgcgggagcaggtgcccgtcgtgtgcctcgatctgtatccaaccacagattatacagttaatgtgacacttttgcgaagtcccaaacgccatagtgtgcagatcactatagccaccccacccgctgtgaaacagaccatttccaatatctccggattcaacgagacatgtctgcgctggcggagtattaagaccgccgatatggaggagatgtatctattccacatttgggggcagcggtggtaccaaaaagaattcgcacaagaaatgacgttcaatattagctccagttctcgggacccagaagtttgtctggacttgcgacctgggactaattataacgtctctttacgcgcactatcaagcgagctgcctgtcgtgattagcctgacaacccagattactgaaccaccccttccggaagtcgagtttttcaccgtgcaccgcggacctctccctcgcctgcgcctccgcaaggcaaaggaaaaaaacggcccaatcagctcttaccaggtgcttgtcctgcccttagctctacagtccaccttctcttgcgacagtgaaggggcatcaagcttcttcagcaacgcatcagatgcggacgggtacgtggccgcagagctcctggctaaggacgtacccgatgatgccatggaaatccctataggagatcgactttactacggagaatactacaatgcacctttaaagagagggagcgattattgtatcatcttacgcattaccagtgagtggaataaggtccgtcgtcatagctgtgcggtgtgggctcaggtgaaggacagcagcctcatgttgctgcagatggctggcgtggggctgggcagtcttgctgttgtgattatcctgacttttctttcattttcggccgtgtag

SEQ ID NO: 54621 - DNA, 2469 bp, Artificial Sequence
  Description of Artificial Sequence: Synthetic coding sequence
atgaaacctgctctgttgccttgggctctgctccttcttgctactgccctcgggccagggcctggcccaacagccgacgctcaagagtcctgctcgatgaggtgcggcgctctcgacggaccatgttcctgccatccgacctgtagtgggctgggcacgtgttgccttgattttagggatttttgcctggagattctgccctattccgggtcgatgatgggaggaaaggatttcgttgtccggcactttaaaatgagttcgcctaccgatgccagtgtcatctgtcgatttaaagactctattcagacgctgggacacgttgacagcagcggtcaggtgcactgcgtaagccccctgttgtacgagtccggtcgaattcctttcaccgtctctctggataatggacattcctttcctagagccggaacctggttagccgtccaccccaataaagtgagtatgatggagaagagcgagctggtgaacgaaacgcgctggcagtactacggcactgcaaatacttctggcaacctttccctcacctggcatgttaaatccctgccaacacagacaataactattgaactgtggggatatgaagagacgggaatgccttattcacaagaatggaccgcaaaatggtcgtatctgtaccctctagccactcacattcccaacagcggttcttttacgttcacccccaagccagctccaccatcttaccagagatggagggtcggggctctgcgaatcatcgatagcaaaaactatgccggtcagaaagacgtccaggctctttggaccaatgaccacgctttagcctggcacctgagtgacgatttcagagaggacccagtggcatgggcccgtacccagtgccaggcttgggaagagcttgaagatcaattaccgaatttcctggaagagttacctgattgtccgtgcacactgacccaggctcgagcagatagcggccgttttttcaccgattacggttgtgacatggagcagggatcagtgtgcacttaccatccaggagccgtgcactgcgtaagaagtgtccaggcgtcactgcgatatggctctggacagcagtgctgttacactgcggatgggactcagctcctgaccgctgattctagcggcggaagcactcccgatagagggcacgattggggggctccaccatttcgcactccgccaagggtgccctccatgtcccattggttatacgatgtgctttcattttactattgctgcctttgggctcccgattgcccaaggtacatgcaaaggagaccctccaatgactgtcggaattatcgcccaccacggctggcatccgcattcggggatcctcacttcgtcacctttgatggtactaatttcacgttcaacggacgcggagagtatgtcctgcttgaagccgcacttacagatctccgagtacaggccagagcccagcccggaacgatgagtaatgggacagagacaagaggcaccggactcacagccgttgccgttcaggaaggcaatagcgatgtcgtggaagtgcgactagccaaccgaaccgggggacttgaggtgctcctgaatcaagaggttttatctttcacggagcagtcgtggatggacctcaagggcatgttcctttctgtcgcagccggagatagggtttcgatcatgcttgcttccggtgcgggtttagaggtgtctgtccagggccctttcctatccgtgagcgtgctgctgcccgagaaatttctgacccacactcatggccttctgggtacccttaacaatgatccaaccgatgatttcaccctgcactctggccgtgtgctgccaccagggacgtctccccaggagctcttcctgttcggcgcaaattggacggtgcacaacgctagctcactcctgacatatgactcatggtttctcgtgcataattttctgtaccagcctaagcatgatcccaccttcgaacctctctttccatcagagaccaccctgaacccgtccttggctcaggaggctgccaaactgtgcggagacgaccacttttgtaacttcgacgtcgccgctacaggtagtctgtccaccggcaccgccacacgcgttgctcatcagcttcatcaaagacggatgcagtcccttcagccagtcgttagctgcggatggctagccccaccccctaacggtcaaaaagagggaaatcgctacctggccggtagcacaatttacttccactgcgacaacggatattccctggcaggtgctgaaactagcacttgccaggcggatggaacttggtcaagtcctacccctaagtgccagccagggagatcctatgccgtactgctaggaatcatttttggaggacttgctgtcgtcgcagcagtagctttggtgtatgtcctgctgagaagacggaagggaaatacgcatgtgtggggagctcaaccttag

SEQ ID NO: 54622 - DNA, 729 bp, Artificial Sequence
  Description of Artificial Sequence: Synthetic coding sequence
atgaagaatattggcttggtgatggaatgggaaatacccgagatcatttgcacttgtgccaagcttcggcttcctccacaagctacatttcaggtgttgcggggaaatggagccagcgtcggaactgtactgatgttccgctgtcccagtaaccatcagatggtggggtccggcctgctcacttgcacttggaaaggatcaatcgctgagtggagttctggcagccccgtgtgcaagctcgtgccaccccatgagacatttgggttcaaagtggccgtcattgccagcatcgtgtcttgcgcgatcattctgctcatgtctatggccttccttacctgctgtctcctgaagtgcgttaagaagtcaaaacgtcgcagaagcaaccggtccgcacagctctggagccagttgaaggatgaggacctggagaccgtgcaggctgcctatctgggtctcaaacacttcaataaacctgtgagcggccctagccaagctcacgataatcattctttcaccactgatcatggcgaatccacgagcaagctggcctctgtgaccagaagcgtggataaagaccctgggatacccagagcgctctctctgtccggaagttctagctccccccaggcccaggtgatggtgcacatggccaaccctagacagccactccctgcatctggactcgcgacagggatgcctcagcagcccgctgcgtacgccttggggtag

SEQ ID NO: 54623 - DNA, 768 bp, Artificial Sequence
  Description of Artificial Sequence: Synthetic coding sequence
atgaggtgggcagctgcgacgctccgcggaaaagccaggccacggggtcgggctggcgtcaccacgccagcaccgggaaacaggaccggcacatgcgcaaaattgcggcttcctccacaggccacgttccaggtgctcagaggcaacggcgctagcgtgggaaccgtgctcatgttcaggtgtccaagcaaccaccagatggtgggaagtgggctgctgacgtgtacctggaagggttcgattgccgaatggtccagcggatcccctgtgtgcaagctcgtacctccacatgaaacattcggcttcaaagtcgcagtgattgcctctattgtatcatgtgcaattatattgctgatgtccatggcattcctgacctgttgtctgctaaagtgtgtgaagaagtccaagaggcggaggtcaaatagatcagcccagttatggtcccagctgaaggatgaagaccttgagaccgtacaggctgcatacctcggactcaagcactttaataaacctgtgtccggcccttcacaggctcatgacaaccattcttttaccacagatcacggcgaatctacttcaaagcttgcttccgtgacccggtccgtagataaggatcctggcattcctcgggcactgtctttaagcggatcctcaagttccccacaggctcaggtcatggtacacatggccaaccctcgccagcccttgcccgcatcaggtctcgccacaggcatgccccaacagcccgctgcttacgccctcgggtag

SEQ ID NO: 54624 - DNA, 711 bp, Artificial Sequence
  Description of Artificial Sequence: Synthetic coding sequence
atgtaccacggcatgaacccctcgaatggtgacgggttcctggaacagcagcagcagcaacagcagccacaaagtccacagcgcttgctggctgtaattctgtggttccagctcgccctatgctttggccctgctcagctgaccggtggcttcgatgacttacaggtgtgcgctgatccgggtatcccagaaaacgggttccgtaccccaagcggtggcgtgttctttgaaggcagcgtggccaggttccattgtcaggatggctttaagctgaaaggggctaccaagcgcctttgtctcaaacatttcaacggtacattgggatggattccttccgataattccatctgtgtgcaggaggactgtaggattccccagatcgaagacgcggagatccataataagacgtataggcacggcgaaaaacttataatcacgtgccatgaaggtttcaagatacgctatcctgatttacataacatggtgtccctgtgccgcgacgacggtacctggaacaatctccctatttgccagggatgtctgaggccactcgcaccccagcacacccccgcacaggggactcgcacccaggctcagggctcccagaaaccggtaaccgcatctcaggctctgctcagctgtagtaaagtgtgcattcatctgccaggggctaagcgcgcaccaacgctgctgcggaccaccctcacgtag

SEQ ID NO: 54625 - DNA, 321 bp, Artificial Sequence
  Description of Artificial Sequence: Synthetic coding sequence
atgtaccacggaatgaacccctctaacggagacggttttctggaacagcagcagcagcagcaacagcctcagtcgccgcaaagattactggctgtaatattatggttccagctggccttgtgcttcggcccagctcagctaactggtgtacaccttactcgcgatttgcttggtttcgagggctgtcctgaatgtcctcccccacctgggttcaaagaagaatcgcaggagttcgctcagcaggtgacacccctcagatccttaacgcatgccaacccttggtctagcggcccactatgcattccaaagtcgtggtcctag

SEQ ID NO: 54626 - DNA, 1473 bp, Artificial Sequence
  Description of Artificial Sequence: Synthetic coding sequence
atgtatcacggcatgaacccctcaaatggcgatggtttcttggagcagcagcaacagcagcagcaaccccaatcaccccagcgcctcctggcggtgatcctctggttccagctcgccctttgcttcgggcctgcacaactcaccgggggatttgacgacctgcaggtttgcgccgatcccggtatcccagagaatggctttcgcaccccttcaggaggcgtattcttcgagggtagcgtcgctcgctttcattgtcaggatggattcaagctaaagggggcaaccaagcggctgtgtctgaaacacttcaacggcaccttggggtggatcccttccgacaattcgatctgcgtgcaagaggattgtagaattcctcaaatcgaggatgctgagatccacaacaagacgtaccgccacggagagaagctaatcattacctgtcacgaaggctttaaaattcggtacccggacctccataatatggtcagcctgtgcagagatgacggaacttggaacaacctgccaatttgccagggctgtctaaggccactggcctcatcgaatggatatgtgaacatcagtgaacttcagacatcgttccccgtaggtaccgtcatttcttaccgatgcttcccgggattcaaattggacggctcggcgtatttagagtgcctgcagaacctcatctggtcaagcagtccacccagatgtctcgccctggaagtatgcccattgccccctatggtgtcacacggcgactttgtctgccatcctagaccctgcgagcggtacaatcacggaaccgtagtggagttttattgcgatccgggatatagcttgacaagcgactataaatatatcacctgccaatatggcgagtggtttcccagttatcaggtctactgcatcaagagcgagcaaacatggccaagtacacacgagaccctgctaacaacctggaaaattgtagcatttacagccacatcagtgctgctggtattactgctggtaattctcgctcgaatgtttcagaccaagtttaaggcgcacttccctccaagaggccctccccgatcttcctcctcagatccggactttgtggttgtggatggcgtgccagtcatgctcccttcctacgatgaggccgtctcagggggactgtctgcacttggccctggatacatggcaagcgtcggacagggatgcccgctccccgtcgatgaccagagccctccagcctatcccggatccggcgacactgataccggaccaggagaatcagagacgtgtgattccgtctccggctcctctgagctcctgcagagtctgtattcgccaccacgatgtcaggagagcacgcaccccgcttcagataaccccgacatcattgcttccaccgccgaagaggtcgcatccacctcaccaggtattgacattgcggacgagatacctctgatggaagaagatccgtag

SEQ ID NO: 54627 - DNA, 873 bp, Artificial Sequence
  Description of Artificial Sequence: Synthetic coding sequence
atgtaccacggcatgaatcccagcaacggtgacggcttcctggaacagcagcagcagcagcaacaaccccagagtccacagcgcctgctggcagtgatcctctggtttcagctcgcactgtgctttggtccggctcagttgacaggcggattcgacgacttgcaggtgtgtgcagatcctgggattcccgagaacggcttccgaacaccttcaggcggtgtattttttgagggatctgtggctcggttccactgccaggatggcttcaaactaaagggggctacgaagcggctgtgtctgaaacatttcaacgggacactcggctggattccatcagataatagtatctgtgttcaggaggattgtcgcatccctcagattgaggacgccgaaatccataataaaacctacagacacggagagaagttgatcattacctgtcatgagggctttaaaatcagataccctgatctgcataatatggtttccttatgtagagatgacggcacttggaataatttgcctatttgccagggttgcctgaggccacttgcctcatccaacgggtatgttaatatctccgaactgcagacaagtttcccggttgggaccgtgataagttatagatgcttccctggcttcaagctggatggcagcgcatatctggagtgtctccagaacctaatctggtcgtccagcccccctagatgtctggccctagagggcggacggccagagcatctattccctgtactgtattttccccatatacggcttgccgctgctgtactctatttctgccccgtcctcaaatcaagtcccactcctgcacccacctgctccagtacctcaaccacaacgtcgctcttttag

SEQ ID NO: 54628 - DNA, 321 bp, Artificial Sequence
  Description of Artificial Sequence: Synthetic coding sequence
atgtatcatgggatgaatccttctaacggggacggattcctggaacagcagcagcaacagcaacagccacagtcacctcagagattgttggccgtgatcctctggtttcagctggcactctgctttgggccagcacagctgaccggagtgcatctgactagagacctgctcggttttgaaggctgccctgaatgcccccctccacctggatttaaagaggaatcccaggaatttgctcagcaggtgacccctctgcgaagtctcactcacgccaatccatggagttctggacctctgtgcattcctaaaagctggagctag

SEQ ID NO: 54629 - DNA, 1473 bp, Artificial Sequence
  Description of Artificial Sequence: Synthetic coding sequence
atgtatcacggcatgaatccatcgaatggggacggctttctagaacagcagcaacagcagcagcagccacaatctccccaacgcctgttagccgtgatcctgtggtttcaacttgcattatgtttcgggccagcgcagctcaccggcggttttgacgatctgcaagtctgcgctgaccctggtatacccgaaaatgggttccgcaccccttcggggggtgtcttcttcgaagggtcagtagctcgctttcactgtcaagatgggttcaaactgaagggcgcaactaagcgcttatgtctgaaacactttaacgggacactggggtggatcccctctgataactcaatatgtgttcaggaagactgtcggattccccagatcgaggatgccgaaattcacaacaaaacatacagacacggggagaaactcataatcacctgtcacgagggattcaaaatccggtatccagatctgcataatatggtgtccttgtgccgggacgacggcacctggaataacctaccgatatgccagggctgtctgcgccctcttgcctctagtaatggatatgtgaatatctcagagctacaaacatcatttcccgtcggaacagttatcagctacagatgttttcctgggtttaaactggacggctcagcttacctggaatgtctgcaaaatctgatttggtcatcctcccctccgaggtgcctcgcgctggaagtatgtcctctacctccgatggtcagtcacggtgattttgtctgtcaccccagaccttgcgaaagatataatcacggcactgtggtggagttctattgcgatcccggatatagccttacttctgactacaaatacatcacatgccagtatggcgaatggtttcctagttatcaggtatattgcatcaagtctgagcaaacgtggcccagcactcacgaaacacttctgacaacatggaagatcgtggcttttacggccacaagtgtgttgctcgtgctgctcctagtgatccttgcaaggatgtttcagaccaagtttaaagcgcacttccccccaagaggtccgcctcgcagctcgtcatccgatccagattttgtcgtggtggatggagtccccgtgatgctgccgagttacgacgaggccgttagcggcggactttcagcccttgggcctggctacatggcttctgtcggccaggggtgcccactgccagtggacgatcagagtcctcctgcgtaccctggcagcggagatacggataccggcccaggcgagtccgagacttgcgactctgtgtcaggcagttccgagcttcttcagtcattatacagtcccccacgctgccaggaaagtacacaccctgccagtgacaaccccgatatcattgcttcaacggcagaggaagtcgcaagcacttccccgggaatcgatatcgctgatgagatcccattgatggaagaagatccttag

SEQ ID NO: 54630 - DNA, 993 bp, Artificial Sequence
  Description of Artificial Sequence: Synthetic coding sequence
atggtttccctgtgccgagatgacggaacctggaacaatctacctatttgtcagggctgtcttcggcctttggcctcctcaaatggctacgttaacattagcgaactccagacttcattccccgtcggaacagtcatttcataccggtgttttccagggttcaagctcgatggtagcgcgtacttggaatgccttcagaacttaatatggtctagttcaccgcctcgatgtctggcgctagaagtttgccccctgccacccatggtttctcacggggattttgtatgccatccaaggccgtgtgaacggtacaatcatggcacggtagtggaattctactgtgacccgggatattctctcacatctgattacaagtacatcacctgccagtatggagagtggttcccctcctaccaggtatactgcataaagtccgaacagacctggcctagcacccatgagactcttctcactacctggaagatagtggcgttcacagctacctccgtactcctggttctcctgcttgtgattcttgcacgcatgttccagactaagttcaaggcgcacttccctccgcgaggaccaccacgctcttcttctagcgaccccgacttcgtggtggttgacggcgttccagtgatgctgccttcctacgatgaggctgttagtggcggactgagcgccctgggccctggctatatggcaagtgtgggccagggctgtccattgcccgttgacgaccagtctccacccgcttatcccggtagcggtgataccgacaccggcccaggggagtccgaaacttgcgacagcgtctcagggagcagcgaattattgcaaagcctgtacagtccccctagatgccaggagtcgacccacccagcctcggataacccagacatcatagcttccaccgctgaggaggtggccagcacctcacccggaatcgatatcgctgacgaaatccccctcatggaagaggatccatag

SEQ ID NO: 54631 - DNA, 1266 bp, Artificial Sequence
  Description of Artificial Sequence: Synthetic coding sequence
atgtaccatggcatgaaccccagcaatggcgacgggttcctggagcagcagcaacagcagcaacagcctcaaagccctcaacgactgcttgccgttatactgtggttccaactggccctctgctttggtcctgcacaactaactggcgactgcagaatcccccagatagaagatgccgaaatccataacaagacttaccgccacggcgaaaagctgatcatcacatgccacgaaggatttaaaatccgctacccggaccttcataacatggtttccctttgtcgggacgatggaacatggaataaccttcctatctgtcagggatgtctgagacccctggcaagctccaatggctacgtgaacatatctgagctccagacttccttcccggtaggcacggttatttcttacagatgcttcccgggttttaagctggatggctcagcatacctcgagtgtttacaaaatctaatttggtcttcttctcctccccgatgcctggccctggaggcccaggtgtgtcccctgccgccaatggtcagccatggagactttgtttgtcaccctaggccttgtgagagatacaatcacgggactgtggtggagttttattgcgatccaggctactccctgacctccgattacaagtacataacctgtcagtacggagagtggtttccatcttatcaagtctactgtatcaaatccgagcagacctggccaagcactcacgagaccttgctcactacttggaaaattgtagcctttaccgccacatcagtactactcgtgcttttgctggtgatcctggcaaggatgtttcagacgaagttcaaagctcattttccccctcggggtccacctcggtcttcctcctccgatcccgatttcgtggtggtagatggggtgcctgttatgctgccctcctacgatgaagccgtgagtgggggtctttccgcactagggcctggatacatggccagcgtgggtcagggttgtccactccccgtggatgaccagtcccctccggcttacccgggaagcggtgacaccgacactgggcctggcgaatccgaaacttgtgatagcgtgagtgggtcatccgagctactccagtcgctgtactctcctcccaggtgccaggagagcacacatccagccagcgacaatccagacattatagcatccaccgccgaagaggtcgcttcgacatctccaggtattgacatcgctgatgaaattcccttgatggaagaggacccctag

SEQ ID NO: 54632 - DNA, 1890 bp, Artificial Sequence
  Description of Artificial Sequence: Synthetic coding sequence
atgaccgcagaaggaccgtctccaccagccagatggcatagacggctccccggactgtgggcggctgccctcctgttacttggcctcccccgtctgagcgttcgagcagatggaaaattcttcgtcttagagtctcaaaacggatcacagggactacagctagaggccgcacgcttgagttgtaaatcaaggggggctcacctcgcttctgctgatgagctgagaagggtcgtccaggactgcagtttcgccgtgtgcaccacagggtggctggccgatggtacgctcgggaccaccgtgtgtagcaagggctcaggtgagcagcagataatgagggcagttgatgtcaggatcgaaagcaacccggtgcctggcggtacctatagcgctctgtgcattaaagatgaggagaagccctgcggagaccctccctcctttcctcataccatcctgcagggacgaactggtctggaaatgggagacgagttgctatacgtgtgcgctccgggtcacattatgggacatcgggagacagccttcactctgctgtgtaattcctgcggagaatggtatggcctggttcaggcgtgcggcaaggatgaggccgaggcccacatagactacgaagacaacttcccggatgatcgaagtgtcagctttcgtgaacttatggaagattcacggacagaggccgacgaggatcgaggccagggggatagtagtgaggaggctcccaaacaggacagacttgtcagcattagtgtgggcagagagaatatcgcacgggataaagtatttgtcccaactacaggattgcctggtgctggttcatccgttcctgcggattcccccggatcacgcttgcttcagaagcatctgttttggtttcccgctgaagcttttcataaacccggactcgaaaaggaagtcgatgacgatactaagaaacaattcagtgctggggataaccatagtggggtaaagctggtaccgggagaacctgagactaaggtgatttatgggaataccgatggcccttccggcccatttgtgggaaagaacgactctaaagcaggtgatccggtcgtgtcttcatccgatgagtcatggctggacgggtatcctgtcacagaaggtgcctggagaaagaccgaggcggaggaggaagaggacggcgacagaggagacggatccgtaggactggacgagaacgtgctcgtcacgcctgatcagccaatcctggttgaggttaagaaacccaagagcagtaccctgactccttccgaaggcatgacgcatagcagcgtgctcccaagtcagatgctcgacgttgaggctctcgcactgaggccagtgaatgctagtgagactgaaggaatcggagatggggacttgacaaaatatcagtctactttaccctggcggttcatcaccgaggaaagccctatggcaacactgtcatatgagctgacctcttctacgttagaaattctcacagtgaataccgtgaaacagactccgaatcatatccctagtaccataatggcaactacacaaccacccgtcgagacgacagtgcctgagatccaggactcgtttccttacctgttgagtgaggactttttcggccaggaggggccaggtccgggtgcctccgaggaactacacccaactctcgaatcctgcgtgggcgatggatgccccggactctcccggggtcccgtgattgcgaccatagtaaccgtgctgtgcttactgctgctcctggctggagtaggaatggtctggggataccggaaatgtcagcataaaagttccgtttacaagctgaacgttggacagaggcaagcacgccattatcaccagcaaattgagatggaaaaggtgtag

SEQ ID NO: 54633 - DNA, 3825 bp, Artificial Sequence
  Description of Artificial Sequence: Synthetic coding sequence
atggcatctggaagtggagatagtgtaacccgtaggtctgtggcctcccagttcttcactcaggaggaggggccaggaatagatggtatgactactagtgagcgggtggtggacttattgaaccaagctgccctcattaccaacgactccaagatcacggtgcttaaacaagtccaagaactgattattaataaggaccccacattgctggacaattttttagacgagatcatcgcattccaggcggacaagtctatagaagtgaggaaatttgtcatcggctttattgaagaagcatgtaagagggatattgagctgctgctcaagcttattgccaacctcaatatgctgctaagagacgaaaatgttaatgtcgtcaagaaagctatattaacaatgacccagctgtacaaggtcgccctgcagtggatggttaaatcccgagtgatctcggagctgcaggaggcctgttgggacatggtgagtgcgatggccggtgacatcatcctgctccttgactcggataatgatggaatccgcacgcatgccatcaagtttgtggaaggattaatcgttaccctgagtccaagaatggcagacagcgagatcccccgaaggcaggaacacgatatctccctagacaggatacctcgagaccacccttacattcagtacaatgtgctgtgggaggagggcaaagccgcactggagcagctcttgaagttcatggtgcatcctgccatctcctcaatcaacctgaccacggcactggggtcgctggccaacattgctaggcagcgccctatgttcatgagtgaggtcattcaggcttatgagacactccacgcgaatcttcctcctactctggcaaaatctcaggtgtcatctgtgcgaaagaatttaaagctgcacttactatcggtgcttaagcatccagcctctctggagtttcaagcgcagattacgactttgctagttgacttaggcaccccccaggccgaaattgcccgaaatatgccatccagcaaggacacgagaaagcgaccgagagacgactctgactccaccctcaagaaaatgaaactcgagccaaacctcggcgaggacgatgaggacaaagatttggagccaggaccaagcggaacgagtaaggcttccgctcagattagcggtcagtccgacacagatattacagctgagttcctgcaacccctgctaacacccgacaacgttgccaatctggtactgattagtatggtctacctgcccgaggccatgcccgcttcattccaggccatttacactcccgtggaatctgcaggaaccgaagcgcagattaagcatctggcgaggcttatggcaacccagatgaccgccgctggcctcggacctggcgtagaacaaaccaagcagtgtaaggaggagccaaaggaggagaaagtggtgaaaacagagtcagtcctgatcaagcgcagactgagcgctcagggccaagccatctcagttgtggggtctttgagtagtatgtctccccttgaggaagaggctccacaggctaagcggaggcccgagccaattatcccagtcactcagcctcgcctggctggggcaggaggtagaaagaaaatatttcgcctgagtgatgtgcttaaacctctcacggatgcacaggtggaggcaatgaagctgggcgctgtgaagcgcattctgagggcagagaaagcggtggcctgcagcggcgcagcacaggtcaggattaaaatccttgcatccctggttactcaattcaattcaggcttgaaagccgaggtgctctctttcatcctcgaagatgttagggctcggctcgatctggcctttgcctggctgtaccaagaatacaacgcctatctggctgcaggggcatccggaagcctggacaagtacgaggactgcctcatccgcctgctgagcggcctgcaggagaaaccagatcagaaagatgggatcttcaccaaagtagtattagaggccccattgattacagagtccgcgctggaggtcgtccgcaagtattgcgaggatgagtctaggacctacctcggaatgtctactctgcgggacctcatctttaagaggccatccaggcagttccagtacctccacgtgcttctcgacctgtctagtcatgagaaagacaaggtgcgaagccaggctctcttattcattaaaaggatgtatgagaaggagcaactgagggaatatgttgagaagttcgctctgaactacttgcagctgcttgtgcaccctaacccaccttctgtcctattcggggcagataaggatacagaggtggccgctccgtggaccgaggaaactgtgaaacaatgcctatacttgtacctggcactgcttccacagaaccacaaattgatccacgagctggcggcagtgtacacagaggccatcgctgatatcaagcggaccgtgcttagagtcattgagcagccaattcgaggtatgggaatgaatagccctgagttgctcctcctggtggaaaactgtcctaaaggcgctgaaactctagtcactcgttgcttgcattctctcacagataaagttccaccctctcccgaactggtcaagcgggtgagggatctctatcataagcgcctccccgacgtccgctttttgatacccgttctaaacgggctggagaagaaggaggtcatccaggctcttcccaagttaatcaaacttaacccaatcgtggtgaaagaggtgttcaatagactgctggggactcaacacggcgagggtaacagcgcactttcccctctcaatcccggtgagctgttgatcgccttgcataacattgattcagtcaagtgcgacatgaaatccatcatcaaggctaccaatctttgcttcgccgagagaaatgtgtacacgtctgaggtgctcgctgttgtaatgcagcagctgatggaacagtcgcctctccctatgttgcttatgaggactgtgattcagtccctaacaatgtacccacggctcgggggttttgtcatgaatatcttgtctcgcctgattatgaagcaggtatggaagtaccccaaggtttgggaagggtttattaagtgctgtcagagaacgaaaccacagtctttccaggtaatcttacaactcccaccacaacagcttggcgctgtttttgataaatgtcccgagctgcgggaacctttactggcccacgtgagaagctttaccccccatcaacaggcccatatcccgaactccattatgactatcttggaggcctctggaaagcaggaacctgaggccaaggaggcccctgcgggacctttggaggaggacgacctggagccacttaccttggccccagcccctgcacccagacccccacaggatttgataggtcttaggctggctcaggaaaaggccctgaagcgtcagctggaggaggaacagaagctcaagccaggcggtgtcggggctccgtcaagcagctcaccgtcaccgagccccagtgctcgccctggtcccccaccgtcagaggaagctatggacttccgcgaggaggggcctgaatgcgaaacacccggaatttttatctcgatggacgacgattccgggttaacggaggctgccttacttgatagttctctggaaggccctctgcccaaagaaaccgctgctggaggcctgactctgaaagaggaacgttctcctcagacactggcccctgtgggtgaagacgccatgaagaccccgagccctgcagctgaggacgcacgtgaacctgaggctaaaggaaattcatag

SEQ ID NO: 54634 - DNA, 465 bp, Artificial Sequence
  Description of Artificial Sequence: Synthetic coding sequence
ctgacagccgctatggcctcaggcagcggtgacagtgtgacacggcgttctgtagccagccagttctttacccaagaggaggggccaggcattgatggcatgacaacttcagagagagtcgtggacctgttgaatcaggccgcattaataaccaatgactctaaaatcacagtcctgaaacaggtgcaggaactcattatcaataaagacccgaccctgctggataactttctggacgaaattatcgcattccaggcggataaatctattgaggtgaggaagtttgtgatcggcttcattgaggaggcatgcaaacgcgacatcgagttgctgctgaaactcattgcaaacctaaacatgctgctgagggacgagaacgttaacgtggtgaaaaaggctattttgacaatgacacagctccctgtgccagttcccgcttgcccacctcgccctcagctgccatag

SEQ ID NO: 54635 - DNA, 3900 bp, Artificial Sequence
  Description of Artificial Sequence: Synthetic coding sequence
atgtccaggtccagggcttcaattcacaggggcagcatccctgctatgtcatatgcccctttccgcgacgtgcgcggaccctctatgcaccgaacccaatatgtgcatagcccatatgaccgccctggttggaacccacgtttctgtatcatctcaggtaatcagctgttgatgctggatgaagatgagatccaccccctcctgatccgagatcgaagatcagagtcctctaggaataaactgctgaggagaaccgtgtcggtaccagttgagggacgcccacacggcgagcacgagtatcacctcggcagatctcgcaggaaatctgttccaggcggtaaacagtatagtatggagggggcaccagccgctcccttcaggccgtctcagggatttctcagcaggagactgaagagcagcattaagcgaactaagtcacagccaaaactcgacagaaccagttccttcaggcagatactccctaggtttcggagcgctgaccatgatagagccagattgatgcagagcttcaaagagtctcacagccacgagtcgttactttcaccaagctcagccgctgaagcgctggaattaaacttggatgaggacagcatcatcaagcccgtgcatagctcgatacttgggcaggaattctgcttcgaagtaactacaagctcgggaactaaatgcttcgcctgccgctcagccgcagagcgggacaagtggatcgagaaccttcagcgggctgtaaagcccaataaggataattcgcgccgagttgacaacgtgcttaagttgtggatcatcgaggctagggagctcccaccaaagaaaaggtattactgcgagttatgcctcgatgacatgttatacgcgagaacaacctccaaacccagatctgcctccggggataccgtgttttggggcgagcacttcgaattcaataacctgcccgctgtcagggctctgaggctgcatttgtatagagacagtgacaaaaaaaggaagaaggataaggccggttacgtaggtttggtaaccgtaccagtagctacactggcagggagacactttaccgaacagtggtatcccgtcacacttccaactgggtcaggcggaagtgggggaatgggctctggagggggtggcggaagcggaggaggctctggagggaaaggcaaaggcggatgccctgcggtccgtctcaaagcgagatatcaaacaatgagcattctgcctatggaactctacaaggagtttgctgagtacgtcacgaaccactacaggatgctgtgcgccgtgttggaaccagcattgaatgtgaagggcaaagaggaggtggcatccgccttagtgcatattcttcaatccacggggaaagcaaaggacttcctgtccgatatggctatgagcgaagtggatcggttcatggagagggagcacctgatttttagggaaaatacactggcaacaaaggccattgaagaatacatgagactaattggacagaagtacttaaaagatgccatcggtgaatttattagggcgctatacgaatccgaggaaaactgcgaagtcgacccaattaagtgcacggctagttctctggccgaacaccaggccaatctgcgtatgtgctgcgagcttgctctgtgtaaggtagtcaactcacattgtgtgtttccacgtgagctcaaggaagttttcgcttcttggagactacgctgtgctgagcggggtcgggaagacattgctgatcgcttgatctcagctagtctgtttcttagattcctgtgcccagctataatgtctccatccctgttcggtctgatgcaggaataccctgacgaacagacctcccgcacgctaactctgattgctaaagtgatccagaatttagctaatttctcaaagttcactagcaaagaggatttccttgggttcatgaatgagttcctcgagctcgagtggggttccatgcagcagtttttatatgaaatctcaaatctagacaccctcacaaactcaagttcattcgaagggtatatcgatctgggcagagaacttagcactctccatgctctcctctgggaggtactgccccagttgtccaaggaagctttgctgaaactcgggcctttaccgcgactgcttaacgatatctccacggccctgagaaaccctaatattcagcggcagccgagccgccaaagcgaacgacctaggcctcaacctgtagttctcaggggcccaagtgctgaaatgcaggggtacatgatgagagacctgaacagtagcatagacctgcagtcttttatggcccgtggtctcaattcatctatggatatggcccgtttaccatcacctacaaaggagaagcccccacctccaccccctggcggtggcaaggacctgttctacgtgtctcggcctcccttggcacggagcagcccggcatattgtactagctcttccgatatcacagaacctgaacagaaaatgttgtccgtgaacaagtccgtcagcatgctggacctgcagggagatggacctggaggacgattgaacagctcatctgtcagtaaccttgctgccgtgggtgacctgctccactcaagccaagcgtctttgactgctgctctgggcttgaggccagccccagctggtagactttcacagggaagcggttcctctatcactgctgccggaatgaggcttagccagatgggagtcaccacggacggcgtccccgcacagcaattgaggattcctttgtcatttcagaaccccctctttcatatggccgcagacgggcctggtccaccaggcggtcatggcggtgggggagggcacggccctcccagttcacaccaccaccatcatcaccaccaccatcacagggggggagaacctcctggagataccttcgcaccttttcacgggtacagcaaatctgaggatctgtcatccggcgtccccaagccccctgcagcctcaatcttacactcacacagctactccgacgagttcggcccatctgggacggacttcactcgcagacagctgtcgctgcaggataacctgcagcatatgctatcacctccacagataacgatcggccctcagagaccagctccctccggtccagggggtggctcaggcggtgggtccggcggaggcggtgggggacaacctcccccacttcaacgtggaaagtcccaacagctcacagtaagcgccgctcagaaaccccgtccttcgagtgggaacctcctgcagagcccagagccctcctacgggccagccaggccacggcagcagtctctgagcaaggagggcagcataggcggtagcgggggttcgggtggaggcggtggtggaggcctgaaaccatcgattacgaagcagcactcccagacccctagtaccctgaatcccacgatgccagcctctgaaaggactgtcgcttgggtcagcaacatgccgcacctctcggccgatattgaatccgctcacatagagcgggaggagtataagctgaaagagtactccaagtctatggacgaatcgcgactcgaccgagttaaagagtatgaagaggaaatccattccctcaaagaacgcctccatatgtccaacagaaaactggaggagtacgaaaggcgtttgctttctcaggaggagcagactagtaagatactgatgcagtatcaagccaggctcgaacagtcagaaaaacggctgcgccagcagcaagcagagaaggactcccaaattaagtcaattatcgggcgtcttatgctcgttgaagaagaactccgacgtgaccatccagctatggcagagccgctccctgagcctaaaaaacggttactggatgcccagcttttaatacggtag

SEQ ID NO: 54636 - DNA, 1464 bp, Artificial Sequence
  Description of Artificial Sequence: Synthetic coding sequence
gaagatttcctcggcttcatgaacgagtttctagaactggagtggggaagcatgcagcaattcctctacgagatttcaaatctggacacactgaccaactcctcctccttcgagggttatatagacttgggccgagagttgagtacactgcatgcccttctctgggaggtactcccacagctgagtaaagaagcgctgcttaaactcggaccgctacccagactgctgaatgacatctctactgcacttcgcaatcccaatattcaaaggcagcctagccggcagtccgaacgccctaggcctcaaccagtagttctacgcggaccaagcgcagagatgcaaggctacatgatgcgagatctcaattcaagtatggacatggcccgtcttccctcacccaccaaagaaaagccgcctccaccacccccaggcggaggcaaagaccttttctatgtctcccgccctccactcgcaaggagctcgccagcttactgtacaagctcaagcgatattactgaacccgaacaaaaaatgttgagtgtgaataagagtgtgagtatgttggacttacaaggggacgggccagggggaagacttaacagcagcagcgtgtctaatctggcggcagtgggagatcttctgcacagttcgcaggcctctctcacagcagctctcggccttcggccagctcctgccggacgcctaagtcagggctctggatcttccattacagcggctggtatgaggctctcacaaatgggcgtgactactgatggagttccagcccagcagctaagaatcccactgagttttcagaacccactgtttcacatggcggcagacggtcctggtccccctggcggacacggtggtggcggtggccacggcccaccctctagtcaccatcatcaccatcaccaccaccatcatcggggaggagaacctcccggtgatacattcgccccttttcacgggtactccaagtccgaggacctgtcttcaggcgtccccaaaccaccagcagcgtcaatcctccacagccacagttactcagacgaatttggaccatccggcacagactttacccgacggcagctctcactccaggataacctccagcatatgctgtctccccctcagatcactataggccctcagagacctgctcctagtggtcctggtggcggttctgggggtggcagtggaggcggagggggaggccagccaccacccctccagagggggaagagccaacagttgacagtgtccgcggcacaaaagcctcgacctagcagcggaaacctgctgcagtccccagaaccttcttacggccctgccaggccaagacagcagagcctttctaaggaaggaagcatcggcggatcaggcggatcgggtggaggtgggggtggcggattgaagccaagcatcactaagcagcattcccagactccctctacatag

SEQ ID NO: 54637 - DNA, 3900 bp, Artificial Sequence
  Description of Artificial Sequence: Synthetic coding sequence
atgagccgttctagggcgagtattcatcgcggatcaatcccggcaatgtcctatgcacctttcagggatgtccgaggaccctccatgcaccgcacacagtatgtccactccccttatgatagacccggttggaatcctcgattttgcattatatctgggaaccagctgttaatgctcgacgaagatgaaatccacccactgctgatcagggatcggagaagtgaatcctcgagaaacaaattgctgcgtaggaccgtgtccgttccagtcgaaggaaggcctcatggggagcacgagtaccacctggggaggagccggcgaaagtcagtccccggtggcaaacagtacagtatggagggcgcacctgcagccccatttcgcccaagccagggatttttgtcccggagactgaagagttccatcaagcgcaccaagtcccagcctaaactggatcgcacaagtagcttccgacagatcctgccgagatttcggagtgcggatcacgaccgggcaagattaatgcagtcattcaaagagtctcactcacacgaaagcctgttgtccccctcctcagcagctgaggccctcgaattgaatctcgatgaagactccataatcaagccggtccactcatcgattctgggccaggaattctgctttgaagtgactacttcctccgggactaaatgcttcgcttgtagaagtgccgctgagcgagacaagtggatcgagaatttgcaaagggccgtgaagccgaataaagataactcacgcagggtagacaacgtcttgaaactgtggataatcgaagcgagggagctgcctccgaagaagcggtactactgcgaactatgcttggacgatatgctgtacgctaggactactagtaaacccagatctgccagtggagataccgttttttggggggagcacttcgagtttaataatctccctgccgtgcgcgctctgcgattacacctttacagagattcagataagaaaaggaaaaaggacaaagcaggctacgtgggtctggtcacggtgcctgttgctacgctggcaggtcggcactttacagagcagtggtatcccgtgacactcccaaccggcagcggcggaagtggtggcatgggctccggtggaggaggcggtagtggcggaggcagtggaggtaagggaaaggggggatgtccagccgtgagactgaaagcgaggtatcagacaatgtcaattctacccatggaattgtacaaagaatttgcagaatatgtcacgaaccactaccgtatgctgtgcgccgtgctggaaccggcactgaatgtcaagggaaaggaagaagtcgcgagtgccctggtgcacatcctccagtctactgggaaagcgaaggactttctttcggatatggccatgagtgaagtagaccggttcatggagcgtgagcatctgatttttagggaaaacactctggcaaccaaagcgatagaagaatacatgcggctcataggccaaaaatacctgaaggacgctattggagaattcatccgcgcactgtacgaatcagaggagaactgcgaggtggacccgatcaaatgtaccgcaagctcgctcgcggagcaccaagctaacctgcggatgtgttgcgaacttgcattgtgtaaggtcgtgaactctcattgcgtgtttccaagggaacttaaagaagtgtttgcttcctggcggttacggtgtgccgaaaggggacgagaggatattgcagatcggctgatttccgcttcactctttttgaggttcctgtgtccagccatcatgtcgcccagcctcttcggcctgatgcaggagtaccctgatgaacaaacctctaggacactgactcttatcgccaaagtaatacagaacctggctaactttagcaagtttacgtctaaagaggattttctcggcttcatgaacgaattcttggaactggagtggggttccatgcagcaattcctgtacgagatctctaatctcgacacgctgacaaacagttccagcttcgagggctacattgatttaggacgagaacttagtactctgcatgcgctgctgtgggaagtgctgccacaactaagcaaagaagccctcctaaaactgggcccattgcctaggttgctaaacgatataagtactgcacttagaaatccaaatatacagcgtcagccaagcaggcagtccgagagaccccgaccacagccagtggtgctaagggggcctagcgcagagatgcaggggtatatgatgcgagatctcaattcctctatagacctccagtcgttcatggctcgtgggctgaacagctcaatggacatggctaggctgccctctccaaccaaagagaaacccccacctccacctcctggaggagggaaggacctgttttacgtgtccagaccaccccttgctcgcagttctccagcatattgcacctcgtcaagcgatatcacagagcccgaacagaagatgctgagcgtaaataaatccgtgtcaatgctggatctgcagggggatggtccaggcggaaggctgaattccagttccgtgtctaacttggcagctgtcggcgacctgctccacagctctcaggccagcttgaccgcagcccttggtcttagaccagctcccgctggcagactgtcacagggttccggatcctcgattactgcagctggaatgcggcttagtcagatgggggttaccactgacggcgtgccagcacagcagttgcgaatccccttgtcattccagaatccactcttccacatggctgcggatggccctggtcctccaggcggacatggcggaggaggaggacacggacctccttccagccatcaccatcaccatcaccaccaccatcaccgcggtggtgaaccccctggcgatacgttcgcgccatttcacggttacagtaagtcagaagatctgtcctctggtgtacccaagccaccagccgcatccattcttcacagccacagctattctgacgagtttggcccatcaggcactgattttacacgtaggcagctgagcttgcaggacaacctacagcacatgctgtctccaccacagatcacaatcggccctcagaggcccgctccatcaggtcccggtgggggaagcgggggagggagcgggggagggggtggtgggcagccccctccactccagcggggaaaaagccaacagctgaccgtttcagccgctcagaaacccaggccctcaagcgggaatctgctgcaatctccagagccgagttatggaccagccagacctagacagcaatccctctctaaggaggggtctattgggggttccggtgggagcggcggaggtggaggcggaggactgaagccatccattactaaacaacattcccagactccttctacactgaaccctaccatgccagcctctgagagaactgtggcatgggtctctaacatgccacatctgagcgctgacatagagtcagcccacatcgagcgtgaggagtacaagctgaaagaatatagcaagtccatggatgagtctagactcgaccgagtaaaggagtacgaggaggagatacactccctgaaggaaagactgcacatgagcaataggaagctcgaagagtacgagagacgcttgctgtctcaggaggagcagacctcgaagatccttatgcaataccaggcaagactggaacagagcgagaagcgccttcggcagcagcaagcggaaaaagatagccagattaagtcaattatcggtcgtctcatgctcgtagaagaagaacttaggagggatcacccggcaatggccgaacccctgcccgaacctaagaagcgcctcctggacgctcagctactgattagatag

SEQ ID NO: 54638 - DNA, 3855 bp, Artificial Sequence
  Description of Artificial Sequence: Synthetic coding sequence
atggggcttagaccgccaacaccctccccatctgggggtagttgctccgggtccttacccccaccgtcccgatgccagcccctccgacggagatgtagttcttgctgttttccaggggagtaccaccttggtcggagccgcagaaaatccgtgcccggagggaagcagtattcaatggagggcgctcctgctgcccctttccgcccaagccaagggtttctgtccagacgcctgaaatcctctataaaacgtacaaagagccaacccaagctggacaggacctcctcatttcgacaaattctccctcgctttagaagcgcggatcatgatcgggctagacttatgcagtcattcaaggagtcgcacagccatgaatcattactgagcccaagttcagcagccgaggccttagagcttaacctggacgaggacagtataatcaagcctgtacacagttctattctgggtcaggaattctgcttcgaagtgactaccagttcgggaacaaaatgcttcgcctgtcgaagcgcagccgaaagggacaagtggatagaaaacctgcaacgggctgtcaagcccaacaaggacaatagtcgaagagtggacaacgttctaaaattgtggattattgaagcccgtgagttgcctcccaaaaagcgatattactgcgagctctgtctagacgacatgctgtacgcccgtaccacatccaagcccagatctgcgtccggcgacacggtgttctggggagagcacttcgagtttaataacttgcctgctgtgcgagccctccgactgcatctttaccgggattcagacaagaagagaaagaaggataaagccggatacgttggcctggtgaccgtgccagttgccacgctggcaggccgacattttactgagcaatggtacccagtgaccctccctactggcagcggcggatcaggagggatgggctcaggagggggtggcggatccggtgggggtagtggaggcaagggaaaagggggatgtcccgctgtgagactcaaggcgaggtaccagacgatgtcgatcctgccaatggaattgtacaaagaatttgcagagtatgtgaccaatcactaccgcatgctctgtgctgtgttagagccagctctcaacgtgaaaggcaaagaggaggtggcttccgcattagtgcacattttacagtcgacaggaaaagcaaaagactttctttcagacatggccatgtcagaggtcgaccgcttcatggagagagaacacctgatctttcgggagaataccctggccacaaaggctattgaagaatatatgaggctgatcggccaaaagtacttaaaggacgccatcggggagttcatcagggccttgtacgaatcggaggaaaattgcgaggtggacccaataaagtgtacagcctcgtcactggcggaacaccaagccaacctgcgcatgtgttgcgagttggcattgtgtaaggtggtaaactcacactgtgtatttccacgggagctaaaggaggtgtttgcctcctggcgacttcgctgcgcagaacggggacgggaggacattgcggatcgactcatcagtgcttcactgttcctcagatttctctgccccgcaataatgtcgccttcgttgttcggcctgatgcaagagtatcctgatgaacagactagtcggaccctgacactgattgcaaaggtcatccagaaccttgccaatttttcaaagtttacttcgaaagaggattttttagggttcatgaatgagttccttgaactggaatggggaagtatgcagcagttcctctatgagatctcaaacctcgatactttaaccaacagttcatcctttgagggctacatcgatctgggaagagaactcagcactcttcacgcgctcctctgggaagtgttgcctcagctctctaaggaagctctgttaaagctaggccctctccccagacttctgaatgatatctccacagctcttcgtaacccaaatattcagcgacagccttcgcggcagagcgagaggccgaggcctcaaccggtggtgctgagaggcccttcagctgaaatgcaggggtatatgatgcgcgatctgaattcatccatcgatttgcagtcctttatggctcggggacttaacagcagcatggatatggccagattgccgtcacctactaaggaaaagcccccaccccctcctcccggaggcggaaaggacctgttctatgtttctcgccctcctcttgcccgaagttcaccggcatattgcacttcatcttctgatatcacggaacccgagcagaagatgttgtccgtcaacaagtccgtgtccatgttggacctccagggggatggacccggtggaagactgaacagctcaagtgtcagcaacctggcagcggtgggcgacttacttcattctagccaggcctctctgacagcagccttgggactgagaccggcacctgccggaagactaagccagggctcagggtcatcaataactgccgcaggaatgagattgagccagatgggcgtgacaacagacggcgtacctgcacagcagttgcgaatccccctgagctttcagaaccctttattccacatggccgctgacggtccaggccctcccggagggcatggtggaggaggcggacatggcccaccgtcaagccaccaccaccaccatcatcatcatcaccatcgtggaggagagccacctggtgatacgttcgctccctttcacggctactctaagagcgaagacctgagtagcggggtgccgaagccccctgctgcatcgatcctgcactctcacagctattctgacgagtttggaccatcagggacagacttcacacggagacagctgagcctccaagataacctccagcatatgctctctccgcctcagatcactattgggccacaacgccctgccccttctggacccggaggaggaagcgggggagggagtgggggaggcggagggggtcaacccccacctttgcagcggggtaaatctcagcaactgacagtttcagcagcacaaaaaccacgccctagctctggcaaccttctgcagagccctgaaccatcatatggtccagcacgaccccgtcagcagagcttaagcaaagaaggtagcatcggtggttccgggggttcagggggaggcggtggtggaggtcttaaaccatccatcacgaagcagcacagccagaccccatccaccttaaatcctaccatgccggcatcagagcgcactgtcgcgtgggtctctaatatgcctcacctgtcagctgatatcgagtctgcacatatcgaacgggaggagtacaagctgaaggagtacagtaagagtatggatgaatcccgcttagaccgggtaaaagagtatgaagaggaaattcattcactaaaggaaaggttgcatatgagcaatagaaagctggaggaatacgagcgccgattgctgtcgcaggaggaacagacatccaagattctgatgcagtaccaggctcgtcttgagcagagtgagaagagactgcgacagcagcaggccgagaaagattcacagataaaaagcatcatcgggagactgatgctggttgaagaagagctgcgccgagaccaccctgctatggccgagcccctgccagaacccaaaaagcgtttgctagatgctcaggaacggcaactccccccactcggcccaaccaacccaagagtgacattggctcctccctggaatgggttagcacccccagcacccccacccccacctcgcctgcaaattaccgagaacggagagtttcggaatacggctgatcactag

SEQ ID NO: 54639 - DNA, 4032 bp, Artificial Sequence
  Description of Artificial Sequence: Synthetic coding sequence
atgtcccgatccagagcaagcatccatcgtggttcaatacccgcaatgtcctatgccccatttcgtgacgtgaggggcccttccatgcaccggacacagtacgtgcattcgccatatgatagacctgggtggaatcctcgattctgcatcatttctggcaaccaactccttatgttagacgaggacgagattcacccccttctaatccgagacaggaggtccgaatcttctcggaacaagctgctgcgcaggacagtgtctgtgcccgtggagggcagacctcacggagagcacgaataccacctgggaagaagtaggaggaaatctgtgcctggcggtaaacagtactcgatggaaggcgcaccagctgccccttttcgaccatcacagggtttcctatcccgcagactaaagtcctccataaaacgaacgaaaagccaaccgaagctggacagaacctcgagcttccggcaaattctccccaggtttaggtccgccgaccacgacagagctcgcttaatgcagtcgtttaaggaaagtcatagccacgagagtcttctgtcgccctctagcgccgcagaagctttggaactgaatcttgacgaagattctattatcaagccggttcacagcagcatcctcggacaggagttctgctttgaggtcactacatcctcaggtaccaagtgcttcgcttgccggagcgcagccgaacgtgataagtggattgaaaacttgcagcgtgccgttaagcctaacaaagataattcccgacgcgtggacaacgttttaaaattgtggattatagaggccagggagcttcctccgaagaaaaggtactattgtgaactctgtctggatgacatgctctacgcccgtactacatcgaagccgagatcagcaagcggcgataccgtcttctggggcgagcacttcgagtttaataacctgcccgctgtgagagccctgcgcctgcatctataccgcgattcagacaaaaaaaggaagaaggacaaagcaggctacgttggtctggtgaccgtgccagttgccacactcgccggacggcactttaccgaacaatggtaccctgtgaccctaccaacaggctcaggcggtagcggcggaatgggctcgggtggcggagggggatccggcggtggatcgggagggaaagggaaaggcggatgcccagccgttcggttaaaagccagatatcagaccatgtctatactgcctatggaactgtacaaggagttcgccgaatacgtaacaaatcactaccggatgttgtgcgcagtgctcgagccagctctgaatgtcaagggtaaagaggaggttgcaagcgctctcgtccacatcctccaatccactggcaaggctaaggatttcttatccgatatggccatgtccgaagttgatcggttcatggaacgcgagcatctgatttttcgggagaatacactcgcgactaaggccattgaggaatatatgcgactgatcggacagaagtatctgaaggacgcaattggcgagttcatccgagccttatacgagagcgaagagaactgtgaggttgatcctatcaagtgcaccgcctcttctctggccgagcaccaggccaacctgagaatgtgctgcgagctagccctctgtaaggtagttaattcacactgcgtgttcccacgcgagctgaaggaggtatttgcgtcgtggagattaaggtgcgcagagagaggccgtgaagatattgctgatcgcctgatcagtgcctcactttttttacgctttctctgtcctgccattatgtctccgtcccttttcggactcatgcaagagtaccccgacgagcagacatcccggacgttaacgctaattgctaaagtgatccagaacttagcgaactttagcaagttcacaagcaaggaggactttctcggcttcatgaatgaattcctggaacttgagtggggaagcatgcagcagttcctctatgaaatttccaacctggatactctcaccaactcttctagtttcgagggatatattgacctcggcagggaactgagtacactgcatgcccttctgtgggaagtgctgccacagctttctaaggaggcccttttgaagctgggcccattgcccagacttctgaacgacattagtacagcgctgaggaacccgaacattcaaaggcagccttctaggcagtcagagagaccccgaccccagccagtggtactgcgaggcccatccgcagagatgcaaggatatatgatgagagacctcaactcgtccatcgatctccagtcatttatggccaggggcttaaattcatctatggacatggcaagactccccagcccaaccaaggagaaaccccctcctccacctccaggaggcggtaaggacctgttctacgtgagtaggcctcccttggctagatcgagcccagcttactgtacttcctcatcagatatcaccgaacccgagcagaaaatgctctctgttaacaagtccgtgtctatgctcgacctgcagggagatggtcccggtgggagattaaactcatcatcagtcagtaatcttgccgcagttggggacttgctgcattcctctcaggcctcacttacggctgctctcggactcagacctgccccagctggcaggctctctcaagggtccggatctagtatcacagccgctggaatgcggctaagccagatgggggttaccacggacggagtgccggctcagcagttgcggataccccttagtttccagaacccgctgttccatatggctgccgatggcccaggcccaccagggggtcacgggggagggggtggccatggacccccaagcagtcaccatcaccatcaccatcatcaccaccatcgcggaggggaaccaccaggcgatactttcgctcctttccacgggtattccaaaagtgaggatctgagctctggggttccaaagcctcctgccgctagtatcttacattcacattcttattcggatgagttcgggccatccggaacagacttcacgcggcgacagctcagcctccaggataatctccagcatatgctgtcaccaccacagattacgattggcccacagcgcccagccccttctggacctgggggtggatcagggggagggtcaggtggcggaggcggtgggcaaccccctcctttgcagcggggtaagtcacaacagcttaccgtgagcgccgcacagaaacccagaccatcctccggtaacttgttgcagtcacctgagccctcctatggccctgctagacctagacaacaatcacttagtaaagaaggctccattgggggatccggaggctctggcggagggggaggcggtggattaaagcccagtatcaccaagcaacatagccagacacctagcactctgaaccctactatgccagcctctgaaagaacggtcgcctgggtttcgaacatgccacatctttctgccgatattgagtccgcccatattgaacgggaagagtataagttaaaagaatactccaagtcaatggacgagtctagacttgacagggtcaaagaatatgaagaagaaatccactcattaaaggagcgcctgcatatgtctaaccggaagttggaggagtacgagagacggctgctttctcaggaagaacagacttccaaaattctgatgcagtaccaggccaggctggagcagagcgaaaaaagactgcgccagcagcaagcggagaaggattcccaaatcaagagcataatcgggaggctgatgctggttgaagaggaactgaggcgcgaccacccagccatggcagagcctctgcccgaaccaaagaaacgtctcttagatgcgcaggagcgccagctacctccccttggtcctacgaaccctagagttacgcttgcacctccgtggaacggactcgccccaccagcaccacccccaccgcctagactacaaatcactgaaaacggagagtttaggaacactgccgatcattag

SEQ ID NO: 54640 - DNA, 3879 bp, Artificial Sequence
  Description of Artificial Sequence: Synthetic coding sequence
atgagtagatctcgggcttctatacaccggggatcgatccccgcaatgagttatgcccctttccgtgacgtccggggacccagtatgcatcggactcaatatgtgcactccccctatgatcgccctgggtggaacccacgattttgtataatctctgggaaccagttgctcatgctggacgaagatgagatccacccactgctgatccgggaccgcaggagtgaatcatctagaaataagctgctgaggaggaccgtttctgtacctgtggagggtcgaccacacggagaacacgaatatcatctgggaaggtcccggagaaagagcgtgccaggcggtaagcagtatagcatggaaggcgcacctgccgcaccctttcgtcccagccaggggtttctctcgcgacggttaaaatccagtatcaagcggaccaaaagccagccgaagctcgatcgaacttcaagcttccgacagatcctgcctcgttttcgatcagcagatcacgaccgagcaagattgatgcagtcatttaaagaatcccactcccacgagtccctcctcagcccatcatcagctgctgaggccctagagttgaaccttgacgaagactccattatcaaaccagtccactcgtcaatcctgggccaagaattttgctttgaggtgacgaccagcagcggtaccaagtgcttcgcctgcaggtctgctgcggagcgcgacaagtggatagaaaatctgcagagagctgtcaaacccaacaaggacaattcaagaagggtagataacgtgctcaagctgtggattatagaggccagagagctacctccaaaaaagcgctattactgcgagttgtgtctggatgacatgctgtacgcccgtacgacaagtaagcctcgctcagccagtggcgatactgtgttttggggtgagcactttgagttcaacaacctccccgcagtgcgtgcactacggctacacctgtaccgggattctgacaagaagcgtaagaaggataaagcgggatatgtcggactcgtgactgtgcctgtagcgacgttggccggacggcacttcaccgaacaatggtatcctgtaacactgcctaccggctctggaggatcggggggtatgggttccggaggaggcggagggtccggtggagggtctggaggtaagggtaaaggcggttgtccggctgttcggcttaaagcacgctatcagacaatgtctatcttgcctatggaactttataaggaatttgccgaatatgtgacgaatcactaccgcatgctgtgcgccgttctggagcccgcacttaatgttaagggcaaggaggaagtggcttccgccctagtccatattctgcaatctaccggcaaggccaaggacttcttaagtgacatggctatgagcgaggtggaccggttcatggagcgggagcaccttatcttccgggagaacaccctggctacaaaggctatcgaggagtacatgaggttgataggccagaaatatctcaaggacgctatcggcgagtttatcagggctctctacgagagcgaagagaattgcgaggttgaccctatcaagtgcaccgcgagcagcttggcggaacatcaggccaacttgagaatgtgttgcgagttagcactatgtaaggtcgtcaattcccactgcgtctttccacgcgaattgaaggaggtgtttgcctcatggagactgcggtgtgcagagcgcggacgagaggacatcgccgaccgactaatctccgctagtctctttcttcgctttctttgtcccgctattatgtcaccctcactcttcggattaatgcaggaatatcctgatgagcagacgtcacggaccctcactctgatcgccaaagtcatccagaaccttgccaatttctccaagtttacaagtaaggaagatttcctcggattcatgaacgagtttctagaactcgagtggggatctatgcaacagtttttgtatgagatttcgaatctggacactctgacaaattcctctagtttcgaaggttatatcgatctcggacgagaactttcaaccctgcacgccctgctgtgggaggtcctgcctcagctaagcaaagaagcattattgaaactggggcctttgccccgtctgctaaatgatatcagcactgcgctcaggaaccccaatattcaacgacagccatccaggcagtcagagcgcccacgccctcagccagtcgtgcttcgaggtccatctgcagaaatgcaggggtacatgatgcgcgatcttaacagttccatggacatggcacggcttccaagccctactaaggaaaaacctccccctcctccgccaggaggaggaaaggatttgttttacgtcagtcgaccgcctctggcaagaagtagcccggcttactgcacctcctcctcagatattacagaaccagagcagaagatgctgtcggtgaacaaatctgttagtatgctcgaccttcaaggcgacggcccaggcggacggctcaacagctctagcgtgagtaacctcgctgcggtgggcgaccttctgcacagctcgcaagcctcactcactgcagccctgggccttcggccagctcctgccggtcggctcagccaaggaagcggctctagcatcaccgctgctggcatgcgcttgtcacagatgggcgttaccacggatggggtcccagctcagcagctcagaatcccattatcgtttcagaacccacttttccacatggcggcagatggacctggtccccctgggggacacggcggagggggaggccacgggcctccgtcctctcaccatcatcaccaccaccaccatcaccaccgcggaggtgagcctcctggggataccttcgcacctttccatggatactccaagtccgaggatctctcttctggtgtgccaaagcctcccgctgccagcattttacatagtcactcatactctgatgaattcggacctagcgggaccgacttcacgcggaggcagttaagtctccaggacaatttacaacacatgctgagccctccccagattaccattggaccacagcgccctgcccctagcggaccaggtgggggaagcggcggtggctctggaggtggcggtgggggacagcctcccccattgcagagaggcaaatcccagcagttaactgtgtccgctgcacagaagcctagaccttcatcagggaacctgcttcagtcgcctgagccctcatacggacccgcaagaccaaggcagcaatccctgagtaaggagggtagtatcggtgggagcggcggaagcggcggaggtggagggggtggcttgaaacctagcatcactaaacaacactctcagaccccctctacactcaacccgaccatgcccgcaagtgaacggaccgtggcttgggtgtccaacatgcctcatttatcggctgacatcgaatcagcccacatcgaaagagaggagtataagctcaaggaatacagcaagtctatggatgaaagtcgattggatagggagtacgaggaagagatccatagcctgaaggaacggcttcatatgtctaacaggaagctggaagaatacgaaagacggttactgtcccaagaagagcagacttccaaaattctcatgcagtaccaggctagactggagcagtctgagaagcgcctacgacaacaacaagccgagaaggactctcagatcaaaagtataattggcagacttatgctcgtagaggaagaacttagacgggaccacccggctatggctgagccactgcctgaaccaaagaagcggcttctagacgcccagagagggtcgttccccccttgggtccaacagacacgggtgtag

SEQ ID NO: 54641 - DNA, 4032 bp, Artificial Sequence
  Description of Artificial Sequence: Synthetic coding sequence
atgtcacgaagcagagccagtattcatagaggatccatccctgccatgagctacgcccctttcagagacgtacgcggacctagcatgcatcggactcagtacgtacatagcccatatgatcgcccaggttggaatcctagattttgcataatctcggggaatcagcttctgatgctcgacgaagatgagattcaccccctgcttatccgcgaccgacggagcgaaagtagcaggaacaagctgttgcgtagaactgtgtctgtacccgtcgaggggcgaccacatggtgaacacgagtatcatttggggaggtcccggcgaaagagcgttcctgggggaaagcagtacagcatggaaggagcccctgcagcaccctttagaccctctcagggtttcctttctaggcgactgaaaagcagcataaaacgaacaaagtcccaacctaaactcgaccgcacctcgagctttagacagattctgcccagatttcggtccgcggaccatgacagagcccgtcttatgcagtccttcaaggaatcacattctcatgaaagcttgctgtccccatcatcagccgcagaggctctagagctcaatcttgatgaggacagtattatcaagccagttcacagttccattttgggacaggagttctgtttcgaagtgactacatcaagtggcaccaagtgtttcgcctgtaggagcgctgcggaaagggacaagtggatcgaaaaccttcagagggccgtaaaacctaacaaagacaattcccgtagggtagacaatgtgctcaagttatggattatcgaagctcgggagctgcccccaaaaaaacgatactattgcgagctgtgcctggacgacatgttgtacgcaagaacaacatctaaaccaagaagcgcctctggtgacactgtattctggggcgagcacttcgagttcaataacttaccggctgtccgcgcattgaggttgcacctgtaccgggattcagataagaaaaggaagaaagacaaagcgggatacgtgggattagtcactgtgcctgtcgccacgctcgcagggaggcactttactgagcagtggtaccccgtgaccttgccgaccggctctgggggttccggcggtatggggagtgggggtggagggggttcaggcggaggcagtggcggaaaaggcaagggaggatgtccggctgttcggctaaaagcgaggtatcaaaccatgagcatcttacccatggagctctacaaggagttcgccgaatatgtgactaaccactacagaatgctctgtgctgtgcttgagccggcactcaacgttaaggggaaggaggaggttgcttctgccctcgtgcatatcttacagtctacagggaaggccaaggatttcttgtcggacatggctatgagtgaagttgaccgctttatggaaagggagcaccttattttcagagaaaacaccctggcaacaaaagcgatcgaggaatacatgaggctaatcgggcagaagtacctaaaggatgctattggcgagtttatccgggcactatacgaatctgaagagaattgcgaagtggatcccatcaagtgtactgcttcaagcctcgctgagcatcaggcaaacctgcggatgtgctgtgagctcgccttgtgtaaggtagtgaatagtcactgtgtgttcccacgtgaactcaaggaagtcttcgctagttggcgactacggtgcgcagaacggggtcgagaagatatcgccgacaggttaattagcgcgtctctgtttttgcggtttctctgtccagctattatgagcccttctctgtttggactcatgcaggaatatcctgatgagcaaacgtctcgcaccctaacactcattgcaaaggtcattcagaacttagctaacttctcaaaatttaccagtaaagaagatttcctggggttcatgaacgagttcctcgaacttgaatggggaagcatgcagcagtttctctacgagatctcaaatttggataccctaaccaattcaagcagcttcgaggggtacatcgacctgggccgagaattatcaaccctccacgccctgctgtgggaagttctgccccaactgagcaaagaggccctgctgaagttaggtccactcccacgattactcaacgatatttccacagccctacgcaatccaaatattcagaggcagccgtcaagacaatctgagagaccacgccctcaacctgtggttctgagggggccttctgcagaaatgcagggctatatgatgcgagacttaaattcaagcattgacctccagtcttttatggcacgcggactgaactcttcgatggatatggcaagactcccttctccgaccaaggaaaagccccctccccctccgccaggcggaggtaaggaccttttttatgtctccagaccaccgctagccaggtcttcccccgcatattgcacgtcttcctcagacatcaccgaaccggagcagaaaatgttgtccgtcaataagagtgtctccatgctcgatctgcagggagatgggcctggaggacggctaaactcttcctctgtctctaacctggccgcagtcggcgatctgttacacagtagccaggcatccttgaccgccgcactgggcctgcggcctgctcctgcaggccgactgagtcagggaagcgggagttcaattacagccgctgggatgcggctctcgcaaatgggggtcacaacggatggcgtccccgctcaacagcttcggattcccctcagtttccagaatccactcttccacatggcagcagatgggccaggcccacccggaggccacggcggtggcggtggccatggtccaccttctagccatcaccaccatcaccatcaccatcaccaccgcggtggcgagcccccaggagacactttcgctccctttcatggatatagtaaatctgaggacctgtcctctggagtgcctaaaccccctgccgctagcatcctgcactcccactcatattccgatgagtttggtccttcaggcactgatttcacgcggaggcagctctctctccaagacaatctacagcatatgctctctccgccacaaatcacgatcggccctcagagacctgctccctcaggtccgggaggaggatccgggggagggagcggcggtggcggagggggacagccacctcccctgcagcggggaaagtcccaacagcttactgtcagcgccgcacagaagcccagaccgagtagtggcaacctgctccagagccccgagccatcttacgggcctgccagacccaggcagcagagcttatccaaagaaggatccattggagggtctgggggaagcggaggcggtggaggtgggggacttaagccaagtattactaaacagcattctcagacccccagcacgctcaatcctacaatgccagctagtgagcgtaccgtggcctgggtttcaaacatgccgcacctgtcagcggacatcgaaagcgcccatattgagagggaggaatacaaactcaaagaatacagtaaaagcatggatgaatctcgcttggatcgggtgaaagagtatgaggaggagattcacagcctcaaagaaagactccacatgagcaatcgcaagcttgaagaatatgagaggcgactgctgtcccaggaggaacaaacgtccaagattctcatgcaataccaggccaggcttgagcagagtgagaagagactgcgtcagcagcaggctgagaaagactcgcagattaagtccataattgggagactcatgctcgtggaggaagaactgaggagagaccatccagctatggctgagcccttgcctgaacccaaaaagcgtttgctcgatgcccaggaacgtcagctgccaccactgggaccgacaaacccgcgtgtgactctagcccctccatggaacgggctggcacctccggctcctcctccgcctccacgtctgcagataactgaaaacggagaattcagaaacactgccgatcattag

SEQ ID NO: 54642 - DNA, 3900 bp, Artificial Sequence
  Description of Artificial Sequence: Synthetic coding sequence
atgagccgatcacgggctagtattcacaggggctcgattcctgccatgagctacgctcctttccgcgatgtccggggaccctctatgcaccggacccaatacgtgcactctccgtacgaccggcctggctggaacccacgtttttgtatcattagcggtaatcagttattgatgctcgacgaagacgaaatccatccactgctgattagggacaggaggagcgagagctccagaaataagctcctgcggcgaaccgtgtcagtcccagtcgagggtcggccacatggagagcatgagtaccacctggggagatccaggcggaagagtgtgccaggtggtaagcagtactcgatggaaggagctccagcagcgccattcagaccatctcagggattcctgagtcgacgcttaaagagctccatcaagcgcacaaagtcccagcccaagcttgatagaacctctagctttcggcaaatactgcccaggttccgcagtgcagaccacgatcgggcaaggctgatgcagagtttcaaagaatctcactctcacgagagccttctttctcctagcagcgcagctgaggccctcgaacttaatctagacgaagactctatcattaagccagttcactcttcaatactgggacaggagttttgtttcgaagtaacaaccagcagcggcactaagtgtttcgcttgtcggtccgccgcagaacgtgataagtggattgaaaatttacagcgagctgtaaagcctaacaaagataacagcaggagagtcgacaacgtcctgaaactgtggatcattgaggctagagaattgcctccaaagaagcgctattattgcgagctgtgtctggacgacatgctctacgcaagaacaacatccaagcctcggtctgcttcaggcgacaccgtgttttggggggagcattttgagttcaataatctgcctgcagtgcgagccctccgcctccacctgtatcgggatagcgacaagaaaagaaagaaagacaaggccggatatgtcgggctagtgaccgttcctgtcgccacacttgccggaagacacttcactgagcagtggtaccctgttaccctacctaccggctcagggggtagtggcggtatgggtagcggaggtgggggtggcagcggaggcggttcaggaggcaaggggaagggtggctgccccgcagtacggctcaaggcaaggtaccaaacgatgtccatccttccgatggaactatacaaagagttcgctgagtacgtaacaaatcattacagaatgctgtgtgcagtattggagccagcgttgaatgttaaaggtaaggaagaggtggcttccgctctggttcacattttacagagcactggtaaggcaaaagactttttgagtgatatggcgatgtcagaagtagatagattcatggagcgtgagcatctcatcttccgcgagaacactctggccacaaaagctattgaagagtatatgcgcctgatcgggcagaagtacctgaaggacgccatcggcgagttcataagagcactttatgaatctgaagaaaattgcgaggtcgacccaatcaaatgtacagctagctcacttgccgagcaccaggccaacctcaggatgtgctgtgaactggcgctttgtaaggtggtaaatagccactgcgtgtttcccagggaactcaaagaggtctttgcctcctggagattaagatgcgcggagaggggacgcgaggacattgccgatcgccttatctcagcatccctgtttttgcggttcctgtgtcctgccattatgtctccttccctttttggtctgatgcaagaatacccagacgaacagacatctagaacactgacccttatcgccaaggtgattcagaacctcgccaatttctcaaagtttacttcaaaagaggacttcctgggattcatgaacgaatttctggaactcgagtgggggagcatgcagcagttcctttacgagatctccaatcttgacactctcaccaacagctcatcttttgaaggctacatcgacctgggtcgcgagttatccacgctccacgctctgctgtgggaggttctaccccagttgtctaaggaggcgctgcttaagctaggacctcttccgaggctgctcaacgacatctccactgccctgcgcaatcctaatatccaacgacagccaagtaggcagtcagaaaggccccgtccccaacccgtggtcctacggggaccaagcgccgagatgcaaggttacatgatgagagatcttaattcctccatagacctgcagagcttcatggcccgaggcttaaacagctcaatggacatggctcggttacccagccctacaaaagagaagcctcctccacccccacctggcggaggtaaagacctcttctatgtgtcaagacctcccctggctcggtcctctcccgcatactgcacttcatcttccgatattaccgagcccgaacagaagatgttatccgtgaataaatccgtgagcatgctggacttgcagggggacggtccaggcggacgactgaacagcagcagcgtatcgaacctggctgccgtgggggatctccttcattccagccaggccagtcttacagcggcactgggactgcgccctgcacctgccggacggttgtcacagggctctgggagcagtattactgccgcaggtatgcgcctgagtcagatgggggtgactaccgacggggtgccagctcaacaattacgtatacccctgtcctttcaaaaccccctgttccatatggccgctgatggccctggacctcctggcggacatggcggtggaggaggccacggccctccttcgagtcaccatcatcatcaccaccaccatcaccatagggggggagaacctcctggagatacctttgcaccgttccatggctactccaaatccgaggatttaagcagtggggttccaaaacctccagccgcttcaatactgcattctcactcatatagcgacgagttcggcccaagcggaacggatttcacacgcaggcagcttagcttacaagataacctgcagcacatgctctcaccaccccagattacaattggacctcagagaccggctccttcgggccctgggggaggctctggagggggtagcggcggagggggtggtggccagccgcctcccttacagaggggaaaaagtcagcagttgactgtgagcgctgctcaaaagcctcgccctagctccgggaacctgctacagagccccgaaccttcatatggcccagctaggcctcgtcagcaatcactgagtaaggagggcagcattgggggtagtggtggtagtgggggaggcggaggaggtggattgaagcccagcataaccaagcagcactcccagaccccatccaccctgaatcccaccatgccggctagcgagaggaccgtggcctgggtgagcaatatgccacatctgagcgccgacatcgagtctgcccacatcgagagagaggagtacaagcttaaagagtacagtaagagcatggatgagagccgactggaccgggtgaaggagtacgaagaggagattcactccctgaaggagcgcctccacatgtcaaaccgcaaacttgaagagtacgaaaggagactcctgagtcaggaggagcagacgtcaaaaattctgatgcagtatcaagctagattggagcagagtgaaaagcggctgagacaacaacaggcagaaaaagacagccagatcaagtcaatcatcggccgactgatgctggtcgaagaggaactccggcgtgaccaccctgcaatggcagagccacttccggaaccaaaaaaacgcttactggacgcgcagctgctcatccgatag

SEQ ID NO: 54643 - DNA, 2049 bp, Artificial Sequence
  Description of Artificial Sequence: Synthetic coding sequence
atggaagagggctttcgggatagagcagcatttattcggggtgccaaggatatcgccaaggaggtcaagaaacacgccgcaaagaaggtggtgaaaggactggaccgcgtgcaggatgagtatagtaggagatcttactcccgttttgaagaggaagatgacgacgacgattttcctgctccctccgatgggtattaccggggtgagggtacccaggacgaggaagagggtggtgcgtcttccgacgctacagagggacatgatgaggacgacgaaatttatgaaggagaataccagggaatccccagggctgaatcaggagggaagggagaaaggatggccgacggggcaccactggctggagtgagaggagggctcagcgatggtgaagggcctccgggaggacggggtgaggctcagcgtcgcaaggagcgtgaagagctggctcaacaatatgaggccattctgcgcgaatgcggacacgggagatttcagtggacactgtatttcgtactgggtttggcgctgatggcggatggagtggaggtgttcgtcgtaggttttgtactgccatcagccgaaaaagacatgtgcctcagtgactccaacaaaggcatgctcgggttgatagtgtacctaggcatgatggttggggcattcctttggggcggtctcgccgaccggctgggtcgaaggcaatgccttctgatctccttatccgtgaactctgttttcgctttcttttcaagtttcgtgcaagggtacggcacatttttgttctgcaggttattgtctggagtgggcatcggtggaagtatccctatcgtgttctcttacttctccgaatttctggcccaagaaaagaggggagagcacctttcctggctgtgtatgttttggatgattggaggggtatatgctgcggcaatggcttgggccattatcccacattacggttggtcgttccaaatgggatccgcataccagttccactcttggcgcgtgttcgtgctggtttgtgcctttcccagcgtatttgcgatcggggctctcaccacacagcctgagtccccaagattcttcttggagaatggaaagcacgatgaagcatggatggtcttaaagcaggtgcacgataccaatatgagagccaaaggtcaccctgaacgcgttttttctgtgacccatattaagacaatccaccaggaggacgagctcatagagatccagtctgacaccgggacttggtaccagcgctggggggtgcgggctctgtctctcgggggtcaagtgtggggtaattttctttcatgtttcggcccagaatatagacgcatcaccctgatgatgatgggtgtgtggttcaccatgagcttcagctattatggactcacagtgtggttcccggatatgatcaggcatcttcaggccgtcgactacgcttccaggactaaagtgtttcctggcgagcgcgtggagcacgtgacgtttaactttaccctggaaaaccaaattcataggggcggtcagtactttaacgacaaattcataggcctgcggctaaagtccgtgtcttttgaggactctctgtttgaagaatgctactttgaggacgtgacatcttctaacaccttctttcgcaattgcactttcatcaataccgtgttttataacacagaccttttcgagtataagtttgtgaattctaggctcatcaatagcaccttcctccataacaaggagggatgccctcttgatgtgacaggtacaggtgaaggggcttacatggtttattttgtttcctttctgggtaccctcgctgtgctgcccggtaatatcgtttctgctctacttatggataaaattggcaggctccgtatgctggccggttctagtgtgatgtcctgcgtgtcttgtttcttcttaagtttcggaaactctgagtccgccatgatcgctcttctttgcctcttcggtggcgtgtcaatcgcctcctggaatgccctcgacgtattaactgtcgaactttacccttctgataagcgctag

SEQ ID NO: 54644 - DNA, 2229 bp, Artificial Sequence
  Description of Artificial Sequence: Synthetic coding sequence
atggaagaggggtttcgagaccgagctgcgttcattagaggggcaaaggacatcgcaaaggaagtcaagaagcatgccgcaaagaaggtggtcaagggtctggaccgagtgcaggatgagtattctcggagaagctactctcgattcgaagaggaggacgacgatgatgatttccccgctccctccgatggctattacaggggcgaaggaacccaagatgaggaggagggaggggcttcctccgacgcaactgaaggacacgacgaagatgatgaaatctacgaaggcgagtaccaggggattccccgtgccgaaagcggcggaaagggcgaaaggatggccgatggagcccctcttgctggggtccgaggcggtttgtccgacggagaaggaccacctggcggaaggggggaggcacagcgaaggaaggagcgcgaagagctggcacagcagtacgaggctatcctacgcgaatgtggccacgggaggtttcagtggacactgtacttcgttttgggcctcgcactgatggccgatggagtcgaagtctttgtggtgggctttgttctcccgtccgctgagaaggacatgtgtctgtcagactccaataagggaatgctcggccttattgtctatttgggcatgatggtcggtgcattcctgtggggcggtctagccgatcggttagggaggaggcaatgcctgctgatttccctgagtgttaattcggtctttgctttcttttcatcttttgtacagggatatggtaccttccttttttgtagactactctctggggtgggaatcggtggcagcatccctattgttttctcttacttttccgagttccttgctcaggaaaaaagaggtgaacacttgtcttggctgtgtatgttttggatgataggaggagtttatgccgctgccatggcttgggcgatcatccctcattatggctggtcgttccagatgggctctgcctatcagtttcatagctggcgcgtcttcgtgctggtttgtgcgttccctagcgtctttgccattggggcactgaccactcagccggagagccccagattctttctcgaaaatgggaagcacgacgaggcctggatggttttaaagcaagtccatgacaccaatatgagagctaaagggcatcctgaacgggtgttttcagtcacccacatcaaaacgattcatcaggaggacgagttgatagagatccagtccgatacaggcacctggtatcaacgttggggcgtccgagctctgagtcttggagggcaggtgtgggggaatttcctgtcttgcttcggacccgagtaccgtcgcataacacttatgatgatgggtgtgtggttcaccatgtccttctcttattacgggctaaccgtttggtttcctgacatgattcggcacctccaggcagtcgactacgctagcagaactaaagtattccctggagaacgcgtggaacacgtgacctttaattttactctggagaaccagatacaccggggtggccagtacttcaatgacaaattcatcggcctccgactgaagtctgtctctttcgaggacagcctttttgaggaatgttactttgaggatgttacaagctccaacacattcttccgcaactgcactttcataaacaccgttttctacaacactgatctgtttgagtacaagttcgtgaatagccgactgattaattcaacgttcctgcacaacaaggaaggatgcccacttgatgtcaccggcacgggcgagggggcttacatggtgtactttgtatccttcctggggacactggcggtgcttcccggaaatatcgtctctgctctgctcatggataaaattggaagattacggatgctagcaggctctagcgtgatgtcatgtgtgtcttgtttttttctgagttttggaaatagtgaatcggccatgattgcgctcctgtgtcttttcggaggggtatctatcgcatcttggaacgcccttgatgtacttaccgtggagctgtatccctcggacaaaagaaccacagcgtttgggtttctaaacgctctgtgtaaactagccgcagttctcggaatctcaatctttacgtcttttgtgggaatcactaaggccgctccaattctgttcgccagtgccgcactagccctgggcagttccctggccctgaagctcccagaaacaagaggacaggttctgcagtag

SEQ ID NO: 54645 - DNA, 2052 bp, Artificial Sequence
  Description of Artificial Sequence: Synthetic coding sequence
atggacgactacaagtaccaagataattacggtgggtatgccccatcagatggatactaccgtggcaatgaaagtaaccccgaagaggatgcacagtccgacgtgactgagggtcacgacgaagaagatgagatttacgagggcgagtatcaagggattcctcaccctgacgacgtgaaggccaaacaggctaagatggcaccatcaaggatggatagtctccggggacaaaccgacctgatggctgaaaggctggaggacgaggaacagttggcccaccagtatgagacgatcatggacgaatgcggtcacggcagattccagtggatcttgttcttcgttctgggactcgccctgatggctgacggcgtggaggtttttgttgtgtcattcgctctgccatcagctgagaaggacatgtgcctgtccagctcgaagaaaggcatgctcggaatgatagtttacctggggatgatggctggcgcattcattctgggcggactggccgacaagctgggaagaaaacgagtcttgagcatgagcttagcagtcaacgcctccttcgccagtctgtcatcattcgtgcagggatacggtgctttcctcttttgtaggctgatctctggaatcggtatcggaggagcacttcctatcgtcttcgcttatttttctgaattcctctcacgggagaagagaggcgagcacctgtcttggttgggcatcttttggatgacaggtggtctctacgcctccgccatggcgtggagcatcattccacactacggctggggctttagcatgggtactaactatcattttcattcctggcgcgtattcgtgattgtatgcgccctgccttgtacagtgtccatggtggccctaaaattcatgccagaaagccctaggtttttactggaaatgggcaaacacgatgaagcgtggatgattctaaaacaggtgcatgacacgaacatgagagccaaaggaacccccgagaaggttttcacggtgtccaacattaaaactccaaagcagatggatgaattcattgagatccagagttccacagggacatggtatcaacgctggttggtcagatttaaaacaatttttaaacaagtgtgggataatgctttgtactgcgttatggggccttatagaatgaacaccttaatcttggcagtagtgtggttcgccatggctttttcatactatggcctcaccgtttggttccccgacatgattcgctacttccaggatgaagaatataagagtaagatgaaggtattctttggagagcacgtttatggtgctaccatcaatttcaccatggagaaccagattcaccaacacggaaaactggtaaacgataaatttactcggatgtattttaagcatgtactgttcgaagatactttctttgacgagtgttacttcgaggacgtcacaagtacggatacttactttaaaaattgcacaattgagagtaccatcttttataatacagacctgtacgagcacaagttcatcaattgtcgatttattaactcaacattcttggagcagaaggaaggctgccatatggacttggagcaggataacgacttccttatctatctggttagttttctcggatccctctccgtgttgcctggaaatattatcagcgctttgctgatggaccggatagggagactcaagatgataggcggatccatgttaatctctgccgtttgctgtttcttcctcttttttgggaattcggagagtgcaatgatcggctggcagtgtttgttctgtgggacttccattgctgcatggaatgccttagacgtgattacagtggaactgtaccccacaaaccaaagagccaccgcattcggtatcctcaacggattatgcaagttcggtgccatcctgggcaacacaatcttcgcctcctttgtcggtattaccaaggtcgtgccaattcttctggccgctgcctcgctcgtagggggaggtctgatagccctcaggctacccgagacccgcgaacaggtcctcatgtag

SEQ ID NO: 54646 - DNA, 2052 bp, Artificial Sequence
  Description of Artificial Sequence: Synthetic coding sequence
atggatgattacaaatatcaggataattacgggggatacgcaccttccgacgggtattatcgtgggaacgagagcaacccagaggaagacgcgcagtccgatgtgaccgagggccacgacgaggaggacgagatctacgagggagagtatcagggtataccccaccccgacgacgtgaaggctaagcaagcgaagatggctccctcccgtatggacagcctgcgcggtcaaacagatctgatggcagaacggctggaggacgaagagcaacttgcccaccagtatgaaactatcatggacgaatgtggacatggacgttttcaatggattctgttcttcgtactggggctcgccctgatggctgacggtgtggaggtgtttgttgtgagctttgctttgccctccgccgaaaaagacatgtgtttgagctcctccaaaaaaggaatgttgggaatgattgtgtatcttggcatgatggcaggagcatttatattgggcggattagctgataagctgggaaggaagagggtcctctccatgtctcttgctgtgaatgccagttttgcctcattatcaagttttgttcagggatatggcgcttttctgttctgtagactcatctctggcatcggcatcgggggagccctcccaatcgtgttcgcatatttcagcgagtttctgtcaagggagaaaaggggcgagcacctttcgtggctaggtatcttctggatgaccgggggactgtacgccagtgccatggcttggagtattatccctcattatgggtggggattctcaatggggacgaactaccattttcactcctggagggtgttcgtgattgtgtgtgcgctaccttgtaccgtctctatggtggctcttaaatttatgccagaatctcccaggtttctgctggaaatgggcaaacatgacgaggcttggatgatcctgaagcaggtgcacgacaccaacatgcgagccaagggcacgccagaaaaggtctttactgtctctaacattaagactcctaagcagatggacgaatttatagagatccaatcatctactgggacgtggtatcaaaggtggttggtgcgttttaagactatattcaaacaggtgtgggataatgccttgtactgcgtaatgggcccatatcggatgaataccctgattctggctgtagtctggtttgcaatggccttttcctactacggtctgaccgtttggtttcccgacatgatcaggtactttcaggatgaagagtataagtcaaagatgaaagttttttttggcgagcatgtttatggcgcaactatcaatttcacaatggagaaccaaattcaccagcacggtaaattggttaacgataaattcaccagaatgtacttcaaacacgtgctgtttgaagacaccttcttcgatgaatgctatttcgaggatgttacctccacggacacttattttaagaactgcactattgaatctaccatcttctataatactgatctgtatgaacataagttcataaattgtagattcataaatagtactttcctggagcagaaagaggggtgtcacatggatctagagcaggacaatgatttcctgatctatctggtttcatttctgggatctctctcagtgcttccgggaaatattatatccgcattgctgatggacagaattgggaggctgaaaatgattggcggaagcatgcttatcagcgcagtctgctgctttttcctgttttttggaaatagtgagagcgccatgatagggtggcagtgcctgttttgtggtacttccatcgccgcttggaacgcactcgatgtgattacagtagagctgtatcccaccaatcagcgcgcaactgccttcggcatcttaaacggtttgtgtaagtttggcgctatcttgggcaacacaatctttgcttcttttgtgggaatcaccaaagtggtacccatactcctggctgccgcaagccttgtgggcggtggcctgattgcattgcgtttgccggagactcgcgaacaggtgctgatgtag

SEQ ID NO: 54647 - DNA, 1599 bp, Artificial Sequence
  Description of Artificial Sequence: Synthetic coding sequence
atgattgtgtaccttggtatgatggccggagcatttatccttgggggattagccgacaaactcggtaggaaacgcgttttatctatgagccttgccgttaacgcctcattcgcttccctttcttcatttgtgcagggttacggcgctttccttttctgcaggctaatatccggcattggtatcgggggtgccttgccaattgtctttgcttactttagtgagtttctaagccgcgagaagcgcggtgagcatttaagttggctgggaatattctggatgaccggagggttgtacgcctctgctatggcctggtctatcattccccactacggctgggggttcagcatggggacaaattatcacttccattcatggagggtgtttgtgattgtgtgtgcactgccttgcacagtcagtatggttgctcttaaattcatgcctgagagtccaaggtttttactagagatggggaagcatgatgaggcctggatgatacttaagcaggtgcatgacaccaacatgcgggctaaggggactcctgaaaaagttttcacggtgagtaacatcaaaacgccgaaacaaatggatgagttcatcgagattcaatcttccacgggcacgtggtatcaacgatggctcgttagattcaaaaccatcttcaaacaagtatgggacaacgctctgtactgcgtgatgggaccttatagaatgaatacactgatcctggcggttgtgtggttcgctatggcattctcttactacggtttgaccgtgtggtttccggacatgatcaggtacttccaagacgaagagtacaagtctaagatgaaagtgttttttggcgaacacgtgtacggcgctactatcaacttcacaatggagaaccaaattcaccagcacgggaagctggttaatgacaagttcacacgaatgtacttcaagcacgtactgttcgaagacacctttttcgatgaatgctactttgaagatgttacaagtacagatacctacttcaaaaattgcacaatcgagtctaccattttctacaacacagacttgtacgagcacaaattcatcaattgcagatttattaacagtacgtttctggagcagaaggagggctgccatatggacctggagcaagacaatgacttcctcatctatctcgtgtccttcctggggagcctgagcgtactacccggaaatattattagtgctttgctgatggatcgaattggccgtcttaagatgattggtggatccatgctcataagtgccgtctgttgtttttttctatttttcggaaattcagagtcagccatgattggttggcagtgtcttttttgtgggactagcatcgccgcatggaacgcccttgatgtcatcactgtggaactgtatcctacaaaccagagggccaccgcatttggcatccttaacggactgtgtaaatttggcgctatcctggggaacaccattttcgctagctttgtcgggattaccaaggttgtccctattctgctcgcagccgcttcactggttgggggaggactcattgccctccgactcccagaaaccagggaacaggttctcatgtag

SEQ ID NO: 54648 - DNA, 2052 bp, Artificial Sequence
  Description of Artificial Sequence: Synthetic coding sequence
atggatgactacaaatatcaagacaactacggcggttatgccccaagcgacggatattatcgcggaaatgagtccaatcccgaagaggatgcccagtctgatgtgactgagggccacgatgaggaggatgaaatttacgaaggcgagtatcaggggatcccccatcccgacgatgtcaaggctaagcaggccaaaatggcccctagcagaatggatagtctccgcggacaaacagacctgatggcagagcgactagaggatgaagagcagcttgcccatcaatacgagaccattatggacgagtgcggacacgggagattccagtggatcctgttctttgtcctcggcctggccttgatggctgatggggtggaggtgttcgtcgtctcgttcgcactgccctcggccgaaaaggatatgtgcctgtcttcttcaaagaaaggcatgttgggaatgatcgtatacttaggcatgatggccggagccttcattcttggcggtcttgccgacaaattggggaggaaacgtgttttgagtatgtcgctggctgtgaatgctagttttgcaagtctgagcagtttcgtacagggatatggagcattccttttctgtcgcctcatctcgggcataggtattggaggggctctgccgattgtgttcgcctattttagtgaattcctgtcccgagagaagcggggagagcacctgagttggctaggcatattttggatgacaggcggtctgtacgctagcgcaatggcatggagcattatccctcactatggatggggattcagtatgggcacaaattatcatttccattcctggcgggtttttgtgatcgtttgcgcactaccttgtacagtcagtatggtggcactgaaattcatgcccgaaagtcccaggttcctgttagagatggggaaacacgatgaggcatggatgatcctcaaacaggtccacgatacgaatatgagagccaagggaacaccagaaaaggtattcactgtctccaacattaaaacacccaaacagatggacgagtttatcgaaatccagtcttccactggcacatggtaccagcgatggctcgtgagattcaagactatctttaaacaggtgtgggataatgctctctattgcgttatggggccttacagaatgaacactcttatacttgcggtggtctggttcgccatggccttttcctattacggcctgaccgtttggttccctgatatgatcaggtacttccaagatgaggaatacaaaagcaagatgaaagttttctttggtgagcatgtctatggcgcaacaattaattttaccatggagaatcagatccatcagcatggaaagctcgttaatgataagttcactaggatgtactttaagcatgtgctgtttgaagatacattttttgacgagtgctatttcgaggacgttacctccacagatacatactttaaaaattgcaccatcgaaagtacaatcttttacaacactgacctctatgaacacaaattcatcaattgtagatttatcaacagcactttccttgagcagaaagagggctgccacatggacctggaacaagacaatgattttctcatatacctcgtctccttcctcggctccctctccgtcttaccaggaaacatcatctctgctctgctcatggaccgcataggaaggctgaagatgattggcggatctatgctcatctctgcagtgtgctgcttttttctgttcttcggcaattccgagtccgccatgattgggtggcaatgtctgttttgcggtactagtatcgcggcatggaatgctctggatgttataacggttgagctttaccctaccaaccagagggctaccgccttcggcattctcaatggtctgtgtaagtttggagccatactcgggaatacaatatttgcatcgttcgtggggataacaaaggttgtgcccatcctcctcgcagccgcttctttggtcggtggcggactgatcgctctgcgattgccagagacacgcgaacaggtcttgatgtag

SEQ ID NO: 54649 - DNA, 2031 bp, Artificial Sequence
  Description of Artificial Sequence: Synthetic coding sequence
atggaggacagctataaggatcggacaagcctcatgaaaggagcgaaagacatcgcccgagaagtgaagaagcaaacagtcaagaaggtgaaccaggcggtggacagagcccaagatgagtatactcaacggtcatacagtaggttccaggacgaagaagacgacgatgactattatcctgccggtgagacttataatggggaggcaaacgacgacgagggctcgtctgaggctacagagggccatgacgaggacgacgaaatatatgagggggaatatcagggtattcccagcatgaatcaggctaaggacagcattgttagcgttggacagcctaaaggcgatgagtacaaagatcggagagagcttgagtccgagagaagggctgatgaggaagaactggcgcagcaatacgagctgatcatccaggaatgtggacacggcagattccaatgggccctgttcttcgtattgggcatggccctcatggccgatggcgtggaggtgtttgtcgtgggcttcgtactgccatctgcagagaccgatctctgcatccccaactccggttcaggctggttgggcagtatagtatatcttggcatgatggtgggcgctttcttttggggcggactggccgataaagtgggcagaaagcagagtctgctcatctgcatgtctgtgaacggattctttgcctttctctcctccttcgtgcagggctacggattttttttgttctgtcgccttttatcaggattcggaattggcggagcaataccaacagtattctcatactttgctgaggtcctggctcgcgaaaagaggggagaacacttgtcgtggctctgcatgttttggatgatcggagggatttatgctagtgctatggcatgggcaatcatccctcactatgggtggtccttctcaatggggagcgcataccaatttcacagttggagggtgtttgtcatcgtttgcgccctgccatgcgtgtctagcgtagtggccctgactttcatgcccgagtcaccacggttcctgctggaagtagggaaacatgacgaggcatggatgatcctcaagttgattcacgatacgaacatgcgggcacgcggacagccagaaaaggtcttcacagtgaataagatcaagacccctaaacagattgatgaactcattgaaattgagtctgatacaggcacttggtataggcgctgtttcgtaagaatccgcacagagttgtatgggatttggctgacctttatgcgttgtttcaattaccccgtacgggataacactatcaagttaacaatcgtctggttcactcttagtttcggatactacggactcagcgtgtggtttccagacgtgataaagccccttcagtccgacgagtacgcattgctaacacgaaacgtggagcgggacaaatacgccaatttcacgatcaatttcacaatggagaaccagatccacacgggcatggaatacgataatggtcgattcatcggagttaagttcaaaagcgtcacatttaaagacagtgttttcaagagctgcaccttcgaggatgtgacttcagtcaacacctatttcaagaattgtactttcattgataccgtctttgacaacacggattttgaaccatataagtttatcgattccgagttcaaaaactgcagcttttttcataataaaaccggatgccagattaccttcgacgacgactactccgcctactggatttattttgtcaactttttagggaccttagcagtgttgccaggcaacatcgttagcgcattattgatggaccgcattgggcgactgaccatgctaggaggaagcatggtgttatcaggtatctcctgcttctttctttggttcggaacttccgagtctatgatgattggtatgctttgcctctataatggtcttaccataagcgcctggaacagtctggatgtggttactgtcgaactgtatccaactgatcgccgaaggcgtgtccttccatgttgtcctggatag

SEQ ID NO: 54650 - DNA, 2184 bp, Artificial Sequence
  Description of Artificial Sequence: Synthetic coding sequence
atggaggattcttacaaagaccgcacctccctgatgaagggagctaaggacatcgccagagaagttaagaagcagaccgtgaaaaaggttaaccaggccgttgacagggcgcaggatgaatacacccagcgaagctattcacgattccaagacgaagaggacgacgacgactactaccccgctggcgagacgtacaacggagaggctaacgacgacgaggggagttcagaggctacggaaggtcacgacgaggatgacgagatctacgagggcgagtaccagggcatcccttctatgaatcaggctaaagactccatagtttctgtgggccaacccaagggggacgaatacaaagacagacgggagctagagtcagagcggcgtgccgatgaagaggaactggctcaacagtacgaactgataatccaggagtgcggccacggcaggtttcagtgggcactgtttttcgtgttggggatggccctgatggcggatggagtggaagtctttgtggtcggtttcgtcttgccctccgccgagactgacctgtgtattcccaacagcggttctggctggctcgggtctatcgtatacttaggcatgatggtgggcgcattcttctgggggggtctcgcggacaaagttggtaggaagcagtctctgctgatctgcatgtccgtgaacggcttcttcgcattcctttcttcgttcgtgcagggctacggcttttttctgttctgccgcttgttatccggatttggcatcggcggagccatcccaacagtgttctcctactttgctgaggtgctggcacgcgagaagcgaggagagcatctatcatggctgtgcatgttttggatgattggagggatctacgctagtgctatggcatgggccatcatccctcactacggctggtctttctctatgggctcagcatatcagttccacagctggcgtgttttcgtcattgtgtgcgccttgccgtgcgtatcctctgtggtcgctctgacctttatgcctgagtctccacggtttcttttggaggtgggcaagcacgatgaggcatggatgatcctaaagcttatacatgacaccaacatgcgcgcacggggacaacctgagaaggtattcacagtgaacaagattaaaacccccaagcagatagatgaactcatcgaaattgagtcagacaccggcacctggtacagacggtgtttcgtgagaatccgaaccgaactgtatggaatctggctgacctttatgcgttgcttcaactacccggtccgggataataccatcaagctgactatagtatggtttactttaagctttggttactatgggctgtctgtgtggtttcccgatgttataaaacccctgcagtcagacgagtatgccttacttacccgcaatgtggagcgagacaaatacgcgaactttaccataaactttacaatggagaaccagatccacactggcatggagtacgataatggcagatttatcggagtgaagtttaagagtgttactttcaaagattccgtctttaagtcttgtacttttgaagacgtcacttctgtcaacacctattttaaaaactgcaccttcatcgacacagttttcgataataccgactttgaaccttataagttcatcgactctgagtttaagaactgttccttcttccataacaaaactggatgtcaaatcacgttcgacgatgactattctgcatactggatttatttcgtgaattttcttggtaccctcgccgtcctgcctggcaacatcgtcagcgcactgcttatggatcggataggcaggctcacgatgctcggcggtagtatggtgctatctggcatttcatgtttttttctctggtttggtacttcagagagcatgatgattgggatgctatgtctgtataacgggctgacgatatccgcctggaattctctagatgttgttacagtggagctctaccccaccgataggagggcgaccgggttcggcttcttgaatgcgttatgtaaggcagcagccgttttaggtaacctgatctttgggtctctcgtaagtataaccaaatcgataccgattctcctcgcttccactgtgctggtgtgtgggggactggtgggtctgtgtctgcctgacacacggactcaagtgctgatgtag

SEQ ID NO: 54651 - DNA, 780 bp, Artificial Sequence
  Description of Artificial Sequence: Synthetic coding sequence
atggccccaaatatatatctagtgcgccagcggattagccgcctgggtcagcggatgtccggtttccagatcaatctcaatcccctgaaggagccactgggctttatcaaagtgctggagtggattgccagtatcttcgcttttgcgacttgcgggggatttaagggacagaccgagatacaagtgaactgccctcctgcggtgacagagaacaagacggttacggcaactttcggttacccctttcgcctcaacgaagcaagttttcaaccaccccctggcgtcaacatttgcgacgtgaattggaaagattacgtgctgattggcgattattccagctctgctcagttctatgtgaccttcgctgtctttgtgttcctgtattgcatagctgcactccttctgtacgtgggctacacttccctgtatctggactcccgaaaattgcccatgatcgatttcgtggtaaccttagttgctacctttctatggctcgtgtcaacttcggcatgggcaaaggccctcacagacattaagattgcaacggggcataacatcatcgacgaactgcccccatgtaagaaaaaggccgtgttgtgctatttcggcagcgtcactagcatgggatctctcaacgtgtcagtcatttttggattcttaaacatgattctctgggggggaaatgcttggtttgtgtacaaagagacatcactgcacagcccatccaacacttccgctccccacagtcagggtggcatacctccccctacgggcatctag

SEQ ID NO: 54652 - DNA, 726 bp, Artificial Sequence
  Description of Artificial Sequence: Synthetic coding sequence
atgtcaggcttccagatcaacctgaaccctctgaaggagcctctcggttttattaaagtcctggaatggattgcctcaattttcgcttttgccacttgtggcggttttaagggacagaccgaaattcaggtcaattgcccgccagccgtgacagaaaataagactgttaccgcaacgtttgggtacccattcagactgaacgaggcaagcttccaaccacccccaggagtcaatatttgtgacgtcaattggaaggattatgttctaatcggagactacagctcgtccgcccagttctacgtgactttcgccgtcttcgttttcctgtactgcattgcggctctgttactctatgtgggatacacatcattatacctcgattccagaaagctgcctatgattgatttcgtcgtgacgttggtcgcaacctttctctggttggttagcacttcagcttgggccaaggcactgacggacatcaagatcgctacaggccataacatcattgacgagttgccaccttgtaagaaaaaagcagtgctttgttatttcggcagcgtgacttctatggggtccctcaacgtcagcgtgatctttgggtttctgaacatgatcttgtgggggggaaacgcctggttcgtatataaagagacaagcttgcactcgccatccaacacaagtgcccctcattctcagggcggtattcctccaccaaccggaatttag

SEQ ID NO: 54653 - DNA, 819 bp, Artificial Sequence
  Description of Artificial Sequence: Synthetic coding sequence
atgtctagtactgaatcggctggtagaacggctgataagtcaccacggcagcaggtggacagactactcgtggggttacgctggcggaggctggaggagcctctgggctttatcaaagtactgcagtggctgttcgcgattttcgcctttggatcttgtgggtcatactcaggcgaaacgggggcaatggtacgatgcaacaatgaagccaaagatgtctcttcaatcatcgtggccttcgggtatcccttccgtctgcaccgcattcagtacgagatgcctttatgtgatgaggagtcatcttccaagactatgcacctgatgggagacttttctgctcccgctgagttcttcgttactctgggtatcttctcattcttctacactatggctgccctggttatctatctcaggttccataacctgtacactgagaataagcgcttcccgctggtagacttctgcgttactgtctcattcactttcttttggctcgtagccgctgctgcctggggtaaggggcttactgacgttaagggcgctactcgaccttctagccttacggctgcaatgtctgtttgccacggtgaagaggccgtgtgtagcgcaggcgctacaccatccatggggttggccaacatctcagtgttgtttggatttattaacttcttcctgtgggcaggtaactgctggtttgtgttcaaggagactccgtggcacgggcaggggcagggccaggaccaggaccaggaccaagaccaagggcagggcccaagccaggagtctgccgctgaacaaggcgctgtggaaaagcagtag

SEQ ID NO: 54654 - DNA, 627 bp, Artificial Sequence
  Description of Artificial Sequence: Synthetic coding sequence
atgtcgagtacagaatctgcaggacgcactgccgacaagagcccccgtcagcaggtggatcgactgctggtcgggctgcgctggcgtcgcttggaggagcccctgggtttcattaaagtgttgcagtggctgttcgctatattcgcgttcggcagttgcggaagctactccggcgagacaggcgctatggtgcgctgtaacaacgaagccaaggatgtgagctctatcatagtcgcctttgggtaccccttccgcctacatcggatacagtacgagatgcccttgtgtgacgaggagtctagctctaagactatgcatttgatgggagacttcagcgcccctgcagaattcttcgtgacactgggtatattttcttttttctatactatggccgcacttgttatctatctcagatttcataacctatatacggaaaacaagcgtttccccctggtgttgttcggattcataaactttttcctgtgggcagggaactgctggttcgtcttcaaggaaacgccatggcacgggcagggtcagggccaggaccaggatcaggaccaggatcagggccaaggcccatcacaagagagtgcagcagaacaaggagccgtcgagaagcagtag

SEQ ID NO: 54655 - DNA, 798 bp, Artificial Sequence
  Description of Artificial Sequence: Synthetic coding sequence
atgtgcatggtgatctttgccccactcttcgccatcttcgccttcgctacatgcgggggttactctggaggactgcgactgtcagtggattgcgttaataagactgagagcaatctgtctatcgacatcgctttcgcctaccctttcagactgcatcaggtgaccttcgaggtccctacttgtgaggggaaggaacggcaaaaattagccttgattggcgattcctctagcagcgcagaattttttgtgaccgtggccgtctttgccttcctgtattccttagcagcaactgtggtttacatcttttttcaaaacaagtacagggaaaacaaccggggtcctctgattgacttcatcgtgaccgtggtcttctcgtttctgtggcttgtaggctcgtccgcgtgggctaaaggcctgagtgatgtcaaggtcgcaacagacccaaaggaggttttattactgatgagcgcttgcaagcaacctagcaataagtgtatggcaatccattcaccagtgatgtcctcactgaacacaagtgtcgttttcgggttcttgaatttcatactgtgggccggaaacatctggttcgtgttcaaggagactgggtggcacagcagtggacaacgttacctgagtgatcccatggaaaaacattcatctagctataaccaggggggttataaccaagattcctatggaagttctagcggctactctcagcaagccagcctgggaccgacctctgacgagttcggacagcaacccacaggcccaaccagttttaccaaccaaatttag

SEQ ID NO: 54656 - DNA, 831 bp, Artificial Sequence
  Description of Artificial Sequence: Synthetic coding sequence
atgtgtatggtaatatttgctccccataacgaagaatgtaagtcccactttcatctgctcttcgcaatatttgcattcgccacatgtgggggttactcagggggtctgaggctgtcagtggactgtgttaataaaactgagtctaacctgagtatcgacatcgcctttgcgtatccctttagactccaccaggtgacattcgaggtgcccacctgcgagggcaaagagcgccagaagttggcactcatcggtgactcctcctcaagcgccgagttcttcgtaacagtcgcagtatttgcctttttgtactctctagcagcaactgtcgtgtatattttttttcaaaataagtacagggaaaataacagaggcccattaatcgatttcatagttactgtggtgttttcatttctgtggcttgtcggttccagcgcctgggcgaaaggcctgtccgacgtcaaggtggccacggatccaaaagaggtcctgcttcttatgtccgcctgtaaacagccctcaaataaatgtatggccatccactctccagtcatgtcctccttgaatacttccgtggtgttcggattcttgaattttattttgtgggccggaaatatctggtttgtgtttaaagaaaccgggtggcacagttccgggcagcggtacctctccgatcccatggaaaagcattcctcctcttacaaccaaggcggatataaccaagacagttatggatcctcaagcggctatagtcaacaagccagccttggtccgaccagtgacgaattcggccagcaacctaccggccctacatcttttacaaaccagatttag

SEQ ID NO: 54657 - DNA, 858 bp, Artificial Sequence
  Description of Artificial Sequence: Synthetic coding sequence
atggaccctgtgtctcaattggcgtcggcgggaacattccgcgtgcttaaggagcccctggcctttctgagagctctagaattactgttcgcaatctttgcgtttgccacatgcggaggatacagtgggggtctgaggcttagcgtcgattgtgtgaacaagacagagagcaacctctcgatcgatatcgcattcgcgtacccctttaggttacaccaggtaacgttcgaggtaccgacgtgcgagggaaaggaacgccaaaagttggccttgatcggagactccagttccagcgctgagttcttcgtgactgtggcagtgtttgccttcctctattcactggccgcaaccgtggtgtacatcttcttccagaacaagtaccgagagaataaccggggacctctcatagatttcatcgtgaccgtggttttttcttttctctggctggttggtagctctgcctgggcaaaagggttgtctgacgtcaaggttgccaccgacccaaaggaggttctcttgctgatgtccgcatgtaaacagccaagtaataaatgtatggctatccacagccctgtcatgagcagcctgaatacatctgtggtgttcgggttcctaaattttatcctctgggcgggaaatatctggtttgtatttaaagagactggatggcactcttcaggtcagcggtatctctcagatcccatggagaaacactcgagctcatacaaccagggcggatacaaccaggactcatacggctcctcttccgggtacagtcagcaggctagcctggggccaaccagtgatgaattcggtcagcaacctactggtcctactagttttaccaaccagatttag

SEQ ID NO: 54658 - DNA, 177 bp, Artificial Sequence
  Description of Artificial Sequence: Synthetic coding sequence
atgtcaggtcagacgctgactgacaggatagcagccgcacaatattctgtcacagggtccgcagtagccagggcagtgtgtaaggctactacgcatgaggtgatgggaccaaagaaaaaacatctggactacctgcagacattttttcagcaggtcctgccgaatttcgagatctag

SEQ ID NO: 54659 - DNA, 2634 bp, Artificial Sequence
  Description of Artificial Sequence: Synthetic coding sequence
atgagcggacaaacactcacagatcgcattgcagccgcacagtatagtgtcaccggatctgcagttgcgagagccgtgtgtaaagccaccacccacgaagtgatggggcctaagaaaaagcatttggattatctgattcaggcaaccaatgaaacaaatgtcaacataccccagatggcagatacactcttcgaacgcgctactaattccagttgggtcgttgtgttcaaagcactggtcactacacatcacttgatggtccatggaaacgagcgtttcatacagtatttggcctcacgcaataccctctttaacctctctaatttcctggacaagtcaggaagccatggctatgatatgtcgacctttatacgtcggtatagtagatacctcaatgaaaaggcatttagttaccgtcagatggcgtttgatttcgccagggtgaagaaaggagccgatggtgtgatgcgcactatggctccagagaagctgcttaagtctatgcccattcttcagggccagattgacgcgttgctggaattcgatgtacaccctaacgaacttacaaacggcgtaatcaatgctgcttttatgctgctctttaaagatctgattaaactgttcgcatgttacaatgatggagtgattaatcttctggagaagttttttgaaatgaaaaagggccagtgtaaggatgccttggagatttataagcgattcctgacgcgtatgacaagggtatctgagttcctgaaagtcgctgagcaagtgggcattgataaaggggatatcccagacctaacccaggccccttcatccctgatggaaacgctggagcagcacttaaacacattggagggcaagaaaccagggaataagagcggcgcaccaagcccactgagtaaatcctcccctgctactaccgtgaccagcccaaatagcacgcccgcaaaaaccatagataccagcccgccagtggacctgtttgccactgcttccgcggctgtgcctgtaagtacaagcaagcccagttcggatctcttagacctgcagcccgactttagctccggcggtgcggctgctgcagccgcaccagctccacccccaccggcaggaggagcgacagcctggggcgacctgctgggggaggacagcctggccgcacttagcagcgtccctagtgaagctcagatcagcgaccccttcgcgcctgaacccactcccccaaccacaaccgccgagatagccactgcatcggcatcagcatccacgacaactactgtaacggctgtgactgctgaagtggacctgttcggggatgcatttgccgctagccctggcgaggctccagccgctagtgagggggctgccgcaccagcaactcccactcctgtagccgcagcactggatgcatgctccgggaatgacccctttgcaccctcagaaggctctgcagaggccgcaccagagctggacctattcgccatgaagcctcctgaaacatcagtccctgtcgtgacaccaaccgcctccacggcacccccagtccccgctactgccccttcccctgcacccgctgttgctgccgctgcagccgcaacaaccgccgctaccgctgccgcaacaacaacaaccacaacctcagccgctacagctaccaccgcgcctcctgcactggatatctttggtgacctgttcgagtcaacaccggaggtcgcagcagctcccaagccggatgcggcacccagcattgacctgttttctacagacgcattttcaagcccacctcagggcgcatctcctgtgcccgagtcgtctctcacagcagaccttctgagcgacgccttcgggagcagcgcctccgagccgcaacctgcgtcgcaggccgcttcaagttcttccgccagtgcggaccttctcgctgggttcgggggaagtttcatggcaccaagtcccagtcctgtgacccccgctcaaaacaatctactccagcccaacttcgaagctgcgtttggaacgacccccagcacctcctccagttcatcatttgacccctctgtgttcgacggcctaggggatttgctgatgccaaccatggccccagctgggcagcctgcccctgtgtctatggttcctcctagtcccgctatggctgcctccaaggctctgggaagtgatcttgattcatcacttgcctcccttgtgggtaacctgggcatcagtgggactactaccaagaaaggggatctgcaatggaacgccggagagaagaaactcacaggcggtgctaattggcagcctaaggtagctccagccacttggtccgccggagtgcctcctagcgcacccctgcagggggctgtgcctccaacctcgagcgtgcctccggtcgcgggagcacctagtgtggggcaacccggagctggattcgggatgcccccagctggtacagggatgccgatgatgcctcaacagccagttatgttcgcccagcccatgatgcgccctccattcggggctgccgcagttccaggtacacagctgtcaccctcccccacccccgctagccagagccctaagaaacctccagccaaagatcccctcgccgacctgaacatcaaggattttctttag

SEQ ID NO: 54660 - DNA, 2709 bp, Artificial Sequence
  Description of Artificial Sequence: Synthetic coding sequence
atgagcggccagaccctcactgaccgcatagcagcagctcaatactccgtgacgggcagcgccgtagcacgggcagtatgcaaagctaccacccacgaagtgatgggcccaaaaaagaagcaccttgattacctgattcaagctaccaacgagactaacgtgaacatccctcagatggccgatacactgttcgaacgggcaaccaatagctcgtgggtggtagtcttcaaggccctagtgacgactcaccacctaatggtccacggtaatgaaagattcattcaatacctagcgtcccgcaatactctgtttaacctctcaaactttcttgacaaaagcggatctcatggctatgacatgagcacctttatccgaagatattccagatatcttaatgaaaaggcattctcttacagacagatggcctttgactttgcacgcgttaagaagggggctgatggcgtgatgagaaccatggccccagagaaactgctcaagtctatgccaattttacaggggcagatcgatgcacttctggagtttgatgtgcaccccaacgaactaaccaacggggtaattaacgccgcattcatgctcctcttcaaggatttgattaaactcttcgcctgctataatgatggtgttattaacctgctggagaagttttttgagatgaagaagggccagtgcaaggacgctttagaaatctacaaacggtttctgacacggatgacacgtgtttcggagttcctcaaggtggccgagcaggtgggcatcgacaagggagatatccctgatctgacccaggcacctagcagcttaatggagactctcgagcagcacctgaacacactcgagggtaagaaacccggaaataatgagggttctggcgctccaagccccctgtcgaaatctagtcctgctaccaccgtcacaagccctaattctacccccgcaaaaacaattgatacatcacctccagtagacctattcgccaccgcctctgcggcagtgcctgtgagtacaagtaagccgtcttcagatcttctggatctgcagccagacttctcatccggtggcgctgcagctgccgcagcccctgctccgcctcccccagctggcggagctactgcttggggcgatctcctaggtgaggactctctggctgcattgagcagcgtaccatctgaggctcaaatatctgatccttttgccccagagccaacccccccaacgacgacagctgagattgccactgccagtgcctctgctagcactacaacgacggtgaccgccgtgaccgctgaagtcgacctgtttggtgatgcatttgctgcctcccctggggaggcccctgccgcatccgagggagcagcagctcctgctacaccaaccccagtggcagcggcactggatgcatgttctggcaatgacccatttgccccatcagagggaagtgctgaggctgctccggaattagatttgtttgcaatgaaacctccagaaacaagcgtgccagtggtcaccccaactgctagcaccgcacccccagtcccagctaccgcacctagcccggcacctgctgttgccgctgccgctgccgcaacaactgcggctacggctgcagccacaacaactacaactaccagtgccgctaccgctactaccgctcctccggcactcgacatctttggcgatctattcgaatctacgcccgaggtggccgcagctccgaaacccgacgctgcgccatccattgaccttttttccacagatgcattttcaagcccacctcagggagcttccccggtacccgagtcttctctgacagctgacctgctttcggtggacgccttcgccgctccatcaccggcaacaaccgcttctcccgctaaggttgatagctccggagtgatcgacctgttcggagatgctttcgggagttctgcctctgagccccaacccgcttcacaggccgcttcctcttcatccgcatcagcggaccttctagccggtttcggaggaagcttcatggctccttcgccatctcccgtcactccagcacaaaataacctcctgcagcctaatttcgaagcggcttttggtacgacacccagcacttctagctcttcgagcttcgatccctccggagacctactgatgcctactatggctcctgccggacagcctgccccagtgagcatggtgccccctagccccgcaatggccgcttcaaaggcccttgggtcggatctggatagttcccttgcttctctggtaggtaaccttggcatcagcggaaccacgacaaagaaaggggacctgcagtggaacgccggtgaaaaaaagctgacagggggagcgaactggcagcccaaagtggcccctgcaacctggtcggccggtgtgcctccctctgccccacttcagggcgcagtgccccctaccagctccgtgcccccagtggcaggcgctccatctgtcggtcaacctggggcagggtttggcatgcccccagcaggcacggggatgcccatgatgcctcagcagcctgtcatgtttgcccagccaatgatgcggcctccttttggtgccgctgccgttcccggtactcagttatccccatctcccacaccagcgagtcagagccccaaaaagcctccggctaaagaccctctcgcggatctgaacatcaaagacttcttgtag

SEQ ID NO: 54661 - DNA, 450 bp, Artificial Sequence
  Description of Artificial Sequence: Synthetic coding sequence
atgtctggacaaacactgactgacagaatcgcagctgctcagtatagcgtgacagggtccgccgtcgcccgagcagtctgcaaggcaaccacacatgaggtcatgggccctaagaaaaagcaccttgactaccttatccaagctacaaacgagacaaatgtcaacattccccagatggctgacacgctctttgagagggcaactaactcctcgtgggtcgtcgtgtttaaagccctggtcacaacgcatcatttgatggttcatggtaatgagaggttcatccaataccttgcgtctcggaatactttgtttaacttatcaaattttcttgacaagtctggttctcatggctacgatatgtcaaccttcataaggagatacagcagatatctcaacgagaaggccttttcttaccgccagatggccttcgactttgctcgcgtgaagtag

SEQ ID NO: 54662 - DNA, 2724 bp, Artificial Sequence
  Description of Artificial Sequence: Synthetic coding sequence
atgagcggtcagacgttgacggacaggattgctgcggcacagtacagtgtgacgggctccgcagtggcgagggcagtgtgcaaagctactacccacgaggtgatgggacccaaaaaaaaacatttggactaccttatccaggcaaccaacgagacaaacgtcaacattcctcagatggcagacaccttgtttgagcgggcaacaaatagctcctgggtggtggtgtttaaagctctcgtgacgacacatcacctcatggtgcacggtaacgagcgcttcattcaatatctggcctcaaggaatacactgtttaacttatcgaactttctggacaaaagcgggagccacgggtacgacatgtcgacatttatccgccgttattccaggtatctgaatgagaaggcattttcgtaccgccagatggcctttgacttcgccagggtgaagaaaggggctgacggagtcatgcgaaccatggcgcctgaaaagcttttgaagtcaatgcccattctgcagggccagattgacgctctgctagagtttgatgtgcatccaaatgagttgaccaatggagtgataaacgccgctttcatgctgctgtttaaagacttaatcaagctcttcgcctgttacaacgacggagtgataaacctcctcgagaaatttttcgagatgaagaagggccagtgcaaagacgccttggagatctacaagaggtttctcactcggatgacacgcgtgagcgaattcctaaaagtggcggaacaggtagggattgacaagggtgacatcccagatctgactcaggccccaagtagcctcatggagacacttgagcaacacttaaacacactagaagggaaaaaacccggtaataatgagggctctggagctccctcacccttgagtaaatcctctcccgctaccactgtgaccagtcctaactctactcctgccaagaccatcgatacctcccctcctgtagacctgttcgctaccgcctctgcagcggttccagtctccacttcaaagccatcctctgatttgcttgatctgcagcccgacttctcatcaggcggagcggcagcggctgcagctcccgcacccccaccccctgctggcggagccaccgcctggggggatctgttgggcgaggacagtctcgccgcactgtccagtgtacctagcgaggcccaaatttccgacccgtttgcccctgaaccaacaccccctacaacaactgccgaaatcgccactgcttccgccagcgctagcaccacaaccactgtgactgctgtgactgctgaagtggacctgttcggagacgcttttgcagcgagccccggtgaggcacctgcagcttcagagggggcagccgctcccgcaacccccactccagtggcagcggctctcgatgcttgcagcggaaacgacccatttgccccaagcgagggctcagctgaggccgctccagagctcgacctatttgctatgaagcccccagagacctctgtccccgtggtgacgcccactgcctcaacagccccacctgtgccggctactgcaccctcacctgcacctgccgtggctgctgctgctgctgccactactgccgctacagccgctgccacaacgacaaccaccacttcagccgcaactgcaaccaccgccccaccagctctggatattttcggggacttatttgaaagcactccagaagtggccgcagctccaaagccagacgccgctccctccatcgatttatttagcactgacgcatttagttcacctccacaaggtgcctcccctgtgcctgaaagttctttgacggccgatctattatccgtggacgccttcgccgcaccctctcctgccaccacggcctctcccgctaaggtggactcaagtggcgttattgacctgttcggagacgcgttcgggtcaagcgcctctgagccccaaccggcttctcaggcggcaagcagttccagtgcttctgccgacctattggctggttttggaggatcgttcatggcaccctccccaagtcccgtgacacccgcacaaaacaatctgctccagccaaactttgaagccgcattcggcaccactcccagtacctcttcctcctccagctttgacccaagcgtgtttgacgggttgggcgacctgctgatgcccacaatggcaccggctggtcagccagcacccgtgtccatggtgcctccgtctccagcgatggctgcatccaaggccctcggatctgatttagattcaagcttggcatccctggtaggcaacctcggtataagcggaacaacaaccaagaaaggcgatctccagtggaatgccggagaaaagaaactgaccggcggtgctaactggcagccaaaagtggccccagctacttggagtgctggcgtgccgcctagcgccccactgcagggcgctgttccgccaacctcaagcgtgccacccgtggccggagctccatccgtggggcagccaggagccggttttggtatgcctcccgctggcactggcatgcccatgatgccgcaacagcctgtcatgttcgcccaaccgatgatgaggccacccttcggagccgctgccgttcccggtacgcagctcagcccatctccgactcctgcctcacagtcaccaaagaaaccaccagccaaggatcctctggcggacctgaacataaaagacttcctctag

SEQ ID NO: 54663 - DNA, 2724 bp, Artificial Sequence
  Description of Artificial Sequence: Synthetic coding sequence
atgagtggacagacccttacagaccggatcgccgctgctcagtatagcgttacaggttccgcagtcgcccgtgcagtgtgcaaagccaccacacatgaagtgatgggccctaaaaaaaaacatctggactacctgattcaggccaccaacgagaccaacgtcaacattccgcagatggcagatacattattcgagagagcaaccaacagcagctgggtggtggtatttaaggcactggtcacgacccatcacctgatggtccatggcaatgaaaggttcatccagtatttagccagtaggaacacgctgttcaatctgtccaatttcctggacaaatcgggatctcacggctacgatatgtctacattcattaggagatattcccgctaccttaacgaaaaagcattttcttatcggcagatggcatttgacttcgccagagtgaaaaaaggagccgacggggtgatgaggactatggcacctgagaagctgctaaagtccatgcctatactgcagggacagatcgacgctctcctggaatttgacgtgcaccccaacgagcttacaaacggggtcataaacgcagcattcatgctgctctttaaggacctgataaaactatttgcctgctacaacgatggggtgattaatctacttgaaaagttctttgagatgaaaaaaggtcagtgcaaagatgcgctggaaatctataagcgcttcttgacacggatgactcgggtgtctgaattccttaaggtggcagagcaggttggtatagacaagggcgacatcccagacttgactcaggcaccgtcgtcactaatggagacactggaacaacatcttaacacacttgagggtaaaaaaccgggtaacaataagatcagcggcgcaccgtcaccattgagtaagtcgagtccagcgacaactgtcactagccctaatagcactccggcaaagaccatagacacatcccccccagtagacctgttcgcaacagcttctgccgcagtgcctgtgagcacatcaaaaccttcctcagacctgttagatcttcagcctgacttcagttccggtggggctgctgctgctgcagccccagcccctccccctccagccggaggggctacagcatggggggacttgttgggagaggatagcctggccgcactttcgtcagtgccttctgaagctcaaatctcagatccatttgcccctgaacctactcctcctactacaactgctgagatcgcaaccgcaagcgcatctgctagtactactacaaccgtgactgccgtgacagcagaggtggacctgttcggagatgcatttgctgcatctccaggtgaggctccagcagcatcagaaggcgctgccgcacctgcaactccaactcctgtcgctgctgcactggatgcttgtagcggtaacgacccgttcgcacctagtgaaggcagtgcagaagccgcaccagagctcgatctgtttgccatgaagccgcctgaaacgtccgtgcccgtggtgacgcctaccgccagtacagcccctcccgtccctgccactgccccttctccggcacctgccgtggctgccgcagccgctgccactacagcagctactgccgctgccacaacaaccaccacaacctccgccgcaacagctaccacagcacctcccgcactcgacatcttcggggacctcttcgagtcaacacctgaagtcgcagcggctcccaaaccggacgcagccccttctattgatctattttccacagatgctttcagctccccaccccaaggagctagtcctgttcctgaaagtagtttgactgccgacctgctgtcggtggacgcctttgctgcgccttcaccggcaaccaccgccagtccagcaaaggtggacagttccggtgtgatagatctgttcggagatgcctttggctcctccgcttccgagccccagccggcaagccaggcagccagttcgagctctgcatccgccgatttgctggcaggcttcggcggatcgtttatggcaccgtccccctcacccgtcactccagctcagaacaatctcctccagccaaatttcgaggccgctttcggcactaccccatcaaccagctcttcaagttcattcgatccaagtgtgttcgacggactgggcgacctgctcatgcccaccatggcccctgctgggcagcctgctccggtgtcgatggtacctccatcaccggcaatggccgcatccaaggctctgggaagtgacctcgattcttcccttgctagtttggtgggaaacctagggatctcagggaccaccactaagaaaggggatctgcaatggaacgctggcgagaaaaagttgaccggcggagccaactggcaacccaaagttgctcctgcgacttggagcgccggagtgcccccatcagccccactgcagggtgctgttccaccaaccagctcggtaccgcctgtggcgggtgcaccctcagtggggcagccaggtgccggtttcggcatgcctcccgcaggaacggggatgcccatgatgccccagcaaccagtgatgttcgcccagcctatgatgcggccacctttcggcgcagcggctgtgccgggtacccagctgagcccttctcccactcctgccagccagtccccgaaaaaacctccagccaaagacccgctggctgatctcaacatcaaggattttctgtag

SEQ ID NO: 54664 - DNA, 1803 bp, Artificial Sequence
  Description of Artificial Sequence: Synthetic coding sequence
atgagcggccagaccctcacagacagaatcgctgccgctcagtatagtgtgaccggttcagccgtcgcacgggctgtctgtaaggccaccacacatgaggtgatggggccaaagaaaaaacacctggattacctaattcaggccaccaatgagacaaatgtgaatattccacagatggctgacaccttgtttgagcgggctacaaatagttcctgggtcgttgttttcaaagccctcgtaacaacgcaccacctgatggtgcatggtaatgaacgattcatccagtatctggctagccgtaacaccctgtttaatctgagcaatttcttggataagtccggctctcatggatatgatatgagcaccttcatcaggcgatactcccggtatctcaatgaaaaggccttttcttaccgccagatggcttttgattttgcacgcgtgaaaaagggcgcagatggggtgatgagaaccatggcaccggagaagctgctgaaatcaatgccaattctgcagggccaaattgacgctctgctggagtttgacgtacatccaaacgagcttacaaatggcgttatcaacgccgctttcatgctgctgtttaaagatctgattaaattgtttgcatgctataacgatggggtcatcaacctcctagagaaatttttcgaaatgaaaaaagggcagtgcaaggacgcccttgagatatataagcgttttctgactcgcatgacaagagtgtcagagttccttaaagtcgccgaggctcctagtagtttgatggagacacttgagcaacatctcaacaccctggagggaaagaaaccaggcaacaagtccggtgccccatctcccctgtccaaaagctccccagccactacagtgacctctccgaactcgacccccgctaagaccattgatacatcaccccctgtggacctctttgcgaccgcctcagccgcagtccccgtatctacgtctaagccctcaagcgatctcctagatctgcagccagatttctccagcggcggagccgcagcggcagccgctccagctcctcctcctccagccggaggggcaacagcttggggcggattcggcggtagctttatggcaccaagcccatctccggtaacaccggcacagaataacttactacaacctaacttcgaagccgcttttgggactacacccagtacttcttcaagctcaagctttgacccgagcgttttcgatgggctgggtgatctgttgatgccgacgatggcgccagctggacagccggctcctgtaagcatggtccctcctagtcctgctatggctgcatccaaagcactcgggtctgacttagatagttccctggcatccctggtggggaacctcggcatctccggcaccaccactaagaagggtgacctccaatggaatgcaggcgagaagaagctaactgggggagcaaactggcagcccaaggttgcgcctgccacatggtccgccggagttcctccgtcagcccctctgcagggtgccgtcccgcctacctctagtgtgccccctgtagccggtgccccatctgttggccagcccggagcaggctttgggatgcccccagccggaaccggaatgcctatgatgccacagcagcctgtcatgttcgctcagcctatgatgcgaccccctttcggtgctgccgcagtgcccggtactcagctttcaccctcccccacccctgctagtcaaagccctaagaagcccccagccaaggaccccctggccgacttgaacattaaagactttttatag

SEQ ID NO: 54665 - DNA, 2724 bp, Artificial Sequence
  Description of Artificial Sequence: Synthetic coding sequence
atgtctggtcaaacactcactgacagaatagccgcagcccagtattctgtcacgggcagtgcagttgcccgagctgtttgtaaagctaccacacatgaggtgatgggaccaaagaagaagcacctcgattatctgatccaggccaccaatgaaacaaacgttaacatcccgcaaatggctgatacactgtttgagcgggcaaccaactccagctgggtcgtggtattcaaggctttagtaaccacccaccatcttatggtccatggcaatgaacgcttcattcagtacctcgcctccaggaacactctattcaatctttcaaattttctggataaatcgggctcacatgggtatgacatgtctaccttcattcggaggtacagcagatacttaaatgaaaaggctttttcatacaggcaaatggcctttgactttgccagagtgaaaaaaggagcggacggtgttatgagaactatggccccagagaaactgctcaaatctatgcccatcttgcaaggacagatagacgccttactcgaattcgacgttcatcctaacgagctgaccaatggcgtaattaatgccgcttttatgctgttgtttaaagatctgattaaactttttgcatgctataatgacggggtgatcaacctgctggagaaattttttgagatgaaaaaaggacaatgtaaggacgcactggaaatctacaagaggtttctcaccaggatgacgcgggtaagcgagtttctgaaggtggccgagcaggtgggtatagacaagggcgacattccagacttgacccaggcaccctctagcctgatggaaactctggaacaacatcttaacactctggagggcaagaagcccggtaacaatgaaggatcaggcgcaccttcacccctgagcaagtctagccccgctaccaccgtgacctcccctaacagcaccccggcaaaaactatcgacacaagtcctcctgtcgatctttttgccacagcctctgcagcagtcccggtgtccacaagtaaaccatcaagcgatcttctagacctgcagccggattttagcagtggaggtgccgctgccgcagcagcaccagcgcctccgcctccagccggaggagcgacggcctggggagatctgttgggggaagattcactggcagctctctcttctgtcccaagcgaagcacagatttcagatcccttcgcgcctgaacccactccccctactactaccgccgaaattgccacagcgagcgcatctgccagcactacaactactgtgacagcagtgactgccgaagtggacctgttcggcgatgcatttgcggctagccctggcgaggccccagctgcctctgaaggcgctgccgctccagccacacccaccccagtggctgctgcactggacgcctgctcaggaaacgacccgtttgctccgagcgagggctccgccgaggccgctcccgagcttgatctatttgccatgaagcccccagagacgtcagtcccagttgttactcctaccgcatccacagctccgccagtgcccgctacagctccaagccctgctcccgctgtggcagccgctgctgctgctacaactgccgcaaccgccgcagctactaccactactactacaagtgcagccaccgcgaccacggcccctcccgctctggacattttcggagatctgttcgaatctactcccgaggtagccgctgcccctaagccagacgccgctccctccatcgacctgttctccacagacgctttcagtagtccaccacagggcgcatctcccgtgcctgaatctagccttaccgccgacctgctctccgttgacgcctttgctgctccatctccagctaccaccgcctctcccgcaaaagtggattccagcggcgtgattgatcttttcggggatgcttttgggagctctgcctctgagccccagccagcaagccaggctgcttcttctagttcagcttccgccgatttgttagccggattcggcggttctttcatggcaccgagcccatccccagtgactccggctcagaataatcttctgcagccaaactttgaagccgctttcggcaccacacccagcacgtcctcgtctagttcatttgacccatcagtattcgatgggctgggagacctcctaatgccaaccatggcccctgctggacaaccagctccagtttctatggttccaccctcccctgctatggccgcttccaaagcactcgggagcgacttagactcgagtctggctagtctggtggggaacctgggcataagtgggaccactactaagaagggagacctgcagtggaatgccggtgaaaaaaaattgaccggcggtgctaattggcagcccaaagtggctccagctacgtggagtgccggtgtgcctccaagtgcaccactgcaaggggcagtccccccaacatcctcggtcccgcctgtggccggtgctccaagcgttggtcagcccggtgcgggatttggaatgccccctgccggaactggtatgccaatgatgccccagcagccagtgatgtttgctcagcctatgatgagacccccattcggggcagcagccgtgcctggcactcagttgagcccctcccctactccagccagccagtctccaaaaaagccgcctgctaaagaccccctggccgatctcaacatcaaagatttcctatag

SEQ ID NO: 54666 - DNA, 633 bp, Artificial Sequence
  Description of Artificial Sequence: Synthetic coding sequence
atggagacacttgagcagcatttgaataccctggaagggaagaagccaggtaataagtacgcatctggcgctccttcaccactatccaaatctagccccgctacaactgtcacgtctcccaatagtaccccagccaagaccatcgacactagccctcctgtggatctgtttgcaacggcaagcgccgctgtgcctgtctcaaccagcaaaccaagctcagaccttttggacctgcagccagacttctcttccggaggagctgccgctgctgccgcaccagcgcctcccccaccggctggcggtgccactgcctggggagacttgttaggcgaagattccctagctgcactgtcttctgtcccttctgaggcccagatctcagacccctttgctccggaacccaccccaccgacaactacggccgaaatcgccacggcctccgctagcgcttctacaacaactaccgtcactgcagtgacagcagaggttgacctcttcggagggtccgcagaggccgctccagaactagacctgtttgcaatgaaaccgccagagacaagtgtcccagtggtgacccccaccgccagtacggctccgccagtaccagcgaccgctcctagcccagcgccttag

SEQ ID NO: 54667 - DNA, 456 bp, Artificial Sequence
  Description of Artificial Sequence: Synthetic coding sequence
atgagcgggcagacacttacagataggatcgctgcagcccagtacagtgtcacagggagcgccgtagctcgggcagtatgcaaagctactactcatgaagtgatgggaccaaagaagaaacacttggattatcttatacaagccacgaatgagacaaacgtgaacatcccccagatggccgatactttatttgagcgtgcgactaactctagctgggttgtggtcttcaaagctctcgtcaccactcatcatctgatggttcacggaaatgagcgatttattcagtacctcgctagtcgcaacaccctattcaacctttccaatttccttgataagtccggaagccatggctacgatatgtccactttcatcaggcggtactccagatatctaaatgagaaggctttctcatatcggcaaatggcgtttgatttcgcacgcgtgaagaaggggtag

SEQ ID NO: 54668 - DNA, 459 bp, Artificial Sequence
  Description of Artificial Sequence: Synthetic coding sequence
atgagcggccagacattaacagaccggattgccgcagcacaatattctgtcacgggttctgctgtggcccgtgcggtctgtaaagccaccacccacgaagttatggggccaaagaagaagcatctggactatctcatacaggcgactaacgaaactaatgtgaacattccgcagatggccgacactctcttcgagcgcgcaactaactccagttgggttgttgttttcaaggccctcgtgactacacatcatttaatggttcatgggaatgaacggttcatccaatacctggcaagccgtaatacccttttcaacctttctaactttcttgacaagagcggctcccatggatatgacatgtctacctttatcaggcggtacagccgctacctgaacgagaaagcctttagttatagacagatggccttcgattttgccagggtcaagaagggcgcttag

SEQ ID NO: 54669 - DNA, 201 bp, Artificial Sequence
  Description of Artificial Sequence: Synthetic coding sequence
atgagcggccagaccttgactgatcgaatcgctgccgctcagtactctgtgacagggagtgccgtcgctcgggctgtttgcaaggccactactcacgaggtgatggggccaaaaaagaagcacttggattatctaattcaggccacaaatgagacaaacgttaacataccccagatggctgatacattgttcgagagatag

SEQ ID NO: 54670 - DNA, 1803 bp, Artificial Sequence
  Description of Artificial Sequence: Synthetic coding sequence
atgagtggccagactctgaccgatcggatcgccgcagcacagtatagcgtaaccggttcagcggtggcgagggctgtgtgcaaggccacgacccatgaggtgatgggaccaaagaaaaagcatctagactatctgatccaggccaccaacgagactaacgtcaatatcccacagatggccgacacgctgtttgagcgagctaccaatagcagctgggtggtcgtatttaaggccctggtgaccacacaccatctcatggtgcatggaaacgagcggtttattcagtacctggcatcaagaaatacactcttcaacctcagcaattttctggacaaatccggaagccacggctacgacatgagcacctttatcaggaggtacagccggtacctgaatgaaaaagcattctcttaccgtcagatggcctttgacttcgcaagggtgaagaagggcgcagatggcgtgatgcgcaccatggcacccgaaaaactcctgaagagtatgccgatcctgcagggtcaaatcgatgctttgctggaattcgacgttcaccctaacgagctgactaatggagttattaacgccgctttcatgcttctgtttaaagatctcattaaactgttcgcctgttataacgacggtgtcataaatttgctcgaaaaattttttgaaatgaaaaaaggtcaatgcaaggatgcccttgagatctacaaacggtttctcacccggatgacccgggtctccgaattcttaaaagtggctgaagctccatcctcgctgatggagactctggaacaacacctcaatactctggagggaaagaagcctggtaacaagagcggggcacctagtccattatccaagtcttcacccgcaactactgtgaccagtcctaacagcacccccgcaaagaccatcgacacatccccaccagtcgacctgtttgccactgctagtgccgctgtgccagtgtccactagtaagccaagtagcgacctcctggacctacagcccgatttcagctccggcggagcagctgctgccgcagcccctgctcccccaccaccagcgggtggggcaaccgcttgggggggatttgggggatcctttatggccccttctccttctcctgtgacacctgcacaaaataaccttctgcagcccaacttcgaggcagcgtttggcaccacaccctcaacgtccagttctagctccttcgacccgagtgtgttcgatgggctcggcgacctcctgatgcctactatggcgccagctgggcagcctgcgcctgtttccatggtcccacccagtcccgctatggccgcttctaaagcattggggtctgatctggatagctccctggcttctctggtaggcaacttggggatctcgggaactaccacaaagaagggcgacctgcagtggaatgctggcgaaaaaaagctcacagggggtgcgaactggcagcccaaggtcgccccagccacatggtccgcaggcgtcccaccatctgccccactgcagggcgcagttccccctacttcttcggtgcccccagttgcaggtgcaccaagcgttggtcagcctggggctggttttggaatgcccccagctgggactggcatgcccatgatgccacaacaacccgtaatgtttgcccagccaatgatgcgcccacccttcggggcagccgcagtgcctggaactcaactgagcccctcccccacaccagccagtcaatcgccaaaaaaaccccctgctaaggaccctctggcagaccttaacattaaggactttctgtag

SEQ ID NO: 54671 - DNA, 2709 bp, Artificial Sequence
  Description of Artificial Sequence: Synthetic coding sequence
atgagtggtcagaccctgactgatcggatcgccgctgcacagtatagcgtcacgggatcagccgttgctcgggcagtgtgcaaggccactacccacgaggtgatggggccaaaaaaaaagcatcttgactacttaatccaggccaccaatgagacgaacgtgaacataccccagatggccgataccctgtttgagcgtgcaaccaactcctcttgggtggtagtgtttaaagctctggtcaccacgcatcacttaatggttcacggcaatgagagattcatccagtacctggccagtcgcaatacgctcttcaatttgtccaatttcctcgacaagtccggatcgcacggctatgacatgagcacattcattcgacggtattctagatatctaaacgaaaaagcgttttcctaccggcagatggcctttgatttcgcgcgagttaaaaaaggcgctgacggcgtgatgcgtaccatggctcccgagaaactattgaagagcatgccaatccttcagggtcagatcgacgcccttctcgagtttgatgtccatccaaacgagttaacaaacggtgtgatcaacgccgcattcatgctcctttttaaggatctgattaagttgttcgcctgctacaacgatggagtaataaatctcctcgaaaaattttttgaaatgaaaaaagggcagtgcaaagacgcactggaaatctacaaacggttcttaacgagaatgactcgagtttcagagttcctgaaagttgccgagcaggtaggaatcgacaaaggggacatccccgacctcactcaggctccttcatctctgatggagactttggaacagcatcttaacactttggagggaaagaagcctggtaataacgagggttctggggctcctagccctctgtccaagagcagccctgctaccacagtaacgagccctaactccacacccgcaaaaacgattgatacgtcacccccagtggacctgtttgcaactgccagcgccgctgtcccagtaagcactagtaagccgagtagtgacttgctggacctgcagcccgatttctcgtctggcggagcagccgctgccgctgctcctgcccctcccccacccgctggtggtgccacagcttggggcgacttactgggcgaagacagtctggcagccctgtcaagcgtgccgagcgaagctcagatttctgacccattcgccccagagcctacccccccaactaccaccgctgaaattgccacggcttccgcctctgcttccacgaccacaacagtgacagccgtgactgcagaggtcgatctttttggcgatgctttcgcagcttctcccggagaggcaccggctgcatccgaaggggcagccgctccagccactcccactccagtggctgctgccctcgatgcatgttctgggaacgatccgtttgctccatccgaaggctcagccgaggccgcacccgaactggacctttttgcgatgaagccgcctgaaactagtgtcccggtggtcactccaaccgcaagcaccgctccacctgttcccgctaccgctccctcacccgctccagccgttgccgcagcagccgcagctaccacagcagccacagctgcagcgaccactaccacaacaacgtccgccgcaacagccaccaccgccccacctgctctagacatctttggtgacctgttcgagtctactccggaagtcgccgcagcgcctaaacccgatgctgcaccttccatcgaccttttctccaccgacgcattttcgtcaccgccacagggtgctagcccagtgccagaatcctcactgaccgcagatttgctgagcgtcgatgcattcgcagccccaagcccagccaccactgcctctcctgccaaggttgattcctccggagttatagacttattcggagacgccttcgggtcaagcgccagcgaacctcagccagcctcccaggccgcaagtagctcaagcgcctctgctgatttgttagccggatttggcggttcttttatggccccaagcccatcaccggtgactcctgcccaaaataacctgctgcagcctaatttcgaggctgccttcggaaccacgcctagcacttctagttcatcctccttcgatccaagcggcgacctgctgatgcccactatggcaccagccggacagccagcccctgtgagcatggtacctccatcgcccgctatggccgcttccaaggccttgggatctgatctggacagtagcctggcctcgctagtggggaatctaggcattagtgggacaaccacaaagaagggcgatctccagtggaacgcaggggaaaagaagcttactggcggagcgaattggcagcccaaagtagctccggctacctggagcgccggtgttcccccatctgctcccctgcagggcgctgtcccaccgacctctagtgtcccccctgtagctggggcacctagcgtcggccagcctggcgctggcttcggaatgccacccgctgggacaggaatgcctatgatgccacagcagcccgtgatgtttgcacaaccaatgatgcgaccaccttttggcgcagctgccgtgccaggcacacagctaagtccgagccctactccagcttctcagtcacccaagaagcctcccgcaaaggatccacttgcggatctgaacattaaggacttcctctag

SEQ ID NO: 54672 - DNA, 2724 bp, Artificial Sequence
  Description of Artificial Sequence: Synthetic coding sequence
atgagcggtcaaactctgacagatcgtattgccgctgcacagtattccgtcacaggatcggccgtcgctagggctgtgtgtaaggctacaacacacgaagtcatgggtccaaagaagaaacacctggactacttgatccaggctacaaatgaaacaaacgtgaatattccccagatggctgacactctgtttgagagagcaactaattcctcatgggtcgtggtttttaaggcattggtgaccacccatcacttgatggtccatggaaacgagagattcatccaatatttagcatcacgcaacacactgtttaatctgtctaatttcctggataagtccggctcccacggctacgacatgtccacatttataagaaggtatagccgctacctgaacgagaaagccttttcctacagacaaatggccttcgacttcgctcgggttaaaaaaggagctgatggtgtgatgaggaccatggccccagaaaaacttctgaagtctatgcccatccttcagggacaaattgacgctttgctggaattcgacgtgcacccgaacgagctgaccaacggcgtgatcaatgccgctttcatgctattgttcaaggatctcattaaactctttgcctgttataatgatggcgtgataaacctcctggaaaaattctttgagatgaagaagggccagtgcaaagacgctctcgaaatttacaaaaggtttctgacgaggatgacgcgtgtatccgagtttcttaaggtagctgagcaggtgggcatcgacaagggagacataccggaccttacccaagcaccctcaagcctcatggaaacactggagcagcacctcaacaccctggaaggaaaaaaaccaggcaataacgaaggaagcggcgcaccttctcctctaagtaagtccagtcctgctaccacagtgacctcacccaatagcacacctgcaaagaccattgatacctcacctccagttgatctgtttgcgacagccagcgcagccgtgcctgtgtccaccagcaagcctagctcggacctgctcgatctccagcccgacttcagctcaggcggagctgctgcagccgctgcacccgcacctccacctccagcaggcggtgctacggcatggggagacctcctgggggaggacagtctcgccgctctatcttctgtgccctccgaggctcagattagcgatccgtttgcacccgagcccacacccccaactactacagctgagatagcaaccgcttctgcttctgctagtaccactactacagttacagcggtgacggccgaggtcgacctatttggcgatgcctttgccgctagccctggagaagcgcctgctgccagtgaaggcgcagccgctccggctacaccaaccccagtggcagcagctctggacgcttgttctggaaacgacccctttgcaccctcggaggggtccgcggaggctgcaccagagcttgacctgttcgccatgaaaccacctgagactagcgttcccgtcgtgactccaacagcgtccacagcgccaccagtacctgcaacagccccatctccagctcctgccgtggctgccgctgcggctgccaccaccgcagctactgccgcagcgacgaccacaactaccaccagcgccgcaacggccacaaccgcgccaccagccctggatatttttggcgatttatttgaaagtaccccagaggtggctgcagctcccaaacccgacgccgctccctcaattgatttgttctctaccgacgcattttcatcacctccacagggggcatcaccagtgcctgaatcttcccttacagctgatttactctcagtcgacgctttcgccgcaccctcccccgctacaactgcttcccctgccaaggtcgactcaagcggggtcattgatctgttcggtgatgcttttggttcatccgcgagtgagccacaaccagcttcccaggcggctagttcctcatcagcaagcgctgacctgctagccggtttcggcggatctttcatggcacccagcccctcccccgtgacacccgcacagaacaacctgctgcagcccaatttcgaagccgcattcgggaccacaccgtctacttcttcatcctcatctttcgacccgagcgtattcgatggcctgggagaccttctgatgcctaccatggctccagccggtcagccagcacccgtttcaatggttccaccttcgccagctatggctgcttcgaaagcccttggtagcgacttagattcttcactggcctctctcgtgggcaacttgggcatctctggaacgacaacaaaaaaaggggatctccagtggaatgccggtgaaaagaagttaacagggggagcaaactggcagccgaaggtggccccagccacttggtctgccggtgtaccccctagcgcccctctgcagggagccgtgcccccaacttcatctgtcccccctgtggccggagccccttctgtaggccagccgggtgccggatttgggatgcctcccgcaggcacaggaatgccaatgatgcctcagcaacctgtcatgttcgcgcagcccatgatgcgaccaccattcggcgctgcagcagtgcccggaacccagctcagtcctagccctacaccagcgtcacaaagccctaaaaagccccctgcaaaagatcccctagctgacctgaatatcaaggattttctgtag

SEQ ID NO: 54673 - DNA, 354 bp, Artificial Sequence
  Description of Artificial Sequence: Synthetic coding sequence
atgagtggacagacccttacggatcgcatcgccgctgcccagtactccgtaacagggtctgctgttgcccgtgccgtctgtaaggccactacccatgaggtaatgggacctaagaaaaagcatttggactacttaatccaagctacgaacgagacaaacgtcaacatcccccagatggcagataccctgtttgaacgggctacgaacagctcatgggtggttgtattcaaagctctcgtgaccactcaccacctgatggttcacggcaacgagcgatttatacagtacttggcatcacgcaacactctatttaacctcagtaacttcctagacaaatccggttctcacggctag

SEQ ID NO: 54674 - DNA, 1689 bp, Artificial Sequence
  Description of Artificial Sequence: Synthetic coding sequence
atggcaaccgagcatgtcaacgggaatggcacggaggagccaatggatacaacatccgccgtgattcattctgaaaacttccagaccctgctggacgctggtttgccacagaaggtcgcagagaagctcgacgaaatctacgtagcagggcttgtagcgcatagtgatctagacgagcgggcaatcgaggccttgaaagaatttaacgaggatggcgcactggccgtccttcagcagttcaaggacagcgatttgtcccatgtgcagaacaagtctgcttttctttgcggcgtaatgaagacctataggcagcgagaaaagcagggtacaaaggtggcagactcttctaaaggccctgacgaagcaaagattaaggccctcctggagaggaccggttacactttggacgtgaccaccggccagcgcaaatatggcggacctcctccagatagtgtttattcaggacagcagccttccgtgggaacagagatctttgtagggaaaatcccgcgtgatcttttcgaggacgagctggtgcccttatttgagaaagctggaccaatctgggacctcagattgatgatggatccccttacagggctaaacagaggatacgccttcgttacgttctgcacgaaggaagcggcacaagaggctgtaaaactgtataacaatcacgagattcgttccgggaagcacatcggcgtgtgtatcagcgtcgcgaataatagattgtttgtggggtccatcccaaagtccaagactaaagaacaaattctggaggaattctctaaagtcacagagggtttgacagacgtcatcctctatcaccaacctgacgacaagaagaaaaacagggggttttgcttcctcgaatatgaggatcacaaaacagccgcacaagcacgccgacgcctcatgtcaggcaaagtcaaggtctggggcaatgtgggcacagtggaatgggctgatccaatagaagatccagaccccgaggtaatggccaaggtgaaggttctgtttgtgagaaatctggcgaatacagtcactgaagaaatactcgaaaaggcttttagccagttcgggaaattagagcgagtgaagaagcttaaggattacgcgttcatccacttcgatgaacgggatggcgcagtgaaggccatggaggagatgaatgggaaggacttggagggcgaaaatatcgagattgtcttcgccaaacctcctgaccaaaagcgcaaagagcgcaaggcacagcgacaggcagctaagaatcagatgtacgatgactattattattacggccctccacatatgccgcctccaaccaggggcagaggcaggggaggtaggggcggttacggctacccgcctgattactacggatacgaagactactacgactactatgggtacgattaccacaactaccgaggcggatacgaggacccttactatggctatgaagatttccaggtcggcgcacgcggacgagggggaaggggcgctagaggagcagccccatccagaggccgaggggcagccccacctagggggagggccggatactctcaacggggtgggccaggaagcgctcgtggagtccgtggcgcacgtggtggggctcagcagcagcgaggcaggggtcaggggaagggggtggaagctgggccagacctgctccagtag

SEQ ID NO: 54675 - DNA, 1872 bp, Artificial Sequence
  Description of Artificial Sequence: Synthetic coding sequence
atggcgactgagcatgttaacggaaatggtactgaagaacctatggatactacatccgccgtgatccacagtgagaatttccaaacactgcttgatgctggtttaccccaaaaggtcgcggaaaagctggatgaaatctacgtcgccggtcttgtggcccacagcgacctggatgaaagggcgatcgaggccttaaaggagtttaatgaggacggcgctctcgcagtgttgcagcaattcaaagatagtgatttgagtcatgtgcagaataagtcagcattcttgtgcggggttatgaagacctatcgacagcgggagaagcaggggacaaaggttgctgatagctcgaaggggcctgatgaggccaaaatcaaagcacttcttgaacgaaccggatataccctggatgtaactaccggacagagaaagtacggtgggcctcctccagatagcgtttatagcggtcagcaaccctctgtaggaaccgaaatttttgtgggaaaaatcccccgagatctttttgaagacgagctggtaccgttattcgagaaagcaggacctatttgggacctgaggttgatgatggatccactcactggattgaaccgcggttatgctttcgttacattttgtaccaaagaagcagcccaggaggcagtgaaactgtataataatcacgaaattagatccggtaaacacataggtgtctgtatctccgtggctaataacaggctgtttgtgggttccattcccaagagcaagaccaaggagcagattctcgaagagttcagcaaggtcactgaaggactaaccgacgttatcctctaccaccagcctgatgataaaaagaagaataggggattctgttttctggaatacgaggatcacaaaacagcagctcaagcgaggagaagattaatgtctggcaaagttaaagtgtggggcaacgtggggactgtggagtgggcagatcctatcgaggatcccgaccctgaggtgatggctaaagtgaaggtgctgttcgtacgtaatctggccaatactgtcaccgaagaaatcctggaaaaagctttcagccagtttggaaaactcgaaagggttaagaagctgaaagattatgcctttatccatttcgatgaacgtgacggagcagtgaaagctatggaggaaatgaacggtaaggacttagaaggtgaaaatattgaaatagtgttcgcaaaacccccagaccagaagcggaaggagaggaaagctcagcgccaggccgctaagaatcaaatgtatgatgactattactactacggacctcctcacatgccgccacccactcgcggacgaggcaggggcggtaggggtggatatggttaccctccagactactatggctacgaggattactacgattattatggctacgattaccacaactatcggggtgggtatgaagacccctattatggctatgaggatttccaggtcggtgcacgcggaagggggggtcgaggagctcgtggggctgctccctcacgtggaagaggggcagctccccctcggggacgtgctggctactcccaacgcggtggtcctggcagtgcgagaggcgtccggggtgcaagaggaggcgcacagcagcagcggggtcgcggagtgcggggagccagggggggtagggggggtaatgtcggtggcaaacgcaaagccgacggctacaatcagccagactccaagcgccgacagactaataaccagaactggggaagtcaacctatcgcacagcagccgctgcagggaggggaccatagcggaaattacggatataagagtgaaaaccaggaattctatcaggatacatttgggcagcagtggaagtag

SEQ ID NO: 54676 - DNA, 558 bp, Artificial Sequence
  Description of Artificial Sequence: Synthetic coding sequence
atggcaacagaacacgtgaacgggaacggtacagaggaacctatggataccactagtgccgtgattcacagcgaaaattttcagacgctcttagacgccggactccctcaaaaagtagcggaaaagctggacgagatctatgtggccggtctagtggcacactcagatttagatgagcgggctatagaggcactcaaagagttcaacgaagacggggcactggctgtgctgcaacaattcaaggactcagacctgagccacgtgcagaataagtccgcgttcctgtgtggagtgatgaagacgtatagacaacgagagaaacagggaacaaaagtggccgattcctcaaagggtcccgacgaagcaaagattaaagcactgctcgaaagaacaggttataccttggacgtgacaactggtcagcgtaagtacggcggaccacctcctgactctgtgtactcagggcagcagccctccgttggcactgaaatttttgtgggcaaaatcccaagggatctgttcgaggacgagctggtccctttatttgaaaaggcgtag

SEQ ID NO: 54677 - DNA, 1260 bp, Artificial Sequence
  Description of Artificial Sequence: Synthetic coding sequence
atgagaaacatctttaagcgcaatcaggagccaatcgtggcccctgccacgaccaccgcaacaatgccgataggtcctgtcgacaatagcacggagtcaggcggagctggagagagtcaggaggatatgttcgccaaactgaaagaaaagctgttcaatgaaattaataaaattccccttccgccatgggccctgatcgcgattgccgttgttgccggacttctgctcctgacgtgttgcttctgcatctgtaagaagtgttgctgtaagaagaagaaaaataaaaaagaaaagggcaaggggatgaagaacgccatgaacatgaaggacatgaaaggaggccaggatgatgatgatgctgaaacaggactgacagaaggtgaaggcgaaggggaagaggagaaggagcctgaaaacctcggaaagcttcagttctctttggattacgattttcaggctaaccagcttactgtgggcgttctacaggcagctgaactacctgctctggatatgggcggaacatcagacccctatgtgaaggtctttttgctcccagacaaaaagaagaaatatgagacaaaggtccaccgcaaaacgctcaatcctgccttcaatgagacttttacttttaaagtgccttaccaggagttggggggaaagaccttggttatggccatttatgacttcgataggttctctaagcacgacattatcggcgaagttaaagtccctatgaatacagtagatcttggccagcccatcgaggagtggcgcgacttgcaagggggtgaaaaggaagaacccgaaaaactaggggatatctgcacatccttgcggtacgtacctaccgcagggaagctgactgtgtgcattttggaagcaaagaacctgaaaaaaatggatgttggcggtctatccgacccctacgtaaagatacatctcatgcaaaatggaaaaagactgaaaaagaaaaaaaccacagtgaaaaaaaaaactctgaacccatattttaacgagagcttcagctttgagatcccttttgagcagatacaaaaggtgcaagtggtcgtaacagtgttggactacgacaaactcgggaagaatgaggcgattggaaagatcttcgtgggcagtaatgctacggggactgaattgcggcattggagtgacatgttggcgaatcccaggaggccgatcgcccagtggcatagcctgaagccggaagaggaagttgatgctttgcttggtaagaataagtag

SEQ ID NO: 54678 - DNA, 1260 bp, Artificial Sequence
  Description of Artificial Sequence: Synthetic coding sequence
atgcggaatatctttaaaaggaaccaagagcccatagtagcccctgcgaccacgacagctacaatgcctatcgggcctgtggacaattccaccgaatccggtggggctggggaaagtcaagaagatatgttcgcaaaactgaaggagaagctttttaatgagatcaacaagatccccctaccgccatgggcactgatagcaatagcagtggtagccggacttctcctccttacttgttgcttctgtatttgcaaaaagtgttgctgtaagaaaaagaaaaataaaaaagaaaagggcaaggggatgaagaacgccatgaacatgaaggacatgaaaggagggcaggacgacgacgatgctgagactggcctaaccgaaggggaaggcgagggcgaggaagagaaggagcccgaaaatctgggcaagctgcaattttcattggactacgatttccaagccaatcaacttacagtgggcgtgttacaagcagcagaactcccagctcttgatatgggagggacttccgatccatacgtgaaagtcttcctgctgcctgacaagaagaaaaaatatgaaactaaagtccacagaaagacgttaaaccctgccttcaacgagacgttcacctttaaagtaccttatcaggagctcggcggaaaaacattagtgatggcaatttatgattttgaccgattctcgaaacacgacattataggagaggtcaaggttcccatgaataccgtagatctcggccagcccatcgaggagtggagagatctgcagggaggcgaaaaagaagagcctgagaagctcggggacatatgcactagcctgaggtatgtaccgactgcaggaaagctgacagtatgcatcttagaagcaaagaatttgaagaaaatggacgtgggcggattgtctgacccgtatgtgaagatccatctgatgcagaacggaaagcgattgaagaaaaaaaaaactaccgtgaagaagaagactctgaatccatacttcaatgagagttttagctttgagatcccctttgaacagattcagaaagtgcaagtggtggtgacagtactggattatgacaagttgggaaagaatgaagccattgggaaaatcttcgttggtagcaatgccaccggaactgagttgaggcattggtctgacatgctggcaaacccacggcgaccgatcgcacagtggcattccttaaagcccgaagaagaggtcgacgccctgctgggaaaaaataagtag

SEQ ID NO: 54679 - DNA, 1206 bp, Artificial Sequence
  Description of Artificial Sequence: Synthetic coding sequence
atgctccatctccacgggtggcagaccatgcagggacgaaagatgggccatcccccagtgtcaccctccgctccggctcctgcagggaccaccgcaatccccggactgattccggacttagtagctggcactccttggcccagatgggcccttattgccggtgctctagccgctggggtgcttctggtgtcatgtctgctgtgcgcagcgtgctgttgctgtagaaggcacagaaagaagccacgtgataaggaaagtgtcgggctaggttcagctagaggtacgacaactacccatctggtgcagcctgacgtcgatggcctggagtcctccccaggagatgcccagcagtgggggtgcctccagctcagtctcgagtttgacttcgggtcccaggagatacgggtggggctgcgtcaggcagcagacctgcggccaggtggtactgtggatccatacgccagggtctccgtttccacacaggccggacatcgccacgaaaccaaggtgcatcgtggcactttgtgcccagtatttgatgagacctgttgctttcacattccacaagctgaactgcccggtgccacactgcaggtgcagctgtttaatttcaaacgattctcaggacacgaaccccttggtgagttgcgactgccccttgggaccgtggacttgcaacacgttcttgaacattggtacttgctcggccctcccgcagccacacagccagagcaggtgggcgagctctgcttcagtctgcggtatgttcctagctccgggagacttacagtagtcgtgctcgaggccagaggactaaggccaggcctggcggagccatacgtcaaagtgcagcttatgttgaatcagcgcaaatggaaaaagaggaagaccgccaccaagaagggcacagccgctccctacttcaacgaagcctttacgtttctggtaccttttagtcaagttcaaaacgtggacttagtcctcgcagtgtgggacaggtcgctgcctcttcggaccgagcccgtgggcaaggtgcatttgggagcaagggccagtgggcagcccctccagcattgggctgatatgctcgctcacgccaggcggcctatcgcccaaagacatcctctgaggccagcgagggaggtggacaggatgctggccctccagccacggctgagattaagactccccctgcctcattcttag

SEQ ID NO: 54680 - DNA, 477 bp, Artificial Sequence
  Description of Artificial Sequence: Synthetic coding sequence
atgggccaccccccagttagtccaagtgccccagcaccggctggtaccacggcaatccctggattaatcccagatctggtcgccggaacaccatggccccgatgggctctgattgccggagctctagccgcaggagtgctactggtaagctgcctcctgtgcgcagcgtgctgctgttgtagaagacatcgaaaaaaacccagggacaaagaatctgtgggtttgggaagcgccagaggcacgaccacaactcacttagtgcagccagacgtagatggcctggaatcatcccctggcgacgcacagcaatggggttgtctgcagctgagtctggaatttgatttcgggagccaggaggtgaaaggcccagcagcacaggaccagagattctgcgaatttcccgagcgagtgactggcgagggccagaccccctgtccaggatggtggggcgctgatagagccggagctctcgggtag

SEQ ID NO: 54681 - DNA, 933 bp, Artificial Sequence
  Description of Artificial Sequence: Synthetic coding sequence
atgcctagctccaagcccggttccccagctccccaagaccccagtccatcttgtagaacgtgctctaaccaggtgcaaccaggccatctcctcttaccactaacaaaggcatccctgaccggaccgagtccccctcctgccaagcttggccgtgcccagggcgcaccctcaccaaaggggccactggagattggttggtctcctgatgctcaacccttgcgcctcggagaaacctttctaccaaaaggcgtagcccagttaagtagagcctcttccagcggccataaagtcggtttccttcaaccatggcctcctcatcccctacttccccaggaaagggtccccagacaccaacggcagtgttgcccacgcgcagggccagccttcggctgtctccggggtcggccaggaggctggcccgcaaccgggtcaggcggacggcaacagggaaggaagatggggcaccccccagtctccccttcggcacctgcgcctgcaggcactactgccatccctgggctcataccagacttggtcgccggaaccccctggccgcgttgggccctgatcgcaggagcgctggctgccggagtacttctcgtgtcttgcctgttgtgcgccgcatgttgttgttgtcggagacatcggaagaagccccgagacaaagaatcggtgggtcttgggtccgctagaggaactactacgacccacctggtgcagcctgatgtggatgggttggaatcctctcctggtgacgcccaacaatggggatgcctgcaactcagcctggaatttgacttcggctctcaggaagtcaaaggcccagcagcccaggatcagagattctgcgaatttcccgagcgagttactggggaggggcagaccccttgccctggctggtggggcgctgacagagccggagctctgggatag

SEQ ID NO: 54682 - DNA, 570 bp, Artificial Sequence
  Description of Artificial Sequence: Synthetic coding sequence
atgcttggctctagggcagtgatgctattacttctgttgccttggacggcacaagggcgagccgttcccggagggagcagcccagcctggacccagtgccagcagctcagccaaaaactttgtaccttagcctggtccgctcatcccctggtggggcacatggacctcagagaggagggcgatgaagagactaccaatgatgttccccatatccaatgcggcgacggttgcgatcctcaagggctgcgggacaattcccaattctgcctacagcggattcatcagggtcttatcttctacgaaaagctgctgggaagcgacatcttcaccggcgagccctctcttctgccggactctccagtcgggcagcttcacgcttcattgctggggctcagtcaactgctacagcccgaaggccatcattgggagacccagcagatcccctccctctcaccatctcaaccatggcagcggctcctgttgcgcttcaaaatcctcagatctctgcaggccttcgtcgccgtggcagcacgagtcttcgcccacggggctgctaccctctcgccttag

SEQ ID NO: 54683 - DNA, 1029 bp, Artificial Sequence
  Description of Artificial Sequence: Synthetic coding sequence
atgcaggtgagctccgttgatttctctatgggcaccgagccggtgctgcagcgcggtgagacgaccacttcaataggccgaataaagcctgaattgtacaagcagaagagcgttgacagcgagggcaatcagaacgaggacgtgaagatttgtggaaagttgaatttcacattgcagtacgattatgagaacgaactgctggtggtgaagattatcaaggctctcgatctgccagctaaggatttcacggggacctcggatccctacgtgaaaatgtatttgcttcctgaccggaaaaagaaatttcagaccagggtccatagaaagaccttaaatccgctatttgacgaaacattccaatttccagtcgcttacgaccagctatctaacaggaagctgcactttagtgtgtacgattttgaccggttctctcgtcacgacatgatcggcgaagtgatcttggacaacctttttgaagtgtcagacctatcccgtgaggctactgtgtggaaagatatccattgcgccaccaccgagtctattgatctgggtgagatcatgtttagcttgtgttacttgccaactgcgggaagaatgaccctgactgttatcaagtgtaggaacctgaaagccatggacattacaggctcttctgacccttatgtgaaagtgtcgctcatgtgcgaaggccgtcgccttaaaaagcgcaaaacaactacaaaaaagaacacactgaatccagtatacaatgaagcaatcatcttcgacatcccacctgagaatgttgatcaagtgtctctgtcaatcgcagtgatggattatgaccgggtgggtcacaatgaggtaattggagtgtgtcgcacaggtctggacgctgagggtctggggagagatcactggaatgagatgctagcctatcacagaaagcccatcactcattggcaccccctacttgagctgcccggacgggcaacgtcctttgactcccagggttcatgcccctcgccaaagcctccttctaccccctag

SEQ ID NO: 54684 - DNA, 1296 bp, Artificial Sequence
  Description of Artificial Sequence: Synthetic coding sequence
atggccgaaattacaaatatccggccatctttcgacgttagcccagtggtggctggtcttatcggcgcttccgtattagtggtgtgcgtctccgttacggtgtttgtgtggagctgttgccatcaacaagccgaaaagaaacagaaaaaccccccttataagtttattcacatgttaaagggcatcagcatttaccctgagacactgtccaacaagaagaagattatcaaagtgcgccgagataaagacggtccaggccgagaaggcggtcggaggaatttactggtagatgctgccgaggccggattattgtcacgagataaagaccccagagggccttcttcaggctcttgcatcgatcagctacccattaagatggactacggtgaagagctccgcagccctatcaccagcctgacccccggagaatctaagaccacctccccttctagccccgaggaagacgtgatgttaggaagcctgacattttcagtcgattacaacttccctaagaaagcgttagtggtaacaatccaagaggcacacggcctccctgtgatggatgatcagacacaaggatccgacccctatattaagatgacgatcctgcctgacaaacggcacagggttaaaacacgagttctgcgaaaaaccctggatccagtctttgacgaaaccttcacattttatgggataccctacagccaattacaagacctggtgttgcacttccttgtcctgagctttgaccgtttcagccgcgatgacgtgataggcgaagtgatggtgcccctggctggggtcgatccctcaacgggcaaggttcaactgacgcgggatattattaagcggaacattcagaaatgtatttccaggggcgaacttcaggtcagtctttcctatcagcccgtggcacagaggatgacagtcgtggtgctgaaggccaggcatctgcccaagatggatattacaggtctgagcgggaatccctatgtcaaagtgaatgtgtactatgggagaaagcggatagctaagaagaaaacccacgtgaaaaaatgcacccttaatcccatctttaacgagagtttcatttacgatatccctactgatcttctgccagatataagcattgagttcctggtcattgattttgaccggaccacgaagaatgaggtggtcgggcgattgattcttggagctcactcagtgacagcctccggggcagagcactggagggaggtctgcgagtcccctcggaaaccagtagccaagtggcactccctgagtgagtactag

SEQ ID NO: 54685 - DNA, 375 bp, Artificial Sequence
  Description of Artificial Sequence: Synthetic coding sequence
atgactgtagtagtgctgaaggccagacatctgcctaaaatggatatcacaggtcttagcggcaatccgtacgttaaggtgaatgtctactatgggagaaagcgcattgcgaaaaagaagactcatgtgaaaaaatgcacattgaaccccatcttcaatgaatcattcatatatgatataccaactgacctcctcccagacatcagtatcgaattcctcgtgattgacttcgaccgaacaacaaagaacgaggtggtaggacgactgatcctcggcgcacactcagtgaccgccagtggtgctgagcactggagagaagtttgtgagtccccgaggaagcccgtcgccaaatggcactcactttctgagtattag

SEQ ID NO: 54686 - DNA, 1425 bp, Artificial Sequence
  Description of Artificial Sequence: Synthetic coding sequence
atggcatatatacagctagagccgctgaatgagggcttcttgtctaggatatcagggttgctgctgtgcaggtggacttgcagacattgctgtcagaaatgttacgagtcaagttgctgccagtcctccgaagatgaagtggagattcttggcccttttccagcccagacccctccttggcttatggcgagcagaagctctgacaaagatggcgatagcgtgcataccgcttccgaagtgcccttgacccccaggaccaacagtccagatggcaggagatcctcctccgatacctcaaaaagcacttattctctcacccgccgaattagtagtcttgagtctcggagaccgtcgtcccccctgatcgatattaagcctattgaatttggagtcctgtctgccaagaaagaacccatacaaccttctgtacttagaagaacatataatccagatgattattttagaaaatttgaaccacacctgtactctctggactccaacagcgatgatgtggactccctgacggacgaggaaatcctgtccaaatatcagttaggcatgttgcatttttcaacgcaatacgacctgctgcacaaccatctgaccgtccgggtgatcgaggccagggacctacccccacctatatcgcatgacgggtccaggcaagatatggctcactccaacccatatgttaaaatttgcctgctccctgatcagaagaactcaaagcagaccggtgtaaagcggaaaactcagaaaccagtgttcgaggaaagatatacattcgaaatccctttcctcgaagcgcagcgcaggacattgctgcttactgttgtggatttcgacaaattttcacgccattgtgtgatcggtaaggtgagcgtgccgttgtgcgaggtggacctggtgaaaggaggacattggtggaaggctcttatccccagttctcagaatgaagttgagctcggtgagctcctgctcagtctcaactacctaccctccgcgggacggctcaacgtggacgtgatccgagctaaacagctgctgcagactgatgtcagtcagggatcagatcccttcgtcaaaatccagctcgtgcacggactcaagctggtcaagaccaaaaaaacgtcctttctgagagggacaatagacccattttacaatgaaagcttctcttttaaggtcccgcaagaggagctcgagaatgcatccctggttttcacagtgttcggtcacaatatgaaaagcagcaatgactttattgggcgaatcgtaattggccagtactcttctgggccttccgagacaaatcactggaggcggatgctgaacacccacaggacggcggtggagcagtggcacagcttacgatcccgcgctgaatgcgaccgagtgtctccggcaagcctcgaggttacatag

SEQ ID NO: 54687 - DNA, 1431 bp, Artificial Sequence
  Description of Artificial Sequence: Synthetic coding sequence
atggcttcccctgagccgaggagggggggtgacggcgctgcccaggccgcaaggaagacaagggtggaagctaattccccactgccgaaaaatagcggcagcctgaatgaagccgaggccctgaatcccgaggtaacgctgagctctgagggcagcctgaacctagaggatattctctatttggaggacacaggagacctcgatgagaccctatacgttcaggagaccgagaaggcggaagaggctctgtacatcgaggaggcgatgcaacccgacgaagcgctgcacgtcgaagagcctggcaatccagaggagacagtgtgcgtggaggaaactacagagcctgaccgcattcagtttgtcgaggggccagtggagcctgggaaacctacgtcccccgagcatgttgtgtacgagggagagaccgtcacccgcgctgagaaatctaatcctgaagaatcactcagggccgaacaaagtccctcgatggaggagaacttgagtatcgaagacctggagctacttgagggtcgctttcagcaatgtgtgcaagctgtcgcccagttagaagaggagcgtgatcagctcatccatgaactggtactcctgagggaacccgctttgcaggaagttcaacaggtgcatcaggatattttagccgcttataagctgcacgcacaggctgaattggagcgtgacggcctcagagaggaaattcgcttggtgaaacagaaactcttcaaggtgactaaggagtgcgttgcctatcaataccagctggagtgccgacagcaagatgtagcacagttcgccgacttcagagaggtgttgaccacaagagcgacccaactgagtgaagagcttgcacagctcagggatgcctatcagaaacagaaggaacagctccgccagcagctcgaagctccgccatcccagcgagatggccacttcctgcaggagagtagacgcctgtccgcccagtttgaaaaccttatggcagagtcaagacaggatctggaagaggagtacgagcctcagttcctgcgcctccttgagaggaaagaggctggcaccaaggccctgcagcgtactcaggcggaaatacaggagatgaaggaggccctgaggcctctccaggctgaggctcgtcaactccggttgcagaatcggaacctcgaagatcagatcgcactggtgaggcagaaaagggacgaggaggtgcagcagtatagagagcagctggaagaaatggaagagaggcagaggcaattgcggaatggagttcagctgcaacagcagaagaacaaggagatggagcagctgcgtctctcgctagctgaggaactgtctacctacaagggctgcctggagatctacggtcaaatctgtaatcctgagacagccaaaaattttctggcaaaggaccactag

SEQ ID NO: 54688 - DNA, 1449 bp, Artificial Sequence
  Description of Artificial Sequence: Synthetic coding sequence
atggcctctcccgagcccagaagaggcggagacggagcggcacaagccgctcggaaaacccgggttgaggctaactcccccttacctaaaaactctggcagcttgaacgaggctgaggcactcaaccccgaggtcaccctctcaagtgagggctctttgaacctcgaggatatcctttatctagaagataccggagaccttgacgagaccttatacgtgcaggagacggagaaagccgaggaggccctctacattgaagaagcaatgcagccagatgaggctttacatgtagaggagcccggaaatcctgaggaaacagtgtgtgtggaggaaacaacagaacccgatagaatccagtttgtcgagggacctgtcgaacctggcaagcccacttccccagaacacgtggtatatgagggcgagactgtgacacgggctgagaagtctaatcctgaggaatctttaagggcagaacagtcaccctctatggaagagaacctgagtatcgaagatctggagctgcttgaggggaggttccaacagtgtgtccaagcggtggcccagttggaggaggagagggaccagctcatacacgagctggtcttactccgtgagcccgcactgcaagaagtgcagcaagtgcatcaggatatcctcgcagcttataagttacacgcacaggccgagctggagcgcgacggcctacgcgaagagattcgattggttaagcagaagctgtttaaggtcaccaaagagtgtgtggcttatcaataccagttagagtgcagacaacaggacgtggcacagttcgctgacttccgcgaagtgctcacgaccagggctacccagctgtccgaagaattggcccagctgagggacgcataccagaagcagaaggaacagctgagacaacagctggaagcaccaccttcacagcgggatggacacttcctgcaggagtcccgaaggttgtcagcacagtttgaaaacctaatggccgagtcaaggcaggacttggaggaggagtacgagccacagtttctccgcttgctcgaacgcaaggaagctggaactaaggccttgcaaaggacccaggccgaaatccaggagatgaaagaagctctccggcctctgcaggcagaggcgagacaacttcggctgcagaatcgcaatttggaagaccagatcgcactggttagacagaaaagagacgaggaggtgcagcagtatcgggaacagctagaagaaatggaggaaaggcagaggcagctgcgtaacggcgtgcagctacagcaacagaagaacaaagagatggaacagctgagactgtcactcgccgaggagctttctacttacaaggcgatgctgttgcctaagagccttgaacaggctgatgcgcctacctctcaggcaggtggcatggaaacgcagtctcagggggctgtttag

SEQ ID NO: 54689 - DNA, 273 bp, Artificial Sequence
  Description of Artificial Sequence: Synthetic coding sequence
atgcagcccgacgaagccctgcacgtagaagagcctgggaatccagaagagaccgtgtgcgtcgaggaaacaaccgagccagacaggatacaatttgtggagggcccagtggagcccggaaagcctacctctccagagcatgtcgtctacgagggggagaccgtcacccgagcagagaagtcaaatcccgaggaatctctgcgggcagaacagtcgccaagtatggaggaaaatctctccattgaggatctcgaattgctggaggggcgatag

SEQ ID NO: 54690 - DNA, 213 bp, Artificial Sequence
  Description of Artificial Sequence: Synthetic coding sequence
atgcagcctgatgaggcgcttcacgtggaagaacccggtaatccggaagaaacagtctgtgtggaggaaactaccgagcccgaccgcatacagttcgtggagggtcctgtcgagccagggaaaccaacctctcccgagcacgtagtctacgagggagagacagtgacacgggctgagaagagtaaccccgaagagagcttgcgcgctgagtag

SEQ ID NO: 54691 - DNA, 405 bp, Artificial Sequence
  Description of Artificial Sequence: Synthetic coding sequence
atgtctcccctgagaccactcctgctggccttagctctcgccagtgttccgtgtgcccagggcgcttgtcccgcaagcgctgatctgaaacatagtgacggcacgagaacgtgcgctaaactgtatgacaagagcgacccctactacgaaaattgctgtggcggtgcagagttgtccttggagtctggcgcagatctaccctacttgccttcaaattgggccaacaccgccagcagcctagtagtggctccaaggtgcgagctgactgtgtggtctagacagggtaaggccggaaagacccacaagtttagcgcaggcacttaccccagacttgaagaataccggagggggatactcggagactggtcgaacgctatttccgccctgtattgtcgctgttcttag

SEQ ID NO: 54692 - DNA, 897 bp, Artificial Sequence
  Description of Artificial Sequence: Synthetic coding sequence
atgtcactatacccctctttagaagacctgaaggtggacaaggtgattcaggcacagacagccttttccgccaatcccgctaaccctgcaatcctttctgaggcttcagcacctattccacacgatgggaatttataccccagactctacccagagctgtcacaatacatggggctgtccctgaatgaagaagagattcgcgctaatgtggcagtcgttagtggggcacctctccagggccagctggtcgccaggccaagttccatcaattatatggtggcgccagttaccggtaacgacgtgggaatcaggcgcgctgagattaagcaagggatccgagaagtgattctttgtaaggatcaggacgggaagattggcctaagactcaagagcatcgacaacggaattttcgtgcagttggtacaggccaacagtccggctagtctcgtgggtctgcggtttggggatcaggtgttacaaatcaacggagagaattgtgccggatggtccagcgacaaagcccataaagtgctgaagcaggcctttggggaaaaaatcactatgaccattagggatagaccatttgagcgtacgattaccatgcacaaggattcaacagggcacgtgggatttatatttaaaaacggcaaaataactagcattgtgaaggatagctctgctgctaggaatggcttattgaccgagcacaacatctgcgaaattaatggtcaaaacgtcattgggctcaaagactctcagatcgcagacattctctccactagtggcaccgtagtcaccataaccataatgcctgctttcatcttcgagcacattatcaaacggatggcaccttctattatgaaatccctgatggatcatacaatccccgaggtgtag

SEQ ID NO: 54693 - DNA, 897 bp, Artificial Sequence
  Description of Artificial Sequence: Synthetic coding sequence
atgtccctgtatccctcactggaagacctgaaggttgacaaggtcattcaagcccaaactgcattctccgctaatcctgctaaccctgcaatcctgtcagaggcttctgctcccattccacacgacggaaacttataccccaggctgtatccggagctctctcaatacatggggctctctctgaacgaggaagaaattagggccaatgtggcggttgtatctggggctccgttgcagggccaactcgtggcgaggccctcgtctattaattacatggtcgcaccagtgacaggcaacgatgttggcatccgcagagctgaaataaagcagggcattcgcgaggtgattctctgcaaagatcaggacggcaaaataggactccgcctaaaatcaatcgacaatggtattttcgtccagctggtgcaagccaacagccccgcaagcttggtgggcctgcgatttggagatcaggtgttgcagatcaacggcgagaattgcgcaggctggtctagcgataaggcacacaaagtccttaaacaggctttcggtgagaagataacaatgactatcagggaccgacccttcgaacgaacaatcaccatgcacaaggactccaccggccatgtgggttttatatttaaaaatggtaagatcaccagcatagtcaaagattccagcgcggcaaggaacgggctcctaactgaacataacatttgtgaaatcaacgggcaaaatgttatagggttaaaggattcccagatagccgacatactaagtacttctgggaccgtcgtgactattactatcatgccagcctttatcttcgaacatataatcaagcgaatggccccttccattatgaagagcctgatggaccatacaatccctgaagtctag

SEQ ID NO: 54694 - DNA, 894 bp, Artificial Sequence
  Description of Artificial Sequence: Synthetic coding sequence
atgtctctgtacccctccttagaggatcttaaagtggacaaagttatacaggcccagaccgccttcagcgccaatcccgctaatccagcgattctgtccgaggcgtctgcccctatcccacacgacgggaatctctatcctcggttgtaccctgaattaagccagtatatggggctgagcttgaatgaggaggaaattagggcaaatgtggccgtagtttcaggggctccacttcagggccttgtcgccagaccaagttccataaattacatggtcgcccctgtgaccggcaacgatgtgggaattcggcgagcagaaattaaacagggcattcgcgaggttatactgtgcaaggatcaggatggcaaaatcggcctgcggctgaagtcaatcgacaatggaatttttgtccagctggtgcaagccaactcacccgcttctctggtgggcctgaggttcggtgatcaggttctccaaattaatggggagaactgcgctggttggagttcagacaaggcacacaaagtcctgaaacaggccttcggggaaaaaataaccatgacaattcgcgacagaccgttcgagaggacaattactatgcataaggacagtacaggccatgtcggttttatattcaaaaatgggaagattacgtccatcgtgaaggatagttccgccgctcgaaacggtctgcttaccgaacataatatatgtgagataaatggccaaaacgtgataggcctaaaggattcccagattgcagacatcctgtccactagcgggacagtcgtgacaattactattatgcccgctttcatctttgaacatatcattaagcggatggcacctagcataatgaaaagccttatggatcacactattccagaggtatag

SEQ ID NO: 54695 - DNA, 879 bp, Artificial Sequence
  Description of Artificial Sequence: Synthetic coding sequence
atgtcactgtacccttctttggaggacttaaaggcccaaaccgcgtttagcgctaaccccgcaaacccagcaatcctgtccgaagccagcgcacctatcccacacgatggtaatttgtaccccagactctaccctgagctctcccagtatatggggctgagtctgaatgaggaggagatccgggcaaacgtggccgttgtatctggagctccgctgcagggccagctggtggccagaccatcttctatcaactacatggtggcaccagtaaccggcaatgacgtgggaattagacgggctgaaatcaagcaaggtatcagagaagtgattctttgcaaggaccaagatggaaagataggcctgagactcaagtctatcgataatgggatctttgtgcagctggtccaggccaactctcctgcatccttggtgggccttcgcttcggtgatcaagtactgcagataaacggtgagaattgcgcaggctggtcttccgacaaggcgcacaaagtcttgaagcaagccttcggagaaaagatcaccatgactatcagagatagacctttcgagcgcacaatcacaatgcataaggattctacaggccatgtcggcttcatcttcaaaaacgggaagatcaccagtatcgtcaaggattctagcgcagcccgaaacggcctccttactgagcataatatatgcgagataaacggtcaaaacgtgataggtctgaaagattcacaaatagccgatattctgagcacctctggtaccgttgttactatcactatcatgcccgctttcattttcgagcatattatcaaacggatggcaccttcaatcatgaagtcactgatggaccacaccatcccagaggtgtag

SEQ ID NO: 54696 - DNA, 894 bp, Artificial Sequence
  Description of Artificial Sequence: Synthetic coding sequence
atgtctctctaccctagtttggaggacctgaaggtagataaagttatacaagcccaaaccgcattttcagcaaatccagcaaatccagctattcttagtgaggcttccgcacccatcccccatgatggcaacctgtaccccagattgtatcccgagttgtcgcaatacatgggactcagtttgaacgaggaggaaatcagggccaacgtcgccgtggtttcgggtgctcccctgcagggtttggtggcgcgtccatcctcaatcaactacatggtggcacccgtcacaggcaatgacgtcggcattagacgggcagagatcaagcaggggattcgggaggttatcttatgtaaggatcaggatgggaagatcggcctgcgcttgaaatccatcgacaacggaatctttgtgcaactagtgcaggcaaactccccagcaagcctggtaggcctaaggttcggagatcaggtgctgcagataaatggagagaactgtgctgggtggagcagcgataaggcccacaaagtgctcaagcaggcattcggggaaaagataactatgaccataagggatcgacccttcgaaaggactatcacaatgcacaaggacagtaccggccatgttggctttatcttcaaaaatggtaagattacctctatagtgaaagactcctctgccgctcgtaatggtttgctgactgagcacaatatctgcgaaataaatggtcaaaatgtaatcggactcaaagacagccaaatagccgatatattgtccaccagtggcacagtcgttacaatcactattatgcctgcattcattttcgaacacatcataaaacggatggccccttccatcatgaaatctcttatggatcatactatacccgaggtgtag

SEQ ID NO: 54697 - DNA, 879 bp, Artificial Sequence
  Description of Artificial Sequence: Synthetic coding sequence
atgtccagcctgtacccgagtttagaggacctcaaagtggatcaagccatccaggcgcaagtccgagcaagccccaaaatgcctgccctgcccgtccaggccaccgctatctcccccccaccagttttgtatcctaacctggccgaacttgagaactatatggggctcagtctgagttctcaagaggtgcaggagagcttgctgcagattcctgagggagactccactgccgtgtccgggcctgggccaggccagatggtcgcccctgtgaccggatattcattaggggtgagaagagcagagattaaacccggtgtgagggagattcacctgtgtaaggacgaaagaggaaagacaggattaagactcagaaaggtggaccagggactgttcgtgcagttggtgcaggccaatacaccagcgtcactggtcggactccgcttcggtgatcaactgctgcagatcgacggacgcgattgtgcgggatggtcttcacataaagcacaccaggtggtaaagaaagcgagcggcgacaagatcgtggtcgtggttagggatagaccgtttcagcgtaccgttactatgcacaaggattccatgggacatgttggattcgtgataaaaaaaggaaaaattgtctccttggtaaaaggttcctccgcagctcggaacggacttctgaccaatcactacgtatgcgaagtggatggccagaacgtgattgggttaaaggacaaaaaaattatggaaatcctcgccaccgctggcaatgtggtaaccctcactatcatcccttccgtgatatacgaacacatggtcaaaaaactgcctcctgtcttgttgcatcacaccatggaccactcaattcccgatgcctag

SEQ ID NO: 54698 - DNA, 879 bp, Artificial Sequence
  Description of Artificial Sequence: Synthetic coding sequence
atgtcgagcctctatccatcgttagaagatctgaaagtggatcaggcaatccaagcccaagtgagagcgtctcccaagatgccagctcttccagttcaggcaactgcgattagcccccctccagtgctctaccccaacctcgcggagctagagaattacatggggctgtcactgtctagccaggaagtgcaggaaagtctccttcagattcccgagggagacagtacggccgtgagcggcccaggtccaggtcagatggtggcccctgtgacaggctattccttgggagtgcgcagggcagagatcaagcctggggtgcgagagattcacttgtgtaaggatgaaaggggaaaaaccggcctccggctgaggaaagtggaccaagggctgtttgtgcagctagtgcaagctaatacaccagcctccttagtaggactgagattcggagatcagttactccaaattgacgggagggactgtgctggttggtcttcgcacaaagcacaccaggttgtaaagaaagcctccggtgataagatcgttgtcgtggtgagggaccggccttttcagcgcaccgtcactatgcacaaggatagcatgggtcacgttggttttgtgattaaaaaaggaaaaatagtatctcttgtaaaaggctcttctgcagcgcgaaacggcctacttactaatcattacgtttgtgaagtggacgggcaaaacgtcataggactcaaagataagaaaatcatggagatcctggctacagcgggaaacgtagtgacactcacaatcattccgagcgtaatctacgagcatatggtgaaaaaactgccacctgtgctgttacatcataccatggatcactccatccccgatgcctag

SEQ ID NO: 54699 - DNA, 624 bp, Artificial Sequence
  Description of Artificial Sequence: Synthetic coding sequence
atggtggcccctgtgacaggctactcacttggagtacgccgagccgagatcaaacctggcgtacgggagatccatctgtgtaaagacgaacggggaaagacagggctgaggctaagaaaagtagaccagggccttttcgttcaactcgtgcaggcaaacaccccggcatccttggttgggctaaggttcggcgatcagctgctacaaatcgacggtcgagattgtgctggctggagttctcacaaagcacatcaggtggttaaaaaggcctccggcgacaaaatcgtggtggttgtccgggacaggcctttccaaagaactgttaccatgcataaagattcgatgggacatgtggggttcgtgatcaagaagggaaaaattgtgtctctcgtgaaagggtcttctgctgcaaggaacggacttctgacgaatcactacgtgtgcgaggtggacgggcagaacgtgataggattgaaagataagaaaatcatggaaattctcgctaccgccggaaacgttgtgaccctcacgatcatcccctccgttatctatgaacatatggtaaagaagctgccccctgtactgctgcaccacaccatggaccattcaattccagacgcctag

SEQ ID NO: 54700 - DNA, 879 bp, Artificial Sequence
  Description of Artificial Sequence: Synthetic coding sequence
atgtcaagtctctaccccagtttggaagacctgaaggttgatcaggctattcaagcccaggtgcgcgcatccccgaagatgcccgcactgccagtgcaggccactgccatcagtcctcccccagtactatatcccaatctggctgagctggagaactacatgggattaagtctaagcagtcaggaagttcaggagtcgttactgcagattcctgaaggcgattccacggctgtgtctgggcctggccctgggcagatggttgccccagtcaccggttatagtctgggtgtgaggagagccgaaatcaagcccggagtgcgggaaatccacctgtgcaaggacgaacgcggtaagacaggactgcgtctcagaaaggtggaccaaggactgtttgtccagctggtgcaggccaacacacctgcctccttggttggtctcagattcggcgaccagctcctgcagatcgatggcagagattgcgcaggctggtccagccacaaggctcatcaagtggtgaagaaggccagtggggataagattgtggtggtggttcgggatcgccctttccagagaacagtaacgatgcacaaagattctatgggacacgtaggattcgtcatcaaaaagggtaaaatagtctcacttgtgaagggatctagtgcggcacgaaacgggctgctcaccaaccactatgtctgcgaagtagacggtcagaacgtgattggcctcaaggataaaaaaatcatggagatcttggccaccgccggaaacgtggtgacactcacgatcattccatcagtgatatacgaacacatggtgaaaaagctacctccggtactattgcaccacacaatggaccatagcattcccgacgcgtag

SEQ ID NO: 54701 - DNA, 750 bp, Artificial Sequence
  Description of Artificial Sequence: Synthetic coding sequence
atgagcctcgaagatcccttcttcgttgtccggggagaagtgcagaaggccgtgaataccgcgaggggtctctaccagcgttggtgcgaactacttcaggagagcgctgcggtaggccgagaggagctggactggacgacaaacgaactgaggaacggcctgcggtccatcgaatgggatctggaggacctggaggaaacaatcggcatcgtggaagctaaccctggtaagttcaagctccccgctggcgacctacaggaaaggaaagtcttcgtggagagaatgcgagaggccgtccaggaaatgaaggatcacatggtcagcccaaccgccgtggcgttccttgaacgcaacaatcgagaaattctggctggaaagccagcagcccaaaaaagcccgagtgacctactagatgcttcagccgtcagtgccacctccagatacatcgaagaacaacaggcgacccagcagctgataatggacgagcaggatcaacagttagaaatggtcagtggtagcattcaggtccttaagcacatgtctggcagggtcggtgaagaactcgatgagcagggcatcatgcttgacgcctttgcccaggagatggaccatacccagtcaaggatggacggagtgctgagaaaacttgctaaagttagccacatgacgtccgaccggagacagtggtgcgccattgccgtgttggtgggcgtgcttctgttggtactgatcttgctttttagcctgtag

SEQ ID NO: 54702 - DNA, 603 bp, Artificial Sequence
  Description of Artificial Sequence: Synthetic coding sequence
atgagcctggaagaccctttttttgtggttaggggggaggtccagaaggccgttaacacagcacgcggtctttatcagcggtggtgtgaactattgcaggagagcgcggctgtgggtagagaagagctggactggacaaccaatgagctacgtaacgggctgcgatccattgagtgggacctagaagacctagaggaaactattgggatcgtcgaggctaaccccggaaaaccagcagcacagaagtccccctctgatctactcgacgcttctgcagtgagcgcgacaagccggtacatagaagagcagcaagccacgcaacagctcataatggacgaacaggatcagcagctggagatggtctctggctcaatccaggtactgaagcatatgtcaggaagagtcggcgaagaactcgacgaacaggggattatgcttgatgctttcgcgcaggagatggaccatacgcagtcgagaatggacggagttctacgaaaactcgccaaggttagccatatgacctcggatcgtaggcagtggtgcgctatcgccgtgctcgttggcgttcttctgctggtcctcattctgttgttttccttgtag

SEQ ID NO: 54703 - DNA, 741 bp, Artificial Sequence
  Description of Artificial Sequence: Synthetic coding sequence
atgtcactcgaggatccctttttcgttgtgcggggtgaagtgcagaaagcggtgaacacggctagagggctgtatcagcggtggtgcgaactgctgcaggagtccgccgctgtcggcagggaggagcttgactggactacgaacgagctgagaaacggccttagatctatcgagtgggatctagaagacctggaggaaaccattggaattgtggaagctaaccccggaaagtttaagctgccggctggagacttgcaggagaggaaggtgtttgttgagcgcatgcgcgaggccgtgcaggagatgaaagaccacatggtatctcctactgcagtagcattcttggagcgaaacaatagagagattctagccggaaagccggcagcacagaagtccccctccgacttgttggacgcctccgccgtgagtgccacgtccagatacattgaagaacagcaagctactcagcagctcattatggatgagcaggatcagcagctcgagatggtgtccggttccatacaggttctgaagcacatgagcgggagggtgggcgaggagctggatgaacaagggatcatgctagatgcttttgctcaagagatggatcatactcaatctaggatggatggcgtcctccgcaaacttgccaaggtctcccacatgacgtctggcgagagtcctcagggtcgcggacagagctggtgggggcaggtggtcggcggtacactgagcccctag

SEQ ID NO: 54704 - DNA, 750 bp, Artificial Sequence
  Description of Artificial Sequence: Synthetic coding sequence
atgtcactggaggacccgttctttgtcgtgagaggcgaggtccagaaggctgtcaacactgcacgcggactgtaccagcgctggtgcgagctcttgcaggagagcgccgcagtcggccgtgaagagctagattggaccacgaatgagctacggaatggattgaggtctattgaatgggacctggaagatctggaagagaccattggtatcgtagaggctaaccctggcaagtttaaactgccagctggagatctgcaggagagaaaggtgttcgttgagcgaatgagggaagctgtgcaggagatgaaagaccatatggtgtcccctactgccgttgccttcctggaaagaaacaatcgcgaaatcctggccggaaagcccgctgctcagaaatcgccatccgacctgctcgatgcgtcagctgtctccgccacaagtaggtacattgaagagcagcaggccactcagcagctcattatggatgaacaggaccagcagctagagatggtgtctggatccatccaggtcctcaagcatatgtccgggagagtgggtgaagaattagacgagcagggtatcatgctggacgccttcgctcaggagatggatcacactcaaagccgcatggacggcgtactacggaaactggctaaggtaagtcacatgactagtgaccggagacagtggtgcgcgatagctgtgctagtcggcgttctactgctggtactgatccttctcttctctctctag

SEQ ID NO: 54705 - DNA, 741 bp, Artificial Sequence
  Description of Artificial Sequence: Synthetic coding sequence
atgagcctcgaagatccttttttcgtagtgagaggggaggtccaaaaggccgtaaacaccgcgcgtgggttgtatcagcggtggtgcgaactcctacaggaatctgctgcagtagggcgagaggaactggactggaccactaatgaactgcgcaatggcctcagatcgattgagtgggacttagaggacttagaagagaccattggcatcgtggaggccaacccgggtaaatttaagcttcccgctggcgatttacaggagcgtaaggtctttgtggagcggatgcgggaggctgttcaggagatgaaggatcatatggtgtccccaacagcggttgcctttcttgaacgtaacaatcgggagattctggctggcaaacctgctgcgcaaaaatcaccttcagatttgctggacgcgagcgctgtgtccgccacttctcgctatatcgaggaacagcaagcaacccagcaattgatcatggacgaacaggaccagcagcttgagatggtgagtgggagtattcaagttcttaagcatatgtcaggcagggtaggagaggagttagacgaacagggcattatgctggatgcgtttgcccaggagatggaccacacccagagtcgcatggacggggtcctgcgaaaacttgctaaagtgtctcacatgacgtctggagaaagccctcagggccgtggacagagctggtggggacaggttgtggggggaacgctaagcccttag

SEQ ID NO: 54706 - DNA, 831 bp, Artificial Sequence
  Description of Artificial Sequence: Synthetic coding sequence
atgagctacggacctctcgacatgtatcggaaccctgggccttcagggccacagctcagagactttagctctattatccagacatgtagcggaaacatccagaggatttcgcaggccacagcccagataaagaacctgatgagccagctgggcacgaaacaggattctagtaagcttcaggagaacctgcagcagctgcaacactctacaaatcaactggctaaggagactaacgaactccttaaagaacttgggtccctcccattgcccctgtctacttctgaacagcgccagcagcggttgcagaaggaacggttgatgaatgacttctccgctgcactcaacaacttccaggctgtacaacgccgagtttcagagaaagagaaggaaagcatcgctagagctcgagccggttcaagactgagtgccgaggagcgccagcgcgaagaacagttagtgtccttcgactcacacgaggaatggaaccaaatgcagtcccaggaggatgaggtggctatcacagagcaggatctcgaattaattaaagaaagagagaccgctattcggcaactggaggctgacatattagacgtgaaccagattttcaaggatcttgctatgatgattcatgaccagggcgatctgatagacagcatcgaagctaacgtggagtcctctgaagtgcatgttgagagagccacggaacagctgcagcgcgctgcgtactatcagaagaagtcccggaagaaaatgtgtatcctcgtgctcgtgctgtcagtaattattttaatcttaggtttaatcatctggctagtgtacaagaccaagtag

SEQ ID NO: 54707 - DNA, 705 bp, Artificial Sequence
  Description of Artificial Sequence: Synthetic coding sequence
atgagctatgggccactggacatgtaccgaaatccaggcccaagcggccctcagctcagggacttttcgtccatcattcagacttgtagtggcaatattcagcgcatttcccaggctacggctcagattaagaacctgatgtctcagttagggactaagcaggattcctccaagctgcaggagaatttgcagcagttacagcattccacaaaccagttggctaaggaaactaacgagctgcttaaagagttaggtagtcttcctcttccgctgagcacatccgaacagaggcagcagcggctgcagaaagaacggctgatgaatgatttcagcgccgcactcaataattttcaagctgtgcagcggagggtctccgagaaggagaaagaatctatcgcaagagcaagagctgggtctcgactttccgccgaggagcgacagcgggaggagcaactggtgtcatttgattctagtctcctgctggacatgaaaaatgtagcgctgcaagacttcatcgatagtaggggattggaaccatgccacgaagaatggaatcaaatgcagagtcaggaagatgaggtggctataacagaacaggacttggagctgatcaaggaaagagagaccgcgatccggcagctcgaggccgacatcctagacgtgaatcagattttcaaagacctggcaatgatgattcacgactag

SEQ ID NO: 54708 - DNA, 1008 bp, Artificial Sequence
  Description of Artificial Sequence: Synthetic coding sequence
atggctgtcgatataacactgctttttagggctagcgtgaaaacagtcaagacaagaaacaaagctctcggcgtggccgtgggagggggtgtcgatggctctcgcgatgagctgtttaggcgcagtcccagacccaagggcgatttctcatcacgggcacgggaagtgatttcacacattggtaaacttagagacttcctcttggagcatagaaaagattacattaacgcttattctcacactatgtcagaatatgggaggatgacggacacagagcgagaccaaatagatcaggatgctcagatctttatgcgtacttgtagtgaagcgatacagcagctccggactgaagcccacaaggaaatccactcccagcaagtgaaagagcacagaactgctgtactcgatttcatcgaggattatctgaagagggtttgtaaactctactccgagcagcgcgcaattagggtcaaaagagtggtggacaagaaaaggctgtctaagctcgagccagagcccaatacaaaaacgagagagtccacctctagcgagaaagtttcccaaagtccttccaaagattccgaagaaaatccggcaacagaagagcggccagagaagatactcgctgaaacacaaccagagcttggcacctggggagacggcaagggcgaggacgagctgtcccctgaagagatccagatgttcgaacaggagaatcagcgtctcatcggtgagatgaactccctgtttgatgaggtgcgccagattgaaggtagggtggtggaaatctcccgcctgcaggagatcttcacagaaaaagtacttcagcaggaggccgagatcgattctattcatcagcttgtggtcggcgctaccgaaaacatcaaagaaggcaacgaggatattcgggaggctataaagaataacgcgggattccgcgtgtggatcctattcttcctagtaatgtgttcgtttagtttgttatttctggactggtacgacagctag

SEQ ID NO: 54709 - DNA, 768 bp, Artificial Sequence
  Description of Artificial Sequence: Synthetic coding sequence
atgtcaatggaggaccccttttttgtggttaagggcgaagtgcaaaaagccgtgaacaccgctcagggtttattccagcggtggacagagctgctgcaagaccctagcactgcaactcgcgaggagattgactggacaacaaatgagctgcggaataacctgcgatccattgagtgggatctggaagatctcgacgagaccatctctattgtagaagcgaatcccaggaagttcaaccttgatgcaaccgagctttccattcggaaggcattcattacttctacgaggcaggtcgttcgggatatgaaggatcagatgtcaacctccagtgtgcaggcgttagcggagagaaagaaccgccaggctttgttgggagactccggcagtcaaaactggtctactggcaccaccgataaatacggaagactcgatagagaacttcagcgggctaactctcattttattgaggagcagcaagctcagcagcagctaattgtagaacagcaggacgaacagctcgagctggtgtctgggtctattggcgtcttgaagaatatgtcacagcgaatcggtggtgaacttgaggaacaggcagtgatgctggaagatttttctcacgagctggagtcaacccagagccgcctggataatgtcatgaaaaagctggccaaggttagtcatatgacctccgaccgtcgacagtggtgcgccatcgccatcctttttgcggttctgcttgtggtgcttatcctgtttctcgtcctgtag

SEQ ID NO: 54710 - DNA, 465 bp, Artificial Sequence
  Description of Artificial Sequence: Synthetic coding sequence
atgaaggatcagatgtctactagtagcgtgcaggctctcgctgaacgcaagaacagacaggctcttctcggcgactccggctcacaaaactggtctaccggaaccacagataaatacgggagactggacagagagctacagcgcgcaaactctcattttattgaagaacagcaggcccagcaacagctgattgtggagcaacaagatgaacagctcgaattagtctccggctcaattggagtcttgaagaacatgagtcagagaatcggcggtgaacttgaagagcaggctgtcatgctggaagacttctcccacgagcttgaatccactcagtctcgcctcgacaacgtcatgaagaagctggcgaaagttagtcatatgacatccgatagaagacagtggtgcgccatcgcaatcctcttcgcggtactgctagtggtgctcatcctattcctggttctgtag

SEQ ID NO: 54711 - DNA, 1779 bp, Artificial Sequence
  Description of Artificial Sequence: Synthetic coding sequence
atggccccaccggtggccgaaagaggcctcaagagtgtcgtttggcagaagatcaaggccactgtgtttgacgactgtaaaaaggagggggagtggaagatcatgctgctcgatgagtttaccacaaaattgttagcttcatgctgcaagatgaccgacctgctggaggaagggatcaccgtagtggaaaacatttataagaaccgtgagcccgtgagacagatgaaggctctgtacttcattacgcctacctctaaaagcgtggattgcttcctgcacgattttgcctctaagtctgagaacaagtataaggccgcttacatctatttcacagatttttgtccagacaatctgtttaacaaaatcaaagcgagttgtagcaagtcgataagaaggtgcaaggagattaacatctcatttatacctcatgagtctcaggtctatactctcgacgtgcctgacgccttctattattgttatagtccagacccgggaaacgccaagggcaaagacgccatcatggaaaccatggccgaccagatcgtgactgtttgtgctacactggacgaaaatcctggagtgagatacaaaagcaagccattagacaatgcctccaagctagcccagctagtcgaaaagaaactggaagactattataagattgatgagaagagtttaatcaagggaaagacccattctcaactgttgatcatcgatcgaggtttcgatcctgtgtctacagtgctgcacgagctaacctttcaagccatggcatacgacctgttgcctattgagaacgacacttacaagtacaagaccgacggaaaagagaaggaggccattctcgaggaggaagacgacctgtgggtccgaatccgccaccgccacatcgccgtggtgctggaggagatacccaaacttatgaaagagatcagtagcacaaagaaggcgactgagggaaaaacttctttgagtgcacttacacagctgatgaagaaaatgcctcacttccgtaaacagatcaccaaacaggtcgtgcaccttaatctggccgaagattgtatgaacaaatttaagctgaatatcgagaaactttgtaagacagagcaggacctggcactcggcactgacgcagaaggtcagaaagtgaaagactcaatgagagtgttgttaccagtcctcctgaacaagaaccatgataactgtgacaagattagagccatcctgctgtacatcttttctataaacggaacaacggaggaaaacctggacagactaattcagaatgttaagatcgagaatgaaagtgatatgattcgtaactggtcatacctcggtgttccaatagttccccagtcccagcaaggcaagcctctccgcaaagaccgaagtgctgaggagacatttcaactgtcccggtggacaccattcatcaaggatattatggaggacgcaatcgataaccgccttgattcaaaagaatggccttactgttcacaatgtccagccgtctggaacggctcgggtgcagtgagtgccaggcagaaacctagggcaaactatctcgaagataggaaaaacggatccaagcttatcgtcttcgtcattggaggaatcacttactccgaggtgcgatgcgcctacgaagtcagtcaggcccacaagagttgtgaggtcattattggaagcacacatgtccttactccgaagaaacttctagacgacattaaaatgctgaacaagcctaaagataaggtgagcctgattaaagacgagtag

SEQ ID NO: 54712 - DNA, 2616 bp, Artificial Sequence
  Description of Artificial Sequence: Synthetic coding sequence
aggatatgttctcaggaagaggtggtgatcccatgcgcctatgatagcgacagtgagagtgtcgaccttgagctgagtaacctcgagatcatcaagaaaggctcctctagtatcgagctgacagatctggacatccctgacatccccggattgcactgcgagcctctgagtcactctcctcgacacttgacacagcaagatccgctgtctgaagccatcgtagagaagctaattcaatccatccagaaggtgtttaatggtgagctaaaaggagagctcgagaagctcaaattcctcggtgatctgagcagtctcagtcaggcactaccatatgacgagactgccaaaagtttcatccactcgcacatcgccgatatcgtgcacaccctcaacgtcttagtacaggaggagaggccccattccctgagtagttcaatgaggcaagaagtttttgttaccatcgccgatttgtcctaccaggacgtgcacctcttgctgggaagcgaggatcgtgccgagctgttcagtcttacaattaaatctataataaccctgcctagtgtgagaacgctcacacagattcaggaaataatgcctaacggaacctgcaacactgaatgtctgtaccgtcagacttttcaggccttctccgagatgctacagtctctagtggtgaaagatccacatctcgagaacctggatacaatcattaagctcccgctccggttccaacggctcggccatctcgtggcactgatggccctgctttgcggagatcctcaggaaaaagtcgccgaggaagccgcagagggaattcacagtctcctccatattacactcagactgaaatatattacgcatgacaagaaagaccagcagaatctgaaacgcgcattgaccaagtgtagagaatttcttgaattacactcatccgctgcgaaatgcttttacaattgcccattccgcatcgctcaggtgccagagattatgggcgtaatctgtgcccagttatccatcatttctcagcctagagtcagacagcagatcattaatacggtgtctctgttcatttcaaggccaaaatacactgatatcgttctgtcattcttgctctgccatcccgtgccatacaaccgccatctcgccgaagtatggcggatgctgtctgtggagctgccatccactacctggatcctgtggaggctgctgaggaagctgcagaaatgccataacgagcccgcacaggagaagatggcatacgtggccgtggcggctacagacgcgctttatgaagtttttcttgggaacaggctgagagcagctactttcaggctgtttccccagttactcatgaccttgctgattcagatccatcatagtatcggattgacgatgtctgatgtggatatccccagtgggctctacacggaacaggaggttccaagcgaggtaacgcctctctgtttcgccatgcaggctactaaaaccttactcttgcgcacgtgctgcctacaggagttcaacatcatggagaagaacaagggctgggctctccttgggggaaaggacggacatctgcagggtctgtttttgctggccaacgcactgcttgagagaaaccagctgcttgcgcagaaggtgatgtatttacttgtaccccttctcaaccgcggtaatgacaagcataagctcacttccgctggctttttcgtggaactcttgagaagccctgtcgccaaacgcctgcccagtatttacagtgtcgctagatttaaagactggctccaggacgggaaccatctcttccgcatactcggactgcgaggcttatataacctcgttggtcaccaggagatgagagaggacatcaaaagtctgctgccttacatcgtggatagcctgcgcgagactgatgagaagatcgtcctgtctgccatccaaatactgctgcagttagtacgcaccatggacttcacaaccctggcagccatgatgcgcacgctgttttcactgtttggagatgtgagaagcgatgttcaccgattcagtgttacactctttggtgcggctatcaagtccgttaaaaatcctgataagaagtctattgagaaccaggtcttggattctctcgttcctctgcttttatattctcaggacgaaaatgatgcggtagcggaagaaagccgacaggtgctcaccatctgcgcacagtttctgaaatggaaactgccccaggaggtgtacagtaaagatccatggcatatcaagcccaccgaagccggaactatctgcaggtttttcgagaaaaagtgcaagggaaagatcaacatcttagaacagaccctgatgtactctaaaaaccccaagcttccaataagaaggtcagccgtcctttttgtggggctgctttctaagtacatggatcacaatgagctgcgcaggatgggcacagattggattgaggatgacttgagagatctgttatgcgatccggagccgtccttgtgtattattgcctcccaaacgctcctgcttgttcagatggctagggccgagccgaaaccgaagcagcgggtaaattggttgcaaaagctgatgggccgtagctctgcgtag

SEQ ID NO: 54713 - DNA, 1620 bp, Artificial Sequence
  Description of Artificial Sequence: Synthetic coding sequence
atggggaccgagggacctcctcctcctgccgctagccggggacgccagggctgtctgctagtccctgctcgaactaagaccacgattgcgttactgtatgatgaagagtctgagaatgcctatgacattagactgaaactcaccaaggaggtattgactattcaaaagcaggacgtggtctgtgttggaggttcacaccaaggcaggaaccgtcgtactgtgactcttcgaaggcagccagtgggtggtctgggcttgtctattaaagggggtagcgagcataacgtccctgtggttatttccaagattttcgaagatcaagcagccgatcagactgggatgctgttcgtgggtgacgcggttctccaggtcaacggcatacacgtggagaacgccacccacgaagaggtggtccatctgctgcgaaacgctggcgatgaggtaaccattactgtggagtatctgagggaagcccctgccttccttaagttaccacttggaagcccaggcccatccagcgatcattcctcaggagcaagctctcccttatttgattccggccttcatcttaatggaaattcatccacaaccgcaccctcaagcccctcatcaccaattgcaaaagatccaagatacgagaaacggtggttagacacactgtccgtgccgctgtccatggcccgaatctctagatacaaggctggcaccgaaaaactgcggtggaatgcatttgaagtactggccctcgacggggtgtcctccgggatcctccggttttacaccgctcaggatgggaccgattggttgcgagctgtgagcgcaaacataagagaactaactctgcagaacatgaagatggccaacaaatgctgttccccctccgatcaggttgtgcatatggggtgggtgaacgagaagctgcagggcgctgattcatctcagacttttagaccaaaatttctcgctctgaaaggcccatcgttctacgtgttctcaacgcctcccgtgtctactttcgactgggtgcgcgctgaacggacttatcatctatgtgaggtcctgtttaaggtgcacaaattctggcttacggaggattgttggctgcaggctaacctgtatttaggcctgcaggattttgatttcgaagaccagaggccgtattgcttctcaatcgtggccggacatgggaagtctcacgttttcaacgtggagctcggctccgagctggccatgtgggagaagagtttccaacgagcaacatttatggaggtgcaacggaccggttcaagaacctacatgtgctcttggcagggagagatgttgtgcttcacagtggattttgccttgggcttcacctgtttcgagtccaagactaagaatgtgctctggaggttcaagttctctcagctgaagggatcctccgatgacggaaaaacccgcgtgaagctgttgttccagaacttggacaccaagcaaatcgagaccaaggaactagagttccaggatctgagagccgttctgcattgtatccactcctttatagctgcgaaagtagcttccgtggatcctggttttatggactcacaatcactcgcgagaaagtacatgtatagctcgtag

SEQ ID NO: 54714 - DNA, 540 bp, Artificial Sequence
  Description of Artificial Sequence: Synthetic coding sequence
taggacctgaaaaacgtgttcccccctgaagtcgcagtctttgagccaagcgaggcagagatctcgcacactcagaaggcgactctggtgtgtcttgctactggcttttaccccgatcatgtcgaactatcctggtgggtcaatggcaaggaggtacattcaggagtaagcacagaccctcagccgctcaaggaacaacctgcgctgaatgatagtcggtattgtctctcttcacgtctacgcgtcagcgccactttctggcagaacccaagaaaccacttccgatgtcaagttcagttttacggcttgtccgaaaacgacgaatggacccaggatagggcaaagcccgtgacccagattgtctcagccgaggcttgggggagggccgattgcggatttacttcagagtcttaccaacagggcgtgctgtctgccacaatcctgtatgagatactccttggtaaagcaactctgtacgcggtgctcgtgagtgccctggtgctgatggcaatggttaagcgaaaagactctagaggctag

SEQ ID NO: 54715 - DNA, 465 bp, Artificial Sequence
  Description of Artificial Sequence: Synthetic coding sequence
taatcccagcctcacactaagccgtccgtctttgttatgaaaaatggaacgaacgtcgcttgcctggtcaaagagttttaccctaaggacattcggatcaatctggtaagctccaagaaaattactgaattcgacccagctatagtgatttctccttcgggtaagtacaacgcagtgaaactcggcaagtatgaggacagcaacagcgttacctgcagcgttcaacacgataacaaaaccgtacactccaccgatttcgaggtgaagaccgactccacagaccatgtgaagccaaaggagaccgaaaacaccaagcagcccagcaaatcttgtcataagccgaaggctatcgtgcacacagaaaaggtcaatatgatgtcccttaccgttctgggcctccgaatgctgtttgccaagactgtggccgtgaacttcctgctcaccgccaagttattttttttgtag

SEQ ID NO: 54716 - DNA, 357 bp, Artificial Sequence
  Description of Artificial Sequence: Synthetic coding sequence
atgcggtgggctctcctggtgctcttggcctttctctcacccgctagtcagaagtcgtcgaacctggaaggcaggaccaagagtgtgacacgacagacagggtcttctgccgagatcacgtgcgatctcaccgtcaccaatactttttacatacattggtacctgcatcaggaaggcaaggctccccaacgccttctctattatgatgtctctaccgcccgagacgtgctcgaatctggtctctcaccgggaaaatactatactcatacgcccaggcgctggtcttggatcttacggctgcagaatctaattgagaacgactcaggcgtttactactgcgccacttgggatcgatag

SEQ ID NO: 54717 - DNA, 816 bp, Artificial Sequence
  Description of Artificial Sequence: Synthetic coding sequence
atgattcctaagctcctttctctgctatgcttcagactgtgtgtgggacagggggatacccggggtgatggatcactgcctaagcctagcttgtccgcatggccatctagtgtcgtgccagccaactcaaacgtcacactgcggtgttggaccccggcacgcggtgtctccttcgtactccggaaaggcggtatcatcctcgagtctccaaagccactcgacagtacggagggagccgcagaatttcacttgaataacctgaaagtgagaaacgccggtgagtatacctgcgaatactacaggaaggccagcccacatattctgagccagagaagcgatgtactcttactgctggtcaccggacacttgagcaagccttttttgcggacttaccagagggggaccgtcacagcaggcggtcgcgtgactctccagtgccagaaacgcgatcagttgtttgtgccaatcatgttcgcccttcttaaagcaggcacacctagccccatccagctgcagtcacctgcagggaaagagatcgatttctcgttggtggacgtgactgccggtgacgcaggcaattacagttgtatgtactaccagaccaaaagcccgttctgggccagtgagcccagtgaccagctcgagatactggtcaccgtcccacctggaacaacgtctagcaactactccctcgggaacttcgtccggctcgggctggcagctgtgatcgtggtgatcatgggcgcttttctcgtcgaggcatggtacagtcggaacgtctcccccggagagagcgaagccttcaagcccgagtag

SEQ ID NO: 54718 - DNA, 840 bp, Artificial Sequence
  Description of Artificial Sequence: Synthetic coding sequence
atgaaggagagaaagaagaaggaaaggaaggaacgcaagaggaaaaaagagcgtaatggcctctgcgtggggcagggcgacactcggggagacgggtccctgccaaaaccaagtctctctgcctggcccagctctgtcgtgccagcgaattccaatgtgacccttagatgttggacacctgccagaggagtctcatttgtccttagaaagggagggattatccttgaaagtccaaaaccgctggactccactgaaggcgcagctgagttccatctgaataacctcaaagtgagaaatgctggagaatacacctgcgaatactataggaaagcctcgcctcacatcctatcacagcgtagcgatgtgctgctcctgctggtcaccggccatctaagcaaaccattcctgcggacataccaaaggggtactgtgacagcgggtggcagggtgacactgcagtgccagaagcgagatcagctgtttgtgcccattatgttcgcgttattgaaggcgggtacccccagcccgattcaactgcagagtcccgctggtaaagagatagactttagcctggtagacgtgacagccggtgacgctggaaattactcttgcatgtactaccaaaccaagagcccgttttgggcttcggagcccagcgatcagcttgaaatcctggttaccgttccacccggaaccacctcttcgaactactcattaggtaacttcgttcgactcggattggctgccgtcattgtcgtgattatgggggctttcctggtcgaagcttggtactcaaggaatgtgagccccggagagtcagaagcgttcaagcctgagtag

SEQ ID NO: 54719 - DNA, 951 bp, Artificial Sequence
  Description of Artificial Sequence: Synthetic coding sequence
atggctcttcagactcttcagtcctcctgggtgacctttcgaaagatcctaagtcacttcccagaggaactgtccctggcatttgtgtatggtagcggggtatataggcaagcaggccctagcagcgaccagaaaaacgccatgttggactttgtttttacagtcgacgatcccgtcgcttggcatagcaagaacttgaaaaagaattggagtcactattcgttcttgaaagtgctggggccaaagatcattacttctatccagaataattacggcgctggggtctactataattcactcatcatgtgcaatggtaggcttataaagtatggagtgataagcacaaacgtattgatagaggacctcttgaactggaataatctctacatcgccggtagactgcagaaaccggtgaaaataatctccgtcaatgaagatgtgacactacgatcagcccttgacagaaacctcaaaagtgccgtgactgccgcatttctgatgttacccgagagtttctccgaagaggatttgtttattgagatcgctggcctgtcatattctggcgacttccgaatggtagtaggcgaagataagacgaaggttttgaacatagtgaaacccaatattgcgcattttcgcgaattatacgggagtatcttacaggagaaccctcaagtggtctataagagtcaacaaggctggctggaaattgacaagtccccagagggacagtttactcagctcatgaccctgccgaagaccctgcagcaacagatcaatcacattatggaccccccagggaaaaaccgcgacgttgaagaaaccttgtttcaggtggcgcacgaccccgactgcggggacgtggtacggctgggactgaagaagtcggtgatatacagcagcctgaagcttcacaaaatgtggaagggatggctcaggaagacatcctag

SEQ ID NO: 54720 - DNA, 2190 bp, Artificial Sequence
  Description of Artificial Sequence: Synthetic coding sequence
atgcagagtacaagcaaccacctgtggctgctgtccgacatcttgggccagggggctacagcaaatgtgttccgaggcaggcacaagaaaaccggagacctgtttgctattaaggtcttcaacaatatctcctttttgcgaccagttgacgtacagatgcgggaattcgaagtgcttaagaaactgaaccacaagaatatcgttaaattgttcgcgatcgaagaggagacaaccacgaggcataaggtgttgatcatggaattctgtccgtgtggctcgctctacactgttctcgaagagccaagtaacgcttacggactccccgagagcgagttcctgattgtccttagggatgtggtgggcggaatgaatcatctcagagaaaacggcattgtccatcgcgacattaagcctggtaacataatgagggtgattggcgaggatggccagtcagtctataagctgaccgattttggagccgctcgcgaactcgaagatgatgaacagtttgtgagcctgtatggcacggaggagtacctccaccctgatatgtacgaacgtgccgtgctgaggaaggatcaccaaaagaagtatggcgcaaccgttgatctctggagtatcggtgttacattttaccacgccgctaccggcagcctgcctttccgccctttcgaaggaccgagaagaaataaggaagttatgtataagatcattacagggaagccctcaggggcaatttccggagtccagaaagccgagaacggacctatcgactggtctggtgacatgcctgtgtcatgctccctgtctcgcggattacaagttttattgacccctgtgcttgccaacatcctggaagcagatcaggagaagtgctggggtttcgatcagttcttcgcagaaacgtctgatatcctgcatcggatggtgattcacgtgttttctcttcagcagatgactgcccataaaatttacattcacagctataatactgctaccatctttcacgagctagtgtacaagcagaccaaaataatctcctctaaccaggagctgatttacgagggcagacgactggtgcttgagcccggaagattggcccagcacttccctaagaccactgaagaaaaccctatattcgtggtcagcagggaacccctcaacactatcggcctgatttatgaaaaaatcagtctgcctaaagtgcatcccagatacgatttagacggcgacgcatccatggccaaggccataactggtgtcgtgtgctatgcctgcaggatcgcgtcaactctgctgctgtatcaggaactgatgagaaaagggatccgatggctgatcgaactgattaaggatgattacaacgagacagtgcacaagaagactgaggtcgtcattacactcgacttctgtattcggaatattgaaaagactgtgaaagtatacgaaaagttgatgaagatcaacctggaggcagcagaactcggcgagatttctgacatacacacaaagctccttagattgtctagtagccaggggacaattgagacttccctgcaggatatagactcccggctgagtccgggtggatcacttgccgacgcctgggcacaccaggaagggacacatcccaaggaccgtaatgtggagaagctccaggtcctgcttaactgcatgaccgaaatctattaccagtttaagaaggacaaggcagagcgcaggttggcctataatgaagaacagatccacaagttcgacaaacaaaagctgtattaccatgccacgaaggccatgactcattttacagatgagtgtgtgaaaaagtatgaggcatttctcaataaatccgaggaatggataaggaagatgctccacttgaggaagcaactgttgagcctgacaaaccagtgtttcgatattgaggaggaagtgtccaaataccaggagtatacgaatgaacttcaagagaccctgccccaaaaaatgttcaccgcctcctcgggcattaagcacacgatgacacctatttacccgtccagtaacaccctggtggaaatgacgctagggatgaaaaagctgaaagaggagatggagggtgtggttaaggaactggcagagaacaatcacatccttgaaaggttcggaagcttgaccatggacgggggactacgtaatgtggactgcctttag

SEQ ID NO: 54721 - DNA, 312 bp, Artificial Sequence
  Description of Artificial Sequence: Synthetic coding sequence
atgcaaagtacgtccaatcatctttggctgctttctgatattcttggccaaggagcaaccgcaaatgtctttaggggacgacacaaaaagacaggggacttatttgccatcaaagtcttcaataatatcagctttttaaggcccgtggatgtccaaatgagggagttcgaagtcctgaagaaacttaatcacaaaaatattgtgaaactctttgccatcgaggaggagaccacgactaggcacaaggtgctcatcatggagttttgcccatgcggctcgctttatacagtcctggaggagccgtccaactag

SEQ ID NO: 54722 - DNA, 297 bp, Artificial Sequence
  Description of Artificial Sequence: Synthetic coding sequence
atgcagtcaaccagcaaccatctgtggttgctcagtgacattctgggacagggcgcaactgctaacgtattcaggggacgccataagaaaaccggagacctcttcgctatcaaagtgtttaataacatcagttttcttcgaccagtagacgtccaaatgagggaatttgaagtgctgaaaaaactcaaccacaagaatatagttaaactctttgctattgaggaagaaactaccactcggcacaaggtgttgatcatggagttttgcccttgtggttccttatataccgtcctttag

SEQ ID NO: 54723 - DNA, 924 bp, Artificial Sequence
  Description of Artificial Sequence: Synthetic coding sequence
atgcacgacgacgagtcaaccatcaacagtagcagctctgtggtccataaaaaagaccacgtattcatacgtgatgaagctgggcatggtgacccacgccctgagccaagacccacacagtcggttcaaagccaggccctccactataggaatcgtgaaagatttgcgacaataaaaagcgccagccttgtgaccaggcagattcatgagcatgaacaggagaacgaactcagggagcaaatgagtgggtacaaacggatgaggaggcagcaccaaaaacagctcattgccctggaaaataaattaaaggctgagatggatgagcaccgccttaaattgcagaaagaagtcgagacacatgctaacaacagctcaattgaacttgaaaagcttgcgaaaaagcaggtggccattattgagaaggaggccaaagtcgctgcggcagatgaaaagaagttccagcaacaaattctggcccagcaaaagaaagatcttactactttcctggagtctcaaaagaaacagtacaagatatgcaaggagaaaataaaggaagagatgaatgaagatcattccacacccaagaaggaaaagcaggagagaatctccaagcataaggagaatcttcagcatactcaagctgaggaagaggctcatctacttacacaacagcgtctctattatgacaagaactgcaggttcttcaaaaggaaaattatgatcaaaaggcacgaagtggaacagcagaatattcgtgaggaacttaataaaaagcgcaccgaaggggacggagcatgccatgccaatccagatgagtctacacgtgaactggagtatagacagttacataccctacagaaattgcatgggtccgaccccttcacagccccagacggcaccggaaagcctgccggtgtgcagtag

SEQ ID NO: 54724 - DNA, 2697 bp, Artificial Sequence
  Description of Artificial Sequence: Synthetic coding sequence
atgaggaaaggagtgctcaaagatccagagattgccgatctcttctataaggacgatccagaagaattgttcataggcttgcatgagatcggtcacgggtcctttggcgctgtgtacttcgcgacgaatgcacacaccagcgaggtggtggccataaagaagatgtcttactccgggaaacagacgcacgaaaagtggcaagacatccttaaggaggtcaaattcttaagacagctgaaacatccgaatacaatcgagtacaaaggatgttatctcaaagagcacaccgcttggctcgttatggagtactgtctgggttccgcctcggatctgcttgaagtccacaagaagcccctgcaggaggtggaaatcgctgctattacccacggcgcactgcacgggctcgcctatctacattctcatgcactcattcaccgcgatattaaggctgggaacatcttgttgacagaacccggtcaggttaaacttgcagattttggcagcgcctcaatggctagtccggctaatagtttcgtaggtacaccgtactggatggcccctgaggtgattttggcaatggacgaaggtcaatacgacggaaaagttgacatctggtcactaggaattacctgcattgagctggctgaacggaaacccccattatttaacatgaacgccatgagcgctctgtatcacattgcccagaatgattctcctactctgcagtccaatgagtggactgacagtttcagacgattcgtggactactgcctgcagaagattccccaggagaggcccacaagcgcagaactccttaggcacgatttcgtgaggagagaccgccctttgcgcgttctcattgacttaatccagaggaccaaagacgcagtcagggaattggacaatcttcagtaccggaagatgaaaaaaatcttgttccaggagaccaggaatgggccattaaatgagagccaagaagacgaagaagattctgagcacgggacttcactgaaccgcgaaatggattccctgggctccaaccatagcattcccagtatgtcagtttcgacaggaagccagtcaagttccgtgaactccatgcaggaagtcatggacgaatcatcttcagaacttgtgatgatgcacgatgatgaatcaactataaatagctcgtcatccgttgtgcacaaaaaagatcacgtgttcatacgggatgaggctggtcacggggatcctaggccagaacctagaccaactcagtcggttcagagccaggccctgcactacaggaaccgagagcggttcgccaccattaagtcggcatctctagtcaccagacaaatacatgaacatgagcaggaaaacgaattgcgcgaacagatgtctggttacaaaaggatgcgcagacagcaccagaaacagctcatcgcccttgagaacaaactaaaggctgagatggatgaacaccggctgaaacttcagaaggaggtggagacacatgctaataactcgtcgatcgagctcgagaaactggccaagaaacaagtggcaattatcgaaaaggaagcaaaagtcgccgctgccgacgaaaagaagtttcagcagcagattttggcacagcaaaagaaggatctgactactttcctggaaagccaaaaaaagcagtacaagatctgcaaggaaaaaatcaaggaggagatgaacgaagatcattcgacgccgaaaaaagagaagcaggagcggatcagtaagcacaaggagaatttgcagcatacccaggctgaggaagaggcccacctgctaacccagcagcggttgtactatgacaaaaactgcaggttttttaagaggaaaattatgataaagcgacatgaggtcgagcagcagaacatccgggaagaattgaacaagaaacggacgcagaaggagatggaacatgctatgctcattaggcacgacgagagcaccagggagctggagtatcggcagctgcataccctgcagaaacttcgtatggatctaattcgactccagcatcagaccgagctggaaaaccaactggaatataataagaggagagaacgggaattacatagaaagcacgttatggagcttaggcagcagcctaaaaacctcaaggcaatggagatgcagatcaaaaagcagttccaagacacctgcaaggtgcagacaaagcagtacaaggcactgaagaatcaccaactagaggtgactcctaagaatgaacataaaactattctgaagacacttaaagacgagcagacacgcaaactggctattctcgccgagcagtatgagcagtcaattaacgagatgatggccagccaggcgctgagactggacgaggctcaggaagcagagtgccaagccttacgcctgcagctgcaacaggaaatggaactcctaaatgcatatcagagcaaaatcaagatgcagactgaagcccaacatgagcgcgagctgcagaaactggagcagcgcgtgagtcttcggagagctcatctcgagcagaagatcgaggaagaactagccgcactgcagaaggagcggtcagaaaggattaaaaatctccttgaaaggcaggagagagagatcgagacctttgacatggagtctctgcgtatgggattcggcaatctggtgacgctggacttcccaaaggaagactatcgctag

SEQ ID NO: 54725 - DNA, 2697 bp, Artificial Sequence
  Description of Artificial Sequence: Synthetic coding sequence
atgcggaaaggtgtcctaaaggacccagagatagctgacctcttctataaggatgaccccgaggagctgttcatcgggctgcacgaaatcgggcatggttctttcggggcagtgtatttcgccacaaatgcccacaccagcgaagtggtggcaattaaaaaaatgagctattccggaaagcagacgcacgagaagtggcaggatatcctgaaggaggtcaaattccttagacaactcaaacatcctaacaccatcgagtacaagggctgttaccttaaggaacacactgcctggctcgttatggaatactgcctggggagtgcttcagatctgctcgaggttcacaagaagcctctacaggaagtggaaatcgctgctattacgcatggtgcgctgcacggcctggcttaccttcattcacacgctctgatacacagagacatcaaggccggaaacattttactgaccgagcccggacaagttaagttagcggattttggttccgccagcatggccagcccagctaattcctttgtgggaactccctattggatggcgcctgaagttatacttgcaatggatgagggacagtacgacggaaaggtggatatctggagcctagggattacatgcattgaactggcagaacgtaaacccccactatttaatatgaacgctatgagtgcactgtaccatattgctcagaatgatagccccaccttacagtcaaacgaatggaccgactctttccgccgttttgtagattactgtctccagaagataccccaggagcgcccaacttcggccgaattgctgcggcacgacttcgtgaggcgcgaccgccctcttcgggtacttatcgacctgatccagaggacgaaagacgccgtacgcgaacttgacaatctccaatatcggaagatgaaaaagatcttgtttcaggagaccagaaatggcccactaaatgagagccaggaggacgaagaggatagcgaacacggaacatcactgaatcgagagatggacagtctgggctccaaccatagcattccttcaatgagcgtttcgacagggtcacagtcctcctccgtgaactccatgcaagaagtcatggacgagtctagctccgagttggttatgatgcatgatgacgagagcacaatcaactccagctcttccgtcgttcataaaaaagaccacgtttttattagggacgaggccggtcacggcgacccaagaccagaacctcgccctacccagtcagtgcagtcacaggcccttcactacaggaaccgggagagattcgccacaataaaatctgcttccctggtgaccagacagattcatgagcacgagcaggagaatgaacttagggagcaaatgagcgggtacaagagaatgcggaggcagcatcaaaaacagttaatcgcactggagaacaaacttaaggctgagatggacgaacaccgactgaaactccagaaagaggtggagactcacgcaaataactcttcaatcgagctcgaaaaactggccaagaagcaggtggcgatcatagagaaggaggcaaaagtggctgcagctgacgagaaaaaatttcagcaacagattctcgcacagcagaaaaaggaccttaccacctttctagaaagtcaaaagaaacagtacaaaatctgcaaagagaagataaaggaagagatgaacgaagaccacagtaccccaaaaaaggagaagcaggaacgaatttccaagcacaaggaaaacctgcagcacacgcaggctgaggaggaagctcacttactgacccagcaacggctctactacgacaaaaactgtcgcttctttaagcgcaagattatgattaaaaggcacgaggtggagcagcagaatatccgcgaggagttgaacaaaaaaagaactcagaaggagatggagcacgcgatgctcattcgtcatgatgaatcgacaagagaattggaataccggcagcttcatactctgcagaagctccgcatggatctaatacgtctgcagcaccagaccgaactcgagaaccagttggagtacaataagcgcagagagagagagctacacagaaagcatgttatggaattgaggcaacagcctaaaaacctgaaagcaatggagatgcaaatcaaaaagcaatttcaggacacctgcaaagtgcagacaaaacagtacaaagcgctgaagaatcatcaacttgaagttacacccaaaaacgaacacaagactatattgaaaactcttaaggatgagcagacaaggaagcttgctatcctggccgagcagtacgagcagagtattaacgagatgatggcatctcaggcgctacgactggatgaagcccaggaagccgagtgtcaagcacttcgacttcagcttcaacaagagatggaactgttaaatgcatatcagtcgaaaatcaagatgcagacagaagcacaacacgagagggagttgcagaaactggaacagcgggtgtccctgcgaagggcgcatctggagcagaagatagaggaagagctcgcagctttgcagaaagagaggtccgagcgtattaagaatcttctcgagcggcaggagagggaaatcgagactttcgacatggagtcccttaggatgggattcggaaatcttgtgaccctggatttccctaaggaggactacagatag

SEQ ID NO: 54726 - DNA, 411 bp, Artificial Sequence
  Description of Artificial Sequence: Synthetic coding sequence
atgagaaaaggagtgctcaaggatccagagattgccgatctgttttataaagatgaccccgaggaactgttcatcggactgcacgagattggacatggctccttcggggctgtttattttgccactaacgcgcacacctccgaagttgtggctattaagaagatgtcctattccggtaagcaaacccacgaaaagtggcaggacatcctcaaagaggttaagtttttacgacaattgaaacacccaaatactatcgagtacaaggggtgttacctgaaggagcatacggcctggctcgtaatggagtactgccttggctcggcttcagaccttttggaagtccataaaaagcccctgcaggaggtggaaattgcagccattactcacggcgctctccacggcctcgcatag

SEQ ID NO: 54727 - DNA, 57 bp, Artificial Sequence
  Description of Artificial Sequence: Synthetic coding sequence
atgcggaagggagttctaaaggatccagagatcgccgatttattctataaagactag

SEQ ID NO: 54728 - DNA, 282 bp, Artificial Sequence
  Description of Artificial Sequence: Synthetic coding sequence
atgagaaagggagtgctgaaggatcccgagatagctgacctgttctataaagacgatcctgaggagttgttcatagggctgcacgaaattggacatggtagtttcggtgctgtgtattttgcaacaaatgcccacacttctgaagtcgtggctattaaaaagatgtcctactccggcaagcagactcatgaaaaatggcaggacatcctgaaggaggttaagttcttgcgtcagctcaagcaccccaatactatcgagtacaaaggttgttacttgaaatag

SEQ ID NO: 54729 - DNA, 66 bp, Artificial Sequence
  Description of Artificial Sequence: Synthetic coding sequence
atgcggaagggcgttctgaaggacccggagatcgctgatttattttataaagacgatcctgagtag

SEQ ID NO: 54730 - DNA, 189 bp, Artificial Sequence
  Description of Artificial Sequence: Synthetic coding sequence
atgcgcaagggtgtgcttaaggacccagagatcgcagatctcttctacaaagacgatccagaggaattgttcatcggactgcatgagatcggtcacggcagttttggcgcagtatattttgccacgaatgcacacacctccgaagtcgtcgctatcaagaagatgtcgtacagcggaaagcaaacctag

SEQ ID NO: 54731 - DNA, 111 bp, Artificial Sequence
  Description of Artificial Sequence: Synthetic coding sequence
atgagaaagggagttcttaaggatcccgagattgcggacctgttctataaggatgatcctgaggagttgttcattggcctacacgaaatcggacacggttcttttggctag

SEQ ID NO: 54732 - DNA, 174 bp, Artificial Sequence
  Description of Artificial Sequence: Synthetic coding sequence
atgcggaaaggtgtcctgaaggaccctgaaattgccgacttattctacaaggatgaccccgaggagttgtttatcggcctgcatgaaatcgggcatgggagttttggcgctgtctatttcgccactaacgctcatacctcagaagtcgtggcgatcaaaaaaatgagctactag

SEQ ID NO: 54733 - DNA, 1407 bp, Artificial Sequence
  Description of Artificial Sequence: Synthetic coding sequence
atgggaactcaggagggttggtgcctgctcctttgtctcgccttaagtggagcagccgagactaaaccacacccagccgaaggccaatggcgtgccgtggatgtggtcttagattgtttcctcgccaaggatggggctcatcggggagcccttgcttcctctgaagatcgagctcgcgcaagtttggttttgaagcaggtgcccgtgctggatgatgggtcactagaagacttcaccgacttccaaggtggaaccctcgcacaggatgacccacctattatcttcgaggcttccgtcgatttggtccagattccgcaggccgaagctcttctccacgctgattgttcaggaaaggaagtgacgtgtgagattagccgctattttttgcagatgaccgagaccacggtaaagaccgctgcttggtttatggctaatatgcaggtttccggcggaggaccaagcattagcctagtcatgaaaacccctcgtgtaacaaaaaacgaggcattatggcaccccacattaaatttgcctctgagtccccagggcaccgtgcgcacagccgtggagtttcaggtgatgacacagacccagtctcttagttttctcctaggctcttctgcttctcttgactgcggtttcagtatggcacccggactggatctgatctctgtggaatggagactccagcataagggtagaggacagttggtctactcctggacagccggacagggacaggcagtgcgtaagggcgctactctcgaaccagcgcagctagggatggccagggacgctagtttgaccctcccaggactcaccatacaggacgaggggacgtacatttgccagatcacgactagcttatatagggcgcagcagatcattcagctgaatatccaggcatcacccaaggtcagattatcactagctaatgaggctctgcttcctaccctgatctgcgacatcgctggatactatcccttggatgtggtcgtgacttggacccgggaagaattaggaggcagtccagcacaggtttcgggggcaagcttctcctccctgcgccagtctgtggccggaacttacagcatttcgtcttcgttaacagctgagcccggatccgcaggtgcgacctatacttgtcaggtaactcacatttctctcgaggaaccgttaggagccagtacccaagtggtcccccctgaaagacggactgcactcggcgtcatttttgctagctctctcttcttattggctctcatgttccttggcctccagcggagacaggcccctacggggttgggcctgttgcaagctgagcgttgggaaacaactagctgtgcagacacccaaagcagccatctccacgaggacagaactgctcgcgtgtctcagcctagctag

SEQ ID NO: 54734 - DNA, 1200 bp, Artificial Sequence
  Description of Artificial Sequence: Synthetic coding sequence
atgtgtgttcagaattgtggacccagctttcaaagtctgatcgtgaaaaaagagtttgtgaaagaaaatctggttaaactcctcaatccacggtacaatttgcctttggacatccagaacaggatcttaaacttcattaaaacctggtcacaggggtttcctggaggtgttgatgtgagcgaagttaaggaagtttatctggacctggtgaagaaaggcgtccagtttcctcccagtgaagcagaagctgaaactgctcgccaggagacagctcaaatttcatcaaacccccctactagcgtgcccacagcacctgcactgagttcggttatagcacctaagaactccaccgttacactagtgcccgagcaaatcggaaaactacattcagaactggatatggtgaagatgaatgtacgcgtgatgtctgccatcctgatggagaacaccccaggctccgagaatcatgaagatatcgagcttctgcagaagctctataagaccgggcgtgagatgcaggaacggatcatggacctgttggtcgtagtagagaatgaagatgtgacagtggagctgatccaggttaacgaagacctcaacaacgcgattttgggttacgaacgctttactagaaatcaacagcgcatcctggagcagaacaagaatcagaaagaagcaaccaacacaacttccgaaccttccgcacctagccaggatctgctcgatctgtcacctagtccaagaatgccccgagcgaccctcggggaacttaacactatgaataaccagttgagtggcctcaacttcagtttgccgagctccgatgtgaccaataacctcaagcctagcctgcatcctcagatgaacttgctggctttagagaacacagagattccgccttttgcccaacgcacgtcccaaaacttaacaagctctcatgcttatgacaatttcctcgaacattcaaactcagtatttctacaacccgtctccctgcaaaccattgctgcggctccgagcaatcaaagcctgccccctctcccctcaaaccaccccgctatgacaaagagtgatctccagccgcctaactactacgaggtgatggagtttgatcctttagcccctgcagtgactacagaagccatctatgaggaaattgacgcacaccagcacaagggcgctcagaacgatggagattag

SEQ ID NO: 54735 - DNA, 1431 bp, Artificial Sequence
  Description of Artificial Sequence: Synthetic coding sequence
atggccttcggcaagagccacagagacccgtacgcaacgagcgtaggtcatctgatcgagaaagcaacttttgctggtgtgcaaactgaagattggggtcagtttatgcacatatgtgacatcatcaacacgacgcaggatggacctaaagatgcggtgaaagctctgaagaagcggatctcaaagaactacaaccataaggaaattcagttgaccctgtcgctgatcgacatgtgcgtgcagaactgtggaccgtcatttcagagcttaatcgttaagaaagagttcgttaaggaaaacctggtgaagttgttgaaccctcggtacaatctgcccctcgatatccagaatcgcatattaaatttcatcaagacttggagtcagggcttcccgggaggagtggacgtatcggaggtgaaggaggtatatctcgatctcgttaaaaaaggcgttcagttcccaccctcggaagccgaggccgaaaccgctagacaagagaccgctcagattagctcaaatccccctacctcagtgcccaccgcccctgctctgagctctgtgatagcaccgaaaaattcaaccgtgacactagtgcctgaacagattggcaagctgcactctgaactcgacatggtgaagatgaacgtgcgggtgatgagcgcgatcctgatggaaaatactcccggatcagagaaccacgaggatatagagctcctgcagaaactgtacaagacaggtagagagatgcaagagcgaattatggacttgctggtcgtcgtggaaaatgaagacgtgaccgtggaactgattcaagtcaatgaggatttgaacaatgctattcttgggtatgagcgctttactcggaatcagcagcggatcctggagcaaaataagaaccaaaaggaggccaccaatacaacttcggaacctagtgccccatcgcaagacctgctagatctgtccccctcaccccgaatgccaagggcaacccttggagagttaaacactatgaataaccaactatctggactgaatttttcactgccaagctcagatgtgacaaacaatctcaagcctagtttacatccccagatgaatttgctcgccctggaaaacacagagatcccgccattcgcacagaggacttctcaaaatctaacatcctctcacgcttatgacaactttctggagcactctaactctgtgttccttcagccagtcagcctgcagacaatcgccgcagcaccaagtaaccagtcactgccaccactgcccagtaatcatcctgcaatgacaaaatcagacctccagcccccaaattattatgaggtcatggaatttgacccgttggccccagccgtgaccaccgaagccatctatgaagagatcgacgcacatcagcataaaggagcgcagaacgacggagactag

SEQ ID NO: 54736 - DNA, 1200 bp, Artificial Sequence
  Description of Artificial Sequence: Synthetic coding sequence
atgtgcgtccagaattgcgggccaagctttcagagccttatcgtgaaaaaagaattcgtaaaggagaacctggtgaagctcctcaatcctcgctataacttgcctctggacattcagaacaggatcctaaatttcatcaaaacttggtctcaagggtttcccggtggagtcgatgtaagtgaggtgaaagaagtctatctggatctagtgaagaagggagtacaattccccccttccgaagccgaagctgagaccgctagacaggaaaccgcacagatctcatctaatcccccaaccagcgtgcctactgccccagcgctgagctctgtgattgccccaaagaattcaaccgtcacattggtgcccgaacagattggcaagctgcactccgaactggatatggtgaagatgaatgtgcgcgtgatgtccgccatacttatggagaatacccccggatccgagaaccatgaagacatcgagttattacagaagctgtacaagaccgggagagagatgcaggaaagaatcatggacctgctcgtggttgttgaaaacgaagacgttaccgtggaattaattcaggtcaacgaggacctaaataacgccattctcggatacgagcggtttacaagaaaccagcagaggattctggaacagaacaagaaccagaaggaagccaccaacaccaccagcgagccttctgcgccttcccaggacttattagatcttagcccctcacctcgcatgccccgagccactctcggagagctcaacaccatgaacaaccagttgagtggactgaatttttcactcccctccagtgatgttactaacaacctcaagccctccttacatccccaaatgaacctgctggccctggagaatacggaaatcccaccctttgcacagagaacaagccagaacctgacctcgtctcacgcttatgacaacttcctcgaacactcaaactccgtctttttgcagcctgtgtccctgcaaacgattgctgctgcaccatcaaaccagtccctgcctcccctgccaagcaatcaccccgcaatgaccaaatctgatctgcagccccctaattattacgaagtgatggagttcgaccctctggcccctgccgtcacgactgaggccatctatgaagaaatcgacgcccatcagcataagggagcccagaacgatggtgattag

SEQ ID NO: 54737 - DNA, 1095 bp, Artificial Sequence
  Description of Artificial Sequence: Synthetic coding sequence
atgtgtgtgcagaactgcgggccaagttttcagtcccttatagtgaagaaggagttcgtgaaggagaatttagtgaaactgttgaaccccaggtacaaccttcccttggacatacagaatcggatcctcaatttcatcaagacatggtcacagggattccccggaggcgtggacgtatcggaagtgaaagaagtgtatctagatctcgtgaaaaagggagttcagttcccaccctccgaggcggaggccgaaacagctagacaggaaataggtaaattacatagtgagctagatatggtgaaaatgaacgttagggtcatgtccgcaatcctaatggaaaacactccaggaagcgagaaccacgaggatatcgagctgttgcagaaactatataaaacaggaagagaaatgcaggagcgcatcatggaccttctggtggtggtggagaatgaggacgtcaccgtggagctgatccaagtgaacgaggatcttaataacgctatcttgggctatgagaggtttactcgaaatcagcagcgcatcctcgagcagaacaagaatcaaaaagaagccactaataccacttctgagccatcggccccttctcaggacctgctcgatttgagcccgtctcctcgcatgccgagagccacacttggggagctgaacaccatgaacaatcagctgtccgggctgaatttttccctcccgtctagtgatgtcacaaataacctgaagccctccctccatccccagatgaatctgcttgccctggagaataccgagattccaccctttgcacagcgaacttcacagaacctcaccagttctcacgcttacgacaactttctcgagcactccaattcagtcttcctccagcccgtgagcctccaaacaattgccgctgccccttccaatcagtcattgcctcctctacccagcaatcacccagccatgacgaaatcggatttgcagcccccaaattactacgaggtcatggagtttgacccgttggctcctgccgttactactgaggccatatacgaagaaattgacgcccatcagcacaagggggctcagaatgacggtgattag

SEQ ID NO: 54738 - DNA, 1431 bp, Artificial Sequence
  Description of Artificial Sequence: Synthetic coding sequence
atggcctttggcaaatcacatagggatccttatgctacttctgtgggccacctgattgagaaggcgacctttgccggagtgcagacggaggattggggacagttcatgcacatttgcgatattattaacactacccaggacggccctaaagacgctgtgaaggctttaaaaaaaaggatctccaagaattacaatcacaaagaaattcagctaaccctgtcactcatcgatatgtgtgtgcagaattgtggcccttcgttccagtcactgatcgtcaaaaaggaatttgtgaaagaaaaccttgtcaaactcctcaacccgaggtacaacctgcccctggatattcagaacaggatactgaactttattaaaacttggtcccagggattccctggtggggtggatgtgagcgaagtgaaagaggtttatctggatctggtgaagaagggagttcaatttcctcccagcgaagctgaagcagaaacagctaggcaagaaaccgcccagatatcgagtaatccccctactagcgtccctaccgccccagccctgtcaagcgttatcgcgccaaaaaatagcactgttaccctggtccccgagcagattggcaagttgcacagcgagttggacatggtgaagatgaatgttcgcgtgatgtccgcaattctaatggagaacacaccgggatccgagaatcatgaagacatcgagctgcttcagaagctgtacaagaccggccgtgaaatgcaggagagaataatggatctgcttgttgtggtggaaaacgaagacgtcaccgtcgagctcattcaggtgaatgaagacctgaacaatgccatccttggctatgagcgctttactaggaaccagcagcgcatcctggagcaaaataagaaccaaaaagaggctacaaacaccacctccgagccaagcgccccatcccaagacctcctggacctgtccccgagccccaggatgccccgagccacccttggggaactcaacacaatgaacaaccaactgtcaggactgaactttagcctgcccagcagcgatgtcactaacaatctgaagcccagcctacacccccaaatgaacttgctggctctcgagaacaccgaaattcctccttttgctcagagaacctctcagaatctaacctcctcccacgcctatgacaacttcctagagcacagcaactctgtatttttgcagcccgtgagccttcagacaattgcggcagctccttccaatcaatcgctgccaccattacctagtaatcacccagcaatgacaaagtcggatttgcaaccgcctaattactatgaagtgatggagtttgaccccctcgctccggctgtgacaaccgaggcaatatatgaagaaatcgacgcacaccagcacaaaggcgcacagaacgacggtgattag

SEQ ID NO: 54739 - DNA, 900 bp, Artificial Sequence
  Description of Artificial Sequence: Synthetic coding sequence
atgctcgaaagccacctgatcatatatttcctccttgccgtgatccaatttctgctgggcattttcaccaatggtattatagtggtggtcaatggaatcgatttaattaagcaccggaaaatggcccctcttgatttgctgctcagctgcctggccgtgagtcgcatcttcttgcaactgtttattttttatgtaaatgtcattgtgattttctttattgaattcatcatgtgctcagctaactgcgcaattcttctgtttattaacgagctcgagttgtggctggcgacttggttaggtgttttctattgcgcaaaagtagctagtgtgcggcacccccttttcatatggttgaagatgcggatcagcaagctcgtgccttggatgatactgggcagtctgctctatgtaagtatgatctgtgtctttcattcaaagtatgcaggttttatggtgccatactttctgcggaagttcttctctcagaatgccacgattcaaaaagaggacactctggctatacaaatctttagcttcgtggctgagttctccgtccccctgcttatcttcctgttcgccgttctactattaatcttctcgctgggacgccatacgagacaaatgcgtaacactgtcgcagggagtagagtcccaggacgaggcgctcctatcagcgctctgctgtccatcctgagtttcctcatcctgtactttagccactgcatgattaaggtgttcctgtcctctttgaagtttcacatcaggcgctttattttcctgttctttatactggtgatcggcatttatccgtcaggacactccttgatccttatcttaggaaacccaaaactgaaacagaatgctaagaagtttctgctgcacagtaaatgttgccagtag

SEQ ID NO: 54740 - DNA, 924 bp, Artificial Sequence
  Description of Artificial Sequence: Synthetic coding sequence
atgctccgagtagtggagggcatctttatctttgttgtagtctccgagagcgtctttggcgttctgggcaacggtttcatcggcctggttaactgcatcgattgtgccaagaataagcttagcacaattggttttatccttaccggactagccatctcccgcatctttctgatctggataatcattacagacggatttatccagatctttagccccaatatctacgcctcgggaaacttgatagagtatattagctatttttgggttatcggaaaccagagttccatgtggtttgctacttccctttccatcttctacttcttaaaaatcgctaatttttccaactacattttcctctggctgaagagtcgcaccaacatggtgctgccctttatgatcgtgttcctgctgatttcttccctgcttaattttgcctacattgccaaaatactgaatgattataagacaaaaaatgatactgtgtgggacttgaacatgtacaagagtgagtacttcattaagcagatccttctcaatctgggggtgatcttcttttttacgcttagtctcatcacatgtatttttcttatcatatcactttggcgtcacaatcggcaaatgcagagcaacgtaactggcctgagggactctaataccgaagcccacgtcaaagcgatgaaagtgctcatttctttcattatcctgttcatcctttattttattggcatggctattgagatcagctgctttaccgtgagagaaaacaagttgctccttatgttcggcatgaccacaacagccatatatccttggggacattccttcatactcatccttggcaacagtaagctcaagcaggcctccctgcgtgtcctgcaacaactgaagtgttgtgagaaaaggaaaaacctgcgcgttacttag

SEQ ID NO: 54741 - DNA, 912 bp, Artificial Sequence
  Description of Artificial Sequence: Synthetic coding sequence
atggagtctgccctgccatccatatttaccctggtgatcattgctgaattcatcatcggaaacctttccaatggatttattgtgctgatcaattgcatcgattgggtcagcaagcgtgagttgagttctgtcgataagctgctgatcatattggctataagccgtatcgggctgatctgggagatccttgtctcgtggttcctcgctctgcactacctagctattttcgtctccgggactggactgcgcattatgattttcagctggattgtttctaaccacttcaatctgtggctcgcaaccattttctcaatcttctaccttttgaaaatagcttccttttccagccccgcttttttataccttaagtggcgagtgaataaggtgatcctgatgattttgctgggtacgctggtattcctgttcctgaacctcattcaaattaatatgcacattaaggattggttagataggtatgagcggaatactacctggaattttagtatgtctgattttgaaactttttctgttagtgtaaagttcacaatgactatgttctcactgacgccctttaccgtcgccttcatttccttcctgctgctcattttcagtttacagaagcacctccagaaaatgcaactgaattataaagggcatcgagatccacggacaaaggtccacactaatgccctgaagattgtgatcagctttttacttttttatgcttcctttttcctctgcgtgctgataagttggatcagtgagctgtaccagaacacggtgatctacatgttatgcgaaacaatcggtgtcttcagcccatcttcccactccttccttcttattttgggcaatgcgaagctgaggcaggccttcctcctagtggctgccaaggtttgggctaagcggtag

SEQ ID NO: 54742 - DNA, 954 bp, Artificial Sequence
  Description of Artificial Sequence: Synthetic coding sequence
atgggaggagtaattaaatcaatcttcaccttcgtgctcattgtcgagtttatcattggaaatctcggcaactccttcatcgctctggtgaactgcattgattgggtcaaaggccgtaaaattagctctgtggatcggattcttaccgcactggcaatcagtcgcatatcgcttgtgtggctgattttcggctcgtggtgcgtttcggtgttctttcctgcactgtttgccacagagaagatgttccggatgttaacaaacatatggacagtgataaatcacttcagtgtatggcttgcgaccgggctcggcactttttatttcctgaaaattgccaacttctctaacagtatctttctctatcttaagtggcgcgtgaagaaggtggtactggtccttctgctggttacatcagtgtttctgtttctgaacattgctctgatcaatattcacattaacgctagcataaacggatatcggagaaacaagacatgttcgtcagatagctccaatttcaccaggttctcctctctgatagtgctcacaagcaccgttttcatcttcatcccctttactctgtccctggccatgtttctgctgctgatttttagcatgtggaagcatcgaaaaaaaatgcaacacactgtgaagattagtggcgacgcctcaactaaggctcaccggggtgtcaaatcagtgattaccttctttcttttatacgccatcttcagcttaagctttttcatcagtgtgtggacaagcgaacgtcttgaagaaaacctcataatcttatctcaggtaatggggatggcctatccttcatgccattcctgtgtgttgatcctaggtaataaaaagctaagacaggcgagtctgtctgtgctgttgtggctcaggtatatgtttaaggacggagagccatcaggccacaaagaattcagagagtccagctag

SEQ ID NO: 54743 - DNA, 1017 bp, Artificial Sequence
  Description of Artificial Sequence: Synthetic coding sequence
atgctcgggagatgctttcccccagatacaaaagaaaagcagcaactgcgcatgactaaactgtgtgacccggctgagtctgagctgtctccattcctcattacgctcatactggcagtccttctagccgagtatctgatcggcattatagccaacggatttataatggctatccacgccgcagaatgggtgcagaataaggccgtgtccaccagtggccgtattctggtgtttctatcagtatctcgaattgccctgcagtccctaatgatgttagaaataactattagcagcactagtctctctttctactccgaggacgccgtgtattatgccttcaaaatctctttcatcttcctgaacttctgcagcctgtggttcgccgcttggctgtccttcttttacttcgtgaaaatcgctaactttagttaccccctcttcctaaagctgagatggagaattaccgggctgatcccatggctcttgtggctctccgttttcatatcattcagtcatagcatgttttgcatcaacatctgcacggtgtactgtaataactcttttccaatccactcatcaaactccacaaagaagacctatctgagtgagattaacgtggtgggactagccttcttcttcaacctgggcatagtgacaccactgataatgtttatactaacagcaaccctgcttatccttagcctgaaacggcacacattacatatggggagcaacgcaacaggcagtaatgatccctccatggaggcacacatgggtgccattaaagccatctcctattttctaattctgtacatttttaatgccgtcgcactgttcatctatctttcaaacatgttcgatatcaactccctttggaataacctctgtcagattattatggccgcatatccagccagccacagcatcctactcatccaggataacccgggtctgcgaagggcttggaagaggctccagctgaggttacacctttatccaaaggagtggaccctctag

SEQ ID NO: 54744 - DNA, 957 bp, Artificial Sequence
  Description of Artificial Sequence: Synthetic coding sequence
atggctgacaaggtgcaaaccacactgctgtttctcgccgtgggcgagttctccgtaggcatactagggaacgcgttcatcggacttgtgaactgtatggattgggtgaaaaagcggaagatcgccagcattgacttgatcctaacctcactcgcaatttcccgcatttgcttactttgtgtcatacttctagactgctttatcttggtgttatatcccgatgtgtatgccacaggcaaggagatgagaatcatagacttcttctggaccctgaccaaccacctgagtatctggttcgctacttgcttgagcatctactacttttttaagatcggtaacttttttcatccactgtttttgtggatgaagtggcgtattgaccgggtgataagctggatcttgcttggatgtgtcgtgctcagtgtgttcattagtctgccagccacagaaaatttaaacgccgattttcggttctgcgtgaaggccaaaagaaaaaccaacctcacctggagttgccgcgtgaacaaaacccaacatgcctcaacaaagctttttttgaatctagctactctgttgccgttttgtgtgtgtctgatgtccttcttcttgctgatactgtctcttcggcgtcatatcagacgcatgcagctttctgccactgggtgccgggacccgtcaacagaagcccatgtgcgggctttgaaagccgtgatttcattcctgctgctgttcattgcatactacctgtctttcctcatcgctacttcctcatactttatgcccgagacagagctcgcagtcattttcggcgagtcgatagccctaatttacccatcctcgcactcttttatacttattttaggcaacaacaaacttaggcatgcctcactgaaagtaatttggaaagtgatgagcatacttaagggtcgcaaattccaacagcacaagcagatctag

SEQ ID NO: 54745 - DNA, 930 bp, Artificial Sequence
  Description of Artificial Sequence: Synthetic coding sequence
atgttttcacctgcagacaatatttttatcattctaataaccggagaatttatcttggggatcctgggtaatgggtatattgccctagttaattggatcgactggatcaagaaaaagaagatcagtaccgttgactatattcttactaatttagtgatagcgagaatttgtttgatctcagtgatggttgtgaatggcatcgtcatagttctgaaccctgatgtgtacaccaaaaataaacagcagattgtgatttttaccttctggaccttcgcaaactacttgaacatgtggataacaacgtgtctgaatgttttctactttctgaagatcgcctccagctctcatcctttattcctgtggctcaagtggaaaatcgatatggtcgttcattggatacttctgggttgttttgcaataagtctcctcgtatcattgatcgctgctatagtcctgagctgcgactataggtttcacgccattgcaaagcacaagcgcaatataacagagatgttccacgtgagcaaaattccatattttgagccactgaccctcttcaatttgttcgcgatcgtgcccttcatcgtgtccctcattagcttcttcctcctcgtccgctcattatggaggcacactaaacagattaagctctatgccacaggttctagggacccgagcaccgaagtgcatgtgagggccatcaaaaccatgactagcttcatcttcttttttttcctatattatatcagttcaattttaatgactttctcttacctgatgaccaagtacaagctggcagttgaatttggtgagatcgcagccatcctctatcctcttgggcacagtctgattcttatcgttctgaataacaagttgcggcaaaccttcgtgcgcatgttaacctgccggaagattgcttgcatgatctag

SEQ ID NO: 54746 - DNA, 939 bp, Artificial Sequence
  Description of Artificial Sequence: Synthetic coding sequence
atgccatctgccatcgaagctatctatattattctgatcgcaggtgagcttaccattggaatctgggggaacgggttcatcgtgctcgtgaactgtatagactggttgaagagaagagatatttctctgatagatatcattttaatctcactggcgatctccagaatatgtctcctgtgtgtcatctcactagacggattttttatgcttctctttcctggcacctatggcaattctgtcctagtttccatcgtgaacgtggtgtggacattcgcaaataactctagcctctggttcaccagctgtctctctatattttatctgctgaaaatcgcgaatatttcccacccattctttttctggctgaagctcaaaataaacaaggtgatgctcgccatcctcctgggttcatttctcataagtctgattatctcagtaccaaagaatgatgacatgtggtaccacctcttcaaagtgtcccacgaggaaaatattacctggaaatttaaagtatcgaagatcccaggtaccttcaagcagctcactctgaacctgggcgttatggttccctttattctgtgtctcatttcttttttcctgcttctttttagcctcgtgcggcacaccaaacagatccggctgcatgcaacaggcttccgtgacccgagcaccgaggcccacatgcgggcaatcaaggccgtcatcatttttctcctactgcttatagtttactaccctgtcttcttggtgatgacaagtagtgccttgattccacaggggaaactcgtcctgatgataggcgatatcgtgaccgttattttccccagttctcactcttttatcttgattatgggcaactctaaactgcgggaggcttttttaaagatgctcagatttgtgaaatgctttttgcgacggcgaaagccgttcgtgccttag

SEQ ID NO: 54747 - DNA, 3702 bp, Artificial Sequence
  Description of Artificial Sequence: Synthetic coding sequence
atgtggctgtcacccgaggaagtgctggtcgcaaacgccctgtgggtcacagaacgggctaacccttttttcgttctccaacgcagacggggacatggccgaggaggaggcctcactggccttctcgtgggcacactagacgtagtgcttgattcttctgctcgcgtcgcgccatataggattctgcaccagacgcaggattcgcaggtgtactggaccgtggcttgtggctcgtcacggaaagagattacaaagcactgggagtggttagaaaacaacctgttacagaccctgtctatctttgattccgaggaagatatcaccacattcgttaaaggtaagattcatggaatcatcgcagaggagaacaagaatttgcagccccagggagacgaagaccctggtaaattcaaggaagcagaactaaaaatgcggaagcagtttggtatgcctgaaggggaaaaactcgttaactattactcttgctcatactggaagggacgtgttcctagacagggttggttgtacctgacagtgaatcatctctgtttctactcgttcctactcggaaaagaagtaagccttgtggtccaatgggtggatattacccgcctggagaagaacgccaccttactcttcccggaaagtatacgggtcgacacacgcgatcaagaactattcttctctatgttcctgaatataggggagactttcaaactgatggagcaattggctaacctagctatgcggcagctgctggactccgaggggttcctcgaagataaggcgctccccaggccaattagacctcatagaaatatatccgcccttaagagggacttggacgccagagctaagaacgaatgctaccgggcaacattcagactgccacgcgacgagagactggacgggcatacatcctgtactttgtggaccccgtttaacaaattgcacattccgggacagatgttcatctccaataactatatctgcttcgcttcaaaagaagaagacgcatgtcatctgataattccgctccgggaagtgacaatcgtggaaaaagcagacagcagctctgtgctgccatcacccctatccatttcaacaaagtctaaaatgaccttcttattcgcaaacctgaaggaccgcgacttcctagtgcagaggatatcggatttcctacaaaagacacccagcaagcaacccggttctatcggctcacgcaaagcgtctgtagtagatcccagcacagagagctctcctgccccacaggagggcagtgaacagcccgcatctcccgcatccccattgagctccagacagagcttctgtgctcaggaggccccaacagccagccaaggtctgttgaagctgtttcagaaaaactcacctatggaagacctgggggcaaagggagctaaagaaaaaatgaaagaggaatcgtggcacattcacttttttgaatacggtcgtggcgtttgtatgtaccggacagcaaaaacccgggcattggtgctcaaggggattccggagagcctgcgcggtgaactgtggctcctgttttctggggcttggaacgagatggtgacacaccccggatattacgcggagcttgtcgagaagtccaccggaaaatactcactcgcaactgaagaaatcgagagggaccttcatcgctcaatgccagagcaccccgcattccagaatgaactgggtattgccgctctgcgccgtgtactaacagcgtatgcttttcgaaatcctactattggatactgccaggcgatgaacatcgttacgtctgtgctgctgttatatggcagcgaagaagaagctttctggctgctggtggcgctgtgtgagcgcatgttgccggactattacaacacacgagtcgtgggcgctctggttgatcagggaatattcgaagagctcaccagggactttcttcctcaactcagtgaaaaaatgcaggatttgggagtgatcagcagcataagtctgtcatggttcctaacactctttttatccgtgatgccctttgagtctgcagtggtaattgtggactgcttcttctacgaaggtattaaagtgatactgcaggtagccctggccgtgctggatgccaacatggaacagctgctcggctgtagtgatgagggagaggcgatgacaatgttgggtagataccttgacaatgtcgtgaataagcaaagtgtgagcccgccaatccctcaccttcgtgctcttttgtcctctagtgatgatccccctgctgaagtggatattttcgagctgttgaaggtgtcctacgaaaaattctcctcattgcgggcagaggacatcgaacagatgcgatttaagcaacggctgaaagtgatccagtcattggaggacaccgctaaaaggagcgtggttcgtgctattcctgtagacatcggcttcagtatagaagagctggaggacttatacatggtgttcaaggccaagcatctggcctcccagtattggggatgcagccgcactatggccggtcggagagatccttctctcccctacctagaacagtatcggatagatgcctcacagtttcgcgaactctttgccagcttgaccccctgggcttgcggcagccatacacccctgctggctggcagaatgttccgtctccttgacgaaaataaagacagtctgattaacttcaaggagtttgtcacagggatgtccggtatgtatcacggtgacctgacagaaaaactgaaggtgctgtacaagcttcacctgccccctgccctgtcccctgaggaggctgaatccgctctggaggccgcacattatttcactgaggactcctccagtgaggaagctcttccccaggaggagcaggaaggctccggaagcgaggagcgcggtgaggagaagggaacatcctctccggactatagacattatcttcgcatgtgggccaaggagaaggaagcacagaaagaaacaatcaaagatttacccaagatgaaccaggagcagttcatcgaactgtgcaaaacgctctacaacatgttctccgaggatcccatggaacaggacctctaccacgctattgcaaccgtagcctcactactcctgcgcattggggaggtgggcaaaaagttctcagctcggaccgggcgtaagcctagagattgcgcgactgaggaggatgaacccccagctcctgagctgcatcaagacgctgctcgtgagctccagcccccagccgctggtgacccacaggcaaaagcaggtggcgacacccacctcgggaaggcaccccaagagtctcaggtggtggttgaaggaggaagcggcgagggacaaggcagtccgtctcagctactgtccgacgacgaaactaaagatgacatgtccatgagctcctattccgttgtgagcaccggatccctgcaatgcgaggatttggcagacgatacagtgctggtgggaggcgaggcttgttcccctactgcgcgaataggcggaaccgtagacacagactggtgcattagctttgagcagatcctagctagcatcctcacagagtcagtgcttgtcaacttctttgaaaagcgggtagacatcggccttaaaattaaggatcaaaagaaagtcgagagacaattttccaccgccagcgaccacgaacagccaggtgttagtggctag

SEQ ID NO: 54748 - DNA, 3753 bp, Artificial Sequence
  Description of Artificial Sequence: Synthetic coding sequence
atgtggctgagtccagaggaggtgctcgtcgcgaatgctctatgggtgactgagcgtgcgaaccctttttttgtgctccagagaagacgtgggcatggcagggggggagggcttaccggcctgctcgtgggcacccttgacgttgtgctcgacagttccgcacgcgtggccccttacaggattttgcaccaaacccaggacagccaagtctactggaccgtagcatgcggatcttcgcggaaagaaataactaaacactgggagtggctggaaaataatctactgcaaacactatctatcttcgatagcgaggaggacattactacattcgtgaagggcaagatccatgggatcattgctgaggagaataagaacctgcagccacagggtgacgaggatcccggaaagttcaaagaagccgaactcaaaatgagaaaacagttcggcatgcctgagggggaaaagctcgttaactattatagctgttcctactggaaagggcgtgtgcctcggcagggttggctgtatctgacagtgaatcacctctgtttttactcctttctccttggtaaagaggtctcgttggtggttcagtgggtggatatcaccagactggagaagaacgcaactctcctattccctgagtccattagagtggatactcgagaccaggaattgtttttctccatgtttttgaatattggggagacctttaagctgatggaacagctcgccaatcttgcaatgagacagctgctggactccgagggattcctggaggataaggcactgcccaggcccatcaggcctcatcgcaatattagcgcactcaagcgggacctggatgccagggctaagaacgagtgttatagggctacatttcgcctcccccgtgatgaacgcttggacggccacactagctgcactctatggaccccttttaataaactgcacattcccggtcagatgtttatttctaacaactacatttgctttgcttccaaagaagaggatgcctgccatcttattataccgctccgtgaagtgaccatagtggaaaaagccgatagctcttcagtgttgcccagtcctttatcaatttcaaccaaaagtaaaatgacatttctgttcgcgaatttgaaagatcgtgacttcctggttcagaggatctccgattttctgcagaaaacacctagcaaacaacctggatccatcggttccaggaaagccagcgtggtggatcccagcaccgaatcatccccagcaccccaggagggtagtgagcagcctgcctcccccgcaagtccccttagttctaggcagagcttctgtgcccaagaggcccctaccgcatcccaaggcctgttaaaactcttccagaaaaatagccccatggaggatctgggggctaaaggcgctaaagagaagatgaaagaggaatcctggcacatacacttctttgaatatgggagaggggtttgtatgtaccgcaccgccaaaaccagagccttagtgttgaaaggcatacccgaatcgctgcgcggtgaattgtggctactgttttctggggcttggaacgagatggtcacacatccgggatattatgccgaattagtcgagaagagtaccggtaagtattccttggcaacggaggaaatcgaaagagatctgcaccgctcaatgcccgaacaccctgcttttcaaaatgaactgggcatcgctgccctccggcgagtacttaccgcctatgccttccgcaaccccaccataggttactgccaagcgatgaacattgtgaccagcgttctgttgctttacggctctgaagaggaggccttttggctactcgtggcactgtgtgagagaatgctccctgattattataatacccgggttgtgggtgcactggtggatcaaggcatcttcgaggagctgacccgcgatttcttgccgcagctttcggaaaagatgcaagatcttggcgtgatttccagcataagcctttcctggttccttaccctttttctgagtgttatgccttttgaatcagccgtcgtcatcgtcgactgttttttttatgaaggaatcaaggtgatcctccaggtggctctcgccgtgctcgatgccaacatggagcagctgctcggctgcagtgacgagggcgaggccatgacaatgctcggacgatatcttgataacgtggtgaataaacagagtgtgtctcccccaatcccccatctacgtgccctgctgtcttccagtgatgatcccccagcagaggtggatatttttgagctgcttaaagtgagctatgagaagttctctagcctgcgagccgaggatattgagcaaatgaggttcaagcagcgccttaaagtcatccagtctctcgaagacactgcaaagagatcagttgtcagagctataccggtggatatcggcttttcgattgaggagcttgaggacttatatatggtttttaaggccaagcacttggcaagccagtattggggttgtagcagaaccatggccggacgcagggatccttctctgccatatttggaacagtacagaatcgatgcctcacagtttagggagttattcgcaagcttaactccttgggcctgcggttcacacacgccactgttggcgggtcgtatgtttagacttctggatgagaataaagactcactgattaacttcaaggagttcgtgaccggcatgtcggggatgtatcacggcgaccttacagaaaagctcaaggtcctatataaactacacctaccccctgcactgtcccccgaagaggctgagtcagctctggaggccgctcactatttcaccgaagatagttctagcgaagccagtcctttggcatctgacctcgacctgtttcttccctgggaggcccaggaggctttgccccaagaagagcaggaggggtccggtagtgaagagcgcggagaggaaaaaggaacctctagccctgattatcggcactacctaagaatgtgggccaaggagaaagaagctcagaaagagaccattaaggacctgcccaagatgaatcaggaacagttcattgagctgtgcaagacgttgtacaatatgttttcggaggatcctatggagcaagacctgtatcatgctattgccactgtcgcaagtttattgctgcgcattggcgaggtggggaaaaagttttcagcaagaactggtaggaagcccagagactgcgctacagaagaagacgagccgccagcccctgagctgcaccaggacgctgcacgggaactgcagccacctgccgcaggtgacccacaagccaaggcaggaggagacacccatcttggcaaggcccctcaggagtcccaggtagtagtcgaagggggttctggtgaaggccagggttccccaagccagctactcagcgatgacgagactaaagatgatatgtccatgagctcttactccgttgtatctacaggaagtctgcagtgtgaagatctggccgacgatacagtgcttgtggggggtgaagcttgttcccctactgcacgtatcggcggtactgtcgataccgattggtgtatctcgtttgagcagatcctggcaagcattctcacagaatccgtgctcgtgaacttctttgagaagagagttgacatcggactgaaaatcaaagatcaaaagaaggtggaacggcaatttagcactgcctcagatcatgagcagccgggagtgtcggggtag

SEQ ID NO: 54749 - DNA, 1176 bp, Artificial Sequence
  Description of Artificial Sequence: Synthetic coding sequence
atggccggacgtcgtgacccctcgttgccctacttggaacaatataggatcgacgcctcccagttccgcgagctgtttgcttccctaaccccctgggcttgcggttcccacacgcccttacttgccggtcggatgtttcggctgctggacgagaataaggatagcttaattaactttaaagaattcgtgacaggaatgagcggtatgtatcatggggatctaacagagaagctgaaagtcctgtacaaattgcacctgcctcccgctcttagcccagaagaagcagagagcgcactcgaagccgctcactacttcacagaagactcgtcatccgaggaggccctgccccaggaggagcaggaaggtagcgggtccgaagagcgcggagaagagaaggggactagctctccggactacaggcactatttaagaatgtgggctaaggaaaaggaggcacagaaggagacaattaaagacctgccaaaaatgaaccaggaacagttcatagaattgtgcaaaaccctctacaatatgttcagcgaggacccaatggaacaggatctatatcatgccattgccactgtggcgagcctgcttctccggatcggcgaggttgggaaaaagttttcagccaggacagggcgtaaacctagagattgtgccaccgaggaagacgaacctcccgcaccagagctgcatcaggacgctgccagggagctgcagccaccggcagccggagacccccaggcaaaagccggtggcgacacccacctcggtaaagcacctcaggagagtcaggtcgtagtggaagggggatctggcgagggacaagggagtccttcccagctactctctgatgatgagaccaaagatgatatgagcatgagctcttacagcgtcgtctccacaggttccctccagtgtgaagacttggcagacgatactgtgctcgtgggaggtgaggcatgcagtcccaccgctcgaatcggcggaacagtggacaccgactggtgcatttcattcgaacagattttggcctcaattctcactgaaagtgtcctcgttaatttcttcgagaaaagggtcgacatagggctaaagattaaggatcagaaaaaagtcgaacgacagttcagcaccgctagtgatcacgaacaaccaggcgtcagtggatag

SEQ ID NO: 54750 - DNA, 975 bp, Artificial Sequence
  Description of Artificial Sequence: Synthetic coding sequence
atgggagatctgttaccacgagcctggccaggggctggctgtactgaaactcagaccacttcccaggggcctcaggagcttgctgtgcccacggctgagtgctattcttgctccttctatttttgcgtgtgtccagaggctcttccccaggaggagcaggagggcagtggcagcgaggagaggggcgaagagaagggtacttcttcgcccgattaccggcattatctgaggatgtgggccaaggagaaggaagcacagaaagagacaattaaggacctccctaaaatgaaccaggagcagtttattgaactgtgtaagactttgtacaacatgttcagcgaggatcccatggagcaagacctctatcatgctattgccaccgtggccagtttgttgctgcgtatcggagaggttgggaagaaattttctgctaggactggaaggaaacccagggactgcgccacagaagaagacgagccacccgcacctgagcttcaccaggatgctgctagggaactccagccccctgcagcgggagacccccaggctaaagcaggaggagatacgcacctggggaaggctccccaggagtcgcaggtggttgttgagggcggaagcggggagggccagggaagcccaagtcagctgttgtctgatgacgagaccaaggatgatatgtcaatgtccagctactccgtagtctccaccggatccctgcagtgcgaggatttggctgatgatactgtgcttgttggaggagaagcgtgttcaccgacagccagaattgggggaactgtcgacacagactggtgcatctccttcgagcagatcctggcctcaattttgaccgaaagcgtcctggtgaattttttcgagaagagggtcgatataggtctgaagattaaggaccagaagaaggtggaaaggcagttttccacagccagcgatcacgaacagcccggtgtgtccggatag

SEQ ID NO: 54751 - DNA, 1137 bp, Artificial Sequence
  Description of Artificial Sequence: Synthetic coding sequence
atgtccaaagaaccactaattctatggttgatgatcgaattttggtggttgtatctcacccctgtcaccagtgagaccgttgtaacagaagtactggggcatagggttaccttgccatgtctatattctagttggagccacaactccaacagcatgtgctgggggaaggatcagtgcccctacagtgggtgcaaggaagctctcatccggacggatggaatgcgggttacttccagaaagtcagcaaaatataggctgcagggtaccatcccaagaggggacgtgagtttgaccatactgaacccttcagaaagtgacagcggtgtttactgttgtcggattgaggtccctggttggtttaacgatgttaagatcaacgttcgcctgaacctccaaagagcttcgacaaccacccaccgcactgccaccaccacgacccgtcgcacgactacgaccagtcccacaaccacccgacagatgaccaccacacctgctgcactacccacaacggtcgtgacaacccctgacttgacgaccggcactccattgcagatgaccaccatagccgtgttcacaacagctaatacctgcctcagcctcactccctcaaccctgcccgaggaggcaactggactgctgaccccagagccctcaaaagaaggaccaattctgactgcggaatcagagactgtccttcctagtgactcgtggagttccgtggagagtacttccgcagatacggtgctcctaaccagcaaagagtccaaagtgtgggacctcccctccacaagccacgtgagcatgtggaagacctctgacagcgtgagctctccacagcccggagccagcgatactgccgtacccgaacaaaacaagactactaagacaggccagatggacggcatcccaatgtctatgaagaatgaaatgcccatctcacagttgttgatgattatagcaccatccctcggtttcgtgctgttcgctctgttcgtagcttttttactaagaggaaaattgatggagacctattgctctcagaagcatacaaggctcgactatattggcgactctaagaatgtgttaaacgatgttcagcacggcagagaggatgaggacggactgtttacactgtag

SEQ ID NO: 54752 - DNA, 1053 bp, Artificial Sequence
  Description of Artificial Sequence: Synthetic coding sequence
atgagtaaagaacctcttatcctctggctgatgatcgagttctggtggctgtatctgactccggtgacttcggaaacagtggtcaccgaagtgctcggacatagggtcacactgccctgcttatactcctcatggtcccataatagcaacagcatgtgttggggcaaggatcagtgcccttactcgggttgcaaggaggcgctgatccggaccgatgggatgcgtgtgacaagtcgcaagtctgccaaataccgcctgcagggcacaattccccgaggcgatgtgagtcttaccattctgaacccctcagaatctgacagcggcgtctactgttgccgcatcgaagtgccgggatggttcaatgatgtgaaaatcaacgtgcggctcaacctgcagcgcgcaagtactacaacgcatagaacggcaactacaactactcggagaacgacaacaacctcacccactactactaggcagatgaccacgactcccgcagctctccccaccaccgttgtgaccacacccgatttgacaaccggaaccccccttcagatgacaaccatcgcagtgttcaccaccgctaatacctgtctctcactgactccttctaccttaccagaagaggccaccggcttgttgactcctgagccctctaaagagggcccaatcctgactgctgagagcgaaacagtgctaccgagcgatagctggagttctgtggaatctacttctgccgacacagtgctgctgacaagtaaagcatcagataccgccgtaccagagcagaacaagactactaagactggccagatggacggcatacctatgagcatgaagaacgagatgccaatttctcagctcctgatgatcatcgccccttcattaggtttcgtgctgtttgcactttttgtggcctttctacttcggggtaagctcatggagacctattgctctcagaaacatacacggctggactatattggcgactcaaagaacgtgcttaacgacgtgcagcacggaagagaagacgaggacgggttgttcacactctag

SEQ ID NO: 54753 - DNA, 3504 bp, Artificial Sequence
  Description of Artificial Sequence: Synthetic coding sequence
atgcctaatagtgtgttatgggctgtggacctgtttgggagggtgtataccttgtctacagcaggacagtactgggagatgtgcaaagattctcagttagagttcaagagagtcagcgccaccactcagtgttgctggggcatcgcctgcgacaaccaggtctacgtgtatgtgtgcgcctctgatgtccccatcagaaggcgggaagaggcatatgagaatcagcgttggaacccaatggggggattttgtgagaagctccttctgagtgatcgttggggatggtctgatgtgagcggcctacaacacaggccattagaccgagtcgctttgcctagccctcactgggagtgggagtcagattggtatgtcgatgaaaatttcggaggcgagcccaccgagaagggcggttggacttatgcaatcgacttcccagccacctacacaaaggacaaaaagtggaacagctgcgtgcgccgacgcaagtggattagatatagacggtacaagtctcgggacatctgggccaaaataccatctaaggatgatcccaaggagctaccagatccgtttaacgatctgtccgtcgggggttgggaaattacggaagagcccgtgggcaggctgagcgtgtgggcagtcagtttgcagggcaaagtttggtatcgcgaagacgtgtcacactccaaccccgaaggtagctcttggtccctccttgacacccccggtgaagtggtacaaatcagttgcggcccacacgacctgctctgggccacgttatgggaggggcaggcccttgttagagagggaataaatagatcaaacccaaaagggagtagctggtcaatcgtcgagcccccaggtagcgagaacggggtgatgcatatttcggtaggagtgtctgtagtatgggctgtgactaaggactggaaagtatggttcaggcggggtgtaaattctcacaacccctgtgggacttcctggatcgaaatggtgggagagatgacgatggtgaatgtcggaatgaacgatcaggtgtgggggattgggtgcgaggacagggcagtatacttcagacagggggtgacgccatccgaattgagcggcaaaacatggaaggcgattatcgccgcaagggagtgtgaccgatcacacagcggctcttccagcagtctgttaagcgctggctgttttttcggcgacgaagtgcgtgggtccggagaatctgctcctagcgacaccgatgcatcaagcgaagtcgaaaggccgggaccaggccaaatcctgcctgctgagcccctcgatgacagtaaaaacgccaccggtaatagtgccagcggcctcggggctggccgaaccgcagaggataccgtcgaagatgcctgccccgcagagggttctagggaggccagaccgaatacccacccagggccagcccctaccccagcggaactcccttggactaatatagatttgaaggaagccaagaaagtcccctcgcactctgccgctggcttcccagagactactagcctgagctctttgggactgctcccactgggactagaagaaccctatggcgtagacgaccacccgctgtgggcatgggtcagcggtggaggctgcgtcgtggaagcctgcgccatgcccaggtggttcactgtccaggcagccggactttccagcagcgttcatatgctgagtctgtccatcacccccgctcagaccgcagcttggcgaaaacagatattccagcagttaaccgagcggaccaagagagagctagaaaactttaggcattatgaacaagccgtggagcagagcgtttgggtgaaaacaggggcactccaatggtggtgtgactggaaaccacacaagtgggtcgatgtccgtctggccttagagcagttcaccggacacgacggggtccgggacagcattttatttatatactatgttgtccacgaagagaagaagtatattcacatttttttaaacgaggtcgtggctctcgtgcccgtgcttaacgaaaccaagcattccttcgctttatacaccccggagcgcaccagacagagatggcccgtgagattagccgctgcgaccgaacaggatatgaatgattggttagctctcctgtccttgagctgttgcgaatcccgtaaagtgcaggggaggccttcaccacaagccatttggagcattacgtgtaagggggatatctttgtctcagagccctcgcccgatttagaggcacacgaacatcctttgccttgtgaccagatgttttggcggcagatggggggtcacctgagaatggtcgaggctaatagtagaggcgtggtctgggggattggctatgatcataccgcttgggtatacaccgggggttacggaggaggatgtttccagggtctggcgtcctctacaagcaatatctacactcagtctgacgtcaaatgcgttcatatctatgagaaccagcgatggaatcctgtcacgggttatacctccagtagaggcttaccgactgatcggtacatgtggagtgacgcttcaggtctccaggagtgcaccaaggccggtactaagcccccatcactacagtgggcctgggtaagcgactggtttgttgatttctcagtgcccggaggcacagaccaagagggctggcaatatgctagtgatttcccagctagctatcacggctcgaaaaccatgaaagatttcgtgcggaggcggtgttgggccaggaagtgcaagttggtcacctcagggccatggttagaagtcccaccaatagccctgcgcgacgtctccattatccccgagtcccccggagcggaaggctccgggcactcaattgctctatgggcggtatctgacaagggtgatgtgctatgtcggctgggcgtgtctgaactgaacccagcagggtcctcctggctgcacgtcggcacagatcagccatttgcgtccatatccatcggcgcttgctatcaggtgtgggctgtggccagggatggatccgctttttaccgcggttcggtctatccatcacagccagcgggagactgttggtatcacattccctcaccaccaaggcagcgacttaagcaggtgagtgccggacagacctcagtgtacgctctagacgagaatgggaacctctggtatcgacaaggcatcactcccagttatccacaggggtcttcttgggagcatgtgtccaataatgtgtgtcgcgtgtcagtagggccacttgatcaagtatgggtgatcgcaaacaaagtgcaggggtcacacagtctatcacgcggtacggtgtgtcaccgcacaggagtccagccacacgagcctaaagggcatgggtgggactatggcatcgggggaggttgggatcacattagcgtgagagctaatgcgacgcgagcaccacgaagcagttcacaggaacaggaaccatcggctccacccgaagctcacggccctgtgtgctgctag

SEQ ID NO: 54754 - DNA, 306 bp, Artificial Sequence
  Description of Artificial Sequence: Synthetic coding sequence
atgccaaacagcgttctgtgggccgtggacttattcggtagagtatacacgctttctacagctggtcagtactgggaaatgtgcaaggattctcagttggagttcaaacgggtgagtgccaccacccagtgctgttggggtattgcatgcgataaccaggtatacgtgtacgtgtgtgcctccgatgtgccaatccggaggagagaagaagcgtatgaaaatcaaaggtggaatcctatgggagggttctgtgagaagttattgctgtctgataggtgggggtggagcgatgtgagtgggttgtag

SEQ ID NO: 54755 - DNA, 3498 bp, Artificial Sequence
  Description of Artificial Sequence: Synthetic coding sequence
atgcccaattctgtgttatgggccgtagacctattcggacgagtatacacgttaagcactgctggccagtattgggaaatgtgtaaagattctcagttagagttcaagagagtttctgcaaccacacagtgttgttggggaattgcttgcgataatcaggtgtatgtgtacgtctgtgcctccgatgtgcccattcgcagacgtgaggaagcttacgaaaaccaaaggtggaaccctatgggcggattttgcgaaaaactgcttctgagtgataggtggggatggtctgatgtgagtggtctgcagcacaggccacttgatagggtggctcttcccagtccacattgggagtgggaatcagactggtatgttgatgagaatttcggaggagagcccacggaaaaagggggatggacttacgctattgacttcccagctacatatactaaagacaagaaatggaatagctgcgtcaggagacggaagtggatcagatatcgtcggtataaaagtcgggacatctgggccaaaatcccctcaaaggacgatcccaaagagttgcctgatccattcaatgacttgtcagtcggcggatgggaaatcacagaagagcccgtagggagactgagtgtctgggcggtcagcttgcagggtaaggtgtggtaccgagaggacgtctctcattctaacccagagggtagttcctggtccctactagacaccccaggcgaggtagtccagatatcctgcggccctcacgacctcctgtgggctactttatgggaaggccaggctttggtcagagagggcatcaacaggtcaaaccccaaaggctcatcctggtcaattgtggaacctcccggatccgaaaatggagtgatgcacatcagcgtgggcgtctcggtagtgtgggctgtgaccaaagattggaaggtttggttccggagaggagtaaactcccataacccgtgcggcacgagttggattgagatggtcggggagatgaccatggtgaatgtgggtatgaacgatcaagtctggggaatcggctgcgaggacagggccgtttactttcgtcagggcgttaccccttcggaactctcaggaaaaacctggaaagctatcattgccgcacgagagtgtgacagatctcacagtgggtccagctcttctctgctgtccgcgggttgtttcttcggggacgaagtgaggggcagcggcgagagcgccccatcagatacagacgcctccagcgaggtagagcgacctgggccaggccagattctgccggcagagccactggacgactctaagaacgccacgggcaactccgccagtggtctgggtgctggacgtactgccgaggatacagtcgaagacgcttgtcctgccgaaggcagtcgggaagccaggcccaatacccaccccggaccagcgcctacccccgctgaactcccatggacaaacatcgatctgaaggaggcgaagaaggtaccatctcattccgccgcaggcttcccagaaacaaccagtctgagctcactcgggttactcccactggggctggaggaaccatacggagtggacgatcaccctctgtgggcatgggtatcagggggaggatgcgttgttgaagcgtgcgccatgcccaggtggtttacggtgcaggccggactctcaagttcagtacatatgctctccctaagcattactccggctcagactgccgcttggcgtaagcagatcttccagcagctcaccgagagaactaaaagagaactggaaaattttagacattatgaacaggccgtagaacagagcgtgtgggtgaaaaccggcgctctgcagtggtggtgtgactggaaaccacataaatgggtggatgtgagactggccttggaacagttcactggccatgacggagttagagactcaatactgtttatttactacgtggttcacgaggaaaaaaagtatatacatattttcttgaatgaggtggtggcattggtgcctgtactgaacgagacaaaacactccttcgccttgtatacacccgagaggacacgccaacgatggccagtccgactggctgccgctacagagcaggacatgaacgattggttagcgctgctgtccctcagttgctgtgagagtcgtaaagtgcaggggcgtcccagcccccaggcaatctggagtattacttgtaaaggagacatcttcgtcagcgagccgtcccccgacctggaagcccacgagcacccgcttccttgcgaccaaatgttctggaggcagatgggtgggcacctgaggatggtagaggcaaatagccggggtgtggtctggggtattggatacgaccacacagcatgggtgtatacgggtggttatggtggagggtgtttccaaggtttggcttcctccactagtaacatctatacccagagtgacgtgaaatgtgtacacatatatgagaatcagaggtggaatcctgtgactggatacacaagccgtggcctgcccactgacaggtatatgtggtcggatgcctctggtctgcaggagtgtaccaaggccggtacgaagccccctagtctccagtgggcatgggtgagtgactggtttgtcgattttagcgtgccaggaggaaccgaccaggaaggatggcagtacgcatcagactttcctgccagctaccatggttctaaaacgatgaaggactttgtgcggaggaggtgctgggctcggaagtgtaagttggtcacatccgggccttggctggaagttccccctatagcgctgcgcgatgtcagcatcattcctgaaagtcccggagccgaaggcagcgggcacagtattgcactgtgggccgtcagcgataaaggagacgtactgtgccggttaggcgtgtcggaactgaaccctgccggttcgtcatggctccacgtaggcaccgaccaaccctttgccagtatcagtatcggagcgtgttatcaggtctgggccgtggcaagagacgggagtgccttctaccggggatccgtgtacccgtcccagcctgccggtgattgctggtaccacatcccttccccccctcgccaacggctcaaacaagtgtccgctggccagacttctgtgtacgcactggacgaaaacggcaacttgtggtaccgtcaagggatcactccctcctacccccaagggtctagttgggagcacgtgtctaacaatgtgtgtagggtctcagtgggccctcttgatcaagtttgggtcattgctaacaaggtacagggatcacactctttaagccgagggacggtttgtcatcggactggagtgcagcctcacgagcccaaagggcatggttgggactatggaatcgggggaggatgggatcacataagtgtccgggctaatgccacccgggcacctcgctccagctcccaggaacaggaaccctcagcgccacctgaggcccacgggccagtgtgttgttag

SEQ ID NO: 54756 - DNA, 2331 bp, Artificial Sequence
  Description of Artificial Sequence: Synthetic coding sequence
atggggggtttctgtgaaaagctgctgctgtccgacagatgggggtggtccgatgtatcaggcctgcagcatcgtcccctggaccgcgtcgcactacctagtccacactgggagtgggagtccgactggtatgtggatgagaatttcgggggagagcccaccgaaaagggaggctggacatacgccattgactttccggcaacttataccaaagacaaaaagtggaactcttgcgtccgacgcaggaaatggatccggtatcggagatacaagtcacgggacatatgggccaagatcccttctaaagatgatcctaaggagcttcccgacccctttaacgacctgtctgtcgggggatgggagatcacagaggagcccgtcggccgacttagcgtgtgggcagtttccctccaaggaaaagtcctctgcccttgcctcgcctcccaagtatggtatcgcgaggacgtgtcccattccaacccagaaggctcctcatggagccttctcgacactccaggggaagttgtgcagatcagctgcgggccacatgatctcctgtgggccacactgtgggaggggcaggcactagtgcgcgaggggattaatcgctcaaaccccaagggatcctcttggagtattgtggagcctccgggatctgaaaacggagttatgcacatctctgtcggcgtttctgtagtgtgggccgtgaccaaggactggaaagtgtggttcagaagaggcgtcaatagccacaatccatgcgggacttcttggatcgagatggtgggggagatgactatggttaatgtaggaatgaacgaccaggtgtgggggatcggttgcgaagatcgagctgtgtattttcgccagggagttaccccaagcgagttgtcgggaaaaacttggaaagcaatcatcgcagccagagaatgtgataggtcccactccggcagcagttcctcactgctctccgccggttgcttttttggagacgaggtgcgaggatcaggcgaatccgcaccttccgatactgatgccagttctgaggtggagaggcccggtccagggcagattcttccagctgagcccttagacgatagcaagaacgcaaccggtaattcggcctccggtcttggcgcaggtagaacagctgaagatacagtggaggatgcctgccccgctgagggctcaagagaggcgagacctaatacccaccccggaccagcacctacacccgctgaactgccttggacaaacatcgacttgaaggaggccaaaaaggtcccatcacacagtgcagcaggctttccagaaactacctccctgtctagtttagggcttttgcccctaggtctggaagagccctacggagtggacgaccacccactctgggcttgggtgtctggtggcggttgtgtggtggaggcctgtgccatgccacgctggttcactgtgcaggccggtttgtcctcctcagtgcacatgttgagcctcagcataacgcctgcacagacagcagcctggagaaaacagattttccaacagctgaccgagcgcacaaaaagggagcttgaaaatttcaggcactatgagcaggcagtggagcaaagcgtgtgggttaagaccggcgcactccagtggtggtgcgactggaaacctcataagtgggtggacgtgcgactcgccctggagcagttcaccggacatgacggcgtgcgggacagtattctttttatatactatgttgttcatgaggaaaaaaagtacattcatattttcctaaatgaggtggtggcactggtgccagtgttgaacgagaccaagcactctttcgcactctacacgcctgagagaactaggcaacgatggccagtccggctcgcggctgcaactgaacaagacatgaacgactggctggctctgctcagcctatcttgctgtgaatctagaaaggtgcagggcaggccttctccccaggcaatctggtccatcacttgtaagggggacatttttgtgtccgagccgagccccgacctggaagctcacgaacatcctcttccttgcgaccagatgttttggagacaaatgggcggtcatctacgcatggtcgaggctaattcacggggtgtcgtgtgggggattgggtacgaccataccgcctgggtgtataccggcggttacggagggggatgtttccaaggcctagcttctagtacatcgaacatatacacacagtctgacgtgaaatgtgtgcacatctacgagaaccaaagatggaatccagtgaccgggtacaccagttccagagataggatttcaccctgttggtag

SEQ ID NO: 54757 - DNA, 627 bp, Artificial Sequence
  Description of Artificial Sequence: Synthetic coding sequence
atgcccccaaaaaaagatgtacctgtcaaaaagcctgccggacccagtatttcaaaaccggcagctaagccagctgctgccggagcaccccctgccaagaccaaagcagaacccgcagtcccgcaagcgcctcagaaaacccaggagcctccggtcgatcttagcaaggttgtgatcgagtttaataaggaccaattggaggaattcaaagaggcgtttgagttgtttgaccgcgtgggcgatggcaaaatcctgtactctcagtgcggtgatgttatgcgtgcacttgggcaaaatcctacgaacgcagaggtattgaaggtcctggggaatcccaaaagcgatgagttgaaatcaaggcgcgtagacttcgagacattcttgccaatgcttcaagctgtcgccaaaaaccgcggacaagggacatatgaagactatctcgagggattccgggtgttcgacaaagaaggtaacggtaaggtaatgggtgccgagctcagacacgtcctaaccacacttggcgaaaaaatgaccgaggaggaggttgagactgtgctggctggccacgaggattcaaacggatgtataaattacgaggcttttctcaagcacatcctctccgtctag

SEQ ID NO: 54758 - DNA, 2790 bp, Artificial Sequence
  Description of Artificial Sequence: Synthetic coding sequence
atgacaaaaaagaggaagcgtcagcacgacttccagaaggtgaagcttaaagtgggcaagaaaaagcctaagcttcagaacgcaaccccgactaattttaagactaagacaatccatttgcccgagcagctgaaggaagacgggaccttgccaaccaataacaggaagctcaacataaaagacctgttgtctcagatgcaccactacaacgccggagtaaaacagtcggcgcttttgggcctcaaagatttgctctcacagtacccttttattatagacgcacacctgtcaaacattctcagcgaagtgactgccgtgtttaccgataaggatgcaaacgtcagattagcggcagtgcagctgctgcaatttctggccccaaagattagagcagaacaaatatctccttttttcccactagtctccgcgcacctcagcagcgccatgactcatattactgaaggcatacaggaagatagcctgaaggtcctggacatcctgttagaacaataccccgctctcatcacgggaagatctagtattctgctgaagaactttgtggaactcatttcccaccagcaactcagtaagggacttattaaccgcgaccgctcacaatcttggattctttctgtcaaccctaacagaaggcttacctcacagcagtggcgcctgaaggtgttggtaaggctaagtaagtttttacaggccttggcggatgggtcctcccgccttagagagtctgaaggactgcaagagcaaaaggaaaacccacacgctactagtaacagtatcttcattaactggaaggagcacgcgaacgaccaacagcatatccaagtatacgagaatgggggatcccagccaaacgtgtcttcccagtttagactgcgatatctcgtgggagggctctctggagttgacgagggcttgtcttccacagaaaatctgaaaggcttcatagagattatcatccccctcctgatcgagtgctgggtcgaggcggtgccgccacagttggcaacacccgtggggaacgggatcgagcgggagcctctccaggtcatgcagcaggtgctcaacatcatcagtctcttatggaagctctcaaagcagcaggacgaaacacacaagcttgaatcatggctgcgcaaaaactacttgattgatttcaagcatcactttatgagccggtttccctacgtgctgaaggaaatcaccaagcacaagcgcaaagagccgaataagtcaatcaagcattgtacagttctgtctaataatatcgaccatctgctgctcaatctgacgctgtctgatatcatggtgtcattagccaatgccagcactctgcagaaagattgctcatggatagaaatgatccgaaaattcgtgactgagacactcgaggacgggtcccggctaaattcaaagcagcttaaccgcctcctgggagtctcatggcgcctaatgcagatccagccgaaccgggaagatacagaaacactgattaaggccgtttatacactgtatcagcagcgcggacttattctgcctgtcagaaccctgcttctgaagttcttcagtaagatatatcagacagaggaattaaggtcatgccgattcagatatcgcagcaaagtgctgtcacggtggctggcaggattgccgctacagctcgctcacctgggcagccggaatccagaactgagcacccagctgattgacatcatccacaccgccgcagccagggcaaataaggagttgctaaaatcgctgcaggcaacagcattgagaatctatgatcctcaggagggtgctgttgtcgtgttgccagccgacagccagcagcgcctggtccagttggtctactttctacccagcctgccagctgacctgctttcacggctctccagatgctgtatcatggggaggttaagcagttctctggccgcaatgttgatcggaattctgcacatgcgcagctcctttagcggctggaaatattccgcaaaggactggcttatgtctgatgtggattacttctcgttccttttttctactctcaccggctttagcaaagaggagttgacatggcttcagtctctccgtggggtgccgcatgttatccagacacaactgtctcccgtactcctctatctcaccgatctggaccagtttttacatcattgggatgttacagaggctgtctttcacagcttgttggtgattcctgctagatcacagaatttcgatatcctacagtcagctataagcaagcatttggtggggcttaccgtaatcccagactctacagccggatgcgtgttcggtgttatttgcaaattgctggaccatacttgcgttgtctcagagacattactgccttttcttgcctcctgttgctattccctgctgtacttcctgctaacaatagagaagggcgaagccgagcaccttcgcaagcgggataagctgtggggcgtgtgtgtgtcaattttagccctgctccccagggttctcagactgatgctccagagtcttcgagtgaatcgcgtaggaccagaggagctacccgttgtgggacagctcctgcggttgctgttgcagcacgctcctcttcgtacccacatgttgacaaatgctattttagtacaacagattattaaaaatataaccaccctgaaaagcgggtccgtacaggagcagtggctcactgacttgcactattgttttaatgtctatatcactggtcatccgcaggggccatccgctctggccacagtgtactag

SEQ ID NO: 54759 - DNA, 516 bp, Artificial Sequence
  Description of Artificial Sequence: Synthetic coding sequence
atgcagcaggtgctcaacattatttccttgttgtggaagctgtccaagcagcaggatgagacgcataagcttgagagctggttgcgaaagaactatctcatagatttcaagcaccattttatgtcacggttcccatacgtactgaaagagattaccaaacacaaaagaaaggagccgaataagagcatcaaacactgcactgttcttagtaacaatatcgatcatttgctactaaacctcacgctctctgacatcatggtaagcctcgccaacgccagcacactgcagaaggactgttcatggatagaaatgatcaggaagtttgtgactgaaactctcgaggacggatcacgcctcaattcaaaacagctgaatcggttattgggtgtgagctggcggttgatgcagatccagccaaatagggaggacaccgaaacactgattaaggcggtgtacactctctaccagcagcggggtcttatcctcccggttaggacgttgcttctgaaattctag

SEQ ID NO: 54760 - DNA, 2394 bp, Artificial Sequence
  Description of Artificial Sequence: Synthetic coding sequence
atgaccaagaagcgcaagcgacagcacgactttcagaaggtgaaacttaaagtgggcaaaaagaaaccaaaactgcaaaacgccactcctacgaatttcaaaactaagaccattcacctacccgagcagttgaaagaggacggcacgctgcccacaaacaaccgcaaactgaatatcaaagacctcctgtctcagatgcatcattacaacgcaggggtcaaacagtccgctctgctgggccttaaggatctcttgtcccagttcctcgctcctaagattcgagcagaacagatttcccctttcttcccgctggcacttgccgacgggtcctccaggctgcgcgaaagcgaaggactgcaggagcagaaagagaacccgcatgccacctctaacagcatttttatcaactggaaagaacacgccaacgaccagcaacacatccaagtctacgagaatggtgggtctcaaccaaacgtgagctcacagttccgcttgcggtacctggtcgggggactgtccggggtggatgagggcctgagtagcaccgagaatctcaagggattcattgagatcatcatccccttgcttatcgagtgctgggtggaggcagtgccaccacagctggcaacgcctgtgggcaatgggatagaacgcgaacctctgcaggtcatgcagcaggttttgaatatcatctccctgctgtggaaactcagcaaacagcaggacgagacccacaaactcgagagttggctgcgcaaaaactacctcatcgacttcaaacatcacttcatgtctcgattcccctatgtactcaaggagataaccaaacataagcgcaaggaacctaataagtccatcaagcactgtaccgtgctgtcaaataatatcgaccacttgctgcttaatctgaccttgtcagatattatggtgagcctggctaatgcatcaaccctgcagaaggactgctcttggatcgagatgattcgaaaatttgtcacagagactttggaggatggttcaaggcttaactctaaacagctcaacagactgcttggcgtttcatggagactgatgcaaatccaacctaatagagaggatactgaaaccttgattaaggccgtttacacactataccagcaacggggtctgattttacctgtcaggactctgctcctgaagtttttttcaaaaatttaccagaccgaagaactaagatcatgtagattcaggtaccgcagcaaggttctgtcccggtggctcgccggactaccactgcaattagcgcatttgggatctaggaaccctgaactgtctacccagttgattgatataatccataccgcagccgcacgcgctaacaaggagctattgaagtccctgcaagccacagcactgaggatttacgatccacaagagggcgcagtggtggtgttgccagctgattcacagcaacgcctggtacagcttgtgtattttctcccttccctgccagctgacctcctgagccggttgtcacgctgttgtataatgggccgacttagctcttcacttgcagctatgcttataggaatattacatatgaggagctcctttagtgggtggaaatattcggccaaggactggctaatgagtgacgttgactattttagctttctttttagcactttgaccgggttttctaaagaagaactcacttggttgcagtccctgaggggagtgccgcatgtgatacagactcagctgtctcccgtgctcttgtaccttaccgacttagaccagttcctgcatcactgggatgttacggaggcagtctttcacagcttactggttatccctgcccgaagccagaatttcgacattctgcagtcagcaatctccaagcatttagtgggcctcactgtgattcctgactctacagctgggtgtgtgttcggagtgatttgtaagttactggaccacacctgcgtcgtctctgaaactttactgcccttcttggcctcctgttgttacagcttattgtacttcctcttgactatcgaaaagggtgaagctgagcatctaaggaaaagagacaagctttggggggtatgtgtgtctatcctggcactgctgccgagggttctgcgccttatgctgcagtctctcagagttaaccgcgttggtcctgaggaattacccgtggtgggtcagctgctgaggctgttgttgcagcatgcgccattgcgcacgcatatgctgacgaacgcgattctggtgcagcagatcattaaaaacatcaccactcttaagtcgggctcggttcaggagcagtggctcaccgacctgcattattgctttaacgtgtacatcaccggtcatccccaggggccttcggccctggctaccgtgtattag

SEQ ID NO: 54761 - DNA, 2742 bp, Artificial Sequence
  Description of Artificial Sequence: Synthetic coding sequence
atgagtcggatgacaaagaaaaggaagcgtcagcacgactttcagaaggtgaagctgaaggttggcaaaaagaagcctaagcttcaaaacgcaacccctacaaactttaagactaaaactattcacctccccgagcagctaaaagaggatggaacgctgccaactaacaatcgtaaactgaatataaaggacctcctatctcagatgcatcactataatgcaggcgtgaaacagtccgctctcctcggtttgaaagatctgctgtcccagtacccttttataatcgatgcacatctctccaatatcctgtcagaagtgaccgctgtattcactgacaaggatgctaatgtgcgactggccgctgtgcagcttctgcagttcttggccccaaaaatacgtgctgagcagataagcccattctttcccctggtaagcgcacatctgtcatcggctatgacccatattactgagggcatccaagaagacagtctgaaggtgctagatattctactcgaacaataccctgcccttataacaggcaggtcctctatccttctgaagaacttcgtggagttaatctcacatcagcagctcagcaaaggactgatcaatcgtgaccgctctcaaagctggatcctgtctgtgaacccgaatcgcagactgacttctcagcagtggagattaaaggtgctggttagactgagcaaatttttacaggccctggcggacggttcctcacggctaagggaatctgagggcctccaggagcagaaagaaaaccctcacgctacatctaattctatattcatcaattggaaagaacacgccaatgaccagcagcatatacaggtctacgaaaacggcggttcacagcccaacgtttcatcccagttccgcttaaggtacctggtagggggactgagtggggtggacgagggtctctcttcaacagagaaccttaaggggttcatcgagataatcattccacttctcatcgaatgttgggtggaggccgttcctccacagctggccacacctgtggggaatgggatagaaagggaaccactgcaggtgatgcagcaagtcctgaatatcatatccctactgtggaagttgagcaagcagcaggatgaaacccacaaacttgagtcctggctccgaaagaactaccttatcgatttcaagcatcattttatgtcaagatttccttacgtgctaaaggaaattaccaagcataagagaaaggaaccgaacaaaagtatcaagcactgtacagtgctgtcaaataatattgaccacctgcttctgaacctcaccctcagcgacatcatggtgagtctggcgaacgcctccacgctgcagaaggactgcagttggattgaaatgattagaaaattcgtgacagaaacgctggaggatggctcgcgtctcaatagcaaacagctgaaccggctgctgggtgtgtcctggcgtcttatgcagattcagccaaatagagaagataccgaaacactcatcaaggccgtctacaccctctatcagcaaaggggactgatcctgccagtgaggaccctgttactgaagtttttttccaaaatctatcaaactgaggaactccgctcttgtcgtttcaggtatcgctcaaaagtgttgtcccggtggctagcaggcttaccattacaactggcccacctgggatcccgaaaccctgaattatcaacccaactgatagatatcattcatactgctgcagctagggctaataaagagttgttgaagagcctacaggccacggctctcagaatatatgacccccaggagggggcagtggtcgtactgccggctgatagccagcagagactggtacagctggtgtacttcctgccaagcctgccagcagacctgttatccaggttatctcgctgttgtattatggggagacttagcagtagtctcgccgctatgttaatcggaatcctccatatgagatcctctttctccggctggaagtattcagctaaagattggcttatgagcgatgttgactactttagctttctgttttcaacactaaccggcttctccaaagaggagttgacttggctccagtctctgaggggcgtcccccacgtgatccaaacacagttgtcccctgtgctcctgtacctcactgacctggaccagtttttgcaccattgggatgtgaccgaggccgtttttcattctcttcttgtgatcccagcgagatcacagaacttcgatatactacagagtgcaatatctaagcatctagtgggccttacagttatccccgatagtactgcagggtgtgtgttcggcgttatctgtaagctgctggaccacacctgtgtagtctccgaaaccctccttcctttcctggcctcttgctgttactccttactctactttctgctgacaattgagaaaggcgaagctgagcatctgcgcaaaaggctgatgctacagagcttgagagttaacagagttggacccgaagaactaccggtggtgggacagctacttaggctgcttttacagcacgccccactgcgcacccatatgttaacgaacgccatcctcgtgcagcaaataatcaagaatattacgacactgaaatccgggtcagtccaagagcagtggcttactgatcttcattactgctttaacgtgtacatcactgggcacccccaaggcccttctgccttggctacggtatattag

SEQ ID NO: 54762 - DNA, 1302 bp, Artificial Sequence
  Description of Artificial Sequence: Synthetic coding sequence
atgcaccactacaacgccggagtgaagcagtcggcacttttagggctgaaggacctgctcagccagtatccattcattatcgatgcacatttatctaacatcctcagcgaagtgaccgccgttttcaccgataaggacgctaatgtgcgactggcagccgtgcagttgctgcagtttcttgcccctaagattagagctgaacagatctcgccattctttcccctcgtgagtgcacatctcagctccgccatgacgcacatcacggagggcatacaggaggattctctgaaggtgctggatatcctactggaacagtaccccgcactgatcaccggccgatcttccattctgttaaagaatttcgtcgagcttataagccaccagcagttgtcaaagggccttattaaccgcgatcggtcacagtcttggatcctgtctgtgaaccctaaccgccgactgactagtcagcaatggaggctcaaagtgctggtgagactgtccaagttcctgcaggccctcgccgatggatccagtaggttacgcgagagtgaaggtctgcaagagcaaaaagaaaacccgcacgcgacttcgaactcaattttcatcaactggaaggagcacgcaaatgaccagcagcacatccaggtgtatgaaaatggtggttcccagcccaatgtgtccagccaattccggctccgctacttagtcggtgggctgagtggggttgacgaaggactctcgtcaacggagaatctgaaagggtttatcgagatcattatccccctattaatcgaatgttgggtagaagccgttcctccacagctggctacacccgtgggcaacggcatcgaacgcgagcccctgcaggtgatgcagcaggtcctcaatattattagcttactgtggaagctgtccaagcagcaagacgagacccacaaattggagtcttggttgaggaagaattaccttatcgatttcaagcatcattttatgtcccgctttccatatgtcctgaaggaaatcaccaagcataaacgaaaagaaccaaataagtctatcaaacactgcacagtcttaagtaacaatatcgaccatcttcttctgaatctcacattaagcgatatcatggtttctctggctaacgcatcaacccttcagaaggattgttcctggatcgagatgattcggaagttcgtcactgaaaccctagaggacggcagtcgcttaaacagtaagcagctgaatcgcctgctcggtgtcagctggcggttaatgcagatccagcccaatcgcggacggtag

SEQ ID NO: 54763 - DNA, 3405 bp, Artificial Sequence
  Description of Artificial Sequence: Synthetic coding sequence
atgacctccctgtacggacgccatgctgagaagacaacagacatgccaaaaccaagcgcacctaaagtgcatgtgcaacgatcggtgtctcgtgacactatcgccattcacttttctgcctctggcgaggaagaggaggaagaagaggaagaattccgagaatattttgaagaaggtcttgatgaccagtctattgtgacagggctggaagcaaaggaagatctgtatcttgagccccaagtcggacacgatccggcagggcctgccgcttcaccagtcctcgccgacggcttgagcgtgtcccaggcaccagccattctacccgtatctaagaatactgttaaactgcttgagtcccctgtccccgcagcccaggtattaagcaccgtacctctcgctgttagtcctggatcttcttcatccggacccctggccagttctcctagcgtctcgagtctaagcgaacagaagacttcctcctcgtctccactgtcatcaccttcaaagtcacccatcctgtccagctcagcatcaacgagtaccctgagcagcgccaaacctttcatgtctttagttaagagcttatcaaccgaagtggaacctaaggagtcacctcaccctgcgagacaccggcacctgatgaagaccttggtgaagagcctgtccacagatacatcccggcaggagtccgacacagtgtcctacaaaccgcctgattccaagctcaatcttcatcttttcaaacagttcacgcagcctaggaacaccgggggtgatagtaagaccgccccatcctctcccttgacgtcgccttcagacacccggtccttctttaaggtgcccgaaatggaagctaagatcgaagataccaagcggagactctctgaggttatctatgagcccttccagctcttgtctaaaattatcggggaggaatccggcagccatagacctaaagcgttgagctcttctgcctcggagctgagcaacttgagttcactgaacggtcacttggagtctaataacaattatagcatcaaagaagaagagtgcgacagcgaaggggatgggtacggcagtgatagtaacatcccccgatccgatcaccctaagtccacaggcgaaccaacacgtgaaatagaactgaagtcatctcagggctcctcgctcaaggatctggggctgaaaacctcttctttggtattagagaaatgcagtttatccgcactggtatccaaagaagacgaggagttttgcgagttgtatacagaagatttcgatttggagaccgaaggggaaagcaaggtggataagctctccgatattccactgaagcctgaagtgcttgcagaagacggggtggtcttggactcagaggatgaagtggatagcgctgtccagcaccccgaactacccgtcaagacactgggttttttcattatgtgtgtctacgtttatctgatccttccgctgccccattatgtctctggcctgtttctggggatcggtctcggttttatgacagcagtctgtgttatatggtttttcacgccacccagcgcacacaaataccacaagttgcataaaaatctaagacattggaacactagatctttagacatcaaagaacccgaaatcctgaaggggtggatgaacgagatctacaattacgaccccgaaacctaccacgctacacttacccacagcgtttttgtgaggttagaaggcggtacacttcggctttccaagccgaataaaaatatttccagacgggctagctacaacgagccgaaacctgaggtgacctacatatcacagaagatctatgacttgagtgatagtaagatatatctggtcccaaaaactctcgcgaggaagagaatatggaataagaagtaccctatctgcatagagctcggccaacaggatgactttatgtccaaagcacagacagataaggagacgtctgaagagaaacccccagccgagggatccgaggaccccaaaaaaccccctcgaccccaggagggcacccgctcctctcaacgtgaccagattctgtacctatttgggaggaccgggagggagaaagaagagtggttccgacgatttatcctggcttcaaaactgaagtcagagatcaaaaaaagcagcggcgtatccgggggaaaaccggcacccgtctttctcgcaccgggtctgctccccgctcactcgagacataactctccctccgggcacctgacacacagtaggagttcctctaagggtagcgtggaagagatcatgtctcagccaaaacagaaagagctggccggatctgtgcgccaaaagatgctattggactactcagtgtacatgggcaggtgcgtcccgcaagaatctcggagtccacagcgttcccctttgcagagcgccgaatcttccccgaccgcaggtaagaaattacccgaggtccctcctagcgaggaggaagaacaggaagcatgggtaaatgctttgttgggcagaattttctgggattttctgggcgagaagtattggtccgatctggtctcaaaaaagatacaaatgaagctgagtaaaataaagctgccatacttcatgaacgagcttaccctcacggaactggatatgggggtggctgtacctaagatcctgcaagcatttaagccctacgttgaccatcaggggctttggattgatttggaaatgtcatataatggttctttcctaatgacgctggaaacgaagatgaatctgactaagcttgggaaggaaccacttgtggaagcactcaaagttggggaaatcggtaaagagggctgcagaccacgggcattttgtttagccgattccgacgaggaatcaagtagcgcagggtcctccgaagaggatgatgcccctgagccaagtggaggcgacaaacaactgctgccaggagccgagggttacgtgggtgggcacaggacgtctaagattatgaggttcgtcgataaaattaccaaaagcaaatactttcagaaggctacagagaccgagtttataaagaagaagattgaggaagttagtaataccccgctgttgttgaccgtcgaagtccaggaatgccggggtacgctcgccgtaaacatcccccctccccctacagatagggtgtggtacggctttaggaaacctcctcatgttgagctaaaagcgaggccaaaactgggtgaaagggaagtgacactggtacacgtcaccgattggattgagaagaagctcgagcaggagttccaaaaagttttcgtgatgcctaacatggacgacgtgtatatcactataatgcactcagcgatggatccgcgtagcaccagttgcttgctgaaggaccctcctgtcgaggcagctgaccagccttag

SEQ ID NO: 54764 - DNA, 591 bp, Artificial Sequence
  Description of Artificial Sequence: Synthetic coding sequence
atgtggttcatgtacctgctctcctggctttctctttttatccaggtggcattcattaccctcgccgtggcggctggcctgtactacctggccgagctaatcgaggaatacaccgtcgctacttccagaataattaaatacatgatatggttttccactgctgtactcattgggctgtacgttttcgaacgatttccgacttctatgattggcgtcggtctcttcaccaaccttgtttacttcggactcttgcagacattcccttttatcatgttgactagtccgaacttcattctgtcctgcgggttggtcgttgtgaaccattatctggcatttcagttctttgctgaggaatattaccctttcagcgaggtgttggcttacttcacattctgtctgtggattatcccctttgccttctttgtgtctctatccgctggagagaatgttttgccatccacaatgcagcctggggatgatgtggtaagcaattattttaccaagggcaagagaggcaaacggctcggcatcctcgtggtcttctcatttatcaaagaagccattctccccagtcggcagaaaatctattag

SEQ ID NO: 54765 - DNA, 1233 bp, Artificial Sequence
  Description of Artificial Sequence: Synthetic coding sequence
atggtgcttaaggcagaacacacacgctctccgtccgcaaccctgccatctaacgtacctagctgccgctcgctcagctctagcgaagacggcccaagcggcccttcatcactcgccgatgggggactggcacacaacctccaagactccgtgaggcatcgaatcctctacctctccgaacagcttagggtagagaaggccagtcgcgacgggaacacagtgagctaccttaaactggtgagcaaagccgatcgccaccaagtgccccatatccaacaagcattcgagaaggtgaatcagcgggcatctgctactatcgcccaaattgagcaccgactgcaccagtgtcaccagcagctgcaggagctcgaagagggctgcagaccagaaggcttactcctaatggccgagagcgatcccgctaattgcgaacctccatccgagaaggccctgctaagcgagccccctgaaccaggcggagaagatgggccagtcaacctaccgcatgcttctcgccctttcattctggagagccgttttcagtccttgcagcaggggacatgtctggaaacggaggatgtcgcccagcagcaaaaccttctcttacaaaaagttaaggctgagctggaggaggccaagcggtttcatatatctctgcaggagagctaccactccctgaaagagcgctctttgacagatctgcaactgttactagagagcctgcaggaggagaaatgcagacaggctctgatggaagagcaggtgaatggtagactgcaaggccagctgaacgaaatatataatcttaaacacaatttagcttgtagcgaagagcgcatggcttacctgtcatatgagcgggctaaggaaatatgggagatcaccgagactttcaaatcgcgcatttctaagctggagatgctccagcaggtaacacagctcgaggccgctgagcacctgcagagccgtccaccacagatgcttttcaagtttttgtcaccgaggctgtccttggccaccgtgctgttagtgtttgtttccactttatgcgcttgcccgagcagccttatcagttctaggctgtgcacatgcaccatgctgatgttaatcgggctcggtgtgctggcttggcaaagatggagggcaatccccgctacggactggcaggagtgggtgccaagtaggtgtcgcctgtactctaaggacagcggcccacctgccgacggcccatag

SEQ ID NO: 54766 - DNA, 1233 bp, Artificial Sequence
  Description of Artificial Sequence: Synthetic coding sequence
atggtcttgaaagcagagcatactaggtctccgagcgctacccttccttccaatgtcccatcctgccgtagcctgagttccagcgaagacggaccctcgggcccatcctctctggctgatgggggtctcgcacacaacctgcaggactctgtacgccaccgcatcctgtacctaagcgagcagctgagagtggaaaaggcctcacgggacggaaacacggtctcatacctcaaacttgtgagcaaagccgatagacaccaagtgccacacatccagcaggcatttgaaaaggtcaaccaacgggcaagcgcaaccattgcccagatcgagcaccgcctacaccagtgtcaccaacaattacaggagttggaggagggatgcagaccggaggggcttctgctgatggccgagtcagatcccgctaactgcgagcctccttcagaaaaggcccttctatctgagcctccagaacccggtggagaggatggccctgttaacctcccacacgcgtcaaggccatttattctcgagtcccggttccagagtctccagcagggaacatgcctggagacagaggatgtggcccagcagcagaacttgctgttacaaaaagtgaaggctgagctcgaggaggctaagcgcttccacataagcctccaagaatcctaccactctctgaaagagcggtctctcacggaccttcagttgttactggagtctctgcaagaggagaaatgccgccaggccctgatggaagaacaagtgaacggccgactacagggtcagcttaacgagatctacaacctaaagcacaacctggcttgtagtgaggagagaatggcctatctctcttatgaaagggctaaagagatctgggagattacagagacctttaagtccaggattagcaagctcgaaatgctgcagcaggtcactcagctggaggcagcagagcacctgcagtcacgccctcctcagatgctgttcaaattcctttcccctcgcctttctctcgcaaccgtgctcctggtgttcgtgagcaccctctgcgcatgcccctcaagtctgataagttcccgcttatgtacctgcaccatgctcatgctcatcgggctgggtgtgctcgcctggcagagatggagagctatacctgctaccgactggcaggagtgggtaccatctaggtgccggctatattccaaggatagcgggcctccggcagacgggccatag

SEQ ID NO: 54767 - DNA, 1068 bp, Artificial Sequence
  Description of Artificial Sequence: Synthetic coding sequence
atggaagagggagaacgctccccactactgagtcaagagactgcgggacagaagccactgagcgtccaccggccacccaccagcggctgtttaggtcctgtgcccagggaggaccaagccgaggcctggggttgctcctgctgccctccagaaacaaagcatcaggctttgtctgggacacccaagaaagggccagctccctctctttcacccggaagctcttgcgttaagtatttgatcttccttagcaattttccctttagcttgcttggcctccttgcccttgcaatcggactgtggggccttgccgtgaaagggagtctgggctcggatctgggcggtccactgccagctgatcccatgcttggccttgcgctcggcggactggtcgtctccgccgttagtctcgctgggtatctaggggctctgtgtgagaatacgtgcctactgcgcggtttcagcggaggcatcttagcttttttagttcttgaggccgtggccggtgctctggtggtggctctctggggccctctacaggactccttagagcataccttgcgggtcgctatcgcgcactatcaggacgacccggacctgagatttctcctggaccaggtgcagctggggctgcgctgctgcggtgctgccagctaccaggactggcagcagaatctgtactttaactgttcttcccccggtgtgcaggcatgctctttacctgcatcatgctgcatcgatccacgcgaagacggagccagcgtgaacgatcagtgtggctttggggtcctgcgactggacgctgacgcagcgcagcgagtcgtctacctcgaaggctgtggcccacctctgcgaagatggctcagagccaacttggccgcttccggtgggtacgccattgctgtcgtgctgctgcaaggagcagagctcttgcttgcggctcggctcctgggagccctcgcagctaggcggggagctgcatatggacccggtgcccgaggcgaggatagggctggtcctcagtctccatcaccaggcgcacctccagccgctaagccggctagaggctag

SEQ ID NO: 54768 - DNA, 708 bp, Artificial Sequence
  Description of Artificial Sequence: Synthetic coding sequence
atggaggagggagaaagatcaccacttctgtcccaagagaccgcagggcagaagcccttaagcgtacaccgcccacctacctctgggtgcttagggccagtacccagagaagaccaagcagaggcctgggggtgttcttgctgtccacctgagaccaaacatcaggccctatctggaactcctaagaaaggaccagctccatcactgtctccagggtcatcatgtgtaaaataccttattttcctatctaatttcccattcagcctgctcggcttgttggccctcgccataggcctgtggggccttgccgttaaaggcagcctgggctccgatctcggtggacccttaccagctgatcctatgctgggtctggctctggggggactcgttgtcagtgccgtctcattagccggataccttggtgccctatgcgagaatacctgtctgcttcgagggttctccggcggtatcctggccttcctggttctggaggccgtggctggggctcttgtcgtggccttatggggtcccctccaggactccctagagcacactctccgcgtggctatcgcccattaccaggatgaccccgatctccgttttctgcttgatcaggtgcagctgggcctgaggtgttgcggcgctgcttcttaccaggattggcagcagaacctgtattgtctctccagtccctgctcttcccagtag

SEQ ID NO: 54769 - DNA, 762 bp, Artificial Sequence
  Description of Artificial Sequence: Synthetic coding sequence
atggctcattacaaaaccgaacaggacgactggttaataatctacctcaagtacctactattcgtgttcaacttcttcttttgggttgggggagctgcagtgctagcggtgggtatctggaccttggtcgagaagtctggttatctctcagtgctggccagctcaacttttgccgctagtgcctacattctaatctttgctggtgttcttgtgatggtgacaggttttcttggcttcggtgctatcctgtgggaacgaaaaggttgcttgagtacctatttttgccttcttctggtcatctttctcgttgaactcgtggccggtgtgctggcccatgtctactatcagagactttccgatgaactgaaacagcatctgaacaggaccctggccgaaaactacgggcaaccaggagctacccagatcaccgcctccgtggatcgacttcaacaggacttcaagtgttgcgggtctaatagctctgccgactggcagcattcgacatacatcctccttcgtgaggctgaaggcagacaggtcccagatagttgctgtaagacagttgtcgtcaggtgtggccagcgggcacacccaagtaacatctacaaagtggaagggggttgcctaacaaagctcgagcagttcctggctgaccacctgttactaatgggagccgtaggcatcggagttgcatgcctgcagatttgtggtatggtccttacttgctgcctgcaccagcgcctgcagcgccacttttactag

SEQ ID NO: 54770 - DNA, 732 bp, Artificial Sequence
  Description of Artificial Sequence: Synthetic coding sequence
atgagatccggcggaggcagaaacgcatgggatacgcggggtgcgtgcgagcaggtggggggtgctgctgttctggctgtaggcatatggacactggtggagaaatctggttacctttccgtgctggcctcttctacattcgcggctagcgcatacattcttatcttcgccggagtgttggtcatggtcacggggtttcttggcttcggtgcaatcctgtgggagcgtaaaggctgcttgtccacctacttttgcttgctgttagtgatatttctggtggagctggtagcaggcgtcctggcccatgtgtattatcagcgtctgtctgacgaactcaagcaacacctgaatcggaccctcgccgaaaactatggacaacccggtgccacccagataacggcctcagtggaccggctgcagcaggactttaagtgttgcggttcgaacagcagcgccgattggcagcactccacgtatattttgctgcgcgaggccgagggcaggcaagtgcccgactcatgctgtaaaacagtggtggtccgctgtggccaaagggcgcatccttctaacatctataaggtggaagggggatgtctgactaagctcgaacagtttctggccgaccaccttctgcttatgggggctgtgggaattggagttgcatgtttgcagatttgcggaatggtattgacctgctgcctacatcagaggctgcaaaggcatttttactag

SEQ ID NO: 54771 - DNA, 762 bp, Artificial Sequence
  Description of Artificial Sequence: Synthetic coding sequence
atggctcattataaaaccgaacaggatgactggctaatcatctacctgaagtacctgctctttgtctttaacttctttttctgggtggggggagctgcagtgctggcggtgggcatatggaccttggtggagaagtctggttatctgtcagtcctggctagctcaacgttcgcggctagtgcctacattttgatattcgccggtgtgctcgtgatggtgacaggttttttgggattcggcgctatcctctgggagaggaaagggtgtctatccacatatttctgcctgcttttggtgatttttctggtggaattggtggccggtgtgctcgcgcatgtttattaccagagactgtccgatgaactgaaacagcacctgaacagaactttggcggagaactacggccagccgggagccacacagatcacggcgtcagtcgatagattacagcaggacttcaagtgctgtggctctaactcctctgctgactggcagcacagcacgtatattcttttgcgtgaggccgaaggcaggcaggtgccggattcctgctgcaagacagttgtggtccggtgcgggcaacgggctcacccctctaatatttataaagtggaaggcggatgcctaacaaaactagagcagttcttggccgatcatctattgctgatgggcgcagtgggcatcggggtcgcatgtctgcagatctgtggaatggtcctgacttgctgcctccaccagcggcttcaacgccacttttattag

SEQ ID NO: 54772 - DNA, 642 bp, Artificial Sequence
  Description of Artificial Sequence: Synthetic coding sequence
atgcattactacagatacagcaacgcgaaggtttcttgctggtacaaatatttattattttcatacaatatcatattttggctggccggagtcgtctttctgggggtgggcctgtgggcctggtccgaaaagggggtcctgtctgacctgacaaaagtcacaaggatgcacggcatagatcccgtggtactcgtgcttatggtaggcgtcgttatgttcaccctcggtttcgccggttgtgtcggcgcactccgggaaaatatctgcttgctgaatttcaaccagtgttgcggagcctatgggcctgaagactgggacctcaatgtctactttaactgcagcggagcttcctactcccgcgagaagtgtggggtaccgtttagttgctgtgtgcctgatcccgcacagaaagtggtgaacacacagtgtgggtatgatgtccgtatccaactcaaaagcaaatgggacgaaagcatcttcaccaaagggtgcatacaagccctggaatcctggttaccacgcaatatatatatcgtggccggtgtgttcatcgcgatcagcctgctgcagatctttggtatctttctggcgagaaccttgatctccgatatcgaggccgtgaaggctggacatcatttttag

SEQ ID NO: 54773 - DNA, 813 bp, Artificial Sequence
  Description of Artificial Sequence: Synthetic coding sequence
atgcactattacagatattcaaatgctaaggtgtcctgttggtacaaatacctgctgttctcatacaatattatcttctggctggctggggtcgttttcctgggagtcggcctgtgggcgtggtcagagaaaggggtgttaagtgacctgacaaaggtgaccagaatgcatggcatcgatcctgtcgtgctcgtcctgatggtcggtgtggtgatgttcactttgggcttcgccggatgcgtcggtgccctcagagaaaacatatgtctcttgaatttcttctgtggtaccattgtgctgattttttttttagagctagccgtcgccgtgcttgctttcctgtttcaagactgggtgcgcgaccgcttcagagaattcttcgagagcaatataaaatcctaccgagatgatatcgatttgcagaacctgatagactcgctgcaaaaggccaatcaatgctgtggcgcatatggaccagaggactgggacctgaatgtgtatttcaactgctcgggagcgtcctacagccgggagaaatgcggggtgccctttagctgctgtgtgcccgaccccgctcagaaagtcgtcaatactcagtgtggctatgatgttcgcattcagttgaaatccaaatgggacgaaagtatattcacaaagggctgcatccaggccctcgaaagctggttaccacggaatatatacatcgttgccggagtgttcattgcaatctccctcctgcagatatttgggatctttttggctcggacactgattagcgacattgaagcagttaaggcagggcatcatttttag

SEQ ID NO: 54774 - DNA, 672 bp, Artificial Sequence
  Description of Artificial Sequence: Synthetic coding sequence
atggaaaggaaggtcctcccgtgctttctgtgtctgttccagggagtcctgtctgatctcacaaaagtgacccgcatgcacggcattgaccccgtggtgcttgtcttgatggtgggtgtggttatgttcactctggggtttgctggctgtgtgggcgcattacgcgagaatatttgtctcttgaattttttttgtgggactattgtacttatcttctttctcgagcttgctgtggccgtgttggcatttttatttcaggactgggtgagagacagattccgcgagttcttcgaatcaaacatcaaatcatatagagacgatatagatcttcagaacctgatcgattcactgcaaaaagctaatcaatgttgcggcgcttacgggcctgaggactgggatctaaatgtctacttcaattgcagtggggcttcatattcacgagagaagtgcggggtgcccttttcatgctgcgtccctgatcccgctcaaaaagttgtgaacacacaatgtggttacgacgtgaggatccagctgaaaagtaagtgggatgaatccattttcacaaagggctgtatccaagctctggaaagttggttgcctagaaacatatacattgtggcaggcgtctttatagcaattagcctcttgcaaatcttcggaattttcttatag

SEQ ID NO: 54775 - DNA, 813 bp, Artificial Sequence
  Description of Artificial Sequence: Synthetic coding sequence
atgcactattacaggtacagcaatgcaaaggtgtcttgctggtataaatacctgttgtttagctataacattattttctggctggccggtgtggtgtttttaggtgtaggtctgtgggcgtggtccgagaaaggcgtgttgtctgacctcacaaaggtcactcggatgcatggcatagaccctgtggtgctggtccttatggttggagttgttatgtttacccttggttttgcaggctgtgtcggggctctgcgcgaaaatatttgcctactcaactttttctgtggaacaatagtactcatctttttcctggagctggctgtagcagtgctcgcattcctgttccaagattgggtgcgcgataggtttcgagaattctttgagtctaatatcaagagttatcgggacgacattgatttacagaacctgatcgacagcctgcagaaagccaatcagtgttgtggcgcttacggtccagaggactgggacttgaatgtctatttcaactgtagcggagcaagctactcacgtgagaagtgtggggtacccttttcttgttgtgtgcctgatcccgcacagaaggtggtgaatactcagtgcggatacgacgtgcgcatccagctgaagagtaaatgggacgaaagcatattcaccaagggctgtatacaggcactggagagctggctaccccgaaatatatatattgttgccggagtttttattgctatcagcttgctccagatctttggcatctttctcgcccgaaccctgatcagcgatatcgaggctgtaaaggctggccatcatttctag

SEQ ID NO: 54776 - DNA, 450 bp, Artificial Sequence
  Description of Artificial Sequence: Synthetic coding sequence
atgcattactacaggtacagtaacgcaaaggtttcttgctggtacaaataccttctattcagctacaacattattttctggctggctggcgttgttttcctgggggtcgggctctgggcatggtctgaaaaaggagtactttctgacctgacaaaggtgacccggatgcacgggattgacccagtggtgctcgtgcaccccttgtccggctcctgccagcgatatttttcatgtccagtctttctgtctctcgcattcttgagccacccaaaaaatttgccaaggccttatgggagcttaccattctttcccagacagctgctcatatgggccgtgtgtaccccaagcttcgcaccgccaaccatgccccacgttgccgagagctgtttaagccagctgtccaccctggccttcttcagtctgtgctccacacgtcactgtacgagctag

SEQ ID NO: 54777 - DNA, 762 bp, Artificial Sequence
  Description of Artificial Sequence: Synthetic coding sequence
atgcactactaccgatactcaaacgccaaagtgtcatgctggtacaagtatcttctttttagctataacatcattttttggggagttctaagcgatctgaccaaagtgactagaatgcacgggatcgaccccgtggttctggtgttgatggtgggagtggtgatgttcactctgggattcgccggatgcgttggcgctttgcgcgagaatatctgcttgttgaactttttctgtggcacaatcgtcctgattttttttctcgagctagcagtggccgttctggcattcttgtttcaggactgggtaagggaccggttcagagaattctttgagagcaacatcaaatcctatcgcgatgatatagatctgcagaatttgatcgactccctgcaaaaggccaatcagtgctgtggcgcttacggaccggaggattgggatttgaacgtgtacttcaactgcagtggtgctagttatagcagagagaagtgcggagttcctttcagttgttgcgtgcccgaccctgcccagaaggtcgtcaacacccaatgcggttatgacgtgcgaatccagctaaagtcaaagtgggatgagtccatcttcacaaagggatgtatccaggccctcgaaagttggcttccgagaaacatttacatcgtggccggagttttcattgcaatttccttgctacagattttcggtatcttcctggctaggactctgattagcgatatcgaggccgtgaaggcaggtcaccacttctag

SEQ ID NO: 54778 - DNA, 813 bp, Artificial Sequence
  Description of Artificial Sequence: Synthetic coding sequence
atgcattattacagatattcgaacgctaaggtctcctgttggtacaagtacttgttattttcctacaacattatcttttggctggccggagtggtttttctgggggtgggactgtgggcatggtccgagaagggcgtcctgtctgatctcactaaagtgacacggatgcacggcatagacccagtcgtcttggtcctgatggtcggagtcgtgatgttcacccttggcttcgctggatgcgtgggcgctttacgggagaacatttgcctgttgaactttttctgtggaactattgtactcatcttcttcttggaacttgccgtggcagtgcttgcgttcctgttccaggactgggtccgggaccgtttcagagaattctttgagagcaacattaaatcctaccgcgatgacatcgacctgcagaacctaattgacagtctccagaaggccaaccagtgctgtggagcttatggcccagaggactgggatctgaacgtgtattttaactgtagcggggcttcttatagtcgcgaaaaatgcggcgtgccattttcatgttgtgtgcccgatcccgcacagaaagttgttaacacacagtgtggatacgacgtccgaattcaactgaagtctaaatgggacgagtctattttcactaagggttgcatccaggctcttgagtcctggctgccgaggaacatttatatagtggcaggcgtattcatcgcaataagcctcctgcaaatttttggcatttttttggctcggactctaatctccgacattgaagctgttaaagctggtcatcatttttag

SEQ ID NO: 54779 - DNA, 444 bp, Artificial Sequence
  Description of Artificial Sequence: Synthetic coding sequence
atgcattattatagatatagtaacgctaaagtgtcttgttggtacaaatacctactgttctcgtataatattattttctggaaccagtgctgcggtgcgtatgggcctgaagattgggacctgaatgtatacttcaattgcagcggtgcctcttattcccgggagaagtgtggggttccattctcgtgttgcgtccccgacccagcgcagaaggttgtaaatacccagtgcgggtacgacgtccgtatccagctcaaatctaaatgggatgaaagcatttttacaaaaggctgcatccaggcgttggagagttggctgcctagaaatatatatatagttgccggtgtttttatcgctatctccctcctgcagattttcgggatctttctggccaggactcttatctccgacatcgaggctgtcaaggccggacatcacttctag

SEQ ID NO: 54780 - DNA, 738 bp, Artificial Sequence
  Description of Artificial Sequence: Synthetic coding sequence
atggcagaaatccataccccctactcgtcactgaaaaaactgctgtcactactgaacggctttgtcgctgtgtctggaattatcctcgtgggcctgggtatcggaggaaagtgtggaggcgcttcactgacaaatgtgctcggcctctcctccgcctacctgttgcacgtgggaaacctgtgcctggtgatggggtgcatcacagtgttgctcggatgtgcaggatggtatggcgcaaccaaagagagcagaggcaccctgctgttttgcatcctgagcatggttattgttctgattatggaggtcaccgcggctaccgtggtcctgttgttttttcccattgtgggcgacgttgccctggaacacacattcgtaacattgcgcaagaactaccggggatacaacgagcccgacgattactctacacagtggaacctggtcatggaaaagttgaaatgttgtggcgtcaataactacactgatttctcaggatcctcgtttgaaatgacaactgggcacacttaccctaggagctgttgtaagagtattggctccgtgagctgcgatggccgagacgtaagtcctaacgtgattcaccaaaaaggatgctttcacaaactcctgaagatcacaaaaactcagtctttcactttgagcggctcgagcctcggcgctgccgtgattcaaagatggggctctagatatgttgcccaggccggtctcgagttattggcctag

SEQ ID NO: 54781 - DNA, 483 bp, Artificial Sequence
  Description of Artificial Sequence: Synthetic coding sequence
atggccgaaatacacacaccttatagctcacttaagaaactcctcagcctcctgaacgggtttgtcgccgtgagtggaattatacttgtaggcctcggaattggcggaaaatgtgggggagcgagccttaccaatgtcttaggtttatcttccgcatacctgcttcatgtgggcaacctctgcctggtaatgggatgcatcacagtcctcctcggctgtgccggatggtatggcgctacaaaggagagcagaggcactctcttgttttgcatcctgtcaatggtcatagtgctcatcatggaggtgactgccgcaactgtcgtcctgctgtttttcccaattgtgggcgacgttgccctggaacacacctttgtgaccctgaggaagaattatcgaggttacaatgagcccgacgattacagcacccaatggaacctggtgatggaaaagggattgtctaagtacttcttctcatctctgtag

SEQ ID NO: 54782 - DNA, 999 bp, Artificial Sequence
  Description of Artificial Sequence: Synthetic coding sequence
atgcctggtaagcaccagcatttccaggaaccagaggttggctgttgcggcaagtatttcctttttggcttcaatattgtgttttgggtgcttggggctctgttcttagccattggcctctgggcttggggtgaaaagggggtgctttccaacataagcgctcttacagacctggggggactggaccccgtgtggctcttcgtggtcgttgggggagtgatgtctgtgctcggtttcgcaggctgcattggcgcacttagagaaaacacttttctgcttaagttcttcagcgtctttctggggctgatctttttcttagagctggcaacaggaatactggcattcgtctttaaggattggattcgcgaccagttaaacttatttatcaacaacaacgtgaaggcgtaccgggatgacattgatctccaaaacctgatcgactttgctcaagagtattggagttgctgcggcgcaaggggaccaaatgactggaacctaaatatctacttcaattgcaccgatctgaacccctcgcgcgagcgttgtggagtgcccttttcctgctgcgtacgggatccagctgaagatgttttaaacacccagtgtggctacgacgtgaggttgaaactcgtgcgaggtgagttggagcagcaaggtttcattcatactaagggctgtgtgggccagttcgagaaatggctgcaggataacctgattgtggtggccggagtttttatgggcatcgccctcctgcaaatctttgggatttgtctggcgcagaatcttgtgagtgacatcaaagccgtcaaggctaactggtcaaaatggaatgacgattttgagaaccactggcttacccctacaattagtgaggtgctgagcaccgcaggaccccagcaaaacagcctgacaggtgctcctggcccagccccaccaagcaggcatgtattcttcggcttaggagggctatacccggaacctacttttaagaattggtag

SEQ ID NO: 54783 - DNA, 801 bp, Artificial Sequence
  Description of Artificial Sequence: Synthetic coding sequence
atgcccggaaagcaccagcacttccaggagccagaagtggggtgctgtggcaaatattttctgttcgggttcaatatagtcttctgggtcctgggagcgttgtttcttgcaatagggctgtgggcctggggcgaaaaaggagtgttatcaaatatcagcgcactcaccgacttaggagggctcgaccccgtctggctcttcgtggtggttggtggagttatgtctgtgctggggtttgccggatgtatcggggcattacgggagaacacattcctgctgaagttcttctccgtatttctcggcctgattttctttctggagctggcaacagggattttggctttcgtttttaaggattggattcgtgatcaattgaacctgtttatcaataataacgtgaaagcctaccgtgacgatatcgatctacagaatctaattgacttcgcacaggagtattggagctgttgcggggctcgtggcccaaatgactggaacttaaacatttacttcaattgtactgatctcaacccaagcagggaaagatgcggggttcctttttcttgttgcgtacgtgatcctgccgaggacgtactgaatacccaatgtggatatgacgtgcggctgaagttggtgcggggtgagctcgagcagcaggggttcattcacacaaagggctgcgtggggcagttcgagaaatggctgcaggataatctgattgtcgtggccggagtgtttatgggcatcgctctgttgcagatttttgggatctgtttggcgcaaaatcttgaacagatggaatag

SEQ ID NO: 54784 - DNA, 990 bp, Artificial Sequence
  Description of Artificial Sequence: Synthetic coding sequence
atgcctggtaaacaccagcatttccaagagccggaagttggctgctgtggaaaatatttcctctttgggtttaacatagtattctgggttctgggggcattgttcctggcgatcggtctttgggcctggggggaaaagggcgtgctttcaaatattagtgccttgaccgatctgggaggtcttgaccccgtttggttgttcgtggtggtggggggagtgatgagtgttcttggcttcgccggatgcattggggctctcagagagaacacctttctgctcaaatttttttccgtcttcttgggactcatcttctttcttgaactggccacaggcatactggcctttgtattcaaggactggattagagatcagttgaatctgttcattaacaataacgttaaggcgtatcgagacgatatcgatttacaaaacctgatcgacttcgcccaagaatactggtcttgctgcggagctaggggaccaaatgattggaatctaaacatctatttcaattgcacagatctgaacccatcacgcgaacgctgcggagtacccttctcctgttgcgttcgggatcccgctgaggatgtgctgaacacgcagtgtggatacgacgtcagactcaagctggaattggagcagcagggattcattcacactaaaggatgcgtaggccaattcgagaagtggctacaagataacctgatcgtagtggcgggtgtctttatggggattgcactacttcagatttttggaatttgtcttgcacagaacctggtcagcgatattaaggcagtgaaggctaactggagcaaatggaacgatgacttcgaaaatcattggttgacacccacaattagcgaggtgttgtccaccgctgggcctcagcaaaatagtttgaccggagccccagggccagctcccccatcccgccacgtgttttttggactaggtggcctataccccgaaccgacattcaaaaactggtag

SEQ ID NO: 54785 - DNA, 792 bp, Artificial Sequence
  Description of Artificial Sequence: Synthetic coding sequence
atgcccggtaaacatcagcactttcaggagcctgaagtgggttgttgcggcaagtattttttattcggtttcaacattgtgttctgggtgttaggggcactcttccttgcgataggcctctgggcctggggcgagaaaggggtcctatcaaatatctccgctctcaccgacttggggggactcgacccagtttggctctttgtcgtggtaggcggtgtgatgtcagtgttgggcttcgctggatgcataggagccctccgagaaaatacatttctgctgaaattcttcagtgtcttccttgggcttatctttttcctcgagcttgctacgggaatccttgcctttgtcttcaaggattggatcagagatcaactgaatctcttcattaataacaatgtgaaggcttaccgggatgacatagacctgcagaacttaattgactttgcccaggaatactggtcctgttgtggcgctaggggacctaatgattggaatctcaatatatattttaattgcacagatctcaatccttcaagagaacgttgtggagtccctttctcatgttgtgttagagatcctgcagaagatgttctcaacacacaatgcggctatgacgtcagactgaagctggagcttgagcagcagggttttatccataccaaggggtgtgtgggtcagtttgaaaaatggctgcaagataatttgattgtcgtagctggcgttttcatgggcattgctctgctccagatctttggaatttgtctggcccaaaatctggagcaaatggaatag

SEQ ID NO: 54786 - DNA, 747 bp, Artificial Sequence
  Description of Artificial Sequence: Synthetic coding sequence
atggaaggtgactgcctgtcttgtatgaagtacctaatgtttgtattcaacttttttatctttctcgggggagcttgtctgctggccatcggaatatgggttatggttgacccaaccgggtttcgggagattgtggccgcaaaccctctgcttctcacaggtgcctatattctactggcgatgggaggtctgctctttctcctgggtttcctcggatgctgtggtgcagtcagagagaataagtgtctgctgttgttcttcttcctcttcatcctgattatttttctggccgagctgtcggccgcaattcttgcattcatcttcagggaaaacttgacgagggaattctttacaaaggagctgaccaaacactaccagggcaataacgatactgacgtgttcagtgccacttggaacagcgtgatgattaccttcggttgttgcggcgttaatggaccagaggacttcaagttcgcgtcagtgtttaggctcctgacactcgatagcgaagaggttccagaggcctgttgtagaagagaaccccagtctcgggacggtgtcctgctatctagggaggaatgtttgctcggacgctcattattcctgaacaagcaggggtgttatactgtcatattgaatacctttgaaacgtatgtgtaccttgcaggcgctctagccattggcgtgctagccattgagctctttgcaatgatttttgctatgtgcctgttccggggaatccagtag

SEQ ID NO: 54787 - DNA, 816 bp, Artificial Sequence
  Description of Artificial Sequence: Synthetic coding sequence
tgatggtctactatggagggtgattgccttagttgcatgaaatatttgatgtttgtttttaacttctttatatttttgggcggagcctgtctccttgcaatcgggatctgggtgatggtggatcccactggattccgggaaattgtcgccgcaaatcccctgttgctcactggggcttacatactgttggcaatgggcggactgctgtttctgttaggattcctcggatgttgcggggcagtgcgggagaacaagtgcctgctgctgttcttttttctcttcatcctgatcatttttttggcagaattgtccgcggcaatcttagctttcattttccgtgaaaatctgactcgagagttcttcactaaggagctcaccaaacactatcagggcaacaatgacacagatgtttttagcgccacttggaactcagtcatgatcacctttgggtgctgcggggtgaatggaccggaagatttcaagtttgcctcagtgttccgccttttgaccttggactctgaggaggtgccggaggcctgttgcagaagagagccccagtctcgagacggggtcctactgtctcgagaggagtgccttctgggacgaagtcttttccttaataaacagggttgctatactgtgattctgaatacattcgagacctatgtgtatctggccggtgccctcgccatcggcgtgcttgcaatcgaagaggagagggcccattccgtttcgcaggcaacgggcatcttgtaccaactgcccgcttcccctcaggccttccagtcacccggaactctaggagcaacagcttag

SEQ ID NO: 54788 - DNA, 747 bp, Artificial Sequence
  Description of Artificial Sequence: Synthetic coding sequence
atggagggagactgcctgagttgcatgaagtatctgatgtttgtgtttaacttctttatcttcctggggggagcctgtctgctcgcaatcgggatctgggtcatggtagacccaacgggttttagagagatagttgcggcaaatccactgctgctcacaggagcctacatcctacttgcaatgggcggactgctgtttctgctgggttttctcggctgctgcggggcagtcagagaaaacaagtgtctgctgctgttttttttcctctttattctcataatattcctcgctgagctctcagccgctattctggcttttattttccgggagaatttaacacgtgagttcttcacaaaggaacttactaaacattatcagggtaacaacgacactgatgtgttctccgccacttggaactcagtcatgatcacatttggttgctgcggggtgaatgggccagaggactttaaatttgcttcagttttccggctgctgacactggattctgaggaggtacctgaagcttgctgtcgcagggagccacagagcagagatggagtgcttctaagtcgcgaggagtgcttattgggaaggtccctattcttaaacaagcaggggtgttacacagtaatcctgaatacttttgaaacctatgtctaccttgcgggtgctctagcgatcggagtgctggccatcgaattattcgcaatgatctttgctatgtgccttttccgaggcatccaatag

SEQ ID NO: 54789 - DNA, 240 bp, Artificial Sequence
  Description of Artificial Sequence: Synthetic coding sequence
atggaaggggactgcctgtcttgcatgaagtacctgatgttcgtctttaacttctttatctttctggggggtgcatgcttactggccattggcatttgggtgatggtcgacccaacaggattccgagaaatcgtagccgctaatccccttctcctgactggggcttatatcttgctagctatgggtggcctgctcttcttgctagggttccttggatgctgtggggctgtgagggaatag

SEQ ID NO: 54790 - DNA, 441 bp, Artificial Sequence
  Description of Artificial Sequence: Synthetic coding sequence
atggaaggcgattgtttgtcgtgcatgaaataccttatgttcgtctttaacttctttatatttctgggaggagcctgtctcctagcgataggtatttgggtgatggtcgacccgactgggttccgagagatagtcgccgcaaacccccttttactgacaggagcatacatcctcctggccatgggtggactgctattcctcctcggttttcttggctgctgcggtgcagtacgggagaacaagtgtcttttgctgttcttttttctgttcatactaatcatcttcctggccgagctctcggcggctatcctcgctttcatctttagggagaacctaacccgcgaattcttcaccaaggaactgaccaaacactatcagggtaataacgacacagatgtatttagcgcaacgtggaacagcgtgatgattacagtctcctag

SEQ ID NO: 54791 - DNA, 852 bp, Artificial Sequence
  Description of Artificial Sequence: Synthetic coding sequence
atggcacgcagaccgagagctcccgcagcgagtggagaagagtttagtttcgtgtctcccctggttaaatacctgcttttcttttttaatatgctcttctgggtcataagtatggtgatggtagcagtgggcgtgtatgcccgtctcatgaagcatgccgaagccgcactagcctgtctggccgtcgacccagctatattgttgatcgtggtgggcgtcttaatgttcctgctgacattttgtggatgtatcggctccctgagagagaacatatgtctactgcagacattctcgctttgtctgaccgcagttttcttactgcagctcgctgcgggtattctgggctttgtgttttctgacaaagcacgcggaaaagtgtcagaaataatcaacaacgcaattgtgcactatagggatgatttggatttgcaaaacctgattgacttcgggcaaaagaagttttcatgctgcggtggcatttcatacaaagattggagccaaaacatgtacttcaattgttccgaggataacccatctagggagaggtgtagcgtgccttacagttgctgtctgccaacccccgatcaggccgtcatcaataccatgtgcgggcaagggatgcaggccttcgattacctggaagcaagcaaagtgatctacactaatggctgcatcgacaagctggttaattggattcattcgaaccttttcctgcttggaggtgtggcccttggcttagcgataccccagctggtcggcatcttactgagccagatcctcgtgaatcaaatcaaggaccagatcaagctccagttatacaaccagcagcacagagctgacccgtggtattag

SEQ ID NO: 54792 - DNA, 1338 bp, Artificial Sequence
  Description of Artificial Sequence: Synthetic coding sequence
atggcagagtatgatctgacgactcgtatcgcccacttcctggaccgacacctcgttttccccctcctggagtttctgtcagtcaaggagatctataatgaaaaggagctgctgcagggcaaactcgacctgctctcggacacaaacatggtggacttcgctatggatgtgtataagaacttatattcagatgacatccctcacgccctccgggaaaagaggacaaccgtcgtagcccagttgaagcaactgcaggccgagactgagcctatcgtaaaaatgtttgaggatcctgaaaccacaaggcagatgcaatctacgcgtgatgggaggatgttgttcgactacctggccgacaagcatggcttccgccaagaatacctggatactctgtataggtacgctaagttccagtacgaatgtggaaactattccggagcggctgaatacctctattttttcagggtgctggtgcccgctaccgacaggaatgctttaagttctctatggggcaaactggctagcgagatccttatgcaaaactgggatgcagctatggaggatctaacacggcttaaggaaaccatcgataacaacagcgtgtctagcccactacagtccttacagcagcggacatggctgatccactggagtctttttgtcttcttcaaccaccccaagggacgagacaacatcatcgatcttttcctctaccaaccccaatatctaaatgctatccagaccatgtgtccccatattcttcgatacttaacgacagctgttattacaaataaggatgtcaggaaacgcaggcaagtgctgaaagacttggtcaaggtgatacagcaggagagctacacctataaagaccccataaccgagttcgtcgagtgcctgtacgtaaatttcgattttgatggagcacaaaagaagctgcgggaatgtgaaagcgtcctggtgaacgactttttccttgtcgcgtgcctcgaagacttcattgagaacgcccgactttttatattcgagacgttttgtaggattcaccaatgtatttctattaatatgctggccgacaagctcaacatgaccccagaggaggccgaaaggtggattgttaatctcatcagaaatgctagactggacgctaagatcgattctaaactgggccacgtcgtgatgggcaataacgccgtgtcaccttatcagcaggtgattgagaaaactaagtccctgtcatttaggtctcagatgcttgccatgaatatcgagaagaaactgaatcagaattctcggagcgaggcgccaaattgggcaacccaggactctggcttttactag

SEQ ID NO: 54793 - DNA, 5586 bp, Artificial Sequence
  Description of Artificial Sequence: Synthetic coding sequence
atgttaaaagcggtgctgaaaaaaagtcgcgaaggtggtaaggggggtaagaaagaggcgggatctgacttcggaccggagaccagtcccgtgctgcatcttgatcactccgctgactctcccgtgagctctttgcctaccgctgaagatacctacagggtgagtctggccaaaggcgtgtcaatgagcttgccctctagcccccttctcccacgccagtcccatctagtgcagagccgggtgaataaaaaaagccctgggccagtcaggaaacccaagtacgtcgaaagcccacgcgttcctggtgatgctgtaatcatgcccttccgcgaggtcgcaaagcccacggaacctgacgaacacgaggcgaaggcggacaatgaaccatcctgctcgccagcagcccaggagttgctgacaagactaggattcctactcggagagggtatccccagcgcaacccacatcaccatcgaagacaagaatgaaaccatgtgcactgctctgagccaggggatcagcccatgctccactttgacttcttctactgcctcccccagcaccgattccccttgcagcacattaaattcttgtgtgtccaagacagcagccaacaagtcgccatgtgagaccatctcgtcgccctccagtacactggagtccaaagatagcggtatcatcgctactatcacatctagtagcgagaatgatgaccgaagcggctctagccttgagtggaacaaagatgggaaccttcggttaggtgtgcagaagggcgttctacatgatagaagagcagacaattgttctccagtggcggaagaagagacgacggggtctgcagaatcgaccctgcctaaggctgagagctccgccggtgatggtcctgtaccctattcccaggggtcatcctcactgatcatgccgagaccaaactcagttgccgcaacctcctccactaaactcgaagatctctcttacctcgatggccagagaaatgcacctctacgcacaagcatccgactcccttggcacaacacagctgggggacgggcacaggaggtaaaggctaggttcgcgccatataagccacaggacatcttgctgaagcctcttctgtttgaagttcccagcataacaacggactctgtgttcgtgggtagagattggctgttccatcagattgaagagaatttgcgaaacaccgagctggcggagaatcggggtgccgtggtggttggcaacgtcggattcggaaagacagctattatatcaaagcttgtggcactgtcctgtcacggatcacgcatgcggcagattgcgtctaacagccctggttctagtccaaaaacctctgaccctacccaggacttgcattttacccccctactctccccgtcatcttctacgtccgcaagtagcacagctaagaccccgctcggatcaatctccgcagagaaccagagaccccgagaggacgctgttaagtacctggcctccaaagtggtcgcgtaccattactgtcaggcagacaatacatatacatgcctagtaccagagtttgtgcatagcatagctgcactgctgtgtcggagccaccaactggcggcttatcgggatctactcattaaggaaccccagcttcagagcatgcttagcctgcgatcctgcgtccaggaccctgtggcggcattcaaaaggggggtactcgaaccactcactaacctacgcaatgagcagaagatccctgaagaggagtacatcatcctgattgacgggttgaatgaggccgaattccacaagccagattatggagacacactgtcctcctttattaccaaaataatttccaagttccctgcctggctgaagttgattgtaaccgtgcgggcaaactttcaggaaatcatcagcgcactgccctttgttaagctgtctctggacgattttccagataacaaggacatccactctgatttgcatgcctatgtccagcacagggtgcactctagtcaggacatcctttccaatatctccctcaacggaaaggcagacgccacgcttatcggtaaggtaagtagccacctggtgctgaggtctctgggcagttacctctatctgaagctgacactcgatttgttccagcgaggccatctcgtgatcaaatccgcgagctacaaggtggtgcccgtgtcactgagcgagctttacctcttgcagtgtaacatgaaatttatgacccaatcagcatttgagcgggcactacctatcttgaatgtggcactggcctccttgcaccccatgacagacgaacagatttttcaggccataaacgcagggcatatacaaggggagcagggatgggaggacttccagcagaggatggatgccctgtcctgtttcctaatcaagcgtcgggataagacacgtatgttttgccatccttccttccgcgagtggctcgtgtggagagctgacggtgagaatactgctttcctttgcgagcctagaaatggccacgccctgttggcgttcatgttctcacgccaggagggcaaactcaaccgacaacagacaatggagcttggtcaccatatcttgaaagcgcatatttttaaaggactgtcaaaaaagacagggatcagctcgagtcatctgcaggctctatggattgggtattctacagagggtctgtccgcagccctggcgagtcttaggaatttatacaccccgaacgtcaaggtgtcccgactgctgattctgggcggagccaatgtgaactatcgaaccgaggtccttaataacgctccgatcctctgcgtgcagagtcacctaggtcatgaagaagtcgtcaccctactgctggagttcggagcgtgtctggatggcacttccgagaacggtatgacagccctgtgctatgcagctgctgctggccatatgaagcttgtttgcctgttgacaaaaaagggagttcgcgtcgatcatcttgacaagaaaggccagtgtgctcttgtgcacagcgcactgcgcggacacggggacatactgcagtaccttctgacctgcgagtggtcccccggaccccctcagccgggaaccctccggaagtcgcatgccttgcagcaagccctgacagccgcagcttctatgggtcattcaagcgtcgtgcaatgcctccttgggatggagaaagaacatgaagtggaggtcaacggcacagatacgctttggggcgagacagccctgacagcagctgccggacgcggtaaattggaggtgtgtgaactcctcctggggcacggggctgctgtcagtcgcaccaatcgtcggggagtaccaccactcttctgcgcggctcgccagggccactggcagatcgttagattattgctggagcggggttgcgacgtcaatctgtctgataagcaagggagaacccctctgatggtagcggcatgtgaaggtcacttgagcacagtcgagtttcttctgagcaagggggcagccctcagcagcctcgacaaggagggtttgagtgccctatcctgggcctgccttaagggccaccgggcagtggtccagtacctggtggaggagggcgcagcaatagatcagaccgacaaaaatgggagaactccgctagacctcgcagccttttatggagatgcagaaactgtcctctatttggtcgagaagggtgccgtcattgagcacgtagatcatagcgggatgcgccctctcgatcgagccattggatgcaggaacacctcagtagttgtagcccttctcagaaagggagcaaagctcggcaacgccgcatgggcgatggctacttcaaagcctgacatccttatcatacttctccagaagctaatggaagagggaaatgtgatgtacaaaaaaggtaagatgaaggaggccgctcagcgctaccagtacgcgctgaggaaatttccacgcgagggttttggcgaagatatgaggccgttcaacgagctgcgcgtttcattgtacctgaatttgagtcggtgcagacgtaagaccaatgattttggcatggcagaagagttcgcctctaaagcactggagttgaagcctaaatcttatgaggccttctacgcccgagcacgggcaaagcgcaatagccgccagttcgtcgctgctctggcggaccttcaggaggcggtcaagctgtgtcctacaaaccaggaagtcaaacgtctgctggcccgtgtggaggaagagtgtaagcagctccagagaagccaacagcagaaacagcagggacctctcccagcaccactcaatgacagtgaaaatgaggaggatacaccaacacccggtctctcggaccattttcactcggaagaaactgaggaggaagagaccagccctcaagaggagagtgtgtccccaaccccaaggtcccagccatccagcagtgtgccaagttcatatattagaaatctccaggagggcttgcagagcaagggacgcccagtatcaccgcagtctcgagcaggaattggcaagagcttgcgggaaccagttgcgcagcctggtctgctgctgcaaccgtccaagcaagcccagattgtgaaaacttcccagcatctcggtagtggccagtccgcggtcaggaacgggtctatgaaggtgcagataagctcccagaatccacctccgagcccaatgccaggccgtattgcagcgacccctgccggatcccggacacagcacctcgagggaacaggaactttcacgactcgcgctgggtgtgggcacttcggggataggctcgggccaagtcagaacgttcgcctccagtgtggggagaatggaccagcacacccgctaccaagcaaaacaaagactacagaacgcctgctctcacacagttccgtcgctgtggatgccgcaccacccaatcagggcggtttggccacttgctcagacgtgcgccatccggcttccctaaccagctccggtagttccggatccccttcctccagcatcaagatgtctagctccacttcttccctaacctcctctagttcgttttcagatgggtttaaggtgcagggacccgacacacgcatcaaagacaaggtcgtaacgcatgtgcagagtgggaccgctgagcatcgtccacgcaatacccctttcatgggtatcatggacaaaaccgcacggtttcagcaacagagtaacccacccagtaggagttggcattgccccgctcccgagggacttctcaccaacacgtccagcgctgctggacttcagtcggccaacaccgagaagcctagtttaatgcaggttggcggttataataaccaggcgaaaacctgttctgtatcgactctgagcgcaagcgtccataacggagcccaagtgaaggagttggaggagtccaaatgccagattccagtacattctcaggagaaccgaattaccaagactgtaagtcacctgtatcaggaatccatcagtaagcagcagcctcacatctccaatgaagctcataggtcccacctgaccgccgctaagcccaagcgctcattcatcgaatccaatgtataa

SEQ ID NO: 54794 - DNA, 5267 bp, Artificial Sequence
  Description of Artificial Sequence: Synthetic coding sequence
atgctgaaggccgttttgaagaaatcgcgagaggggggaaagggaggcaaaaaggaggcgggatccgacttcggcccagagacgagtccagtcctgcatcttgaccattctgctgattccccggtgtcttctctgcctacggccgaagacacatacagggtctcactggcaaagggcgtaagcatgagcctcccatcctctccactcctgcccagacagagccaccttgtccagagccgggtgaacaagaagtctcccggtcctgtgcggaagcctaagtatgtggagtctcccagagtgcccggagatgcagtgatcatgccttttagagaagttgcgaagcccactgagccagatgagcacgccactatcacttcttcctcggagaacgacgacaggtccggaagcagtctggagtggaataaagacggaaatctgcggttgggcgtgcagaaaggcgtcctccacgaccgacgtgctgacaattgttctccagtggcagaagaggaaacaactggttccgccgaatccaccctgccaaaggcagaatcctctgctggggacggcccagtaccttactcacagggatcctctagtcttatcatgccacgtcctaacagtgtcgcagctacaagctcaacgaaactcgaagacctctcttatctggacggtcagcgtaacgcccctctccggacaagcattaggctcccttggcataatacagctggtggcagagcgcaggaagtaaaagccaggtttgccccatacaaaccacaagatatactcctgaaacctctgctgtttgaggttccttccatcacaacggactcagtgtttgttgggagagactggctatttcatcagatcgaggagaacctgagaaatacagaactcgccgaaaatcgtggcgctgttgtggtcggaaatgtaggattcggaaagactgctattatttccaagctggtagctttgtcgtgtcatggttcccggatgaggcagattgcgtcaaatagccctggtagctctcccaagaccagcgacccgacacaggacctgcactttacacccctgctgagtcccagttctagtaccagcgctagcagcaccgctaaaactcctcttgggtccatctccgcggagaatcagagaccgagagaggacgcagtgaagtatctggcctctaaagtcgtggcctaccattattgccaggctgacaacacttacacctgtctggtgcccgagttcgtccacagcattgccgcactactttgcaggagccaccagcttgctgcctacagagatctcttgataaaggagccccagctccaatccatgctgtcacttcgctcatgcgtacaagatccagtcgccgcattcaaacggggagtgctcgaacctttgacaaatctgcggaatgaacagaaaatacctgaggaagaatatataatcctcatcgacgggctcaatgaggctgaattccataaacccgactacggcgataccctgagctccttcattactaaaataatatccaagtttcccgcttggttaaaacttatcgttacggtgcgggctaactttcaggagataatttccgcactgcctttcgtgaagctgtcacttgacgactttcccgataacaaagacatccacagtgatttgcatgcatacgttcagcacagggtgcacagctctcaggacatattgagtaatattagcctgaatggcaaagctgatgccacgttgatcggcaaggttagttcacacctggtgctgcgcagcctgggttcttatttgtacctcaaactcacactggacttgttccagcgtggccacttggtgattaagtcagcctcttacaaagttgttccagtgagcctgtccgagctgtacctgttacagtgcaatatgaagttcatgactcaatccgcctttgagcgggcacttcctattctgaatgttgctttggctagcctgcaccctatgaccgacgagcaaatcttccaagccatcaatgccggtcatatacagggcgaacagggatgggaggattttcagcagcgaatggacgctttgtcttgctttctgattaagcgcagggataaaactcggatgttttgccacccatcctttagagaatggttagtatggcgggctgatggggaaaatacagccttcctctgtgaacccagaaatggccatgccctcctagcttttatgtttagtcgccaggaaggcaaactcaataggcagcagacgatggaattgggacatcacatccttaaggctcacatatttaaagggctgagtaagaagaccgggatttcatcctcacacctgcaggccctgtggatcggctacagtacggaaggactcagtgccgcactggcttcgttgcgcaacctctacaccccaaatgtcaaggtgtcccggctgctcatcctgggaggtgccaacgttaattacagaacagaggtactgaacaatgcaccaatcctgtgtgtgcagtcccatttgggacacgaggaggtggtgaccctgctgctggagtttggcgcatgcctggacgggacttcggagaatggcatgaccgcgttatgctacgctgcagccgcagggcatatgaaactcgtctgtctgctaaccaagaaaggcgtaagggtagatcatctcgacaaaaagggtcagtgcgccctcgtccattcagcacttaggggtcacggagacatcctacagtacctcttaacctgtgagtggagtccaggtcctccccagcctggcactctgcgcaaaagccatgcgctccagcaggcacttacagccgctgctagtatggggcactcaagcgtggtgcagtgtcttcttggcatggaaaaggaacatgaagtagaagtgaatggcacagacaccctgtggggagagacggccttgactgccgcagcaggccgaggcaaactcgaggtgtgtgaattgctcctgggacacggcgctgccgtgtcaagaacaaataggaggggggtgccgcctttattctgcgctgcacggcaaggacattggcagattgttcggctcttgttggaacggggatgtgacgtgaacctctccgataaacagggtcggacacctctcatggttgccgcttgcgaaggacacctgtctaccgttgaattcctcctcagtaaaggggcagccctcagtagtctggacaaggaggggttgagcgccctgagctgggcttgcttgaaggggcacagagcagttgttcagtacttggttgaagaaggcgctgcaatcgaccaaactgacaagaatggacgtacacccctggatcttgccgctttttacggggatgccgaaactgtcctctacctggttgaaaagggagcggtaatcgaacatgttgatcactcgggaatgaggcccctcgacagagccattggctgtagaaacacttctgtggtagtggcccttctgagaaagggtgctaagttgggcaatgccgcatgggccatggccacctccaagccagacatccttataatcctcctgcaaaaactgatggaagagggcaacgtcatgtacaagaaaggtaaaatgaaagaagccgcacaacgctatcagtatgccctccgcaaattccctcgcgaggggtttggggaagacatgcggccattcaatgaactgcgcgtgtcactgtatctcaatctgtctcgatgcaggagaaagactaacgactttggaatggctgaggagttcgcatccaaggctttggagttaaagccaaaaagctacgaggctttttacgctcgagccagagccaagcgaaacagcagacaatttgtcgcggctctggcagatctccaggaggcagtgaagttatgtcccacaaaccaggaggtcaaacgtttgctcgcaagagtcgaggaagagtgcaagcagctgcagcggtctcaacagcaaaagcagcagggtccactcccagccccattgaacgatagtgaaaacgaggaagacacacccacacctgggttaagcgaccactttcactctgaggaaactgaggaagaagagacctctccacaagaagagtctgtgagccccacccctcgctctcagccgtcctcttcagtacctagcagctatattagaaacctccaggagggattacagtctaaaggcagacctgtttctcctcagtcacgcgcaggaattggcaaatctctgcgcgagccagtggcccagcccggattgctgcttcaaccttcgaagcaggcacagatcgtgaagaccagccagcatctgggatccgggcagtccgctgtaagaaatgggagcatgaaggtgcaaattagtagccaaaatcctccaccatcaccaatgccgggaagaatcgccgcaacacccgctggcagccgaacccagcatttagagggaaccggcacctttaccaccagggccggatgcgggcacttcggtgaccggttaggcccttcccagaacgtgcggctccagtgtggggagaatggaccggctcaccctctcccgagcaagaccaagaccactgagcggctactctcacattcgtctgtggctgtggatgcagccccacccaaccaggggggactagccacttgctcagacgtccgtcatcccgcatccctcacttcgtctgggagctcagggtcaccttccagttccatcaagatgtcatcaagtaccagcagccttacaagctcgtcatccttcagtgatggctttaaggtccagggacccgatacacgcattaaggataaggtcgtaacacatgtccaaagcggaacggcggaacataggcccagaaacacgccctttatgggcataatggacaagacagccaggttccagcagcagtctaaccctccttctcggagctggcactgccccgcacccgaaggattgctaaccaatacttcatctgctgccggattacagtccgccaatactgaaaagccgagtttaatgcaggtggggggatacaacaaccaggcgaagacctgctctgtgagcacactcagcgcttcggtccataacggggctcaggtcaaagagctggaggaaagcaagtgtcaaattccagtccactcacaggaaaaccgtattactaagactgtgtcacacctctaccaggaatccatctctaagcagcagccgcatatcagtaatgaagctcatcggtcccacctgacagccgctaagcccaaaaggagcttcattgaaagtaatgtcta

SEQ ID NO: 54795 - DNA, 2139 bp, Artificial Sequence
  Description of Artificial Sequence: Synthetic coding sequence
atggcccagtcgtccccccagctcgacatccaggtgctccatgacctgcggcagagatttcctgagatccccgaaggagtggtgtctcagtgcatgttgcagaataataataatttggaggcttgctgccgcgctctctctcaggagtcctctaagtacctctacatggagtaccactcacctgatgacaataggatgaatagaaaccgcctcctgcacataaacctagggattcactcccccagtagttatcatccgggtgatggggctcaactaaatgggggtagaacactggtacacagctccagtgacgggcatattgacccccaacacgctgcaggcaagcagctcatttgtttggtgcaagaaccccattccgcaccggcagtagttgctgcgacacccaactacaacccattctttatgaacgagcagaatcgcagtgctgccacccccccaagccagccaccccagcagccgagtagtatgcagactggcatgaaccccagtgccatgcagggaccttcaccacctccacccccaccctcttatatgcatattcctcggtatagtaccaatccgataactgtgactgtgtctcagaatctcccatctgggcagacagtccctagagctttgcagatcctgccccagataccatcgaatctgtatggttcgcccggtagcatctatattcggcagactagtcaatcttcatcggggcgacaaaccccacagagcaccccatggcagagttcccctcaagggccagtgccgcactactcgcagaggccattgcctgtgtacccccatcagcagaactaccagccatcacagtacagtccaaaacagcagcagatacctcagtcagcgtatcattctccccctccttcccaatgtccttcgcctttcagctccccacagcaccaggtgcaaccctctcagcttgggcacattttcatgccaccaagcccgtcaacaaccccaccccacccctaccagcagggtcccccatcatatcagaaacagggttctcatagtgtggcctacctcccatacacagcatcaagcctatctaagggatccatgaagaaaattgagattaccgtggagccctctcagcgaccaggcaccgcaattaatagaagtcccagcccgatctctaaccagccatctccatggaaccaacactctctgtacacagccaccacacccccatcttcctctcccagtagaggaatcagcagccagccaaaacccccattttccgtcaatccagtttacattacctacacgcaaccaacgggaccttcgtgtacgccctcccctagccccagggtgattcctaatccaactacagtcttcaagatcaccgtcgggagggcaaccacagaaaatcttctcaacttagtagatcaggaggaaaggtctgcagcgccagaaccaatccagcctatttctgtcattcccggttctggaggagaaaagggctcacacaagtaccagcggagcagctcgtctggctcggacgattatgcctatacccaggccctgcttttacaccagagggctcgtatggaacgcctagccaagcaactgaaactggaaaaagaggaactggagcggctgaagagcgaagtgaatggaatggaacacgaccttatgcaacgacggctccgcagagttagttgcactaccgctattccgacacccgaggagatgacacggctgcgctcgatgaatcgtcagcttcagatcaacgtcgattgtacactcaaggaggtggacttgctgcaatcaaggggcaattttgatcctaaagccatgaacaacttctatgacaatattgaaccaggcccagtcgtgccccctaagcctagtaaaaaggactccagcgacccgtgtactatagagcgcaaggccagacgcattagcgtgacgagcaaggtgcaggccgacatccacgatacgcaggcggcagctgcagatgaacatcgcaccgggtccacacagtcgccacggacccagccgagagacgaagactacgagggcgctccctggaactgtgactcctgtacattcctgaatcaccccgctctcaacagatgtgagcagtgtgagatgccgagatatacatag

SEQ ID NO: 54796 - DNA, 252 bp, Artificial Sequence
  Description of Artificial Sequence: Synthetic coding sequence
atggagcacgatctaatgcagagaaggcttcgtcgtgtgagttgcaccactgccatccctacccctgaagagatgacgaggttgcgcagtatgaacaggcaactgcagatcaacgtagactgtacactgaaggaggtagatctgctccagtccagggaagtttactattctcgatcttcgctgaaactcagcttcacgcagctgactaggctagagatggtcttcatcttttgcggcaagtacacagattag

SEQ ID NO: 54797 - DNA, 2139 bp, Artificial Sequence
  Description of Artificial Sequence: Synthetic coding sequence
atggcccagtcttcacctcaactagatatccaggtcctgcacgatttacggcagcggtttcctgagattcctgagggcgtggtgagccagtgtatgctacagaacaacaataatctcgaggcctgctgcagagctctatcccaggagagcagcaagtatttgtacatggagtatcactctccagacgacaatcgcatgaatagaaatcgcttgctacacatcaatctgggcatccattccccttcttcttatcacccaggtgacggtgctcagctcaatgggggaaggaccttagtgcatagcagctccgacggacatatcgatccccagcacgctgccggtaagcagctgatctgcctggtccaggaaccgcactcagccccagcagtggtggctgctactccgaattacaaccctttttttatgaacgagcagaacaggtcagcggctacacctccaagccaaccacctcagcaaccttcttcaatgcagacggggatgaacccgagcgctatgcaaggaccctctccaccacccccaccaccctcatatatgcacattccaagatattccacaaacccaatcaccgttaccgttagtcagaacctaccctctggacagactgtaccccgagcactgcagattctccctcaaataccctcgaatctctatggctcacccggaagtatctacattcggcagacaagccagagctcttccggtcgccagacgccccagtccacaccatggcaaagctctccacaagggcctgtccctcattattcacaacgacccctcccagtatatcctcaccagcaaaactatcagccatcccaatactcgcccaaacagcagcagattccgcagtcggcctatcatagcccccctccttcgcagtgtcctagtccattctcatctcctcagcaccaggttcagccatcccaactgggccatatctttatgcccccttcaccttctactacacctcctcacccgtaccagcaaggcccaccttcataccagaagcaggggtcgcattctgtggcctatctgccctatacagcatcctccctgtccaagggaagtatgaaaaaaattgaaataacggtggagcccagccagcgaccaggaactgccataaatcgatctccgtcaccaataagtaaccagcccagtccctggaaccagcattctctctacacagccacgacacccccttcttctagtcccagtcgagggataagttcccaaccaaaaccacctttctccgtgaatcccgtgtatatcacctacacacaaccaacgggaccatcttgtaccccctcccccagcccaagggtgattcccaatcctaccaccgtgtttaagataacagtgggcagagctaccactgagaatctgctcaatcttgtcgaccaggaggaaagatcagcggctccggaacccattcagccgatatccgttatccccggaagtggaggggaaaagggatcgcataagtatcagcgttctagctcttctgggagcgacgactacgcttacacacaggctcttctgctccaccagcgcgctaggatggagagattggccaaacagctcaagctggagaaagaagagctggagaggctgaaatccgaagtcaacggaatggaacacgacctcatgcaacgccgactccgaagagtgtcttgcaccactgccatccccaccccagaagaaatgacaaggctcaggagcatgaatcggcagctgcagataaacgtggactgcactctgaaggaagttgatcttctgcagtcacggggtaacttcgacccaaaggccatgaataacttttatgacaacatcgaacctggaccagttgtgccacccaagccaagcaaaaaagattcttccgatccctgcactatcgagcgcaaggcgagacggatttctgtaacttccaaggtgcaggccgatatccacgatacacaggccgctgccgctgatgaacaccggaccggctctacacagtctcctcgcacccagcctagggacgaagattatgagggggcaccatggaactgcgactcatgtaccttcctcaatcatcctgccctgaacagatgtgaacagtgcgaaatgccaagatacacctag

SEQ ID NO: 54798 - DNA, 2055 bp, Artificial Sequence
  Description of Artificial Sequence: Synthetic coding sequence
atggctcagtcaagtccccaattagatatccaggtcctgcacgatctcagacagagattcccggaaataccggaaggggtggttagccagtgtatgctgcagaacaataataatctcgaagcttgctgcagggccctgtctcaggagtctagtaagtacctttatatggagtaccattctcccgatgataaccgcatgaacagaaaccgcttgctgcatataaacctgggcatccattccccctcctcttaccacccaggagacggagctcagctaaacgggggtcggacactggtgcacagcagctctgatggccatatagatcctcagcacgcggctgggaaacagcttatttgcctggtgcaggaacctcattcagcccctgcggtggtggccgctacccccaactataaccctttctttatgaacgagcagaaccggtctgctgctactcctccctctcaaccaccgcaacagccttcgtccatgcaaactggcatgaacccttccgctatgcagggcccttcacctccccctccaccacccagttacatgcatatcccaaggtactctacaaatcccattacggttaccgtgtcccagaatctaccatccggtcagacggtgcccagggcgctgcagattctcccccagattccgagcaacttgtacgggagtccgggttccatttacattaggcagactagccagagtagttcaggacggcagacacctcaatccaccccttggcagagtagcccccagggaccagttcctcattattcacagcgaccattgcctgtatatccgcatcagcagaattatcagccttcccaatattcacctaaacagcaacagatcccccagtccgcttaccactctccgccaccatcccaatgtccatccccattttcaagcccacagcatcaggtgcagcccagccagctggggcacattttcatgccaccttcaccgtccaccaccccaccgcacccttaccaacaggggcctcccagttaccagaagcagggctcccatagcgtggcatacctgccttatacagcgagttcactatccaaaggctctatgaaaaagatcgaaatcacggttgagccaagtcagagaccgggtaccgctataaatcgatcaccctcgccgatctccaatcagccgagcccatggaaccaacactctctatatactgctaccacacccccttcttcctcacccagtcgcggaattagttctcagcctaagcctcctttctccgttaacccagtgtacattacatatacgcagcccactggcccttcctgcacacccagtcctagtccaagggttatcccgaatcccaccacagtgttcaagatcaccgtggggagggcaaccacggagaacctgctgaatttagtcgaccaggaagaacggtccgctgccccagagcccatacagcccatcagtgtcatccccggaagtggaggagagaaaggatctcacaagtaccagaggtcaagctctagcggctctgacgattacgcatatacgcaagccctgctgctccaccagcgggcacgaatggagcgacttgcgaagcagttgaagctcgagaaggaggagctcgagagactgaagtctgaggtcaacggtatggagcatgacctgatgcaaagaaggctgcgcagggtgtcatgtaccactgccattcccaccccagaagaaatgacacgattgaggtccatgaaccgccagctgcagattaatgtggactgtacgcttaaggaagttgatctcctgcaatctcgcgacagctccgatccatgcaccatcgagcgaaaggcacgcaggataagcgtgactagtaaggtgcaggctgatattcacgacacccaggccgcagccgctgatgaacacaggacagggtctacacagagcccgcgaactcaacctcgagacgaggactacgaaggagccccatggaattgtgactcctgcactttcctcaaccacccagccttaaacaggtgtgaacaatgtgaaatgccgaggtatacctag

SEQ ID NO: 54799 - DNA, 2139 bp, Artificial Sequence
  Description of Artificial Sequence: Synthetic coding sequence
atggcccagtcttcgccccaactggatattcaggtactccatgacctaaggcagagattcccagagatccctgaaggggttgttagccagtgcatgttacaaaataataacaatctggaggcatgttgcagagctctgtctcaggagtcaagcaaatacctctatatggaataccattctcctgatgataataggatgaaccgcaaccggctgttgcatatcaatctgggtatccatagcccttccagctaccaccccggagatggagcccagctgaacggcggacgtacccttgtgcactcatcttcagatggacacatcgacccacagcacgctgctgggaagcagttgatttgccttgtgcaggagcctcattcagcacctgctgtggtcgctgccacacctaactacaatcccttttttatgaatgaacagaaccggtccgccgctactccgcctagccaaccccctcaacagccatccagcatgcagaccgggatgaatccctctgctatgcagggccctagcccacccccaccgccaccgagctacatgcacatcccacgctattctaccaatccaattacagtcaccgtttcccagaacttaccttctggccaaaccgtaccaagagcgcttcagattctgcctcagattccgagcaatctgtacgggtccccaggctctatttatattagacagactagccagtcctctagtggtagacagacaccacaatctactccctggcagagcagcccccagggcccagtaccccattacagccaaaggccactgccagtgtatccccaccagcagaattatcagccctctcaatacagcccaaaacaacagcagattccccaatccgcctaccacagcccaccaccgtctcagtgcccgtccccattttcgtctccacagcaccaagtgcagcctagtcagctgggacacatttttatgcctcccagcccaagcacaacacccccacatccctaccaacaagggcctccaagttatcaaaaacaaggttctcacagcgtagcctatctgccgtacactgcctccagcctctccaagggcagcatgaaaaagatcgaaattacagtcgagccaagccagagaccgggtactgctatcaaccggtctccctctcctattagcaaccagccatccccctggaaccaacactccctctacaccgccactacaccaccatcttcctctcctagcagaggcatctcttcccaacccaaacccccattctcagtgaacccagtctacataacatacacacagccaaccggaccttcctgtacgccaagccccagtccgagagtgatccccaaccctactaccgttttcaaaatcacagtgggcagagctaccacagagaacttactgaatctggttgatcaggaggaaagaagcgcagctcccgaaccaattcagcccatttctgtaataccgggatctggaggcgagaaaggctcacataagtatcaaaggtcatcaagttctgggtcagatgactacgcttatacccaagccctgctcctccaccagagagcgaggatggaaaggttggcgaagcaattgaaactggagaaggaagagctggagagattgaagagcgaggtcaatgggatggaacatgatctgatgcagcgcaggctgaggcgagtgtcatgcacaaccgccattcccactccagaagaaatgacccgcctcaggtccatgaacaggcagctgcaaataaacgttgactgcactctaaaagaggtcgacctgctccagagcagaggaaatttcgacccgaaggcgatgaacaacttctacgataacatcgagcctggcccagtggtgcccccaaaaccttccaaaaaagatagttccgatccttgtaccatcgaacggaaggccaggcgaatctcagtgacaagcaaagtgcaagccgacatccacgatacccaggcggcagccgctgacgagcatcgaaccgggtctacacagtctcctagaacgcagccacgagacgaggactatgaaggcgcaccctggaactgcgacagctgcaccttccttaaccaccccgctctcaaccgctgcgaacagtgcgaaatgcctagatacacttag

SEQ ID NO: 54800 - DNA, 723 bp, Artificial Sequence
  Description of Artificial Sequence: Synthetic coding sequence
atgctccgctcttgcgccgctcggctgaggaccctgggcgctctctgtctcccccctgtggggagacgactcccaggaagcgagcctcgtcccgagctaagatccttttcaagtgaggaggtaattctaaaggactgttcagtcccaaatccttcatggaataaggatttacgactgctgtttgatcagttcatgaaaaagtgtgaggacggatcctggaagcgcctaccaagttacaaacggacaccaactgagtggatacaggactttaagacacactttctagaccccaagctcatgaaagaagaacagatgtcgcaggcacagcttttcacgcgatcctttgatgacggtttgggttttgaatacgtaatgttttacaatgatatcgagaagcgaatggtgtgcctctttcagggaggtccataccttgagggtccaccgggatttatccatggaggtgccatcgcgaccatgattgacgccaccgtgggaatgtgcgctatgatggctggcggaattgttatgaccgcaaacctcaacatcaattacaagcgccctatcccattgtgtagcgttgtgatgattaattctcaactggacaaagtcgagggaaggaagttcttcgtgagctgtaatgtgcagagcgtggacgagaaaacattgtactccgaggctacctcactcttcattaagttgaatccagcgaagtctctcacctag

SEQ ID NO: 54801 - DNA, 744 bp, Artificial Sequence
  Description of Artificial Sequence: Synthetic coding sequence
atgattaggcggtgtttccaggtagcagcaagactgggacatcacagaggattattagaggccccaaggattctcccaagactgaaccccgcttccgccttcggaagtagtactgattcaatgttcagccgtttcttgcccgagaagactgatctgaaggactacgccctgcctaatgcaagttggtgctccgacatgctgtcgttgtaccaggaattcctggaaaagaccaagtctagtgggtggatcaaactgcccagttttaaatccaacagggaccatatccgtggtcttaaacttccttccgggctggccgtgtcttcggataagggagactgtcggatctttacccgttgcatacaggtggaaggccaaggtttcgagtatgttatcttctttcagccaactcagaagaagagcgtgtgcctatttcaaccgggatcataccttgaaggcccacctggattcgcccatggcggatcacttgcagcgatgatggacgagacgttctcgaaaacagcatttctagctggtgaggggctgttcacactgtcgcttaatatcaggtttaagaacttgattcctgtcgactccctcgttgtgatggatgtcgagctggataagattgaggatcaaaaactgtacatgtcatgtatcgcccattcgagggaccaacagacagtgtacgcaaagtctagcggggtgttcctgcaactgcagctagaagaggagagtccacagtag

SEQ ID NO: 54802 - DNA, 5883 bp, Artificial Sequence
  Description of Artificial Sequence: Synthetic coding sequence
atggcacagcaggctgcagacaagtatctctatgtcgataagaattttattaataatcctcttgctcaggctgattgggcggctaagaagctagtgtgggttccgtccgataagtcaggcttcgaacccgcaagcttgaaggaagaggtgggcgaggaggctatcgttgaactcgtggagaatggtaagaaggtcaaggtcaacaaggacgatattcagaaaatgaatccaccgaaattcagtaaagtggaagatatggccgaactcacatgtctgaatgaagcctcagttttacacaatttaaaggagcggtattatagtgggctgatatatacatactccgggttgttctgcgtcgtaatcaatccttacaaaaacctgcctatatactccgaagagattgtggaaatgtataaagggaaaaagaggcacgagatgcccccacacatttacgccatcaccgacaccgcatataggtccatgatgcaggacagggaagatcaatcaatcctctgtaccggcgaatcgggcgctggaaagaccgagaacacaaaaaaagtgattcaatacttggcgtacgtggcgtcatcccataagtcaaaaaaagatcagggcgagttggagcgccagttgctgcaggcgaatcccatccttgaagccttcgggaacgcaaaaaccgtcaagaacgataacagcagccgattcgggaagttcatccggataaacttcgatgtgaacggttatatcgttggcgcaaatatcgagacctacctgctggagaagagtcgagcaattcgccaggccaaggaggagcgcacatttcacatattttattacttgctcagtggtgctggcgagcatcttaagacagacctcctgttagaaccttacaacaagtatcggttcttgtctaacgggcacgtgacgattcccggacagcaggataaagatatgttccaggaaaccatggaggctatgcgcattatgggtattcccgaagaggagcaaatggggctgctgcgcgtgatctccggggttctccagctgggcaacattgtgtttaaaaaggagcgcaacaccgatcaagcgtctatgccagacaacactgctgcccagaaggtatctcacctgttgggcattaatgtgactgacttcaccaggggaatcctgactcctcggatcaaagttggtagagattacgtgcagaaggcccagacaaaagagcaggccgattttgctatcgaggcccttgccaaggccacatatgaaagaatgttcagatggctggtgctccgaatcaataaagctcttgacaaaacaaaacggcaaggcgcatctttcattggtatcttggatatagctgggtttgaaatcttcgatttgaattcttttgaacagctatgcatcaattacacgaacgaaaaactgcagcaactgtttaatcatactatgttcatcctggagcaggaggaataccagcgggaagggattgaatggaacttcatagacttcggcttagatttacagccatgtattgatctcattgagaagccagctggtccaccagggatcctggctcttctggatgaagagtgttggtttcctaaagccaccgataaatcttttgttgaaaaggtcatgcaggagcagggcacccatccaaagttccagaagcctaagcagttaaaagacaaagccgatttctgtattattcactatgccggaaaggtagattacaaggcagacgagtggctgatgaaaaacatggatcccctgaatgacaatattgccactctgttgcatcagagttctgacaagtttgtttctgagctgtggaaggatgtagacagaatcatagggctggaccaggtagctggcatgtctgagacagcactgcctggcgcattcaaaacccgcaaggggatgtttcggaccgtcgggcagctgtacaaggagcagctggccaagttaatggcgacactgaggaatactaaccctaactttgtgagatgtatcattcccaatcacgagaagaaagccggaaaactggacccgcacctagtactagaccagctacgatgtaatggtgttttagagggaattcggatatgccgccagggattccctaacagagtggtgttccaggaatttaggcaaagatatgaaatccttacacccaactctattcccaaaggtttcatggacggcaagcaggcctgcgtccttatgataaaagctttagagctggattcaaacctgtacaggatcggtcagtcaaaagtgttttttagagccggagtactcgctcaccttgaggaagagagggatctcaaaattacggatgtaatcattggtttccaggcctgttgtcgaggataccttgccagaaaagcctttgcaaagagacaacagcagttaaccgctatgaaggtgcttcaaagaaattgtgccgcttaccttaaacttcggaattggcagtggtggagattattcactaaagttaaaccgctgttgcaggtgtctcgacaggaggaagaaatgatggccaaggaggaggaactcgtgaaagtcagggagaaacagctagcagccgagaatcggctgactgagatggaaaccctgcagagtcagttgatggccgagaagctgcagctacaggagcagctgcaggccgaaaccgaactctgcgcagaggcagaagagttgagagctaggctgacagccaagaagcaagaactcgaagagatttgccatgacctcgaggctcgcgtggaagaggaggaagagcgttgccagcacctgcaggcagagaaaaaaaagatgcagcagaacatacaggaactagaggaacagctggaggaggaagagagcgcacgtcagaagctgcagctggagaaggtgacgaccgaggctaagctgaaaaagctcgaagaagaacagataatcctggaggatcaaaactgcaagctcgccaaggaaaagaagctcctagaggacagaattgcagagtttactacaaacctcactgaggaggaggagaagagcaagtcactggctaagctcaagaacaagcatgaggcaatgattacagacctcgaggagaggttgcggagagaggagaagcaacgacaggagttggagaaaacccgcaggaagctcgagggcgattcaactgacctctcagatcagattgctgagctgcaggctcagatcgctgagttaaaaatgcaattagctaagaaagaagaggaactgcaggccgctctggctcgggtggaggaggaggctgcacagaagaatatggccctcaagaaaatcagagaattggagtcccagatctccgaactccaggaggacctggaaagcgaacgcgcatctcgcaacaaggctgagaagcagaaacgggacctgggggaggaactggaggcacttaaaaccgagctcgaagacactctcgatagcacagcggcacaacaggaacttcgctccaagcgggaacaggaagtgaatatactgaaaaaaaccctagaggaggaggcgaaaacccatgaagcccaaatacaagaaatgaggcaaaaacatagtcaggcggtggaggaactggccgagcagctagaacaaactaagcgggtgaaggccaacctggagaaggcaaaacagacccttgaaaacgagagaggggagctggccaacgaggtgaaggtgctcctccaagggaagggagacagcgagcacaagcgcaagaaagttgaggcgcagttgcaggaattgcaggttaagttcaacgagggagagagagttcggactgagctagctgataaggtaactaagctgcaggtggagctagacaatgtcacaggcctcctgtctcaaagcgacagcaagtcctcaaagttgacaaaggatttctcggccctcgagtcccagctgcaggatacccaggagttgttgcaagaggaaaaccggcaaaaactttcgcttagtaccaaactgaaacaggtggaggatgagaaaaactcctttagggagcagctggaggaagaggaggaagccaaacacaacctcgagaaacagatcgctaccttgcatgcccaggttgctgatatgaagaaaaagatggaggatagcgttggctgtctggagactgcggaggaggtcaagcggaagctgcagaaagacctggaaggcctctctcaacggcacgaagagaaagtagctgcctatgataagcttgagaaaacgaagactcgcctacagcaggaactggatgatcttttggtcgatctggaccaccagaggcagtctgcatgcaacttggaaaaaaagcagaagaagtttgaccagctgctggcagaagagaagactatttctgccaagtacgctgaagaaagggaccgcgcagaagcggaagcacgagagaaggagacaaaagcactgtctttggccagggccttggaggaggcaatggaacagaaggctgagcttgagaggctaaataagcagtttcgaacagaaatggaggatttaatgtcttccaaggacgatgtcggcaaatccgtccacgagctggagaagtcaaagcgggcattagaacaacaggttgaggaaatgaaaacccagctggaagagctggaggacgagctccaagcaaccgaggacgccaaactcaggcttgaggtgaacctccaggcaatgaaggcccagttcgaacgcgacctccaaggaagagacgagcagtccgaagagaaaaaaaaacaactagtgagacaggtaagagaaatggaagctgagttggaagacgagaggaagcaacgctcaatggctgtagcggctagaaagaagctggaaatggacttgaaagacttagaggctcatattgacagtgccaataaaaatagagatgaagctataaagcagctccggaagttgcaagcgcagatgaaggactgcatgagggaattggacgatacccgggcttcaagggaagagattctagcacaggccaaagagaatgaaaagaaacttaaatccatggaagcggagatgatccagttacaggaggaactggccgcagccgaacgggctaagcgccaagcccagcaagagcgagacgaattggcagacgagatcgcaaatagctcggggaagggtgcactcgccttggaagagaaaaggaggctggaggcccgaattgcacagctggaggaggaattagaggaggaacaaggtaacacggaactgatcaatgaccggctaaagaaggcaaatctgcagattgaccaaattaacactgacctgaatctggaacggtctcatgcccagaaaaacgagaacgcacggcagcaactagaaagacagaataaggaactgaaagtgaaactccaggagatggagggtaccgtgaaaagcaagtataaggcctctattaccgcccttgaggctaagattgctcagcttgaagagcagctggacaacgagacgaaggagaggcaggccgcttgcaagcaggtgagacggaccgagaaaaaactgaaggatgtgctgctgcaagtggatgacgagcgacgcaatgccgagcagtacaaagaccaggccgacaaagcctctactcgtttaaagcagctcaaaagacagctcgaagaggcagaagaagaagctcaacgggcaaacgcgagcagacggaaactgcagcgtgaattggaggacgctactgaaacagccgacgcgatgaatagggaggtgagcagcctgaagaacaagttaagacgcggagatctgccttttgtggttccacggaggatggccagaaagggagccggagacggctccgacgaagaagtggacggcaaggcagacggggcagaagctaaacctgctgagtat

SEQ ID NO: 54803 - DNA, 501 bp, Artificial Sequence
  Description of Artificial Sequence: Synthetic coding sequence
atggcacaacggttgctcttgcgaagattcctggcatccgtgatttctcgtaagccctcccagggacaatggcccccactcacatctagagctttgcagactcctcagtgcagtccagggggactcactgtgacccctaaccccgcacggacgatctatacaactcgcatcagtctgactactttcaacattcaagatggacctgatttccaggaccgtgtagtcaattctgagacacccgttgtggtcgactttcatgcgcagtggtgtggaccatgtaagattttaggcccacgattagaaaagatggtggcaaagcagcatggcaaagttgtgatggccaaggttgatatagacgaccacaccgacctggccattgagtatgaagtgtccgcagtcccgaccgtgttggccatgaaaaacggcgacgttgtggataaatttgtgggcatcaaggacgaagatcaattagaggcttttttaaagaaactaattggttag

SEQ ID NO: 54804 - DNA, 2877 bp, Artificial Sequence
  Description of Artificial Sequence: Synthetic coding sequence
atgtctgaatgcgggggaagaggcggaggttcctcctcctccgaggatgcggaagacgagggcggtggaggcggagggcctgcaggctccgactgtctgagcagctcacccaccctcgcgacagcatctagtgcaggacgtctaagaaggggcttgcggggtgcattcctgatggccagacagaggcccgagctcttgtgcggagccgtggctttagggtgcgccctgttgctggcgttgaagttcacttgcagtagagctaaggatgtgatcatccctgctaaacctccagtgagctttttctccctgagatcacctgtccttgatttgttccagggccagctggattatgcagagtacgttcgcagggatagtgaagtagtgttgctcttcttttatgcaccctggtgcggtcaatccattgcggctagagctgagattgaacaggctgcttccaggttatctgaccaagtcttgttcgtcgcgattaactgctggtggaaccaggggaagtgtcgaaagcagaaacattttttttactttcctgtcatttatctgtatcaccggagcttcggtcctattgaatataagggacctatgagcgctgtttacatcgagaagtttgtgcggagggtgatgaagcctctgctatatatccctagccagagtgaattgctggacttcctctctaattacgagcccggagtgctcgggtattttgagttctccggtagcccacagcccccagggtatctcacattcttcacaagtgccctgcactcactaaaaaaggattatctgggaactgtcagattcggagtgattacaaacaagcacctggcgaagcttgtgtccctggtgcactctggctcagtgtacctccatcggcactttaataccagtctagtgtttcccagggaggttctgaactacacagccgaaaatatttgtaagtgggctttggaaaatcaggaaacattatttcgctggctgcgccctcatggcggaaagagcctgctgctcaataatgagcttaagaagggacccgctttgtttctgtttattccattcaatcctctggccgaatcgcatcccctgatcgatgagattaccgaagttgctctggaatacaacaattgtcacggagatcaggtggtagagaggcttttgcagcacctacgtcgcgtagatgccccagtgctagagtccttggctctggaggtgcctgctcaattacccgaccctcctacaattaccgcgtcaccatgctgcaataccgtggtgctcccacagtggcatagcttctcaagaacacataatgtttgtgagctttgtgtgaatcaaacaagcggcggtatgaaaccctcaagcgtctccgtcccacagtgcagcttctttgagatggcagcagccctggattcgttctaccttaaggaacagacattctaccatgttgcgagtgacagcattgagtgtagcaactttctcacttcctacagcccattttcctattacacagcgtgctgtcggactatttctcgtggagtgtcaggcttcatcgactctgagcaaggggtctttgaggccccaacagtggccttctcttccctggagaaaaaatgcgaggtggacgctcccagttcggtaccacatattgaggaaaaccgctacctgtttccggaggttgatatgacatcaaccaactttaccggtctgtcttgtcgaaccaacaagactttgaacatttatctccttgattcaaacttattctggctgtacgccgagaggctgggggcaccgtcttccacacaggtaaaagaattcgcagcaatcgtcgatgttaaagaggagagtcactatattctcgacccgaagcaggcattgatgaagctgactttggagtctttcatccaaaacttctctgtcctgtatagcccgttgaaaagacacctgatcgggagcggaagcgcccagtttcccagccaacacctgattaccgaagttactacggacactttttgggaagtcgttctccagaaacaggatgttctactgctctattatgcaccctggtgtggcttctgccccagtctgaaccacatattcattcaactggcacgaaacctgcctatggatacatttaccgtggccagaattgacgtttctcagaacgatctgccctgggaattcatggtcgatcgccttcctaccgtgctatttttcccttgtaatagaaaggatctgagcgtcaagtaccccgaggacgttcctataacactccccaacttactcaggtttattttacaccacagcgaccctgcaagttcaccgcagaacgtggccaacagccctacaaaggaatgcctgcagtccgaggcagtgctgcagagaggccacatcagtcacttggaaagagaaattcaaaaactcagagcagaaattagcagtttgcagcgggctcaagtccaggtcgaaagccaactgtcatcagccaggagggacgagcacaggttgcgtcagcaacaaagagctctggaggagcaacattcactgcttcacgcccacagtgaacaactacaggctttatatgagcaaaaaacaagggagttacaggagctggcacgaaagctccaagagctggcggacgccagcgagaaccttctcacggagaacacctggctaaaaattctcgttgccaccatggaacggaaactggagggtagagatggcgctgaaagcttggctgcccagcgtgaagttcaccctaagcagcccgaaccctccgcaaccccccagctcccaggttcttccccacctcctgcaaatgtgtctgccactctagtttctgagagaaataaggagaatagaacagattag

SEQ ID NO: 54805 - DNA, 2958 bp, Artificial Sequence
  Description of Artificial Sequence: Synthetic coding sequence
atgagcgaatgtggcggaaggggcggaggaagctcctcaagtgaagatgccgaggatgaaggtggagggggtggcggacccgcaggaagcgactgtttatcttcttcacctaccctcgcgactgctagctccgcaggaaggcttagacggggactgagaggggctttcttaatggctaggcagcggcctgaattgctttgtggcgctgtggccctcggatgtgcgttgttactcgctctgaaattcacatgtagccgggcaaaggacgtgataataccggctaagccgccagtgtctttcttttccctgcgtagccctgtcctcgacttgtttcaagggcagttggattacgcggagtacgtgcgtcgggactcagaagtcgtcctgctattcttttacgcaccatggtgcgggcaaagcattgcagctcgggcagaaatcgagcaggcagcctctagactcagtgaccaggttctgtttgtcgcgattaactgttggtggaatcaagggaaatgtcgcaagcagaaacattttttctatttccctgtaatttacctgtatcaccggagttttgggcctatcgaatacaagggacccatgagcgccgtatacatcgagaagttcgtgcggcgagtgatgaaaccactgttgtacatccccagccagagtgaattgctagattttctatccaactacgagcccggagtgctagggtattttgagtttagcggctctccgcagcctcctgggtacctgaccttcttcactagtgccttacactcactcaaaaaagccctcgaatctacctcttcacctcgagccctcgtgtctttcaccggtgaatggcacctcgaaactaagatttatgtgcttgattacctgggaaccgtgcggttcggcgtgataaccaacaagcatctggccaaattagtgagtctcgtccatagtggctctgtctacttacatagacacttcaacactagcctggtatttcctagagaagtactaaactacacggccgagaacatctgtaagtgggcgctggaaaaccaggaaacgctgttccgatggctccgaccacacgggggaaaatccctgctgctgaataatgagctcaaaaaaggaccagctctgttcctttttatcccatttaacccgctcgccgagagtcaccccttaatcgacgagatcactgaagtcgcattggaatataacaattgccacggcgatcaggtcgtcgagcgtctgctccagcacctgcggagagttgacgctcctgtactcgagtcactggcactggaagtgcccgcacaattgcctgatcctccaaccattactgcgagtccttgctgtaacacagtagtgcttccccagtggcacagctttagtcgcacccacaacgtgtgcgaactttgtgttaaccagacctccggtgggatgaagccaagctcagtgagcgtcccacagtgttcttttttcgaaatggctgccgcattagatagcttctaccttaaagagcagaccttctaccacgtcgcctccgactcgatcgaatgtagcaactttctgaccagttattcacccttctcttattataccgcctgttgcagaacaatatctcgcggtgtatccgggtttatcgatagtgagcagggagtctttgaagctccaacggtcgcgttttcctcccttgagaagaagtgtgaggtggatgcaccttccagcgtgccccacattgaggagaatcgttacctgtttcctgaggtcgacatgacttcaacaaatttcactgggctctcatgccgaacgaacaaaaccctgaacatctatctgcttgactccaacctattctggctctatgccgagcgcctgggcgctccctcatcaactcaggttaaggaatttgccgctattgtcgatgtgaaggaggagtcccactacatacttgatcctaaacaggccctgatgaagctgacactggaaagcttcattcagaacttctcggttctgtacagcccactcaagcgccacctgatagggtcagggtccgcacagtttcccagccagcacctgatcacagaggtcactaccgatacattttgggaggtggtgctacagaagcaggacgtcctgttactttactatgccccatggtgcggattttgcccttcattgaatcatatttttatccagctggccagaaatctccccatggataccttcaccgtcgcccgaatcgacgtgtcccagaacgacctgccgtgggagtttatggtagatagattgccaaccgtgctgttttttccttgtaaccgcaaggacctgtctgtgaagtacccagaggacgtgcctattacccttccaaacctgcttagatttattctgcaccactctgatcctgcgtcttctccacaaaacgtcgccaatagccctacaaaagaatgtttacagagtgaggctgtgctccagcgcggacacatctctcatctggagcgggaaatccagaaactccgagccgaaatatcttccctgcagcgcgctcaagtgcaggtcgagtctcagctttccagcgccaggcgtgacgagcaccggctgcggcagcagcagcgggcactggaagagcagcattccctgttgcacgcccattcagaacagttgcaagccctgtacgagcaaaagacgagggaactgcaggagcttgctaggaaattgcaggagctggccgacgcctccgaaaatctgttaacggagaacacctggttgaaaatcctagtcgcaaccatggagcggaagctcgagggacgcgacggagctgagagcctggctgctcagagggaagtgcatcctaagcaacctgagcctagcgccactccccagctgcctggtagtagtcccccaccagccaatgtctcggccacactggtctcagagcgcaacaaagaaaatcgcacagattag

SEQ ID NO: 54806 - DNA, 666 bp, Artificial Sequence
  Description of Artificial Sequence: Synthetic coding sequence
atggccagacagcgtcccgaactgctctgcggggcagtggcactgggatgcgcccttctcctggccctgaagtttacttgtagcagagcaaaggatgttattatcccagccaagccacctgtgtcctttttcagcctacgcagccccgtgctagacctgttccagggccagctggactacgctgagtacgtgcggagggattctgaggtagtattgctgttcttctatgctccatggtgtggtcaatctatcgccgcacgggcagaaatcgaacaggccgcaagtcgactgagcgaccaagtattgttcgtggcaattaactgttggtggaatcagggtaaatgccgtaagcagaagcattttttttactttcccgtgatttatctgtatcaccgcagcttcggcccaattgagtacaaaggtcctatgagtgccgtgtatattgagaaatttgtcagacgagttatgaaaccactcctctacatcccatcccaatcagaactgctcgactttttgagcaattacgagccgggtgtgctcggctattttgaatttagtggttccccacagcctccagggtatctgaccttctttacgtcagctctgcattctctcaaaaaggacggggtttccccttgtcggcctggatggtccgcagttgcctag

SEQ ID NO: 54807 - DNA, 1083 bp, Artificial Sequence
  Description of Artificial Sequence: Synthetic coding sequence
atggtgccggctgctggcagacgtcccccacgcgtcatgagacttctggggtggtggcaggtgctcctatgggtgctggggctgccagttaggggcgttgaagtcgcagaggagtcgggacgcctctggagtgaggaacagcctgcccaccctttgcaagtgggcgctgtgtatctcggagaggaagagctcctgcacgacccaatgggacaagacagggccgcagaagaggctaacgctgtgctcgggttggacacacaaggagatcacatggtcatgctgtcagttatcccaggggaagcagaagacaaggtttcttcagaaccctccggcgtgacatgcggcgctgggggagctgaagatagccggtgtaatgtgagagagtccttatttagcctggacggcgcaggcgctcattttcctgaccgcgaggaggagtactatacagagccggaagtggccgagagcgatgccgctcccactgaagactctaacaacactgagtccctgaaaagccccaaagtgaattgcgaagagcgcaacataacagggctcgagaacttcacgctgaagattctcaatatgtcacaggacctaatggacttcctcaacccaaacggaagtgattgcacccttgtgctgttctatacgccatggtgtagattttctgcctcactggctcctcacttcaatagtttgcctagagctttccccgctttgcatttcctggccttagacgcctcccagcactctagcctcagcacccggttcgggaccgtcgccgtgcccaacatccttctgtttcagggcgctaagcctatggctaggttcaaccacacagaccggactcttgagactctgaagatttttatttttaatcagaccggcatagaggccaaaaagaacgtagtggtaacacaggcggatcagatcggccctctcccttcgactttgatcaaatctgtagactggctattggtgttctccttgttttttctgatcagctttatcatgtacgcaaccatccgaaccgagagtatccgatggttaatccctgggcaagaacaagaacatgttgaatag

SEQ ID NO: 54808 - DNA, 1035 bp, Artificial Sequence
  Description of Artificial Sequence: Synthetic coding sequence
atggtacccgcagccggtcggcgaccgcctcgagtgatgcgcctgctgggttggtggcaggtgctcctttgggtacttggactcccagtaaggggagtagaagtcgctgaagagtcaggaaggctctggagcgaggaagaactactccacgatcctatgggtcaggatcgagccgctgaagaggctaacgcagtcctcggactagatacccagggtgaccatatggtgatgctgtccgtgatcccaggggaggcggaggataaagtctcatccgagccatccggagtgacatgtggggctggaggtgctgaggacagtaggtgcaatgtcagagagagcctatttagtctggatggtgccggagcccactttcccgacagggaagaggaatattacaccgaacctgaagtggcagagtccgatgcagccccaactgaggactccaataatactgaatccttgaagtctcccaaggtcaactgtgaagaaagaaacatcaccggtctggagaattttaccttaaaaatcctgaatatgtcccaggaccttatggattttctgaaccctaatggttctgactgtacgctcgtacttttctataccccatggtgtaggttctccgcctcattggcaccgcacttcaattccttgcccagagcttttcctgctctgcatttcctggctctcgatgcaagtcagcattcctcactgagcacacggtttgggaccgtcgccgtaccaaatatcctgctgttccagggagccaagccaatggcccgttttaaccatactgaccgcacactggagacattgaaaatttttatttttaatcaaacaggtatcgaggcaaaaaagaacgtagtcgttacacaggcagatcagatcggaccactacccagtacactgatcaagagtgttgattggctgctggtgttctctttgtttttcctcatttcgtttatcatgtacgccacaattcggacagaaagcattaggtggctgatccccggacaggaacaagagcatgtcgaatag

SEQ ID NO: 54809 - DNA, 1014 bp, Artificial Sequence
  Description of Artificial Sequence: Synthetic coding sequence
atggaggccggtcagcagcgggtggtggagaaagtcgctgaagagagcggtaggctgtggtctgaggaacaacccgcacacccgctgcaagtgggcgctgtgtacttgggtgaagaagaactcctccacgatccaatggggcaggacagggccgcagaggaggctaacgcagtgctaggcctagatacccagggtgaccacatggtgatgttgtctgtgattcctggagaagctgaagataaggttagctccgaaccttctggagtaacatgcggtgccggtggtgccgaggattcccggtgtaacgtaagggaaagtctattctccctcgacggtgccggtgctcacttccctgatcgtgaggaggagtactataccgaaccagaggttgcagaatcagacgcagcccctaccgaggattctaacaacacggagtcgttgaaatccccaaaggtgaattgcgaggagagaaatattacaggactcgagaatttcactcttaagatcctcaatatgagccaagacctgatggactttcttaaccccaatggatctgattgcaccctggtcctcttttataccccttggtgtcgcttctccgcatcccttgccccacattttaactccctgccccgtgcttttcctgcactgcactttctcgctcttgatgcatcacagcactcctcactctcaacacggtttggtaccgttgcagtcccaaacattttgctttttcagggcgctaagcctatggcaaggttcaaccatactgaccgcacacttgaaaccttaaaaatctttatctttaaccagacaggaattgaagctaagaagaatgtggttgtcacacaggccgaccagatcggcccactgcctagtacgctcattaaatccgtggattggctcctagtcttcagcctcttctttctgatttcattcattatgtatgcaaccatcagaacggagtccatacgatggcttatccctggtcaggaacaagagcatgtcgagtag

SEQ ID NO: 54810 - DNA, 1299 bp, Artificial Sequence
  Description of Artificial Sequence: Synthetic coding sequence
atgccagctcgccctggcagactgctccccctgcttgctagacccgcagctctgaccgcacttctactgcttctgcttgggcacggcggtgggggaagatggggagctcgcgctcaagaggccgcagctgccgctgcagatggccctccagcagccgacggggaagatggacaagatccccactccaagcacttatacactgccgacatgtttactcacggaattcaatccgcagcacacttcgtgatgttcttcgctccttggtgtgggcactgtcagcggctccaacctacctggaatgaccttggagataaatacaattctatggaagatgcaaaggtatatgtggctaaggtcgactgtaccgcccattcggatgtctgcagcgcccaaggggtgcggggataccccacactgaaactcttcaaacccggacaggaagctgtcaagtaccagggccctcgggactttcagaccttggaaaactggatgctgcagacattaaatgaagagccggtgactcctgagcctgaagttgagcctccatccgcccctgagttgaagcaggggctgtacgaactgtctgcgagtaatttcgaattgcacgtggctcagggcgatcatttcattaagttttttgccccttggtgcggccattgcaaggccctagcaccaacctgggaacagttggccctaggcctggaacactctgagactgttaagatcggaaaggtggactgtacgcagcattatgaattgtgtagcggcaaccaagtcagaggctatccgaccctgctctggttcagagacgggaaaaaggttgatcagtacaaaggaaaaagggacttggagtcactgcgcgagtatgtggaatctcagcttcagcgcacagaaaccggagctacggaaacagttactccaagcgaagcacctgtgcttgccgcagagcccgaggccgacaagggcaccgtcctcgccctcactgagaacaacttcgacgacaccatagccgagggcatcacctttatcaaattctatgctccttggtgcggtcattgcaaaactttggccccaacgtgggaggaattgagtaagaaggaatttcctggccttgctggggtcaagattgctgaggttgattgcaccgccgaacggaatatctgctctaagtacagcgttcggggttatcctacacttctgttatttcggggtggcaaaaaagtcagtgaacatagtggaggtagggatctggatagcctgcaccgattcgtcttgtcccaagccaaggacgaactgtag

SEQ ID NO: 54811 - DNA, 975 bp, Artificial Sequence
  Description of Artificial Sequence: Synthetic coding sequence
atggaggacgccaaggtttatgtggcgaaggtggactgtaccgctcattcagatgtatgttccgcacagggagtgcgaggctaccctactctgaagctcttcaaaccaggacaggaggccgttaagtaccagggccctcgcgattttcagacgcttgagaactggatgctccagactctgaacgaagagcctgtgacccctgaaccggaagtcgagccgccatccgcccctgagctgaagcagggcctctatgagctgagcgccagcaactttgagttgcacgtagcacagggagatcattttataaaattttttgccccatggtgtggacactgcaaggctttagcacccacatgggagcagctggctttgggtcttgagcatagcgagactgtgaagataggaaaggtcgattgtactcagcattatgagttgtgcagcggaaaccaggtgcgagggtaccccaccctcttgtggttccgtgatggaaaaaaggtcgatcagtacaaagggaagcgagacctggaatctcttcgggagtacgtggagtcccaattgcagcggactgagacgggtgctacagagactgtgactccctctgaagcgcctgtcctcgccgctgaacccgaggctgacaaggggactgtactcgctctgaccgaaaataacttcgatgatacaatagctgagggcataacctttatcaaattttatgccccatggtgcggacactgtaagacgttagcgccaacctgggaggaattaagcaagaaagagtttccaggcctggcaggggtgaaaattgccgaggttgactgtactgctgaacgcaacatctgttcgaaatattccgttcgaggttatcccacgttgctcctgttcagaggtgggaagaaggtgtccgaacacagcggtggtcgagacctggacagtctacaccgcttcgtactgtcccaagccaaagacgaactttag

SEQ ID NO: 54812 - DNA, 1083 bp, Artificial Sequence
  Description of Artificial Sequence: Synthetic coding sequence
atgacccagagtgttgacagcaacaggggaaacagaaacgagaagagatgtggccattgtcaaaggctgcagccaacttggaacgacctgggcgacaagtacaatagtatggaagacgccaaagtttacgtggcgaaagtcgactgcacggctcattccgacgtgtgtagtgcgcagggcgtgcgtggctatcctaccttgaaactgtttaaaccagggcaggaggccgtgaaataccagggacctagggacttccaaacgctcgaaaactggatgttgcaaacattgaatgaagaacccgtgacccccgagcccgaagtcgaaccaccgtctgccccagaactcaagcaagggttgtacgagttaagcgctagtaacttcgaacttcacgtggcacagggggaccacttcataaagttttttgcaccatggtgcgggcactgcaaagcactcgctcccacgtgggagcagctagcactcggacttgagcacagtgagaccgtgaagatcggcaaggtggattgcactcaacactacgagctttgctccggaaatcaggttaggggctatccgacactgctctggtttagagatgggaaaaaggttgaccagtacaaaggtaaacgggaccttgaatcgctgagagagtatgtggagtcgcagcttcagaggaccgagacaggggctaccgagacggtgaccccatctgaggccccagtgcttgctgccgaaccagaagccgacaaggggacagtactggccctgactgaaaacaattttgatgatacgatcgctgaaggcatcacgttcatcaagttttatgcgccttggtgtggtcactgcaaaactctggctccaacttgggaagagctgagcaaaaaggaatttcccggattagccggagtcaaaatcgccgaagtggattgtactgccgagcggaacatctgctcaaagtactcagtcagaggataccctaccctgctgctctttcgcggaggcaaaaaggtgtccgagcacagtggtggaagggatctggattccctgcatcgctttgtacttagccaagccaaggacgagctgtag

SEQ ID NO: 54813 - DNA, 843 bp, Artificial Sequence
  Description of Artificial Sequence: Synthetic coding sequence
atggctccttctggctcactcgcagtgcctctcgccgtgctggtgctactgctgtggggggcaccatggacccatggccgaagatcaaacgtgcgggtgataactgatgagaattggcgggagctgctagaaggagactggatgatcgagttttacgcaccctggtgtcccgcatgtcagaatctccagccagaatgggaatccttcgccgaatggggagaagaccttgaagtgaacattgctaaagttgatgtaaccgagcaacctggcctgtcaggaaggttcataattacagccttgccgaccatttatcactgtaaggatggcgaattcaggcgttaccaggggccaagaaccaaaaaggatttcatcaactttatttccgacaaagaatggaaatctattgagcctgtctctagttggttcgggcctggatctgtgttgatgagcagcatgtcagcattgtttcagcttagcatgtggattaggacttgtcacaactactttattgaagatcttggacttccagtgtggggttcctacaccgtattcgcgctggccaccctgttctccggcctactacttggactgtgcatgatatttgtcgccgactgtctctgcccttctaagaggaggcgtccccagccctacccctatcccagcaaaaaattgttgtccgaaagcgcccagcccctgaaaaaagtggaggaagagcaggaggcggatgaggaggacgtctccgaggaagaagccgagagcaaggaaggcacaaacaaagatttcccgcagaatgcaatcagacagcggtccctaggccctagcctggccacagacaagtcttag

SEQ ID NO: 54814 - DNA, 891 bp, Artificial Sequence
  Description of Artificial Sequence: Synthetic coding sequence
atggcagtattggcgcctctgatcgctctggtgtattccgtccccaggctgtctaggtggctggcgcagccgtattatttactttcagcattgctatctgcagccttcttactcgtgaggaagctccctcccctctgccacggactgcctacacagcgggaagacggcaacccctgcgactttgactggcgcgaggtcgagattctaatgtttttgtctgcgattgtgatgatgaagaacagaaggagcatcactgtggaacaacatattgggaatatttttatgttttctaaggtagcaaacacgattctgttcttccggctcgacattaggatgggcctcctttacataacactctgcatcgtgttcctgatgacctgcaagccgcctctatatatgggaccggagtacattaaatatttcaatgataaaacaatagatgaagagctagagcgcgacaagagggtaacttggatcgtggaattcttcgcgaactggtcaaatgactgtcagtcattcgcccctatatatgccgatctgtctctgaaatataactgcacaggactgaacttcggaaaggtcgacgttggtcgctacaccgatgtctccactagatataaggtgtccacctcacctctgacaaaacagttgcctaccttgatcctgtttcagggcggaaaagaggcaatgcggcgacctcaaatcgacaagaagggcagagccgtctcatggaccttttccgaagagaatgttatccgggaatttaatttgaacgaactgtaccagcgggctaaaaaattatccaaagccggagacaacattcctgaggagcagcctgttgctagtacaccaactacagttagcgatggcgagaataagaaagataagtag

SEQ ID NO: 54815 - DNA, 777 bp, Artificial Sequence
  Description of Artificial Sequence: Synthetic coding sequence
atggctgtgctagcaccccttatcgctctcgtgtacagcgtcccaagactgagccgctggctggcccaaccatattatctgctcagcgccctactgtccgccgctttcctgctcgtccggaaactacctccgctgtgtcacgggttacctacccagcgcgaagatggcaatccttgtgattttgattggcgagaagtcgagatactcatgttcctaagcgccatcgttatgatgaaaaacagacgcagcatgttcctgatgacttgtaaaccaccgctctatatggggccagagtatatcaagtatttcaacgacaaaaccatcgatgaagagctggagagagataaacgtgtaacttggatcgttgaatttttcgcaaactggtcaaacgattgtcagtcatttgctccaatctacgctgacctctcacttaagtataattgcactgggctgaatttcggaaaggtcgacgtgggcaggtacactgacgtgtcaacacggtacaaggtttcgacaagccctttgacaaagcagctgccaacactgatcctttttcaggggggaaaggaggccatgcgaaggcctcagatcgacaaaaaagggagggctgtgtcatggaccttctcggaggaaaacgtcattagggagtttaacctaaacgaactttatcagcgagcaaagaaactgagcaaggccggagataacataccagaggaacagccggtggccagcactcccaccacggtcagcgatggagagaacaaaaaggacaagtag

SEQ ID NO: 54816 - DNA, 1365 bp, Artificial Sequence
  Description of Artificial Sequence: Synthetic coding sequence
atggccgcatggaaatcctggaccgctcttcggttgtgcgcgactgtagtagtgctggacatggtcgtgtgtaaaggttttgtcgaagacctagatgaaagtttcaaggaaaatcgtaacgacgatatctggctcgtggatttctatgctccttggtgtggtcattgtaagaagctagagccgatctggaacgaggtcggcctcgagatgaagagcattgggagcccagtcaaagtcggaaagatggatgcgaccagctattcctccattgcatccgagtttggggtgcgtggatacccgacaatcaaactccttaagggggatctcgcctataactatcggggacctcgcacgaaggacgatatcatcgagttcgcccatcgggtgtccggtgcgcttatccggccattgccgagtcagcagatgtttgagcatatgcagaagcgccacagagtcttcttcgtttacgtggggggagagtccccgttaaaggaaaaatatattgacgctgccagcgaactgattgtgtacacctacttcttctcagcatctgaggaggtagtgccagaatacgtcaccctgaaggagatgcccgcagtgctggtcttcaaggatgaaacatattttgtgtatgacgaatatgaggatggtgacctctccagctggattaatcgggagcgcttccagaactacctggccatggatgggttccttctatacgaactgggcgatacagggaaactcgttgcgctggccgtgattgacgagaagaatacaagcgtggagcacacaagactgaaaagtatcatccaggaagtagctagagattacagggatctgtttcatcgcgacttccagtttggccatatggatgggaacgactacatcaatacgttacttatggatgagcttacagtgccgaccgtggtggtgctgaacaccagcaaccagcagtattttttactggaccgccaaatcaaaaatgtggaggacatggtgcagttcattaacaatattctggacggcaccgtggaagcgcaagggggagactccatactacagcgactgaaaagaatcgtctttgatgccaagtcaacaatcgtgagcatctttaagtctagcccgctgatgggctgcttcctgttcggtcttcccttaggagttatcagtataatgtgttacggaatatacacagccgacaccgatggtggctacattgaagagaggtacgaggtttctaagtctgagaatgagaaccaggagcagatcgaggaaagtaaggaacagcaggaaccgagcagcggaggcagcgtcgtccctacagtgcaggaacccaaggacgtcctggagaaaaaaaaggattag

SEQ ID NO: 54817 - DNA, 594 bp, Artificial Sequence
  Description of Artificial Sequence: Synthetic coding sequence
atggccgcttggaagagctggaccgctctgagactctgtgccactgtggtcgttttggacatggtggtctgtaaggggttcgtggaagacctggatgagtcctttaaggaaaacagaaatgatgatatatggctggtggatttttacgctccctggtgtggacactgcaaaaagctggagccaatttggaacgaggttggcctggagatgaaatccataggaagccccgtcaaggtaggtaagatggatgccaccagttactcttcaattgcctccgagtttggcgtaaggggctatcctacaattaaactagctcttatcagacctctccctagccagcagatgtttgagcacatgcaaaaacgccatagagtgttttttgtttacgttgggggtgagtcccccctgaaggagaaatacatcgacgcggctagtgaattgatcgtgtatacttattttttcagcgctagtgaggaagtggttcctgagtacgtgacgttaaaggaaatgccagccgttctcgtatttaaggacgagacctatttcgtctacgatggcaagttccagattttcaactcatgtaaaactttctag

SEQ ID NO: 54818 - DNA, 1257 bp, Artificial Sequence
  Description of Artificial Sequence: Synthetic coding sequence
atggcagcatggaagtcctggacggccctgcgactgtgtgccactgtcgtcgtcctggacatggttgtgtgcaaaggatttgtcgaggacctcgacgagtcttttaaagagaatcggaacgatgatatctggctggtcgacttctatgcaccctggtgcggtcactgcaaaaaactggagcccatctggaatgaggtaggtcttgaaatgaaatcgattggctcccctgtcaaagttgggaaaatggatgcaactagctattcttcaatcgcctcagaattcggcgttaggggataccctactattaagctcctgaagggagacctcgcttacaactaccgaggaccccgtaccaaggatgacatcattgagtttgcccaccgcgtgagcggggctttgataaggcctctgccgtcccagcagatgtttgagcatatgcagaagaggcaccgggtgtttttcgtgtacgtagggggagagtcacctcttaaggaaaaatatattgacgccgcatctgagctgattgtctacacgtacttttttagcgccagcgaggaagtggttcccgaatacgtaacgcttaaggaaatgcctgccgtgctcgtctttaaggatgaaacctacttcgtctacgatgagtacgaggatggggacctttcttcctggatcaacagggagcgcttccagaactacctcgccatggacggctttcttctgtatgaactcggggacacaggtaagctggtagccttggctgtcattgacgagaagaatacttccgtcgagcatacaaggctcaagagtattatacaagaagtagctcgcgattacagggacctctttcatagagactttcaatttggccatatggacgggaatgactatattaacaccctgctcatggatgaattaacggttccaactgtggtggtgttaaacacttccaaccagcaatatttcttgttagatcgccagatcaaaaacgtggaggacatggtgcagttcatcaacaatatacttgacggcacagtggaagcccagggcggagactctattctgcagcgcctgaaaagaatagtattcgacgctaaatctaccatcgtgtccatcttcaagtcaagccccctaatgggctgttttctcttcggcctcccccttggggtgatctcaattatgtgctacgggatctatactgccgacaccgatggtggttatatcgaagagagatacgaagtcagcaagaaaaaaaaaaagtag

SEQ ID NO: 54819 - DNA, 1050 bp, Artificial Sequence
  Description of Artificial Sequence: Synthetic coding sequence
atggccggagggcgttgcggaccccagcttactgccctgctggccgcatggattgccgcagttgctgccacagcaggcccagaagaggcagctcttccaccagagcagagtagagtccaaccgatgaccgctagcaattggactctcgtcatggaaggtgagtggatgctgaagttctatgcaccatggtgcccaagctgtcagcagactgattcagagtgggaggctttcgccaagaatggtgagatacttcaaattagcgtggggaaagttgacgtgatccaagaacccggactttctggacgtttctttgtcacgactctccccgcattttttcacgccaaggacggcattttccggagatatagagggccagggattttcgaggatttgcagaattatatcctggaaaagaaatggcagtcagtcgaacccctgacggggtggaagtctcccgcttctctgactatgtccgggatggctggactgttcagcatttccggaaagatctggcacctgcataactatttcaccgtgacactgggaattccagcttggtgctcctacgtgttcttcgtcattgcaaccctcgtattcgggctgtttatgggactcgtgcttgtggttatttccgagtgtttctacgtgcctctccctcgccatttatctgaacgcagtgagcaaaaccgcagaagcgaagaggcacacagggccgagcagctgcaggacgccgaggaagagaaggatgactccaatgaagaagaaaataaggactccttggtggatgacgaagaagaaaaagaagacctgggggacgaagatgaggcagaggaggaggaggaagaagataatctggcagccggagtggacgaggagcggagcgaggcgaatgatcagggaccacctggcgaagatggagtgacaagagaggaagtggagccagaggaggccgaggaggggatatccgaacagccttgtcctgcggacacagaggttgtggaagattcgctgcggcaaaggaaatcccagcatgcggataaaggtctgtag

SEQ ID NO: 54820 - DNA, 1806 bp, Artificial Sequence
  Description of Artificial Sequence: Synthetic coding sequence
atggattggggaactgagttgtgggatcaattcgaagtcctagaacgacatacccaatgggggctagatctcctggaccgatatgtgaagttcgtcaaggaacgaaccgaagtggaacaggcgtacgccaaacagttaaggtcactcgtgaaaaagtatctgccaaagcgtccggctaaggatgacccggagtctaaattctctcagcaacagtccttcgtgcagatcttacaggaggttaacgattttgcaggccaacgtgaactggtcgccgagaacctgtccgtccgtgtctgtcttgagctaacaaagtatagtcaggagatgaagcaagagcgaaagatgcactttcaggaaggacgacgagctcagcagcagttggagaatggcttcaaacagctagagaatagtaagcgcaagttcgagagggactgtcgtgaggcagagaaggcggcacagacagccgagaggctggatcaggacattaatgccaccaaagctgatgtggagaaggccaaacagcaggcccacctccggagccacatggccgaggaatcaaagaacgaatacgctgcccagctccagaggtttaaccgcgaccaggcacatttctatttctctcagatgccccaaatctttgacaaacttcaggatatggacgaacgccgtgccacccgactgggggctggatatggactgcttagcgaggcggaacttgaggtcgtccctattatcgccaaatgcttggaaggcatgaaggttgccgctaatgcagtagatccaaagaacgattcccacgtcctcattgagctgcacaaaagtggctttgccagaccaggagatgtggagttcgaagacttcagtcaacctatgaatagggcaccaagcgacagctcactcggtacaccttccgatgggcgtcctgaactgaggggccctggaaggtcgaggacaaagaggtggccctttggaaaaaaaaacaaaccacgaccgccacctctgtccccattaggtggaccggtgccatccgctctgcctaatggccctccctcacctaggtcagggcgtgatccgttggccattctctcagagatcagcaaaagtgtgaagccacggttagcctccttcaggagtctaagagggagcaggggcactgtcgttaccgaggacttctctcacctgcccccagaacagcagagaaagaggcttcagcagcagctggaggaaaggtcccgggaattgcaaaaggaagtggaccaaagggaggccttgaagaaaatgaaagatgtgtacgaaaagaccccccaaatgggggatccagcgtcgctggagccgcagattgccgaaacgctgtcaaatatcgagagattaaagctggaagtgcagaagtatgaggcctggttggccgaggccgaaagccgagtgctaagcaatcgcggtgactctttgtcaagacacgcccgtccgcctgacccacctgcctccgctccgccagactcgtcttctaacagtgccagccaggacaccaaggagtcatcagaggaacctccctctgaagagtcccaggacaccccaatttacaccgaatttgatgaggattttgaggaggagccaacaagccccattggacactgcgtggctatctaccactttgaaggttcctccgagggtaccatatcaatggctgagggagaggatttgagcctcatggaagaagataaaggggacggttggacaagagtgcggagaaaagaagggggtgaggggtatgtgcccacttcataccttagggtgactctcaattag

SEQ ID NO: 54821 - DNA, 1638 bp, Artificial Sequence
  Description of Artificial Sequence: Synthetic coding sequence
atggactggggcaccgagttgtgggaccagtttgaagtgctggaaagacacacccagtggggcctggacctccttgaccgctatgtcaagtttgtcaaggaacgcacagaggtcgagcaggcttacgctaaacagcttagatctttggttaaaaaatacttgcccaagcgtccagcgaaggatgacccagaaagcaagttctctcaacagcagtcgtttgttcagatcttgcaggaagtgaacgactttgcaggccagagagagcttgtggctgagaacctttccgtgagggtgtgtctggaactgactaagtatagtcaggagatgaagcaggaacgcaaaatgcactttcaggaaggcaggagggcgcaacagcagctggagaacggatttaaacagctggaaaactctaagcgaaaatttgaacgggactgtcgagaagccgaaaaagccgctcaaaccgcagagcggctagatcaggacatcaatgcaactaaagccgatgttgaaaaggccaaacagcaggctcatttacgttcgcacatggctgaggaaagcaagaacgaatacgctgcccagctgcagagatttaacagggatcaggcacatttttatttctcacagatgccccagattttcgataaactccaggacatggatgaaagacgcgctacaagattaggcgctgggtacggattgctatccgaggcagagctggaagtcgtaccaattatcgcgaagtgtctagaagggatgaaagtagccgcaaacgccgtagatcctaagaacgacagccacgtgttgattgaactgcataagagtggtttcgccagaccaggggacgtggagttcgaagacttcagccagcccatgaacagagccccttctgactcctcacttggtaccccgtccgatggccgaccagagctgcggggacctggcagatccaggaccaagagatggccgttcggaaagaaaaacaagacggtagtcacagaggacttctcccatctccctccagagcaacaacggaaacgtcttcagcagcagctggaggaacgctcgcgagagctccagaaagaagttgaccagcgtgaagcactgaagaaaatgaaagacgtctacgagaagacccctcaaatgggtgaccccgcttccctcgagccccagatcgccgaaactctgagcaatatcgagcgtcttaagctggaagtgcaaaaatatgaggcttggctggcagaagccgaatcaagagtgctcagcaaccgcggagattctctctccaggcatgcacgtccacccgacccacccgctagtgcaccccctgatagctcatctaacagcgcctcccaggataccaaagagagcagcgaggagcccccttctgaagagagccaggacactccaatttatacagagttcgatgaagactttgaagaggagccaactagtcctattgggcactgtgtggccatatatcattttgagggcagctcagaaggaacaatttcaatggccgagggggaggatctgagtctgatggaagaggataaaggcgacgggtggaccagagtgcgccgtaaagagggcggagaaggttatgtaccaacgtcatatttacgggtgacactgaactag

SEQ ID NO: 54822 - DNA, 1782 bp, Artificial Sequence
  Description of Artificial Sequence: Synthetic coding sequence
atggattgggggaccgaactttgggaccaattcgaggtgttggaacgacatacgcagtggggactggatctgctagaccggtacgtgaagtttgtgaaagaacgcacagaggtggagcaggcctacgctaagcagctgcgctccctggtaaaaaagtacctcccgaagcggccagccaaagacgatccagagagtaagttctctcaacagcaatcctttgtgcaaatcctccaagaggtgaatgactttgcagggcagagagaactggtcgctgaaaatctgtcggtccgggtgtgccttgagcttaccaagtatagccaagaaatgaagcaagaacgtaagatgcacttccaggagggccgacgggctcagcaacaactggagaatgggttcaagcagcttgaaaactccaaaagaaagtttgaacgcgattgccgagaagcagagaaagccgcacagactgcggagcggctggatcaggatatcaacgccactaaggccgatgttgaaaaggctaaacagcaggcgcatcttagatcacacatggccgaagaaagcaaaaacgagtatgcagcccaacttcaacgttttaatcgcgaccaggctcacttctacttttcacaaatgccacagatattcgacaagctccaagatatggatgagcggcgagcaaccaggctgggtgcagggtacggactgctgtcagaggccgaacttgaggtggttcccattattgcaaaatgcctcgagggcatgaaagtagcagccaatgcagttgacccaaagaacgacagccatgtgctgatagagctgcataaatcaggctttgcacggcctggcgacgtcgagttcgaagactttagtcagcctatgaaccgggcacctagcgacagttctctggggacaccatcagatggacggccagaactgcggggtcccggacggtccaggaccaagcggtggcctttcggtaaaaaaaataagacagtggtgactgaagacttcagccacttgccacccgagcaacagcgtaaaagattacagcagcagctggaggagcgtagtagggagctgcaaaaagaggtagaccagcgcgaagccctcaagaaaatgaaagacgtgtacgaaaaaacccctcagatgggcgatccagccagcctagaacctcagatcgcagaaaccctctcaaacattgagcgcctgaaacttgaggtacaaaaatacgaggcttggcttgcagaagctgaatcacgcgttctctcaaatcgtggagactccctctcccggcatgcgcgtcccccagatcctcccgcttctgcgccacccgattcctctagcaactctgctagccaggatactaaggagagtagcgaagaaccacctagcgaggagtcccaagataccccaatctataccgaattcgatgaagactttgaagaagaacctacctcccccatcggtcattgcgtggccatttaccacttcgaggacctgggccctccacccccaccatcccagggccctgctcgcgcactcagtttatggccaagggtaaaaacttccgtcctgtggaagaaaaccaagggcacagctggacccggatcaggtgggaagagagaggcccgagccacgtgcccaccacctacgtcggagagccggagcatcgagccttgtcaaagaagggaagaaggaggctgtagattgttactactgggccacggcgagccacaggacctctgcaccctctttctcactccatggctgaggctgcgaccagtttag

SEQ ID NO: 54823 - DNA, 1299 bp, Artificial Sequence
  Description of Artificial Sequence: Synthetic coding sequence
atggatgaggcagttggcgacttgaagcaggctctcccctgtgtggcggaatccccaacagttcacgtagaggtacatcaacgcggttccagtactgccaaaaaggaggatattaatctcagcgtgaggaaattgctaaatcggcacaatattgtgttcggggattatacttggacggaatttgacgagccgttcttgacacgtaacgttcagtctgtcagtataatcgatacagaactgaaggtgaaagacagccagcccattgacttaagcgcttgtactgtcgccctacatattttccagcttaatgaggacggacctagtagtgagaatctggaagaggaaactgaaaacattatagccgcaaaccactgggtgctgcccgctgctgaattccacggcctgtgggacagcctggtttacgatgtcgaggtaaaatcacatctgctggattacgttatgaccaccctccttttctctgacaaaaatgtgaattctaatctcatcacctggaatcgagtggtgctgctgcatgggcctcccggtacgggcaagacatcactgtgtaaggccctggctcagaagctgaccatacgtttaagctcccggtatcggtacgggcagctgatcgagattaactcacactcattgttttccaagtggttttctgagtcgggcaagttggtgacaaagatgtttcagaagattcaggacctcattgacgataaagacgctctggtattcgtactcatcgacgaggtcgagagtctgaccgccgctagaaatgcatgtagggccggaactgagccttctgatgctatcagggtcgtgaatgctgtcctgacacagatagatcaaatcaaacgacattctaatgtggttatcctaaccacttccaacatcactgagaaaattgacgtggccttcgttgatcgcgctgatattaaacagtatataggcccaccctccgctgccgcaatctttaagatatatttgagctgtcttgaggagctgatgaaatgtcagattatatatccgagacagcagctgttgactctgcgggaactagagatgattgggttcatcgaaaacaacgtgtctaaactttcactgctgttaaatgatatcagtagaaagagcgagggactgtctggcagagtgcttcggaagctgccctttctggcacacgctctgtacgtccaggcaccaacagtcactatagaaggttttctgcaggctttgagcctcgccgtggacaagcagttcgaagagcgcaagaaacttgccgcatatatctag

SEQ ID NO: 54824 - DNA, 591 bp, Artificial Sequence
  Description of Artificial Sequence: Synthetic coding sequence
atggatgaggcagttggtgatcttaagcaggcactgccttgcgtcgccgaatcacccacagtacatgtagaagttcatcaacgaggctccagtactgcgaagaaagaggatatcaatctctctgtgcggaagttactgaaccggcataatatcgtcttcggcgactacacctggactgagtttgacgaaccgtttcttacgaggaatgttcagagcgtcagcatcatcgacacagagctgaaagtcaaagactcccaacctatcgatttgtccgcttgcacagtcgctctgcacattttccagttgaacgaagacggaccttcttccgaaaatctggaagaggagaccgaaaatattatcgccgctaaccattgggtgctccctgcagccgagttccacggactgtgggatagcctggtgtatgacgtggaggtgaaatcccacctgctggattacgtcatgactacccttctgtttagcgacaaaaatgtgaactctaacctgatcaccattgagggattcctccaggccttaagtctggctgtcgataaacagttcgaagagcggaagaagcttgccgcatacatctag

SEQ ID NO: 54825 - DNA, 744 bp, Artificial Sequence
  Description of Artificial Sequence: Synthetic coding sequence
atgccaaggctgctccatccagctctacctttgttgctgggcgcaaccttgacattcagagccttgaggagggccttatgccgccttccactgccagtgcacgttcgggcagatcccctgaggacttggaggtggcataacctccttgtgtccttcgctcactccattgtgtccggtatctgggcgctcctgtgcgtgtggcagacccctgatatgttggttgagatcgaaactgcttggagcctaagtggatacttacttgtgtgcttttcagcgggatacttcatacacgataccgtggacatcgttgcatccgggcaaactcgggcttcttgggagtatctcgtgcaccatgttatggcaatgggggcattcttttctgggattttttggagctctttcgtgggaggcggagttctgaccctgctcgttgaagtttcaaatatctttctaacaatccgaatgatgatgaagatttccaatgcacaggatcacctgttgtatcgtgtgaataagtacgtgaaccttgtgatgtatttcctattccggttggcgccacaggcttacctcactcatttcttccttcgatatgttaatcagagaactctgggaaccttcttactgggtatcctgctgatgctggacgttatgatcattatctatttttcccggctcctgagaagcgacttttgccccgaacatgttcccaagaagcaacacaaagataagtttctgaccgaatag

SEQ ID NO: 54826 - DNA, 603 bp, Artificial Sequence
  Description of Artificial Sequence: Synthetic coding sequence
atgggatatagtgctgtccctaaatgtccccctcggggtcgtggcagggattcagtgtggcagacgcctgatatgctagttgaaatcgaaacggcatggagcctgtcaggctatttgttagtgtgcttcagtgccggatacttcattcacgataccgtggatatcgtcgcttccgggcagactcgcgcatcctgggaatacctcgtgcaccacgtgatggctatgggggcatttttttcgggcatcttttggtcttctttcgttggcggaggcgtgctgactttgcttgtggaggtgtctaatatatttttaacgatcagaatgatgatgaaaattagtaatgcccaagatcatctactgtatcgcgtcaacaagtacgtgaatctagtgatgtactttctgtttaggttggctccccaggcttacctgacacacttctttctgcggtacgtgaatcagaggaccttgggcacattcctgctgggaatcctgctcatgctcgacgtaatgataatcatttacttctcaaggctgcttcgctccgatttttgtccagagcacgttcccaagaagcaacacaaggataagttccttacggagtag

SEQ ID NO: 54827 - DNA, 624 bp, Artificial Sequence
  Description of Artificial Sequence: Synthetic coding sequence
atggccgctgcttggccgagcggaccctccgcccctgaagccgtcacagcacgccttgtaggcgtgctgtggttcgtgtccgtgaccactgggccttggggcgcagtggcaacttcagcgggtggggaagaatcgttaaagtgtgaagaccttaaggtgggccaatacatttgtaaagacccaaaaataaatgacgcaactcaagagccggtgaactgcacgaattacacagctcatgtgtcttgcttccccgcaccgaatataacttgcaaagattcgtccggcaacgaaactcatttcacgggcaatgaggtgggattctttaagcctatttcctgtcgcaatgtgaacgggtattcatacaaggtggctgtggctctgagcttgtttctgggatggctgggggctgataggttttatctgggttaccccgcactgggccttttgaagttctgcacggtgggtttctgcggcataggctctctgattgacttcatcttgatctctatgcaaattgtaggaccttccgacggatcttcatatattattgactattacggtacccgtttgacccggttaagtattacaaacgagacattccgtaagacgcagctgtatccctag

SEQ ID NO: 54828 - DNA, 561 bp, Artificial Sequence
  Description of Artificial Sequence: Synthetic coding sequence
atggcagccgcatggccgtccggcccatcggccccagaggccgtgacagcacgtctggtgggcgtcctgtggtttgtgagtgtcaccaccggcccatggggtgcagtggccaccagtgcgggaggggaggaaagtctaaaatgcgaggacttaaaggtgggccagtatatttgtaaagacccaaagataaatgacgccacgcaggagcctgttaactgcacaaattatactgcgcatgtctcatgttttcctgcccctaacataacttgtaaagatagcagtgggaatgagactcacttcaccggcaacgaggtgggcttctttaaacctattagctgccgaaatgtaaatggctatagctacaaagtggcagtggcccttagcctcttccttggatggctgggcgcagaccggttctacctagggtaccctgcactggggaaggagaccgtgacccgggaagtcaaaggattcacagagtcgcgtggcttccctttattctgtgatatattcgtggttataattttcgtgctgtggatcggtaagctcagtcgagactag

SEQ ID NO: 54829 - DNA, 531 bp, Artificial Sequence
  Description of Artificial Sequence: Synthetic coding sequence
atggcagccgcttggccaagtggcccatccgcccctgaagctgtcacggccagactcgtgggcgtgctgtggttcgtgtctgttactactgggccttggggggctgtcgcaacttccgcgggtggagaagaatccctgaaatgtgaggaccttaaggtagggcagtatatttgcaaagatccaaaaatcaatgatgcaacacaggaacctgtaaattgtaccaattataccgcacacgtctcctgcttccctgccccaaatatcacctgcaaggattcaagtggtaacgaaacccacttcactggcaatgaagtgggattcttcaagccaatttcctgcaggaatgtcaatggctatagctataaagtggccgtggcattgagcctgtttctgggctggctcggagccgaccggttttaccttgggtacccagccttgggactgttgaagttctgtaccgtcgggttttgtggcatcggatccctaattgactttatcctgatcagcatgcaagtgagtttctctatctag

SEQ ID NO: 54830 - DNA, 810 bp, Artificial Sequence
  Description of Artificial Sequence: Synthetic coding sequence
atgcatattctgaaaggttcccccaacgtgatacctagagcacacgggcagaaaaatactcgcagagatggcacggggctctaccctatgcgcggtccttttaagaaccttgccctgctgccatttagtttgccgctcctcggaggtggtggctcaggatccggcgaaaaagtgtctgtgagcaagatggcggcagcatggccttctgggcctagtgctccagaggctgtcactgctcggctggtgggagttctgtggttcgtaagtgtcactactggcccttggggagccgttgcaacatcagccggtggcgaagagtccttgaaatgcgaagaccttaaggtggggcagtacatctgtaaggacccaaagatcaacgacgccacccaagagcctgtgaattgtactaattatacagcccacgtgtcatgctttcctgcccctaatatcacatgtaaggactccagcggcaatgaaacccatttcacagggaacgaggtggggttctttaaacctatatcctgtcgtaacgtgaacgggtacagctacaaggtggccgtagcactgagcctgtttctgggttggctaggagcagacaggttctacctgggatacccagccttgggcctactaaagttctgcacagtaggcttctgtgggatcggcagcctaatcgatttcatccttatatctatgcagatagtggggccaagcgacggttcgtcatacatcatcgattattatgggaccaggcttacgcgactgtctataaccaacgaaaccttccggaaaacccagctttacccgtag

SEQ ID NO: 54831 - DNA, 516 bp, Artificial Sequence
  Description of Artificial Sequence: Synthetic coding sequence
atgaaaaagtgccttctccctgtgctcatcacatgtatgcagacagcaatttgcaaagatcggatgatgatgatcatgatcctccttgtcaattaccggccagatgagtttattgaatgcgaagacccggtagaccatgttggaaatgcaactgcctctcaagagctgggctatggctgcttaaagtttgggggtcaagcgtacagcgacgtggaacacacatctgttcagtgccacgcgcttgacgggatcgaatgcgcgtcaccccgtactttcctcagagagaacaaaccctgcattaaatataccggccactactttattaccaccctcctctacagcttctttcttggatgcttcggcgtggacaggttctgcctgggccacacaggcactgccgtgggaaaactgttgacactgggcggactcggtatttggtggtttgtagacctgattttactcatcacaggcggactgatgccatctgatggcagtaactggtgtaccgtgtattag

SEQ ID NO: 54832 - DNA, 516 bp, Artificial Sequence
  Description of Artificial Sequence: Synthetic coding sequence
atgaagaagtgtctgttaccggtcctgattacatgtatgcagaccgccatctgtaaagacaggatgatgatgatcatgattttgctagtgaactaccgtcccgatgagtttatcgaatgcgaagaccctgtcgaccatgtgggcaatgcaacagcgtcccaagaactgggatatggctgtttgaagtttggcggacaggcatacagtgatgttgagcatacgagcgtacaatgccatgccctggacggcattgaatgcgcctcaccaagaacattcctgcgcgaaaataagccatgcatcaagtatacaggtcactactttatcacaacactgctctattcctttttcttaggctgcttcggcgtggatagattttgtctgggccatactgggacagccgtcgggaagctgctcacgttaggcggactcggcatctggtggtttgtggatctgatactgctcattacgggcggattgatgccatctgatgggtccaattggtgcacagtctattag

SEQ ID NO: 54833 - DNA, 645 bp, Artificial Sequence
  Description of Artificial Sequence: Synthetic coding sequence
atggtgctgggcggatgtcccgtcagctacttgttactgtgcgggcaggccgcacttcttttaggtaacctcctcctgttacattgcgttagtcggtcccattcccaaaacgcaaccgccgagcctgagctcacttcggccggagctgcgcagcccgaggggcctggcggagcagcctcgtgggaatatggggacccacatagcccggtgatcttatgtagctaccttcctgacgagtttatcgagtgcgaggaccccgtcgaccacgttggtaacgcaaccgcttctcaggagctggggtatggatgccttaagtttggcggacaagcctactcggacgtggaacacacctccgtgcaatgtcacgcccttgatgggatagaatgcgcctcccctaggactttcctgcgcgagaacaaaccatgcatcaaatacaccggtcactatttcatcacgacgttgctgtattctttctttctcgggtgtttcggtgttgaccgcttctgccttggacatacagggactgctgtcggcaaactgctaactctgggcggactaggcatctggtggttcgtggacctcatactgcttattaccgggggactcatgcccagcgacggcagcaattggtgcaccgtctactag

SEQ ID NO: 54834 - DNA, 516 bp, Artificial Sequence
  Description of Artificial Sequence: Synthetic coding sequence
atgaaaaaatgccttctaccagtgttaataacttgcatgcagacagccatttgcaaggaccgcatgatgatgataatgatactgttggtgaattacaggccggacgaatttatagagtgtgaggacccggtggatcacgtcggcaacgcaaccgctagccaggagctgggctacggctgtcttaaattcggcggtcaggcctatagcgacgtggaacacacatctgtccagtgtcacgcactggacggcatcgagtgcgcctcccctaggacattcttgcgcgagaataagccttgcattaaatatacgggtcattacttcataacaaccctcttgtacagtttttttttggggtgcttcggggtcgatcggttctgtctgggccatacaggcaccgcggtcggtaagttgcttacccttgggggattaggcatttggtggttcgtggacctgattcttttaatcacagggggtcttatgcctagtgacggcagcaactggtgcactgtttactag

SEQ ID NO: 54835 - DNA, 192 bp, Artificial Sequence
  Description of Artificial Sequence: Synthetic coding sequence
atgaaaaagtgtctattgcccgtcctaatcacctgcatgcaaacagccatatgcaaagatagaatgatgatgatcatgattctgctcgtgaattatcgcccagacgaattcatcgaatgtgaggatcctgttgaccacgtgggaaatgccacagcaagtcaagaactgggctacggatgcttaaaagtgtag

SEQ ID NO: 54836 - DNA, 138 bp, Artificial Sequence
  Description of Artificial Sequence: Synthetic coding sequence
atgaagaagtgtctgctgccggtgctcatcacctgtatgcaaactgctatatgtaaagaccgtatgatgatgatcatgatccttctcgtcaattataggcccgatgagttcatcgaatgtgaggacccagtggattag

SEQ ID NO: 54837 - DNA, 366 bp, Artificial Sequence
  Description of Artificial Sequence: Synthetic coding sequence
atgaagaagtgcttgctaccagttctgataacatgtatgcagacagcaatctgcaaagaccggatgatgatgataatgatcttgctcgtgaactacagaccagatgaatttatcgagtgtgaagacccggtggaccacgtgggtaatgcgaccgccagtcaagagttagggtacggctgtctcaaatttggcggacaagcctatagtgacgtagagcatacctcagtgcaatgccacgcgttggacgggatagagtgtgcctcgcctcggacattcttgcgcgaaaacaaaccatgtattaagtatacgggccattatttcattacaacgctgctctattctttcttcctgggatgtttcggatag

SEQ ID NO: 54838 - DNA, 1215 bp, Artificial Sequence
  Description of Artificial Sequence: Synthetic coding sequence
atgcctcggccagggtctgcccagcggtgggccgctgtagcgggaaggtgggggtgcaggctcctggccttgcttctgctggtaccaggacccggaggcgcttccgaaattacctttgagctgccagacaacgccaagcaatgcttttacgaggatatagcccagggcacaaaatgtacgctggaattccaggtgatcaccgggggacattacgacgtcgattgtcggttagaagaccccgacggtaaagttctttacaaggaaatgaagaagcagtacgatagcttcaccttcaccgcctctaagaacggcacctacaagttttgcttctctaatgagtttagcactttcacacacaaaaccgtgtatttcgactttcaggtgggggaagatcctcctctgtttccttctgaaaatcgtgtgagcgcattaacacagatggagtctgcctgtgtctctattcatgaagccctaaagagcgtgatcgactatcaaacacactttcgcctgagagaagcgcaaggtcgcagccgggctgaagatctcaacactcgggtagcttactggcattcagttgacacctcacccggataccatgaaagtgacagcaagaagagcgaggatttatctttgtgtaacgtggcggaacattccaacactactgaaggtccgaccggcaagcaagagggcgcacagagtgttgaagaaatgttcgaagaagaagctgaggaagaggtgttcctgaagtttgtcattctgcatgccgaggacgatacggatgaggccttgcgtgtgcagaatctgttgcaggatgattttggaatcaaaccgggaatcatatttgccgagatgccctgtggacgtcaacatcttcagaaccttgacgacgcggtgaatgggagcgcctggacaattcttctcctgaccgaaaattttctcagagacacctggtgtaacttccagttctataccagtctcatgaactctgtgaatcgccaacacaaatacaacagtgttatccctatgagacccctgaacaatccattaccccgagagcggactcctttcgccctccaaaccattaatgctttggaagaagaatcaagaggtttccctacacaggtggagcgcatttttcaggaatcagtttataaaacccagcagacaatttggaaggagactagaaatatggttcaacggcagttcattgcctag

SEQ ID NO: 54839 - DNA, 567 bp, Artificial Sequence
  Description of Artificial Sequence: Synthetic coding sequence
atgccgaggccaggttcagcccagaggtgggcggcagttgccggacgatggggctgtcgactactggcactgctacttctggttcctgggcctgggggagctagcgagatcacattcgagctgccagacaatgcaaaacagtgcttctacgaggatatcgcgcagggtacaaaatgcactctggagttccaggttattacaggaggacattacgacgtcgattgtagactcgaggatcccgacgggaaggtgctgtataaagaaatgaaaaaacagtatgattcttttaccttcacggcttccaaaaacggaacatacaaattttgcttcagcaatgagttctccacattcacccacaaaaccgtctacttcgactttcaggtcggagaggatccacccctgtttccctcagaaaatagggttagcgctctcactcaaatggaaagcgcctgtgtgtccatccacgaggcgctcaagagcgtgatcgattaccagacacatttccggctgcgtgaagcgcagggcaggtctcgcgctgaggatctcaacactagagtcgcctactag

SEQ ID NO: 54840 - DNA, 375 bp, Artificial Sequence
  Description of Artificial Sequence: Synthetic coding sequence
atgccagtcagggggccagacgtggaggcatactgtctacgctgcgagtgcaagtacgaggaaagatcaagcgtgacaattaaagtcactatcattatttacctctcgatcctgggcctgttacttctctatatggtgtacctcactctggtggaacccattctgaaaagacgattgttcggccacgctcagctaatccagagtgatgacgacatcggtgatcatcagccattcgcgaacgcacacgacgtgctcgcacgtagtagatcccgcgctaatgtgctgaataaggtcgagtacgcacagcagagatggaagctgcaggtgcaggaacagagaaaaagcgttttcgatagacacgtggtcctgtcttag

SEQ ID NO: 54841 - DNA, 375 bp, Artificial Sequence
  Description of Artificial Sequence: Synthetic coding sequence
atgcctgtccgtggaccagatgtcgaggcctattgtctgagatgcgagtgcaagtatgaagagaggtcctctgtgaccatcaaggtgaccatcattatctacctatccattctgggcctactactcctgtacatggtgtatcttactctggttgagcctatcctgaagcggcgactttttgggcatgcccagctgatccaaagcgatgacgacattggggaccaccagccctttgccaatgcgcacgacgtgctggctaggtcaagatccagggccaacgtgcttaacaaggtggaatacgctcaacagaggtggaagcttcaggtgcaggaacagcggaagtccgtcttcgaccgacatgtcgtactgagttag

SEQ ID NO: 54842 - DNA, 597 bp, Artificial Sequence
  Description of Artificial Sequence: Synthetic coding sequence
atggctacgctttggggcggattgctgcgtctcggctcactgctgtccctgtcttgtctggcacttagtgtattgcttctggcccagctgtccgacgctgctaagaactttgaggacgtccggtgtaagtgtatctgccccccttacaaagaaaattctggacacatttataataagaacataagtcagaaagactgtgactgtctccacgtagtggagcccatgcctgtgcgtggcccagacgttgaagcctattgtcttcgttgtgaatgtaaatatgaggagagatcatcagtcacaatcaaggtgacaatcatcatatatcttagtattctgggcctgctattgctgtatatggtgtacctgacactcgttgagcccatactgaaacggaggctgttcggtcacgcgcagctgatccagtcagatgacgatataggggatcatcaacccttcgcaaatgcgcatgacgtgcttgcgagatccagatcaagagccaacgtcctgaataaagtggagtacgcgcaacagagatggaagctgcaggtgcaggagcaacgcaagtccgtctttgaccggcacgtggtgctgtcttag

SEQ ID NO: 54843 - DNA, 318 bp, Artificial Sequence
  Description of Artificial Sequence: Synthetic coding sequence
atgtaccgcccagtcatggccagttgtacctcagtgagtctatggatgatcgctctgttagtgttcggcgtgctggcaattttcggtattacgatcggactcttggttcacttcttagctgtcgccaataggatatatttctaccaagggtcttttaagatgttagatatcccatacaactcaaattatgaaagggagacaagtcccgagaataattatctcagccagattctggagacacgctggctgatgcatttcaaggtgcttgctttcaccgacaatatttccttccttaagagttcccattggtgtaagtag

SEQ ID NO: 54844 - DNA, 1413 bp, Artificial Sequence
  Description of Artificial Sequence: Synthetic coding sequence
atgcctggattcgattacaagttcctcgaaaaaccaaaaaggaggctgctgtgtccattgtgtggtaaacctatgcgggaaccagtccaggtctccacttgcggacatagattctgcgacacctgtcttcaggaatttctttctgagggggtttttaagtgccctgaagatcagctcccactggactacgccaaaatctaccccgacccagagttagaggtccaggtcctcggactgcctatcagatgcattcacagtgaggagggttgtcgatggtccggtcccctgcgccacctccagggacacctcaacacatgcagcttcaacgtgattccctgccccaaccgatgtcccatgaagctatcccgtagagatttgcctgcccacctgcagcacgattgcccaaaacgtcggctgaagtgcgagttttgcggctgtgacttttcaggcgaggcgtacgaaagtcacgaggggatgtgcccacaggaaagtgtttactgcgagaacaagtgtggggctcgaatgatgcgacgccttctggcacaacacgccacatcagagtgtccaaaacgaacacagccttgcacttattgcacgaaagaatttgtgttcgacaccatacaaagccatcagtatcaatgtcccaggcttccagtcgcatgccccaaccaatgtggagtcggcacagtcgccagggaggatttaccaggccacctcaaggatagttgtaacacggcactcgtgctatgtccatttaaagactcggggtgcaaacatcgttgccctaaacttgctatggcgagacacgtggaagagagcgtcaagccccatcttgccatgatgtgcgccctcgtaagccgacagcggcaggagttgcaggagttgcggcgtgaactggaggagctcagcgtaggctcagacggggtcctgatctggaagattggcagttatgggagacggctgcaggaggccaaggccaagcctaatctggaatgtttctcgcctgccttctatacccacaagtatgggtataagctgcaggtgagcgcctttctcaatgggaatggcagtggtgaaggcacccatctgtccctttacatccgagtcctcccgggagcattcgacaacctgctggagtggccgttcgccagaagggttacattttccctgctcgatcaatctgatccagggctcgctaaaccgcagcacgtgaccgagaccttccaccctgatcctaactggaaaaactttcagaaaccgggaacttggaggggaagcctggacgaatccagtctgggctttgggtatccaaagtttatcagccaccaggacatccgaaagagaaattatgtgagggatgacgctgtgttcatccgtgcggcagtggagctgcctcgcaagatactcagctag

SEQ ID NO: 54845 - DNA, 588 bp, Artificial Sequence
  Description of Artificial Sequence: Synthetic coding sequence
atgccaggtttcgattacaagtttctcgaaaaacctaaaaggcgcctactgtgccccctttgcggcaagcctatgcgggagcccgtacaggtgtcaacatgcggccacagattttgtgacacttgtctccaggaatttctctcagagggcgtttttaagtgtcctgaggatcaactgcccctggactacgccaaaatctacccagaccccgaactagaggtgcaggtcctgggacttcccattcggtgtattcactctgaagagggatgcaggtggagcggcccactgcgccatcttcagggccatctcaatacatgtagtttcaatgtcataccctgtcctaaccgctgtcccatgaagctgtcacgcagggacttgccagcccacttgcagcacgattgccccaagagaaggctgaagtgcgaattttgcggttgtgatttcagcggtgaggcctatgagagctcattaggttttgggtacccaaagtttatctcacatcaggatattcgtaagcgcaattatgtgagggatgatgccgttttcattcgagctgctgttgagctaccaagaaaaattctgtcctag

SEQ ID NO: 54846 - DNA, 504 bp, Artificial Sequence
  Description of Artificial Sequence: Synthetic coding sequence
atgccgggattcgactacaaattccttgagaaacctaagaggaggctgttgtgtccactttgcgggaaacctatgagggaaccagtgcaggtgtctacgtgtggtcatcggttttgcgacacttgtcttcaagtctccgccttcttaaatggaaatggctccggcgaaggaactcacctgtccctgtacattagagtacttcccggagccttcgacaatctgctcgagtggcccttcgctagacgcgtcacctttagcctgcttgatcagagcgaccccggtctggccaagccccagcacgtaactgaaacattccacccagatcctaactggaaaaattttcagaagccaggaacatggcgcggaagtttagatgagtcatccctggggtttggctaccccaaattcatctcacatcaggatatccggaagagaaactacgtgagggatgatgccgtcttcatccgtgccgcagtggaactacccaggaaaattctttcctag

SEQ ID NO: 54847 - DNA, 435 bp, Artificial Sequence
  Description of Artificial Sequence: Synthetic coding sequence
atgcctggatttgattataagttccttgagaagccaaagaggaggctgctctgccctctgtgtgggaagcctatgcgggagcctgtgcaggtcagcacttgcgggcaccggttctgtgatacctgtctacaggagttcctctcagaaggggtatttaagtggccttttgctagaagggtgactttctctctgcttgaccagtctgaccctggtctagctaaacctcagcacgtcaccgaaacattccatcccgatcctaattggaaaaatttccagaagccagggacatggagaggctctcttgatgagtcttcgctgggatttggctatcctaagtttatttcgcatcaggacattcgcaagaggaattatgtgcgcgacgacgccgtattcataagagctgccgtagaattgcctagaaaaattttaagttag

SEQ ID NO: 54848 - DNA, 549 bp, Artificial Sequence
  Description of Artificial Sequence: Synthetic coding sequence
atgcctggattcgattacaagtttttagagaagccaaaacggaggctcctatgccctttatgtggcaagcccatgcgcgagcccgtgcaagtttcaacatgcgggcatcgcttttgtgacacttgtttgcaggagttcctgtcagagggggtctttaagtgtccagaagaccagttgccactggattatgctaagtttccccacccctaccctcagatatacccagatcctgagctggaagtccaggtgttgggactgcctatcaggtgtattcacagcgaagaaggatgccggtggagcggtcctctgcggcacctccagggccaccttaatacatgttcattcaatgtgataccttgccccaacagatgtcccatgaagctatccaggagggatctgcccgcacacctgcagcacgactgtcctaagaggcgtctgaaatgtgaattctgcgggtgtgacttttccggggaagcctacgaatctcacgagggcatgtgtcctcaggagagcgtgtactgcgaaaacaagtgcggcgctcggatgtag

SEQ ID NO: 54849 - DNA, 1179 bp, Artificial Sequence
  Description of Artificial Sequence: Synthetic coding sequence
atgcccggattcgactacaaattcttggagaagcccaagcggcgactgttgtgtcctctatgcggcaagccaatgcgtgagccagtgcaggtgagcacctgtggtcacagattctgtgacacatgtctgcaggaatttctgtcagagggggtttttaagtgtccagaggatcaactgccactagactacgcaaagatttaccctgaccctgaattggaggttcaggtgctgggcttgccaattcgctgtatccacagcgaggagggctgccgttggagcgggcctctccgccacctgcagggccatctgaacacctgctcgtttaacgtgatcccgtgccccaataggtgccccatgaaactgtctcgacgggatcttcccgcacatctgcaacacgactgcccaaagcggaggctcaaatgtgagttctgcgggtgtgacttctctggggaagcctacgagtcacacgaaggcatgtgccctcaagagtccgtatactgtgagaataagtgtggcgcacgaatgatgagaaggctgctcgcccagcatgccaccagtgagtgtccaaagcggacgcagccctgcacatattgtaccaaggagtttgtcttcgacacgatccaatcgcaccagtatcagtgcccacgcctgcctgtagcttgccctaatcaatgcggcgtcggaacggtagcccgagaagaccttccaggccacctaaaggactcgtgcaatacggcattggtgctctgcccttttaaggacagtggatgtaagcatcgctgtccaaagctcgcaatggccagacatgttgaagaatcagttaaaccacacttggccatgatgtgcgctttagtatccagacagcggcaagagctgcaagaacttaggagggaactcgaagaactttctgtgggaagtgatggagtccttatatggaaaatcggctcctacggcagaagattgcaggaggccaaagctaagccgaacctggaatgttttagcccagccttttacacacacaaatatggctacaaattacaggttagcgccttcctgaatgggaatgggagtggcgagggtactcatctttctttgtacataagagttttgccaggcgcttttgacaacctcctggaatggccgttcgccaggcgggtcacattcagtctgctgggctag

SEQ ID NO: 54850 - DNA, 597 bp, Artificial Sequence
  Description of Artificial Sequence: Synthetic coding sequence
atgccaggattcgactacaaattcctcgaaaaaccaaagaggcggcttctctgccctttgtgtggcaaacctatgcgagagcctgtacaagtgagcacctgtggtcatagattctgcgacacatgcctccaggagtttttgtctgaaggcgtctttaagtgtcccgaggatcagctccccttggattacgcaaaaatttatccagacccagaattggaagtccaggttctgggtctccctattcgttgcatacactcagaagaaggatgtaggtggagtggtccattgcggcatctacaaggacatttgaacacgtgcagctttaacgtgattccttgcccgaataggtgcccaatgaagctgtccagaagggacctcccagctcatctgcagcacgactgccctaaacggagactaaaatgcgagttttgcggatgtgacttctcaggagaggcttacgaaagtcacgagagctctctcgggttcggatacccgaagttcatttcacatcaggatattcggaaacgcaattacgttcgggacgatgcagtgttcattagggcggctgtagagctgccaagaaagatcctgtcctag

SEQ ID NO: 54851 - DNA, 2436 bp, Artificial Sequence
  Description of Artificial Sequence: Synthetic coding sequence
atgaggctgataagaaatatttatatattctgcagtatagttatgactgccgagggagacgctcccgagttacctgaggagcgcgaattaatgacaaactgttcgaacatgtctctgaggaaggtacctgctgacttaacaccggctacgacaacactggacctcagttacaacctcttgtttcaactgcagtcctctgatttccattcagtaagcaagctccgcgtcctgattttgtgtcacaatcgcattcagcaattggacctcaaaaccttcgagttcaataaagaattgcgatatctagatttatctaacaaccgtctgaaatccgtcacttggtaccttttggccggtctgcgctaccttgatctgtccttcaatgattttgacactatgccaatttgcgaggaggccggtaatatgtctcatctcgagattttgggtcttagtggggctaagatccaaaaaagtgacttccaaaagatcgcacacctgcacctgaacactgtgtttcttgggtttcggactctgccccactatgaagaaggctctctccccattctgaatacgaccaagctccacatcgtactgcccatggatacgaatttctgggtcctgttgcgcgacggtattaaaacatctaagatcctggagatgacaaacatcgacgggaagtctcaatttgtttcatacgaaatgcagcgcaatttgagtctcgagaatgcaaaaacgtcagtgctactcctgaataaagtggacttgctttgggatgatctatttctaatattacagtttgtttggcacacctccgtggaacatttccagatccggaatgtgacgttcggtggcaaagcgtacctcgaccataactccttcgattatagtaatactgtaatgaggacgattaagttggagcatgtccactttagagtcttttacattcagcaggataaaatctacctactcctgacaaaaatggatatcgaaaacctgacaattagtaatgcacaaatgcctcatatgctgttcccgaattatccgacaaaatttcagtacctgaatttcgccaataatatcctcacagatgaactgtttaaacggactatccagctgccacatctcaaaaccctcattctgaacggcaataaattggagacgctcagtctcgtcagctgcttcgccaacaacacccctctggaacacctggatttatctcaaaacttgctgcagcacaaaaatgatgagaactgctcttggccggaaacagtggttaacatgaacttgtcctataacaagttgtccgactctgtctttcggtgtcttcctaagtcaatccagattctcgaccttaacaacaatcagattcagacagtgcccaaggagactattcacctgatggccctcagagagctgaacattgctttcaatttcctgacggacctgcccggttgttctcatttttcccgtctgagcgtcttgaacattgagatgaatttcattctgtccccgtccctggattttgttcagagttgtcaggaagtgaagaccctgaatgctggcagaaacccgttcagatgtacctgtgagctgaaaaacttcatccaattggagacgtacagcgaagtgatgatggtgggctggtccgatagttacacatgcgagtatccgctcaacttaagaggcacccgcttaaaggatgtccacttgcatgaactgtcctgtaataccgctctcctcatcgttacaatcgtcgtcatcatgctggtgttagggctcgccgtggcattctgttgtctgcactttgacctcccatggtatttgcggatgttagggcagtgcacccaaacctggcacagagtcaggaagacaacccaggagcagctcaaaaggaacgttagatttcacgcattcatctcttacagcgagcacgactcactttgggtgaaaaacgaacttatcccgaaccttgaaaaagaagacgggtccattctaatatgtctgtacgagagctactttgatccgggaaagtctatttccgagaatatcgtctccttcattgaaaagtcatacaaatcgatttttgtcctctctccaaatttcgtacagaacgagtggtgtcactacgagttttactttgctcaccataacctattccatgagaactctgatcacataatcctgattctgctcgaaccaatccctttttattgcatcccaactagatatcataaactgaaggctctgctggagaagaaggcctatttggagtggcccaaggatcggcgaaaatgcggcctgttctgggccaacctgagggcagccatcaatgtgaacgtcctggccacaagggagatgtatgagctgcagacttttactgagctgaacgaagaaagtcggggtagcaccatcagcctgatgaggaccgattgtctgtag

SEQ ID NO: 54852 - DNA, 2436 bp, Artificial Sequence
  Description of Artificial Sequence: Synthetic coding sequence
atgaggcttatccggaacatctacatcttctgttctatcgtgatgactgccgagggcgatgctcctgaattgccggaggaacgggagctgatgactaattgtagtaatatgtctttgagaaaagtccctgccgatttgactcctgccactaccacgctggatctcagctataatttgctatttcaactgcagtccagtgatttccatagtgtctcgaaactccgcgtgctgattctttgccacaacaggatacaacagctcgacctgaaaacgttcgaatttaacaaagagctcagatacctggacctatctaacaatagacttaagtctgtaacctggtatttgctggctggactgaggtatctcgacctgtcattcaacgactttgacactatgcctatctgcgaagaggccggaaacatgagccaccttgagattctcggactgtctggcgcaaaaatccagaaatccgattttcagaagattgcgcacctccatctgaacactgtctttctggggttccgcacgttaccacactatgaagaaggttcactgcctattctgaatacaacgaagctgcatattgtgttgcctatggatacaaacttctgggtgttgctgcgcgatggcatcaagacatcaaaaatcctggagatgactaacatcgatggaaaatcacaattcgtcagctacgaaatgcaacggaatctctcactggaaaatgcaaagacatccgtcttgctgcttaacaaggtcgacctgctctgggatgacttgttcctgattctgcaatttgtttggcacacctctgttgaacactttcagattcggaatgtcacctttggcggaaaggcttacttggatcacaactcttttgattattccaacacggtgatgaggaccattaagctcgaacatgtgcatttccgggttttctacatccagcaggacaagatctatttactcctcactaagatggacattgagaacctgaccatttctaacgctcagatgccacacatgttgtttccaaattatcccacaaaattccagtatctgaacttcgcaaataacatcctcaccgacgagctgttcaagagaaccatccagttaccgcacctcaagactttaatacttaatgggaataagctcgaaaccctgagcctggtttcatgctttgcaaataacacgcccctagagcacctcgatctgagccaaaatctgctccaacataaaaacgacgagaattgctcttggcctgagaccgtcgttaatatgaacctcagctataacaagctgagcgatagtgtctttcgatgcctgcctaaaagcatccagattctagacctaaataacaatcagatccagacggtgccaaaggagacgattcacctcatggcattacgagaactcaacattgctttcaatttcttaacagatctgcctggatgtagtcacttttcccgtctttccgtgttgaatattgagatgaattttattctgtcgccgagcctagactttgtgcaatcttgtcaggaagtgaagacactgaacgctggtcggaatcccttccggtgcacatgtgaactcaagaatttcattcagctcgaaacctacagcgaggtaatgatggtggggtggagcgatagttacacctgcgagtaccccttgaacctgcggggaaccaggctgaaggacgtacatctgcatgaactttcatgcaataccgcactactaattgtcacaattgtggttataatgctggtactcgggcttgcagttgcattctgctgcctgcactttgaccttccctggtacctgcgaatgctcgggcaatgtacacagacttggcaccgcgtccggaagacgacacaggaacagctgaagcgtaacgtccgtttccacgctttcatatcatacagcgagcatgacagtctgtgggtaaagaatgaactgattcccaacttggagaaagaagacggcagcatcctaatctgcctgtacgaatcctattttgacccaggcaaaagcatttctgaaaacatagtatcttttatagaaaagtcctacaaatccattttcgttttgtcccccaatttcgtgcagaacgaatggtgtcattatgaattctacttcgctcaccacaatctgtttcatgaaaattctgaccatatcatcctgatcctgctggagcccattcctttttactgtattcctaccaggtatcacaagctgaaagcactcctagagaagaaggcatatctggagtggcctaaggatcgcaggaagtgtggattgttttgggcaaacctgcgggcagctattaacgtgaatgtccttgccactcgagagatgtatgaactgcagacctttaccgaactgaacgaagagtcccggggatccactatctcactaatgaggactgattgcttgtag

SEQ ID NO: 54853 - DNA, 2436 bp, Artificial Sequence
  Description of Artificial Sequence: Synthetic coding sequence
atgcgcctcattcgcaatatctatattttttgctccatagtgatgactgctgagggcgatgctcccgagcttccagaggaacgggagctgatgaccaattgctccaatatgtcactgcgcaaggtgccagcggatctgacaccggctactactacactcgacctgtcatataatttgttatttcagctgcaaagcagtgacttccactccgtaagcaaactgagagtgttaattctgtgtcataacaggatccaacagctggatctgaaaacgttcgaatttaacaaagagctgaggtacctggatctgagcaataaccggctgaagagtgttacctggtatctcctagccggactgcggtatctggacttgagtttcaatgatttcgacacgatgcctatctgtgaggaggctggcaatatgtcacacctggagatcctgggcctttcgggcgctaaaatccagaagtctgatttccaaaaaattgctcatctgcacctcaacacagtgtttctcggctttaggacactcccgcactatgaagagggctctctgcccatactcaataccactaagctacacattgtcctcccaatggataccaatttttgggttttgctgagagatggtattaagacatctaagattttagaaatgacaaacattgatggaaagtctcagtttgtgagttacgaaatgcaacgaaacctgtccctggagaatgctaagacatccgtgttgttacttaacaaagtggacctgctgtgggacgacctttttctgattttgcagtttgtttggcatacttctgtggaacactttcagatacgaaacgtgacatttggaggaaaggcgtacctggaccacaactctttcgactacagcaataccgtgatgaggacaatcaaactggagcatgttcacttccgggttttctacatccagcaggataaaatttacctcttgctcaccaagatggacatcgagaacctgaccatttctaacgctcaaatgccccatatgctgttccccaattacccaaccaagttccaatacctcaatttcgcaaacaatatcctgacggatgagctgtttaaaaggacaatccagttgccacacctcaagacactgatcctgaacggaaacaaacttgagaccctctcacttgtctcatgttttgccaataataccccactggagcacctggacctgtctcagaacctactgcaacacaagaatgacgaaaattgtagttggcctgagacggtagtgaatatgaacctgagctacaataagttgtcagactcagtctttagatgcctaccaaaatccattcaaattctggacctgaacaacaaccaaatacagaccgtgccaaaggaaaccattcacctgatggctcttcgcgagcttaacatcgcctttaattttctcaccgatctgccgggatgcagtcacttcagcaggctgtctgtactaaacatcgaaatgaattttatcctgtcccccagccttgattttgtgcagagttgtcaagaggtgaaaacactcaacgccggtaggaatccctttcgctgcacctgcgagttaaagaactttattcaattggaaacatacagcgaggtcatgatggtgggatggtcagattcatatacctgcgagtacccactgaatctgcgcggaacccggctcaaagatgttcaccttcatgagcttagttgtaatactgctttactgatagtcactattgtcgtgattatgttagtgctgggcctcgccgtggctttctgctgccttcacttcgatctcccctggtatctccggatgctgggccagtgcacccagacttggcacagagtcagaaagaccactcaggagcagctgaagcgcaacgtgcggttccacgcctttatatcgtacagcgagcacgattccctctgggtgaagaatgagctaatcccgaacttagaaaaagaggacggaagtatactgatttgcttgtacgaaagctactttgatcccggaaagagtatctccgagaacattgttagtttcatcgagaagtcatataaatcaatatttgttttgtctcccaattttgtccaaaacgaatggtgtcactatgaattttacttcgctcaccataatctgttccacgaaaacagtgaccatatcatcctcatcctgctagagcctattccgttctattgtatacccacacgctatcataagctaaaggcccttctagagaagaaggcttatctggagtggcccaaagaccgccgaaagtgtggtttgttctgggccaacttgcgagccgctattaatgtgaacgtcctggcaaccagagaaatgtacgaattgcagacctttactgagctgaacgaggaatcccggggaagcacaatcagcttgatgcggacggactgtttatag

SEQ ID NO: 54854 - DNA, 2436 bp, Artificial Sequence
  Description of Artificial Sequence: Synthetic coding sequence
atgaggctcatccgcaatatctacattttctgttcgattgtgatgaccgctgagggggatgcccctgagctacccgaggaacgagaactgatgacgaattgcagtaacatgtccctcaggaaggtccccgctgacctgacgcctgcaacgaccacgttagacctgtcgtacaacctcctgttccagctgcagtcgtctgactttcactctgtctccaagctgcgcgtgcttatcctttgtcataacagaatacagcaattggacctgaagacctttgagttcaacaaagagctcagatacctggatctgagtaataatcgactcaaatcggtgacctggtatctgctcgcagggctccggtacctggacctgtctttcaacgacttcgacacgatgccaatctgcgaggaagccggtaatatgtctcatctcgaaattctaggtctgagcggtgccaagatccagaagtctgattttcagaaaatcgcacatctccacctgaatacggtttttcttggcttccggactctccctcactatgaagagggatctctgcctatccttaacaccaccaagcttcacattgtgctgccaatggatacgaacttctgggtgctcttgcgggatggaataaaaacatccaaaatcctggaaatgacgaacatcgatggaaaaagccaatttgttagctacgagatgcagcggaatctttctctggaaaacgccaagacaagcgtgctcctgttgaataaagtggatctcctgtgggacgatttgttccttatactgcaattcgtgtggcatactagtgtggaacatttccagatacggaatgtgacattcggagggaaagcgtatctcgaccacaactctttcgactattctaacacagtgatgaggactatcaaactggaacacgttcattttagagtgttctatatccagcaagacaaaatctatctgctcttgactaagatggatatcgaaaatttaacaataagcaatgcccagatgcctcacatgctcttccccaattacccaacaaaattccagtatctcaactttgctaataatatcttgaccgatgaactgttcaaacgtactatccagttgccgcaccttaaaacgctaatcctgaatgggaacaagctcgaaacactgtcccttgtgtcatgcttcgccaataacacgcccctggaacatctcgatctgagccagaatctgttgcagcataagaacgacgaaaactgttcttggcccgagacagtggtgaacatgaatttgtcatataataaactcagcgattctgtcttcaggtgcctgccgaagtccatccaaattctggatcttaacaacaatcagatacagacggtgcctaaggagactatccaccttatggcgctccgcgagctaaacatagccttcaatttcctgaccgatctcccaggctgttcccatttctcccgactatcagttctgaacatcgagatgaactttatcttgtcaccgtctctcgactttgtccaatcatgtcaagaagtgaagaccttaaacgcgggtaggaaccctttccgttgtacgtgcgagctgaaaaacttcattcaactggagacttatagcgaggtgatgatggtgggctggtccgactcctacacttgcgagtatccattgaatctcagaggaacgcgccttaaggacgtgcatctgcatgaattgtcctgcaataccgcactacttatcgtaactatagtggtgataatgcttgtgctgggcctggctgtggccttctgctgcctgcacttcgatctcccttggtacctgagaatgctgggtcaatgtacccagacgtggcatcgggttcggaagacgacacaggaacagcttaaacgaaatgttaggttccatgcttttatcagttattccgaacatgactcactgtgggtgaagaatgaactcatcccgaaccttgagaaggaagatggcagtattctgatctgcctgtatgaatcctactttgacccgggaaaatccatcagtgagaatattgtctccttcatcgaaaagtcctataagtctatcttcgttcttagtccgaacttcgttcagaacgaatggtgccactatgaattctacttcgctcaccacaatctcttccacgaaaacagtgaccacatcatcctaatcctcctggagccaattcccttttactgtatacctacccggtaccacaagctcaaagctcttctcgaaaaaaaggcgtacttagagtggccaaaagatcgtcgaaaatgtgggctattctgggccaatctgcgagcggcaattaacgtgaacgttctggccacccgcgagatgtacgagctgcagacatttaccgaattgaatgaggagagtagaggttccacaatcagccttatgagaacagattgcttatag

SEQ ID NO: 54855 - DNA, 1215 bp, Artificial Sequence
  Description of Artificial Sequence: Synthetic coding sequence
atgccacggcctggctctgcccagcggtgggccgcagtcgcgggacgctggggatgccgtctgttggcactgctactgttagttccaggccctggcggtgcctcggaaataacatttgagctgcccgataacgcaaaacagtgtttctatgaggatattgcacaggggactaaatgcactctggagtttcaagtaataaccggcggtcactatgatgtagactgcaggctcgaggatccggatggaaaggtactgtacaaggagatgaaaaagcagtacgattccttcacctttacagctagtaaaaacggtacctataaattttgctttagtaacgaattctctactttcacccacaaaaccgtgtactttgactttcaggtgggtgaggatccccctcttttccccagcgaaaaccgcgtttcagctctgacgcagatggaatccgcttgtgtgagcatccacgaagccctgaagagtgtcatcgattaccagacccactttcggctgcgagaagcccagggtcggtcaagggccgaggacttgaacactagagtcgcctactggcactcagtcgatacttcccccggttaccacgagtcagattctaagaaaagtgaggacctgtctctatgcaatgtagccgagcacagcaacacaacagaggggcctaccgggaaacaagagggagcacagagcgtggaggagatgttcgaagaagaagcggaggaggaggtgtttctgaaattcgtgatcctgcatgctgaagacgacacagacgaggcactgcgagtacagaacctcctgcaagatgatttcgggatcaaacccggtataatcttcgctgagatgccatgtggtcgccagcacctacagaatctggacgacgccgttaacggcagtgcatggaccatactgctgctcactgagaatttcctgcgggatacatggtgcaactttcagttctacacctctctaatgaacagcgtcaataggcaacacaaatacaacagtgtcattcctatgcgaccactaaacaatccgttgcccagggagcggactccgttcgccctacaaacgattaatgctcttgaggaggagtcgagggggtttccaactcaggtggagaggatattccaggaaagtgtctacaaaactcagcaaactatttggaaggagacgagaaatatggttcaacgtcagtttatcgcatag

SEQ ID NO: 54856 - DNA, 708 bp, Artificial Sequence
  Description of Artificial Sequence: Synthetic coding sequence
atggggatagggaagtcaaaaattaactcttgtccgcttagtctgagctgggggaagagacatagcgtcgatactagccctggctatcatgaaagtgattcaaaaaaatccgaagacctttccctgtgtaatgtcgctgagcactctaacaccaccgagggtccgaccgggaagcaagaaggagcccaatcagtggaggaaatgtttgaagaagaagccgaagaggaggtcttcctgaagttcgtgatactccatgcagaggatgacaccgatgaagccttaagggtgcaaaacctgttgcaggatgattttgggatcaagccaggcatcattttcgctgagatgccttgcgggaggcagcaccttcagaatctggacgacgcagtaaatggaagcgcttggaccattctgctcctcactgagaattttctccgcgatacctggtgtaacttccagttttacacctccttgatgaactccgtcaatcgtcagcacaagtataattccgtgatcccaatgagacccctgaacaaccctctgcctagagagagaactccatttgcccttcaaactattaatgcccttgaggaggaaagtaggggctttcctacacaggtcgagaggatctttcaggaaagcgtttacaagacacagcagacgatttggaaagagacaagaaatatggtgcaaaggcagttcatcgcctag

SEQ ID NO: 54857 - DNA, 1137 bp, Artificial Sequence
  Description of Artificial Sequence: Synthetic coding sequence
atggccggtgatggaagaagggcagaggccgtgagggaaggttggggcgtctatgtcacacccagagcccctatccgggagggcagaggacggctggcaccccaaaatggcggtagctcagatgcgcctgcgtacaggactccgccaagtagacagggacgcagggaggttcgtttcagtgatgaacctccagaagtttatggggatttcgagcccctagtcgccaaggagcggagcccggtgggaaagcggacacgacttgaggaattcagaagcgactctgcgaaggaagaggtgcgtgaaagcgcttattacctccgttccagacagagacgacagcccaggccgcaggagaccgaagaaatgaagactaggcgaacaacaaggctccagcagcaacactccgaacagccgcctttgcagcccagtccagtgatgaccagaagaggcttgcgcgacagccattcttctgaggaggatgaggccagtagtcagacagacctgtctcaaactattagcaaaaagacagttcgtagtattcaggaagccccagtgtcagaggacctggttattagactccggaggcctccactcaggtacccacgttacgaagctacttctgtgcaacagaaggttaatttttccgaggaaggggagaccgaagaagacgatcaggactcatcccattcttccgtgacaacggtcaaagcgagatcccgcgactccgacgagtccggcgataagaccaccagatctagcagccagtacattgaatcattttggcagagctcacaatctcagaactttacagctcatgacaagcagccttctgttttaagcaaaggctcaacacttatcttctacaaatactgcgaccacgagaatgccgcttttaaagatgtcgccctggtcctgactgtgctgctggaggaggagacgctggggacctccctgggactcaaagaagttgaggagaaagttcgcgactttttaaaggtcaaattcacaaactctaatacacctaacagttacaaccatatggacccagataaattgaatggtttgtggtctcggatcagtcacctggtgctgcctgtgcagccggagaatgcgctgaaaagaggaatctgcctgtag

SEQ ID NO: 54858 - DNA, 1752 bp, Artificial Sequence
  Description of Artificial Sequence: Synthetic coding sequence
atggctggcgatggcaggcgagcagaggctgtaagggaagggtggggcgtgtacgttaccccaagggcgcctatccgcgagggcagggggcgactggctcctcagaatgggggaagctctgacgctccagcttaccgcaccccaccaagcagacagggcagaagagaagtcaggttcagcgatgagccccctgaggtatacggagacttcgagccccttgtggcaaaagaacgttccccagtggggaaacgcaccaggttggaggaattcagaagcgactccgcaaaagaggaggttcgggagtcagcctactatcttcgcagcaggcaacgccgtcaacctcggccacaagagacggaagagatgaagacacgcaggactacgagattgcagcaacagcacagcgaacagcctcctttgcagccttcacccgtcatgacaagaaggggtttgagggactcgcacagctctgaagaagatgaggcaagcagtcagacagacctgtcacagactattagcaaaaagaccgtgcggtctatccaggaggccccagtgtctgaggatctcgtaattcgccttcgccgaccgcctctgcgctacccacggtacgaagccacatcggtccagcaaaaagtgaatttctccgaagagggagagaccgaagaggacgaccaggatagtagccacagctcagtgactacagtgaaagcacgcagcagggattcagacgagtcaggggataaaactacacgatcatcaagtcagtacatagaaagcttttggcaatcgtctcaaagtcagaactttactgctcacgacaaacaaccctcagttcttagttcgggttaccagaaaacccctcaggagtgggctccacaaacagcacggatcaggactcggatgcagaatgactctattctgaagtccgagctcgggaaccagtccccatctacgagttcccgacaggtgacggggcagccccagaacgctagctttgttaaacgcaacaggtggtggttgctgcctctcatagcagccttagcgtctggctcattctggttctttagcacccctgaggtggagacgaccgctgtgcaggagtttcagaaccagatgaaccagctgaagaataagtatcagggccaggatgaaaaactgtggaaaaggagccagacctttctggagaaacatctgaatagcagccacccaaggtcccagcccgcaattctgcttcttaccgccgcacgggacgctgaggaggcactgcgttgcctgtccgagcagattgccgatgcttacagtagttttagatccgtgcgagcaattcgaatcgatgggaccgataaagctactcaggatagcgatactgtcaagttggaggtggaccaggaactctcaaatgggttcaaaaatgggcagaacgccgctgtcgtacacagattcgaatcatttccggctggctctactttaattttctataaatattgcgatcacgaaaacgctgcattcaaggatgtggcacttgtgttgacggtgcttctggaagaagagacattaggtacctccctcggccttaaggaggttgaggagaaggtgagggatttcctgaaggtcaagtttacgaacagtaatacacccaactcttataaccacatggatcctgataagctgaacggcctgtggagcaggatcagccacctggtactgcccgtccagcccgagaacgcccttaagagaggcatttgtctatag

SEQ ID NO: 54859 - DNA, 1413 bp, Artificial Sequence
  Description of Artificial Sequence: Synthetic coding sequence
atggcagactcaggtcttagagagccccaggaggactctcagaaggacttggaaaatgacccctcagtaaactcccaggcccaagagacgaccattattgcatcaaacgcagaggaggcagagatactccactcggcgtgtgggttgtccaaggaccatcaggaggtggaaactgaaggaccagagagtgctgacactggtgataagagcgagtcccctgatgaggccaatgtcggaaaacaccccaaggataagaccgaagatgagaataagcagtcattcctggacggcggtaagggtcaccacttacccagcgagaacctcggtaaagagccgctcgatccagacccatcccactcacctagcgacaaagttgggcgtgccgatgcacacctgggttccagttctgtagcactccccaaagaagcttctgatggtactggtgctagccaggagccccctactactgatagccaggaagcccagtcccccggtcattcatctgctggtcaggagggggaggacactcttagacgcaggctcctggcacctgaggccggaagccacccacagcagacccagaaattggaagagatcaaggaaaacgcccaggatacaatgcgacagattaacaagaagggattttggtcttacggcccagtaattctggtggtgctcgtggtagcagtcgtcgccagttctgtaaactcatactacagcagcccagctcaacaagtacccaagaaccctgctttagaggcttttttggcccaattttcccagctggaggataagtttcctggccagtcctccttcttatggcagaggggaagaaagtttctgcagaagcacctgaacgctagtaaccctactgagcccgcaaccatcatctttaccgccgcacgagagggtcgtgaaacactcaaatgcctcagtcatcacgtcgccgatgcatacacttcatcccaaaaggtatccccaattcagatagatggtgccggtcggacctggcaggacagtgacaccgtgaagcttctcgttgacctggaactgtcctacggctttgaaaatggccagaaggccgcagttgtgcaccacttcgaatctttccctgcagggagcacccttatcttttataaatattgcgatcatgaaaatgcggcttttaaggacgtagctttggtactcacggtgctccttgaggaggagactctggaagccagcgtggggcctagagaaactgaggaaaaggtaagggatctcctgtgggctaagtttacaaatagcgacacacccacaagcttcaatcacatggactccgataagctctccggcctttggtctcggatcagccatctcgtactgcccgtccagcccgtgtcttccattgaggagcagggctgtctcttttag

SEQ ID NO: 54860 - DNA, 1014 bp, Artificial Sequence
  Description of Artificial Sequence: Synthetic coding sequence
atgcgcgctgtttttattcagggggcagaagagcatcccgctgccttttgctaccaagtgaacggaagctgtccccgaacagtacatactctgggaattcaacttgtcatttaccttgcttgcgctgctggcatgctgattatcgtactcggaaacgtattcgtggcatttgctgtcagttatttcaaggccctccacacacctacaaattttcttcttttaagcctagccctggctgatatgttcctcggacttttagttctacccctgagcactatccgttcagtcgagtcctgttggtttttcggcgacttcctttgtagacttcacacatacctagatactctgttctgcctgaccagtatttttcatttgtgttttatctccatagatcggcactgcgcgatatgtgatccactgctgtatccatctaaattcacagtgagggttgcgctaaggtacatccttgctggttggggcgtccccgctgcttatacatctttatttttgtacaccgatgttgttgagacccgactatctcagtggttagaggagatgccgtgcgtgggtagttgccagttacttttaaacaaattctggggatggctgaattttccattgtttttcgttccttgccttatcatgatcagcctttatgtgaaaatctttgtggttgctactagacaggcccagcagataacgacactctccaagtctctggctggtgccgctaagcacgagagaaaagccgctaaaactctgggtattgcagtggggatttatttgctgtgctggctacccttcacaattgacacgatggtcgacagtctgcttcattttatcactccacctctggtgttcgacatattcatctggtttgcctacttcaacagcgcatgcaatcctatcatttacgtcttctcttatcagtggttcaggaaagctctcaagctgacattgtcccagaaggttttttccccgcaaactcgtacagtggacctgtatcaagaatag

SEQ ID NO: 54861 - DNA, 1029 bp, Artificial Sequence
  Description of Artificial Sequence: Synthetic coding sequence
atgacttctaacttttcccagccagtggtgcagctctgttacgaagacgtgaatggctcttgtattgagactccctacagtccaggctctagggtcattctgtacaccgccttctccttcggtagccttttggcagtgttcggcaacctgttagtcatgaccagtgtgctgcacttcaagcagcttcatagtccgaccaacttcctgatcgcatcactcgcctgcgctgacttcctggtgggggtgactgtgatgcttttctccatggttcgaactgttgagagttgctggtacttcggcgcaaagttttgcacgctgcacagctgttgcgatgtagctttctgctacagctccgtcctgcatttatgcttcatctgtatcgatcgttacattgttgttactgaccctctcgtctacgcaaccaagttcacagttagtgtctcagggatatgtatatctgtgagttggattctgccattgacatattcaggcgcagtgttttacacaggtgtgaatgacgatggattggaagaattggtgtccgccctgaattgcgtcggagggtgtcaaatcattgtgtctcaggggtgggtcctaattgacttcttgctattcttcatcccaactctggttatgataattctgtactccaaaatctttttgatcgctaagcagcaagcgattaagatagaaacgactagtagcaaagtagagtctagtagcgaatcctacaaaatacgagtggccaagagagagcgtaaagctgccaagacactaggcgtgaccgtcctggcgtttgtcatttcgtggcttccttacactgtagatattctgatcgacgcgtttatgggttttctgacaccagcatacatctacgagatctgctgttggtccgcatactacaattccgccatgaacccacttatttacgccttgttctatccttggttccggaaagctatcaaacttattctgtctggcgacgtactgaaagcatcgagtagcaccatctccctgttcttggaatag

SEQ ID NO: 54862 - DNA, 3780 bp, Artificial Sequence
  Description of Artificial Sequence: Synthetic coding sequence
atggatgcatccgaagaacccctgccaccagtgatttataccatggaaaacaaaccaatcgtgacctgcgcgggtgaccagaatctcttcacatccgtctatcccaccctatctcagcagctgcctagagagccaatggaatggcgccgtagctatggcagggcccctaagatgattcacctggagtctaattttgtacagtttaaagaagagctgctacctaaagagggcaacaaggctctgctgacctttccgttcctgcatatctattggacggaatgctgtgacaccgaggtgtacaaggctacagtgaaagatgacttgactaaatggcagaacgtgctcaaggcccactcttccgtggactggctgatagtgatcgtggagaatgatgccaagaagaaaaataaaacgaacatactgccacgtacttcaatagttgacaagattcgtaatgatttttgtaacaaacaatccgacaggtgtgtggttctgagtgaccctctcaaggactcatcaaggacgcaagagagttggaacgcctttctcaccaaactcagaactctgttactcatgagcttcacaaaaaatttaggcaaattcgaggacgacatgcggacacttagggagaaacgcacggagccgggatggtccttctgtgaatatttcatggtccaggaagagctcgccttcgtcttcgagatgctgcagcaattcgaggacgccttggtccagtacgatgaactggacgccttattctcgcagtacgtggttaactttggagctggggatggagcaaattggttgacatttttctgccagccggtgaagagttggaacggattgattctgagaaagcctattgacatggaaaagcgggagtctattcaacggagagaggccacacttttggatctgcgcagttatctgtttagtaggcagtgtaccctgttgttgttcttacagcggccatgggaggtagcccagcgagccctggagcttctgcataactgcgttcaggagttgaagctgctcgaagtgagcgtgcccccaggagccttggactgttgggttttcctctcctgcttagaggtgctccagcgcatcgaagggtgctgtgatcgggcacagattgactccaacatagcccataccgtgggattgtggtcatacgccactgagaagctgaagtccctgggttatctatgcggactggtaagcgaaaaaggacccaactcagaagacttgaatcgaaccgtcgacctcctcgctggactcggagccgaacgtcctgagaccgccaataccgctcagtctccatacaaaaagctcaaggaagctctttcctctgtggaggctttcgagaaacactacctggatctgtcgcacgccacaatcgagatgtacacaagcatcggtcgcatccgcagcgctaagtttgtcggaaaagatcttgcagagttctatatgcgaaaaaaggcccctcagaaggccgagatctatctgcagggcgcactgaagaattatttggccgagggctgggcgctgcccattactcatacacggaaacaattggccgagtgccaaaaacatctaggacagatcgagaactatctccaaaccagctccctactcgcaagcgatcatcatctcactgaggaggagcgcaagcacttctgccaggagattctcgacttcgcctctcagccaagcgattctcccggacataagattgttctccccatgcacagctttgctcagctccgggacctgcatttcgacccatccaatgcggtggtgcacgtgggtggcgtgctgtgtgtggaaatcactatgtacagccagatgccagtaccagttcacgtcgagcagatcgtggtgaacgtgcatttcagcattgagaagaattcttacagaaagacagctgagtggctcaccaaacacaagacctccaatggaataatcaacttcccccctgaaactgcccctttccccgttagccagaacagcctccctgcactggaattgtacgagatgtttgagcggtctccttccgacaattctttgaacaccacgggaatcatatgcagaaacgttcatatgctgttacggaggcaggagagctcttccagtctcgaaatgccctccggggtcgctctggaggaaggagcgcacgtgttgcgctgctctcacgtgacactggaaccaggggcaaatcaaatcactttcagaacacaggcaaaagagccaggcacatacactctcaggcagctttgtgcttccgtgggcagcgtgtggtttgtgttaccccacatttaccctatcgtccagtatgacgtgtatagccaggagccccagctgcatgtcgagcctcttgcagattcgctcttagccggaatcccccagagagtcaagtttacggtgactacagggcattacacaatcaagaatggggatagccttcagctgtctaacgctgaggctatgctgatcctgtgccaggcagaatccagggccgtggtgtacagtaatacgcgtgagcagagcagcgaagcagcgctgagaatacagtccagcgataaagtcacctcaatttccctgccagtggcacccgcatatcacgtaatagagttcgaactggaggttctgtccctcccaagcgcccctgctttgggaggcgagagcgacatgctcgggatggccgaaccacataggaaacacaaagataaacaacgtacaggacggtgcatggtaaccacggatcataaagtctctatcgattgtccttggtccatctacagcacagtaattgctctgacattcagcgtcccattccgcacaactcatagtctgctgtcctcaggaacacgcaagtatgtgcaggtctgcgtgcaaaatcttagtgagctagattttcaactctcagattcttatctggtggacaccggcgatagcactgacttgcagctggtacctctcaatactcagtctcagcagcctatttatagcaaacagagcgttttcttcgtatgggagttgaagtggaccgaggaaccaccacctagcctccactgcaggttttccgttggtttcagcccagctagcgaagaacagctcagcatctctctcaagccctacacatacgagtttaaggtcgaaaacttctttaccctgtataatgtgaaggcggaaatttttcctccttctgggatggaatactgccgaacgggctctctgtgttcattggaggtcttgatcacaagacttagcgacctgttagaggtggacaaagacgaagcgctaacagagtccgacgaacacttcagtaccaagctgatgtacgaagtggttgacaactcctctaattgggcagtgtgcggtaaaagctgcggcgtgatctccatgccagtagctgctcgcgctacgcaccgtgttcacatggaagttatgcctctgtttgctggttatctgccgcttcccgatgtgcgtttgtttaagtacctacctcatcacagtgcccacagtagccaattggatgctgactcctggatcgaaaacgacagccttagtgtggataagcacggggacgatcaacccgattcatctagcctcaagagcagagggagcgttcactccgcgtgcagctccgaacacaaggggctgccaatgccccgactccaggccctccccgctggccaggtctttaactcgtcttccggaactcaggtgttggtgattccgagtcaggatgatcatgtcctcgaggtgtcggttacctag

SEQ ID NO: 54863 - DNA, 1173 bp, Artificial Sequence
  Description of Artificial Sequence: Synthetic coding sequence
atgctgatcctctgtcaggctgaaagcagagccgttgtctactctaacactagagcacccgctctgggaggggagtcagacatgcttggcatggcagagccacatcgcaaacacaaagacaaacaaaggaccggtcggtgcatggtcacaacggatcacaaggtgtcgattgactgcccatggtctatatacagcacggtaatagccctcaccttttcagtgccttttcgaacaacgcattcactactgtcctctgggactcggaagtatgtccaggtctgcgtgcagaacttgagcgagttggactttcagcttagcgattcatacctggtggacacaggagattccaccgaccttcagctggttccactgaacacccagagtcagcagccaatttattctaagcagtcagtgttctttgtatgggagcttaagtggacggaagagcccccacccagcctccactgcagattcagcgtcggattctcacctgcaagcgaggaacagttgagcatatcactcaaaccatatacttatgagttcaaagtcgagaacttcttcacgttgtacaacgttaaagccgaaatcttcccgccatctggaatggagtactgtcgaactggctccctgtgctcactggaagtgctcatcacaagactctccgatttgttagaagtcgataaggatgaagccttgactgagagtgacgagcacttttctaccaaactcatgtatgaagtggtagataacagtagcaactgggccgtgtgcggcaagagttgtggggtgataagcatgccagtggccgctcgcgcaacccacagggtccacatggaagtcatgcctctatttgccggttatctgcctctgcccgatgttcgactgtttaagtatttaccgcaccactccgctcactcctcccaattggatgctgatagctggattgagaatgactccctcagcgtggacaagcacggcgatgaccagcctgatagcagtagcctcaaatccaggggttctgtccactcggcctgttcgtccgagcataaaggtctgccgatgcctaggctgcaagccctccccgctggccaggtgtttaattcatcctctgggactcaggtgctggtgattccaagtcaggacgatcacgttttagaggtcagcgtcacctag

SEQ ID NO: 54864 - DNA, 423 bp, Artificial Sequence
  Description of Artificial Sequence: Synthetic coding sequence
atgagtgggagtttctacttcgtgatcgtaggccatcacgataatcccgtttttgaaatggagttcttgcctgccggtaaggctgagagcaaagacgaccatcgccacctgaatcaattcatcgcgcacgcagcactggacttggtagatgaaaatatgtggctctccaacaatatgtacttaaagacagttgataaatttaatgaatggttcgtgtcagcattcgtgactgcaggacacatgaggtttattatgctgcatgacatccggcaggaagacggtatcaagaattttttcacagatgtatatgacctctacattaaatttagcatgaaccccttctacgaacccaacagccctatccgaagctctgctttcgatcggaaagtgcagttcctcggtaagaaacatctgcttagctag

SEQ ID NO: 54865 - DNA, 567 bp, Artificial Sequence
  Description of Artificial Sequence: Synthetic coding sequence
atggaggccaggtttacccggggaaagagtgcacttctcgagcgcgctcttgctcgcccaagaacagaggtgtcactttccgcatttgccctgcttttcagcgagcttgtccagcactgccagagccgagtcttcagcgtggcagagctccagtctcgcctggcggctttagggaggcaagtgggtgctagggtcctagatgcactggtcgcaagagagaagggggcacggcgagagaccaaagtgctaggggctttactctttgtaaagggggcagtctggaaggctctcttcggcaaagaggctgataagctggaacaagcaaacgatgatgccagaacattctatattatcgaacgagaaccgctgattaacacctatattagtgtgcctaaggagaattcaacccttaactgcgccagcttcacagcgggaatcgttgaagccgtgctgactcactcggggtttccagcaaaggtgacggctcactggcataaggggaccacactgatgattaaattcgaagaagccgtgatcgccagggacagggccctcgaaggcaggtag

SEQ ID NO: 54866 - DNA, 567 bp, Artificial Sequence
  Description of Artificial Sequence: Synthetic coding sequence
atggaagctaggtttacccgaggcaaatccgcattactggagagagcactagccaggccaaggactgaggtcagcctctcagccttcgctctgctgttttccgagctagtccagcactgccaatcccgtgtgttcagtgttgctgagcttcaaagtcgccttgctgcactcggacggcaggttggagcccgagtccttgacgccctggtcgccagggaaaagggagcacgacgagaaaccaaagtactgggtgccctgctgtttgtaaagggggcagtctggaaggcactcttcggtaaagaagctgataagctggagcaagccaatgatgatgcacgaactttttacataattgaacgcgagcccctgatcaatacctacattagcgtgccaaaggagaatagcactctgaactgtgcatccttcactgctgggattgttgaggccgtgctgactcacagcgggtttccagctaaagtcacggcccattggcataaaggcacgacactgatgatcaaattcgaagaggcggtaattgcacgcgatcgagctcttgagggcagatag

SEQ ID NO: 54867 - DNA, 567 bp, Artificial Sequence
  Description of Artificial Sequence: Synthetic coding sequence
atggaagccaggtttacgaggggcaaatccgccctgctcgagcgagctcttgcaaggcctagaactgaagtgtctctgtccgcttttgctttgctgttcagtgagcttgttcagcactgtcagtcacgggtattcagcgtggcggaacttcagagcaggctggccgcattagggagacaggtcggcgctcgagtgttggacgcattagtggcccgagaaaagggtgctcggagagaaacgaaagttctcggagcattgttgttcgtgaaaggtgcagtgtggaaggcgctctttggaaaggaagctgacaagctcgagcaggctaacgacgatgcgcgtacattctatatcattgagagagaacccttgatcaacacttacatctctgtcccgaaagagaatagtaccctgaactgtgccagttttactgctggtattgtggaggccgtgctgacacacagcgggtttccggcaaaggtgactgcccattggcataagggtactacactcatgatcaagtttgaagaggctgtgatcgcaagagatagggccttagaaggcaggtag

SEQ ID NO: 54868 - DNA, 522 bp, Artificial Sequence
  Description of Artificial Sequence: Synthetic coding sequence
atggcagacacagtgctgttcgagtttctccatactgaaatggtcgctgagctgtgggcacacgatcctgaccctggtcctggggttagcgcagggttgagaggagaggaagctggtgcgacaaaggggcaaaaaatgtcactgtctgtcctggaaggcatgggtttcagggtgggccaggcactaggcgagcgcctacctcgggagacacttgcctttagggaagaattggacgtactcaagttcctgtgtaaagatctgtgggtggcggtgttccaaaagcagatggactccctgagaacaaaccatcaagggacatacgtattgcaggataacagcttcccactactcctgccaatggcgtccggacttcaatacttggaggaggctcctaaatttctggcttttacatgtggcctcctcagaggggcactctacaccctggggatcgaaagcgtggtcactgcatccgttgccgctctgccggtgtgcaagttccaagtggtcatccccaagtcttag

SEQ ID NO: 54869 - DNA, 480 bp, Artificial Sequence
  Description of Artificial Sequence: Synthetic coding sequence
atggccgacacagttctgtttgagttcttgcatacagaaatggtggccgaactgtgggctcacgaccccgaccccggtcctggtggccagaaaatgagcctgagcgtgctcgagggtatggggttccgagtgggtcaagcacttggggagcgtctccctagggagacactggcctttcgagaggagctggacgtgctgaaattcctctgcaaggacctgtgggtggctgtgttccaaaaacagatggatagcctgcggactaatcatcagggaacttatgtgctgcaagacaactcttttccgctgctgttgccaatggcctctggcctgcagtatctcgaggaagctccaaaatttctggcgttcacctgcggtctcttgaggggagccctctacacactgggtatagagtcagtcgtgacggcttccgtggctgctctgcctgtgtgcaaattccaggtcgtgatccctaagtcttag

SEQ ID NO: 54870 - DNA, 342 bp, Artificial Sequence
  Description of Artificial Sequence: Synthetic coding sequence
atggccgatacagtactctttgagtttctccatacagaaatggtggcagaattgtgggcgcacgaccccgatcctggcccaggggctgcccctggggacgccggactgcaaggtggcgctgggtgtccccaggtcttagtccagcgaccagtggggggtggtgtgcctgaagctgacggccagcccgcacatcagtcaccaggcgacctgcgcccagcacgccagcaactgccgcctcctcctcctgacggactgtggccagccgtgagcggaggtagcactcaggtgcctggcctccacctgagaccgcctgcacgacgacctctgtaccccggacactag

SEQ ID NO: 54871 - DNA, 477 bp, Artificial Sequence
  Description of Artificial Sequence: Synthetic coding sequence
atggcagacgaggccctctttctgctccttcacaatgagatggtgagtggcgtatacaagagcgccgagcaaggcgaggtagagaacggtcggtgtatcacaaaattggaaaacatgggtttcagagttgggcagggactgatcgaaagatttaccaaagataccgctagatttaaagacgaattggacattatgaagttcatttgcaaggacttttggaccacagttttcaagaaacagattgataatcttcgcacaaaccaccagggaatctacgtgctacaggataacaagttccgactgctgacacagatgagtgcaggtaaacagtatctggagcatgcttcaaaatacctggccttcacttgcggcctcatccggggtggtttgagcaatctgggcataaagtccattgtaacagctgaggtcagttcaatgccagcctgtaagtttcaagtcatgatacagaagctatag

SEQ ID NO: 54872 - DNA, 393 bp, Artificial Sequence
  Description of Artificial Sequence: Synthetic coding sequence
atggctgatgaagccctgtttctgctgctgcacaatgagatggttagtggggtctacaagtcggccgagcagggggaagtagaaaacggtcgctgcatcacgaagctggaaaatatgggcttccgcgtgggacaggggctgattgagcggttcaccaaagataccgcacgttttaaggacgagctagacatcatgaagtttatttgcaaggatttttggacaactgtattcaaaaagcagatcgacaatttgagaacaaaccatcaatacctcgcatttacatgcggcctgattcgcggaggtcttagcaatctgggaatcaaaagcatcgttaccgccgaagtaagcagcatgccagcatgtaagttccaggtaatgatccaaaagctatag

SEQ ID NO: 54873 - DNA, 1092 bp, Artificial Sequence
  Description of Artificial Sequence: Synthetic coding sequence
atgttcaagaggcacaagtccctggccagcgagcgcaagcgggctttgctcagccagcgggctacacgcttcatcttaaaagatgacatgcgtaactttcatttcctgtcaaagctggtgctgtctgcgggaccgttaaggccaacaccagccgtgaagcacagcaagaccacccatttcgaaatagaaatatttgacgcccagacccgtaagcagatttgtatactcgataaggtcacccagtcatccaccatccacgacgtgaagcaaaagttccacaaggcctgccccaagtggtatccatccagggtggggctgcagctggaatgcggagggccttttctgaaagattacatcactatacaatctatagccgcaagctctatcgtgacactgtatgctaccgatctgggccagcaggtctcatggacaacagtattcctggcagagtacactggacccctcctgatttatttgttattctacctaaggattccgtgtatctacgatggaaaggagagtgccaggcgcctgcggcacccggtggtgcacctcgcctgtttctgccactgtatccactacattagatatcttctggaaacactctttgtacacaaggtgtctgctggccacacaccactaaaaaatctgatcatgagctgcgccttctattggggctttacaagctggattgcctactacataaaccatcccctttatactccaccatcgtttgggaatagacagattaccgtaagcgcaatcaactttcttatctgcgaggcaggcaaccacttcatcaatgtgatgctttcacatcctaaccacacggggaataacgcctgtttcccttcccctaactacaatcccttcacttggatgttttttttagttagctgccccaactatacatacgagatcgggagctggataagcttcaccgtgatgactcagacattacccgtgggaatttttacgctcctcatgagcatccaaatgtccctttgggctcagaagaaacacaagatttacttaagaaaattcaactcatacattcaccgaaaatcagctatgatcccgtttattctttag

SEQ ID NO: 54874 - DNA, 2262 bp, Artificial Sequence
  Description of Artificial Sequence: Synthetic coding sequence
atggcagcgggatcaaccaccttgcatgcagtagaaaagctacaggtgaggctcgcaacgaagacagagccaaagaaactggagaagtacctgcaaaaactttcagcacttccaatgactgcagacatcctggctgagactgggatccgcaaaaccgtaaaacggctgaggaaacatcagcacgttggagatttcgccagagacttggcagccaggtggaagaaactcgtgctcgtcgatcgcaatactagaccagggccacaggacccggaggaatccgcgagcagacagcgtttcggagaggccctgcaggaccaggaaaaggcatggggtttccccgagaatgccacagctcccagatccccttcccatagccccgaacaccgcagaaccgctcgtcggaccccccctggtcagcagcgcccacatcctagatcccattccagggagcctcgcgctgagagaaaatgccccagaatcgccccagccgattcaggtagatatagggcctccccaaccagaaccgcacccctcagaatgcccgagggacctgagccggctgcccctgggaagcaacctggcagaggacacacccacgctgctcagggaggccctctgctgtgccccggatgccaagggcagcctcaggggaaagcagtcgtgtcacatagcaagggacacaagagctctagacaggaaaagagaccactgtgcgcccagggagactggcacagccctacccttattcgggagaagagctgtggggcatgtttacgagaagagacacccagaatgccgtcatgggccagtgcaagagaccggcagcccagtgacttcaagacagataaggagggcggacaggccggatctggacagcgggtccctgcccttgaagaggctcctgactcccaccagaagcgccctcaacactctcattctaataaaaagaggcccagtctcgacgggagagatccaggcaacgggacacacgggctcagtcccgaggagaaggagcaactgagcaatgacagagaaacacaggagggcaaacctcccacagctcacttagacaggactagcgtgtcctctctgagcgaggtagaagaggtggatatggctgaagagtttgaacagccaacactgtcctgcgagaagtatctgacatacgatcagcttcgcaagcaaaaaaagaaaacaggtaaaagtgcaaccaccgcattaggagacaaacaaagaaaggccaatgaatccaagggtacgcgagagagttgggactctgcgaagaaattaccaccagtccaagagtctcaatctgagcggttacaggctgccggtgcagactccgccggtcctaaaaccgtccccagccacgtgttcagcgaactatgggacctttcagaagcctggatgcaggccaattatgatcctcttagcgatagcgactctatgacgagccaggccaagcccgaggccttaagttctcccaaatttagggaagaagccgcttttcccggaagacgggtgaatgccaaaatgcctgtgtacagcggttcacgacccgcttgtcagctgcaagtccctactctgagacagcaatgtgctcaagtgctgagaaacaatcctgacgcgctgtccgatgtgggagaggtgccttactgggtactggagcccgtgctggaaggctggaggccagatcagctttatcgacggaagaaggacaaccacgcactggtcagggagactgatgagttaagacgcaatcactgctttcaggacttcaaggaagagaagccccaggaaaacaagacgtggagagagcagtacctgcgccttcccgatgcgcctgaacaaaggctccgcgtcatgacaactaacatcaggtccgcccgaggcaacaatccaaatggtcgagaggccaagatgatatgtttcaaaagtgtagcgaagactccttacgatacctccagacgtcaagagaaaagcgcaggcgacgcagaccctgaaaatggggagatcaaacctgcctctaagcccgctgggtccagtcacacacctagctctcagagtagtagtggtggaggcagggattctagctcttcaatcctccgttggctgcctgagaaaagggctaatccatgcctgtcctcttctaacgaacacgctgcacccgctgccaagaccagaaaacaggcagcaaagaaggtggctccccttatggctaaagccattagagattacaagagacgattctcacgtcgctag

SEQ ID NO: 54875 - DNA, 1641 bp, Artificial Sequence
  Description of Artificial Sequence: Synthetic coding sequence
atggcagccggatccaccacccttcgcgcagtgggaaagctgcaagtccgcctcgccaccaaaacggaacccaaaaaactcgagaagtatctgcaaaaactcagcgctctgcctatgaccgccgatattctcgccgagactggcatccgcaagacagttaaaagactgcgcaagcaccagcatgtcggagacttcgccagagatctggcggctagatggaagaagctcgtgctggtggacagaaatactggacctgaccctcaggaccctgaagaaagcgccagccgccaaaggttcggagaagcacttcaggaacgagaaaaggcatggggatttccagagaatgctaccgctcccaggtctccctcccactccccagagcatagacgcactgccagacgcacaccaccaggacaacagcggcctcacccacggagccctagtagagaaccaagggctgaaagaaaacgacctagaatggcccctgcggactctggccctcatcgggatcccccaacacgcaccgctcccctacctatgcctgaagggcctgagccggctgttccaggcgaacagcctggccgagggcacgctcacgcagctcagggagggccattacttgggcagggttgccagggacagccccagggcgaagcagtgggctctcattcgaaaggacacaaatccagcagaggggcttcagcccagaagtctcccccagtgcaggagtctcagtctgaacgattacaagctgctggagctgactctgccggtccgaagactgtcccaagtcatgtcttcagtgagctttgggacccatccgaggcctggatgcaagcgaattacgacttgctgagcgccttcgaagccatgacctcacaggccaacccagaagcccttagtgcgcctgctctgcaagaggaagccgcttttcccggacggagagttaacgcaaagatgccagtgtacagtggatcccggcctgcatgccagctgcaggtgcccactcttcgacagcaatgtctgcgagtccccagaaataacccagatgccctgggcgacgttgaaggggtgccttacagtgtactcgagccagttctggaagggtggacgcctgaccaactttacaggactgaaaaagacaacgcagccttggcgcgagaaaccgacgaattgtggcgtatccattgccttcaggacttcaaagaggagaaaccccaggaacacgaaagctggcgtgagctctacctgcggctccgggatgccagagaacagcggctccgggtcgtaaccacgaagatacgctctgccagagagaataagccaagcggacggcagacaaagatgatatgcttcaatagcgtcgccaaaactccttacgacgcctcccgacgtcaagaaaaatctgcaggagcggctgaccccggaaacggcgaaatggagcctgccccaaagcccgctggctcaagccaggctccctctggcctaggagacggggacggcggttctgtgtccggcggtggttccagcaataggcatgcggctcctgccgataaaactaggaagcaggctgccaaaaaggtcgcccctttgatggccaaggccatccgggactataaaggccgtttcagcagacgttag

SEQ ID NO: 54876 - DNA, 1641 bp, Artificial Sequence
  Description of Artificial Sequence: Synthetic coding sequence
atggccgctgggtcaacgaccctgcgggctgtgggtaagctacaggttcgcttagccactaaaacagagcctaaaaaacttgaaaaatatttgcagaaactgtctgcccttcctatgactgctgacatccttgccgagaccggtataagaaaaacggtgaagagactacggaaacaccagcacgttggagatttcgccagagatctggcagcccgatggaagaagctggttcttgtcgaccggaatacagggccagacccacaggaccccgaagagtcagcgagccgtcagaggttcggggaagcgctgcaggagagggaaaaggcctggggtttcccagaaaacgccacagcacccagaagccctagccattcccccgagcaccgcagaacagccaggagaactcctcctgggcaacagagaccacatccgcgtagcccgtccagagagcctcgggctgaacggaagcgcccaagaatggccccagcagacagcgggcctcatagagacccaccaactaggacagctccacttccgatgcccgaaggacccgagccggcagtgccaggagaacagccaggacggggacacgctcacgccgctcagggcggtcccttgctgggacagggctgccagggacagcctcagggagaggctgtagggtcgcacagcaagggtcacaagtctagtcggggagcatccgctcagaagtcaccaccagttcaggagagccagtcagagcgccttcaggctgcgggtgctgattctgcaggcccaaagacggtgccaagtcatgtgttctccgagctatgggacccttctgaagcctggatgcaagctaactacgacttgttgtccgcgtttgaagccatgacttcacaggccaacccagaagcactgagcgctcccactctgcaggaggaagcagcatttccaggccgtagagttaatgccaaaatgcctgtttactctggcagccgccctgcttgtcagctgcaggttccgactctgaggcagcagtgtctacgcgtgccaaggaataaccccgacgcactcggggacgttgagggggttccatattctgtgctcgagcctgtgctagaaggctggacacctgatcagccataccggaccgagaaggacaacgccgctctcgcccgagagactgatgaactttggagaattcattgtctgcaggactttaaggaggagaagcctcaagaacatgaatcttggagagagctgtacctgcgcctcagagacgctcgcgagcagagattaagggtggttacgacgaaaatcagatccgcgcgtgaaaataagccctcaggtcggcagactaaaatgatctgcttcaactccgttgcaaagaccccctacgatgcatctaggcggcaggagaagagtgccggagcggctgatccaggcaatggggagatggaaccagcacccaaaccggcagggtcctcgcaggccccttccggactcggtgatggtgatggtggatctgtgtctggtgggggtagttctaaccgccatgctgcacctgctgacaaaacgcgaaaacaggccgcaaaaaaggtggctcccctcatggcaaaggctatcagggactacaaagggcgattttcacgacgctag

SEQ ID NO: 54877 - DNA, 1083 bp, Artificial Sequence
  Description of Artificial Sequence: Synthetic coding sequence
atgagcgggagtgtgctatttactgccggagagcggtggaggtgctttctgacgccttcgcgttcctcactctactgggccctccacaacttttgctgtaggaagaaatcaactacaccgaagaaaatcaccccaaacgtcactttctgtgacgagaatgcgaaggagcctgagaatgcactggacaagttgttctcatctgaacaacaggcgtctattttacatgtactgaatacggcctccacgaaggagttagaagctttccgcctgctcagaggaaggaggagtattaacatcgtggagcatagagaaaactttggccctttccagaatctggagtcgctcatgaatgtgcccttgtttaagtacaagagtacagtgcaggtctgcaactccatactgtgtcccaagacggggagagaaaaaagaaaaagtcccgagaatagattcctgcggaagctgctcaaacccgacatcgagagagagcggctgaaagccgtgaactcaatcatttcaatagtgtttgggactagacgaattgcttgggctcatttggatcggaagctgaccgtgttggactggcagcaatcagataggtggtccttgatgcgtggaatttattcctcgtccgtctacttagaggaaatcagctccatcatctcaaagatgcctaaggctgatttttatgtgctggagaagacgggcctctctattcagaatagctctctgtttcccatcttactgcacttccacatcatggaagctatgctgtacgccctgttgaataagaccttcgcgcaggacggtcagcaccaagtgctatcaatgaatcgaaatgcagtgggaaagcactttgagttgatgatcggcgatagcaggacctcaggaaaggagcttgtgaagcagttcttgttcgactccattctgaaggcggacccaagagtattttttcctagtgacaagattgtgcattacagacagatgtttctctctactgaattgcagcgcgtagaggagctgtacgacagtctcctccaagcaatcgctttttacgagctggccgtgtttgatagtcagccctag

SEQ ID NO: 54878 - DNA, 1083 bp, Artificial Sequence
  Description of Artificial Sequence: Synthetic coding sequence
atgagcggatctgttctcttcacagcaggagagcggtggcgatgttttctgaccccttctaggtcctctctctactgggccctgcacaacttctgctgtcgcaaaaagtctaccacgccgaaaaagatcacccctaatgttaccttttgcgacgagaacgctaaggaacctgaaaacgccttggataagttattttcatctgagcagcaggctagcatcttgcacgtactaaatacagcttccaccaaggaattggaagccttccgcctcctgcggggaaggcgctcaatcaacatcgtggagcatcgggaaaattttgggccttttcaaaatctggagagtctaatgaatgtgcctctcttcaagtataaatccactgtgcaggtgtgcaatagcattctttgcccaaaaactggccgagagaaaagaaaaagccccgaaaaccggtttttgcgaaaactcctgaaacccgatatagagagggaacggctcaaggcagtgaactccatcatttccatagtatttggtaccaggaggattgcatgggcacatttggatagaaaactgacggtgctggattggcagcagtcggatcgatggagtctgatgagagggatttattcatctagtgtgtacctggaggagatttccagtatcatctctaagatgcccaaggcagacttctatgtgctggagaagacagggttaagtatccagaattctagtttgttcccaatcctcctacattttcatatcatggaagccatgctgtatgccctcctgaacaagacttttgcccaggatgggcagcatcaggtcctgtctatgaataggaacgcagtcgggaaacactttgagttaatgataggtgatagtaggacatcagggaaggagctagtgaagcaattcttgtttgactcgattctgaaggccgaccctcgggtgttctttccctctgataagatcgtgcattaccggcagatgttcttatcaaccgagctgcagagggttgaggagctctacgatagcttattgcaggccatcgctttctatgagctagctgtcttcgactcacagccctag

SEQ ID NO: 54879 - DNA, 546 bp, Artificial Sequence
  Description of Artificial Sequence: Synthetic coding sequence
atgtccggaagtgtactttttaccgctggcgagaggtggaggtgctttcttacaccaagtcgctctagtttatactgggctctgcacaatttctgttgtcgcaaaaaatctacaacccccaagaaaatcacccccaacgtgacattctgtgatgaaaacgccaaggagcctgagaacgccctggacaagctgttctcttctgagcagcaggccagcattctgcacgtcttaaacaccgcatccaccaaggagctggaagccttcaggctactccgcggacgaagaagcattaacattgtggagcacagagagaacttcgggccttttcagaatctggaatccctcatgaatgttccactcttcaaatataaatcaacagtgcaggtgtgcaactcgatcttatgccctaagacggggagggagaaacgaaagtctccagagaacagatttctacgtaagctgcttaagccagacatcgaaagagagaggttgaaggtatattcttcatgcttgttgtactgcttgatattcgaaaacctactgtag

SEQ ID NO: 54880 - DNA, 1191 bp, Artificial Sequence
  Description of Artificial Sequence: Synthetic coding sequence
atgtggataccagtggtaggactgccaagaaggcttcgccttagtgccctcgccggagctgggcgtttctgtatactcggcagcgaggcagcgacacggaaacatcttcctgcaagaaaccattgcggcctcagcgactcatcgccccaattgtggcctgagccagatttccgtaatccacctagaaaagcctccaaggcttcattggacttcaagcgctacgttaccgataggcgcttggcggagacactggcccagatctacctgggcaagccttctcgacctccgcaccttctgctggaatgcaatcccggaccagggatcctgactcaggccctgttagaagctggtgccaaggttgtggcattggaatctgacaaaacatttataccccacctggagtcactcgggaaaaatctcgacgggaaactgcgggtgatccactgcgattttttcaaactcgatcctcgcagcggaggagttatcaaaccacccgcaatgtcctctaggggcctgttcaagaatctgggcatcgaggcggtcccttggactgccgatattcccttgaaggtggtgggaatgttccccagcaggggagagaagcgggctttgtggaaattggcttacgatttatatagctgcacgtccatatataaatttgggcgaatcgaggtcaatatgttcatcggcgaaaaggagttccagaagctcatggcggatcccggaaacccagatctttatcacgtgctgagcgtcatctggcaactggcatgcgaaattaaggtcctgcacatggagccctggtcctcctttgacatctacactcgtaagggcccattggagaaccctaagcggagagagctgctggatcagttacaacagaaactgtatctaatccagatgattccacgacagaatctcttcacaaagaacctgacccccatgaattacaacatcttctttcacttactgaagcactgtttcggcaggagatccgccacagtcattgaccatctgaggtcgctgaccccccttgacgcgcgtgatatcttaatgcaaatcgggaagcaggaggatgaaaaggtggtgaacatgcacccccaagattttaaaaccctgtttgagactatcgagaggagcaaagactgcgcatataaatggctctacgatgagaccctggaagatcggtag

SEQ ID NO: 54881 - DNA, 414 bp, Artificial Sequence
  Description of Artificial Sequence: Synthetic coding sequence
atgtggattcccgtcgtcgggctgcccagacggctcaggttatccgctcttgctggggcaggtcggttctgcattctcggtagtgaagcagcaacacgcaagcacctacccgcacggaatcactgtgggctgagtgactccagtccacagttgtggccagagcccgattttcggaacccacctagaaaggcatcgaaggcctccctcgacttcaaaagatacgtcactgacaggaggcttgctgaaacattggcgcagatctacttaggaaagcctagtcggcctccccacctgctcctcgagtgcaatccgggtccaggcattctaacccaggcactcctggaggccggtgcaaaggtggtggccctagagtcagacaaaaccttcattcctcatttggaaacatcactgtag

SEQ ID NO: 54882 - DNA, 1896 bp, Artificial Sequence
  Description of Artificial Sequence: Synthetic coding sequence
atggccgctcacctggtcaagcgctgcacatgcttgttgcgggaggccgcacgtcaagctcctgccatggccccagtggggcgtctgcgcttagcgtgggtagctcataagactttgacatcttccgctaccagccccatctcacacctccccggaagcttgatggagcctgtggagaaagagagagccagcactccctatatcgagaaacaggttgatcacctgatcaaaaaggcaacccgcccagaggagctgctggagctcctggggggatctcatgatcttgactctaaccaggccgcaatggtactgattcggctgtcccaccttctcagcgaaaaacccgaagataaggggcttttgatccaggacgctcattttcaccagttgctttgtctgttgaattcacaaattgcatccgtgtggcatgggacactttcgaaacttctcgggagcctttatgcactaggcattccaaaggcctcgaaggagttgcaaagcgtcgaacaggaagtgcggtggcggatgcgcaaactgaagtataaacatctagccttcctagctgaatcttgcgcaactctgtcccaggagcagcattctcaggagctcctcgcagaattactgactcacctggaacgcagatggaccgagatcgaagacagccatactctcgtaacagtgatgatgaaggtcgggcacctgtcagagccccttatgaacaggttggaggataaatgcctcgagcttgtggaacacttcggaccaaacgagctcaggaaagtgcttgttatgctggcagcccagagccggaggtctgtgcctctgttgagagcaatcagctatcatctggtccagaagcccttttctctcacaaaggacgtactcctcgatgtggcctacgcttatggaaagctgtcattccatcaaacgcaggtgagtcagcgtctggctactgaccttctttcactgatgccgtctttaacctcaggagaagtagcccattgcgccaagtcattcgcactgctgaagtggctttccctgccgttattcgaggcgtttgcccagcacgtcctgaatcgtgcacaggacatcaccctgcctcacctgtgttccgtcctgcttgcttttgcgcgattaaattttcacccagatcaagaagaccaatttttttctctagtccacgagaaactcggtagcgaacttccgggactggaacccgctctgcaggtagatctggtgtgggccctttgtgtcctgcagcaagcccgagaggcagagctccaggctgttttacaccctgagtttcatatccagtttttgggtggaaagagccaaaaggatcagaatacattccagaagctactccatataaacgcaacagccctgctggaataccccgaatacagtgggccactcctgccggctagcgctgtggcacctggcccttccgcccttgatcgcaaggtgactccactgcagaaggagctgcaggagacccttaagggcctgctgggctccgccgataaaggatctttggaggtggcaacccagtacggctgggtgctagatgcagaggtgcttctggacagcgatggagaatttctgcccgtccgggactttgtcgcccctcatttagctcaacctacaggatcccaatctcccccaccagggagcaagcgtctggcttttctaagatgggagtttcctaacttcaatagtcggagtaaagatctcttgggccgttttgtactggctcggaggcacatcgtggcagccggattcttgattgtggatgtgccattctatgaatggctggagcttaaaagtgagtggcaaaaaggagcctacctcaaggacaagatgaggaaggccgttgccgaggaactggctaagtag

SEQ ID NO: 54883 - DNA, 1566 bp, Artificial Sequence
  Description of Artificial Sequence: Synthetic coding sequence
atggctgcacatctggtcaaacggtgcacatgtcttctgcgtgaggccgctagacaggcccctgctatggcaccggtggggagactgaggctggcatgggtggcccacaaaactctgacgagctcggccaccagccctatttcccatttgccaggcagcctcatggaaccagtagagaaagagcgggcttctaccccatacatagaaaaacaggtcgatcacctcattaaaaaagccacccgcccagaggaactgttggaactgctgggagggtctcatgacctcgactccaaccaagcggctatggtcctgattaggctgtctcacttactgagcgaaaagcctgaggataagggactgttgattcaagatgctcattttcatcagctcctgtgtctgcttaacagtcaaattgcgtccgtgtggcacggaactctgagcaagctactgggcagtttgtatgccttggggatccctaaggctagcaaggaactccaaagcgttgaacaagaagtacgctggcgcatgaggaagctgaagtacaagcacctggctttcctggccgaaagctgcgcgacattgtcccaagagcagcacagtcaggaactgctagcagaattactgacccatctcgaaagacggtggacggagatcgaggactcgcatacccttgtgactgtgatgatgaaggtggggcacctcagtgaaccactcatgaatcgactggaggataaacacgtcctgaatcgagcccaggatataacactgcctcacctgtgctccgtcttactggccttcgctcgacttaatttccatccagaccaggaggatcaatttttctccctcgtgcatgagaagttgggctcagaactccccggactggagcctgcgctccaagtcgatttagtgtgggcactgtgtgtcctgcagcaagctagggaagctgagctccaggctgtgctacatcctgaatttcacatccaatttctggggggaaagtcccagaaagaccaaaacacatttcagaaactgctgcatattaatgctacggccctcctcgagtatccagaatatagtggccctttgttaccagcctctgcagtggcccctggcccaagcgccctcgatagaaaggtgacacctctccagaaggagctccaggagaccctgaagggacttttaggatccgctgataaggggtccctggaggtggcgactcagtatggctgggtgctcgacgccgaagttctgctggatagcgacggggaatttttgcccgttcgagatttcgtggctccacatctcgctcagcccactggatctcagtcacccccacccggatccaagcggcttgctttcctgcgttgggagtttcctaacttcaactctagatccaaggatctccttggaagattcgtcttggctcggcgacatatcgtcgctgcaggattcctcattgtggatgtgcctttttacgaatggctggagctaaagagcgaatggcagaagggggcttacctaaaagataagatgcgaaaggcagtcgccgaagagttggcgaaatag

SEQ ID NO: 54884 - DNA, 1566 bp, Artificial Sequence
  Description of Artificial Sequence: Synthetic coding sequence
atggctgctcatctggtgaagcgctgcacatgtctcttgcgggaagcagcccgtcaggctccagctatggcacctgtcgggcgtttgcgactggcttgggtggcccataaaaccctgacctccagcgcaacatcaccgatctcccacctgccaggctccctgatggaacccgtggagaaggagcgggcttcaacgccatatatcgaaaaacaagttgaccaccttatcaagaaagcgactagaccggaagaactgctggagcttctcggcggtagtcatgatttagactctaaccaagctgccatggtcctgatccgcctgtcacatcttctcagcgagaaacctgaggataaaggattgctaatccaggatgcacactttcatcagctcctgtgtctcctgaactctcaaattgcgagcgtgtggcacggcacactgtcaaagttgctgggctccctgtatgcactcgggatcccgaaagcttccaaagaattgcagtccgtagagcaggaggtccgctggcgaatgaggaaactgaaatataagcacctggcttttttagcagagtcctgcgctaccctgagtcaggaacagcacagccaagagttactcgcagaactacttactcatctggaacgcaggtggaccgagattgaggatagccatactctggtgaccgtgatgatgaaagtgggacatctgtccgagccactaatgaaccggctggaggataagcacgtgttaaacagagcccaggacataaccctgccccatctgtgtagtgtgctgcttgctttcgctagacttaacttccaccctgatcaggaagaccagtttttctctctcgtacacgagaagctcggatcagagctgcctggcctggaaccagctctacaggtcgatttagtatgggccctgtgtgtactgcagcaggcgagagaagcagaactgcaggcagttctgcatcccgaatttcacatccagttcctgggcggaaagtcacagaaggaccagaacacttttcaaaagcttctgcatattaacgctacggccctgctggagtatcccgagtactctggaccccttttgccagcatccgccgtagcccctggtccctccgccctcgatcggaaagtgacgccacttcagaaggaactccaggaaaccctgaagggacttttgggaagtgcagacaagggctcgctggaagtagcaacacaatacggatgggtgctggacgcagaagtgctgcttgacagtgacggggagttcctccctgtgcgggacttcgtcgcgccacatctcgcgcagcctaccggatcacagtcccctccccctggaagcaaacggctcgctttcctccgttgggagtttcctaacttcaacagcaggtccaaggacctgctgggccgattcgtgttggcaaggcggcatatcgtggctgccggtttcctgatcgtggacgtgccattctacgagtggctcgagttaaaaagtgaatggcagaaaggcgcatacctgaaggacaagatgcggaaggcagtcgccgaagaactggcaaagtag

SEQ ID NO: 54885 - DNA, 387 bp, Artificial Sequence
  Description of Artificial Sequence: Synthetic coding sequence
atggccgcacatctggtgaaaagatgtacttgcctcctccgcgaggcagccaggcaggccccagcaatggcaccagtcggtagattgcgcctcgcctgggtagcccacaagacacttacatcctccgcaacaagccctatcagccacttacccggatccttgatggagcccgtggagaaggagagagccagcacaccttatattgagaaacaggtcgatcacctgatcaagaaggccacccgcccagaggagcttctcgagcttctcggaggctcacacgaccttgactccaatcaggcggctatggtcctgattagactatcgcacctgttgagcgaaaagcctgaggataaagggctgctgatacaagacgcccactttcactag

SEQ ID NO: 54886 - DNA, 357 bp, Artificial Sequence
  Description of Artificial Sequence: Synthetic coding sequence
atggctgcccacttagttaaacgctgcacatgcctgttgcgggaggccgcacgacaggcccctgcaatggccccagttggacggctgaggctcgcttgggtggctcataagacgttaaccagcagcgcaacgagtccgatttctcatctgcctgggagcttaatggagcctgttgaaaaggaacgggctagtaccccctatatcgagaagcaggtggatcaccttatcaagaaggccactaggcctgaagaactgttggagttactgggcggatcccatgatctcgacagcaaccaagccgcaatggtactgattcgcttgagccatttgcttagcgagaaacctgaagataagtag

SEQ ID NO: 54887 - DNA, 1896 bp, Artificial Sequence
  Description of Artificial Sequence: Synthetic coding sequence
atggcagcccacttggtaaagcggtgtacctgtctgttgagggaggctgccaggcaggccccagccatggccccagtggggcgactccgtcttgcatgggtggcgcacaagactttgacgtcttccgccaccagccccatatcccatctgcctgggtctctaatggaacccgttgagaaggaacgcgcatcaacgccttacatcgagaaacaggtggaccacttgattaagaaggccactcggcctgaggagcttctggagctactcggtggctctcacgatctcgacagtaaccaggctgctatggtgctgattcgtctgtcacatctgctctctgagaagccagaggacaaaggcttgttaattcaggacgcacatttccatcagcttctgtgtctgttaaactcccaaatagcctctgtatggcatggcaccctgagcaagttgctcggctcactatacgcccttggcatccctaaggcctccaaggaacttcagtcagtagagcaggaggtgcgctggaggatgcggaaactgaagtacaagcatttggcttttttagccgagtcttgcgccacactttcccaggaacagcactctcaggagcttctggccgagctgctgacccatctggagcgacgttggacagagattgaagactctcacacactggttaccgtgatgatgaaagtaggccatctgtctgaacctcttatgaatcgattagaggataaatgcctcgagctcgtggagcatttcggaccaaacgagctgcgcaaagtcctcgtaatgctcgctgcgcagagcagaagaagcgtgcccctgctgagggccatctcgtatcacttggttcagaaacccttctctctgacaaaagatgtgcttttggatgttgcgtacgcctatggaaaactttcttttcaccagacccaggtgagccagagactggcgacggatctcctgagcctcatgccctcactgacgtctggcgaggtcgcacactgcgctaagtccttcgccctgctaaagtggctcagcctgccattattcgaggcctttgcccagcacgtcctcaaccgtgcccaggatattacactgccacatttgtgtagtgtgctcctggcctttgcacgtctgaacttccaccccgatcaggaagaccagtttttctctctggtgcacgaaaagctgggaagcgagttgcctggactcgaacccgctcttcaggtcgaccttgtttgggcactgtgtgtgttacagcaggcacgggaggctgaactacaggcagtgttgcaccctgagtttcatattcagtttctggggggaaaatcccagaaggaccagaacacatttcagaagctcctacacataaacgcgacggcacttttagagtaccctgaatacagtggacctctcctcccggctagcgccgtggccccaggaccatctgcacttgaccggaaagttaccccattgcagaaggagctgcaggaaaccctcaagggtctgctaggtagcgcggataagggcagtctcgaagtggctacccagtacggctgggtgctggacgcagaggtactattggacagcgacggcgagttcctcccggtcagggatttcgtggctccacatctggctcagcctacaggcagtcaatcccctcctcctggttcaaagcggctcgcatttctcagatgggaattccctaattttaactctcgctctaaagacttacttggtcgctttgtgctagccaggaggcacatcgtcgctgctggattcctgattgttgacgtccccttttacgaatggctggaacttaagtcggagtggcagaagggcgcatatcttaaggacaagatgcggaaggcagtagccgaggagttagccaaatag

SEQ ID NO: 54888 - DNA, 312 bp, Artificial Sequence
  Description of Artificial Sequence: Synthetic coding sequence
atggccgcacacctcgtgaaacgctgtacttgcctcttgagggaggcggctagacaggctccagccatggcgccagtgggcaggctgcgactggcctgggtcgcacacaagaccttgactagttccgcgacttccccaatttcccaccttcccggttccctgatggagccggtggagaaagagcgagcctccactccctacatagagaagcaggtcgaccaccttataaagaaggctacccggcctgaggagctcctcgaactcctggggggttcccatgacctggattcgaatcaggcggctatggtgtag

SEQ ID NO: 54889 - DNA, 2547 bp, Artificial Sequence
  Description of Artificial Sequence: Synthetic coding sequence
atggagggatcaccatctctgcgtagaatgaccgtcatgcgcgaaaagggcaggagacaggccgtacggggacccgcatttatgttcaacgaccgaggaacttcactgaccgctgaagaggaaaggtttttagacgccgcagagtacgggaacatccccgttgtgcggaaaatgttggaagagtcaaaaaccctgaacgtaaattgtgtcgactatatgggacaaaatgctctgcagcttgccgtaggcaacgagcatctcgaggttactgagcttctgcttaagaaggaaaacctcgcgagaatcggcgacgcactgcttctcgccatcagcaaggggtacgtccgcatcgtagaggccatccttaatcaccctgggtttgccgcttccaaacggctgactctctctccgtgtgagcaggaactacaggacgacgacttctacgcctacgacgaggacggcacgcgattttccccggacattacacccatcattttagctgctcattgccagaaatatgaagtggtgcacatgctgttgatgaaaggcgctaggatcgagcgaccacatgattatttctgcaaatgtggcgactgcatggaaaaacagagacacgattcattctcccatagccgctcccgaatcaacgcgtataaagggctggccagcccagcatacctgtcactgtcgtcagaggatcctgtcctgactgctttggaactaagcaacgaattggccaaactggcaaatatcgaaaaagagttcaagaatgattataggaagctaagtatgcagtgcaaggatttcgtcgtgggggtgctcgatctctgtagagactccgaagaggttgaggccattttgaacggagatctggagtccgctgagcctttggaggtccaccgacataaggcaagcttgagtagagttaagctggcaatcaagtacgaggtgaaaaagttcgtggcgcacccaaactgtcaacagcagcttttaacaatatggtacgaaaacctgagcggcttgagagagcagacaatcgctataaaatgtctggtggttcttgtggtggcacttgggcttccatttctcgcgatcgggtattggatcgccccttgtagcagactgggaaagattctgcgtagtcccttcatgaaattcgtggcacatgccgcatcctttatcattttcctgggactgttggtgtttaatgcgagcgatcgctttgaggggatcactacgctcccgaacatcactgtcaccgactaccccaaacagatcttcagggtgaaaaccacgcagtttacttggaccgagatgctcataatggtgtgggtgctgggcatgatgtggtccgagtgcaaagagctatggctggaaggtcccagggaatacattctccagctctggaacgtactagacttcggtatgctgagcatttttattgctgccttcaccgcgcgatttctggcattcctccaggcgactaaggcacagcagtatgtggacagctacgtgcaggagtccgatctttctgaagtgactttgccacccgagattcaatactttacatacgctagggataagtggcttcctagtgacccacagattattagtgaagggctctacgcgatcgcagtcgtgctgagcttctccagaatagcttatatcctgcctgccaatgagtcgtttggtccacttcagatctccctggggaggacagttaaggacattttcaaatttatggtcctgttcatcatggtttttttcgcttttatgattggcatgttcattctttattcatactatctaggagctaaagtgaatgctgccttcaccactgttgaggagagcttcaaaacactgttctggtcaatctttggcctgtcagaagttacgagcgtggtgctgaagtacgaccataaatttattgagaatatcggctacgtgttgtacggtatctataatgtgaccatggtggtggtgctgctgaacatgctgatagcgatgattaatagcagctatcaggaaatagaagacgatagcgatgtggagtggaaattcgctcggagcaaattatggctgtcatatttcgacgatggaaagacgctgcctccgccattctcactggtgcctagccccaaatccttcgtatattttataatgaggatagtgaactttcctaagtgtcgaaggcggaggctgcagaaggacatcgagatgggtatgggcaattccaagtctcgactgaatctgtttacccaaagtaactcacgagtgtttgaatcacacagctttaatagcattttgaaccagcctacccgctaccagcagatcatgaaacggctgataaagcgctatgttctgaaagctcaggtagataaggagaatgatgaggttaatgagggagagctcaaagagattaaacaagacatctcctctctgcgctacgagcttctcgaggataagtctcaggcgaccgaggagctggccatattgattcacaaactgagcgaaaaactgaatcccagcatgctcaggtgcgagtag

SEQ ID NO: 54890 - DNA, 2766 bp, Artificial Sequence
  Description of Artificial Sequence: Synthetic coding sequence
atgtccaccaaggttagaaagtgtaaggaacaagcaagggtgacatttccagctccagaggaagaagaagatgagggggaggacgagggggcagaaccacaacgacgacgtcgaggttggagaggggtaaatggtggcttggagcccagatcagccccttcgcagagagaaccccacggatactgcccacccccattttcgcacgggcctgacctgtccatggaaggctccccatccctccgcaggatgacggtgatgagggaaaagggcagaagacaggccgttcgcggaccagcatttatgttcaatgacagaggaacttccctcaccgcagaggaggaaagatttctggacgccgcagagtatgggaacattccggtagtgagaaaaatgctcgaagagtcgaagacgttaaatgtaaactgcgtggactacatgggacagaacgctctgcagctggctgttggaaacgaacaccttgaggtgacagagttactgctaaaaaaagaaaacctagccagaatcggggacgcgttgctgctggcaatctccaagggatatgtgagaattgttgaggcaatcctgaaccaccctggttttgcggcttcaaaacggttgaccctgtctccatgtgagcaggagctgcaggacgacgacttttacgcttacgacgaagacggcactagatttagtccagatataactcctataattctagccgcacactgtcaaaagtacgaggtcgttcacatgctcttgatgaaaggggcacggatcgaacggcctcacgattatttttgtaagtgtggcgactgcatggaaaagcagcgtcatgactccttctcccactctcgaagccggattaatgcctacaaaggcctggcatctcctgcttacctcagcttaagcagtgaggatcccgtcctgaccgccctggagttgtccaacgaacttgcaaagttggctaatattgaaaaagaatttaaaaatgactacaggaaactaagtatgcagtgcaaggattttgtggttggagtcctagatctatgtagagactccgaggaggtggaagcaatccttaacggggatttggagtcagccgagccactggaggttcaccgacacaaggcatcgttatcacgtgttaagctcgctattaaatacgaagtaaaaaagttcgtcgcacatcccaattgccagcagcagctgctgaccatctggtatgaaaatctgtcaggactccgggaacagaccatcgccattaaatgcctggtcgtgctggtagtggcactggggcttccttttttggcgattggatactggatcgcaccttgctcacgcctgggaaagatactcagatcaccatttatgaaattcgtcgcccacgcagcttcctttataatatttttagggctgctcgttttcaacgcatcagatcgcttcgagggaattacgaccttgccaaacatcacagtcactgattaccccaaacagatcttccgggtgaagacgacgcagtttacctggaccgaaatgctgattatggtttgggtcctgggtatgatgtggagcgagtgcaaagagttgtggctcgagggtcccagagagtatattctgcaactgtggaatgtgttggacttcggaatgttgtccatttttatcgccgcattcaccgctcgatttctggccttcctgcaggcaactaaggcgcagcagtacgtggattcctacgtgcaggaatctgatctctctgaggttactcttccgccagaaattcagtatttcacatatgccagagataagtggctcccttctgacccgcagataatcagcgaggggctgtatgctattgccgtggtgctctcattctctcggatcgcttatatactgccagccaacgagagcttcggcccactgcaaatttcactgggaagaactgtcaaggatattttcaagttcatggtcctcttcatcatggttttttttgcattcatgatcggcatgttcattctctacagctactacttgggagctaaagtaaatgccgcatttactacggtggaagagtcttttaaaaccctcttttggagtattttcggcttgtccgaggtgacgtcagtggtgctgaagtacgaccacaagtttattgaaaacatcggttacgtcctgtacggaatttacaatgtcacaatggtcgttgttttacttaacatgctcattgctatgattaatagctcgtaccaggaaatagaggacgactccgatgtcgagtggaagttcgccaggagcaagctgtggttgtcgtatttcgatgacggaaagacactgccgccaccttttagccttgtgccctcaccgaaaagcttcgtatattttattatgcggatagtcaattttcccaagtgtcggagacgtcggctccagaaagatatcgaaatgggcatgggtaactccaaatcacgactgaacctcttcacacagtcaaatagtcgcgtttttgagtctcattcttttaacagcattctgaaccagccaacccgataccaacagatcatgaagcgtctcattaagcggtatgtgctgaaagcacaggtagataaggagaatgacgaggtgaacgagggtgagctgaaagaaattaagcaagacatttcctcactgcggtacgagctactcgaggataagagccaggctaccgaagagttagctatcctcattcataaattaagtgagaagttgaacccaagcatgctcaggtgtgaatag

SEQ ID NO: 54891 - DNA, 282 bp, Artificial Sequence
  Description of Artificial Sequence: Synthetic coding sequence
atggaggggtcaccgtccctcaggagaatgaccgtgatgagggagaagggcaggcgtcaggcagtgcgtggccctgccttcatgttcaacgaccgcggtactagtttgacagcggaagaagaacggttcctggacgcagcagaatatgggaatatccctgtggtaaggaagatgctggaagagtcgaaaaccctgaatgtcaactgtgtcgattatatgggccagaacgccttgcagctggctgtgggtaacgagcacttagaggtgacagagttgctgtag

SEQ ID NO: 54892 - DNA, 2382 bp, Artificial Sequence
  Description of Artificial Sequence: Synthetic coding sequence
atggaaggatctccttcgctcaggcgaatgactgtaatgagagagaagggcaggcggcaggcggtgaggggcccagccttcatgttcaatgataggggcactagtctgaccgccgaagaggagcggttcttagatgccgctgagtatggaaacattcctgttgtccggaaaatgctcgaggagagtaagacattgaatgtgaactgcgtagactacatgggtcaaaatgccctccaacttgcagtcgggaatgaacacctggaagttactgaattgctcctaaaaaaagaaaacttggccaggataggagatgcactcctgttggccatttctaagggctatgtacgtatcgtcgaggccatccttaatcacccgggatttgcagcatctaaacgactaactctcagcccgtgcgagcaggagctccaggatgatgatttctacgcttacgatgaagacggcacgaggttttcccccgatattacccccatcattctagccgctcactgtcagaaatacgaagtggtccacatgctgttgatgaagggtgcccgaattgagcggccacacgattacttttgcaagtgcggcgattgcatggagaaacagagacacgacagtttctcacatagtcgctccaggatcaacgcctataagggactcgcatccccggcttacctgtctctctcctcagaagaccctgtgctaaccgccctggaattatctaatgagctagcaaaactcgctaacattgagaaagagttcaaaaatgactatcgcaaattaagcatgcagtgcaaagatttcgttgtgggagttctcgacctttgtcgcgatagcgaagaggtcgaagcaattctgaacggggatttggaatcagccgagcctcttgaagtgcacaggcataaagccagcctttctcgagtaaagttagccataaaatacgaggtaaagaaactcggaaaaattctgcgcagcccattcatgaaattcgtggcacatgctgcctctttcattatcttcctgggtttattggtgttcaatgcctccgaccgatttgaaggcattaccacccttcccaatatcacagttactgactacccgaaacagatcttccgcgtgaagactactcaatttacgtggacggagatgctgataatggtgtgggtgctcgggatgatgtggtcagaatgcaaggagctatggctcgagggcccaagggagtacattttgcagctgtggaatgtgttggattttgggatgctgtctatctttatcgctgcattcacagccaggttcctggcatttcttcaagcaactaaggcacagcagtatgtggactcatatgtgcaagagtctgatttgtcagaggtgacccttcccccagagatccagtacttcacatacgctagagataaatggctgccatcagatccccaaattatctctgaaggtctctacgccatagctgttgttttgtccttttccaggatcgcttatatactcccagccaatgaatcattcgggccactgcagattagcctgggcaggactgtgaaggacatctttaaattcatggtccttttcattatggtgtttttcgccttcatgatagggatgttcatattgtactcttactatctcggtgcaaaggtgaacgcagcctttaccactgtcgaagagtcatttaaaacactgttctggtcgatttttggactcagcgaggtgacgtctgtggtgctgaaatatgaccacaagtttatcgagaatataggctacgtcctttacgggatatataacgtgacaatggtcgtggtgctgttaaacatgctgatcgccatgatcaattcgtcttatcaagaaattgaagatgactctgacgttgagtggaagttcgccaggtctaaactgtggctctcctattttgatgatgggaagactcttccaccacccttctcactcgtaccaagccccaagtccttcgtttatttcatcatgcggatcgtgaacttcccaaaatgcaggaggcgcaggcttcagaaagacatcgaaatgggaatggggaactcaaaatcaagactcaacctgttcactcagagcaacagccgtgtttttgagtctcactcatttaactcaatcctcaatcagccgacccgatatcagcaaatcatgaaacgcctcattaagcggtacgttctcaaggctcaggtggacaaagaaaacgacgaggtgaatgagggggaactgaaggagataaagcaggatatttcatcattgaggtacgagctgctggaggacaaaagccaggccacagaagagctggccatcctcatacataagctgtccgaaaagctgaacccatccatgctgagatgtgagtag

SEQ ID NO: 54893 - DNA, 747 bp, Artificial Sequence
  Description of Artificial Sequence: Synthetic coding sequence
atgatctgcacgttcctccgggctgtccaatatacagagaaactgcatcgctcttctgctaagcggcttttgctgccatacatcgttctgaacaaggcctgcctcaagaccgagccttccctccgctgtggtctgcagtatcagaagaaaactttacgaccacgctgtatcctaggagtaacgcaaaaaaccatctggacccaaggaccttccccccgaaaagctaaggaggacggatccaaacaggtgtccgtccaccgaagtcaacggggagggacagctgtccccacgtcacagaaagttaaagaggctggcagggacttcacttaccttatagttgtgctttttggcataagtatcaccggaggcttgttctatacaatctttaaagaacttttttctagctctagcccctcgaagatctacggcagagccctggagaagtgtcgatctcatcctgaggttattggggtgtttggagaatctgtcaagggatacggagaagtgacgcggagaggtcgaaggcagcacgtgcgtttcactgagtacgtcaaggacggcttaaagcacacctgtgttaagttttacatcgagggaagcgagcccggtaagcaaggcacagtgtatgctcaggtcaaggagaatcccggatccggcgaatacgatttcaggtacatcttcgtggagatcgagagttacccacgtagaaccataattatcgaggacaaccgcagccaagacgactag

SEQ ID NO: 54894 - DNA, 405 bp, Artificial Sequence
  Description of Artificial Sequence: Synthetic coding sequence
atggagggaggtggtggaagcgggaataagacaacaggagggctggccggattctttggtgctggcggagctgggtattcacacgccgacttggctggtgtgcctctcactggtatgaatcccctttccccatacctgaacgttgaccccaggtatctggttcaggacactgatgagttcatccttcccacaggcgctaataagacaagaggtcgctttgagttggctttctttacaattggtggctgttgtatgaccggcgctctctgggcgaatacactgggatctctggctctgctgtactcagctttcggtgtcattatagagaaaacccgcggtgccgaagacgacctcaacacggtcgctgccggtactatgaccggtatgctgtataagtgcacgtag

SEQ ID NO: 54895 - DNA, 516 bp, Artificial Sequence
  Description of Artificial Sequence: Synthetic coding sequence
atggaaggaggcggaggatccggtaacaagacaacaggcggtctggccggtttttttggcgcaggcggagccggatatagtcatgctgacctggccggagtccccttgaccgggatgaatccactgtcaccgtacctgaatgtcgacccacgctacttggtgcaggacaccgacgagtttatcctgcctaccggcgctaataagacaagggggaggtttgaactggccttcttcactatcggcggatgttgtatgaccggcgcagctttcggagcgatgaatgggctaagacttggactcaaagaaacacaaaacatggcctggagcaagccaaggaatgttcagatactcaatatggttactagacagggggcactgtgggccaacaccctgggctccctcgcactgctgtattctgcgttcggtgtcattattgagaaaacacgcggagctgaagacgacctcaacaccgtagcagcgggaaccatgacgggcatgctgtacaagtgcacctag

SEQ ID NO: 54896 - DNA, 450 bp, Artificial Sequence
  Description of Artificial Sequence: Synthetic coding sequence
atgactggggcagcgttcggcgcaatgaatgggctgaggctggggctgaaggaaactcagaacatggcctggtcaaaaccaagaaatgtgcaaatcctgaacatggtgacccgacaaggggctctctgggctaataccctcggttctctggcactgctttattccgcctttggagtgatcattgagaagacacggggagcagaagatgacctcaacaccgttgcagccggtaccatgacagggatgctctataagtgcacggctagcgctagtcagggagctggaatcgcagatggcgtgtccttcacccaatgtagtatgctcccacgtctagagtgctcgggcgtgatctccgctagttacaatctgcacctgcccgcagcttgtctgggccttcccaagtgtagagattgcagtctttgcccggctgctacaccttctgggaaatag

SEQ ID NO: 54897 - DNA, 372 bp, Artificial Sequence
  Description of Artificial Sequence: Synthetic coding sequence
atggaagggggtggcggatccggcaataaaacgactggtggtctggcgggattctttggcgctggtggcgcagggtacagccatgccgacctggcaggagtgccactcacaggcatgaaccccctctctccttatctgaacgtggatccccgatacttggtgcaggacacggacgaatttattctgccaactggcgctaacaaaactcgcggacgcttcgagttagctttttttaccattggtggttgctgcatgaccgcactgttgtatagcgccttcggtgtgataatcgaaaaaactcgcggtgcagaagacgacctgaataccgtcgctgcagggactatgaccggaatgttatataaatgcacctag

SEQ ID NO: 54898 - DNA, 1371 bp, Artificial Sequence
  Description of Artificial Sequence: Synthetic coding sequence
atggcatcagctctgtcactgggcaacaagtgcgatccctttctgcggtgcgtgttgtgtagggggggaggtgcactccaaggcccacgcggtcgagggccagacgatttcgagagtcagctgtcaccacccggttccgccagaaggctggtccggtccaagagggcctgtggaaacccacctgatgcatttggtcttagccgggcttccgtgcacccccctctgcctcgagtgtcgatcggctgctcgtctgggcctggtagggccaagcgtgaaagggtgggcggtgctgcttggagacaacggaaaatggctgcttccgccgctgtgttctctagactccggtcaggcctgaggctcgggtctcggggtctgtgcactaggctcgccactccacctagacgggcaccggaccaggcagcagagatcggtagccgcggttccaccaaagctcagggcccacagcagcagccaggctccgaaggccctagctacgctaagaaggtcgcactatggctcgcagggctgctcggagcgggtgggaccgtctccgtggtctatatcttcggtaataaccccgtggacgaaaatggtgcaaagataccggatgagttcgataatgatccaattttggttcagcaactgagacgcacatacaagtattttaaggactatcggcagatgataatcgagcccacttccccatgcctgctgcccgatcccctccaggagccctattatcagcctccgtataccttggtgctggaactgaccggggtccttcttcaccctgagtggtcgctagccaccggctggaggtttaagaaacgtcccggtatcgaaacactgttccagcagctagcaccattatacgagatcgtcatcttcacctcagagacaggaatgactgcatttccactgattgactccgtggaccctcacgggtttatatcctatagattattcagagatgctaccaggtatatggatggccaccacgttaaagacatatcttgcctgaaccgtgatccagctcgggtggtagtggtcgactgcaaaaaggaggcctttaggcttcagccgtataacggcgtcgcactgcggccatgggacgggaactcagatgatagagtcctacttgacttatcagccttcctgaagacgattgcccttaacggcgtggaggatgttaggaccgtactggaacactatgccctcgaggacgaccctctcgccgcattcaaacagaggcagtctcgactagaacaagaagaacaacaacggctggctgaactttcgaagtcaaacaagcagaacttgtttctgggaagtctcacaagccgcctctggccacgctcgaagcaaccgtag

SEQ ID NO: 54899 - DNA, 723 bp, Artificial Sequence
  Description of Artificial Sequence: Synthetic coding sequence
atggtcccacgattccttatgtccagcactatgatgattattgaaccaacctctccctgcctgctgcccgaccctctccaggagccctactaccaaccgccatacacactcgtattagaacttaccggcgtcctgctgcatcctgagtggagcctcgccacaggctggcgcttcaaaaagcgtcccggaatcgagacattatttcagcagctggctcccctatacgaaattgtcatttttacttccgagaccggaatgaccgcctttccactgattgactcagtagacccacatggctttattagttacaggctctttcgggatgcgacaagatatatggatgggcatcatgtgaaggacattagctgcctaaatagggacccagctagggtagtggtcgtggattgcaaaaaggaggcctttcgcctccagccatacaacggggtggctctaaggccttgggatggcaacagcgacgacagagtgcttttagacctgtccgcatttctgaaaactattgcactgaacggtgtggaggacgttcgcactgtgttggagcattacgccctggaagatgacccccttgccgcttttaagcagagacagagtcggctggagcaggaggaacaacagaggcttgcggaactctccaaatctaacaagcaaaacctgttcttaggctccctgacctctcggttgtggcccagaagcaagcagccctag

SEQ ID NO: 54900 - DNA, 252 bp, Artificial Sequence
  Description of Artificial Sequence: Synthetic coding sequence
atggctgaactgggagaggcggacgaggccgagctgcagcgcctggtggccgcagagcagcagaaagcacaatttactgcccaggttcatcattttatggagctctgttgggataaatgcgtagagaagcccggaaaccggctggactcacgtactgaaaactgcttgtccagctgcgttgatcgcttcatcgacacaactcttgccatcacctccagatttgcccaaatcgttcagaagggagggcagtag

SEQ ID NO: 54901 - DNA, 297 bp, Artificial Sequence
  Description of Artificial Sequence: Synthetic coding sequence
atgagaaaacattcatgcaggaaggttgccagcctcagacggaccatggccgaactgggtgaagctgatgaggcggaactgcagcgcctcgtcgccgctgaacaacagaaagcacagtttaccgctcaggttcatcactttatggaactgtgctgggacaagtgcgtggaaaaacctggcaatcggctcgacagtaggacggagaactgtctgtcgagctgcgtggaccggttcattgataccactctggctataaccagcagatttgcacaaatcgtacagaagggtggccagtag

SEQ ID NO: 54902 - DNA, 858 bp, Artificial Sequence
  Description of Artificial Sequence: Synthetic coding sequence
atggaagtcccgcctcctgcaccccgatccttcctgtgcagggccttgtgcctcttccccagagttttcgctgccgaagcggtgacagccgattccgaggtgctcgaggaaagacagaaacgtctcccctatgtgccggaaccctactacccagagagcggttgggatcggctcagagagctgtttggcaaagacgagcagcagcgcatttctaaagatctagcaaacatatgcaaaacggcggcaactgctggaatcatcggttgggtgtatggaggaattcctgcattcattcatgccaagcagcaatatattgaacaaagtcaggccgagatatatcacaatagattcgacgccgtccagtccgcgcacagggctgccactaggggtttcatccggtacggttggagatggggatggaggaccgccgtgtttgtgacaatttttaacacggtcaatacctccctaaacgtctacaggaacaaggacgctctgtcccatttcgttattgcaggtgccgtgactgggtccctgtttcgaattaacgtgggactccgcggactggtggcaggtggcatcattggagccttgctgggcacaccagttggaggtcttctcatggctttccagaaatacagcggagaaactgtccaggagcgcaagcaaaaggatcgaaaggcactccatgagctgaagctggaagaatggaaaggtcgattgcaggtgacggaacacctgcctgaaaaaatcgagtctagtttacaggaagatgagcctgagaatgacgccaagaaaatcgaggcgctgttgaatctgcctcgaaatccctcagtgatcgataagcaggacaaagactag

SEQ ID NO: 54903 - DNA, 438 bp, Artificial Sequence
  Description of Artificial Sequence: Synthetic coding sequence
atggtaggaaggaattccgcgatagccgctggagtttgtggggctctcttcataggctactgcatatactttgacagaaaacgccgtagcgatccgaatttcaaaaaccgcctgagggagcggaggaaaaaacagaagcttgccaaagaaagagctggactgtctaaactgcccgacctgaaggacgcagaggccgtgcagaaattttttctcgaagagatccaacttggagaggaactgctggcccaaggcgaatacgaaaagggagtggaccatctcactaacgctatcgccgtctgcggccagcctcagcagcttttgcaggtgcttcagcaaactctccctccaccggtgttccagatgttgttaacaaagttgccgacaatcagccagcgcatcgtgtcggcccaatcccttgccgaggatgacgtagagtag

SEQ ID NO: 54904 - DNA, 459 bp, Artificial Sequence
  Description of Artificial Sequence: Synthetic coding sequence
atgcctagcgtacggagcttgctgcgcctgctcgccgctgcagcagcctgtggagcctttgcgttcctggggtactgcatttatttgaatagaaaacgaaggggggacccagcctttaaaagaaggctgcgcgacaagaggcgcgcagagcctcagaaagcagaagagcagggaacccagctctgggatcccactaaaaacaagaagttacaggagctgtttctacaagaagttcgtatgggtgagctttggttgtcgcggggtgagcatcgcatgggcatccaacatctcggcaatgccctgctggtctgcgagcagcctcgcgagctactaaaggtttttaagcataccctacccccaaaggtgttcgaaatgctgctccacaagattcctctcatctgccagcagtttgaggcagatatgaatgaacaggattgtctcgaggatgacccggactag

SEQ ID NO: 54905 - DNA, 930 bp, Artificial Sequence
  Description of Artificial Sequence: Synthetic coding sequence
atggccccaaaattccccgatagcgttgaggaactgagagctgcgggtaatgagagtttccggaacggccagtatgctgaggccagtgctttatacggtagggccctcagagtgctgcaagcgcaaggctcttctgatcctgaagaggaatctgtgctgtactcaaaccgcgcagcttgccatctgaaggacggtaattgccgcgattgcattaaggattgcacttctgctctcgctctggtgcctttctccatcaaaccactgttgaggcgcgcaagtgcgtatgaagctctggaaaagtacccaatggcatatgttgattacaagaccgtactgcagatcgacgacaacgtcaccagcgccgttgaggggattaatagaatgactcgggctttaatggactccctcggtcctgaatggcggctgaaattgccttcaatacccctcgtgcccgtatctgcgcaaaagagatggaattccctgccctccgaaaaccacaaggaaatggccaagtccaagtccaaggagacgacggcgacaaaaaacagggtgccctctgccggagatgtcgaaaaggctcgcgtactcaaggaggaaggcaacgagcttgtaaagaaaggcaatcacaaaaaggcaatcgagaagtattcagagtcccttctctgttcaaacttagaatccgccacttattccaatagagccttgtgttacctcgtgttaaagcagtacactgaggccgtgaaggactgcacggaggcactgaaactagacggaaagaacgtgaaagctttttataggagagcccaggcccataaagctttgaaagactacaaatcatcttttgcggacataagcaatctgttgcagattgaaccacgtaatgggccagctcaaaagctgcggcaggaggtcaagcagaatctgcactag

SEQ ID NO: 54906 - DNA, 927 bp, Artificial Sequence
  Description of Artificial Sequence: Synthetic coding sequence
atgggcaacaccctcgggctggcaccaatggggacactgcccagaaggagcccgaggagggaggagcctctgcctaatccgggatctttcgacgagttgcaccggctgtgcaaggacgtcttcccagcccagatggaaggggtgaagctggtggtcaataaggtgctcagttcccatttccaagttgctcacacaatacacatgagcgcactcggactccctgggtatcacctgcacgccgcttacgctggcgactggcagcttagtccaacagaagtctttccgacagtggtgggggacatggactccagcggctcccttaacgcccaagtattgctgctgctcgccgagcgactcagggcaaaagcagtttttcaaactcaacaagcaaagtttctcacctggcagtttgatggcgagtaccggggtgacgattacacagccactctcaccttgggaaacccagacttaatcggagaaagcgtgattatggtggcccattttctgcagagtctgacgcatcgcttggtactgggcggtgagcttgtctatcacaggagacctggcgaggagggggctattttgacattagcgggaaagtactccgccgttcactgggtcgcaacccttaatgttgggtctggcggagctcatgcttcctactaccaccgggcaaacgagcaagtacaggtgggcgtcgaatttgaggccaacacccgactgcaggatactacattctcctttggctatcacctcaccctaccccaggctaacatggttttcagaggacttgtggattctaactggtgcgtcggtgctgtactcgaaaagaaaatgcctccccttccagtgactttagcactcggcgcattccttaaccactggcgaaatagattccactgcggatttagcattactgtaggttag

SEQ ID NO: 54907 - DNA, 927 bp, Artificial Sequence
  Description of Artificial Sequence: Synthetic coding sequence
atggggaatacactgggcctggcccctatggggaccttgcccagacgctcccccagaagggaggaaccactccctaacccgggatcatttgatgagctgcacaggctgtgtaaggatgtttttcccgcacaaatggagggcgtgaaattggtggtgaacaaagtgttaagcagccactttcaagtcgcacacacaatccacatgtcagcactgggtttgcccggttaccatttacacgccgcatatgcaggcgattggcaactctctccaactgaggtctttcccaccgtggttggagatatggattccagcggcagcttgaatgctcaggtgctgttactgttggcagagcgtttgcgggctaaagccgtgttccagacccaacaagccaaattcttgacttggcagttcgacggggaatatcggggtgacgactacacagccactcttacactcggaaatcctgacctaatcggagaatccgtgataatggtcgcccactttctgcaatcactgacccaccgactggtgctcggcggagaactggtgtaccaccgacgacccggtgaggaaggcgctattttgacgttggccggaaaatactcagctgtccactgggtcgctactttgaatgttggctcaggcggtgctcatgcatcatactatcacagggccaatgagcaagtgcaggtcggcgtcgagttcgaggcgaacacgaggcttcaggacactacattctcattcggctaccatctgaccctgccacaggcaaatatggtgttcaggggcttagtggattcaaattggtgcgttggggctgtcttggagaagaaaatgcccccattacctgtgactcttgccctcggcgctttccttaatcactggcgcaaccggtttcactgcggcttttctatcactgttgggtag

SEQ ID NO: 54908 - DNA, 633 bp, Artificial Sequence
  Description of Artificial Sequence: Synthetic coding sequence
atgtcttgcacagtgtacgccaaagttgcgcataccatccacatgtcagcactgggcctgcccggatatcatctgcatgccgcttacgcaggggattggcagctgtccccaaccgaagtgtttcctactgtcgttggtgacatggattcaagcggctccctgaatgcccaggtcttattactactggcagagaggctgcgggctaaggccgtgttccagacccagcaggccaagtttctcacctggcagttcgatggggagtaccgcggtgatgactatacggcaactctgaccctggccggaaaatactctgccgtgcattgggtggctacgctcaacgtagggagtggcggagcacatgcgagctactaccacagagccaacgaacaagtacaagtcggcgtggagtttgaggccaatacccgcctgcaagatactacattttctttcggctatcatctgacactgcctcaggccaacatggtgttccgtggactcgtggactcaaactggtgtgtgggtgcagtgcttgaaaaaaagatgccccctctgcctgtgaccctagctttaggggcatttctgaaccactggcgaaatcgtttccactgtggatttagtattaccgttggctag

SEQ ID NO: 54909 - DNA, 825 bp, Artificial Sequence
  Description of Artificial Sequence: Synthetic coding sequence
atggggaatacattagggcttgcccctatggggacactacctcggagatcaccccgaagagaggaacctttgcctaacccagggagctttgacgagttgcacaggttgtgcaaggatgtctttccagcccaaatggagggcgtcaagctcgtggtcaataaggtgctctcaagtcactttcaagtagctcatacgatacacatgagtgccctcggcctcccgggatatcatttacatgccgcatacgctggcgactggcagctgagcccgactgagacacagcaagctaaattcctgacttggcagtttgacggagagtacagaggggatgactatacagctactctgaccctggggaatcccgatctgattggcgaatccgtgattatggtggctcattttttgcagagtctaacccatcggctggtgctgggaggagagttggtctaccataggcgaccaggagaggagggcgcaatactaaccctggccggtaaatattcggccgtacactgggttgctaccttgaacgttggaagtggtggagctcatgcttcatattaccatagggccaacgagcaagtacaagttggtgtggaattcgaagctaacacccggctccaggataccacattttcattcggataccatctcacactgccccaggccaatatggtgttccgtgggctcgttgactcaaactggtgtgtcggggctgtcctagagaagaaaatgcccccactgccggtcaccctggccctcggcgcattcctcaaccactggcggaacagatttcactgtgggtttagcattacagttggatag

SEQ ID NO: 54910 - DNA, 156 bp, Artificial Sequence
  Description of Artificial Sequence: Synthetic coding sequence
atgtttagaattgaaggattggcccctaaactggatccagaagagatgaagcgtaagatgcgagaagatgtgatttcctcaattaggaacttcctcatctatgtcgcgctacttagggtgacaccttttatcctaaagaagcttgattcaatctag

SEQ ID NO: 54911 - DNA, 258 bp, Artificial Sequence
  Description of Artificial Sequence: Synthetic coding sequence
atgtttcgtattgaggggctggcaccaaagctcgatccagaagaaatgaaaaggaaaatgagagaggatgtgatctcaagtattcgaaactttctgatatatgtagctctgctgcgtgtgagcgaatgtctaccgggttgtgactgcgaaacatcaggtgagctgacagacgggcatccattgacccttaggggccacaggggactcaggacagagttaaatgcgccatttattctaaagaagctcgactctatctag

SEQ ID NO: 54912 - DNA, 279 bp, Artificial Sequence
  Description of Artificial Sequence: Synthetic coding sequence
atgttccgcatcgaaggcctggccccaaaattggaccccgaggaaatgaaaagaaagatgagagaggatgtgatttcatctatacgcaatttcttgatctacgtcgccttgctccgtgtgtccgagtgcctgcccggatgtgactgtgagacaagcggcgagttgacagatggacacccgctcaccttgcgcggtcatcgaggtctccgtacggagctgaatggctcaggtgaacagggaggctgcgccctgaaggctaccggaatctgcgccgtgtag

SEQ ID NO: 54913 - DNA, 225 bp, Artificial Sequence
  Description of Artificial Sequence: Synthetic coding sequence
atggcgagcagcaccgtgcccgtcagcgcggctggctccgcaaatgagacccccgagatccctgataatgtgggagattggctgcggggtgtatacagattcgcgaccgatagaaatgattttcggaggaatctgatcctgaacctcgggttgttcgcggctggtgtgtggctagctcgaaacttatccgacatcgacttgatggcgcctcaacccggtgtgtag

SEQ ID NO: 54914 - DNA, 225 bp, Artificial Sequence
  Description of Artificial Sequence: Synthetic coding sequence
atggctagcagcacggtccccgtttctgccgctgggtcagcaaatgagacacctgaaatcccagataacgtgggggattggctgcgaggggtgtacaggttcgccacagatcggaacgacttcagaaggaatctgatactgaatctgggcctctttgctgcaggagtctggttagcacggaacctgtcagacattgacttaatggccccacagcccggagtctag

SEQ ID NO: 54915 - DNA, 168 bp, Artificial Sequence
  Description of Artificial Sequence: Synthetic coding sequence
atggtcaagctctccaaagaggccaaacagaggctccagcaactatttaaaggctcccagtttgcaatcaggtggggatttataccacttgtgatctacctcggctttaagaggggtgcagatcccggaatgcctgagcccacagtgctcagtcttctgtggggttag

SEQ ID NO: 54916 - DNA, 1827 bp, Artificial Sequence
  Description of Artificial Sequence: Synthetic coding sequence
atggccgctagtaagccagtcgaggccgcagtggtggccgctgcggttcccagttctggatcaggcgtcggtggcggaggtaccgctggacctggtaccggcggacttccaaggtggcagctggctctggccgtgggtgcccctctcctgctcggcgctggtgcgatctacctttggagccgtcaacagagaaggcgagaagcacggggacggggtgatgcctctggactgaagagaaattccgaaagaaagacccccgagggacgcgctagcccggcaccaggcagtggacatcccgaaggtcctggcgcacacctcgacatgaacagtctcgatcgcgctcaggcagctaaaaataaagggaataagtatttcaaggccggaaagtacgaacaggcgatccagtgttacacagaagccatttctctttgccctacagagaagaacgttgatctctccactttttatcagaacagggccgcagccttcgaacagctgcagaaatggaaagaagtggcccaggattgtacaaaagctgtggaattgaatcctaaatatgttaaggccctttttcgtcgcgcaaaggcccatgagaaactcgacaataagaaggaatgcttggaggatgttaccgctgtttgtattcttgaaggattccagaaccaacagtccatgctgctcgccgataaagttctcaaactactcggcaaagaaaaagccaaggagaaatataagaacagagagcccctaatgcccagtccgcagttcatcaagagttactttagctctttcaccgacgacatcatcagtcagcctatgctcaagggggagaaaagcgatgaggacaaggataaggagggagaggccctggaggtgaaggagaactctgggtacctgaaagctaagcagtacatggaggaggaaaactatgacaagatcatcagcgagtgttccaaagaaattgacgcggaaggtaagtatatggcggaagctcttctcctccgagccaccttctatctcttgatagggaatgctaacgccgcaaagccagacctggacaaggtcataagcctgaaagaggctaatgtgaagctcagggcgaatgccctgattaagcgcggtagcatgtacatgcagcagcaacagcctctactctctacacaggatttcaatatggctgcagatatcgatccgcaaaatgccgacgtctaccaccatcgaggccaacttaagattctgcttgaccaagtggaggaggcggtggccgacttcgacgaatgcattagactgcggccagagtcggccctagcacaggctcaaaaatgctttgccttgtaccgccaggcatacacagggaataatagctcccagatccaggctgcaatgaaggggtttgaggaagtcatcaagaagtttcccaggtgcgccgagggatacgctctgtacgctcaggcgctcacagaccagcagcagttcggaaaagccgacgagatgtacgataaatgcatcgacctggagccagacaacgccacaacatacgttcataaagggctgctgcagttgcagtggaagcaggacctggaccggggattggagctgatctctaaagcaattgagattgataataagtgtgactttgcatacgaaacaatgggcaccattgaagttcaaagggggaatatggaaaaagccatcgacatgttcaacaaggccattaaccttgccaagtctgagatggagatggctcatctgtattctctatgtgacgctgcgcacgcccaaactgaagttgccaagaagtatggtttaaagcctccaacattatag

SEQ ID NO: 54917 - DNA, 1506 bp, Artificial Sequence
  Description of Artificial Sequence: Synthetic coding sequence
atgaacagcctagatagggcacaggcagccaagaacaaaggaaacaaatatttcaaggccggtaaatatgagcaggccatacaatgctataccgaagctatttcactctgcccaaccgaaaagaatgtggacctaagcacgttttaccaaaatcgcgcagcagctttcgaacagcttcagaaatggaaggaggttgcccaagactgcactaaagctgtggaactgaatccaaaatatgtaaaagcactgttccgtcgggcaaaggcacatgagaaactcgataataagaaagaatgcttagaagacgtgaccgccgtatgtatcctcgaagggttccagaaccaacagtccatgctgctggctgacaaggtgctcaagttgctgggtaaggagaaggccaaagagaagtacaaaaatagggagcctttaatgccatcaccccaatttattaagtcatatttcagttccttcactgacgacatcattagccagcctatgctgaagggagagaaatcggacgaagacaaggacaaggaaggggaagcactggaagttaaggagaactcaggatatttgaaggcaaaacagtatatggaggaggagaactatgataaaataatctcggaatgctccaaagaaattgacgctgagggcaagtatatggccgaggctctgcttctccgcgcaactttttatcttctgatcggcaatgccaacgccgctaagcctgatcttgataaggtgatctccttgaaagaggccaacgtgaaattacgcgctaacgccctgatcaaaagaggttctatgtacatgcaacaacagcagccccttctatctactcaggacttcaacatggccgctgatatcgacccgcagaatgccgatgtgtatcatcacaggggacagctcaaaatcttactggatcaggtcgaggaagccgttgctgacttcgatgaatgcatccgtctgcgcccagagtccgcgctggcccaggcacagaaatgcttcgccttataccgccaggcctacaccggtaacaactcttcacagatccaggcggctatgaaggggttcgaagaggtgataaaaaagttccctcggtgtgccgagggatacgcactctatgcgcaggccctgacagatcagcagcagttcggaaaagccgatgagatgtacgacaaatgtatcgacctcgagcccgacaacgcaactacatatgtgcacaagggactcctgcagcttcaatggaaacaggacttagataggggcttagaattgatctcaaaagccatcgagattgataacaagtgcgatttcgcttatgaaacaatgggtaccattgaagtgcagcggggaaacatggagaaagccattgacatgttcaataaggccattaatctggccaaaagcgaaatggaaatggcccacctgtactcactgtgcgatgccgctcacgcccaaaccgaagttgccaaaaaatacggcctgaaacccccaactctttag

SEQ ID NO: 54918 - DNA, 1125 bp, Artificial Sequence
  Description of Artificial Sequence: Synthetic coding sequence
atggccattcgtaagaaatccactaagtccccacccgtcttgtctcatgaatttgtgctgcaaaatcacgccgacattgtgagctgcgtcgcaatggtctttctccttgggctgatgttcgagatcacggctaaagccagtattatcttcgttacacttcagtacaatgtgaccttgccagcaactgaggaacaagcaactgaaagcgtgtccctgtattactatggtataaaggacctggccacagtcttcttctatatgcttgtagccataattatccacgccgtgatccaagagtacatgctcgacaagattaacaggaggatgcacttttcaaagaccaaacatagcaagttcaacgagagcgggcagctgagtgcattctacctgtttgcctgtgtgtggggcacttttatcctgattagcgagaattacatcagtgatccaaccatcttgtggcgcgcttatccccataatctaatgacattccagatgaagttcttctacatcagccagctggcgtattggttgcacgcctttccggagctgtattttcagaaaacaaaaaaggaggacatacccaggcagctagtttacattggcctttacctcttccacatcgcgggagcgtaccttctgaatctaaatcacctggggctggtgctactcgtgctccactatttcgtagagtttctgttccacatttctaggctgttctatttttcaaatgagaaataccaaaaaggcttctctctgtgggcagttctcttcgtcctaggcaggttgctaacattaatcctgagcgtcctgacagtgggctttggtctcgcccgagccgagaaccagaagttggatttctccacgggaaatttcaacgtgcttgcagttaggattgccgtcctggctagtatatgcgttactcaggccttcatgatgtggaaattcataaacttccaactgaggaggtggcgcgaacactctgccttccaagcgcctgctgttaaaaagaaacccacggtgaccaaggggagaagctctaagaaggggactgagaatggcgtgaatggaaccctcacatccaacgttgctgacagtccccgaaataaaaaggaaaaatcttcgtag

SEQ ID NO: 54919 - DNA, 1032 bp, Artificial Sequence
  Description of Artificial Sequence: Synthetic coding sequence
atggtgtttctactgggtttgatgtttgagattactgcgaaagcctcaataatattcgtgaccctacagtacaacgtcacccttccggctactgaagagcaggccacagagtcagtgagcctttactattatgggattaaggacttggccacggtgtttttctacatgctcgtggctataatcattcatgccgtgattcaggagtatatgttagacaaaatcaaccgcagaatgcacttcagcaaaaccaagcatagtaagttcaacgaaagtgggcagctgagtgccttttacctctttgcttgcgtgtggggcacatttattctgatttctgagaactatattagcgacccaaccatactgtggcgagcttatccgcataacctgatgacatttcagatgaagttcttttatatctcccagttggcctattggttacacgcgtttcccgagttgtattttcagaagacgaaaaaggaagatatccctcgccagctcgtgtacatcggactgtatctgtttcacattgctggcgcttatctgctgaatttgaaccacttggggctagtgcttcttgttctgcactattttgtggagttcctgtttcatatctcacgacttttctatttcagtaatgaaaagtatcagaagggcttcagcctgtgggcagttctctttgttctgggccgtttactgactctgatactctcggtcttgacagtgggcttcggcctggctagagcggaaaaccaaaaacttgacttctccacaggaaacttcaacgttctggctgtaagaatcgccgttcttgccagcatttgcgtgacccaggcattcatgatgtggaaattcatcaacttccagttgagaagatggagggagcatagcgccttccaggcacccgctgtcaagaagaaaccaaccgtaactaagggacgttcctccaaaaaaggcaccgaaaatggagtcaacggcactctcacgtctaatgtggctgattcaccccgaaataaaaaggaaaaatctagctag

SEQ ID NO: 54920 - DNA, 1110 bp, Artificial Sequence
  Description of Artificial Sequence: Synthetic coding sequence
atgggcttacgcaagaagtcaaccaagaacccaccggtcctttctcaggaatttatcctgcagaaccacgcagatattgtgtcgtgtgtcggcatgttttttctactcgggcttgtctttgaagggacggcagaggcatcaattgtatttttgacgctgcagcacagcgttgctgtgccagccgcagaagagcaagctacaggaagcaagtcgctatactattatggcgttaaggacctcgctacagtcttcttttatatgctcgtcgccatcatcatccacgctactattcaggaatacgtcttagataaaataaataagcggatgcagttcactaaagcgaagcagaataagttcaatgagtctggccaatttagtgtgttctatttcttctcatgcatttggggcacttttatcctgatttcggagaactgcctctccgaccccactctcatttggaaggctcggcctcatagcatgatgacttttcagatgaaatttttctatatttcacagctggcctactggttccacgccttccctgaactgtattttcagaagacaaaaaagcaagacataccaagacagttggtgtatattggtctgcacctattccatatcaccggtgcctatttactttacctcaaccacctcgggcttctgcttctcgtacttcattactttgtggaactcctgtcccatatgtgtggcctgttctactttagcgacgaaaagtaccagaaggggatttcgttatgggccatcgtgttcattctgggcagactagtgactcttatagtctcagtgcttacagtaggctttcaccttgccggtagtcagaaccgcaatcctgacgccttgacagggaatgtgaacgtcctggccgctaagattgctgtgctgtcgagttcctgtacaatccaggcgtacgtcacctggaatctcattaccctgtggctacagcgatgggtggaggactccaacatccaggccagttgcatgaagaagaagagaagccgaagcagtaagaaacggaccgagaacggtgtgggcgtggagacaagcaatcgcgtggattgccccccaaagcggaaggagaaaagtagctag

SEQ ID NO: 54921 - DNA, 1113 bp, Artificial Sequence
  Description of Artificial Sequence: Synthetic coding sequence
atggccttcagaaggcggactaaatcataccccctcttttcacaagagtttgttatccacaaccacgcggacatagggttctgtctggttctttgtgtgttgattggtctcatgttcgaggtgactgccaagactgcattcctttttattttgcctcagtacaacatctctgttccaaccgccgatagcgagactgtacattaccattacggccctaaggacctagtaacaattttattctacatatttatcaccattattttgcacgcggtagtgcaggaatacattctggataagatttccaagcgcttgcatctaagcaaggtgaaacattccaaattcaacgagtcgggtcagctagtcgtcttccactttacatccgtgatttggtgcttctacgttgttgtcacggaaggttatctgacaaacccacggtcattgtgggaggactatccccacgtgcatctcccttttcaggttaagtttttctatctctgtcagctggcgtactggctgcacgcacttccagaactatactttcagaaggttcggaaagaagaaatccccaggcagttgcagtatatctgcctctatttagtccacattgcaggagcttacctgttaaatttgtcccgcctgggcctgatcctgctgctgctgcaatactctacagagttcctctttcacaccgccaggctcttttatttcgccgatgagaacaatgagaagctattttcggcatgggcagctgtgtttggcgtgaccaggctgttcattttgaccctggctgtactcgctatagggtttggcttggctaggatggagaatcaggcgttcgaccctgaaaaaggcaatttcaatactctgttttgccgcctctgcgttctgctgctagtttgcgctgctcaagcttggctcatgtggcgctttattcacagccagctcagacattggcgggagtactggaatgagcagagtgccaaacgacgggtacccgcaacacctcggcttccagctaggcttataaagcgcgagtcaggataccacgagaatggcgtagtaaaagctgagaatggcacaagtcctagaaccaaaaaattaaaatctccctag

SEQ ID NO: 54922 - DNA, 513 bp, Artificial Sequence
  Description of Artificial Sequence: Synthetic coding sequence
atgcgccttcagggcgcaatttttgttctcctgccgcacttgggcccaattctcgtctggctgttcactagagaccatatgtctggttggtgtgagggcccacgcatgctctcttggtgcccattttacaaagtactgctgctggtgcagaccgctatttatagcgtggtcggctacgcatcatacctggtatggaaagatctaggtggaggactcggatggccactggcattgcccctcgggttgtatgcagtgcagctcacaatatcctggacggttctggtgcttttttttaccgtgcacaatcctggccttgccctgctgcacctgttgctattgtatggccttgttgtgtcaactgctctcatttggcatcccatcaacaagctggcagccctcctgctcctaccctatctggcctggcttaccgtcacatctgcactgacctaccacctctggcgggatagcctgtgtccagtgcaccagccacagcctaccgagaagagcgactag

SEQ ID NO: 54923 - DNA, 513 bp, Artificial Sequence
  Description of Artificial Sequence: Synthetic coding sequence
atgaggctgcagggtgccattttcgtgctgttgccacacctgggcccaatacttgtgtggctgttcacacgcgatcatatgtcaggctggtgcgaaggtccccgaatgttgtcatggtgcccattttacaaagtgctcctgctggtccaaaccgcgatctactctgtcgtagggtacgcttcatatctggtgtggaaagatctgggcggagggctggggtggccacttgcactccccctcggcctttacgctgtccagctgactatcagttggacagtgctcgtactctttttcaccgtgcacaatcctgggctagcgttactgcatctcctgctgttgtacggtttagtggtgtcaacagccctgatttggcatccaattaataagctcgcagcactgttgctgcttccatacctggcttggctcaccgtgactagcgctctcacttaccacctttggcgtgactcactgtgtccagtgcaccagccgcagcccaccgagaagtctgactag

SEQ ID NO: 54924 - DNA, 1047 bp, Artificial Sequence
  Description of Artificial Sequence: Synthetic coding sequence
atgcgcttgggactcctctcagtagctctgctctttgtgggttctagccacttatacagcgatcattattccccctcaggccgtcaccggctgggtccttctccagagccagctgcttcctcccaacaggctgaagccgtaaggaaacgacttcgcaggcggagggaaggaggggcacatgccgaggactgcggcactgctcccctaaaggatgtgctgcaggggtcccgcataattgggggaactgaggcccaagctggagcttggccttgggtggtgtccctgcagataaagtacgggagagtgctcgtccacgtgtgcggagggacactggtgcgggagcgttgggtattaacagctgcacattgtaccaaggacgcatcagaccctctgatgtggaccgcagtgatcggaacaaacaatatccacgggaggtacccccacactaaaaagataaagatcaaggctattataattcaccctaacttcattctggaaagctacgtgaacgatatcgcacttttccacctcaagaaggcagtgcgctacaatgattacatccagcctatttgccttccctttgacgtcttccagatcctggacgggaacacaaaatgctttatttccggatggggcagaacgaaggaagaagggaatgcgacaaacatactccaagacgcagaggtccactacataagcagggagatgtgtaactctgaaagatcgtatggcggaatcatccctaacacatccttttgcgcaggcgatgaggatggtgcgttcgatacgtgcaggggcgatagcgggggaccacttatgtgctatcttccggagtataagcgattttttgtcatggggatcacctcctacggacacggctgcgggagaagaggctttccaggcgtgtacatcggcccttctttctaccagaaatggctgacggaacacttctttcacgccagcactcaggggatcttgacgataaatatcctgagaggacaaatcctgatcgctctttgctttgtcattctgctcgccaccacttag

SEQ ID NO: 54925 - DNA, 606 bp, Artificial Sequence
  Description of Artificial Sequence: Synthetic coding sequence
atggggtcgaggaaatgcggcggttgtctatcctgcttactgatcccccttgccctctggtcaatcattgtcaatattctcctttatttccccaatgggcagaccagctatgcgagctctaacaaattgaccaattacgtgtggtacttcgagggcatctgttttagcggtattatgatgctgattgtaacaaccgtgctgctggtcctggagaacaataacaactacaaatgttgtcagtccgagaattgcagcaagaagtacgtgacgttgttgagtattatcttcagttccctgggcatcgcattctcagggtactgccttgtgatctctgctctgggcttagtccaagggccttactgccggactttggacgggtgggaatatgccttcgaaggcacggctggacgcttcctaactgactccagtatctggatccaatgcctggagcccgctcatgttgtagagtggaatattatcctctttagtatactcatcacgttatctggccttcaggtaatcatctgcctgatccgcgtggtcatgcagctgtcgaaaatcctgtgtggttcttattctgtgatatttcagcctggaatcatctag

SEQ ID NO: 54926 - DNA, 606 bp, Artificial Sequence
  Description of Artificial Sequence: Synthetic coding sequence
atgggctcccgcaagtgcgggggatgtcttagctgtctgctgattcctttggcactgtggtctattattgtcaatatccttctgtatttccccaatggacagacctcttatgctagcagcaacaagctcacaaattacgtgtggtactttgaaggtatctgcttttcggggataatgatgctcatcgtgaccaccgtcttgctggttctagaaaacaataacaattacaagtgttgtcagagcgaaaattgttcaaaaaaatacgtcacacttctaagtatcatcttttcttcattgggcatagccttctcaggttattgcctcgtgatcagcgccctggggctagtccagggaccgtattgtagaacattggacggttgggaatatgccttcgaaggcaccgccggaagatttctgacagatagctccatttggatacagtgcctagaacccgctcatgtagtggagtggaatattattttgtttagcatccttatcactttgtcaggactgcaggtcatcatctgcctgatcagagtggttatgcagctaagtaagatattgtgtggttcctattcagtcattttccaaccaggcataatatag

SEQ ID NO: 54927 - DNA, 480 bp, Artificial Sequence
  Description of Artificial Sequence: Synthetic coding sequence
atggggagcagaaagtgcgggggatgcctttcttgccttctgattcctctggccctgtggtctatcatcgtcaacattctcctttacttccccaacggccagacctcctatgcttcttccaataagttgactaactacgtttggtacttcgagggaatttgcttctctggcatcatgatgctaatcgttaccacagtgctactggttttagaaaataacaacaattacaaatgctgtcagagcgaaaactgctccaagaaatacgtcacactcttaagcataatcttctcttcactgggcattgccttctccggctactgtcttgttatctctgcgctcggacttgtgcagggaccctattgtagaaccctggacggctgggaatacgcctttgagggaacagccggaaggttcctgacagactcttctatctggatacagtgcctggagccggctcatgttgtggagtggaatatttag

SEQ ID NO: 54928 - DNA, 630 bp, Artificial Sequence
  Description of Artificial Sequence: Synthetic coding sequence
atggtaagttccccatgcacccaagccagttcaagaacatgtagcaggatcctggggctcagtctgggaactgcagctttatttgctgccggtgccaacgtggctctgctgttgcctaattgggatgtaacctacctgctccggggactgctcggccgacatgctatgcttggcactggcctgtggggaggaggcctgatggtgctgacggcggctatcctgatatcattaatgggctggcgctacgggtgtttttctaaatcagggctgtgtcgatctgtactgacagccctactctctggtgggcttgccctgcttggcgcacttatatgttttgtcacaagtggagtggccctgaaagatggccctttttgtatgtttgatgtatcctcctttaatcaaacccaagcgtggaagtacgggtacccttttaaggacctgcatagtcgcaactacctatacgataggtctctgtggaattccgtctgtcttgagccgtctgccgcagtggtctggcatgtgtcccttttctcagccctcctgtgtatctccctattgcagctcctgcttgttgtggtgcacgtcattaattccttgttaggcctgttttgtagtctctgtgaaaagtag

SEQ ID NO: 54929 - DNA, 630 bp, Artificial Sequence
  Description of Artificial Sequence: Synthetic coding sequence
atggtctcatctccttgtacccaagcttcatccaggacctgttcaaggatactcggcctgtccctcgggacggccgcattgtttgccgcaggagctaacgtcgctctgctattgccaaactgggatgtgacttacctgctgagagggctgctcggtcgacacgcgatgttggggacgggtctgtggggaggcggtctcatggtcttaacggccgcaattctaatatcgttaatggggtggagatacggctgttttagcaagtctgggctatgcagatctgtcctcactgcgcttctgtcaggcggactggcattactcggtgccctgatttgcttcgtgacctctggcgtcgcactcaaagacgggccattttgcatgttcgatgtgtcatccttcaaccaaactcaggcctggaagtatggttacccctttaaggacctccatagtcgcaactacctttatgatcgttctttatggaatagcgtctgtctggaaccttctgctgccgtggtttggcacgtatctctattcagcgctttattgtgtatttcactcctgcagctcctccttgtggttgtgcacgttataaattctcttttggggcttttctgctccctttgtgagaaatag

SEQ ID NO: 54930 - DNA, 552 bp, Artificial Sequence
  Description of Artificial Sequence: Synthetic coding sequence
atggtgagttcgccttgtacccaggctagcagccgcacttgttctagaattctgggactgtcgctcggcacagcagccctgtttgcggcaggcgctaatgtcgctttgctcctgcccaattgggacgttacttacctgctgcgcggactgctcggcagacacgccatgctgggaacaggattgtggggcggaggactgatggtactgaccgctctactctcaggaggtttggcacttttgggagcactgatttgcttcgtcaccagcggtgtggcgctaaaagacgggcctttctgcatgttcgatgtgtcgtctttcaaccagacccaggcttggaaatatggatacccttttaaagatctgcattctcggaactatctgtatgatagaagcttgtggaactcggtgtgcttagagccaagcgctgccgtggtctggcacgtgtctctgttctccgccctcttgtgtatctctctcctgcagctactcttagtcgttgtccatgtaatcaattcattactgggtctattttgtagcctgtgtgaaaaatag

SEQ ID NO: 54931 - DNA, 690 bp, Artificial Sequence
  Description of Artificial Sequence: Synthetic coding sequence
atgacatgctgcgaggggtggactagctgcaatggcttctccctcctggtgctgctcctgttaggcgttgtacttaatgctatccccttaattgtatctttggttgaggaggaccaattcagtcagaatcccatttcttgctttgaatggtggttcccgggaatcattggcgcaggcctgatggctatccctgccaccacgatgtctctaactgccaggaagcgggcatgctgtaataacaggaccgggatgttcttgagtagcctgttctcagtgatcacagtgatcggagcgctctattgcatgctcatctcaatccaggccctcctgaaaggtccgctgatgtgcaattctccatctaactcaaacgcaaactgtgagttttctctgaaaaacatatctgacatccacccagagtctttcaacttacagtggttcttcaacgattcatgcgcccctcccaccggattcaacaaaccaacctctaacgacaccatggcatcaggctggagagcaagttccttccatttcgactcggaagagaacaagcacaggctgatccacttctcagtctttctagggcttttactggtggggatcttagaggttttattcggactttctcagatcgtgattggctttcttgggtgcctctgtggtgtcagtaagcgtcgcagtcaaattgtgtag

SEQ ID NO: 54932 - DNA, 45 bp, Artificial Sequence
  Description of Artificial Sequence: Synthetic coding sequence
atgacctgctgcgagggctggacaagttgcaacgggtttagttag

SEQ ID NO: 54933 - DNA, 1821 bp, Artificial Sequence
  Description of Artificial Sequence: Synthetic coding sequence
atgaccgtggtgggaaaccctcgaagttggagttgtcagtggctgcccattctgatcttgctgctgggaacaggtcatgggccaggagtggaaggggtcacacactataaagcaggggacccagtgattctctacgtcaacaaggttgggccatatcataatccgcaggagacataccattactatcagctgcctgtgtgttgccctgaaaagattcgccacaagagtctgagtctcggtgaagttctagacggcgacaggatggcggagtccttgtacgaaatcaggtttagggaaaatgtggaaaagcgcattctctgccacatgcagctgtcttccgcacaggtggaacagcttcgacaggcgatcgaagagctgtactacttcgagtttgtggttgacgaccttccaattagaggattcgtcggatatatggaggagtcgggcttcctgccacatagccacaaaatcggactgtggacccacttggatttccatcttgagtttcatggcgacaggatcatctttgccaatgtcagtgtccgggatgtgaaaccccattcccttgatggcctgaggcccgacgaatttctgggcctcacacatacttactctgttcggtggagcgagacttctgtagaacgacgttccgatcgccgtagaggagatgacggcggtttcttcccaaggactctggaaattcactggctatccatcattaattccatggttcttgtgtttctgttggtgggtttcgtggcagttatcttaatgcgggtcttgaggaatgaccttgccagatacaatttggacgaggagaccacctcagccggttccggcgatgatttcgaccagggagataacggttggaagattattcacactgacgtctttcgcttccccccttaccgtggtcttctatgtgcagtgctgggcgttggtgcacaattccttgcacttgggacaggcattattgtcatggccctgctgggtatgttcaacgtgcatagacacggagctatcaactctgcagccatactcctttacgccctgacatgttgcatatcgggatacgtgtcaagccatttttatagacagattggtggagagagatgggtgtggaatatcatcctgacaacatctttgttcagcgtccctttttttctgacttggtctgttgtcaactctgtacattgggccaatggtagcacccaggctctgcccgcaaccaccatcctgctacttcttactgtttggctcctggtaggcttcccgctgacagtaatcggcggtatatttggaaaaaacaacgcaagccccttcgatgctccttgcaggactaagaacatcgccagggagattccaccacagccctggtacaagtcaacagtgatccacatgactgtcgggggattcctcccattcagcgcaatctccgtagagttgtattatatcttcgctactgtctgggggagagaacagtatactttgtacggaattctgttctttgtatttgccatcctgttatctgtgggagcctgtatatccattgctttgacttactttcagctttcgggggaggattaccggtggtggtggaggagcgtccttagcgtcggctccaccgggcttttcatcttcctctattcagtgttctattacgcaaggagaagcaacatgtctggggcagtgcagactgtggagttcttcggatacagcttgctgacaggatatgtcttcttcctgatgctgggaacaatcagcttcttttcaagccttaagttcattcgatacatttatgtgaacttgaagatggactag

SEQ ID NO: 54934 - DNA, 1470 bp, Artificial Sequence
  Description of Artificial Sequence: Synthetic coding sequence
atgacagtggttggtaaccccagatcgtggagttgtcaatggttacctatcctcatcctcctattgggaacaggccacggcccaggggttgagggagtgacccactataaggctggcgatcccgtgatcctgtacgtcaacaaagtgggaccataccataatcctcaggaaacttaccattactaccagctgccagtgtgctgccctgaaaaaatacggcataaatcactctccctgggagaggtcctcgacggagatcggatggctgagagcctatacgagatccgcttccgggaaaacgtggagaaacgcattttatgtcatatgcagctgagttcagctcaggtggaacagctgaggcaagccattgaagaactctactactttgaattcgtcgtggacgacctgcccattcggggtttcgtgggctatatggaagaatctggattcttgccacactctcataaaattggactctggacacacctggatttccatctggaattccacggcgatcgaatcatttttgccaatgtctccgtgagggacgtgaaaccacattctcttgacggtctgcggccagacgagtttctcggcctcacacacacatatagcgtgcgctggtccgaaaccagcgttgagaggaggtccgaccgcaggagaggggatgatggcggattcttcccaaggacgctggaaatccattggcttagcattatcaactccatggtgttggtattcttgctcgttggcttcgtggcggtgatcctcatgagagtgcttcggaatgaccttgcaagatacaatttggacgaggagaccactagcgccggatctggcgacgatttcgaccaaggcgacaacggctggaaaataatccatactgatgtgttcaggttccctccttaccgaggccttctatgtgcggtgttgggggttggagcccagtttctggccctgggcactggcatcatagttatggcccttttgggaatgtttaacgtgcaccgccatggggcaatcaactccgccgctatcctcctctacgccctcacctgttgcatctcggggtacgtatcgtcacacttctatcgtcagattggtggtgaaaggtgggtgtggaatatcattttgaccacatccctgttcagcgtaccattctttctcacctggtcagttgtgaactccgtgcattgggccaacgggtccacacaggccctgcctgccactactatcctgctgttactgaccgtgtggctcctagtcggatttcccttgacagtgattggcggtatattcggcaaaaataacgcctcacctttcgacgctccttgtcgtactaagaatattgcacgagaaatcccaccccagccctggtacaagtctactgtaatacatatgaccgtggggggattcctgccgttccgttaccctccattcatcccctggctgctcctgtctggcagttag

SEQ ID NO: 54935 - DNA, 729 bp, Artificial Sequence
  Description of Artificial Sequence: Synthetic coding sequence
atgaccgtggtcggaaacccgagaagctggagctgccagtggttacccatacttatcttactgctgggcaccggacacggccctggggtggaaggggtgacacactacaaagccggagatccagtaatcctttacgttaacaaggtcgggccataccataatccacaggagacctaccattactatcagctgccagtgtgttgtccagaaaagatacgacataagagcctgagcctcggcgaggtgctagatggggatagaatggccgaatcactgtatgaaatccggtttcgggagaacgttgagaagcgcattctctgtcacatgcagctaagcagtgcgcaggtggagcaactccgacaagccatcgaagaactctactactttgagttcgtagttgatgacttgcccatccggggattcgtaggctatatggaggagtctgggtttctcccacactcccataagatagggctctggacacacctggactttcatcttgagtttcatggtgataggatcatcttcgccaacgtgagcgtgagagacgtgaagcctcactccctggacgggctgaggcccgatgaattcctgggcctcacccacacctatagcgtcaggtggtctgaaaccagcgtagaaaggcgctccgacaggaggcgcggagacgatggtggctttttccccaggaccctggaaatccactggctgtcaatcatcaacagctag

SEQ ID NO: 54936 - DNA, 633 bp, Artificial Sequence
  Description of Artificial Sequence: Synthetic coding sequence
atgactgtcgttgggaaccccaggtcctggagctgccagtggctccccattttgattttactgctgggtaccggacatggccctggagttgaaggcgtaactcactataaagccggagaccccgtcattctttatgtcaataaagtcgggccttatcacaacccccaggagacatatcattattatcagctcccggtctgctgtcctgaaaagatccgccacaagtctctctccctgggagaggtactcgacggcgaccgcatggcagaatccctgtatgagattcggttccgcgagaacgtggagaagagaatcctgtgccacatgcagctctcctcggcccaggtagagcagttacggcaagccatcgaggaactttactactttgaattcgttgtggacgatctcccaatcaggggcttcgtgggttatatggaggaatctgggtttctgcctcactcccacaagatcggcttatggacgcacttagactttcacctggagtttcatggagatagaataatttttgcaaacgtaagcgtccgcgacgtgaagccccattcactcgacggcctacggccagacgagtttttgggcctgacgcacacatatagtgttcgctggtccgagtag

SEQ ID NO: 54937 - DNA, 906 bp, Artificial Sequence
  Description of Artificial Sequence: Synthetic coding sequence
atgacagtcgtgggcaatcctcgctcctggtcctgccagtggctgcccatcctaatcttacttctgggaaccggccatggtccaggggttgaaggagtgacccactataaagccggagaccccgtgatactgtatgtcaacaaggtcggtccataccacaatccccaggaaacctaccactattaccagttgcctgtgtgttgtccagagaagataaggcacaagagcttatccctcggggaagtcctagacggcgaccgcatggccgaaagtctgtatgagattagattccgcgagaatgtggagaagcgtattttgtgccatatgcagctctcctccgcacaggtggaacagctgcgacaggcaatagaggaactctactattttgaatttgttgtggacgacctccctattagggggttcgtcggatatatggaggagtcaggtttcctcccccatagccacaagatcggcctctggactcacttggacttccatctagagttccatggcgataggatcatcttcgctaatgtgtctgttcgtgatgtaaagcctcactcgctggatgggctgcgccctgatgagttcctagggctgactcatacttactcggtacggtggtcagaaaccagcgtggagcgaaggtctgaccgcagacgaggggatgatggcggattctttcctcggacccttgaaattcattggcttagcataataaactcaatggtgctggtcttccttttggtggggtttgttgctgtcatccttatgagagttcttagaaacgacctggcccgatacaatcttgatgaggaaactacctccgccggtagtggggatgacttcgaccaaggcgataacggatggaagatcatccacacggatgtcttcaggtttccttag

SEQ ID NO: 54938 - DNA, 774 bp, Artificial Sequence
  Description of Artificial Sequence: Synthetic coding sequence
atgactgtcgtgggaaatcccagaagctggtcttgccagtggctcccgatactgatactgctgttaggaacaggccacgggcctggggtggagggcgtgacacactataaggcaggagacccggttatcctgtacgttaataaggtcggaccatatcacaaccctcaggaaacttatcattactatcaacttccagtctgttgtcccgagaagatcagacacaagtcactgtccttaggcgaagtcctggacggggacagaatggccgaatctctctatgagatccgcttccgtgagaatgtagagaagcgaattctgtgccatatgcagctgtccagcgcccaggtcgaacaactcaggcaggccatagaagaactgtactacttcgaattcgtagtcgacgatctcccgatccgcggatttgtgggatacatggaggagtctggtttcctgcctcactctcacaaaatcggtctgtggacccacctggactttcacctggaatttcatggcgataggattattttcgccaatgtgtccgtccgagacgttaaaccacactccctcgacgggcttcgcccagacgaatttctcgggctaacgcacacttattcggttcgatggagtgagacttctgtggagcgccgatcagatagaaggcgcggtgacgatggtggctttttcccacggactcttgaaattcattggctctcaatcatcaattccatggtccttgtatttctgctggtcgggtttgttgccgtcatcttatag

SEQ ID NO: 54939 - DNA, 2448 bp, Artificial Sequence
  Description of Artificial Sequence: Synthetic coding sequence
atgtccggcttggggaggctattcgggaaggggaaaaaagaaaagggaccaacccctgaagaggcaatccagaagttgaaggaaaccgagaaaatactcattaagaaacaggaatttttggaacagaaaatccaacaggaactccaaacagcaaaaaaatatggtacaaagaacaaacgagcagcactgcaggcccttcgcagaaagaagcggtttgaacagcagctggcccaaacggacggaactctatctacattagaatttcagcgggaagccatcgaaaacgccactactaatgccgaagtcctcaggaccatggagttagccgctcaatcaatgaagaaggcctaccaggacatggacatcgataaggttgatgagttgatgactgatatcaccgaacaacaggaagtcgcgcaacagatctctgatgccatctcaagaccaatggggtttggggatgatgtggatgaggatgaactgctcgaagagttagaagagctggagcaagaggagctggcccaggagttacttaacgtgggagataaggaggaagagccttcggtgaagttgccttccgtgccgtcgacacatctgcccgcaggccctggatcaactgcactaagaatgactgtagttgggaaccccagatcatggagttgccagtggctgcccatactcattctgcttctgggtacagggcacggccctggcgtggagggcgtaacccactacaaggcgggtgacccagtgatcctctatgtgaataaggtgggaccctaccacaacccccaagagacttatcactactaccaactgccagtttgttgcccagagaaaataagacacaagtcattgtcacttggcgaagtcctggacggagaccgcatggcggagtctctctatgagataaggtttcgggaaaatgtggagaagcgtatattgtgtcatatgcagctgagctctgcacaggttgaacagctccggcaggccattgaagaactgtattactttgaattcgtggtggatgatttacctatacgcggttttgtcggctacatggaggaaagtggtttcctgccccacagtcacaaaatcggcttatggacccatctcgacttccacctggaattccatggtgaccggataattttcgccaacgtgtctgtaagagacgtgaaaccacactcactcgacgggctcagacctgacgagttcctcggactaacccatacctatagcgtgaggtggagcgagaccagcgtggaacggaggtccgaccgcaggcgaggagacgatggcggtttcttcccgagaacactagaaatccactggctgagcattatcaacagcatggtactagtgttcctgctcgtggggtttgttgccgtgatactcatgcgcgtgctaaggaatgatctcgcaaggtacaatttggatgaggaaacaacatcagcaggatccggagatgacttcgatcagggcgataatgggtggaaaattatccacacagatgtgttcaggttccctccttatagagggttgttgtgtgcagtcctcggcgtcggcgcacagttccttgctttggggaccggcataattgtaatggccctcctggggatgtttaatgtgcatcgccacggcgctattaattccgccgctatcctgctatatgcccttacctgctgtattagtggatacgtcagctcacatttctatcggcagatcgggggagaacggtgggtctggaatataatcctgactacttccttattttccgtgccttttttcttgacctggagtgtcgtgaacagcgtgcactgggctaatgggagcacacaggcattgccagctacaaccattctgctgctcctcactgtgtggcttcttgtcggctttcctctgaccgtgatcggtggaatatttggaaagaacaatgcctcacccttcgatgccccatgtagaaccaagaatatcgccagggagattcctccacagccctggtacaagtctactgtgatccacatgacagttggcggtttcctgccattttcagcaatcagcgttgaattatactatattttcgccactgtctggggtcgcgaacagtacaccctctacgggattctgttctttgtctttgctatcctcctctcggtaggggcttgtattagcattgccctcacctatttccaactttcaggggaagactaccgctggtggtggaggtcagttctgtcagtgggcagcaccggactattcatcttcctgtactctgtcttctactatgcccgaagatccaacatgagcggagctgtgcagacggtggagttcttcggatactccttgctaaccggctatgtctttttccttatgttgggtacgatcagttttttcagctctctcaaattcatcaggtacatctacgtaaatttgaagatggactag

SEQ ID NO: 54940 - DNA, 2448 bp, Artificial Sequence
  Description of Artificial Sequence: Synthetic coding sequence
atgagtgggttgggccgtctttttggtaaggggaaaaaagagaaaggccctacgcccgaagaagctattcagaaactcaaggagacagagaagatattaattaaaaaacaggagttcttagaacagaaaatccaacaggagctgcaaaccgctaagaaatacggcacaaaaaacaagagggcggctctccaagcactacgtcgcaagaagcggttcgagcaacagcttgctcaaacagatgggacgctgagcactctcgagtttcaacgggaagcgattgagaacgccaccaccaatgccgaggtactacgcacaatggagttagctgcccagtccatgaagaaggcttaccaggacatggatatagacaaagtcgacgagctcatgacagatataactgaacagcaggaggtggcccagcagatctcggatgcgatatccagacccatgggttttggagatgatgtggacgaagacgagctgcttgaagagctcgaggaattggaacaggaagaacttgcgcaagaactgctgaacgtcggagataaggaggaggagccttcagtgaagctgccgtcagtgcccagcacccacctacccgcagggccaggttccacagccctgaggatgaccgtggtaggcaacccaaggtcatggagctgccagtggctgccaatcctcatcttgcttctcggtacaggacatgggccaggagtggagggagtgacccattataaggctggcgatccagtgatcctgtacgtgaacaaagtcggaccgtatcataatcctcaggagacctaccactactaccaactgcccgtatgttgtcccgagaagattcggcataaaagcctgagcctgggggaggtcctcgacggcgatcgcatggctgagtccctctatgaaattcgctttagggaaaacgtcgaaaaaagaattctgtgccacatgcagctgtcttctgcacaagtagagcaactgcgacaggctattgaggaactgtactatttcgagttcgtggttgatgacctccccattaggggttttgtgggctatatggaggaatctgggttccttccacacagccacaaaatcggcctctggacgcatttagacttccatcttgagttccacggagaccgtatcatctttgccaacgtctcagtcagagatgttaaaccccacagcctggacgggctgaggcccgacgagtttctcgggctgacgcatacttactccgttaggtggtcggagacttccgtggagagacgttctgaccgacggagaggcgatgatggcggattctttccacgaacacttgaaatccattggctaagcattattaattccatggttctggtgtttctcctggttggcttcgtggctgtaatcctgatgagagttctccggaatgacctggctagatacaacttagacgaggagactacttcagctggcagcggcgatgatttcgatcagggggataacggttggaaaatcatccacacagacgtgtttagattccccccataccgcggtttgttatgcgccgttctgggagtcggcgcacagtttttagctctggggacaggaatcatcgtgatggccctgctcggtatgtttaatgttcataggcacggagctatcaactcagccgcaattttgctctatgccctgacatgttgtatttccggttacgtctcaagtcacttctatagacagataggcggagaaaggtgggtgtggaatattattctcacaacatcgttatttagcgtgcctttcttcttaacgtggagtgtggtcaattccgtccattgggctaacggcagtacccaagcactgcccgcaactactatcctcctccttctgaccgtctggctgctcgttggctttcccctaactgtcattgggggtatattcggcaaaaacaacgcctctcctttcgacgccccttgcaggacaaaaaatattgctcgggaaattccacctcaaccttggtacaagtccaccgtgatccatatgactgtgggaggatttttacctttctctgccatctccgtggagctgtactatatatttgccaccgtgtgggggagggagcagtatacactgtatggtatccttttcttcgttttcgcaatcctgctgagcgtgggcgcatgtatatcaattgcattgacatatttccagctctccggcgaagactatagatggtggtggcggtctgtactgagcgtggggtccaccggactatttatttttctttacagcgttttctactatgccaggaggtcaaatatgagcggcgcagtccagaccgtggagttttttgggtactcgcttctcacaggctatgtattctttttgatgctggggaccatcagtttcttttcgtccttaaaattcatcaggtatatctacgtgaacctcaaaatggactag

SEQ ID NO: 54941 - DNA, 1992 bp, Artificial Sequence
  Description of Artificial Sequence: Synthetic coding sequence
atgtccgctaggcttccggtcctctcacccccacggtggccacggttgctcttgctgtcgctgctgctgttgggggcagtgcccggaccacgacgttccggggctttttacttgcccggtctggcacccgttaatttttgcgacgaagaaaagaagtctgacgagtgtaaagcggagatcgaattattcgttaaccggctggattctgtggagtcagtactcccgtatgagtacaccgccttcgacttctgtcaagcctccgaggggaagcggccatctgagaacctggggcaggtcctgtttggcgaacgcatagaacccagcccttacaaatttaccttcaacaaaaaggagacctgtaagcttgtgtgcaccaagacttaccacaccgagaaagctgaggacaagcagaaactggagttcctgaagaagagtatgctgctgaattatcagcaccactggatagttgacaacatgccggttacctggtgttatgacgttgaggacggccaacggttctgcaaccccggatttccgattggctgttacatcaccgataaggggcatgccaaagacgcttgtgtaatatcctctgactttcacgaacgggacactttttacattttcaatcacgtagacataaaaatctattatcatgtcgtggagacaggatcaatgggggcacgtctcgttgcagccaagttagagcccaagtccttcaagcatacgcatattgacaagcctgactgcagcggcccacccatggacatttccaataaagcctccggggagatcaaaatagcctatacatattcagtaagctttgaggaagatgataagattagatgggcatctcgctgggattacatcctggaatccatgccacatactcatattcagtggttctcaattatgaattctctggtaatagtgctgttcctatccggtatggtcgccatgatcatgctccgaaccctgcataaagacatcgctaggtataaccagatggattccacagaggatgcgcaggaggagtttgggtggaaactggtgcacggcgacattttccgccctccaaggaaaggaatgctactgtcagtatttctggggagcggcacacagattctgatcatgacctttgtgacgctgttttttgcatgcttggggtttctcagcccagcaaaccgcggagctctcatgacctgcgcggtagtgctctgggtactgctaggaaccccggctggatacgtggctgcacgattctataaaagctttggtggggaaaagtggaagacaaacgtactcttgacctcttttttatgtcctggcattgtctttgcagattttttcatcatgaacctgatcctgtggggtgagggctcaagcgctgccatccccttcggcactcttgtagctatcctggcgctctggttctgcatatcagtgcccctgacattcattggggcttatttcgggttcaaaaagaacgcgattgaacatccagtgcggaccaaccagatccccaggcagattcccgaacagagtttctatacaaaacctctgcctgggataattatgggcggtatcttgcccttcggctgtatttttatccaattattcttcatcctaaacagtatctggtcccatcagatgtactatatgttcggtttcttgttcctggtcttcattatcttggttataacttgttccgaagccaccattttactctgctattttcacctctgcgccgaggactatcactggcagtggagatccttcctgacatcaggatttaccgccgtgtattttctcatctacgctgtgcactactttttttccaagctgcagattacagggacggcctccacaatcctgtatttcggctacacaatgattatggtgctgatcttttttctcttcactggtaccatcggcttctttgcctgcttctggttcgttaccaaaatctacagtgtggtaaaagttgactag

SEQ ID NO: 54942 - DNA, 1770 bp, Artificial Sequence
  Description of Artificial Sequence: Synthetic coding sequence
atgcggccattacccggagccctcggcgtggcggctgcagcagcactgtggttactactgttacttctgcctcgaactcgcgcagatgaacacgagcatacataccaggataaagaggaggtagtgctctggatgaacaccgtgggaccttaccataatagacaggagacatacaaatattttagtttgcctttctgcgtgggctccaagaaatctataagccattatcacgagactctcggtgaggcccttcagggggtggagctagaattttccggcttagacattaaattcaaggacgatgttatgcccgcaacttattgcgaaattgacttggacaaggaaaaaagagatgccttcgtgtatgctatcaaaaaccactactggtatcagatgtatattgatgatctccctatatgggggatagtgggcgaggcagacgaaaatggagaggattattatctttggacgtataagaaacttgagattggtttcaatggcaaccgtatagtggacgttaatctcacctccgaaggcaaggtaaagctggtccccaatactaaaatccaaatgtcttatagtgtgaagtggaaaaaaagtgatgtgaaattcgaggatcgctttgataagtatcttgacccctctttcttccagcataggattcattggtttagtatcttcaacagttttatgatggttatatttttagtggggctggtgtcaatgattctgatgcggactcttaggaaggattacgcgaggtacagcaaagaagaagaaatggacgatatggacagggatcttggcgatgagtacggctggaagcaggtgcacggcgatgtgttccgtccttcatcacaccctttgatatttagcagcctcatcggatcaggctgtcagatattcgccgtttccttgattgtcatcatcgttgccatgatcgaggacctgtatactgagaggggatccatgctgagtacagctatattcgtttatgcggctacttccccagtaaacgggtactttggcggaagcctgtacgctcggcaaggtggcaggagatggataaaacagatgttcattggcgctttcttaatcccggctatggtgtgtgggacggcattttttattaactttatcgctatttattaccacgccagccgggctattcccttcgggacgatggtggctgtctgctgcatctgttttttcgtgatactccctttgaaccttgttggcactattctcggccgtaacttgtctgggcaaccaaactttccatgtcgggtgaacgcggtccctaggcccatcccagaaaaaaagtggttcatggagcccgctgtcatcgtttgcctaggaggcatcctgcccttcggatcgattttcattgagatgtactttatcttcaccagcttttgggcctacaaaatttactatgtgtacggattcatgatgctggttctggtgatcctgtgtattgtcaccgtgtgcgtgactattgtgtgtacgtactttctcctgaatgccgaggactacagatggcagtggaccagtttcctgtcagccgctagcactgccatctatgtatatatgtactctttctattattatttttttaagacaaaaatgtacggactgtttcaaactagcttctacttcgggtatatggccgtgttctccacagcccttggaataatgtgcggagcaatcggctatatgggcacttcagctttcgtgcggaagatttatacaaatgtgaaaatcgactag

SEQ ID NO: 54943 - DNA, 765 bp, Artificial Sequence
  Description of Artificial Sequence: Synthetic coding sequence
atgaacactgttgggccttatcacaacaggcaggagacttataaatactttagcctccccttctgcgttggaagtaagaagagcattagtcattaccacgagacactcggtgaagccctccagggggtagagctcgagttttccggcctggacatcaaattcaaggatgacgtgatgcctgctacgtactgcgagattgacctggataaggaaaaacgtgatgctttcgtttatgccattaagaatcactattggtaccagatgtatatcgacgatctccctatctgggggatcgtgggcgaagccgatgagaacggggaggactattacctctggacttataagaagttggagatcggcttcaatggaaacaggatagttgacgtgaatctgacttccgaaggtaaggtgaagctggtgccaaatacgaagatccagatgagctatagtgttaagtggaagaaatcagacgtaaagtttgaagatcgctttgacaagtatcttgatccgtccttctttcagcaccggattcactggttttccatttttaactcatttatgatggtaatctttctggttggcctcgtgtctatgatcctcatgaggactctgcggaaggactatgcccgttattctaaggaggaggagatggacgatatggatagagacctcggagacgaatatggctggaaacaggttcacggtgacgtcttccggccatctagccaccctttgatcttcagcagtttgattggcagcggatag

SEQ ID NO: 54944 - DNA, 765 bp, Artificial Sequence
  Description of Artificial Sequence: Synthetic coding sequence
atggcttggcaaggcctcgtgctggccgcatgtctcctgatgttcccttcaacaactgccgactgcctgtccaggtgcagcttgtgcgccgtgaaaacacaggatggcccaaaacccatcaacccacttatctgctcacttcagtgccaggccgctttgctgccgagtgaagaatgggagcgatgtcagagtttcctgtctttttttacgccttctactcttggattgaatgacaaggaggatctcggcagtaaaagcgtgggcgagggcccttacagcgaattggcaaaactgagcgggtccttcttaaaagaattggaaaaaagtaaatttttgccgtccatctcgaccaaggagaacaccctgtctaaaagcctagaagagaaactgagaggcctgtccgacggcttcagggagggggcagaatcagagttaatgagggacgcacagctcaatgacggagctatggagacaggtactctctacctagccgaggaagacccgaaggaacaggtaaagaggtatggcggatttctccggaagtatcccaaaaggagcagtgaggttgcgggtgagggcgacggagacagcatggggcacgaggacctgtacaaaaggtatggtggcttcttgaggagaatcaggcctaaactgaagtgggataaccagaaacggtacgggggattccttcgcaggcaatttaaagtggtgactcggagccaagaagatcccaacgcatatagtggcgagctgttcgatgcctag

SEQ ID NO: 54945 - DNA, 1929 bp, Artificial Sequence
  Description of Artificial Sequence: Synthetic coding sequence
atggccaccgctatggattggctgccatggagtttacttttgttttctttgatgtgtgaaacatccgcattttatgtgccaggggtcgctcccattaactttcatcagaatgatccggtggagattaaagcggtgaagctaacctctagcagaacacagctgccctacgaatattacagcctgcctttttgtcaaccatctaagattacttacaaggctgagaatctgggggaagttctgagaggtgacaggattgtcaacactccctttcaagtgctcatgaattctgaaaagaaatgcgaagtactgtgcagtcaaagtaacaagcctgtaacattaacagttgagcagagccggctggtggccgagagaattacggaggattattatgtccaccttatagctgacaatttaccagtggcaacccggctggagctctactcgaacagggactctgatgacaaaaaaaaggaaaaagacgtgcagtttgaacacggctatcgtctcggcttcacagatgttaacaaaatatatttacacaatcatctgtcttttatactctattatcacagagaagatatggaggaggatcaagagcatacgtaccgagtggtgcgctttgaggtaatccctcagagcattagattggaggatctgaaagcagacgaaaaaagttcgtgtacgctgccagagggaaccaactccagtccccaggaaatagaccccactaaagaaaaccagctgtactttacctactccgtgcactgggaagagagcgacattaaatgggcatcaagatgggacacatatctgaccatgtccgatgtccagatccactggttttctatcattaacagtgtggtggtcgtgttctttctttccgggattctgtccatgatcatcataaggaccctcaggaaggacatagcaaattacaataaggaggacgatatagaagatacaatggaagaaagcggctggaaactcgtgcatggggatgtttttagacccccacagtaccccatgatattaagctctttgctgggttctgggatacaattgttttgcatgatcctcatcgtgatcttcgtcgcaatgctggggatgctcagcccctcatcaaggggcgcactcatgacaaccgcgtgcttcttgtttatgttcatgggagtgtttggaggattctccgccggaaggctctacagaacactcaaaggccaccggtggaaaaagggtgcattttgcactgccacattatatccaggggtggtatttggaatctgtttcgtgctcaattgtttcatctgggggaagcacagctcaggagccgttccatttcccacaatggttgcactgctgtgcatgtggtttgggatctcactgcctcttgtgtacctaggctactattttggctttcgcaagcagccatatgataatcctgttaggaccaatcagatacctcgccagatccctgaacagcgctggtacatgaatcggttcgttggaattctgatggctggcattttaccttttggcgcaatgttcattgagctttttttcattttttcagccatctgggagaatcagttctattatctcttcggctttctcttcctcgtatttatcattctggtggtctcatgtagtcaaatttctatagtgatggtatatttccagctatgtgccgaagactaccgctggtggtggcgcaacttcctcgtgagtggtggtagcgctttttacgtgctggtgtacgcaatcttttattttgtcaataagcttgacatcgtggaatttatcccaagtctcctgtatttcggatacacagccttgatggtacttagtttctggctcctcactggtaccattggtttctacgcggcttatatgttcgtgaggaagatctatgctgccgtgaaaattgactag

SEQ ID NO: 54946 - DNA, 735 bp, Artificial Sequence
  Description of Artificial Sequence: Synthetic coding sequence
atggcccagatgtttctggaacctctagcagataagtttatctactgtcaggttctgatgaactccgaaaagaaatgtgaggtgttgtgcagtcagtcaaataaacctgttaccctgacagttgaacaatctaggctagttgcggagcgtatcactgaagactactacgtacatcttatcgcagacaacttgcccgttgccactcgcttggagttgtatagcaaccgtgactctgatgacaagaagaaagagaaggatgtgcagttcgagcacgggtacagactcgggttcactgatgtgaataaaatttatctgcacaatcacttgtcttttatcttgtactaccaccgggaggacatggaggaggatcaggaacatacctacagggtggtgagattcgaggtaattccacagtccataaggctggaggacttaaaggccgacgagaaaagctcctgcacactgcccgaggggaccaatagcagtccgcaggagattgaccctacgaaagagaaccagctgtattttacctactccgtacattgggaggaatccgacatcaaatgggctagtagatgggacacatacttaacgatgtcagatgtgcaaattcactggtttagtatcattaactccgtggtggtcgtcttttttctctccggtatcctgtccatgattatcatcagaaccctccggaaggatattgctaactacaataaggaggacgatatatag

SEQ ID NO: 54947 - DNA, 1425 bp, Artificial Sequence
  Description of Artificial Sequence: Synthetic coding sequence
atggtccagcgcttctctttacgtaggcaattgtctaagattgagcgcttggaggtgagctctctcgcccagacaagctccgccgtggcttctagcaccgatggcagcatccatacagactcggttgacgggaccccagacccccagcggaccaaggctgctatcgcccatttacaacaaaagatcttaaagctgaccgagcagattaagattgcgcagacagcacgagacgataatgtcgccgagtaccttaaactggctaatagcgcggataaacagcaggccgcacgcattaaacaggtgtttgaaaagaagaatcagaagagtgcacagaccattctgcaactgcaaaagaaactcgagcactaccatcgcaagctcagggaagtcgagcaaaatggtatcccgagacagcctaaggacgtttttcgagacatgcaccaagggcttaaagacgtgggtgcaaaggtcaccggattttcggaaggggtggtggacagtgttaaaggtggcttcagctccttctctcaagccacgcattctgccgctggggctgtagtttctaagccgagagagatcgcttccctgatcagaaataaattcggctctgctgacaacatacccaacctgaaagatagtctggaagagggccaggtggacgacgccggtaaggcccttggagtgatatcaaattttcagtcatcaccaaaatacggttccgaagaagactgcagctccgccacaagcggcagcgtgggcgcaaactcaacaacaggcggtatcgccgtgggcgcttcttccagtaagacaaacacattggacatgcagtcttccggcttcgatgctttgttacacgagatccaggaaattagagaaacacaggctagactggaggaatccttcgagacactgaaggagcattaccagcgagattacagtctcataatgcagactctgcaagaagagagatataggtgcgagaggctggaagaacagctgaacgacctcacagaattgcatcagaacgagattctcaacttaaagcaggagctggcgtcaatggaggagaagatcgcataccagtcctacgaaagggctcgggatatccaggaggccctagaagcctgccaaacgagaataagcaaaatggagctgcagcagcagcaacagcaggtggtgcagcttgagggtctggagaacgccacagcccgtaatcttttgggcaagctcatcaacatacttctcgctgtgatggcagtcctccttgtctttgttagcaccgtggccaactgcgtcgtcccactcatgaagacccgaaatcggaccttttccactctatttctggtagtttttattgcctttctgtggaagcactgggacgccctctttagctacgtggagaggttttttagctccccgcgttag

SEQ ID NO: 54948 - DNA, 1962 bp, Artificial Sequence
  Description of Artificial Sequence: Synthetic coding sequence
atggagccatctggaagcgaacagcttttcgaggaccccgatccagggggaaaaagccaggacgctgaagccagaaaacagaccgagtcagagcagaagttatctaagatgactcacaatgctcttgagaatatcaatgtgatcggacagggactaaagcatctcttccaacaccagaggcgacgcagctccgtctcaccacacgatgtgcagcagatacaggccgacccagaaccagaaatggatctcgagagccagaacgcatgtgcagaaatcgatggggtgccaacccatcctaccgccctgaatcgtgtgcttcagcaaatcagagttccgcctaagatgaaacgaggcactagcctgcactctcggaggggcaagcccgaagcccctaaaggctccccccaaataaatcgcaaatccggacaggagatgactgcggtgatgcaatctggacgcccacgatctagttcaacaaccgatgcccctacttcctcagcaatgatggagatcgcctgcgccgctgcggctgcagccgcagcttgtttgcctggcgaggagggaactgccgagcgtattgagcgtctcgaagtgagttccctagcgcaaacaagctctgccgtggcctcttcaacagacggcagcatccatacggactctgtggacggaactcctgaccctcagagaaccaaagccgcaatcgcacatctccagcagaagatcctgaagctcaccgagcagatcaaaatcgcacaaactgccagggatgataacgtggctgaatatctgaagctagctaactctgctgataagcagcaggccgcacgtatcaaacaggtcttcgaaaaaaaaaatcaaaaaagcgcccagaccattctgcagcttcagaagaaacttgaacactaccacagaaaactgcgagaggtcgaacagaacggcatcccgaggcaacccaaggacgtgttcagagacatgcatcaggggctcaaggacgtgggcgctaaggtcacgggcttctcagagggtgtggtagattccgtcaagggaggattcagttccttctcccaggctacccatagcgcggctggtgcagttgtaagtaagccgagagagattgcttcactgataaggaacaagtttggatcagccgataacatccccaatcttaaagattctctggaggagggccaggttgacgatgcaggcaaagcactgggtgtgataagtaactttcaatcatctcccaagtatggctcagaagaggattgctccagtgctacctctgggtcggtgggggctaactccacgactggtgggatcgctgtcggcgcttcaagctccaagaccaatactcttgacatgcaatcaagcggatttgacgcactgttgcacgagattcaggaaattagggagactcaagcacgcctggaagagagttttgaaacactgaaggaacactaccagagggactatagcttgattatgcagacactacaagaagagaggtatcgatgtgagaggcttgaggagcaacttaatgacttaaccgagctgcaccaaaacgaaatcctcaatcttaagcaggaacttgcatccatggaagagaagattgcttatcagagttacgagagggcacgagacatccaggaggcactcgaggcttgtcagacccgaattagcaaaatggaactgcagcaacaacaacaacaggtcgttcagttagaaggactagaaaatgctaccgcaaggaacctgttggggaaactgatcaacatcctactggccgttatggccgttcttctggtctttgtcagcacagtagccaactgcgttgtgccgctgatgaagacacgcaataggaccttctccacactgtttttagtggtatttatcgcgttcctgtggaagcactgggacgcgcttttttcctacgtcgaaaggtttttttcttcccctcgctag

SEQ ID NO: 54949 - DNA, 1620 bp, Artificial Sequence
  Description of Artificial Sequence: Synthetic coding sequence
atgaagagggggacctccttgcattcccgacgaggcaaaccagaggctccaaaaggatctccccaaataaaccgcaaatccggccaggagatgaccgcggtaatgcagagtgggcgaccccgatcgagtagcactacagatgcgcctacaagctccgcaatgatggaaattgcgtgtgctgccgcagcggctgctgctgcttgtttgccaggagaagaggggaccgccgagaggatcgagcgcctggaggtttctagcctggcacaaacaagctctgctgttgctagctcgacagacgggtcaatccatacagacagcgttgacggaaccccagatccccagcgcacaaaggcagcgatcgcccacctgcagcagaagatcctgaagctgaccgaacagatcaagatcgcccagactgcccgagacgataacgtggccgagtatctgaagctggccaattccgccgacaaacagcaggcggcaaggattaaacaggtcttcgaaaaaaagaatcagaagtcagcccagactatcctgcagttgcaaaagaagctcgagcactatcaccgaaagctgagggaggttgagcaaaatggtattccgagacaacccaaggacgtctttagggatatgcaccagggattgaaagacgttggggctaaagtaacagggttttctgaaggcgtggtggatagcgtgaagggaggtttctctagcttttctcaagccacacatagtgccgcaggcgctgtggtatctaaacctcgagagatcgcgtctttgatacggaataagttcgggtctgctgataacattcccaaccttaaagactctctcgaagaggggcaggtcgacgacgccggaaaagctcttggcgtcatctcgaactttcagagctccccaaagtacgggagtgaagaggattgtagctcggcgacatccggttcagtgggggcaaattctaccacaggcggaattgccgtcggcgctagtagctccaagacaaataccctagacatgcagtcttctggatttgatgcgctgttacatgaaatacaggagattagggaaactcaggccagactggaggagagttttgaaaccctgaaggagcactaccaacgggactattccttgatcatgcagaccctgcaggaggagagatacagatgcgaaaggcttgaggagcagctgaatgacctcaccgagctccatcagaatgagatattgaatctgaaacaggaactggccagcatggaggagaagatcgcctaccagtcatatgaaagggccagagacattcaagaggcactcgaagcatgccagactcgaatcagcaagatggaactgcagcaacagcaacagcaggtggtccagttagagggactggaaaacgctacggctagaaatctgctaggcaagctcattaacatactgcttgccgtgatggcagtgcttcttgtgttcgtctcaaccgtcgctaattgtgttgtgcccctaatgaagacccgaaacaggaccttcagcacactttttctggtagtgtttatagcctttctgtggaagcattgggatgcactgttctcatacgtagaacgattcttctcgagtcctagatag

SEQ ID NO: 54950 - DNA, 990 bp, Artificial Sequence
  Description of Artificial Sequence: Synthetic coding sequence
atgcatcagggcctcaaagatgttggtgctaaagtcacgggttttagtgaaggggtggtggatagtgtgaaggggggattttctagtttcagtcaggccacgcattcagccgctggggctgtggtgtctaagccacgggagatcgccagcttgatccgaaacaagtttgggagcgctgataacatccccaatcttaaggacagcctggaggagggccaggtagacgacgccggtaaggcgttaggggttatatccaacttccaatcctcacccaaatatggtagcgaagaggattgttcttccgctacttctggaagcgttggagcaaattcgactactggaggtatagcagtcggggcatcaagctctaaaacaaataccctcgacatgcaatcctccgggtttgacgctctgctccacgagattcaggagatcagggaaactcaggcaaggctggaagagagtttcgagacactaaaggagcactatcaaagggattactcactcattatgcagacacttcaagaagaacgctaccgatgtgagcgattggaggaacagctgaacgacctgaccgaattacaccagaacgagatcttaaacctcaagcaagagctggctagtatggaagaaaaaattgcctatcagtcttatgaacgcgcaagagatatccaggaggccctggaggcctgccagaccagaatcagtaaaatggagctccagcagcagcagcagcaagtagtccagctggaggggttagagaacgcaacggccagaaatctgctgggaaaacttataaatattcttctggccgttatggcagtacttctcgtttttgtgagcacagtagcgaattgcgtggtccctctaatgaagacaaggaatcggaccttttcaacactcttcctggtagtatttattgcatttttgtggaagcactgggatgctttgttctcatatgtggagcggttcttcagttcaccacggtag

SEQ ID NO: 54951 - DNA, 1410 bp, Artificial Sequence
  Description of Artificial Sequence: Synthetic coding sequence
atgaagagcaaggaggaggagacggctgttgacaagggggatctggtggctcttagcctgcccgctggtcatggcgacacagacgggccaatatctctcgacgtgcctgacggggcaccagatccccaacgcactaaggccgctatcgatcacctgcatcagaaaattctgaagattaccgaacagatcaaaatcgagcaggaggctagagacgacaatgtggctgagtatttaaagctggccaataatgcagacaaacaacaagtgagtaggatcaagcaggtgttcgaaaaaaaaaatcagaaatcagcacaaactattgcgcagctccacaagaaattagagcactatcgcagacgattgaaggaaatcgagcagaatggaccatcgagacagccaaaagatgtattgagagacatgcagcagggattaaaggacgttggggctaatgttcgcgcaggcatcagtggcttcggcggaggggtcgttgagggggtgaaggggagcctgagcggtctttctcaggcaactcatactgccgtggtgtctaagcccagagaatttgcatccctgatacgcaataaattcgggtcggccgacaacatcgctcacctcaaggatccacttgaagatggtccacctgaggaagctgcacgcgcattgtcaggatcagcgactctggtatcttcccctaagtacggatcagacgacgagtgcagctccgctagcgcgagctcagcaggcgcaggaagcaattccggggcagggccaggcggagcgctggggagtcctaagagtaacgccttgtatggcgctcctggtaatctggatgccctgctagaagaacttcgcgagatcaaggaggggcagtcccacctggaggatagcatggaggatttgaaaacacaattacagagagactatacttatatgactcaatgtctgcaagaagagcggtaccggtacgaaagactggaagagcaactgaatgacctcacagagcttcaccagaatgagatgactaatcttaaacaggaactggcctcaatggaagaaaaagtcgcttatcagtcttatgagagagctagggatatccaagaagctgtcgaatcttgcctaacccgcgtcacgaaacttgagcttcagcaacaacagcagcaggttgtgcagctggagggcgttgagaacgctaacgctagagctctcctgggcaaatttatcaatgttatactcgcattaatggcagtgctacttgtgtttgtctcgaccatcgctaatttcatcacgcctctgatgaagaccagattgcgaattaccagtactacactattggttctggtgttatttctcctgtggaaacattgggattctttgacgtatttgctagagcatgtgctgctgcccagctag

SEQ ID NO: 54952 - DNA, 1455 bp, Artificial Sequence
  Description of Artificial Sequence: Synthetic coding sequence
atgaatcaagtcgttcagccactgatgtcacggcactcagcttgcagagggagccaggcgcatctttcctgggtggataagggggatttggttgccctatcgttgcctgccggacacggcgataccgatggacccatctcacttgacgtccccgatggcgcaccagaccctcagaggaccaaggctgccattgatcatctgcaccagaagatcctgaagattacggaacagatcaagattgaacaggaagctcgggacgacaatgtggccgaatacctcaagcttgccaacaacgctgataagcagcaggtgtccagaattaaacaggtgtttgagaaaaagaaccagaaatcagctcagaccattgcacagctacacaagaaactcgagcattacaggcgcaggctcaaggaaattgagcagaatggcccaagtcggcaacccaaggacgtgctccgagatatgcagcagggcttaaaggacgtcggtgctaatgtgcgggcaggcatatctggattcggcggaggggttgtggagggtgtcaaggggtctctctccggtttatctcaagctacgcatacagctgtggtgtcaaagccacgcgagttcgcttccctaattcgcaacaagttcggaagtgctgacaacattgctcaccttaaagacccactcgaggacggtcctccggaggaggccgcaagagcattgagtgggagcgcaacccttgtaagcagcccaaagtacggcagcgacgatgagtgtagttccgcttccgcaagttctgccggtgctggctcaaactctggggcaggacctggcggtgctctggggagtcctaaatccaacgcactttacggcgctcccggaaatttggatgcccttctggaggagctgcgggagattaaagaaggacagtcacacttggaggatagtatggaagacctgaagacacagttgcagagagactatacatacatgacccagtgtcttcaggaggagaggtataggtatgaacgccttgaggaacagctcaatgacctgacagaactgcaccagaacgaaatgaccaatctcaaacaggagctagctagtatggaagagaaagtggcctaccagtcttatgaaagagcccgtgatattcaggaggccgtggaaagctgtcttacccgggtaaccaagctcgaactgcagcagcagcaacagcaggtggtgcagctggaaggagttgaaaatgctaatgcaagagcgctgctgggaaagtttatcaatgtaattctcgcgttaatggctgttctgctagtcttcgtttccaccatcgccaacttcatcacacccttgatgaagacacgacttagaattaccagcactacgctgctggtgctggtgctgtttttgctgtggaagcactgggatagcctaacctacctcctcgagcacgtcctccttccctcttag

SEQ ID NO: 54953 - DNA, 2130 bp, Artificial Sequence
  Description of Artificial Sequence: Synthetic coding sequence
atgaaacgatgccggagcgacgagctccagcagcagcaaggggaggaagacggagcaggcctggaggatgcggcttctcatctacctggtgccgatctccgccctggagaaaccacgggagccaactctgccggaggtccgacaagcgatgcaggcgcagcggctgcccctaaccccggacccagatcaaagcctcccgacctgaagaaaattcaacagttatccgagggctcaatgtttgggcacgggttgaaacacctgttccattcacgacggagatcacgagagagagaacatcagacctctcaggattcacaacagcatcaacagcagcaaggaatgagcgatcatgacagtccagacgaaaaggagaggtccccggagatgcacagggtgagctatgccatgtcgctacatgacttgccggcaaggccaacagcctttaaccgcgtgctgcagcagattcgtagccggccatccataaagcgcggtgcatccctccattcctccagcgggggaggctcttcaggctcctcttcccggaggacgaaaagttctagccttgaaccacagagggggtctccccacttgcttaggaaggcaccccaagacagcagcctggcagcgatcctgcatcagcatcagtgccgccctcgttcaagttccacgactgatactgcccttctgctggccgacggcagcaatgtgtacttactcgccgaagaggccgagggaataggggacaaagtggataagggagacctggtcgctctgtcactcccagctggacacggcgacacagacgggcctatctctctcgacgtaccagacggggctcccgacccacaaagaacgaaggctgcgatcgaccacctccatcagaaaatcctgaaaatcacggagcagattaaaatagagcaggaggctagggacgataatgtggcagaatacctcaaattagccaacaacgctgacaagcagcaggtttcaaggattaagcaggtgttcgaaaagaagaatcagaaatctgcacagaccatcgctcagctgcacaaaaaattggaacattaccggcgaaggctcaaagaaatcgaacagaatggccctagtaggcagcccaaagacgttctgagagatatgcagcagggcctgaaggacgttggcgctaacgtgcgggcaggcattagcggtttcggcggaggggtcgtggagggtgtgaaaggaagtctttccggactgtcccaagcaacccacactgctgtggtgtcaaaacccagagaattcgcctccctgatacgcaacaagtttggctccgccgacaacatcgcccatctgaaggaccccctggaggatgggccacctgaagaggctgccagggctcttagcggatccgcgaccttggtttcttcgcccaagtatggatccgacgatgaatgttccagcgcctcggcttcatcagctggtgcaggaagtaatagcggcgctggccctggtggagctctaggaagccccaaatcaaacgccttgtacggagcccctggaaatctggatgcgctgctagaggagctccgcgagatcaaagaaggccaatcacatctggaggatagcatggaggacttgaagacgcaacttcaacgcgactacacttatatgactcagtgcctccaagaggagcgctatcgctacgagcgcctcgaggaacagctgaatgacttaacagaactccaccagaatgagatgacaaaccttaagcaagagttggcaagtatggaagagaaggtagcctatcaatcttacgagagggctcgggacattcaagaggctgtagaaagttgcttgacgcgggtgacaaagttagagcttcagcagcaacagcagcaggtggtgcagttagagggcgttgagaatgctaatgcacgcgctctgctgggcaagttcattaatgtaattctggcgctcatggccgtactcttagtattcgtcagcacgatcgctaatttcatcacgccgctgatgaaaacacgtctgcgcataacaagcacaacgttgttggtgttagtcctgttcctgctgtggaagcactgggatagtcttacttacctcttggagcacgtgcttttgccctcctag

SEQ ID NO: 54954 - DNA, 771 bp, Artificial Sequence
  Description of Artificial Sequence: Synthetic coding sequence
atgaaccaggtggtgcaaccactgatgtcgcggcattccgcctgtaggggatcccaggcccacctgtcctggttgtggacgtcagtgcccctctgctggccgcttaccgagttcccggctggcaccgtgaagatgaagagcaaagaagaggagacagcggtggataaaggagaccttgtcgcgttatctctgccagccggtcacggggatactgatggtccgattagcttggacgtccccgacggcgctcctgacccccagcggaccaaagctgccattgaccacctgcatcagaagattctcaaaatcacagagcagatcaaaatcgagcaagaggctcgtgacgacaacgttgccgagtacctgaagctggcgaataacgctgacaagcagcaagtgtcccggattaaacaggtattcgaaaagaagaatcagaaatccgcacagacaatcgcccaactgcacaaaaaactggaacactaccgcagacgacttaaagagatagagcaaaatggcccaagccggcaaccaaaggatgtgctgagagacatgcaacagggactcaaggacgttggggcaaacgtgagggcaggtatttctggcttcggcggaggtgtggtcgaaggagtgaaggggtctctctccggactcagccaggccacgcacacagcagtggtgtctaagcccagggagttcgcgtccttaatcaggaataagttcggctcagcggataatatagcccatctcaaagatcccctggaggacggatag

SEQ ID NO: 54955 - DNA, 1896 bp, Artificial Sequence
  Description of Artificial Sequence: Synthetic coding sequence
atgttcggccatggtctgaagcacttgttccactctagacggagatctcgagaaagagagcatcagacttctcaggacagtcagcagcatcagcaacagcagggcatgtcagatcatgattcgccagacgagaaggagagatcaccggaaatgcaccgcgtgagttacgccatgtcgctacacgacttgcctgcccgaccgaccgctttcaacagagtgctgcagcagattaggtcccgaccctcaataaagaggggagcctccctgcactcatctagtggaggcggttcgagtggatcttcttctcggagaaccaagtcctcttcccttgaacctcaacgcggttccccacacctgctcagaaaagcacctcaggacagctcattagccgctatactgcaccaacatcagtgtaggccgagatcatcgagcaccacggacaccgcccttctgctggcggatgggagtaacgtgtatctgctcgctgaggaagcggaggggatcggagataaagtggataaaggggaccttgttgcgcttagtcttcccgcaggtcacggggacactgacggccctatttctctcgacgtccctgatggcgctccagatcctcaacggaccaaagccgcaatcgatcacctgcatcagaagatcctgaagatcacagagcaaatcaaaatcgaacaggaagcacgtgatgacaatgtcgctgagtacctcaagcttgcaaacaacgccgataaacagcaggtgtctcgcattaagcaggttttcgagaaaaagaaccagaagtcggcccaaacaattgcccaactgcacaagaaactggagcattacagacggaggttgaaagaaatcgagcagaacggcccatctaggcaacccaaggacgtgcttcgcgacatgcagcaggggttaaaagacgtgggagcaaatgttcgggcaggaatcagtggattcggtggaggagtggtggaaggagttaagggatccttgagtggcctcagccaggccactcacactgccgtcgtgtcaaagcctcgagagttcgcctccttaatccgcaataaatttggcagcgccgataacatcgcacaccttaaagatccactggaggacggaccacccgaggaggcagcccgtgccctgagtggatctgctactctggtaagttctccaaagtatggatccgacgacgagtgttccagcgctagtgcgtcaagcgccggagcaggtagtaactctggggcaggcccaggtggtgccctgggcagccctaaatctaacgccctgtacggcgctccgggtaatctggacgcactcctcgaagaactgcgcgagattaaagaggggcagtcccacctggaggattccatggaggacctaaagacccagcttcagcgggactatacttacatgactcagtgcctgcaggaggagcgctacagatatgaaagacttgaggaacagctgaacgacctgaccgagctacatcagaacgagatgactaatctgaagcaagagctggcatccatggaggagaaggtggcttatcagagctacgaacgggctagggacatacaggaggctgtcgaatcttgtctaaccagagtgactaaactcgagctccaacaacagcagcagcaggtcgtgcaactggagggtgtcgagaatgctaatgctcgagcactgctgggaaaatttatcaatgtgatactggcgctcatggcggtactgttggtgtttgtgagtactatcgctaattttatcactccattgatgaagactaggttaagaataacttcgaccaccctcctggtcctggtcctcttccttctctggaaacattgggactccctgacatatctgctggagcacgtgttactgccaagttag

SEQ ID NO: 54956 - DNA, 1434 bp, Artificial Sequence
  Description of Artificial Sequence: Synthetic coding sequence
atgccagggtccgacacagcacttacagtggaccggacctactcgtatcccggtcggcaccataggtgtaagtctagagtagaaagacatgacatgaacacactttcgctgccacttaacatccggcgaggcggtagcgacacaaaccttaacttcgacgtcccggatgggatcctggactttcacaaggtgaaactgacagccgactccctgaaacagaagatattgaaagtgactgagcagatcaaaatcgagcaaacctccagagatggtaatgtggccgaatacctgaaactggtgaataatgcagataagcaacaagccggaagaataaagcaagtattcgagaaaaagaatcagaaatcagcacacagcatagcccagctgcaaaaaaaattggagcagtaccacagaaaactcagagaaatcgagcaaaacggtgccagcagaagctccaaggacatcagcaaggaccacctgaaagacattcacagatccttaaaagatgcccacgtgaaatcaaggactgcacctcattgtatggagtcctccaaatcaggcatgcctggagtgtcactgactccccctgtgtttgtatttaacaaatcacgagagttcgcgaatctcatcaggaacaaattcggtagtgccgacaatatcgctcacctgaagaattcactggaggaattccgcccagaagcctctgcaagggcttacggcggatccgctaccatcgtgaacaaaccaaaatacggttcagacgacgaatgtagtagtgggacaagtggctctgccgactcaaacggaaaccagagctttggcgctggtggtgcctccacgctcgattcacaaggtaaactggcggtgatcttagaggaattgagagagataaaagacactcaggcccagctggccgaagacattgaggcgcttaaagtgcagttcaagcgagagtacggtttcatatcccaaaccttgcaggaggagcgctatcgctacgagcgcctggaagaccagctccatgacttgacagatcttcaccagcatgaaactgcaaaccttaaacaggaactggccagtatcgaggagaaggtggcgtaccaggcctacgagaggtcgcgcgacatacaggaggcgctggagtcttgtcagacaagaatctccaagcttgagttgcatcagcaggaacagcaggccttgcagaccgataccgtgaacgccaaggtcctgctcggccgatgcataaatgtgatcctagcctttatgacagttatcttagtttgcgtgtcaacaattgcaaagttcgtgtcccccatgatgaagtctagatgtcacatcctgggcacgttttttgccgtgacattgctagccatattctgtaaaaactgggaccatatcctttgcgccattgaaaggatgattattccgcgatag

SEQ ID NO: 54957 - DNA, 549 bp, Artificial Sequence
  Description of Artificial Sequence: Synthetic coding sequence
atgagcacttcatcatcctccagttgggacaacttactagaatcactaagtctgtccacggtttggaactggattcaggccagtttccttggagaaaccagcgcccctcagcagacctctctcggactcctggacaatctggccccagcagtgcaaattattctacggatatccttcctgatactcctgggcattggtatatacgcgctgtggaaaagaagcatacagagcatacagaaaactctgctgttcgtgattactctgtataagctgtataagaaaggaagtcacatattcgaggcgctcctcgcaaatccggagggatctggccttaggatccaggataataacaacctctttctgtcactgggtctccaggagaagattctcaagaagttaaagaccgtggaaaataaaatgaagaacctcgaggggatcattgtggcccagaagccggcaacaaaacgggattgttcaagcgagccatactgttcttgttctgactgccagtcaccattgagtacctctggattcacatcacccatttag

SEQ ID NO: 54958 - DNA, 2034 bp, Artificial Sequence
  Description of Artificial Sequence: Synthetic coding sequence
atgaaggtcctggggagatctttcttttgggtgctgtttccagtgctaccctgggccgttcaggccgtggagcacgaagaagtggcccagagggtgatcaagttacacagagggagaggtgttgctgccatgcagagtaggcaatgggtccgtgactcttgtcggaagctgtccgggctgcttcgtcaaaaaaatgctgtgctgaacaaactaaaaaccgctatcggcgctgtggagaaggatgttggtttgtccgatgaagagaagctgttccaggtccacacattcgaaatttttcagaaagagctcaacgagtccgaaaattcagtctttcaggccgtctacggactgcaacgtgcactacagggggattacaaggatgtggtcaatatgaaagaaagttcgcgccagaggctggaagcactgcgtgaagcggcaatcaaagaggaaactgaatacatggagctcttggccgctgagaagcaccaggttgaggcccttaagaacatgcagcaccagaatcagagtctgtctatgctcgacgagatcctggaggatgttcggaaggctgccgaccggttggaggaagaaatcgaagagcatgctttcgacgataacaagagcgtgaagggcgtgaacttcgaagctgttctgagggtggaggaggaggaggctaattcaaaacagaatattaccaaaagagaggtggaggacgatcttgggctgagcatgctgatcgactcccagaacaatcagtatatcctaactaagccgagggatagtaccattcctcgggctgaccatcacttcatcaaggacatcgtaaccatcggtatgttgagcctcccttgcggttggctttgtaccgcaatagggctgcctacaatgttcggatatattatttgcggagtgctgttaggcccttccggtctgaactctattaaaagtattgtgcaagtggaaacactgggggagttcggggtcttcttcacattgtttctggttgggctcgagttcagtcccgaaaagcttagaaaggtgtggaagatttctctccagggtccttgttatatgacattactcatgatcgcttttgggctgctgtggggacacctgctccgcatcaaacccacgcagtccgtctttatctccacttgcctgagcctgagttcgacacctctggtttctaggttcctcatgggaagcgcacgtggagacaaagaaggagatatcgattattctaccgtgctgctcggaatgctcgtcactcaagacgttcaactcggcctgtttatggctgttatgcccaccttaatacaggccggagccagcgcgtcaagttcaatcgtcgtggaggtgctcagaatcttggtcctcatcggacaaatactgttcagcctggccgcagtgttcctgttatgtttagtgattaaaaagtatttgatcggaccatattataggaaattgcatatggagagcaagggtaacaaagagatcctgattttagggatctcggctttcatattcctgatgctaacagtgactgaactgttggatgtgtcaatggaacttggttgtttcttggcaggtgcgttggtttcctcccagggacctgttgttacagaagagattgccacctccatcgagcctatccgagactttttggctatcgtttttttcgcatccatcgggctccatgtgttccccaccttcgtagcgtatgaactgacagtcttggttttcctaactctgagcgtcgtcgtaatgaaattcttactagcagccttggttctttcacttatccttcctaggagcagtcagtacatcaaatggattgtctccgctggtcttgcgcaggtctccgagtttagttttgtgttaggatcccgcgctcggagggctggcgtcattagtagggaggtttaccttttgatcttatctgtgactacgctaagcctcttactcgccccagttctatggagagccgctatcactagatgtgtgccccgtcccgagagaagaagcagtctatag

SEQ ID NO: 54959 - DNA, 1905 bp, Artificial Sequence
  Description of Artificial Sequence: Synthetic coding sequence
atggcgatgtggaaccgaccttgccagagactgccacaacagccgctggtggcggagcccactgcggagggggagcctcacttacctaccggaagggagctgaccgaggcgaatagattcgcgtacgccgcactgtgtgggatctccctgagccagctttttccagagcccgagcattcctctttttgtactgagtttatggccggtctggtccagtggttggaactttcagaggccgtcctccccactatgacagcctttgcatctgggctgggtggcgagggagcggacgtgtttgttcaaatcttactgaaggatcccatcctgaaagacgaccccaccgtaattacccaggacttgttgtctttttctcttaaggacggacattacgatgctagagcccgagtccttgtctgtcacatgacctccctgctacaggtgccccttgaagagctcgatgtgctggaagagatgttcctcgagagcctcaaagagatcaaagaggaggaaagcgagatggccgaagcctcccgtaagaagaaagagaatcggcgaaagtggaagcgttatttgctgatcggtcttgccaccgtgggagggggaaccgtcatcggagttacaggcggactggccgctcctctggtcgctgcaggggcagctactatcattgggagcgcgggtgcggcagccctgggttccgctgccggaattgccattatgacttcactgttcggggctgcaggtgccggactcacgggctataaaatgaaaaagcgggtgggcgcaatagaagaatttacttttctccccctaactgagggtcgccagctacatattacaattgccgtcactggctggctagcatccgggaagtacagaacgttcagtgccccatgggccgcactcgctcacagcagggaacagtactgtttggcctgggaggccaaatatctaatggaacttgggaatgccttagagaccatcctatccggtttggcgaatatggtcgctcaagaagccttgaagtacacagtgctttctggcattgtggctgctctcacatggcctgcctctctgttgtccgtagctaacgtaatcgataacccttggggcgtctgcctgcatcgcagtgcagaggtgggtaaacacttggcacacatcctgttaagcagacaacaagggcgtaggccagtcacccttattggattctctctaggcgcacgcgtgatctacttttgcctgcaggagatggcccaggagaaagactgtcagggcatcattgaggatgtcattctgctgggcgctcccgtggaaggggaggcgaaacactgggagccctttcgaaaggtggttagcggaaggataataaatgggtactgcaggggtgattggcttctgagttttgtgtaccgcaccagttccgtccagctgcgcgtggcaggccttcaaccggtccttctgcaggataggcgagtagagaatgttgacctgacaagtgtggtcagcggccacctagattatgcaaagcagatggacgcaatattaaaagcggtcgggatacgaacaaaacccggttgggacgaaaagggcctgttattggccccaggttgcctgccctctgaggagcccagacaggccgctgccgctgcatcttctggtgagacgccacaccaggttggacagacccagggacctattagcggagacacctccaaacttgccatgagtaccgacccctcacaagcgcaggtacccgtgggactggaccagagcgaaggagcttcccttcccgcagccgcatctcctgagaggccccctatatgctcgcacggaatggaccccaatccattgggatgccccgactgcgcatgtaagacgcagggcccaagcaccggtttggattag

SEQ ID NO: 54960 - DNA, 1785 bp, Artificial Sequence
  Description of Artificial Sequence: Synthetic coding sequence
atggctatgtggaatagaccatgccagcggttgccccagcaaccacttgtggcggaacctaccgcagagggagaaccccatctgcccaccggcagggagctgaccgaggcaaatagatttgcttacgcagccctgtgcggcatttctctctctcagctgttcccagagcccgaacactcctctttctgcacggaatttatggcagggttggttcaatggctggagctgagcgaagcggtcctcccaactatgacagccttcgcctccggcctcgggggagaaggcgcagacgtttttgtacagattttgctgaaagacccaattcttaaagacgatcccaccgtaatcactcaagacctgctctcttttagcctcaaggatggtcattacgacgctcgggctagagtactagtgtgtcatatgacgtcgctgctacaggtccccctcgaggaacttgatgttcttgaagagatgtttttggaatctctgaaggaaatcaaagaggaggagtcggaaatggccgaagctagtcgaaagaagaaggagaatcgcagaaagtggaagcgctacttactgatcgggttggctaccgtcgggggtggcacagtcatcggtgtgaccgggggtctcgctgcaccactggtcgcggcaggagcagccaccatcattggctcagccggagctgccgctttaggatcggccgcaggtattgcgatcatgacgtcactgtttggagcagctggagccggacttactggcactttttccgccccttgggcagctctggctcattctcgcgagcagtactgcctcgcctgggaggccaagtatttaatggagctgggcaatgcacttgagaccatcctcagcgggctggccaatatggtcgcccaggaggcccttaaatatactgttttgagtggaattgtagccgctctgacatggcccgcttccctgctatctgtggccaacgttatcgacaatccctggggggtgtgcctgcacagaagtgccgaagtggggaagcacctcgcccatattctgctgagccgacagcaggggcgaaggccagtgactcttatcggattctccctgggggcacgtgtgatctacttttgtctgcaggagatggcccaggagaaagactgccagggaatcatcgaagacgttattttacttggagctcctgtagagggcgaagctaaacattgggaaccattccggaaagttgtttcgggacgtatcatcaacggctactgcaggggagactggctgctctcatttgtgtaccgaacaagtagcgtgcagcttcgcgtagctgggctgcagccagtgttgctgcaggacaggagagttgagaatgtcgatctgacgtccgtcgttagcggacatcttgattatgcgaagcagatggacgccatcctgaaagccgttggcattaggacaaaacctggctgggatgaaaaaggtctcctgctcgctccaggttgcctccctagcgaggagcccagacaggcagcagctgcagcttcttcgggagaaacaccacatcaggttggtcagacacaaggcccaatcagcggggacacttccaaactggccatgtcgactgatccctcacaggcccaggttcctgtcggcctggaccagtcagaaggcgcttccctcccggcagctgcctctcctgaacggcctcccatatgtagtcacgggatggatcccaatccccttggctgtccagactgcgcttgtaagacgcagggaccaagcactgggttggattag

SEQ ID NO: 54961 - DNA, 1743 bp, Artificial Sequence
  Description of Artificial Sequence: Synthetic coding sequence
atggctatgtggaatcggccatgtcagcgacttccccaacagccactggttgcagaacctaccgccgaaggggaaccacacctgccaaccgggagggagctgaccgaggcaaaccggtttgcttacgccgctctgtgtggcatctcactgagccagctgtttcctgagcccgagcactcttcattttgtacagaattcatggcagggctcgtgcagtggttagagctgagtgaggctgtccttccgaccatgaccgctttcgcctcagggttgggtggggaaggtgccgatgtgttcgtgcagattcttctcaaggatcctatactcaaggatgatcctactgttataacccaggatctgctgtcattctccttaaaagatggccattacgatgctcgcgctagagttctggtttgccacatgacatctctgctgcaggtgccactcgaggaactggacgttctcgaggagatgttcctcgaatcattgaaggaaatcaaggaagaagagtcagaaatggccgaggcctcccgtaagaaaaaggagaataggaggaaatggaagcggtacctgctgatcgggctggctaccgttggaggcggaacagtgatcggggtgactgggggattggcggctccgctggtagccgctggagctgctaccattatcggatcagctggcgcagctgctctgggaagtgcagctggcattgcaattatgaccagcctctttggcgcagcaggggcaggcctgactggctataagatgaaaaagcgggtgggggcaatcgaggagttcaccttcctgccccttaccgaaggcagacagctgcacataaccatcgctgtcacggggtggttggcctccgggaagtaccgcaccttttctgctccctgggccgctctggcccacagtagagagcaatactgtttagcttgggaggccaagtatcttatggaactgggcaacgcactcgagactatcctctcaggcctcgccaatatggttgcccaggaagccttgaagtataccgtgttatcgggaattgtggccgcactcacatggccggcatccctcctgtcagtggctaacgtaattgacaatccatggggtgtgtgcctgcaccgttctgcggaggttggcaagcacctcgcccacatcctcctaagcaggcagcagggcagacggccagtaaccctgatcggatttagcctgggagctcgggttatttacttttgtcttcaggaaatggcccaggaaaaggattgccagggcattattgaagatgtcatcctgttgggggcaccagtggagggggaagccaaacactgggagccctttaggaaagtggttagtgggcgaattatcaatgggtactgcagaggggattggctcctcagctttgtttacaggacaagctcggtgcagcttcgagttgcagggttacagccagtgctcctccaagatagacgagtggaaaatgtggaccttacctccgttgtctccggacacttagattatgcaaagcaaatggacgccattcttaaggctgtgggcattagaacgaagcctgggtgggatgaaaagggccttctcctggcaccagggtgtttaccttctgaggaaccacgccaggctgcggcagccgcaagtagtgcactggagagtggttgtccgagtgggggaccagagggcagcctaggccctgaagcacctacaccagccctcccctggccccaatag

SEQ ID NO: 54962 - DNA, 867 bp, Artificial Sequence
  Description of Artificial Sequence: Synthetic coding sequence
atggagatctcacgcctggcccagagcaagaggaacatcatctctctgaacatggatctggaaagagatactcaacgaatcgatgaggctaatcagaagctcctgctgaaaatccaagaacgggaagacaagattcagagactagagtctgagatcattcagacccgcggtcttgtcgaagatgaggaatgggaaaaggaaaatcgtacgacgatggagagagaacgtgctctgcaggaactagaggaggaaactgctaggctcgagcgtaagaacaagacccttgtccactcaatcacagaactgcagcagaaactgacccgtaaatcccagaagataactaattgtgagcaaagttcccctgatggggctttggaggagaccaaggtcaagctgcagcaactagaggcatcatacgcttgccaggagaaagaactactcaaggtgatgaaagagtatgcctttgtgacccagctgtgcgaggaccaggctctgtatatcaagaagtaccaagagacactgaagaagattgaggaagaactagaggctttgtttctcgaacgcgaggtctccaagcttgtctctatgaatcccgtcgaaaaagaacacacgagccaaaataatgagggcacacccacacagaaaacagcgaggctgttctcaaagaagatattctgctgcctgttcttcatcaccctattcttcatcaggttactgtcctatatgttttttcacgttaggttcattaatcctgacctgcttgtgaacgtgctgcctaaggtgttaggcaggtccaccctgtggaagctccgctgtttctttttccccagccttaccttggaaacagaagacatgctgccccattag

SEQ ID NO: 54963 - DNA, 687 bp, Artificial Sequence
  Description of Artificial Sequence: Synthetic coding sequence
atggaaatttccagactcgcccagtccaaacgaaatatcatctcattaaatatggatctcgaacgggacacacagaggatagatgaagccaaccagaagctactgctcaaaattcaagaaagagaggacaagatccaaagactagagtctgaaatcattcagacacgcggtctggtggaagatgaggaatgggagaaagaaaaccggaccactatggaacgggagcgcgcacttcaggaattagaggaggagactgcccgtttggaacgtaaaaacaaaaccctggttcactcaatcacggaactgcagcaaaagctgactcggaagagccaaaagattacaaattgtgaacaaagctcccctgacggggctctggaagagacgaaagtgaagctgcaacagctggaggctagttacgcctgtcaagaaaaggagttactaaaggtgatgaaagagtacgctttcgtgactcagctgtgcgaggaccaggctttgtatatcaagaagtatcaggagactctgaaaaagatcgaagaagagcttgaggcactgtttctggagcgggaggtatccaaactggtctctatgaatcctgtcgaaaaagagcacacgtcgcagaacaatgaaggcacaccgactcagaagactgccagactgttttccaagaactggcaccattctttttag

SEQ ID NO: 54964 - DNA, 246 bp, Artificial Sequence
  Description of Artificial Sequence: Synthetic coding sequence
atggagatctcccggctggcccaatccaaacgcaacattatatctttaaacatggatctcgagagagacactcagcggatagatgaagccaaccagaagttgctcctcaagatccaagagcgcgaggataagattcagcgactcgaatccgagatcatccagacaaggggactcgtggaggacgaagaatgggaaaaggagaatagaacaaccatggagagggagcgtgctctgcaggagctgtag

SEQ ID NO: 54965 - DNA, 435 bp, Artificial Sequence
  Description of Artificial Sequence: Synthetic coding sequence
atggaaatctcccgcctggcccagagcaaacgaaatattattagcctgaatatggatctggagcgagatacccagcgcattgatgaggccaatcagaaattgttgttaaaaatacaggagagagaagacaagatccagcggctcgaaagcgaaataatacagactaggggcctcgttgaggacgaagaatgggagaaggagaacaggaccactatggagcgagagcgagccctccaggaactcgaagaagagaccgccagactggaaaggaaaaataagacattagtgcacagcatcactgaattacagcagaaattaacacggaaaagccaaaagatcaccaattgcgaacaaagttcacctgacggggcactggaggagactaaagtgaagctacagcaactggaagcctcctacgcctgccaggaaaaatag

SEQ ID NO: 54966 - DNA, 687 bp, Artificial Sequence
  Description of Artificial Sequence: Synthetic coding sequence
atggagattagtagacttgcccagtcaaagagaaatataatatcccttaacatggatcttgaacgggatacccagagaattgacgaggccaaccagaagctgctcctcaagatccaggaacgtgaagacaagattcagagacttgaatcggagatcattcagaccagaggcttggtcgaggacgaagaatgggaaaaagagaaccggaccacaatggagagagaacgcgctctgcaagaactggaggaagagactgctagactcgaaagaaaaaataagaccctagtgcattccattactgaactgcagcagaagctgactaggaagagtcagaagatcactaattgcgagcagtcatcacctgacggggctttggaagaaacaaaagtgaagctgcaacagctggaagccagttatgcctgtcaggagaaagagctcctgaaagtcatgaaggaatatgccttcgtcacccagctgtgcgaggaccaggcgctgtatattaagaaataccaggagacgctgaaaaagattgaagaagagctggaagctctgtttttagagcgtgaggttagcaaattggtaagcatgaaccctgtggagaaagagcatactagccagaataacgagggaactcccactcagaagactgctaggttattcagcaaaaaatgggcatctagcttttag

SEQ ID NO: 54967 - DNA, 216 bp, Artificial Sequence
  Description of Artificial Sequence: Synthetic coding sequence
atggagatctcgcggctcgcccagtcgaaacggaacattatctcgctgaacatggatttagaaagagatacacagagaatcgatgaggctaaccagaaactcctgctaaagatccaggagagagaggacaagattcaacgcctcgaaagcgaaattatccagactagagggctcgtagaagacgaagagtgggaaaaggaaaataggacaacatag

SEQ ID NO: 54968 - DNA, 3285 bp, Artificial Sequence
  Description of Artificial Sequence: Synthetic coding sequence
atggcagctcggcaagccgtcggatcaggcgctcaggagacctgcggactggatcgcatcctggaggccctcaaattactcctatcacctggcggaagcgggtcctccagcctccaagtcacaaaacacgacgtgctactcgccaccttgaagtccaatctgagcgctttggaggataaattcttgaaggaccctcaatggaagaatctcaagttgctgcgggacgagattgcagacaaggcggaatggccccagaacagcgtcgatgtcacatggagcttcacctcacagaccctactgctgttgctgtgcctcaaggagaccatgattcgactggctgcaaactttaacccgggtaagccaaatccgagaaccccagaggtggccccagctctgtcaccggacgcacttagtatttcccaacagaagactgtccagtttgtactccagttcgtggtgacgcttggaatttgcccatatctcatgccaggcgtgggcgtcccgctacggtatcgaacagagttcggcgctgtcgtgcaggacgtggtttgtttcgatgcggcacctgacgctactagaaggttgtatacatcctgcaaggcactactgaatgtcgctcaacacacctccctaggcagcctcattttctgtcaccacttcggagacattgccgctggcctgtgccaacttggattttgtccaacaaaacggaagttgttgacccctgcagaagaggtattgaccgaagaggagaggaccctatctcggggtgcactgcgcgacatgctggaccaagtgtaccagcccctcgcagttcgagaactgctgatactgcagggtggcccacctcagtcttgcacagatgtgaaaacccagatgcgctgcagagcccctgcttggttgaggagactgtgcggacaactccttagtgagcgactgatgcgcccaaacggggtgcaggctgtcgtcagagggatactcgaaggagccggtgccggagcggcaggcggatccgatgcagaagtgactgcagcagactggaaaaagtgcgatcttattgccaagatcctagcctcgtgtcctcagcagtcactgagtccagagaattactatcgcgatatatgccctcaggtgcttgacttattccacttccaggacaaactcaccgccagacagtttcagcgagtcgcgacaacaacctttataacactttctcgggagcggcctcacctcgcggcaaaatatctccttcaaccggtgcttgctccactacaccggtgccttaatactgcagagttatctgaatccgacatggtgcccggaaccatcctcgtcaccgaagaagagttgtctaggtgcatcgaagacgtcttcaaggtgtacgtggttggcaatgagccactcactgtgctcatggacagccttctccccgtgctgggagttctgtttctgctgtactgcttcaccaagcagtcagtctcacacatcaggtctctttgccaagagatactattgtggatccttggtaagttggaacggaagaaggctatcgcctcgttaaaagggttcgccggtctcgacaaggccgtccccagcctgcattcactctgccagtttagagtcgccacgcagggtggcataatgattaccattaaggaagctatctcagacgaagatgaagatgaagccttatatcaaaaggtgagtagcgagcaaggacgagttgaacacttaggcgaccttctcagccattgtcaggagtgtggactcgccggagacttctttattttttgcttgaaggaattgacccatgtggccagcgagaacgaaaccgaacttaaaacagaacctttcagttctaagagtttactggaactcgaacaacaccagactcttctggttgaaggccaagagcggaagctattagtgttacaactgatggccgtgctgtgtgagcgaatgtccgagcagatcttcaccaacgtgacacaggttgtggacttcgttgctgcaacgctacagcgcgcatgtgcctccctcgcacaccaggcagagagtaccgtggagagtcaaacgctgagtatgagcatgggactggtggccgtaatgcttgggggagctgtgcagctgaagtcttctgatttcgcagtgctgaaacagctgttgccgctcctggagaaagtgagcaacacgtacccagaccccgtgatccaggagctggcagtcgatttgcgtatcacaatttccactcatggcgctttcgcgactgaagccgtgtcaatggcagcacaatccaccttgaatcggaaagacctggaggggaagattgaagagcagcagcagacctcccacgaaagaccaactgacgtcgctcatagtcacctggagcaacagcagtctcacgagaccgccccacagactggactgcagtccaacgcgccaataatcccgcagggtgtgaatgaacccagcactaccacatcacaaaaaagtggatccgtaaccactgagcagttgcaggaggtcctccttagcgcctacgaccctcagatccccacccgggctgcagcccttagaacactgtcccattggatagaacagagggaggccaaagcgctggaaatgcaggaaaagctgctgaaaatttttctggagaatttggaacacgaagacacttttgtctacctctcagctatccaaggagtcgcactgctatctgacgtctatccagaaaagattttgccggatctcttagcacagtatgattccagcaaggacaagcacaccccagagactcggatgaaggttggcgaggtcctaatgcggatagtacgggctcttggtgacatggtctccaaatacagggagccattgatccacacctttttgcggggagtcagggatcccgatggggcacatcgcgcatcatcacttgctaatttaggcgagctgtgccagcgtctagactttctgttgggctccgtcgtgcacgaagtgaccgcatgcctaattgcagttgccaaaaccgacggtgaggtccaggtgagacgcgctgccatccatgtggtagtgcttctcctgaggggcctaagccagaaagccaccgaggtgttgtccgctgttcttaaggacctgtaccacctgctgaaacatgttgtgtgcttggagccagatgatgtggctaaactccatgcccagttggcattggaggagttggatgacatcatgaaaaacttcttattcccaccgcaaaagcttgaaaagaaaataatggtgctgccatag

SEQ ID NO: 54969 - DNA, 789 bp, Artificial Sequence
  Description of Artificial Sequence: Synthetic coding sequence
atggcctggaagtcctcggtgatcatgcaaatgggacggttcctgttgctcgtgattctcttcctacccagggagatgacatcctcagtgctgactgtgaatggtaagactgaaaattacatcctggacacaacacctgggtcccaggcaagtcttatctgtgcagtacagaatcacactcgagaagaggagcttctctggtatcgcgaggagggacgagtcgatctgaaatcaggcaataagatcaactctagcagcgtgtgcgtcagttcgattagcgagaatgataacggaatatcattcacgtgccgtctaggaagagaccagagcgtgtccgtgtctgtggtcctgaacgtgacctttcccccacttttatccgggaacgacttccagaccgtagaagagggatcaaatgtcaaacttgtttgtaatgtcaaagctaacccacaagcccaaatgatgtggtataagaactcctccttacttgatctggagaaaagccgacaccagattcagcagacatctgagagtttccagctgtcaattaccaaggtggaaaagcctgataacgggacttattcgtgcatcgctaaaagctcactaaagaccgagagcctcgactttcacttgatcgtaaaagacaagacagtcggagtccctatcgaacctattatcgccgcatgcgttgtcatttttctgactctgtgcttcggtcttatcgccagacgcaagaagatcatgaaattatgtatgaaggacaaggacccccacagcgagacagctttgtag

SEQ ID NO: 54970 - DNA, 657 bp, Artificial Sequence
  Description of Artificial Sequence: Synthetic coding sequence
atggcctggaaatcaagtgtcattatgcagatgggaaggttcctgctcttggtgatcctgttcctgcctagagagatgacgtcaagcgtgctgactgtgaacggcaagacggagaactacatccttgacacaacccccggaagccaggccagcttgatttgcgcggttcaaaatcacacgagagaagaagagttgctctggtaccgtgaagagggtagagtggacctgaagtccggcaacaaaattaacagctcgtcggtctgtgtgtctagtatttctgagaatgacaacggcatctcctttacgtgcaggctgggcagagaccaatctgtttccgtttccgttgttctcaatgtgaccttcccaccactcctctctggcaatgattttcaaacagtagaggaaggaagtaacgtcaagctggtttgcaacgtgaaagcaaacccacaagcccaaatgatgtggtacaaaaacagctcgctgcttgatttagaaaagtcacgccatcagatccagcagactagcgagtcgttccagctgtcgataacgaaagtggagaaacctgacaatgggacatattcgtgcatcgccaagagcagtctgaaaacagaatctttagattttcacttgatcgtgaaggctttgcaacaaggttag

SEQ ID NO: 54971 - DNA, 849 bp, Artificial Sequence
  Description of Artificial Sequence: Synthetic coding sequence
atgggttcgccaggcatggttttaggtctgcttgtccagatctgggcactgcaggaagctagctctctcagcgtgcaacagggccctaatctgctgcaggttaggcaggggtcgcaagccacattggtgtgtcaggtcgaccaggccacagcatgggaacgactcagggtgaagtggaccaaagatggtgccattttgtgccaaccatatattacaaacgggagcctcagtctgggtgtctgtggaccacaaggccgactgagttggcaggccccatctcacttgacccttcaacttgatccagttagcctcaaccactctggagcgtacgtgtgctgggctgcggtcgaaatccctgagttagaggaggctgaggggaacattaccaggctttttgtcgatcccgacgacccaacccagaataggaacaggatcgctagcttccctgggttcctgttcgtcttgctgggcgtcggttctatgggagtggccgctatcgtgtggggcgcatggttctggggcagaagaagttgtcagcagcgcgactcaggcaatagtcctggcaatgctttttacagcaatgtactataccgacccaggggcgctcctaaaaagtctgaggattgtagcggtgagggtaaggatcagcgcggtcagtctatatattcaacttccttccctcaacccgctcctcgacagccacacctggcgtctcgaccgtgcccgagtcctaggccttgcccatcccccagacccggacacccagtttctatggtgagggtttcccctaggccatcacccacccagcagccaagacctaaaggcttccccaaggtcggagaagagtag

SEQ ID NO: 54972 - DNA, 2325 bp, Artificial Sequence
  Description of Artificial Sequence: Synthetic coding sequence
atgaaccccttctacttccacgcagtgaatataatcctgcactgtttggtaaccttagtgctgatgtatacctgcgataaaaccgttttcaagaatcgtggcctcgcatttgttacagccctattgttcgccgtccaccccatccataccgaggccgtggctgggattgtgggcagggccgacgtactggcgtgccttttgttcctgctggcctttctgtcatacaatcgatccctcgatcagggctgtgttgggggttcctttccttccaccgtatctccgttctttctgttactgagcctgttccttgggacgtgcgctatgctcgtcaaggagaccgggatcaccgtgtttggcgtatgcctcgtatatgaccttttcagcttgagtaataagcaggataagtcttcgaacggcgcactgtgccccaggtctccccagcagcctgggtcaccccaacccagctcactgcccggacaccctcaccgcgaaaacggcaaacagcagcgtttccctcataagggggcttggggcggatgccactccccgcttcctcccgagcctaaatccagcggttttcctgtatcgccgcgtgctgtttggtcaatgatgcgatttctaacatactcttacctgctggctttcaacgtgtggctgcttctggccccagtcacactatgctacgactggcaggtaggaagcatccctctagtggagactatttgggacatgagaaacctggcaacgatttttctggcagtagtcatggcattgctgtcgttacattgtctcgccgcattcaaacgactggaacacaaagaagttctggtaggtctactgtttctggtgttcccgttcattcccgcatcgaacctgtttttccgggtcgggttcgttgtcgcagagcgggtgttatatatgccatcaatgggctactgcattttattcgtccacggattatctaaactgtgtacttggctgaatagatgtggagctaccacccttattgtttccaccgttctcctcctgcttctgttcagctggaaaaccgtaaaacaaaatgaaatctggttaagtagggaaagtctgttccgcagcggtgtacagacccttccccataacgcgaaagtgcactacaattacgctaactttctgaaggatcaaggaagaaataaggaggcgatctatcattatagaaccgccctgaagctgtacccgagacatgcttccgcactcaataacctgggcactctcactagagacactgcagaagcaaagatgtattaccagcgtgccctacaactccacccccaacataacagggccttgtttaacctggggaatcttctcaagtcccaggagaaaaaggaggaagccattacgctgctcaaggatagcataaagtatgggcctgagttcgccgatgcctattcatcccttgcttcattgctcgcagagcaggagcgattcaaggaggcagaagagatctaccaaaccgggatcaagaattgtcccgattcctccgatctgcacaacaactatggggtcttcctggtcgataccggcctgccagagaaagctgtggcccactaccagcaggccatcaaactatccccctctcaccacgtggccatggttaacttgggcagactgtacaggtctctcggagaaaattcaatggctgaggagtggtacaagcgtgccctgcaagtggcccacaaagctgaaattctgagcccactgggagcattgtactataatacgggcaggtacgaagaagcacttcaaatataccaagaggccgctgccctgcagccttcacaacgggagctacgcctggccctggcacaagtgcttgccgttatgggccaaactaaagaagccgaaaagatgaccaatcatattgtgtcagaagaaacaggctgtctggagtgctatcgcctgctcagcgctatctacagtaagcaagagaaccacgataaggcgttggacgccattgacaaagcattacaattgaagcccaaagatccaaaagtgatatctgagctcttttttaccaaagggaaccagctaagggaacagaatctcctggacaaggctttcgaatcttatcgagttgccgtccagctgaaccccgatcaggcccaggcctggatgaatatgggtggtatccagcacattaagggaaagtacgtttcggccagggcatactacgagcgggcactacagttggtcccagattccaaactattaaaagagaatctggccaaactcgatcgcctggagaagcgcttgcaggaagtgcgagaaaaggaccagacttag

SEQ ID NO: 54973 - DNA, 1725 bp, Artificial Sequence
  Description of Artificial Sequence: Synthetic coding sequence
atgaaccccttttatttccacgccgtcaacattatcctgcattgtctcgtgacactcgtgctaatgtacacatgcgacaagacagtgttcaagaatcggggtctggcgtttgtgaccgccctgctgtttgccgtgcatcctattcataccgaagctgttgctgggattgtggggagagctgacgtgcttgcatgcctgctctttctgctcgccttcctcagttacaaccgttcattggaccaggggtgcgtgggaggctcttttccatcaaccgtgtcacccttctttctcctcctgagccttttccttggcacatgcgccatgctagtaaaggagacagggatcaccgtgttcggggtgtgcctggtctacgatttattcagcctgagtaacaaacaggataaatcttctaatggggctctttgcccacgaagcccgcagcagccaggtagcccacaaccgagctccctgcccggtcacccacaccgtgaaaatggcaaacagcagaggttcccacataagggggcatggggaggctgccactcaccactcccacctgaaccgaaaagctctggcttccctgtcagccctagagcagtgtggtccatgatgcgttacctgagagcgtcctccaatcgcaactttcttctgacaatgaggccgttcctcaagagggccattctggttctcagctacgtacttgtgatcctgtattttagattgtggatcatgggcggatccatgccgctcttctcagaacaggataaccctgctagtttttccccctatatcctcactagatttctaacatatagttatctgctcgccttcaacgtttggctactgctggctcccgtgaccctgtgttacgattggcaggttggctctattcccctggtagaaaccatttgggatatgcgtaacctggcgactatattcctggcagtcgtcatggcattgttgagcctgcactgcctggcagcgttcaagagactcgaacacaaggaggtgctggtaggcctactctttttagtgtttcctttcattccagcttcaaatctttttttccgggttggctttgtcgtggcagagcgagtgttatacatgcctagtatgggctactgtattctgtttgttcacggactttctaagctgtgtacatggcttaaccggtgcggggctactaccctgatcgtgtccaccgtgctgctcctgcttctgttctcatggaaaactgtcaagcagaacgaaatatggctaagccgtgaaagcttattcaggtccggggttcagacactcccccataacgcgaaggtgcattacaactacgcaaattttttaaaggatcagggcagaaacaaggaggctatctatcattataggactgctctcaagctttatcctaggcacgcttccgcgctgaacaatttgggcaccctcacgcgggataccgccgaggccaagatgtactaccagcgggcactccagctccaccctcagcacaaccgcgctctctttaacctgggaaatttgctcaagtcccaggagaagaaggaagaagccattactctgcttaaagattccatcaaatacggccctgagttcgcggacgcctatagcagtctggcctccctgttggcagagcaggtgattgtgtcccacagtagttttttccagtgctattgttatatgtacaaattgatgcttcatcgcttcctgtactag

SEQ ID NO: 54974 - DNA, 2649 bp, Artificial Sequence
  Description of Artificial Sequence: Synthetic coding sequence
atggtggtcactacctctgcgcgtgggggtggcggagacaggactccgtccaggcggcgtggctgtggattggcaccggcaggtgccgctgccctgctcgccggagctagctgtctgtgctacggtcggtctttgcagggcgaattcgtccatgacgacgtgtgggccatcgttaacaatccagatgtgagaccaggagcaccactcaggtggggtattttcacaaatgacttttggggaaagggcatggctgaaaataccagccataaaagctatcgacccttatgtgtgctgactttcaagctcaacatattcctgacggggatgaatccattctattttcatgccgtgaacattattctgcattgtctcgtgacactggtgcttatgtatacctgtgataagactgtgttcaagaaccgcggacttgctttcgtcacagccctactgtttgctgtgcatcccatccacaccgaggccgtagcgggtatcgtcggtagggccgacgttctcgcctgtctattgttcttactggctttcttaagctacaaccgatctctcgatcagggctgcgtgggtgggtcatttcccagcacagtaagtccattcttccttctgctgagcctctttctgggaacctgcgctatgctggtgaaggagactgggatcaccgtgtttggtgtgtgcctagtgtacgatcttttcagtctctctaataagcaggataagtcatcgaacggggctctgtgtcccaggtcgccacagcaacccggttctccacagcccagttcactccccggacatccacaccgggaaaatggcaagcagcagcgatttccccacaagggcgcatggggtggatgtcacagtccattgcccccagagcccaagagttctgggttcccagtttctccgcgagccgtgtggtccatgatgcggttcttaacttattcctatttgcttgcttttaacgtttggctgctccttgcgccagtaaccctgtgttacgattggcaggtgggatctatccccttagtcgagacaatttgggacatgcgtaaccttgctactatttttctcgctgtcgttatggctctcctgtccctacactgtctcgcagccttcaagcgcctagaacacaaagaggtacttgttggactgctgtttctggtgttccctttcattcccgcatctaacttattttttagagtgggattcgtggttgccgagagagtattgtacatgccttcaatgggttactgtatactgtttgtgcatggactgagcaagctgtgtacctggctaaacagatgtggggcaaccactctcattgtctcaactgtgttactgttgttactcttctcatggaagactgtcaaacaaaacgagatttggctcagtcgtgagagcctttttcgcagtggggtgcagacgctccctcacaacgcaaaggtgcattataactacgcaaattttttaaaggaccaaggcaggaacaaagaagccatctaccactaccgtaccgccctaaagctttacccacgccacgcgtctgcccttaataatctgggaacactgacccgcgacacagctgaggcaaaaatgtactaccagcgcgctttacagctgcatccccagcacaaccgagcgcttttcaatctgggaaatttgctgaaatctcaggaaaagaaggaggaagccattacactgcttaaggactccattaagtacggccctgagtttgccgacgcatacagctctttagctagcctgctcgctgagcaggaaaggttcaaggaggccgaagagatataccagactgggatcaaaaattgccccgactcaagcgatctacacaataactacggtgtgtttctggtggacacaggacttcctgagaaagctgtggcacattaccaacaggcaattaagctgagtcccagtcaccacgttgctatggttaatctggggcgactgtacaggagcctcggggagaacagcatggctgaagaatggtataagagggcccttcaagtagcacataaggcagagattctgtctccccttggagccctgtactacaatactggacggtatgaggaggccctgcagatatatcaggaggctgctgccctgcagccatctcagcgcgagctgcggctcgcgctcgcacaagtgttggcagtgatggggcaaacgaaggaagcggagaaaatgactaatcacatagtttctgaagagaccggatgtctggaatgttatcggctgctgagcgccatttattccaaacaagagaatcatgataaagcactcgatgctatcgacaaggcactgcagcttaagcctaaggaccccaaagttattagcgagctcttctttaccaaaggaaaccaattaagggagcagaatttactggacaaagcctttgagtcctacagagttgccgtgcagttgaatccagatcaggctcaggcctggatgaacatggggggaattcagcacattaaagggaagtatgtgtccgccagggcttattacgagcgtgccctgcagctggtgccagactccaagctgctcaaggagaatcttgcaaaacttgaccgactggaaaaaaggttgcaggaggttagagaaaaagatcagacttag

SEQ ID NO: 54975 - DNA, 1938 bp, Artificial Sequence
  Description of Artificial Sequence: Synthetic coding sequence
gtaactgagagagactcagtttccaaaaagaaaaaaaagcgttacctgcgggcatcaagcaaccgtaacttcttgctgacaatgcgcccttttttgaagcgggcaattctggtgctctcatacgtcctagttatcctgtattttcgactatggattatgggtggttccatgcccctgttctcggagcaagacaatcccgcttccttcagcccatacattctgaccagattcctgacatattcctacctacttgccttcaatgtttggctgctcctggccccagtcacactgtgctacgattggcaggttgggtccataccattggtggagaccatctgggacatgcgcaacctggccacgattttcctggcggttgtgatggcgttattgagtctgcattgtcttgccgcttttaagcgacttgaacataaggaagtgctcgtgggcctgctgttcttagtctttccattcatcccggcttccaacttgttctttcgagtaggcttcgtagtagctgaacgggtgctttacatgcctagcatgggatactgcatcctgttcgtgcatggactgagtaagctgtgcacctggcttaatcgatgcggcgctacaacccttattgtcagcacagttcttctgttgctgcttttttcatggaaaacagtgaagcagaatgagatctggttgtctagagaatcactgtttagaagcggagttcagacgttaccacacaatgcgaaggtgcattacaattacgctaatttccttaaggatcagggccgaaacaaagaagctatctatcattatcggaccgccctgaaactgtatcctcggcatgctagtgccctgaataatttgggtactctgacacgggacaccgccgaggctaagatgtattaccaaagagccctgcaactccacccccagcacaatagggctctgtttaatctgggcaatcttctgaagtcgcaggagaagaaggaagaggcaattacccttctgaaggactccatcaagtacggaccggaatttgccgacgcctattcgtctttggccagtctgctagcagagcaggagagattcaaggaagccgaggaaatataccagactggaataaagaactgtccagacagcagtgacctccacaataactacggtgtcttcttagtggacactggactccccgagaaggctgtggcccactatcagcaagccataaaactgtcaccgtcccatcacgtcgccatggttaatctgggtagactatacagatctctcggggagaacagtatggcagaggagtggtataaacgagccctgcaagtggcccataaggctgaaatcctctctccgctaggagcattgtactataataccggcagatacgaggaggctctgcagatttatcaggaagccgctgcacttcagccttctcaaagagagctcagactggccctggcccaggtcttggcagttatgggccagacgaaagaggctgaaaagatgacaaaccatattgtttcagaagagactggttgcctagagtgctacagactcctatctgctatttacagcaagcaggaaaatcacgacaaggcattggatgcgatagataaagccctccagttaaagccaaaagatccaaaggtgatctcagagttgttctttacaaagggaaatcaactacgagaacagaacctcctagacaaagctttcgagtcctacagggtggcagtccagctgaatccagaccaggcccaggcatggatgaatatgggaggaattcagcacattaaagggaaatatgtgagtgccagggcttattatgaaagagctctccaacttgtgccggattcgaaactgctgaaagagaatttagcgaaactggaccgccttgaaaagcggttacaagaagttagggagaaggaccaaacctag

SEQ ID NO: 54976 - DNA, 2835 bp, Artificial Sequence
  Description of Artificial Sequence: Synthetic coding sequence
atggtggtaaccaccagcgctaggggcggtggaggcgatagaacgccaagcaggaggcgtggttgcgggttggcgcctgcgggagcagctgccttgctggctggcgctagttgtttgtgctacggaaggtccctgcagggggagttcgtacacgatgatgtgtgggcgatcgtaaataaccctgatgtccgacctggggctccgttgcgttggggcatcttcaccaacgatttttggggtaaaggaatggctgagaatacttctcataagtcttatagacctctttgcgtcctcaccttcaagcttaacatcttcctgaccggtatgaatcctttttatttccatgcagtcaacatcatccttcactgtctggtgacccttgtgctaatgtatacttgcgataaaaccgtgtttaagaatagaggtctggctttcgtgacagccctcttgtttgcagtgcatcccattcatactgaagctgtcgccggaattgtcgggagagccgacgttctggcatgtcttctcttcctgctagcattcctgtcctacaataggagcctagatcaaggctgcgtggggggttctttccccagcactgtcagtccattctttcttcttttgtcactcttcctggggacctgtgcgatgctggttaaggaaacaggtatcaccgtctttggtgtgtgtctcgtttatgatctgtttagcctgagtaacaagcaagacaagagtagcaacggtgccctgtgtcctcgctctccccaacagccaggatcacctcagccgtcaagcctcccgggacaccctcaccgggagaatgggaagcagcagcgatttccccacaagggcgcatgggggggatgccacagccccctcccccctgaaccaaaaagttctggctttccggtctcccccagggcagtttggtcgatgatgcgttacctgcgggcaagttccaatagaaattttctgttgacaatgcggccattcctgaaacgggcaattctggtgctgagttacgttcttgtcatactttacttccggctgtggataatgggcggaagcatgcctttgttctcagaacaagataatcccgcatcgttttccccctacatcctaacacgtttcctcacctattcttatctgctcgctttcaatgtgtggctcctcttggccccagtgactctctgttacgattggcaggtcggatccatcccccttgtggaaaccatttgggacatgagaaatctggccaccattttcctagccgtcgtgatggctctgctaagcctgcactgccttgccgctttcaagagactggagcataaagaagtccttgtggggctgttgttcttggtgtttccttttatcccggcatcgaatctttttttccgagtagggtttgttgttgctgagagggttctgtacatgccctccatggggtattgtatattattcgttcacggactgtcaaagttgtgcacatggctgaacagatgcggagcgaccactttgatcgtgagcacggtgctccttttgctgctgttctcgtggaagactgtgaagcagaatgaaatttggttaagcagagagagcctttttagaagtggagtgcagacattgccccacaatgctaaggtgcattacaactacgccaactttctgaaagaccaagggaggaacaaagaagcgatctaccattaccggaccgctctgaagttgtatcctcggcatgcttcggccctgaacaatttgggcacactgactcgggataccgcagaggccaaaatgtactaccagcgggctctgcagctccacccccaacataatagggccctatttaacctgggcaacctgctgaaatcgcaggagaagaaagaagaggccattacgctgctaaaagacagcatcaagtacggacctgaatttgcagacgcttactcttcgcttgcatctcttttagctgaacaggaaaggtttaaggaagccgaggaaatttaccaaactggaataaagaattgtcctgactctagtgatctccacaacaactacggagtgttcctggtggacacgggtctgccagaaaaggccgtggcgcactatcaacaggccataaaattgagcccttcccatcacgtggccatggtcaatctagggagattataccggtcccttggcgaaaattccatggccgaggagtggtacaagcgagctctccaggtagcacacaaggctgaaatcctttcacccctaggcgcactgtattacaatacggggagatacgaagaggcactgcagatctaccaagaagcagccgcactccagcctagtcagcgagagctgagacttgcacttgctcaggtgttggccgtcatgggccagacaaaggaggccgagaaaatgactaaccacattgtgagtgaggagacaggatgtttggagtgctatcggctactgagcgccatttattctaaacaggaaaaccatgataaagcactggacgcgatcgacaaggctctgcaactcaagcctaaggacccaaaagtgataagcgagctattttttaccaaaggaaatcaactgcgagaacagaaccttctggataaagcttttgagagttaccgcgtcgctgtccagctgaacccagaccaggcgcaggcttggatgaacatgggtggcatacaacatatcaaggggaaatatgtgtccgctcgcgcatactatgagcgggcattgcaactggtgcccgactcaaagctcttaaaggaaaaccttgccaaattggaccggctcgagaagcgtctccaagaagtgagagagaaagaccagacctag

SEQ ID NO: 54977 - DNA, 2511 bp, Artificial Sequence
  Description of Artificial Sequence: Synthetic coding sequence
atgattgctgaactcgtaagctcagcccttgggctagcgctgtacctaaacacactgtctgctgacttttgttacgatgactctcgcgcaatcaagacaaatcaggatcttctgcctgagacgccatggacccatatcttctataacgacttctggggcacattgctgacccattccggatcccataagtcctatagaccattgtgcacactttcattcagactgaatcacgccattggagggcttaatccatggtcctaccaccttgtaaatgtactactacacgccgctgtcactggcctgttcaccagcttcagcaagatacttttgggcgatgggtattggaccttcatggctggtctgatgtttgcctcccatcctattcatacagaggccgtggccggtatcgtgggcagagctgatgtcggggcatcgttattcttccttctatcattactgtgttatataaagcactgttcaacccggggatacagtgcccgtacctggggatggttcttgggatcaggactgtgcgcgggttgttccatgttgtggaaggagcagggggtgacagtgctcgctgtatccgccgtgtacgacgtgtttgtttttcacaggcttaagattaaacagattctgcctaccatttacaaacgcaaaaatctttctctgttcctaagtatcagcctcctaatattttgggggtcgagcctgctcggagcgaggctctactggatgggtaataaaccccctagcttttctaattcagacaacccagccgctgacagtgactctctactgacaaggacactcaccttcttctacctgcccacgaagaatctttggttgcttctatgccccgataccctttcattcgactggtctatggacgccgtcccccttctaaagacagtgtgcgattggaggaacctgcatacagtggccttttatactgggctcctcttactagcatattacggactgaaatcaccttctgtggaccgcgaatgtaatggaaaaactgtgaccaatgggaagcagaatgcgaacggacactcctgcttgagcgatgttgagtaccagaatagtgagactaaatcatcatttgcaagcaaggtggagaatggtatcaaaaatgacgtcagccagaggacacaactcccgtccactgagaacatcgtagttctgtctcttagtcttctgatcattccctttgtaccggcaacaaatctgttcttctacgttgggttcgtgatcgccgagagagtgttgtatataccatctatggggttctgtcttcttatcacagtgggcgctagagctctctacgtcaaagtgcagaaaaggttccttaaatctcttatcttctatgccactgctacattaattgtcttttacggtctcaagacagccatcaggaacggcgattggcaaaatgaggaaatgctctacaggtctggcatcaaagtgaacccagccaaggcctggggcaatttaggtaatgtactgaagagccagagcaaaatctctgaagccgaatctgcctataggaacgccttatattacagatctaatatggctgacatgctgtacaacttggggttgctcctgcaggagaactctaggtttgcagaagctctgcattattataaactggccatcggcagcagacctacacttgcatctgcctacctgaacaccggcattatcttgatgaaccagggtagaaccgaggaagcccgacgcacttttctgaagtgttccgaaatacctgatgaaaatcttaaggaccctcacgcacacaagtcctcagtcacgagctgtttgtacaatctgggcaagctttaccatgaacagggtcattacgaagaagccctgagcgtgtacaaggaagccatccaaaagatgcctcgacagtttgcaccccaaagtctgtataatatgatgggcgaagcttacatgcgcctgagcaagctgccagaggcggaacactggtacatggagtctctccggagcaaaactgaccatatccccgcacacctgacttatggaaagctgctggccctgacaggtcgcaagagtgaggccgagaagttgttcttaaaggcaattgaactggaccccactaagggtaactgctatatgcactacggccagtttctcttggaggaagctaggctcatcgaggccgctgaaatggccaaaaaggccgctgaactggactctacggagttcgatgtggtattcaacgctgcccacatgttacggcaggcatccctcaacgaggccgctgagaaatactacgacttagccgctcgcctccgccctaactaccccgcagcgctaatgaatctgggagctattctccatctcaacggcagactccagaaagctgaggctaattatctgagggcgctgcaacttaagcccgatgacgtaatcacgcagagcaatttgcgtaagctgtggaacattatggagaaacagggcctaaagactagtaaaacgtag

SEQ ID NO: 54978 - DNA, 2745 bp, Artificial Sequence
  Description of Artificial Sequence: Synthetic coding sequence
atggccaatataaacctcaaggagatcaccctgatcgttggggtggtgaccgcttgctattggaacagccttttctgcgggtttgtgtttgacgatgtgtctgccattctggacaataaggatcttcatcccagcactcctctaaaaacattgttccaaaatgacttttggggcacacccatgagcgaggagcgatcgcacaagtcttaccggcctctgacagttcttacattcaggttgaactacttactttccgagcttaaacccatgtcttatcatctcctgaatatgatattccacgcggtggtttccgtcatctttctgaaggtgtgtaaattgtttttggataacaagagcagcgtcatagctagtcttcttttcgcagtgcaccctatccacactgaggctgttactggagtcgtgggacgagcagaattactctcatccattttctttttggctgcattcctaagttatacgcgttcaaaggggcctgataacagcatcatctggacacccatagccctgaccgtatttcttgtcgccgtcgcaaccttgtgcaaggagcaggggattacagtggtggggatttgctgtgtgtatgaggtgtttatagcacagggttacactttaccccttctttgcaccacagcagggcaattcctcagggggaaaggaagcattcctttctctatgctgcagaccttggtgaagttgatcgttctgatgttctctaccctactgctcgtggtgataagggtgcaggtaatacagagccaattgcctgtgttcacgcgattcgacaatccagccgcagtgtccccaacccctacccgccagctaacgtttaattatttattacccgttaacgcctggctcctgttaaatccttcagagttgtgctgtgattggacgatgggcactatcccactgattgagtccttgctggacatccggaacctggctacctttactttcttttgcttcctaggaatgctcggagtgttttcaatcagatactcaggagatagcagcaaaacagtactcatggctctgtgtctgatggcattgccctttatcccagccagtaacctgtttttccccgtgggcttcgttgtggccgaacgggtgctgtatgtgccatcaatgggcttttgcatcctggtcgcccacggctggcaaaagatctccactaaaagtgtgtttaagaagcttagctggatctgcctcagtatggtgattttaacacattccctgaaaactttccatcggaactgggactgggaatccgagtatacgctatttatgtcagctcttaaggtgaataagaataatgctaaactgtggaataatgtggggcacgcgctcgagaacgagaagaactttgagcgggcactcaagtatttcctgcaggcaacacatgtccagcctgacgacatcggggcacacatgaatgtcgggagaacttataaaaacctgaaccgcactaaagaagctgaagaatcatatatgatggctaaaagcctaatgccacaaatcatcccaggaaagaagtatgccgcaagaatcgctcctaatcacctgaatgtgtacatcaacctggccaatctgattagagccaatgagtctcgcctggaggaggccgaccagctgtacaggcaggccatcagtatgcgtcccgattttaagcaggcatacatatcgcgaggcgagctccttctcaagatgaataaaccgctgaaggcaaaagaggcatacctgaaggcattggaacttgacagaaataatgccgatctgtggtacaacctagccatcgtgcacatagagttaaaggagccgaacgaggccctcaagaacttcaaccgggcattagagctaaaccccaaacataagcttgccctatttaatagtgccatcgtaatgcaggagtcaggcgaggttaagctgcgccctgaagctcgcaaacgcttactgtcttacattaatgaggaacccctagatgcgaatggctactttaatctagggatgctggccatggatgacaagaaggataacgaagctgagatctggatgaaaaaagcaatcaaactgcaggcagacttccgctccgctctcttcaacttggcgctgctgtatagccagaccgccaaagagctcaaggcattaccaatcctcgaggagctgctgcggtactatcctgatcatatcaagggcctaattctgaaaggagatattttgatgaatcagaaaaaagatatcctgggcgcaaagaaatgctttgagcgaatcctcgaaatggatcctagcaatgtgcaaggaaagcataacctgtgtgtcgtgtactttgaggagaaggatctgctgaaggccgagcgttgcctgcttgaaaccctggcacttgccccacatgaagagtacatacagcgtcacctgaatatcgttagggataaaatttcgtcttcaagcttcattgagcccattttccctacaagcaagatatcgtccgtggaaggcaagaagataccaacagagtcggtcaaggagataaggggagagagtcgccagactcagatcgtgaaaacctctgacaataagagccagagtaagagtaataagcagctcggaaagaatggcgatgaggaaaccccccacaaaacaaccaaagacatcaaggagattgagaagaagagggtggccgctttgaaacgactggaggaaattgaaaggatcctaaacggcgagtag

SEQ ID NO: 54979 - DNA, 447 bp, Artificial Sequence
  Description of Artificial Sequence: Synthetic coding sequence
atggcgaatattaacctgaaggaaatcacccttatcgtgggagtggtcaccgcctgttactggaacagcttgttttgcgggtttgtctttgatgatgtgagcgccatcctggataacaaagatctgcatccaagtactccgctgaagactttgtttcagaacgatttctggggaactcctatgtctgaagaacgctcacataaatcttaccgaccactgactgtgctgactttccgtctcaactaccttctctcagagctgaagccgatgtcctatcacctgcttaacatgatttttcatgccgtggtgagcgtgatctttctcaaagtatgcaagctcttcttagacaacaagagcagtgtgatagcttcgcttttgtttgccgttcacccaatccatacagaggccgtcaccggtgttgtgggcagggccgagcttctgtcctag

SEQ ID NO: 54980 - DNA, 1893 bp, Artificial Sequence
  Description of Artificial Sequence: Synthetic coding sequence
atggctgtattggacaccgatctagatcacatactgccctccagcgtactgcccccattttgggccaagcttgtggtcggatcggtcgctattgtctgcttcgcccgttcctacgatggcgacttcgtcttcgatgatagcgaagctattgttaacaataaagtggcaggcgtggttggccgagcagatttgctgtgcgcactatttttcctgttgtccttcctcgggtactgcaaggcattcagggaaagcaacaaagaaggcgctcattcatccactttttgggtcctactgtcgatttttctcggcgctgttgctatgctttgtaaggagcaagggattacagtcttgggcctgaacgccgtctttgatattcttgtcattggcaaattcaatgtcttagagatcgtccagaaggttctgcataaggacaaaagcctggaaaatctcggaatgctgcgcaacggcggattgttgttccgaatgactctcctcaccagtggtggggcaggcatgttgtacgtgaggtggagaatcatgggaaccggtccacctgcgttcactgaagttgacaatccagcatccttcgctgactctatgctggtccgagcagtgaactataattattactactcactcaatgcctggttactattgtgtccctggtggttatgtttcgattggagcatggggtgtataccactgattaagagcattagtgattggagggtgattgccctagcggctctgtggttctgtttgataggtctaatctgccaggccctatgtagcgaggacggacacaagcgaaggatccttactttggggctcggcttcctggtgatcccctttttgcccgctagcaatctgttctttagagtgggtttcgtagttgcggaacgagttttataccttccttccgtgggctattgcgtactgctaacttttggctttggggctttaagtaaacacacaaagaagaaaaagcttattgcagccgtggttctgggaatcctgtttatcaacacattgagatgtgtcttgaggtcaggagaatggagaagcgaggagcaactgttcaggtcagccttgtccgtgtgtccgttaaacgccaaggtgcattacaacatcggaaagaacctagccgataaaggcaaccagacagcggctatcaggtactaccgcgaagcagtgcgactcaacccaaagtacgtccacgccatgaataatctcggcaacatcctgaaggagcggaatgagctgcaggaagcagaagagctcctgagtctcgccgtacagatacagcccgatttcgcagcagcgtggatgaatctgggaatcgtgcagaactcactgaagcgcttcgaggcggctgagcaatcttaccggaccgccatcaagcaccgtcgtaagtatccagactgttactataatctcgggaggctttatgcagatctgaatcgccacgtggacgccctgaacgcctggcgaaacgctacggtcctaaagcccgaacactccctggcttggaataacatgatcattttgctcgataatacaggcaacttggcacaagctgaagctgtcggccgagaggccctcgaattaattcccaacgaccactccctgatgttctctctagccaatgttctaggaaagagccagaagtacaaggaatctgaagcgttgttccttaaggcaataaaagctaatccgaacgccgcttcttaccatggcaatttagcagttctgtaccacaggtggggacacctggacctcgccaagaagcactatgagataagtctgcagctggatcccaccgcatcaggtactaaagagaactacggcttgctcagaagaaaattagaattgatgcagaaaaaagctgtgtag

SEQ ID NO: 54981 - DNA, 2283 bp, Artificial Sequence
  Description of Artificial Sequence: Synthetic coding sequence
atgatcccaaaccagcacaacgcgggtgccggttctcatcaacctgctgtctttcgaatggcagtgctcgatacagacctcgaccatattctgccctccagcgtactgcctcccttctgggctaagctggtggtgggttcggtggccatcgtatgttttgctcggtcctacgatggcgacttcgtgttcgacgattcagaagccatcgtgaataataaggacctccaggcagaaacaccactgggcgacctttggcaccacgatttctggggatctaggttgtccagcaatacatcccacaagtcctataggcctcttacggttcttacatttcgcattaactactacctatcaggaggatttcacccagttgggtttcacgtagtcaatattctgctgcactccggaatcagcgtgctgatggtagacgtgttttccgtgctctttggcggattgcagtacaccagtaaaggacggaggctccacctggcccctcgggcatctcttctggcagccttacttttcgccgtgcatcctgtccacacggaatgtgtcgcaggcgtggttgggagagctgatttgctgtgtgccctgttttttctgttgagcttcctcggctattgtaaggcattcagggaaagtaataaagagggcgctcatagcagcaccttctgggttttgctgagcattttcctgggggctgtagccatgttatgcaaagaacagggcattaccgttctggggttgaacgccgtttttgacatcctggtgatcgggaagttcaacgttctggaaatcgttcagaaagtgctccataaagacaaaagcctggaaaacctgggcatgcttaggaacggaggcctactgttccggatgaccctcctgacaagcgggggtgcagggatgctgtatgtgaggtggcgtataatggggactggaccccctgccttcacggaagtggataatccggcatcatttgctgactcaatgttagtgcgcgcagtgaactacaattactactactccctgaatgcctggctactgctgtgtccctggtggctatgcttcgattggagcatgggttgtattccactaattaagtccatatccgactggagagtaatcgcccttgctgccctctggttctgtttgattgggttgatctgtcaggccctgtgcagcgaggacggacataagcggaggattctgaccctggggctcggatttctagtgatcccgtttttgccagcctctaatctattttttcgtgtggggtttgtagtggctgaaagagtactctacctgccctctgtgggctactgcgttctgcttacgtttggcttcggcgcactcagtaagcataccaagaaaaaaaagctgattgccgctgtagtgctggggatcctgtttattaatacgctgcggtgcgtcttgaggtccggggagtggagatccgaagaacagctttttaggtccgctctatcagtgtgtcctctgaacgccaaagtgcattacaatatcgggaaaaacctggccgacaaggggaatcaaaccgcagctattagatactacagagaagcagtgcgcctgaaccccaagtacgtccatgcaatgaacaatcttgggaatattctgaaggagcgcaatgagctgcaggaggcagaggaactgctctctctggccgttcagattcagcctgacttcgctgctgcgtggatgaacctcgggatcgtccagaacagcctcaaacgatttgaggcagccgagcagagctacaggacagcaataaagcaccgaagaaagtatcccgattgctattataaccttgggaggctatacgccgatttaaaccggcacgttgatgccttgaatgcctggagaaatgccacagtactgaagccagagcatagcctcgcttggaacaacatgataattcttctcgataatactgggaatctggcccaggcagaggccgtcgggcgagaggcacttgaactcatcccaaacgaccactctctaatgttcagtctcgcaaatgtcctgggaaaatcccagaagtataaagagagcgaagctttattcctgaaagcgataaaagctaatcccaacgcggcttcctatcacggaaacttggctgtgctgtaccaccgttggggacatctggacctggctaaaaagcattacgagatcagtctgcagctagatccaacagcttccgggacgaaggaaaattacggcctgcttcgtagaaaactcgaattgatgcagaagaaggccgtgtag

SEQ ID NO: 54982 - DNA, 2226 bp, Artificial Sequence
  Description of Artificial Sequence: Synthetic coding sequence
atggcggtgttagacaccgacctggatcatatcctcccctctagtgtccttccaccattctgggctaagttagtggtgggatcagtggccatcgtgtgtttcgccaggtcatatgacggagatttcgtcttcgatgactcagaggctatcgtaaacaacaaggacctgcaggcggaaacccctctcggcgatctttggcatcacgacttctgggggtctaggctcagttccaacactagccacaaatcttaccggccacttaccgtgctcaccttcaggattaactactatctcagcgggggatttcaccccgtggggttccatgtagttaacattctgctgcattcagggattagtgtcctcatggtggacgtgttttctgtgcttttcggcggattgcaatacacctccaagggtcgccgtctgcacctggcccctcgagcttctctcctcgcggctctgttgtttgctgtgcacccagtgcatacggagtgtgttgccggagtggtcggaagggcagaccttctctgtgcccttttcttcctcttgagctttctgggctactgtaaagcgttccgtgagtctaataaggaaggtgcccacagttctaccttttgggtgctccttagcatattcctgggcgcagtagccatgctctgtaaggaacagggaattacagtgctaggccttaacgccgtttttgacattctcgtgatcgggaagttcaacgtgctcgaaattgtccagaaggtgcttcataaggataagtcattggagaacctgggcatgttgaggaacggcggactcctctttcggatgactcttctaacatcaggcggtgctgggatgctgtacgtgcgatggaggatcatgggcacaggcccacccgcattcactgaagtcgacaatcctgcgagtttcgctgacagcatgctcgtccgcgctgtcaactacaactactactacagtctgaacgcctggttgttactgtgcccctggtggttatgctttgattggtccatgggatgcatccccctgattaaaagtataagcgattggagggtgattgctctcgccgcattgtggttctgcctgattggtttgatatgccaggccctctgctccgaagatggacacaaaagaagaattctaaccctgggtctcggatttctcgtgattccattccttcctgccagcaacttgtttttccgcgttggatttgtggtcgccgagagggtgctgtatctgccatccgtgggatattgtgtgctcctgaccttcggcttcggggcattgtcaaagcacacaaaaaaaaaaaagttaatagccgctgtcgtgttaggcatcctctttattaataccttacgctgcgtcctcaggagtggcgagtggagaagcgaggaacaactgtttagatctgccctaagtgtctgtcccctcaacgcaaaggttcactacaatattggcaagaatcttgctgataaggggaaccagacggccgctattaggtactaccgcgaggctgtccgcttgaatcccaaatacgtccatgctatgaacaatctaggcaatattcttaaggaacgcaatgaattgcaggaggctgaagaactgctgagtctggcagtccaaatacagccggattttgccgcagcctggatgaacctcgggatcgtgcagaatagcttgaagaggtttgaggccgcagagcagtcctaccgcactgccattaaacatcgcagaaagtaccctgactgctattataacctagggaggttatatgctgaccttaatcggcacgtggacgccctaaacgcttggcgcaacgcaactgtgctgaagcctgaacattctctggcatggaacaatatgattattctccttgataataccggaaatctggcgcaggctgaggccgtagggagggaggccctggagctcatacccaacgaccacagtctaatgttctcgctggccaacgtgttagggaagagccagaagtacaaggaatcagaggccctgtttttgaaggccattaaggctaatcccaatgccgcatcttaccacggcaatctggctgtgctctatcatcgatggggccacttggacctggcaaagaaacactatgaaatcagccttcaactcgatcccacggccagcggaacaaaggagaattacggtctcctgcgacgcaagctcgagctgatgcagaaaaaggcagtttag

SEQ ID NO: 54983 - DNA, 165 bp, Artificial Sequence
  Description of Artificial Sequence: Synthetic coding sequence
atggctgtgctggacaccgatctggatcatattctgccctcttcggtgctgcctccattttgggcaaagctggtcgtaggatccgttgccatcgtatgctttgcaaggtcctacgacggagattttgtctttgacgacagcgaggctatagtcaacaataaatag

SEQ ID NO: 54984 - DNA, 222 bp, Artificial Sequence
  Description of Artificial Sequence: Synthetic coding sequence
atgatacccaaccaacacaacgctggggctggctcacatcaacctgctgtttttaggatggctgtactggataccgacctcgatcatatacttcccagcagcgtcctgccgcctttttgggcaaaactggtggtgggatcagtcgccatcgtatgtttcgcgaggagctacgacggggactttgtgttcgacgacagcgaagccatagtgaacaacaagtag

SEQ ID NO: 54985 - DNA, 741 bp, Artificial Sequence
  Description of Artificial Sequence: Synthetic coding sequence
atgacgcttatcgagggggtaggcgacgaggttacggtgcttttctcagtgctggcctgcctgcttgtgctggcgctggcctgggtcagcacgcacactgcagaaggcggtgatccgctgccccagcctagcggcaccccaacaccgtcacagccgtctgctgcaatggctgctaccgacagcatgaggggtgaagctcccggagccgagaccccgagccttcggcacagaggccaggccgctcagcctgaaccgagcactgggtttacggcaacaccacccgcacctgactcaccacaagagccattagtgttacggctgaagttcctaaacgacagcgaacaggtcgcacgcgcttggccacacgataccataggatctcttaaacgtactcaatttcccggaagggaacagcaggtcagactgatctatcagggtcagctgctgggcgacgacacgcaaacgttggggagcctccatctgccacccaactgcgtgctgcactgccatgtatctacccgggtggggccacccaacccaccctgtccccctgggtccgaaccgggtccttccggactggagatcggttccctgttattacccctgctacttctactactgctgctgctgtggtattgtcagattcagtaccgacccttctttcctcttacagcgactttggggctggctgggttcaccctcttgctgagtctcctcgcctttgcaatgtatcggccttag

SEQ ID NO: 54986 - DNA, 741 bp, Artificial Sequence
  Description of Artificial Sequence: Synthetic coding sequence
atgacacttatcgagggggtgggagatgaggttactgtgctgtttagcgttctggcgtgccttctggtgctcgccttagcctgggtgtctactcacacagcagaaggtggggatcccctccctcagcctagcggtacccccacacccagtcagccgtctgcggctatggccgcaacagattcaatgagaggggaagcccctggcgcagagaccccctcgctgagacatagggggcaagcagcccagcctgaacctagtacaggcttcaccgcgacgccacctgctcctgacagccctcaggagccattagttttgaggttgaagtttctgaatgatagcgagcaggtggccagagcctggccacatgacacaattggcagtctcaaacgaacacagtttcctggcagagagcagcaggtgcgacttatttatcagggccagctgctgggcgacgatacgcagacactcgggtctctccacctgccaccaaactgcgtgctgcactgccacgtaagcacgcgcgttggaccacccaatcccccatgtccccctggaagcgagccgggaccaagtgggctcgagattggatccttactactaccactgctgctgctattactgctgctgttgtggtactgccaaatccaataccgccctttctttccactaactgccacactcgggctcgcgggatttacccttcttttgtcactactggccttcgctatgtatcggccttag

SEQ ID NO: 54987 - DNA, 741 bp, Artificial Sequence
  Description of Artificial Sequence: Synthetic coding sequence
atgacactgattgagggagtgggggacgaggtaaccgtgctgttctccgtgctagcctgtctccttgtgttggcactggcctgggtaagcactcatacggctgagggcggtgatccactccctcagccgtcgggcactcccaccccttcccagccgtcagcagctatggccgctaccgattctatgagaggagaagccccaggggctgagacaccttctctgaggcatcgcggacaggccgctcagcccgagccttcaaccggctttactgctacacctccagcaccagactctcctcaggagccgctcgtgctccgcctgaaattcctgaacgatagtgagcaagtggcaagggcatggccgcatgacactatcgggagcctcaagcgcacgcagttcccaggtagagaacagcaagtgagactaatctaccagggtcagctgctaggcgatgacactcagaccctgggttctctgcacctgcctccaaattgcgtgctccactgccatgtctccacccgggtcggaccaccaaaccccccatgccctcccggaagtgaaccaggtccctccgggctagaaattggatccctgttgctgcctctcctcctgctgttactgttgctattgtggtattgccagattcagtacaggcctttcttccccctgaccgctacactcgggttggcaggcttcaccttgctgctaagcctgctagctttcgccatgtacagaccatag

SEQ ID NO: 54988 - DNA, 741 bp, Artificial Sequence
  Description of Artificial Sequence: Synthetic coding sequence
atgacactgatagaaggggtgggagacgaggtgacggtgctcttctccgtcctcgcatgcctattggtgctcgctttggcttgggtctccactcacaccgccgaagggggtgacccattaccccagcccagcggcacaccaacacccagccagccctcggccgctatggcagcaaccgactctatgcgaggtgaggccccaggtgccgaaacaccttctctcagacacagagggcaggctgcccagcctgaaccatccaccggcttcaccgccacaccacccgcacccgactctccccaggagcccctggttctgagactgaagtttcttaacgattccgaacaggtcgctcgggcatggcctcacgatacaattggctccctgaagaggacccaattccccggacgagaacagcaggtgcgacttatttaccagggacaacttctgggcgacgatacacagacactcggttcgctccacctgccgcctaattgtgtcctgcactgccacgtcagtacccgagttggacctcctaatcctccgtgccctcccggatctgagcctggcccttccgggctggaaattgggtcactgctgctgccactcctgctgttactcctgctgctcctgtggtattgccagatccagtaccgcccattcttcccactgaccgccacactaggcctggccggttttaccctgctgctgagtctgctggccttcgcaatgtatagaccctag

SEQ ID NO: 54989 - DNA, 741 bp, Artificial Sequence
  Description of Artificial Sequence: Synthetic coding sequence
atgacattgatagagggggtaggcgacgaggtgaccgtattattctccgtcctggcctgtctactggtcctagccctcgcttgggtttctacccacaccgccgaaggaggagatcccctgccgcagccatccggcacacctaccccgtctcagcctagtgccgctatggcagccaccgatagtatgcgaggagaggctccaggcgctgaaaccccatccctccggcatcggggtcaggctgcccagcctgagccgtctaccgggttcactgctacccctccagcacccgacagcccacaggagcccctggtgctgagactgaagttcctgaatgactcagagcaggtggctagggcttggccccatgatactatcggaagtcttaagagaacacaattccccggtcgcgaacaacaagttcgcttgatctaccagggtcagctgctcggcgatgacactcagacactgggatcactgcacctgcctccaaattgtgtcttacactgtcatgtgagtacaagggtcggcccaccaaatcccccttgtccacccggatccgaaccagggccatctggcttagagatcggttcattactccttcccctgctgctgctactgctactcctactgtggtactgccaaattcagtaccggccttttttccctcttacagccactttaggattggctggtttcacgctgctgctgtcccttctggcattcgccatgtaccggccatag

SEQ ID NO: 54990 - DNA, 516 bp, Artificial Sequence
  Description of Artificial Sequence: Synthetic coding sequence
atgaccctaatagaaggcgtcggcgacgaagtcacggtgctcttttcagtactagcttgtcttctcgttttggccctggcctgggtgtcaacccacactgccgagggcggagaccccttacctcagccgagcggcaccccaacccccagccaaccgagtgctgccatggcggcaaccgactctatgaggggcgaagcccctggggctgaaacccccagcttgaggcaccgaggtcaggcggctcagccagaaccttctaccggtttcaccgcaacccctccggctcctgactccccccaggagcccctcgttcttcgactgaaattccttaacgattccgagcaggtggccagggcatggccccacgatactatcggatcgttgaaaaggacacaatttccagggagggaacagcaggtaaggttgatctatcagggacagctgctaggggacgacactcagacgctggggtcactgcacctgccgcctaactgcgtcctgcactgccatgtctag

SEQ ID NO: 54991 - DNA, 459 bp, Artificial Sequence
  Description of Artificial Sequence: Synthetic coding sequence
atgaccctgatcgaaggcgttggggatgaggtgactgtgcttttctccgtgctggcatgcctgcttgtcttggcactggcttgggtgtctacccacacagccgaagggggagatcctttgccccagccttccggcactcccacaccctctcagccaagcgctgcgatggccgcaaccgacagtatgagaggcgaagcccctggcgctgaaacaccatcacttcgccacaggggacaggctgcccaaccagaaccttcaacaggattcactgcaacccccccagcaccagacagtccacaggagcccttggtgttaaggcttaagttcctcaacgattctgagcaggtggctagagcttggccccacgatactattggatctctgaagagaacgcaattccctggcagagaacaacaagtacgtcttatttatcaaggccagcttttaggggacgactag

SEQ ID NO: 54992 - DNA, 906 bp, Artificial Sequence
  Description of Artificial Sequence: Synthetic coding sequence
atggagttatctgatgtgacgttaatcgagggggttggcaacgaggttatggttgtcgcgggagtggtcgtgttaatcttggccctcgtgctcgcctggcttagcacgtacgtagctgacagtggtagcaatcagcttttgggtgccattgttagcgccggtgacacatccgtgctgcatttgggccacgtcgaccacctcgtcgccggacaaggaaaccccgagcccacagagctcccacaccccagcgagggcaacgacgagaaagctgaagaggcaggcgaagggaggggagactccacaggcgaagccggtgccggtggaggtgtcgaaccctcccttgagcatctgctggacatacaaggcctgccaaagcgccaagccggagcagggtcttcttcacccgaggccccactgcgatcagaggactccacctgccttcctccaagtcccggtctcatcaccgtcaggctaaagttcctgaacgatactgaggaattggcagtggccaggccagaagataccgttggtgcacttaagtcaaaatattttccgggacaggagtctcagatgaagctgatctaccagggtcgcttgctccaggacccggctcgaactctgcggtctctcaacatcacggataactgcgtcattcattgccatagatcacctccgggaagcgcagtacctggaccaagtgcaagtctcgcccctagcgccacagaacctcccagcctgggcgtgaatgtcggcagcctgatggtgcctgtattcgtagtcctattaggtgttgtatggtacttcaggataaactaccgacagtttttcactgcacctgctaccgtgagcctggtgggtgtgactgtgttcttcagctttctagtcttcggaatgtatggacgatag

SEQ ID NO: 54993 - DNA, 906 bp, Artificial Sequence
  Description of Artificial Sequence: Synthetic coding sequence
atggagctgagtgacgtgaccctcattgagggagtgggaaacgaggtgatggtggtggcaggtgttgttgtgctcattttggccctggtcctggcatggctgagcacctatgtcgctgactctggcagtaaccagttgctcggggcaatcgtctcagccggtgatacttcagtgttacatctgggtcatgtggatcacttagtggccggacaggggaaccctgagcctacggagcttccccacccttctgaaggaaacgatgaaaaggctgaagaggccggagaagggagaggggattcaactggggaggccggtgctggaggcggtgtggagccatccctggagcaccttctcgatattcagggactgcctaaacgacaagcaggagcgggaagcagttcccccgaggccccactcagaagcgaggacagtacatgtcttcctccaagccccggactgattacagtgcggctgaagtttcttaatgacactgaagagctggccgtcgctagacccgaggacacagtcggggcactcaagagtaagtactttccgggtcaggaaagccagatgaagctgatctatcagggtagactgcttcaggatcccgctcgcacccttcgctctctgaacataacagacaactgtgtgatccattgccaccggtcaccgcctggcagcgccgtgccgggaccaagcgcaagcctcgcaccaagcgcaactgagcccccaagtttaggggtcaacgtgggatctctcatggtgcccgtgttcgtggtgctactgggcgttgtttggtactttcggatcaactaccggcagttcttcaccgcccctgccactgtgtcattggtcggggtaacagtcttcttctctttcctggtgtttggcatgtatggcaggtag

SEQ ID NO: 54994 - DNA, 795 bp, Artificial Sequence
  Description of Artificial Sequence: Synthetic coding sequence
atggagctgtctgacgtcactcttatcgaaggtgttgggaacgaagtcatggtcgtggctggtgtcgtggttcttatactggcacttgtactggcgtggctgtccacatatgtcgcagactccggctcaaatcagttactgggagcgatagtatcggcgggagatacttcagtgctccacctcggacacgttgaccacttggttgcaggccagggcaatcctgaaccaacagagctaccgcacccgagtgaaggcctgcccaagcggcaggccggtgcaggcagtagctccccagaggcccctctgcgctccgaagatagcacttgccttccccctagtcctggtcttatcacagtccggctgaagttcctcaacgataccgaagagctggccgtagctaggccagaagacacggtcggcgctctgaaatccaaatacttccctggacaggagtctcagatgaagctcatctatcagggtcggctactgcaagacccagccagaacactgaggtcactgaacatcaccgacaattgcgtgattcattgtcaccgctctcctcctggttcggcggtacctggccctagcgcgtccttggcaccaagcgcgacagagcctcctagtctcggggtcaatgtgggctcgttgatggtgcccgtttttgtggtcctgctgggcgtggtttggtactttcgcatcaactaccgccagttctttactgcccctgctactgtctcgcttgtgggagtcacggtcttcttttcctttctggtgttcggtatgtacggtaggtag

SEQ ID NO: 54995 - DNA, 966 bp, Artificial Sequence
  Description of Artificial Sequence: Synthetic coding sequence
atgatctcaaggcatctgcagaacaatttgatgtccgtggatcccgcatcttcacaggccatggaactgagtgacgtgacactcatcgaaggcgtgggaaatgaagtaatggttgtggccggagtggtcgtgctgatcttagcccttgtgctggcttggttgtccacgtacgtagccgacagtggctcaaaccagttacttggagccatcgtctccgcaggggacaccagcgtgctgcacctcggacacgttgaccatttggtagctggccagggaaatcccgaacctacagagctgccacatccttccgaggggaatgatgagaaggccgaggaggcaggggaaggcaggggcgactctacgggcgaagctggcgctggcggaggggttgaaccatcccttgagcacctcctcgatatccaggggctgccaaaaaggcaggctggagccggttcctcatcgcccgaagctcctctgcgcagtgaagacagtacttgtcttcccccttcacccggtttaatcacggtgagactaaaatttttgaacgacacggaagaactggccgtcgctagacctgaggacactgtaggagcattgaaaagcaaatacttccccggacaggagagccagatgaaattaatttaccagggccgtctactacaggaccccgctcggactctgaggagtttgaacattacagacaattgtgtgatccattgccaccgcagccctcctgggtcggccgtgcctggcccttcagcctccctggcaccatctgccacagagccacctagccttggggtgaacgtcggttcactcatggtccccgtcttcgtggtgctcttgggggtggtttggtactttcgaatcaattacagacagttctttactgcgcctgccacagttagcctcgtaggcgtcactgtgttcttttccttccttgttttcggaatgtatgggcgatag

SEQ ID NO: 54996 - DNA, 936 bp, Artificial Sequence
  Description of Artificial Sequence: Synthetic coding sequence
atgagcaatccgagcgctcctccaccttatgaggatagaaacccgctgtatcctggcccacccccaccagggggttatggccagccatccgtactgcccggtggctaccccgcatatcctggctatccacagccaggctacggtcaccccgctggatacccacagcccatgcctccgacgcacccgatgccaatgaattacggcccaggacatgggtatgacggggaggagcgcgcagtgtcagacagctttggcccaggtgaatgggacgatcggaaagtacgacacaccttcatccggaaggtctatagcatcattagtgttcagttactgattactgttgccatcatcgccatctttacgtttgtcgaacctgtttccgccttcgtgcggagaaatgtggcagtttattacgtctcctatgccgtgtttgttgtgacttacttaatacttgcctgctgtcaggggccacgccgacggttcccctggaacattatcctcttgacactcttcacttttgccatggggttcatgaccggcacaatatcctctatgtaccagaccaaagccgtgatcattgccatgattattacagcagttgtgtctatttctgttacgattttctgtttccagaccaaggtggatttcactagttgtaccggactgttttgcgttttgggcattgtgctcttagtaaccgggatcgttacatccattgtgctttattttcagtacgtgtattggcttcacatgctgtacgcagcccttggcgcaatctgttttaccctgttcctggcctacgacacccagctggtgctgggaaacaggaaacatacaatatcaccagaggattatattacaggtgccctgcaaatttataccgatatcatttatatctttactttcgtcttgcagttaatgggcgacaggaactag

SEQ ID NO: 54997 - DNA, 936 bp, Artificial Sequence
  Description of Artificial Sequence: Synthetic coding sequence
atgtccaatccatcagctcctccgccatatgaagatcggaaccctctgtatccaggccctccgcctcccggtggatacggacagcctagtgtattgcctggcggttaccccgcttatcccggatacccacagcccggttatgggcatccagctggttaccctcaacctatgccacccacacatccaatgcccatgaactacggacccggtcacgggtatgacggcgaagagagggcagtgtctgactccttcggcccaggagagtgggacgataggaaagtacgccacaccttcataaggaaggtttatagcataatctctgttcagttgctgatcacagtggctattattgccatttttaccttcgtggaacccgttagcgctttcgtgagaagaaacgtggccgtgtattacgtatcctatgccgttttcgtggtaacatatttgatactcgcctgttgccaggggccaagaagacggtttccttggaacatcatattgctaaccctgtttaccttcgctatgggctttatgactggcaccatctccagcatgtaccagaccaaggccgtcattatcgcaatgatcattactgcggtcgtctcaatttcagtcacaatcttctgctttcaaacgaaagtggactttacttcttgtacagggctcttttgtgtgctggggatagtgctcctggtaactggcatcgttacttcaatcgtcctttattttcagtatgtatactggttgcacatgctgtacgcggcactcggcgctatttgcttcactttgttcctggcttacgatactcagctagtgctcggtaataggaaacacacaatttcacccgaggattatataacgggcgctttacaaatctataccgatattatatacatctttacattcgtgttacagctgatgggtgataggaattag

SEQ ID NO: 54998 - DNA, 141 bp, Artificial Sequence
  Description of Artificial Sequence: Synthetic coding sequence
atgtcaaacccttccgccccacccccatacgaagatagaaaccccctctacccaggcccaccccctcctggcggatacggacagccatctgtactcccgggtggttatcccgcttacccaggttacccacaacctggatag

SEQ ID NO: 54999 - DNA, 456 bp, Artificial Sequence
  Description of Artificial Sequence: Synthetic coding sequence
atgtccaacccctcagctccaccgccatacgaggaccggaaccctctgtacccaggccctccaccccctggtggatacggccaacccagcgtgctgccaggtggatatccggcatacccaggttacccacaacctggctacggccacccggctgggtacccacaacctatgcccccaacccatcccatgccaatgaattatggtcccggacatggttacgatggcgaagaaagggctgtgtccgattccttcggcccaggagagtgggatgatcgtaaggtcaggcacacatttatcagaaaagtctactccatcatctcggttcagctgctcatcactgttgctataatagcgatttttacctttgtagagccggtgtcggcgttcgtgagacgcaacgtggctgtgtattacgtgtcatacgccgtttttgtcgtcacctacctgattctatag

SEQ ID NO: 55000 - DNA, 27 bp, Artificial Sequence
  Description of Artificial Sequence: Synthetic coding sequence
atgtctaatccatctgcaccaccttag

SEQ ID NO: 55001 - DNA, 504 bp, Artificial Sequence
  Description of Artificial Sequence: Synthetic coding sequence
atgagtaacccatcagcaccccctccttacgaggacaggaatccgctgtatcctggaccccctccccctggcggatatgggcagccttcagtcttgcctggtggctaccccgcttaccctgggtacccccagcccggttatgggcatcctgctggttatcctcagcccatgcctcctacacatccaatgcccatgaattacggaccagggcacggctatgacggtgaggagcgagccgtcagcgatagctttggaccgggtgaatgggatgaccgcaaggtgcgccatacctttattcgcaaagtttacagcattatcagtgttcaactcctcatcacagtcgccatcattgccatcttcacgtttgtcgaacctgtgtctgccttcgtacgacgaaatgttgcggtttactacgtaagctatgcagtgtttgtcgtcacctaccttatattggcttgctgccaggggccacggaggagatttccgtggaatattatcttgtag

SEQ ID NO: 55002 - DNA, 516 bp, Artificial Sequence
  Description of Artificial Sequence: Synthetic coding sequence
atgagcaatccctccgcccctcctccgtacgaagatagaaatccactttatcctgggccacctccaccaggaggctacggtcagccttctgtgctgcccggtggatatccggcttatccaggatatccccagcctgggtatggtcatcctgctggctatccacagccgatgcccccaacacaccccatgccaatgaactacggaccaggacatggctatgacggtgaggagcgcgcagtatccgacagcttcggacctggagagtgggacgaccgtaaagtgagacatacattcatccgcaaagtctacagcatcatctccgttcagctcctgattaccgtcgctatcatcgccatctttacatttgtggagcccgtttctgccttcgtgcgccgaaatgtagccgtttattatgtgtcatacgcagtctttgtggtgacgtatctgattctagcatgttgccagggcccaaggaggaggtttccctggaacataatcctgttgacactgttctag

SEQ ID NO: 55003 - DNA, 207 bp, Artificial Sequence
  Description of Artificial Sequence: Synthetic coding sequence
atgagtaatccgtctgcaccgccaccctacgaggatcggaaccccctgtacccgggaccacccccacctggaggctatggccaaccgtccgtgctgcccggtggctaccccgcatatcccggatacccccaaccaggatatggacatcccgctgggtaccctcagccaatgccacccactcatcccatgccgatgaattatggctag

SEQ ID NO: 55004 - DNA, 648 bp, Artificial Sequence
  Description of Artificial Sequence: Synthetic coding sequence
atgagcaacccttcagctccgcctccctacgaggatcggaatccactctatcccggtccccctcccccagggggatacggccagccaagcgtgctcccagggggttatccagcctatcccggatatccccagcccggttatggacaccctgccggatatcctcagcccatgcctcctacacaccccatgcctatgaactacggtccgggacatggctacgatggggaggaaagggctgtctctgactccttcggacccggtgagtgggacgatagaaaagtgcgtcataccttcattcggaaaggaacctgccaacggctgtgcgaggagaagtgtggctgcctgctacgtgtgctctgttgtctccgatgtcatcttcctgacccctgcctactccctgggacacagactccttttccaatggaacaccacagcgcagaccctttctacttctgtcatgggctgcacgacggccatcacttccagtatgtgcccaaccagtctagacaccattgcaacgaccaccattgtggcggtatccactttagccaccaccttctactgagtgaccaaggaggtcttcacctagtgcaccgaccactgctttgtccaggtaactgcgcaccgggagactgggattgccactag

SEQ ID NO: 55005 - DNA, 324 bp, Artificial Sequence
  Description of Artificial Sequence: Synthetic coding sequence
atgtccaaccccagcgctcccccaccgtacgaggaccgcaacccactatatcctggtcccccaccccctgggggatatggtcaaccttccgtcttacccggagggtatcctgcctaccccggatacccccagccaggttacggacatcccgcaggatatccgcaaccaatgcctccaacacatccgatgccaatgaattatgggcctggacacggctatgatggcgaagagagggccgtgagcgattcgttcggccctggggagtgggatgacaggaaagtccggcatacctttatccggaaggtgtattctataatctcctag

SEQ ID NO: 55006 - DNA, 273 bp, Artificial Sequence
  Description of Artificial Sequence: Synthetic coding sequence
atgagtaatccgagtgcaccaccgccttatgaagaccgaaacccattgtacccagggcctccccctcctggcggatacggacagccaagtgtgttaccaggtgggtacccggcatacccaggttacccgcagcccggatatggacaccccgcaggttacccacagcctatgccacccacacaccccatgcccatgaattatggcccaggacacggatacgacggggaggagcgggctgttagcgactcctttggccctggcgagtgggactag

SEQ ID NO: 55007 - DNA, 321 bp, Artificial Sequence
  Description of Artificial Sequence: Synthetic coding sequence
atgagtaacccctctgccccacccccttacgaagatcgaaaccctttgtatcccggaccaccccctcccggaggatacggacaaccctcagtgctgccagggggttacccggcttatcccggatatccccagcctgggtacggacaccccgctggctacccacagccaatgccacccacccaccctatgcctatgaattacgggcctggacatgggtatgacggcgaggaaagagccgtgtctgatagcttcggcccaggagagtgggatgaccgtaaggttcgtcatactttcatccgcaaggtttattcaatcatatag

SEQ ID NO: 55008 - DNA, 936 bp, Artificial Sequence
  Description of Artificial Sequence: Synthetic coding sequence
atgagtaatccaagtgcccctcctccctatgaggacaggaaccccttgtatcctggaccacctccccctggcggttatggccagcccagcgttctgccgggaggctatccagcctaccctggctacccacaaccaggatacgggcacccggcaggatacccccagccaatgcctcctacacatcctatgccgatgaactacggccctgggcacggctatgatggagaagagcgcgctgtctctgacagcttcggaccaggcgagtgggatgacaggaaagtgagacataccttcatccgcaaggtgtattccatcatttcggtccagttgctcattaccgtggcaataattgctatctttacttttgtggagcccgtgagcgcgtttgtacggcgaaatgtggccgtctattatgtcagctatgcggtgtttgtcgtgacttacttgatcctggcctgctgccaaggtccaagaaggcgattcccatggaacatcatattgctcacactgttcacattcgccatgggttttatgacgggaactatatcatcgatgtatcaaactaaagctgtgattatcgcaatgatcatcacagcagtggtttcaatttcagttactatattttgctttcagaccaaggtagactttacatcatgcactggactattctgcgtcctcggcatcgtgcttctcgtcactggaattgtgactagcattgtgctgtactttcaatacgtgtactggctgcacatgctttatgctgctctgggcgctatttgcttcacactgttccttgcttacgatacacagctcgtacttggcaacaggaagcataccatatccccagaggactacattaccggagctttacagatctatactgacattatttacatctttacattcgtgttacagctgatgggcgacagaaactag

SEQ ID NO: 55009 - DNA, 414 bp, Artificial Sequence
  Description of Artificial Sequence: Synthetic coding sequence
atgggatttatgacaggaaccatttcatctatgtatcagaccaaagcggttatcattgcgatgatcatcacagccgtggtgtccattagcgtgacgattttttgtttccagaccaaggtggattttacctcttgcacaggactattctgtgtccttggcatagtgttgttggttaccgggatcgtgacgtctatcgtgctatacttccagtacgtctactggctccacatgctctatgctgccttaggagcgatctgcttcaccctgttcttagcttatgatacgcagttggtgctcggaaaccgtaaacacactatctcccctgaggactacattacaggcgcactgcaaatctatacagacatcatatatatctttactttcgttctgcagctgatgggcgaccgaaactag

SEQ ID NO: 55010 - DNA, 222 bp, Artificial Sequence
  Description of Artificial Sequence: Synthetic coding sequence
atgagcaacccctccgctccaccgccatacgaggatcgcaatccgctctatccaggtccccctcccccaggaggttacggtcagccctcagtgttgcctgggggatacccagcgtatccgggatacccccagccgggatatggacacccagctggttaccctcaacctatgcctcccactcaccctatgcccatgaactatggacctggccacgggtactag

SEQ ID NO: 55011 - DNA, 255 bp, Artificial Sequence
  Description of Artificial Sequence: Synthetic coding sequence
atgagtaatcctagcgcacctcctccttacgaggatcgtaatccactctaccccggtccccctcctcccggaggatatggccagccatctgttttaccaggcggttacccggcttatccaggctatccacagcccggttatggccacccagccggatatccacaaccgatgccaccgacacacccaatgcctatgaattatggcccaggccacgggtacgatggcgaggagcgcgctgtgtctgatagcttttag

SEQ ID NO: 55012 - DNA, 279 bp, Artificial Sequence
  Description of Artificial Sequence: Synthetic coding sequence
atgtctaatccatctgctccccctccatatgaagacagaaaccccttgtacccgggaccaccccctcccggtggatacgggcagccatcagtgttgcctggtggatacccagcctaccctggttaccctcagccaggttacggacatccggcaggctatccccagccgatgccgccaacccatccaatgcccatgaattacggacccggacacggatacgacggggaagagagggctgttagtgatagttttgggccaggtgaatgggacgatcgctag

SEQ ID NO: 55013 - DNA, 750 bp, Artificial Sequence
  Description of Artificial Sequence: Synthetic coding sequence
atgcctatgaattacggccctggacacggctatgacggggaggagagagcagtatccgattcattcgggccaggggagtgggatgatcggaaggttcgacatacttttatcaggaaagtctattccatcatttcagtgcaactgctcatcacggtggcaataatcgctatctttactttcgtggagccagtaagcgcattcgtcaggcgcaatgtggcagtgtattatgtctcgtatgcggtatttgttgtcacttacctcatcctggcttgctgccagggcccaagacgacgctttccttggaacataattctactgacattatttaccttcgcaatgggctttatgaccggcacaatatcttcaatgtatcaaaccaaggcagtcatcatcgcaatgatcatcactgcagttgtgtctatcagcgtgacaatcttctgcttccaaaccaaagtagacttcacatcttgcactggattgttctgcgtcttggggattgtgctgctggtcacggggatcgtgacttccatcgtgctgtacttccaatacgtgtactggcttcatatgctctacgccgcattaggcgctatctgttttactctgttcctcgcctatgatacccagctggtgctgggaaacagaaaacacacaatcagcccagaagactacattaccggagctctccagatctacaccgatatcatttatatattcacctttgtattgcagttgatgggggatagaaactag

SEQ ID NO: 55014 - DNA, 717 bp, Artificial Sequence
  Description of Artificial Sequence: Synthetic coding sequence
atggcggatcccgaccctagataccccagaagctctatcgaagacgattttaactacggatccagtgtagcttccgctactgtgcatataagaatggcgtttctaaggaaagtgtactcgatcctaagtcttcaggttttactgacaaccgtgacttctactgtgtttctgtatttcgagagcgtcagaacattcgtgcatgaatcaccagctctgattcttctatttgccctgggaagtctagggcttattttcgccttgatactgaatcggcacaagtacccgctaaacctgtacctgttattcggatttaccctgttggaggccttgacggtcgccgtggtagtcacattttatgacgtctatatcatactgcaagcctttatcctgactacaacggtgtttttcggattgaccgtctacacgctccagagcaagaaagatttctctaaatttggcgctggacttttcgccctcctgtggattctttgcctctctggatttctcaaattcttcttttactctgaaataatggaacttgtgctagcagcggcaggcgctctgttgttttgcggttttataatctacgatacacactctctgatgcacaaactctcccctgaagagtatgtcttggcagccatctcgttatacctcgatatcataaacctgttcttacacctcctaagattcctagaagctgttaataaaaagtag

SEQ ID NO: 55015 - DNA, 636 bp, Artificial Sequence
  Description of Artificial Sequence: Synthetic coding sequence
atggcagatccagatccccgatatcccaggtcaagcatcgaggatgatttcaattacggctcctccgtggcttccgcgaccgtccacatccgtatggcatttcttcgaaaggtttactccatcctgtcactgcaggtgctactcaccaccgtgacatccacagtgttcctgtattttgagtcggtgagaacgttcgtccacgagagtccagccttgatcctgctgtttgcgctcggcagccttggtcttatctttgctctcattttgaacaggcataagtatcctctgaatctgtatcttctctttgggttcacgctgttagaggcccttacagtggccgttgtagtgaccttctatgacgtttatataattctgcaggcattcatactcactaccacagtgtttttcggcctaacagtttataccctccaaagtaagaaggactttagcaaattcggggcaggacagtccgcactattagtcgacatagtccccgtgcggatcctggaggtgttcttctattctgaaatcatggagctggtgctggcagctgccggagctcttttattctgcgggtttattatttacgatacccactctttgatgcacaaattgagtcctaaaagtacctactag

SEQ ID NO: 55016 - DNA, 852 bp, Artificial Sequence
  Description of Artificial Sequence: Synthetic coding sequence
atggctgacagacctcctgtgccctcgctgagcatagaggatgactttaactacggtagcagtgtggcttccgcaactgtccacatccggatggttctccagcgggattgtacgttttctaagcagtatatgcgcatcccatctgccccatctgccaccttaaacattatacgttttttccaccttcggcagagcgggaggagcgggatggtcaatattttctacaaagggccaactttcttacgcaaagtttactctatactttccctgcaggtgttgctgacgacagtgacctcaacagtgttcctctattttgagtcagtcaggacctttgtgcatgagagtcccgcattaatcctcctgttcgcgctcggcagcctcgggctgatctttgcactcatattaaacagacataagtatcctttaaacctctacctgctctttggttttactttgctggaggccctgacggtagctgttgtagtgaccttctacgacgtttacatcatcctgcaggctttcatattgaccacgactgtgttctttggacttactgtctataccctccaaagtaagaaggacttctcgaagttcggtgccggactgttcgccctgttatggattctgtgtttgtccggcctcgaagtctttttctattctgaaatcatggagctggtgctcgctgcagccggagctctgctgttttgcggtttcatcatctatgacacccactcactgatgcacaagctgtcgcccgaagaatacgtgctggctgctattagtctgtaccttgatattattaatctctttcttcacctcctgagattcttggaagcagtcaataagaaatag

SEQ ID NO: 55017 - DNA, 507 bp, Artificial Sequence
  Description of Artificial Sequence: Synthetic coding sequence
atggcggaccccgatccccgataccctaggtcttctatcgaagacgacttcaactacggatcaagcgtagctagcgcaactgttcatattcggatggccttcttgcgcaaagtgtacagcatcctgtccttgcaggtcctgttgactacagtaacttccacggtctttctttattttgagtccgtgagaaccttcgtgcatgagtcgcccgcactcattctcctgttcgcactgggatcactggggctgattttcgccctgatcctcaatcggcacaagtatcccctgaatctgtacctgctgtttgggttcaccctactagaggctctgaccgtggcagtcgtggtcactttctatgatgtttacattatactccaggcctttatacttactacaactgtgttctttgggctaaccgtgtacacactacagagtaagaaggattttagcaagtttggggcaggaagatgtcgctcgcctagttttctgtggatccatcacctatag

SEQ ID NO: 55018 - DNA, 714 bp, Artificial Sequence
  Description of Artificial Sequence: Synthetic coding sequence
atgaatatttttgatcggaaaattaactttgatgcccttcttaagttttcgcatatcactccctctactcaacaacacctcaaaaaggtatatgccagcttcgccctgtgcatgttcgttgccgctgcgggagcttatgtgcatatggtcacgcactttatccaggccggattattaagtgccctgggatcactgattttaatgatctggttaatggccactccccattctcatgaaaccgagcagaaacgtctgggcctccttgctgggttcgcttttcttactggggtcggccttggcccagccctggagttttgtatcgccgtcaacccatccatcctgcctacagcatttatggggaccgcaatgattttcacctgcttcacactgtccgccttatacgcgcgaagaaggtcctatctatttttgggaggcattttgatgtctgcactcagcttgctgcttctcagctctctaggcaatgtgttcttcggctccatttggctattccaagccaatttatacgtcggactggtagttatgtgtggatttgttctcttcgatacccaactgattatcgagaaagcggagcatggagaccaggactatatctggcattgtattgatttgtttctggacttcatcactgtatttcgcaaacttatgatgatcttggccatgaacgaaaaagataagaagaaggagaaaaagtag

SEQ ID NO: 55019 - DNA, 714 bp, Artificial Sequence
  Description of Artificial Sequence: Synthetic coding sequence
atgaacattttcgaccgcaagatcaatttcgatgcattattgaagttctcccacatcacccctagcacacagcaacatctgaagaaggtgtacgccagctttgccctttgtatgtttgtggctgccgctggtgcctacgttcacatggtgactcacttcatccaagcagggctcctgagcgccctgggatcccttattctaatgatctggctaatggctaccccacactctcacgaaacggagcagaagcgtcttgggctactggccggttttgctttcttgacaggagtcggcctcgggccagcgctggagttctgtatagccgtgaatccttccattctcccaaccgcctttatgggcacagccatgatctttacctgctttactctttcagcactttatgccaggcgacgatcctacctgtttctcggagggatcttaatgtcagcactgtcattactgctgttatcatccctcggcaatgttttttttgggtccatttggctcttccaggctaatctctacgtgggcctggtggtcatgtgcggattcgtcttgttcgacactcaactcattatcgaaaaggctgaacacggggaccaagactatatttggcactgtatagacttgttcctagactttattacggtgtttcggaaactgatgatgatcctcgctatgaatgagaaggacaaaaaaaaagaaaaaaagtag

SEQ ID NO: 55020 - DNA, 888 bp, Artificial Sequence
  Description of Artificial Sequence: Synthetic coding sequence
atgtcacactcttcggtgacacgggaggcaccacaactgctttctcagcgtcaaaggagggaagtgagaggtgtgtggggttgggggtgcttgcctggcccacgaggcggtcccgctctctttggcctggtgaccttcggtcaatctggcgattgctgtactgatagtggtacaatgaacatttttgaccgcaagatcaactttgatgcgctgctcaagttctctcacatcactccatctactcagcagcacctcaaaaaagtctatgcttctttcgccctatgcatgtttgtagccgcagccggtgcatacgtccatatggtaacacacttcatccaggcaggcctgctcagcgccttgggatcattaatcctgatgatctggctgatggctactccgcatagccacgaaactgaacaaaagcggctgggcttgctggctggattcgcgtttctgacaggtgttggtctagggcctgccctggaattttgcatagcagtgaatccatcgattttgcccacagccttcatggggaccgccatgatttttacgtgcttcacgctgagcgctctttacgcccgaagaaggtcttacctgttcttgggcggaatcctgatgtcagctctgtccctgctgttgttgtcaagcctcggtaatgtcttctttggctcgatttggctttttcaggccaatctctacgtagggttggtggtaatgtgtggctttgtgctctttgatactcagttgatcattgaaaaagccgagcacggtgatcaagattatatctggcactgcattgacttattccttgattttattacggtatttaggaaactgatgatgatcttagcaatgaatgagaaggacaaaaaaaaggagaagaagtag

SEQ ID NO: 55021 - DNA, 381 bp, Artificial Sequence
  Description of Artificial Sequence: Synthetic coding sequence
atgaatatttttgataggaaaatcaatttcgatgctctgttgaagttctcccatatcaccccgagcacgcaacaacacttgaagaaagtgtacgcgtcatttgctctttgtatgtttgtggcagctgccggagcctacgttcatatggtcacccacttcattcaggctggattgctgagtgccctaggctccctgatacttatgatttggctcatggcaaccccccattctcatgaaacggagcaaaagcgattggggcttctggccggatttgcgttcctgacaggcgtgggactgggacctgccctagagttctgtatcgcagtcaacccctcgatcttacccacagcctttatgggaaccgcgctcattagcagctag

SEQ ID NO: 55022 - DNA, 714 bp, Artificial Sequence
  Description of Artificial Sequence: Synthetic coding sequence
atgaatattttcgatcgcaagatcaactttgatgccctcttaaaattctcgcacatcactccaagcacacaacaacacctcaaaaaagtgtacgccagcttcgcactgtgtatgtttgttgccgcagccggtgcctacgttcatatggttactcatttcattcaagcaggactgttgtccgccttgggcagcctgattcttatgatctggcttatggctactcctcactctcacgaaacagaacaaaaacgcttaggcctgctcgccggatttgcgtttctaacaggggtggggctggggccagcacttgaattttgcatcgcggtgaacccaagcatccttcccacagcctttatgggaactgccatgattttcacatgttttacactcagcgccttgtacgctaggaggaggtcatacctgttcttgggaggcatcctcatgtcagctctctcactactgctgttgagctcactgggcaacgtctttttcgggagtatctggctcttccaggcaaacctgtatgtgggcctcgtagtgatgtgcggtttcgtactgtttgacacacagcttataatcgagaaggcggagcatggagaccaggactatatctggcattgcatcgatctgttcctggactttatcaccgtatttcggaaattgatgatgatcctggcgatgaacgagaaagacaaaaagaaagagaagaaatag

SEQ ID NO: 55023 - DNA, 438 bp, Artificial Sequence
  Description of Artificial Sequence: Synthetic coding sequence
atgaacattttcgacagaaaaattaattttgatgccctgcttaagttctctcacatcaccccatcaactcaacagcacttaaagaaggtgtacgccagctttgccctgtgcatgtttgttgccgcagccggtgcctacgtgcatatggtgactcatttcatccaggcgggtctcctgagcgctctgggcagtttgatattgatgatctggctaatggctacacctcacagccacgagactgagcagaaacgcctgggcctgctggctgggtttgctttcctgacaggcgtggggttgggaccagccctggaattctgtatcgcggtgaacccctcaattcttcctaccgcgttcatgggaacagctatgatttttacctgttttaccctgtcagccctttatgccaggcggcgaagctatctttttttagggggttag

SEQ ID NO: 55024 - DNA, 291 bp, Artificial Sequence
  Description of Artificial Sequence: Synthetic coding sequence
atgaacatatttgaccgaaagatcaatttcgacgctctgctgaagttttcacacataaccccatcaacccaacaacacctcaagaaggtatacgcctccttcgcactgtgcatgtttgtcgccgcagcaggcgcttacgttcatatggtaacccatttcatccaagccggactgctgtctgccctgggctcacttattttaatgatttggctgatggcgacccctcattcccacgagacagaacaaaagcgcctgggccttctcgccggatttgctttccttacgggctag

SEQ ID NO: 55025 - DNA, 291 bp, Artificial Sequence
  Description of Artificial Sequence: Synthetic coding sequence
atgaatatatttgacaggaagatcaacttcgacgctctgttgaaattcagccacattacccctagcacacaacagcatctaaaaaaagtgtacgcgagcttcgctctttgcatgttcgtcgccgcagccggagcctacgtacacatggtgacgcactttatccaggccggacttctgtccgccttaggatccctaatcttgatgatatggctgatggctactccacactcccatgagacggaacagaaacgtttaggactactagcaggattcgctttcttgacggggtag

SEQ ID NO: 55026 - DNA, 417 bp, Artificial Sequence
  Description of Artificial Sequence: Synthetic coding sequence
atgaacatctttgaccgcaaaattaactttgatgcgctcctaaaattttcccacattaccccgtcaacacaacagcatctgaagaaagtgtacgcttcgttcgccctgtgcatgtttgtcgctgctgccggagcttacgtccacatggtcacccacttcatccaggccggactgctgtctgctctgggttcactgatactgatgatctggttgatggcaacgccacactcacatgaaaccgaacagaagcgcttagggctcctggctggcttcgcctttctcactggggtagggctagggccagccttggaattttgcatagcggtgaacccctcgatcctgcccacggcttttatgggcaccgccatgattttcacttgttttactctcagcgccctttacgcgaggcgccgatag

SEQ ID NO: 55027 - DNA, 393 bp, Artificial Sequence
  Description of Artificial Sequence: Synthetic coding sequence
atgaatatatttgataggaagatcaatttcgatgcccttctaaagttttcacacataacaccttccacgcagcagcatttaaaaaaggtgtatgccagcttcgctctgtgcatgttcgttgctgccgctggggcatacgtccatatggtcactcatttcattcaggctggacttctgtccgccctgggaagccttatccttatgatctggttaatggccaccccacactcacatgaaaccgaacagaagcgcctggggcttttagcagggtttgcatttttgaccggggttggacttgggcctgcgctggagttttgtatcgccgtgaaccccagcattcttccaaccgccttcatgggcaccgccatgatttttacatgctttacgttgtag

SEQ ID NO: 55028 - DNA, 33 bp, Artificial Sequence
  Description of Artificial Sequence: Synthetic coding sequence
atgaacatttttgatcgcaagatcaacttctag

SEQ ID NO: 55029 - DNA, 36 bp, Artificial Sequence
  Description of Artificial Sequence: Synthetic coding sequence
atgaatatcttcgacaggaaaatcaatttcgattag

SEQ ID NO: 55030 - DNA, 51 bp, Artificial Sequence
  Description of Artificial Sequence: Synthetic coding sequence
atgaatatcttcgatagaaagataaatttcgatgctttgctgaaattttag

SEQ ID NO: 55031 - DNA, 270 bp, Artificial Sequence
  Description of Artificial Sequence: Synthetic coding sequence
atgaacatttttgataggaaaatcaatttcgacgctctccttaaattctcccatattactcctagtactcaacagcacctgaagaaagtctacgcttctttcgcactctgcatgtttgtggccgctgccggtgcctatgtgcacatggtaactcatttcatccaggccggacttctgtctgcccttggtagtttgattctgatgatatggctcatggccaccccacatagccatgaaaccgaacagaagcgcctggggttgctcgcatag

SEQ ID NO: 55032 - DNA, 714 bp, Artificial Sequence
  Description of Artificial Sequence: Synthetic coding sequence
atgaatatcttcgaccggaagattaacttcgatgcgctcctgaaattctcacatatcacaccttccacacagcagcatctgaagaaggtatacgcttccttcgccctctgcatgttcgtggctgccgctggtgcatacgttcatatggtgactcacttcattcaagccggactgctgagcgcattgggcagcctgatcctgatgatatggctgatggccacccctcattcacacgagacagaacaaaaacgtctagggcttctcgccggttttgctttcctgactggggtcggactgggtccagcattagaattttgtatcgcggtcaacccatcaattctgccgaccgccttcatgggtaccgcaatgattttcacctgctttacactctcagccctgtacgcaagacggaggtcctacttgttcctcggcggtattctcatgtctgcgcttagccttctgttgctctcaagcttgggtaacgttttctttggatctatctggctatttcaggccaacctgtatgtcggactcgtggtgatgtgtggattcgtgctgttcgacactcagctgatcattgagaaggctgagcatggagatcaggattacatctggcattgcattgacctgttccttgactttattaccgtctttcggaagttgatgatgatccttgcaatgaatgaaaaggataagaagaaggaaaaaaagtag

SEQ ID NO: 55033 - DNA, 291 bp, Artificial Sequence
  Description of Artificial Sequence: Synthetic coding sequence
atgaacattttcgaccggaagattaactttgacgcacttctcaagttctcccacataactcccagcacacagcagcacttaaagaaagtctacgcaagctttgcactatgtatgtttgttgccgctgcaggcgcttacgttcatatggtcacgcacttcatccaagctgggttgctatcagcccttggatcccttattctgatgatctggttgatggccacaccacactcccacgaaactgaacagaagaggctcggactgttggctggtttcgcctttctgacaggctag

SEQ ID NO: 55034 - DNA, 327 bp, Artificial Sequence
  Description of Artificial Sequence: Synthetic coding sequence
atgaacatcttcgaccgtaagatcaactttgacgcgttactgaagttttcacacatcactccctcaacccagcaacatctcaagaaggtgtatgcctcctttgctctgtgcatgttcgtggctgctgctggcgcttacgtgcacatggtaacgcactttattcaagccggtctcttaagcgccttggggagtttaattctgatgatttggctgatggccactcctcactcacatgaaaccgaacagaaaagactggggcttctcgccggattcgcttttctgacgggagtgggtctcggacccgctctcgaattctgtatcgcttag

SEQ ID NO: 55035 - DNA, 438 bp, Artificial Sequence
  Description of Artificial Sequence: Synthetic coding sequence
atgaacatctttgaccggaagattaactttgatgccttgctgaagttttcccatatcacaccttctacccagcagcacctgaaaaaagtttacgcttcctttgctctatgcatgttcgtggccgctgcaggagcctacgtccatatggtgacccactttatccaggcaggcttactaagcgccttgggatcactgatcttgatgatttggctgatggcaacaccacattctcatgagactgagcagaagaggttaggtttgctggctggatttgcctttcttacaggtgtggggctcgggcctgccttagagttctgtatcgccgtcaatccaagcatccttcccacagccttcatgggtacggccatgatctttacctgctttacactatctgccctgtacgcacgcaggcgctcttaccttttccttgggggttag

SEQ ID NO: 55036 - DNA, 135 bp, Artificial Sequence
  Description of Artificial Sequence: Synthetic coding sequence
atgaatatcttcgatcgcaaaatcaattttgacgctttattgaaatttagccacataacaccaagtactcagcagcacctgaaaaaagtgtatgcctccttcgccctctgcatgttcgtagctgccgctggatag

SEQ ID NO: 55037 - DNA, 126 bp, Artificial Sequence
  Description of Artificial Sequence: Synthetic coding sequence
atgaacatattcgatcggaaaataaacttcgacgctctgcttaaattttcacacattacaccatctacgcagcagcatttaaagaaagtgtacgccagctttgctctctgcatgtttgtagcttag

SEQ ID NO: 55038 - DNA, 618 bp, Artificial Sequence
  Description of Artificial Sequence: Synthetic coding sequence
atgaatatattcgatagaaaaattaactttgacgcattgctgaagttctctcacattacgccctctacccagcagcacctgaagaaagtttacgctagcttcgcgttgtgcatgttcgtggccgctgcgggagcttacgtccatatggtcacacacttcatacaggccggactgctctccgccctagggtctctgattttaatgatatggcttatggctacaccccacagtcacgaaacagagcagaaaaggttgggactgctcgcgggattcgctttcttgacaggagtgggactcggacctgctctagagttttgcatcgccgtaaacccctctatactacctacagctttcatggggaccgcaatgatttttacatgtttcacccttagtgcattgtatgccagacgacgatcctacttatttttgggaggcattctgatgtccgccttgtcattactgctcctctcctcgctggggaatgtgttcttcggcagcatctggttgtttcaggctaacctctacgtgggactggtggtaatgtgtggattcgtgttgtttgacacccagctgatcattgaaaaagcagaacacggggaccaagattacatatggtag

SEQ ID NO: 55039 - DNA, 888 bp, Artificial Sequence
  Description of Artificial Sequence: Synthetic coding sequence
atgagtcatagcagcgtgacccgcgaggcaccacagcttctgtcccagcggcagcggcgtgaggtgagaggagtctggggttggggttgtctgcctgggcctcggggtggcccagccctgtttggactggtgacctttggccagtcaggagattgttgtaccgacagtggaacaatgaacatttttgatcgcaagatcaacttcgacgccttactgaagttctcccacattacccccagtacgcagcagcacttgaagaaggtatatgccagcttcgcactgtgtatgtttgtagcggctgcgggtgcctatgtacatatggtcacacactttattcaagcgggattgctgtccgcgctggggagtctgatcctcatgatctggctgatggccactccccacagccacgagaccgaacagaagcgtcttgggctcctcgccggattcgcttttcttaccggcgtggggctggggccagccttagaattttgcattgcagtcaacccctcaattcttcccactgcgtttatgggcaccgccatgatatttacctgttttaccctgtccgctctgtatgccaggagaaggtcatatctgtttttagggggtatactaatgtccgcattgtccctcttgctgcttagctctctcggcaacgttttctttggatctatctggcttttccaggcaaacctctatgtcggtcttgtggtgatgtgtggatttgtgcttttcgatacccaactcataatcgagaaagcagaacacggagaccaggactatatctggcactgtatagacctgttcctagactttattactgtgtttcggaaactgatgatgatcttggctatgaatgagaaagataaaaagaaagagaagaaatag

SEQ ID NO: 55040 - DNA, 3303 bp, Artificial Sequence
  Description of Artificial Sequence: Synthetic coding sequence
atgaaaaccagcaaggctagtcagagataccgaggaattagacggaacgcctcacagtgctatttgtatcaagagtctctgcttctgtccaacctggacgactccttctctgcggacgaaaccggagactctaacgatccggaacaaatcttccagaatattcaattccaaaaggatttgatggcaaatattcggtgtcgcccttggaccatgggccaaaagctgagggcgctgagacaggccaagaacatcgttctgaagtttgaagggagactgacaaggactcggggatatcaagcggcaggagcagagctttggcggaagttcgctaggctcgcctgtaatttcgtggtgattttcattccatgggagatgcgaattaagaagatcgagtctcatttcggctccggagtggcttcttacttcatctttcttaggtggctatttgggatcaatatagtcctgactatcatgacaggcgcttttatagttattcccgaattgatagccggtcagccttttggctctactgccagaaagaccatccctaaagagcaggtgtccagcgcccaagatttggacaccgtatggagtttaggcggatacctgcagtacagtgtgctattctacggttactacggacgcgaaagaaagattgggagagcaggttatagactccccctggcatactttctagtgggcatggctgtctttgcttattctttcattatccttcttaagaaaatggcaaagaattcgagaacttctctcgcatcagcctccaacgagaactacacattctgctggagagtcttctgtgcctgggattatcttatcggcaaccctgaggcggctgagtctaagactgctgcgattgtgaatagtattagagaggcgattctggaagagcaagagaaaaagaagtctaaaaatctggctgtcacaatatgcctgcgcattattgcaaacattctggtgcttctgagtcttgctggctccatctacctgatctacttcgtcgtggataggagccagaaactggaacagagtaaaaaggagttgacactgtgggagaaaaacgaggtgtccgttgtggtgagtctcgtaaccatgatcgccccatccgcattcgaccttattgctgccttggaaatgtatcaccccaggacaactctccgatttcagcttgccagagttctggtgctttaccttggcaacctatacagcctgattatcgctcttctggacaaggtcaacagcatgagcattgaggaaatggccaccaagaacaacacctcacactggatcgattcgactacattttttgcaaccaggacagcccctgaggaggagaagtggagcacatccagacctggcatgggcctgcgcaggaacaacacttgggcccttgaagagacctccatctccgcatatacaatgcccctcatcaaggcaaacaagacctctctccatacacaaagtccccaggatcagtgctgggaaacatacgttggacaggaaatgctgaagctgtccatcatagatatgctgtttacggtggccagcatcctgcttattgattttttcagagggctatttgtccggtatctctcggattactggtgctgggatcttgaatcaaaattccctgagtatggcgagttcaagatagccgagaacgtgctgcaccttgtgtataatcaggggatgatttggatgggggcatttttcagcccctgtcttcctgcctttaatgtactgaagctaatcggtttgatgtaccttcggtcttgggccgttctcacttgcaacgttccccaccagcaggtcttccgcgcatcacgcagtaataatttctaccttgccatgctgctgtttatgttattcctctgtatgttgcccactatattcgccattgtaagatacaagccttcattgaactgtgggcctttttccggccaggagaagatttacgatatcgtgagcgaaaccatcgaaaaagacttccctgtctggttcggctctgttgttggccacatttcctcacccgtggtcattctccctgccgtcttgttgctgttcatgcttatatattatctgcaatccatcgccagatcccttaagctctcaaatcaccagctaaagatgcagatacagaatgcccgttccgaggataaaaaaaaggttgctcagatggtggaggcacggatccagacgcaagaagaaagcaccaaaaaactgccaaatgacagcgatctcacgagtcagctgagcagtgcacattcaggaacaccacagaataacggtaatgtcgctcacttcgattcaggctcctccaaaagcgggaggatcgagacagtggctcagtccatgccacagagcccacgacctggcgaccgggcacccagctctccactccctggagttccgaagagcagactggagcacgagaccaacaggtatcttcacggactgtgcgcgagcacctcagacttacatcgcaatagatcccgtacccccatgactttcacgacccacattgaagatgtacatagcgaaccgctgttccggaaagactttcagcagatcaatcctccgcatcgcggtccgcaggcaagtaccctgttagcacaggggccacggccacatgcaccacgctattacgtaattaatgaatgtgacagttataagaaaaaacatctgaacgtgtggccggagagacactttaagatagatgcaagcggagacatagtggagctctatccacggaatgtgaggcagtatgcttcaagagtacccagacagcctcccagtccccaattgtctgaagaggaggaagaaactccaagccgagactggatcaagaggtctctcccccctaggagcctgattgatctgaggcgggctccacatttttacattggtgaacggagcgaaagccagactagagatccagagcaccagggcagagtccactacaagtcttggaacgaagattttgaaggccacctggaaaggcccgcttatgtgcctcgcaaaccacggagcaggaactttcaataccctcaaccaccgctcaagccacggggaaaacctagatttgagccatcccttaccgaaagtgacagtgtgagcgctgccagttcaagtgaccagcagaacagctcagccgaccagtatttgcaggtcactcattcacagggacggttcccacggtctgtgggacagccctcccgcagaaaggccaagtccggacaggaactgacagtcgacctagacgacctgatctgcagtgacgtttag

SEQ ID NO: 55041 - DNA, 3306 bp, Artificial Sequence
  Description of Artificial Sequence: Synthetic coding sequence
atgaaaacgtcaaaggctagccagcgctatcgcggaatccggaggaatgcatcccagtgctatttgtaccaggagagcttgcttctgtctaacctcgacgattcatttagtgcagatgagaccggcgactcgaatgatcctgagcaaatcttccagaacattcagtttcaaaaggaccttatggccaacataagatgtcggccttggactatggggcagaaactccgtgccttacggcaggcaaaaaatattgtgctaaagttcgaaggccgtctaacacggacccgcggataccaggcagcaggggctgaattgtggaggaaattcgcacgcttagcctgcaactttgttgtaatattcatcccatgggagatgcggattaaaaagattgagagccattttggatctggggtggcctcgtacttcattttcctaaggtggctatttgggatcaatatagtcctgactatcatgactggggcttttatagtgattcccgagctgatcgctggacagccgttcgggagtacagcacgcaaaactatacccaaggagcaggtttcaagtgcacaagatctggacacggtgtggagcctgggcggatacctccagtatagcgtgctgttctatgggtactatggtagagagagaaagattgggagggcaggatatcgcctgcctctggcatactttcttgtcggtatggccgtgttcgcttactcctttatcatcctgctgaagaaaatggctaagaattcaaggaccagcctcgcttcagcctctaacgagaactacacattctgttggcgcgtcttttgcgcctgggattaccttattgggaatccggaggctgccgaaagcaaaacggcagccatcgtgaatagtattagagaagctatcctggaggagcaggagaagaagaaatcaaagaacttagcggttaccatctgcctgcggatcattgctaacatcttagtacttctgtctttagctggcagtatctatctgatttactttgtggtcgataggtcacagaaactggagcagtcgaagaaggaactcaccctatgggaaaaaaacgaacaagtgtctgtcgtggtttctttggtgactatgattgctccgtccgcatttgatctcattgctgcgttggagatgtaccaccctaggacaacattgaggtttcaactcgcgagagttcttgtgttatacctggggaatttgtattcgctgatcatagccctccttgacaaggtgaacagtatgtccatcgaagagatggctaccaaaaataataccagtcattggattgacagtacaaccttctttgccacaagaacagcaccggaagaagagaagtggtcaacctcccgccctgggatgggtttacggaggaataacacatgggcgctggaggaaaccagtatctctgcgtacaccatgcctctcatcaaggcaaataagacatctttacacacccagtcaccgcaggaccagtgttgggaaacatacgttggacaggaaatgctcaagctcagcatcattgatatgctttttaccgtggcatccatattgcttattgattttttccgaggactctttgtgcgttacctgagtgactactggtgttgggatctggagtcaaagtttcctgagtatggcgaatttaagattgctgagaatgtcctgcatctggtctataatcaaggaatgatatggatgggggcttttttctccccttgccttccggctttcaacgtgcttaaactgataggccttatgtatttgagatcgtgggccgttctcacttgtaacgtgccccatcagcaggtcttcagggcaagtcgctcaaataatttctacctggccatgttgctgtttatgctgtttctttgcatgctgcctaccatctttgcgattgtgaggtacaaaccgtccctgaattgtggaccattttccggccaagaaaagatttatgacattgtgtccgagactatagaaaaggacttccctgtgtggttcgggtctgtggtcgggcacataagctctcctgtggtgattttgccagctgtgctgttgctctttatgctcatttactacctgcagtcaatcgcgaggagcctgaaactgagcaatcaccagcttaagatgcaaattcagaacgcgagatctgaagacaagaaaaaagtggcacagatggtggaggcacggattcagacccaggaagagtcaactaagaagttgcccaatgatagtgacctcactagtcagctaagctctgctcacagcggaactccccagaacaacggaaacgtcgctcactttgacagtggctcctcaaaatctggaaggattgagacagtagcccagtctatgccccagtcaccgcgacctggagaccgagcgccaagcagccctcttcccggagtcccaaaatctcgcctggaacacgaaaccaatcggtatctccacgggctgtgtgcttcgacgagtgacctccataggaataggagcagaaccccgatgacctttactacacacatagaagacgttcattcagagcccctgtttcgcaaagactttcaacaaataaaccctccacatagaggaccacaagcctcaactcttcttgcgcagggaccccgaccccatgcgccacggtactatgtcattaatgaatgcgatagctacaagaaaaagcacctgaatgtctggcctgagcgccatttcaagatcgacgccagcggcgatattgtcgagctatacccccgtaatgtgaggcagtacgcttcgagggtgcctcgtcagcctccaagcccacagttgtccgaggaggaggaggaaacaccatctagagactggatcaaacgcagcctacctcccaggagtttgatcgacctgcgtagggccccacacttctacattggtgaacgaagcgaatcccagacaagggatcccgaacatcaagggagagtccactataagtcctggaacgaggattttgaaggtcatctggagcgcccagcttacgtgccgaggaaaccgaggtctcgcaacttccagtacccacagcccccactcaagccgagaggaaaaccaaggtttgagccctcactgactgaaagcgactctgtgtctgctgcgtctagttcagaccagcagaacagctcagctgatcagtatttgcaggtgacgcattctcagggccgttttccgcgatccgtgggccagcctagtcgaaggaaggctaaatccggtcaggagctgaccgtagacctggatgacttaatctgttcagacgtgtag

SEQ ID NO: 55042 - DNA, 2121 bp, Artificial Sequence
  Description of Artificial Sequence: Synthetic coding sequence
atggaggagaatccaaccctcgaatccgaggcatgggggagttcacggggatggttggccccaagggaggccagaggcggaccctctctctctagtgtcctgaatgaactgccctctgccgctaccctgagataccgggatcccggtgttctcccgtggggtgcgctcgaggaggaggaggaagatggcggtagatcccgcaaggctttcaccgaagtgactcagactgagcttcaggatccccacccaagccgtgaactgccatggccaatgcaggcaaggcgcgcacatcgacagagaaacgcttctcgggaccaagtggtgtacgggtctggcactaagacagatcggtgggcgaggctccttagaaggtcgaaggagaagactaaagagggcctgaggtccctacagccctgggcctggaccttgaagaggattggcggtcagtttggagcagggactgagtcatatttctcgctacttagattcttactgctgttgaacgtactcgccagcgttcttatggcttgcatgaccctgctgccaacgtggctcggaggagcaccacccggacccccaggcccagacatcagttctccctgtggatcctataacccgcattcgcagggccttgtaacttttgcaacccaactctttaaccttcttagtggagaaggctatctggagtggagtccactattttatggcttttacccgccaaggcccaggctggctgtgacctacttatgctgggccttcgcagtgggcctgatttgtctgctgttaattttacatagatccgtgagcggtctaaaacagacgcttctggccgaaagcgaggcactcacaagttacagtcatagagtgtttagtgcttgggattttggcctctgtggagatgttcacgtcaggctaagacagaggattattctctatgagctcaaagtcgagctggaagagaccgttgtcaggcgccaagcagcggtgcgcaccttggggcagcaggcacgggtgtggctggttcgcgtgctgctcaatttactggtcgtcgctttgctgggggctgccttctatggcgtttattgggctactggttgcaccgtcgaattacaagagatgcctttagtccaagagctgcctctcctgaaactcggggtgaactatctaccttctatttttattgccggtgtgaacttcgtgctaccgccagtgttcaagcttatcgcccctctggaaggctacacacggtccaggcagatcgtatttatcttacttcgaacagtctttctgcgtttagcctctttagtcgttctgctgtttagcctttggaaccagataacgtgcggaggtgatagtgaagccgaggactgtaagacctgtggatacaactataaacaactgccttgctgggagacagtgctcggtcaggaaatgtacaaactccttctattcgatctgctcacggttctcgctgtagcactgctaatacagttcccccgtaagctgctgtgcggcctttgtcctggcgctctgggcaggctggctggcacccaagaattccaggtccccgacgaggttttgggtctgatttatgcacagactgtggtctgggtaggttccttcttctgtccactactcccactgctgaataccgtgaagttcttgctgctgttttatctcaagaaactcacactcttttccacctgtagcccagctgccaggacctttagggctagtgccgctaactttttcttccctctcgtcctcctgctcggccttgccatctcgagtgtgcccctcttgtactcaatctttctgataccaccaagcaaactttgtggtccttttagaggtcagagctctatttgggctcagattccagagtctatctcaagtctgccagagacgacccagaatttcctcttctttctgggtactcaggcctttgccgtcccccttctgctgatctcatccatcctcatggcatatacggttgcactggcaaactcttacggcagactgatctctgaattgaagaggcaaagacaaacggaagcccagaacaaggtctttctagctcggagagccgtggccctgacatccacaaaacctgccttatag

SEQ ID NO: 55043 - DNA, 2139 bp, Artificial Sequence
  Description of Artificial Sequence: Synthetic coding sequence
atggaagaaaatcccacactcgaaagcgaggcatggggaagctcccgaggctggcttgctcctcgcgaagcccgaggcgctccgtgtagcagtccagggccatcccttagcagtgtgttgaacgaacttccttctgccgcaacactgcggtacagagaccctggcgtcctgccttggggggctttagaggaggaggaggaggacgggggacggagcagaaaagccttcaccgaagtaacgcagacggagctgcaggatccccacccctcaagggaactcccttggccaatgcaggcacgcagggcacatcggcagcgcaatgcctcccgagaccaggttgtgtacggctctggtaccaaaaccgaccggtgggccaggttgctgcgccgaagcaaggagaaaaccaaggaaggtctaaggtctctgcagccttgggcatggaccctcaagcggattggcggacagttcggtgcgggaaccgagtcctacttttctctgctccgcttcctgctgctgttaaatgtgctggcatcagtcttaatggcatgcatgactctgctcccgacgtggttaggaggcgcaccacctggccctcccggaccagatatctcctcgccctgtggctcgtataacccccactcacaggggctggtgacttttgccacccagctctttaatctgctgagtggcgaaggatatctcgaatggtctccactgttttacggtttttacccacctaggccgcgactggccgtaacatatctctgttgggcctttgccgtgggccttatctgtctactgctgatcctccataggagtgtttccgggttaaagcagactctgcttgccgagagtgaggcacttaccagttatagccaccgtgtcttcagtgcttgggatttcggcctgtgtggggatgtacatgtaaggctccgtcaacgtattattctctatgagttgaaagtggagctagaggaaacggtggtccgccgtcaggctgctgtcagaactcttggtcaacaggcccgagtctggctggtgcgagtgttgctcaatcttctggtggtcgcactgctcggagcagctttctacggcgtgtactgggccacgggatgcactgtggagctccaggagatgcccttagtgcaggagctgccgctgctcaagctgggcgtgaattacctgccttctatatttatcgccggagtgaacttcgtgttgccaccggtctttaagctgattgcacctctcgagggatacacccgttctcgtcagatcgtttttattctgttgcggacagttttcctgagactggcgtcattggtcgtacttctgtttagcctatggaatcagataacgtgcgggggtgacagtgaggctgaggattgcaaaacctgcggctataactataagcagttgccctgctgggaaaccgtcctcggtcaggagatgtataaactgcttttgttcgacttgttgacggtcctggctgtcgccctactgatccagttcccgaggaagctcctgtgtgggctttgcccaggagctttaggtaggttagctgggacacaggagttccaggttcctgacgaagtgcttggtctgatatacgctcagacagtggtgtgggttggctcgtttttttgccctctactaccgctgctgaataccgtgaagtttcttttacttttctatctcaagaaattgaccctgttttctacttgttccccggctgcacgtacattccgcgctagcgccgcaaatttttttttccctctggttctattgctggggcttgctattagtagtgtgccattgctatacagtatcttcctcatccccccaagcaaactctgcggccctttccggggacagtcttccatttgggcccagattccagagtccatttcttccctgcctgagaccactcagaatttcctgttctttttaggcacccaggcttttgccgtacccctgcttctcatctccagtatactgatggcctacactgtggcactggctaactcttatgggaggctgataagtgagctcaagcggcagcggcagactgaggcccaaaacaaggtgtttctggcgcgtagagccgtagccctgacctctactaagcctgccctatag

SEQ ID NO: 55044 - DNA, 885 bp, Artificial Sequence
  Description of Artificial Sequence: Synthetic coding sequence
atgaaaggtggaggaggtcagcgggatgttggcgctgatcgcaccgtttttctgcgcctcgcgagcctcgtcgtccttttgttctctctctggaaccagattacctgtggaggagattcggaggccgaagattgcaaaacctgcgggtataactacaagcaattgccatgctgggagacagtgctgggccaggaaatgtacaagcttctgctgttcgatcttctgacagtgctggcagtcgcactgttgattcagtttcctcgaaagcttctctgcggcctgtgccccggagcactcggaagactcgctggcacccaagaattccaggttccagatgaagtgctcggtctgatctacgcccagacagtagtatgggtcggctcctttttttgtccactgctgcctctgctgaacaccgtgaagttcctccttctattttacctgaaaaagctcaccctgttttctacctgttcacctgcagccaggactttcagggcaagcgctgccaattttttttttccacttgtcctgttgctgggccttgctatttcttctgttcctctcttgtatagcatcttcttgattccaccttcaaaactctgtgggccattccgtgggcaatcaagtatctgggcacagatccccgagagtatctctagtttacccgaaaccacccaaaatttcctcttctttcttggaacacaggccttcgctgtgccgctgttgctaatcagctcaatcctgatggcttacactgtggccctcgccaattcctatggcaggctgatatctgaactgaagcggcaaaggcagacagaggcgcagaataaggtgtttcttgctcgacgcgcagtggctctgacaagtacaaagcctgcattgtag

SEQ ID NO: 55045 - DNA, 1377 bp, Artificial Sequence
  Description of Artificial Sequence: Synthetic coding sequence
atggcagctcaaggtgccgcagcggctgtggcagctggcacatctggtgtggcaggggagggcgagcccggtccgggtgagaacgcagccgcagaaggcaccgcaccgagcccaggcagggtgagccctcctactccagcaagaggggagcccgaggtgacagtggagattggagaaacgtacttatgtcgaagaccagattcgacgtggcattctgctgaagtgatccaatctagagtgaacgatcaggaggggagggaggagttctatgttcattacgtgggattcaacagaagactggatgaatgggtcgataagaaccgccttgccttgactaagactgtgaaagacgcggttcagaaaaactccgagaagtatttatccgaactggccgagcaacctgaacgcaagattacacgcaatcaaaagagaaaacacgatgaaatcaatcacgtccagaagacatatgctgagatggaccccacaactgccgctttagaaaaggagcacgaggccatcacaaaagtgaagtacgttgacaaaatccacatcggtaactatgagatcgacgcctggtatttttcccccttccctgaggactatggaaaacaacctaaactctggttatgcgaatactgcttgaaatatatgaagtacgaaaaatcttatcggttccacctcggtcagtgtcaatggaggcagccaccaggaaaggagatttacagaaagagtaatatctctgtgtacgaagtggatggtaaggaccataaaatatactgtcaaaacctgtgcctccttgctaagctgttccttgatcacaaaactttgtatttcgacgtcgagccgttcgtgttctacatcttaaccgaggttgaccgccagggcgcacacattgtgggatattttagcaaggaaaaggagtctccagatggaaacaatgtggcatgcatcttaaccctcccaccctaccagagaagagggtacggtaaattcctgattgcatttagttatgaactcagtaaacttgagtcgacggtcgggagccccgaaaagcctctgagcgatctcggaaagctttcctaccgcagctattggagttgggttctgctggaaatcctgagggattttcgcggtacactttctattaaagacctgagtcagatgacgtccataacgcaaaacgacatcatttcaactctccaaagtcttaatatggtcaagtactggaaaggccaacacgtaatttgcgtgacgcccaaattagtggaggaacatctgaaatccgcccagtataaaaaaccaccaatcacagtggacagtgtttgtcttaagtgggcacctcctaaacacaaacaggtgaagttgagcaagaagtag

SEQ ID NO: 55046 - DNA, 2847 bp, Artificial Sequence
  Description of Artificial Sequence: Synthetic coding sequence
atgtctgcctactatcgcaacaactggtctgaggaagaccccgattatcccgattactccggatcccagaatcgaacccagggctatttaaagactcaggggtatcccgatgttccaggccctctgaataatcccgactacccaggcaccaggtctaacccgtattccgtggccagcagaaccaggccagactatcctgggagcttggccgagcccaattacccgaggtccttatccaacccggattactccgggactcggagtaacgcttacagtgcggctagccgaacttcacctgatcatcccacatctctgcctgagcctgattactctgagttccagtcacacccataccatcgtgcgagttctaggcaaccagactaccctggctctcagcgcaatccggactttgcaggaagttcctccagcggaaactatgctggttcaagaacccatcccgatcattttggatctctcgagccggactaccctggagcgcaatcaaattctgatcacccgggaccccgagcgaatctgaaccacccaggaagccgaaaaaatctcgagcacacatccttcagaattaacccatatgcggattctctgggcaagcccgattaccctggcgctgacatccaacctaattcccccccattcttcggagagccagactacccctccgcggaggataatcagaatcttccttccacttggcgtgaaccagactactccgatgcagagaacgggcatgactacggctcctctgaaacgccaaaaatgacccgcggagttctcagcagaacctcatccatacagccaagttttaggcaccggtccgacgaccctgtgggctccttgtggggcgagaacgactaccctgaaggtatcgaaatggcctccatggaaatggccaatagctatggccactccctgccaggcgctccaggctcagggtacgtcaatcccgcatacgtaggcgagagtggaccggtacacgcatatgggaacccaccattgtcagaatgcgattggcacaagtcaccccaagggcagaaactaattgcatccttgatccctatgacatctcgtgatcgcatcaaggccatccgtaaccaacccagaactatggaggagaagcggaacctgcgcaaaattgtggataaggagaagagcaagcagactcaccggattctgcagctcaattgctgcattcaatgccttaacagtatctctagggcataccgcagatccaagaactccttaagcgaaattttgaacagcatttccctctggcagaaaacattaaagattatcggcggaaagtttggtaccagcgtactgagctactttaatttcttgagatggctcttaaaatttaatatcttctctttcatcctcaatttctcgttcattattatccctcagtttacagtagctaagaagaacacattgcagttcaccggcctggagttttttacaggcgtgggctactttagggacaccgtcatgtattacggattttacactaactcgactatacagcatggcaattctggtgcctcttacaatatgcagcttgcttacatctttaccattggagcctgtctcacaacctgtttttttagcctgctcttttccatggcaaaatactttcgcaacaacttcatcaatcctcacatatattcaggaggcattacaaaattgattttttgttgggattttacagtgacccacgagaaagccgtcaaactgaaacagaagaacctctcaacggagattagagagaacttaagtgagctgaggcaggagaacagtaagctgacatttaatcagctacttacccggttcagtgcatatatggtcgcatgggtggtgtccacaggcgtggccattgcttgctgtgctgctgtctactacttagcggaatataaccttgagttccttaaaactcacagcaatcccggagctgtcctcctgttaccattcgttgtgagctgtatcaacctggccgtaccctgcatctactccatgttccgtcttgttgaaagatatgagatgccccgacacgaggtttatgtgctgctaattcgtaacatctttctaaagataagtattattggcattctgtgctattactggctcaatacggtggctctctccggagaggagtgttgggaaacacttatagggcaggacatttatcgtctgctgctcatggattttgttttctcattggtgaacagtttccttggagagtttctgaggaggatcatcggtatgcagctgataactagtttaggactgcaggagtttgacattgcccgtaatgtcctggaacttatctatgcgcagaccctggtatggatcggtatattcttctgtcccttgctgccctttattcagatgatcatgctcttcattatgttttactctaaaaacattagcctgatgatgaacttccagccgcctagcaaagcatggcgggcaagccaaatgatgacattcttcatttttctgctgttctttcctagctttaccggcgttctgtgtaccttagccattactatctggagaataattacttatctatactggcagattactgagggcagaaagatcatgattaggctgctgcatgagcaaatcattaatgagggcaaggacaaaatgtttttaatcgagaaacttataaagctgcaggatatggagaaaaaagccaatccctcatccctcgttctcgaacgcagggaagtggaacagcaaggcttcctacatctgggtgagcatgatgggtccctggatctgcgctcccgtaggagcgtacaagagggaaacccacgcgcatag

SEQ ID NO: 55047 - DNA, 3021 bp, Artificial Sequence
  Description of Artificial Sequence: Synthetic coding sequence
atgtcagcatactacaggaataattggtctgaagaggaccctgattaccctgactatagtgggtctcagaatcgcacgcagggatatctgaaaacccaaggctatccagatgtccctggtccactaaacaatccggactaccccggtactcgctcgaatccatattctgtggcctctaggactcgtccagattatcccggttccctggctgagcctaactatcctaggtctttgtctaatcctgactattccggcacccggtctaatgcttattctgcagccagccggacaagtcccgaccacccgacttccctacccgaaccagactactccgagtttcagtctcacccttaccaccgcgcttcaagtcgccagcccgattatccgggaagccagagaaatcccgattttgctggctcttcctcctctggaaactacgcagggtcgcgcacacatccggatcactttggcagcctggagcctgattatcctggcgcacaaagtaattctgatcatcctggacccagagcaaacctcaatcatccagggagccgtaagaacctcgagcacacgagctttaggattaacccttacgctgactccttagggaagcccgattaccctggtgcagatatccagcccaacagtccacccttcttcggcgaacccgattatccttcagctgaagacaaccagaatctcccctccacctggcgggagcctgactacagtgatgccgaaaatggccatgattacggatcaagcgagacccccaaaatgaccagaggcgtactgtcacgcacctccagcatccagccctcctttcgccaccggtctgacgatcccgtgggttccctttggggcgaaaatgattacccggaaggcatcgaaatggcctccatggaaatggcaaactcttacggccacagcttgccgggagcccctggctccggttacgtcaatcctgcttatgtgggagaaagtgggcctgttcacgcatacggtaacccgccattatccgagtgcgactggcataagtccccccaaggacagaagttgatcgcttctctcattcccatgaccagcagagatagaatcaaggcaatcagaaaccagcctcgcaccatggaagagaagaggaatctgcgcaagatagtggacaaggaaaagtccaagcagacccatcgtattctccagctaaattgttgcatccagtgtctgaactcaatatcccgggcataccggcgttcaaagaactccctcagcgagatcctcaacagtatcagcctgtggcaaaagactctgaagatcatcgggggtaagttcggaaccagtgtcttatcgtactttaactttctgcgatggctgctgaaatttaacatcttctccttcatactgaacttctcctttatcattatcccacagtttaccgttgctaagaaaaatacattgcaatttactggtctggaatttttcactggcgtaggttattttcgcgataccgtgatgtactatggattctatacaaatagcacaattcagcacggtaacagtggcgcttcttacaatatgcaactggcttacatcttcacaatcggtgcctgtttgacaacatgcttcttctcactcttattctcaatggccaaatacttcagaaacaattttatcaacccacatatttattctgggggtattacaaaattgatcttttgctgggactttaccgtcacccacgagaaagcggtgaagctaaaacagaagaatctgagtactgaaattcgggagaacctgtcagagcttcgacaggagaattctaagctgaccttcaatcagctgctcactaggttctcagcatatatggtggcgtgggtggtatcaactggcgtggccatcgcctgttgtgcggcagtttactacctggccgaatacaatcttgagttcctgaaaacccatagcaaccccggagcagtcttgcttctgcctttcgtagttagttgtattaacttggccgtgccgtgtatatatagtatgtttaggctggtggagagatatgagatgccacgtcatgaggtatacgtgctgttaatcaggaacatcttccttaagatctccattattggtatcctttgttactattggctcaatactgtcgctctctctggcgaagagtgttgggagaccctgattgggcaggatatttacaggctactgcttatggatttcgttttttcactggttaacagtttcctgggcgagttcttacgacggatcatcggcatgcagctaataactagcctcggactgcaggaattcgacatcgcacgcaacgttctggaactgatctacgcacaaactctggtttggattggcatttttttctgccccctgcttccattcatccaaatgataatgttgttcataatgttctacagcaagaatatatcactgatgatgaacttccagcctccctcaaaagcctggcgggcaagccagatgatgaccttttttatttttctgctcttttttccgtcattcaccggggtcttgtgcacccttgcaattaccatctggaggctcaaaccatcggccgactgcggacccttccggggacttcctctctttatccattctatctacagctggattgacactctgtctacgaggccaggctatttgtgggttgtgtggatctaccggaacttaattggttcggtacacttcttttttatcctgacactgatcgtactcatcatcacttacctgtactggcagataactgagggacgtaagattatgatacggctgctccatgagcagattatcaatgagggcaaggacaagatgtttctgattgagaagttaatcaaactgcaggacatggagaagaaggctaaccctagctctctggttctcgaaaggcgggaggtcgagcagcagggatttctgcatcttggagagcacgatggcagcttggacttgcggagccgacgatccgtgcaggaaggcaatcccagagcctag

SEQ ID NO: 55048 - DNA, 2103 bp, Artificial Sequence
  Description of Artificial Sequence: Synthetic coding sequence
atgctgagcgacgatcacgtgaatgagatcataatacagaaactaatcgcttccctcattccaatgacatctagagatcggattaaggctattaggaaccagccacgaaccatggaagagaaaaggaacctctcgcgcggaggccttaccattactacagaagacgagggtagagcaaaagcgcatttgacttggtggaagattgttgacaaagaaaaatctaagcaaacacataggatcctccagctcaattgctgtatacagtgtttaaattcaatttcaagagcatatcggaggagcaagaattcgctgtcagagatcctgaatagcatctccttgtggcagaagacactcaagatcatcggcggtaagtttgggacaagcgtcctgtcctactttaatttcctgcgctggctcctcaaatttaacatcttctctttcatcttgaatttctcttttattatcatacctcaattcactgtagctaagaaaaacaccctccaatttactggactggaattcttcacgggcgtgggatacttccgcgatactgtcatgtactatggtttctacacaaattcaaccatccagcacgggaactccggcgctagttataacatgcagctcgcatatattttcacaattggtgcatgcctaacgacatgtttctttagcctgctcttttctatggctaaatacttccgcaataatttcattaatccacatatctattccggtggcatcacaaagctgatcttttgctgggattttactgttacccatgaaaaggcagtcaagctgaaacagaaaaacttgagtaccgaaatcagggagaatctgagtgaactccgccaggagaattccaaattaacatttaatcagctgctgacccgattctcggcatatatggtggcctgggtggttagcacaggtgtggcaattgcttgctgtgctgctgtctactacctcgccgagtataatctggagttcctgaaaactcactcaaaccctggggcagtgctgttgctgccattcgtggtgtcttgtataaatctcgcagtaccttgcatttattcgatgtttaggctggttgagagatacgaaatgcccaggcacgaagtgtatgtcctcctgatccggaatatttttctcaaaatctctattatcggcatcctctgctattattggctaaacactgtcgcactaagcggagaggagtgttgggaaaccctaataggacaggacatatataggctgctccttatggatttcgtcttctccctggtaaactccttccttggtgagttcctgcgccgtatcatcggcatgcaactgattacgtcgctggggttacaggaattcgacatcgccaggaacgtgctggagctaatatatgctcaaaccttggtttggattgggatctttttttgccccctgcttcccttcattcagatgatcatgctgttcatcatgttttactcgaaaaacatttcgctgatgatgaactttcaaccaccgagcaaggcctggcgtgcctcccagatgatgacgttcttcattttcctactcttctttcctagctttacaggcgtgctctgcactcttgcaattacaatttggcgactcaaaccttctgctgactgcggccctttcagggggctgccactctttatccactcaatctattcttggattgatacactgagcacaaggccagggtatctgtgggtcgtttggatctaccgcaacctgatcgggagcgtccacttctttttcattttaacgttgatcgtcctcattattacttacctgtactggcagatcaccgaggggagaaagataatgatcaggttactgcacgaacagatcatcaatgagggcaaagacaagatgttcctgatcgaaaagctcattaagctccaagatatggaaaagaaggctaatccatccagcctggtgctggaacggagggaggtggagcagcagggattttgcatttgggggaatatgatggctgtgctgacctgcgatttagaggatcagtttaaaaaagtgatacaggggccagacgatagtttcggtaaccaaacccccatcaagtag

SEQ ID NO: 55049 - DNA, 2865 bp, Artificial Sequence
  Description of Artificial Sequence: Synthetic coding sequence
atgtctgcctactaccggaacaattggtccgaggaggacccggattatcctgactactcaggcagtcaaaacagaacccaggggtatctgaagactcagggctatcccgatgtccctggccctcttaacaatcccgactacccaggtactaggagtaatccgtactcggtcgctagtagaaccaggccagattatccaggctctttagccgaacccaactacccgcgatctctatctaaccctgattatagcggcacgagatccaacgcgtatagcgcagcttctagaacaagtcccgaccaccccacctccctccccgagcccgattactctgagttccagtcacatccatatcatcgtgcatcttctagacaacctgattaccccggtagtcagagaaaccctgatttcgctggctcctcatcgtcgggtaactatgccggaagccggacacatccggatcatttcgggtcattggaaccagactacccaggtgcacagtccaatagcgatcaccccggaccacgggctaacttaaaccatccgggatccaggaaaaacctagagcacacctccttccgcatcaatccttacgcagacagcctgggtaagccggattacccaggagccgacattcaacccaactccccacccttctttggtgagccagattacccctctgcggaagacaatcagaacctgccatctacgtggcgcgaacccgattacagtgatgccgagaatggacacgactatggatcgtctgagacaccaaaaatgactcgcggagtcctctctaggacttcttcaattcagccatcttttcgccacagatctgatgaccctgtgggctcactttggggcgagaatgactaccctgaaggtatcgagatggcctctatggagatggccaattcatacggacactcattacctggcgctccagggtcaggttacgttaatccagcatacgtgggtgaatcaggacctgtgcacgcttatggaaacccccctctttctgaatgcgactggcataagagtcctcagggacagaagctcatcgcatctctcatcccgatgacttcacgagatagaattaaggccatcaggaatcagccaaggactatggaggaaaagaggaatctgcggaagatcgtcgacaaggaaaagagtaagcagacccatcgcattctccagctgaactgttgcatccaatgcttaaacagcatttctcgcgcttacagaaggtccaagaattccctgagcgaaattttaaactctatttctctgtggcagaagactctgaagattatcggcggtaagttcgggactagtgtgctttcctacttcaattttttgcgttggctgttaaagtttaatatcttcagtttcatcctaaatttttcatttattatcatcccgcagttcaccgtcgctaaaaagaacactctgcagtttacagggctcgaattctttaccggagtgggttattttagagataccgtgatgtattatggtttctacaccaactcaacaattcaacacggcaactcgggagcatcctataacatgcagctggcgtacattttcaccatcggtgcctgccttactacttgctttttctccctgctcttttccatggccaaatatttccgcaataattttatcaatccccacatttatagcggcggaattaccaagcttattttttgctgggactttactgtaacacatgagaaagccgtcaaattaaagcagaagaatctctccaccgagatcagatttctcaaaacacattcaaacccaggagcagttctgctgctgccatttgtggtctcgtgtatcaacctcgccgtgccgtgtatctattccatgttccgactcgtagaacggtatgaaatgccgagacatgaggtgtacgtgctcttaataaggaacatcttcctgaagatctctatcatcggcattctgtgctactattggcttaatacggtggccctctcaggagaagagtgttgggaaactctcatcggccaggatatctaccggctgctcctcatggacttcgtgttctctcttgtgaacagcttcttgggagagttcctaagacgcatcattgggatgcaacttatcacatccctgggcctccaggagtttgatatcgccaggaatgtcttagagctcatttacgcacagactctggtgtggatcggaattttcttttgtcccctgctcccttttattcagatgatcatgctattcattatgttttactccaaaaacatttcattgatgatgaactttcagcccccttctaaggcttggagggcttcccagatgatgactttctttatctttttgctctttttcccatccttcaccggggtcctgtgtaccctagccattacaatttggagactcaagccttccgccgattgcggcccatttagggggttacctctttttattcacagcatctactcgtggatcgacactctgtctacacgcccaggatatctgtgggtggtttggatttaccggaatctcatcggcagcgtccactttttcttcatcctaactcttatcgtcctcatcattacctacctgtactggcagatcacagagggcaggaaaatcatgatcagacttcttcacgagcagatcatcaacgaaggcaaagataagatgttcttgattgagaagctgattaagctgcaggatatggagaaaaaggccaatccctcctctcttgttcttgaaaggagagaggtagaacagcagggatttcttcatctgggagagcacgacggatcacttgatctgagatccagacgtagcgtgcaggaaggcaaccccagggcatag

SEQ ID NO: 55050 - DNA, 3021 bp, Artificial Sequence
  Description of Artificial Sequence: Synthetic coding sequence
atgtctgcgtactaccggaacaattggtcagaggaagacccagactatcctgattattccggcagccagaacagaacccaggggtacttgaagactcagggataccctgatgttccgggtcccctgaataatccagactatcctggaaccaggtccaatccttacagcgtagcctcccgcactaggcctgactatccaggcagtctggcagagccgaactatccgcgaagtctgagtaaccctgactacagcggcacccgcagtaacgcatacagcgccgcatccaggactagtccagaccacccaacctcgttgcccgagcccgactactcagagttccagtctcatccataccatcgcgcttcttctcggcaaccggactaccctgggtcccagcgtaacccggacttcgccggtagttcaagctctggtaattatgcgggatctcggacacacccagaccacttcggtagcctggagcctgattacccaggagctcagagtaattctgatcacccgggtccaagagcaaatctgaaccacccagggtccagaaaaaatctggagcacacttccttccgtatcaatccatatgccgactcactaggtaagccagattatcccggtgccgacatccagccaaattcgccacccttttttggcgagccagactatccatccgctgaggacaatcagaacctgccaagcacatggcgtgaacctgactactcagatgccgagaatggccacgattacggatcaagtgaaactcctaagatgacgcgcggtgttctcagccgtacatcctccatccaaccaagcttcaggcatagatcagacgatcccgtagggtcgctttggggagagaacgattaccccgaaggtattgaaatggccagcatggagatggccaattcctacgggcattcactccccggagcgcctggaagcggttacgtgaatcctgcctacgtgggggagagtggaccagttcatgcttacggaaaccctccactcagcgaatgcgattggcacaaatcaccacagggacaaaaactgattgcttctttgatccctatgacatccagggataggattaaagccatcagaaaccagccaaggactatggaagaaaagcgtaatctacggaagatagtggacaaggagaagtcgaaacagacccatagaatcctccagctgaactgctgcattcagtgtctaaattcaattagcagggcctacaggcggagtaagaatagcctaagcgaaattctgaatagcatttccctgtggcagaagaccctgaagatcattggcggaaagttcggtacaagcgtcctatcgtatttcaatttcttaaggtggctgttaaaattcaacatcttcagctttattcttaatttttctttcatcatcattccacagtttacagtggcaaagaagaacacgttgcagttcacgggactggaattttttacaggagttgggtacttcagggacacggtgatgtattatggattctataccaattccaccatccagcacggcaattcgggagctagttataatatgcaactggcttacattttcaccattggcgcttgcttgaccacctgtttcttttccctccttttttcgatggcgaaatatttcaggaacaatttcataaatccacacatctacagtgggggaattactaagctgatattctgctgggatttcaccgttacacacgagaaggccgtgaaactaaaacagaaaaacctgtcaaccgaaatcagggagaatttatctgagttgaggcaggaaaacagtaagcttaccttcaatcaattgcttacaaggtttagcgcctatatggtcgcctgggtggtctctaccggcgtagccatagcctgctgtgctgctgtgtactatttagccgaatacaatctggaatttctgaaaacccacagtaatcctggcgctgtcctgctcttacccttcgtcgtgagctgcatcaacttagccgtcccatgcatttattccatgttcaggctcgttgaaagatatgaaatgccccgtcacgaggtttacgtgttgcttatccgcaatatctttctcaagatatctataattggtatattgtgttattattggctgaacaccgtggccctttcaggcgaggaatgctgggaaacgcttattggccaggacatctatcgtttactccttatggactttgtgttttccctggttaatagcttccttggggagttcctgcgacggattattggaatgcagctgatcacttctctagggctccaagagttcgacatagctagaaatgtgctggaactgatctacgctcagacattagtgtggatcggtatcttcttttgcccacttctgccctttatccagatgataatgctatttatcatgttttatagcaagaatatctctctcatgatgaattttcaacctcccagtaaagcatggcgcgcttctcagatgatgaccttctttatatttctactgttcttcccatctttcaccggagtcctgtgcacattggccatcacaatatggcgcctgaaacctagtgcggactgcggcccattcaggggattgcccctgttcatccatagcatctactcctggattgatactttgagtacaaggccgggatacctatgggttgtgtggatttatcggaatctgattggctctgtacattttttctttatcctaactctcatcgtgcttatcattacttatctgtattggcaaattacagaagggagaaagatcatgattagactattgcacgagcagatcataaacgaaggtaaggacaagatgtttcttattgaaaagctgattaaattgcaggacatggagaaaaaggccaacccgagtagcctggttctcgagcgtagagaggttgaacagcaaggttttcttcatctgggagagcatgatggaagcttagacctccggtctaggaggtcagtgcaagaaggcaatcccagagcttag

SEQ ID NO: 55051 - DNA, 2172 bp, Artificial Sequence
  Description of Artificial Sequence: Synthetic coding sequence
atgagtgagagcagtgggagcgctctgcaaccgggaaggccttccagacagccggcagtgcatcccgagaacctttcattggattcttcctgcttctccagccccccagtgaatttcctgcaagaattaccaagctaccgaagtattgccaggaggcgaacaacagtgcactccagggataagcaatcaggaacgttgctgaaacccaccgattcatattcgagtcaactggaggatagaatcgcagagaatctttctagccacagtctgcgcaattatgcactgaacatctctgagaagaggaggcttagggacatacaggaaacgcagatgaagtacctgagtgaatgggatcagtggaaacgttattcttcaaagagctggaaacggtttcttgagaaagctcgcgagatgacaacccatctggagttgtggagggaggacatccgttcaattgagggtaagtttggcaccggaatccagtcctatttcagttttcttcgattcctcgtgctgctaaatttggtgatttttttgattatcttcatgctagtgcttctccccgtcctgctgaccaagtataaaatcacaaatagttctttcgtgctgatcccttttaaagacatggataagcaatgcaccgtctatccagtgtcctcctcgggattaatctacttctactcatatatcatcgacctgctttccggcacgggcttcttggaggagaccagcctcttctatggtcattatacgattgacggcgtaaagtttcagaacttcacttatgatctgcccctggcatatctcctgagcaccatagcgagtctagccctgtcactgctatggatagttaagcggtccgtcgagggtttcaaaataaatttgattcggtctgaagagcattttcagtcctattgtaacaaaatctttgccggttgggacttctgcatcaccaataggtccatggccgacctcaagcatagttccttacgttacgaactgagagctgatttggaagaggagcgcatgcgacaaaagattgctgaacgtacgtctgaagaaaccatcagaatctattctctcaggctgtttcttaactgtattgtgctggccgtgctgggagcttgtttctatgccatttacgtggccaccgtctttagtcaagaacatatgaagaaagagatagacaaaatggtgttcggggaaaatctttttatcctgtatctccctagtattgtcatcacacttgccaatttcattacaccaatgatcttcgctaagatcatcaggtatgaagactactcgccgggattcgagatccgccttaccattctgcgctgcgtgtttatgcgtctcgctacgatctgcgtcctggtctttaccttaggatccaagatcacttcatgcgacgatgatacctgtgatctgtgcggctacaaccagaagctgtatccctgctgggagacgcaggtcggtcaggaaatgtataagctgatgattttcgactttattatcatcctagccgtcacactgttcgtggattttcccaggaaacttctcgtcacatactgcagttcctgtaagctgatccagtgctggggccaacaagagttcgctatcccagacaacgtgcttgggatcgtatacggacagacaatttgttggattggcgcattcttctcccccctcctccccgcaattgccacactgaagttcatcatcatcttttacgtcaaagagtggagccttttatacacatgccggccatcaccgaggcccttccgagcctctaatagtaactttttctttcttttagtcctgcttattgggctctgtttggccattattcctctgaccatcagcatttcgaggattccgtcaagtaaagcatgtgggccattcaccaatttcaacaccacatgggaggtcatccccaagacagtatccacgtttccctcatcactgcagtcgtttatccacggcgtaacatccgaggccttcgcggtgccttttttcatgatcatttgccttatcatgttctatttcatcgccttggccggagcccacaaacgcgtggttattcagctgagagaacagctgtctctggaaagtagggacaagtgctacctgattcaaaaactaacggaggctcagagagacatgagaaactag

SEQ ID NO: 55052 - DNA, 1842 bp, Artificial Sequence
  Description of Artificial Sequence: Synthetic coding sequence
atgaagtatctcagcgagtgggaccagtggaagaggtactcgtctaaatcatggaagcggttcctagaaaaggcaagggaaatgacaactcatctagagttatggcgggaggacatacgttcgatagagggaaagtttgggacgggtattcagagttatttctctttcctgcgatttctcgtactgttgaacttggtaatatttcttatcatttttatgttagttctcttgcctgtgctattaaccaaatacaagatcaccaatagttccttcgtgctgataccttttaaagacatggacaagcagtgtacagtgtatcctgtttcgagttccggactcatctatttctattcatacattattgacctcctttctggcaccggattcttagaggagacctccttgttttatggacattatactattgatggggtcaagttccagaacttcacttatgacctaccactcgcatatctccttagtactatcgccagtctggccctttcgctcctctggatcgtcaagagatcagtggaagggttcaaaattaaccttattcggtccgaagagcatttccagagctactgtaacaaaatctttgcagggtgggatttctgcatcactaatcggagcatggccgatttaaaacactcctctttgaggtatgagctgagggctgacttggaagaagagagaatgcggcagaaaatcgcagaacgtacttctgaagaaaccattagaatctatagcctgaggctgttcctcaattgcattgtgctggcagtcttaggtgcctgtttctatgcaatatatgtagctaccgtcttctcccaagagcacatgaagaaagagatcgataaaatggtctttggggaaaatctgtttatactatacttgcccagtattgtcataactctcgctaattttattacaccaatgatcttcgccaagattatacgatacgaggactactcacccggatttgagatccgtctgactattctccgctgcgtgtttatgcgcctggcgaccatctgcgtcctggtgtttacgctggggtccaaaattacttcctgtgatgacgatacctgcgatttatgcggatataatcagaaactctatccctgttgggaaacacaggtcggccaggagatgtacaagcttatgatctttgacttcatcatcatcctggcggtgacacttttcgtcgacttccccagaaagctcttggtaacttattgttcaagctgcaagcttatccagtgctggggtcagcaggagttcgccattccagataatgtcctaggaatagtgtacgggcagaccatttgctggattggcgcatttttctcacctctgttgccagcgatcgcgactttaaagttcattattatattttatgtgaaggagtggagcctgctctatacttgccggccatcacccagacccttcagggccagcaactcaaacttctttttcttattagtgctactaattgggctgtgcttggccattatccccctgaccattagcattagtagaataccatctagcaaagcttgcggcccttttaccaattttaatacaacttgggaggttatccccaaaacagtatcaacattccctagctcactacaatcctttattcacggggtgacgtcagaggccttcgcggtgcccttttttatgatcatttgcttgatcatgttctacttcatagctttagcgggtgcgcataaacgcgtggtcatccaacttcgcgaacagctgtcactggagtctagagacaagtgttacctgatccaaaagttgaccgaggcccaacgtgatatgaggaattag

SEQ ID NO: 55053 - DNA, 606 bp, Artificial Sequence
  Description of Artificial Sequence: Synthetic coding sequence
atggttacattggctgagctgctggtcctgcttgccgcactgttggctaccgtctctgggtacttcgtctctatagacgcacacgctgaagagtgttttttcgagcgtgttacatctgggacaaaaatgggactcatctttgaggtggcggagggcggattcctggatatcgacgttgaaatcaccggacccgataataagggaatatataagggagatcgcgagtcttctggtaaatacacctttgcagctcatatggatggaacctacaagttctgtttcagcaaccgcatgtcaaccatgactcctaagatcgtgatgttcacaatcgacattggggaagctccaaaaggccaagatatggaaactgaggcccaccagaacaagctcgaggagatgatcaatgagttggccgtagccatgactgcagtgaagcacgagcaggagtatatggaggtgagagaaaggatacaccgagccatcaacgacaataccaattctcgtgtggtattgtggagcttcttcgaagccctggtgctggtagctatgactctgggccagatctactacctcaaacgcttttttgaagttagacgggttgtgtag

SEQ ID NO: 55054 - DNA, 510 bp, Artificial Sequence
  Description of Artificial Sequence: Synthetic coding sequence
atggttacgttagcggagctcttagtgctgctagcagcattactcgccacagtctccgggtactttgtctcaatagacgtggagattactggacctgataataagggcatatataagggcgatcgggaatcaagcgggaaatacaccttcgccgcacacatggatggaacatataaattctgtttctccaatagaatgagcaccatgacgccaaaaatcgtgatgtttacgattgacattggggaggcgcctaagggacaggacatggagaccgaagcccaccagaacaagctcgaggagatgattaacgaacttgctgtggccatgactgctgttaagcatgaacaggagtatatggaagttagggagcgtatccaccgtgccatcaacgacaatacaaattcgcgggtcgtcctgtggtcatttttcgaggccttggtgcttgtagcaatgactctggggcagatctattacttgaagcgtttcttcgaggtgagaagggtggtgtag

SEQ ID NO: 55055 - DNA, 456 bp, Artificial Sequence
  Description of Artificial Sequence: Synthetic coding sequence
atggtgactctcgcggaattactcgtgcttctcgccgcacttctagccactgtatccggctattttgtttcgatcgacgctcatgcagaggagtgcttctttgaacgtgttacatctggcactaaaatgggcctgattttcgaagttgccgagggaggctttctggacatcgacgtagagataaccggtcccgataataagggacaagacatggaaactgaagcgcatcagaataagctggaagagatgatcaacgaactcgctgttgctatgacagcggtgaagcacgagcaggaatatatggaggtgcgcgaaagaatccaccgggctatcaacgataatactaacagtcgcgtcgtgctttggagctttttcgaggcgctggtgcttgtcgcaatgaccttgggccagatctattacctgaaacgtttcttcgaagtccggagagttgtgtag

SEQ ID NO: 55056 - DNA, 654 bp, Artificial Sequence
  Description of Artificial Sequence: Synthetic coding sequence
atgggcagcacagtgcctcgtagtgcatccgtgttgctactcttactgctgttgcgacgtgccgaacagccatgcggggcagagctgacctttgagctccctgacaatgccaagcagtgtttccacgaggaggtggagcaaggggtgaaattcagcttggattaccaagtcataaccgggggacattatgatgtagactgttatgttgaagaccctcagggtaacacaatatacagggaaacgaagaaacaatatgatagcttcacttatagggcagaggtcaaaggcgtgtaccaattctgcttctccaacgaattttctactttttcccacaagaccgtgtacttcgatttccaggtgggggatgagcccccaatactccctgatatgggcaaccgtgtgaccgcccttactcaaatggagtcagcttgtgtgaccattcatgaggccctcaaaaccgtaatcgactcacagacccactaccgcctgcgagaagcccaagatcgagcccgtgccgaggacctaaattctagagtgagctattggtctgtgggcgaaactatcgcattatttgtggttagtttttcccaggtgctgttactcaagtcctttttcactgaaaaacgacctatctccagggctgtgcacagctag

SEQ ID NO: 55057 - DNA, 522 bp, Artificial Sequence
  Description of Artificial Sequence: Synthetic coding sequence
atgggaagcacagtacccaggtctgcgtcagtccttctcctgcttctattactcaggcgggcagagcaaccttgtggagcggaacttaccttcgaattacctgataatgccaaacaatgtttccacgaggaggtggaacaaggggtgaaattctctcttgattatcaagtgattaccggaggccattacgatgtagattgttacgtggaggacccacaaggcaacaccatttatcgagagaccaagaaacagtatgatagcttcacgtaccgcgctgaagtgaaaggtgtctatcaattctgcttcagtaatgagttctcaaccttctcacacaaaacggtgtactttgacttccaggttggcgatgagccaccaatcctgcccgatatgggcaaccgagtgactgcgctgacacagcgttttcggggagcttattggaaggaggttgataagatggtggattacatgcagcctgggggtacacctgctaccgagggtctggggcgtttggccccttcgtag

SEQ ID NO: 55058 - DNA, 489 bp, Artificial Sequence
  Description of Artificial Sequence: Synthetic coding sequence
atgggcgataagatttggctcccgttccctgtgctgctcttggccgcattaccccctgtattgctgcctggcgcagcgggattcaccccttctctggactcagattttacgtttactcttccagccggacaaaaagagtgcttctatcagcccatgccgttaaaggcaagtttagagatcgagtatcaggtgttagacggagccggtctggacatcgacttccacctcgccagtcctgagggaaagacattggtctttgaacagcggaaatccgatggagtgcacacggtggagaccgaggttggcgactacatgttctgtttcgataatacctttagtactatctccgagaaggttatctttttcgagctgattctcgataatatgggcgagcaagctcaggaacaggaggactggaagaaatatattacaggaactgatattctggacatgaagctggaggacattctggtctcaatggttttctag

SEQ ID NO: 55059 - DNA, 690 bp, Artificial Sequence
  Description of Artificial Sequence: Synthetic coding sequence
atgggcgacaaaatctggctgccctttcccgtcctcttgttggccgctctgcctcccgtgctcctcccaggggctgccggattcacacctagtcttgactccgatttcacatttacccttccagctggccagaaggagtgcttttatcagcctatgcctctgaaggcgtccttggaaatcgagtaccaggttctagacggggctgggctggatatcgatttccatttagcgagccctgaaggaaagacgttggtgttcgaacagcggaagtccgatggtgttcacacggttgagacagaagttggtgattacatgttctgctttgacaataccttcagcaccattagtgagaaagtcattttctttgagctgattctggataacatgggcgagcaagcacaggaacaagaagactggaaaaagtatatcacagggacagatattcttgatatgaaactggaggatatcttagagtccattaacagcattaaatcacggctgtctaagtctggacatatccagacactcttacgcgctttcgaggcccgtgaccggaacatccaggaatccaacttcgacagagttaacttttggagcatggtaaatttagtggtgatggtggtggtatcagccattcaggtctacatgttaaagtctctgttcgaggataaacgaaaatccagaacctag

SEQ ID NO: 55060 - DNA, 582 bp, Artificial Sequence
  Description of Artificial Sequence: Synthetic coding sequence
atgggggataaaatctggttgcccttccctgtgctcctgctggcagcacttccgcctgtgttgctgccaggggctgctggattcacaccctccctggacagtgatttcacctttactctccctgccggtcaaaaggagtgtttctaccagccaatgcctctgaaggcaagcctggaaattgagtatcaggtcctcgacggcgctggactggacattgactttcacctggcctctcctgaggggaaaacactggttttcgagcagcgcaagtctgatggggtgcacacagtggaaacagaagtgggagactatatgttctgctttgacaacacattttccaccataagtgaaaaggtaatcttcttcgagttgatactcgacaacatgggggagcaagcacaggaacaggaggactggaagaagtacattactgggaccgatatcctggatatgaagctggaggatatcttggaccctatcataaagatcgcttccgacgtgcagatccggttacacctgggtattcaccagcagcaccaggtgcagacaaagcagaagtgggcacacacgaatagcgcttag

SEQ ID NO: 55061 - DNA, 537 bp, Artificial Sequence
  Description of Artificial Sequence: Synthetic coding sequence
atgcccctcaaagcatccctcgagatcgagtaccaagtccttgacggagcaggactagatatcgattttcacctggcttcgcccgaaggaaaaactttggtgttcgagcagcgaaaaagcgacggcgtacacacagtggagacagaggtgggtgattacatgttttgtttcgataataccttttctaccattagcgagaaggtgatattcttcgaattgatcttggataatatgggggagcaggcccaggaacaagaagattggaaaaagtatatcacgggcaccgatatattggacatgaaactggaggacatccttgaaagcatcaatagcataaagtccagattaagcaaatctggccacattcagaccctgctccgggctttcgaagcacgggacagaaacatccaggaaagtaattttgatagagtgaatttctggtcaatggtgaacctggtcgtgatggtggtggtaagcgcaatacaggtgtatatgctcaaatctttatttgaggataagagaaagtcccgcacctag

SEQ ID NO: 55062 - DNA, 723 bp, Artificial Sequence
  Description of Artificial Sequence: Synthetic coding sequence
atgtcccccttgctttttggggctggattggtggttttaaatctagtgacgtctgccagaagccagaagacggagcctctttcagggtctggagatcagcccttgtttcgtggcgcagacaggtatgactttgctattatgatcccccctggcggaactgagtgcttttggcagtttgctcatcagacaggttacttttacttctcctacgaggtgcagcggaccgtcggtatgagccacgacaggcatgtggcggcaacagctcataatccccaagggtttttgattgataccagccaaggcgtgaggggtcagatcaacttttctactcaggaaacaggtttctaccagctctgcttgtcaaaccagcacaatcactttggatcagtccaggtgtacctgaattttggggtgttttatgagggaccagagactgatcataagcaaaaggaaaggaaacagctgaacgacaccttggatgccatagaggatggcacccagaaagtccagaacaatatctttcatatgtggcgctactacaatttcgctcgcatgagaaaaatggccgacttttttttaattcaatcaaactataattatgtgaattggtggagcaccgctcagtctttagtgattattttgtccggaatcttgcagctgtatttcctaaaacggctgtttaatgtcccaacaaccactgacaccaaaaagccgagatgctag

SEQ ID NO: 55063 - DNA, 675 bp, Artificial Sequence
  Description of Artificial Sequence: Synthetic coding sequence
atgccccgtcctggctctgctcagcgatgggccgcagtcgcaggcagatggggatgtagacttctggccctgttgctgctggttcctggcccagggggagcctcagaaattacgttcgagttacccgataacgccaagcaatgtttttacgaggacatcgcccagggtaccaagtgtactctagagttccaggtgattacaggtggtcactacgatgtcgactgtaggcttgaggatcccgatgggaaggtcttatacaaagagatgaaaaagcaatatgattcctttaccttcactgcctccaaaaacggcacctacaagttttgcttttcaaatgaattctctacattcactcacaagactgtctactttgactttcaagtgggagaagatccaccactgttcccgagtgaaaatcgggtgagcgcacttactcagatggagagcgcttgtgtctctatccatgaggcattaaaatctgtgatcgattaccaaacccacttcaggctaagggaagctcagggcaggtcgcgggctgaggacctcaatacccgggtcgcctattggagtgtcggagaggccctaatccttttagttgtgagcataggccaagtgtttctgctaaagagtttcttcagtgacaagcgtaccaccacaacaagggttggcagttag

SEQ ID NO: 55064 - DNA, 249 bp, Artificial Sequence
  Description of Artificial Sequence: Synthetic coding sequence
atgcctaggccaggatcagcccagcgctgggcagctgttgcgggacggtggggttgtcggctccttgctcttttactgttagtgcccggacctgggggagcatccgaaatcacctttgagttgcctgacaatgcaaaacagtgtttctacgaggatatcgcacaaggcacgaaatgtaccctagaatttcaggtgattactgggggtcactatgacgtggactgtagattagaggacccggatggctag

SEQ ID NO: 55065 - DNA, 651 bp, Artificial Sequence
  Description of Artificial Sequence: Synthetic coding sequence
atgcaagccggaaagccaattctctatagctatttccgttcatcttgctcgtggcgggtgcggatagccctggctctgaaaggcattgattatgagaccgttcctatcaatctgattaaagatggaggccaacagttcagcaaggattttcaagcacttaatcctatgaaacaggttcctacgctgaagattgatggaatcactattcatcagtctcttgccatcatcgaatacctggaagagatgaggccaactccacgacttcttccacaggatccaaagaaacgggcttcagttcgcatgatatccgacctgatcgccggtggcatacagcccctgcagaacctgtcggtgttgaagcaggtgggagaggaaatgcagctgacctgggcgcaaaacgccatcacgtgtgggtttaatgctctggaacagatcctgcagtccactgcaggtatctattgtgtaggagatgaggtcaccatggcagacctgtgtttggtcccgcaggtagcaaacgcggagcgctttaaagtcgacctgacaccttaccctaccatttcgtcaattaataaacggctgctggttctcgaggctttccaggtgagccacccatgcaggcagccagatacacccaccgagcttcgcgcttag

SEQ ID NO: 55066 - DNA, 708 bp, Artificial Sequence
  Description of Artificial Sequence: Synthetic coding sequence
atggccgtggaacttggagtcctccttgtgcgacccaggcccggtaccggcctagggagggtgatgagaacattgctgctggttctgtggctggctaccaggggcagcgctctgtatttccacatcggagaaacggagaaaaaatgtttcatcgaggagattccagatgagacaatggtgatcggcaattatcgaacgcagttgtatgacaagcagagagaggagtatcagcccgctactcccggattgggtatgtttgttgaggtgaaggatccagaggataaagttattttagccagacagtacggcagcgagggtaggtttacatttacttctcacaccccgggtgaacaccagatatgcctccacagtaacagcaccaaatttagcctgtttgccggtggaatgctccgtgtccaccttgacatccaagtgggcgaacacgcaaatgactacgctgagatcgcggcaaaagacaaactttctgagctgcagttgcgagtgagacagctagtggagcaggtagagcaaatacaaaaggagcaaaactatcagcggtggagagaggagaggttcagacagacaagtgagtcgaccaaccaacgggtgctctggtggagcattctccaaacccttatcctcgttgctattggagtctggcagatgaggcacctcaaaagtttctttgaagccaagaagctggtgtag

SEQ ID NO: 55067 - DNA, 822 bp, Artificial Sequence
  Description of Artificial Sequence: Synthetic coding sequence
atgattctgaaagggtgcctcctgtaccccctttgttcccctagaaataaacagcggtgtgcgagattgtggaaaatagcatacggcggacttctgaagatagttaccgggtcactcctcacgttctatgtggtcctctgcttggatggaggcatggttttgatgaggaaacaggttcccagccggttcatgtatcccaaagaatggcaacacctgactatgtttatactgctgaccttaaacgggtgtgtcgactttatgagcaagaacgtactcccacagcggtgtgtaggactagagaagggaacactggtcctcatcatctacgagctgctgcttctgatggtgtctcatgtgaaggattcggagggcgtggaactgcacgtgtactctttgctcatactcgttgtgttcctcctattactggtactgaccgccgagttatgggcacccaatatgtgccacttgcagctgatggagacattccttatcctgatgatggggtcgtggctcatgcaggctggttttatactgtatcggcctgtcagtgggtacccttggcaggatgacgatatctctgacatcatgttcgtaaccacctttttctgctggcacgtcatgatcaacgcctcctttttactcgggatttacgggtttagctctttctggtaccactgttttcggcctagcctgaagctgaccggcccaaaggaggccccttattatgcctccacaccaggccctctttacaagctgctgcaggaggttgagcaaagcgagaaagaagaccaagctctcctgctccccaagtcctcaccctag

SEQ ID NO: 55068 - DNA, 1338 bp, Artificial Sequence
  Description of Artificial Sequence: Synthetic coding sequence
atgaatgagagcccccaaactaatgagtttaaagggacaacagaagaggcaccagccaaagaatcgcctcatacctcggagttcaagggagccgcacttgtatctcctatcagtaaacggatctttggcgtgttcctggtgctgctcgatgtgactctcctccttgcagatctgattttcaccgacagcaagctttatatccccttagagtataggtcaatatccctcgctatcggccttttctttctcatggatgtcctgttgcgggtgtttgtcgaagggtggacccatctggtgcgtctgcttaggctgatcattcttatccgaatcttccatttactgcaccagaagcgccagctggagaaactgatgcggaggcttgtatccgaaaacaaaaggcgctacactagggatgggttcgatttggatctaacatacgtcaccgagcgaatcatcgctatgagctttccgtcttcaggccgacagtctttctacagaaacccaatcgaagaggttgtgaggtttctggataaaaagcataggaaccactaccgtgtgtacaacttgtgttctgaaagggcctatgaccctaagcactttcacaacagggtctcaaggatcatgatagatgaccataacgtgccgacccttcatgagatggtggttttcacaaaggaagtgaacgaatggatggcccaggacctcgagaacatcgtggcaatccattgcaagggcggaaagggcaggacaggaacaatggtgtgtgcccttctgattgctagcgagatattcctgacagctgaggaatccctgtactatttcggggagcgaagaacaaataaaacacattctaataagttccaaggagtggagacccccagccagaatcggtacgtagggtacttcgctcaggttaagcacctgtacaactggaatttaccccctcggcgtatccttttcatcaaacggtttataatttacagcatccgcggagacgtctgcgacttgaaggtgcaagtcgtgatggaaaaaaaagtggtattctcatctacctccttaggtaactgttcaattctgcacgacatcgagacagacaagatcctgatcaacgtatacgatggcccacccttgtatgacgatgtgaaggttcagttcttttctagtaatcttccgaaatactatgataactgtccgttcttcttttggtttaacacatcctttattcaaaacaaccgactgtgtcttcccagaaatgaactagataacccgcacaagcaaaaggcttggaagatctaccctccggaatttgccgtggagattctctttggggagaagtag

SEQ ID NO: 55069 - DNA, 1467 bp, Artificial Sequence
  Description of Artificial Sequence: Synthetic coding sequence
atgaatacctccccgcagactaacgaattcaagggcactacggaggaggctcctgcaaaagaatccccacatacaagtgagttcaagggagctgctcttgtctcaccaatctcaaagagcatgctcgagcgcttaagcaaatttgaagtggaagacgcagagaacgttgccagctacgattcaaagattaagaaaatcgtccacagtattgtgtcatcgtttgcttttggtatcttcggcgtgtttcttgtcttgctcgatgtgactcttcttctcgcggacctgatcttcaccgacagcaagctgtacatacctctagaatatcggtcaatttcactggccataggtcttttcttccttatggacgtgctgttaagggtgtttgttgagggcagacagcagtacttctcagatctgttcaatatcctggacacggccatcatcgtcatccctctgctcgtggatgtgatctacattttcttcgatattaaattgctgcgaaatatccctcggtggacccaccttgttaggcttctaaggctgatcatcctaatccggatcttccaccttttgcaccagaagaggcaactcgagaaactcatgcgtagacttgttagtgagaacaaacgcaggtatacacgggacgggttcgatctggacctaacctacgtaactgaaagaataatcgctatgtctttccctagcagcggaagacagtctttttatcggaatcccatcgaagaagtggtgaggttcctggacaagaagcatcgaaatcattaccgggtgtacaacctgtgttctgagcgggcttacgaccccaaacactttcacaatagggtgtccagaatcatgatcgatgaccacaacgtgcctacactccatgagatggtggtgtttacgaaggaggtgaacgaatggatggcgcaggaccttgaaaacatagttgcaatccattgcaaaggtggaaaggggagaaccgggactatggtctgtgcgctccttatcgcgtccgagatattcctcacggcggaggaaagcctatactactttggcgagcgtagaacaaacaagacacacagcaataaatttcagggagttgagactccgagtcaaaaccggtacgttggatattttgcccaggtaaagcatctctacaactggaacctgcctccaagacgaatcctctttattaaaaggttcattatatatagtatccgtggtgatgtgtgtgacctgaaagtgcaggtcgtgatggagaaaaaagtagttttctcttccactagccttgggaactgctctatcctgcacgatatagaaacagacaagatcttaattaacgtgtatgatggcccaccactttacgacgacgtaaaagtgcagttttttagcagtcgggcagagaagagggccgctcacagagctaactggaagggagagccttctcggcgacccgttctggactag

SEQ ID NO: 55070 - DNA, 1449 bp, Artificial Sequence
  Description of Artificial Sequence: Synthetic coding sequence
atgaacgaatcaccccagaccaatgaattcaaaggcactaccgaggaagctcccgcaaaggagtccccacacacttccgaattcaagggtgccgcactagtctcccccatctctaagagtatgctcgagagactctccaagttcgaggtggaggacgcggaaaatgtggcgtcatatgatagcaaaatcaaaaagatcgtgcactcgatcgtctcctcgttcgccttcggcatctttggcgtgtttttggtcctgctcgacgtcacactcctgctggctgacctgatatttactgactcgaagctgtacatccctctagaatatcgctctatctccctggcgatagggttattcttcctcatggacgtgctgctgcgcgtgtttgttgagggctggacacaccttgttcgcctcctacgcttaatcattttgatcaggatttttcaccttctgcaccagaagcgtcagctggagaaattaatgaggcgactggtctccgagaataagagacgctatacccgtgacggcttcgacctggaccttacatacgtaaccgagcgaattattgctatgagcttcccgtctagtggacgacagtctttctatagaaaccccattgaggaagtggtgcgatttttggataaaaaacatcgcaaccactacagggtgtataacttgtgttctgagagggcatacgatcccaagcactttcacaatcgcgtctccaggataatgattgatgatcacaatgtgccaacactgcatgagatggtggtgttcaccaaggaggtgaacgagtggatggctcaggatctggagaacattgtcgccattcactgtaaagggggaaaagggagaaccgggacgatggtgtgtgcccttctcatagcttcagaaatcttccttacggccgaggagtcactgtattatttcggcgaacgacgcaccaataaaacgcattctaataaattccagggagtcgaaactccatcacagaatcgatatgtgggatacttcgctcaggtcaaacatctttataactggaacttgccccctcgacgaatcctctttatcaagagattcattatctactccataagaggtgatgtctgtgacctgaaagtgcaggtcgtgatggagaagaaggtggtgttctctagcaccagtctgggaaactgcagcattctgcacgacatagagactgataagatcctgattaacgtgtatgacggacccccactgtatgatgacgtaaaagtgcagttctttagcagtaatctgcccaagtactatgataactgcccatttttcttctggtttaatacttcattcatacagaataatcgcctttgtttgccgagaaacgagctggacaatcctcataaacagaaggcctggaaaatctacccaccagagtttgctgtggagattctgtttggcgaaaagtag

SEQ ID NO: 55071 - DNA, 1569 bp, Artificial Sequence
  Description of Artificial Sequence: Synthetic coding sequence
atgaatgaatccccacagaccaatgagttcaaaggaactacggaggaagctccagccaaggagtcccctcacacatctgaatttaaaggcgctgcccttgtgtccccaatttccaaaagtatgcttgaacgcctgtccaaattcgaggtggaggacgccgaaaatgtggcgagctacgattcaaaaatcaagaaaattgttcatagcattgtgtcttccttcgcctttggcatatttggggttttcctcgtactattggacgtgaccctactgctggcagaccttatctttacagatagcaagctttatatacccctcgagtaccggtctataagcttagccatcggtctgttttttcttatggatgtcctgctgcgggtatttgttgaaggccgtcagcagtatttcagcgatctgttcaatattttggacacggcaatcattgtgataccactgctggtggacgttatttatatcttctttgacattaagctgcttcgaaatattcctcgatggacccacctagtgcggctgctgcggttgatcatactgattagaattttccacctgctccaccaaaagcggcagctggaaaagttgatgaggagacttgtatcggaaaacaagcggcgatatactcgcgatggatttgacctggacctgacttacgtgactgaacgcatcatcgccatgtcattcccatcctccggcaggcagtccttctacagaaaccctatcgaggaggttgtccgctttctcgacaaaaagcatagaaatcattaccgcgtgtacaatctttgctcagaaagggcctatgaccctaagcacttccataatagagtctctcgcattatgatagacgatcataatgtgcctaccctgcacgaaatggtggtgtttacaaaggaggtgaacgaatggatggcccaagatctcgaaaatatagtggccatccattgtaagggcggtaaaggtcgaaccggtaccatggtatgcgccctcttgattgcatccgaaatctttctgactgccgaggagtctctgtattacttcggcgaacgcaggaccaacaaaactcatagcaataagttccagggtgtggaaacccctagccagaatcgctatgttggctatttcgcccaagtgaagcacctgtacaactggaatttgcccccacggagaattctgttcattaagcggtttatcatctattccatacgcggtgatgtctgtgacctgaaggtgcaggtggtaatggaaaagaaggtggtgttctcatccacttctctgggtaactgctctattttgcacgacatcgaaaccgacaagatcctgataaacgtgtacgacggaccacccctttacgacgacgtgaaggtccagtttttctcctcaaacctccccaagtactatgacaattgtcccttctttttctggttcaacacctcattcatccagaacaatagactttgcctgcccagaaacgagctagataaccctcataagcagaaagcctggaaaatctaccccccagagtttgccgtggaaatcctgtttggagaaaaatag

SEQ ID NO: 55072 - DNA, 1338 bp, Artificial Sequence
  Description of Artificial Sequence: Synthetic coding sequence
atgaacgagagtccccaaacaaacgagtttaagggtactacagaggaagctcctgccaaagagagccctcacaccagtgagttcaaaggtgctgcgctggtaagtcctatctctaagcggatcttcggtgtcttcttggtactgctcgatgtgacactcctgcttgctgacctgattttcaccgactcgaagttgtacattcctctcgaatatcgttcaatcagcctcgcgattggccttttcttcctaatggatgtcttgctgcgagtgtttgttgagggctggacacacctggtgcggttgctgcgcctcatcatcctgatccggattttccatttgcttcatcagaagcgccagcttgagaaactgatgaggcggttagtaagtgagaacaagcggagatatactagggatggtttcgacctcgatctcacctacgtgacagaacgtatcatagcaatgtcattcccttcatctggcaggcagtcattttatagaaacccaatagaggaggtggttaggttcctggataagaagcatcgcaaccactatagagtttataatctatgctccgagagggcctacgatcctaaacacttccacaatagggtgagtcggattatgattgatgatcacaacgtgcccacgctgcatgaaatggttgtgtttacaaaagaagttaacgagtggatggcacaggatctcgagaatatcgtggccatacattgcaaaggcggaaagggtcggaccggcaccatggtgtgcgcacttctgattgccagtgagatctttttgactgcagaggaaagcctgtattatttcggggagcgcaggacgaacaaaacgcacagcaacaagtttcagggagtagagacaccttcccaaaataggtatgtgggatattttgctcaggtaaagcatctctacaactggaacctgcccccacgacgcatactattcatcaagcggtttatcatttattccatccgcggagatgtgtgtgacttgaaagtgcaggtggtgatggaaaaaaaggtggtattctcttcaactagcctcggcaactgttccattttacacgacatcgagacagataagatcctgatcaacgtatacgacggaccacccctgtatgatgatgtgaaggttcagtttttttcgagtaatctgcccaaatattacgacaattgcccttttttcttctggtttaacacatcttttattcagaacaaccggctgtgcctaccaaggaatgagctggataacccacataagcagaaggcctggaagatctaccctcccgaattcgcagtggaaatcctctttggggagaagtag

SEQ ID NO: 55073 - DNA, 1236 bp, Artificial Sequence
  Description of Artificial Sequence: Synthetic coding sequence
atgaatgagagcccccagactaatgaatttaaaggcactaccgaagaggccccagccaaggagtcaccacacacttccgaattcaaaggcgcagcattagttagtcccatatcaaagtcaatgttagagagattgtccaagttcgaggtggaggacgccgagaacgtggctagctatgaatggacacatctagtgcgactgctccgcctgataatccttatccggatatttcacctgctccaccagaagcgtcaattagagaagctgatgcgaaggctagtgtcagaaaacaagcgtagatacaccagggatggatttgatttagatctcacatacgtcactgaacggattatcgccatgagcttcccatctagcgggagacaatcattctatcgaaaccccatagaagaagttgtacggttcctggataagaagcataggaaccattatagggtctataacctgtgctctgaaagggcgtatgaccctaaacatttccataacagggtaagcaggattatgattgatgatcacaatgtgccaactctgcacgaaatggtcgtttttacaaaggaggtgaatgagtggatggcccaagatttggaaaatatcgtcgcaattcactgtaaaggcggaaagggccgtacgggtaccatggtatgcgcgctactgattgcctccgaaattttcctgaccgccgaggaatctctttactacttcggcgaacgccgaactaacaagacgcattctaataaattccaaggcgtcgagaccccttcgcagaatagatatgtaggctatttcgctcaggtcaagcacctgtataactggaatctgccacctcggcgaatcctcttcattaagaggtttatcatttattccatacggggagatgtatgtgacttgaaagttcaagtcgtcatggagaagaaagtggtgttctccagcactagtctcggcaactgttccatcctgcacgatatcgaaacagacaagatccttatcaatgtctatgacgggccaccactctatgacgacgttaaggtccagtttttctcatcaaatttgcctaagtactacgataattgcccttttttcttttggttcaataccagctttattcagaacaacaggttgtgcctgccgcgaaacgagctagataatccacataagcagaaagcctggaagatttatccacccgaatttgctgtggagatcttgttcggcgagaaatag

SEQ ID NO: 55074 - DNA, 1569 bp, Artificial Sequence
  Description of Artificial Sequence: Synthetic coding sequence
atgaacgagagcccccagacgaatgagttcaagggaaccaccgaagaggcccctgctaaggagagtccgcacacgtccgagtttaagggtgccgcactggtcagtcccatctcaaaatcaatgctagaacggcttagcaaatttgaagtcgaggacgcggagaatgtggctagctacgattcaaaaatcaagaagatcgttcatagcatcgtgtccagttttgcgtttgggatttttggagtcttcttggtactgctcgatgtgactctactgctggctgatctcatatttacggattctaaactgtatatccctctggagtaccgcagcatctccctcgcaatcggcctttttttcctcatggacgtgttgttacgcgtcttcgtggagggccgtcagcagtactttagtgatctattcaacattctagataccgctataattgtgatccccctgctcgtggatgtaatttatattttcttcgatattaagctccttcgaaacatccctagatggactcacttggtgcgccttctgagactgatcatactgatccgcattttccacctcctgcatcaaaagaggcagcttgaaaagcttatgcggagactcgtcagcgaaaacaaacgcagatacactagggacggtttcgatctggatctcacatatgtcaccgagcggatcatcgccatgagtttcccgtctagcggtcgccagagtttctataggaaccccattgaagaagtggtgcgctttctcgataagaaacaccgcaatcattaccgcgtgtataacttgtgttctgagcgggcttacgatcccaaacactttcataatagagtgtcgcgcatcatgatcgacgatcacaacgttcccactcttcacgagatggtcgttttcactaaagaggtgaacgagtggatggctcaagacttggagaacattgtggcaatacattgtaagggagggaagggaagaactggtaccatggtgtgtgcactgttaatcgcctctgagatctttctcacggccgaagagtctctttactatttcggtgagcgtcggaccaataaaactcactcaaacaagttccagggagtcgagacgccatctcagaatagatacgtgggctattttgcacaggtgaagcatctttacaactggaatctgcctcccaggaggatcttgttcattaagcgatttattatttattccattcggggagacgtctgtgacctcaaagttcaggtcgtgatggagaagaaggtggtgttcagttcgacttctctgggaaactgctcaatcctgcacgatatcgagactgataaaatcctgattaacgtatatgatgggcctcctctgtacgacgacgtcaaggttcagttcttctcttcaaacctgccaaagtattatgataactgccctttctttttctggttcaacaccagttttatccagaataaccgtctctgtttgccgagaaacgaattagacaacccacataaacagaaagcctggaaaatctacccacctgaattcgcggtcgagattctcttcggtgagaaatag

SEQ ID NO: 55075 - DNA, 975 bp, Artificial Sequence
  Description of Artificial Sequence: Synthetic coding sequence
atgaatgaatccccccagacaaatgaatttaagggcactaccgaggaagcacccgcaaaagaatcgccacatacaagcgaattcaagggggctgccctggtgtctccaattagcaagaggtggacacatctcgtgagacttcttagacttattattttgattcggatatttcatctccttcatcagaaaagacagctggagaagctgatgcggcgtcttgttagcgaaaataagcgtagatatactcgcgatggttttgacttggatctgacctacgtgaccgaacgcatcattgccatgagctttccctcgtccggacgccagtcattttataggaatcccatcgaagaggtggtgaggtttctggataagaaacacaggaaccactacagggtgtacaatctctgctccgagcgcgcatatgaccctaaacactttcacaatcgagtctcccgaataatgattgacgaccacaacgttcccaccctgcacgaaatggtagtgttcaccaaggaagtgaatgaatggatggcccaggacctggaaaacatcgtcgccatccactgcaaaggcggaaagggcaggaccggaacaatggtgtgcgcacttctgatcgcatccgagatctttctgacggccgaagagagcctgtactattttggcgaaaggcgcacgaataagacacattccaataagttccaaggagtggaaaccccctcacagaataggtacgtgggttattttgcccaggtgaaacatctgtacaactggaacctgccacctaggagaatcctttttatcaagagatttataatatactctatacgaggcgatgtctgtgaccttaaggttcaagtcgtcatggagaagaaagtggtctttagtagtacaagcctggggaattgtagtcgggaagagggatctactcgagctaactggaagggggaacctagcaggcgcccagttttggactag

SEQ ID NO: 55076 - DNA, 1236 bp, Artificial Sequence
  Description of Artificial Sequence: Synthetic coding sequence
atgaatgaaagcccacaaaccaatgaattcaaaggcaccacagaggaggctcccgctaaggagtcccctcatacctccgagttcaagggtgcagctcttgttagtcctataagcaagtctatgctggagagactgtctaaatttgaggttgaggacgctgagaacgtagcgagctacgagtggacccatctggtgagactgcttaggctcatcatccttatcagaatattccaccttctacatcagaagcgccagctggagaaactgatgagaaggctagtgtctgagaataagcgccgttatacacgcgacggttttgatctcgatctgacttatgtgacagaaagaattatcgcaatgagctttcccagctccgggagacagtcattctatagaaatcccatcgaagaggtcgtccgctttctggacaagaagcatcggaaccattaccgcgtttacaatctctgttctgagcgtgcctacgatcccaagcactttcacaatagagtatcgaggattatgatagacgatcacaacgtcccaactttacacgagatggtcgtctttacaaaggaggttaacgagtggatggctcaagatctggaaaacatcgttgctattcactgtaaggggggtaagggcagaaccggcacaatggtatgcgccctgctgattgcttccgaaatctttctgacagctgaagaatctctgtattatttcggggaacgcagaacgaataagactcactccaacaaattccagggtgtagagactccttcgcaaaacaggtatgtgggctatttcgcccaggtcaagcacctctataattggaacctgccccctcgcaggatcctttttattaagcggtttataatatacagtattaggggagacgtctgtgatctgaaggtgcaggttgtgatggaaaaaaaggtggtgttcagcagtacatctctgggtaactgttcaatcttacacgacatcgagacagataaaatcttaatcaatgtttatgatggtcccccactttacgatgatgttaaagttcagttcttctcttctaacctgccgaaatactatgacaactgtcccttcttcttctggtttaatacgagttttatacagaacaaccgattgtgtttgccacgcaatgaactggacaaccctcacaagcagaaggcatggaagatatacccaccagagtttgccgttgagatactgtttggagagaagtag

SEQ ID NO: 55077 - DNA, 1257 bp, Artificial Sequence
  Description of Artificial Sequence: Synthetic coding sequence
atgtaccggcctgcccgagtgaccagcactagtcgtttcttgaatccttacgtcgtgtgttttatagtggtggccggtgtcgtgattctggccgtcacgattgccctccttgtttactttctagctttcgatcagaaaagttacttttaccggagctctttccaattgcttaacgtggaatataacagccaactgaattcacctgcaacccaagagtacaggactctgtccggaaggattgagtcactcattactaagacgttcaaagagagcaacctgagaaatcagtttatccgagcccacgtggccaagctaagacaggatgggtctggtgtacgggctgacgtggtcatgaagtttcagtttacccgcaataataatggcgcttccatgaagtcacggatagaatctgttctgcgccagatgctcaacaacagtggaaacctagagattaacccaagtaccgagatcacatccctcactgaccaggcagcggcaaattggttgattaacgaatgtggcgctggccctgacttgatcactttatctgagcagcgcattcttggaggcacagaggctgaagaaggttcctggccttggcaggtatctcttcggttgaataatgctcatcattgcggcggaagtttaattaataacatgtggatcttgaccgccgctcactgcttccggtccaacagcaatcccagggattggatcgccacctcggggatttccacaactttcccaaaactgcggatgcgtgttcggaatattctcattcacaacaattataagtcggccacgcacgagaatgacatcgccctagttcgcctcgaaaactcagttaccttcacaaaagatattcattccgtgtgcctgcccgctgccacgcagaacatcccgcctggaagtaccgcttacgtaactggttggggagcccaggagtacgcaggacacacagtgccggaactccggcagggacaggtgcgcataatctccaacgacgtgtgcaatgccccacattcgtataacggtgccattctaagcggaatgctgtgtgccggtgtgcctcaaggaggggtggacgcctgccagggggactctgggggtccactcgtacaggaggattcgcgcaggctatggttcattgtgggaatcgtctcctggggggaccagtgtggccttccagataagccgggtgtgtacacacgagtgacagcgtaccttgactggatcagacagcagaccggaatatag

SEQ ID NO: 55078 - DNA, 906 bp, Artificial Sequence
  Description of Artificial Sequence: Synthetic coding sequence
atgaaattccagtttacgcgtaacaacaacggtgcttcaatgaagtctcgaattgaatcagtgctccgccagatgctgaataattcagggaacctggagattaacccctccacggagattacatctctaacagaccaagccgctgctaactggctgataaatgagtgtggcgctggacccgacttgataactctgagcgaacaacgcatattggggggaacagaagccgaagaaggtagttggccatggcaagtctcgctgcgccttaataatgcccaccattgcggagggagtctcatcaataacatgtggatccttacagccgctcactgtttccgtagcaactcaaatcccagggattggattgctacctcaggaatttctacaacatttcctaagctgagaatgcgggttagaaacatacttattcataacaactataagagcgctacgcacgaaaacgacatcgcccttgtgcgattagagaacagtgttacctttaccaaagacatccactccgtttgtttgcccgcagcaacgcaaaacataccccctggtagtaccgcttacgttaccgggtggggagcccaagaatacgctggtcacaccgtgcccgaacttcgccaggggcaggtcaggattatttccaacgatgtatgcaacgctccccacagctacaacggcgctatcctgtccggcatgctgtgtgcgggtgtgccacagggtggggtggacgcgtgtcagggagattctgggggtccactggtacaagaggacagtcggaggctgtggtttatagtgggcattgtcagctggggcgatcagtgtggccttccagacaagcccggagtgtacacacgcgtgaccgcatacctggattggatccgccagcagactgggatttag

SEQ ID NO: 55079 - DNA, 3060 bp, Artificial Sequence
  Description of Artificial Sequence: Synthetic coding sequence
atgggaagcaaacgcggtatcagtagtagacaccactccctgtcctcatacgagattatgtttgccgctctgttcgcgattttagttgttttgtgcgccggtttaattgctgtgtcctgcctgactattaaagaaagccagagaggggctgccttaggccaaagccatgaggcacgagcgacgtttaagatcacgagtggcgtgacctacaaccccaacttacaggacaagttaagcgtcgattttaaggtactggcgtttgatctgcagcagatgattgacgagattttcctgtcctctaatttaaaaaatgagtataaaaactcccgggtccttcaattcgaaaatggttctatcatcgtagtcttcgatctgttcttcgcgcagtgggtcagcgacgagaatgtgaaagaggaattgatccaggggctcgaagccaataaatccagtcagctggtgaccttccacattgaccttaacagtgtggacatcctcgacaagctgacaacaaccagccacctggcaacccccggaaacgttagcatagagtgtttgccaggttcctcaccttgcacagatgcattgacctgtattaaagctgacctgttttgcgatggcgaagtcaactgccccgatggatctgacgaagataataagatgtgtgctacagtgtgcgacggacggtttctgctcactgggagctctggctcattccaggctacgcactatcctaaacccagtgaaacgagtgtggtctgtcagtggatcatcagagttaatcagggcttatcaattaaattgagcttcgatgactttaacacttactatactgatatcctcgatatctatgagggagtcggatccagcaaaatcttaagggcttctatatgggagaccaaccctggtacaatccgcattttcagcaaccaagtgacggccacattccttatcgagagcgacgagtctgactatgttggattcaacgccacctacaccgcttttaatagtagtgagctgaacaattacgaaaaaattaattgcaactttgaagacgggttttgtttttgggtccaggacctgaatgatgataatgaatgggagcggatacaaggcagcacattttctcccttcaccgggccaaatttcgaccatacattcggaaacgcatcagggttttacatctccaccccaaccggtcctgggggtcgccaggagcgggttggcctgctatctttgcctctcgatccaaccctggagccagcctgtctctccttctggtaccacatgtacggcgaaaacgtacacaaactctctattaatattagcaacgaccagaatatggaaaagacagtatttcagaaggaaggcaattacggagacaactggaattatggccaggtaacactcaacgaaacggtgaaattcaaggttgcctttaatgccttcaagaacaaaatcctgagcgatattgctttagacgacattagcctgacgtatggcatctgtaacggaagcctgtaccctgaaccaacgctggtgccaactcctccgccagagctccccaccgactgcgggggaccattcgaactttgggagcccaataccactttctctagcaccaatttcccaaacagttatccaaatctggccttttgcgtgtggatcctgaatgctcagaagggcaagaatattcagctccatttccaggagttcgacttggagaatattaatgacgtagttgagatcagggacggcgaggaggccgattccctgctcctggcagtctataccgggcctgggcctgtgaaggatgtgttctccaccacaaaccgtatgaccgtgctactgatcactaatgatgttctggcccgaggcggatttaaagccaacttcacaactggatatcatctcggaatccctgaaccttgcaaggctgatcatttccagtgtaaaaatggcgagtgcgtgcctctggtgaatctttgcgatggacatctgcactgcgaagacgggagcgacgaagctgattgtgtgcgctttttcaatggtactacaaataacaatggcctggtgcggttccgtatccagtcaatttggcatacagcctgcgccgaaaattggactactcagatttccaatgacgtctgccagctcctggggctgggatctggaaatagctccaagcctatctttcccacagacgggggtccatttgtgaaactcaataccgcccctgacggacacctaatcctgaccccctctcagcagtgtctccaggatagcctcatcagactgcagtgcaaccataaaagttgcgggaaaaaactggcggctcaggatatcacacccaaaatcgtcgggggttctaacgcaaaagagggcgcttggccttgggtcgtaggcctttattacggtggacggttgttatgcggcgctagtctggtcagtagcgactggctcgtttctgctgcccattgtgtgtatggtaggaacttggagccctctaagtggactgccattcttggcttgcatatgaaatccaatctaacgagtccacagactgtaccacgactgatcgatgaaatcgttatcaacccccactacaatcgtcgcagaaaggacaacgacatcgctatgatgcaccttgagttcaaggtaaactacaccgactatatacaacccatctgcctccctgaggaaaaccaggtgttcccgcctggtaggaactgctcaatcgccggttggggcaccgtggtatatcagggaacaacagcaaatatccttcaggaagccgatgtgccgctgctgagcaacgagaggtgccaacagcaaatgcctgaatacaacattaccgaaaatatgatttgcgcgggatatgaagaagggggaattgactcttgtcagggtgactctgggggtcctctgatgtgtcaggagaacaataggtggttcctggccggagtgaccagctttggctataaatgcgctctgcctaataggcccggagtctacgccagggtaagccgcttcacagagtggattcaaagctttttacattag

SEQ ID NO: 55080 - DNA, 2154 bp, Artificial Sequence
  Description of Artificial Sequence: Synthetic coding sequence
atgtttcgtattaccaatatcgaattcctccccgagtacagacaaaaggaaagcagggagtttttaagtgtcagtcggactgtacagcaggttattaacctcgtttacacaacgtccgcgttttcaaagttttatgagcaaagcgtcgtggctgatgtttccaacaataaaggaggtctgctggtccatttttggattgtgttcgttatgccaagggccaaagggcacattttctgtgaagactgcgtggccgctatccttaaggactccatccaaacctctatcatcaacagaacgagcgtagggtcgttacagggactggcagttgacatggactccgtggtgcttaacgacaaggggtgctcgcaatatttttatgcggagcatctctctctccactaccccctggaaatcagtgcagcttcagggaggctaatgtgccattttaagctggtggcgatagtcggctacctgatccgtttatcaattaagtcaatccaaatagaggccgacaactgcgtgactgactccctcacaatctacgactctctcttaccaatccgatcgagtatcctctaccggatttgcgagccgaccagaaccctgatgagcttcgtctcaaccaacaacctgatgttggtaaccttcaagagcccgcatatccggagactgagcggaattcgggcttatttcgaggttattcccgagcagaagtgcgagaacaccgtgctggtaaaggatatcaccggtttcgagggaaaaatctcatccccttactatcctagctactaccctcccaagtgtaagtgtacatggaaattccagacgtcattaagcacattgggcatcgccctgaaattttataattattctattacgaagaagagtatgaaagggtgtgaacatggctggtgggaaataaatgaacatatgtattgcgggagttacatggaccatcagacaatcttcagagtgccctccccactggttcatatacagttacagtgttccagccggctttccgataaaccgctgctggccgaatacgggagctataacataagtcagccgtgtccagtcggatccttcaggtgttccagtgggctttgcgtcccccaagcccagaggtgtgacggagtgaacgattgttttgacgagtcggacgagctgttctgcgtatcccctcaacccgcatgcaacacctctagcttcagacagcatggccctctgatatgtgatggttttcgagactgcgaaaacggtcgcgacgaacagaattgcacccagagtatcccgtgtaacaatcggacctttaagtgtgggaacgacatttgcttccggaaacagaacgccaagtgcgacggcactgtcgactgccccgatggcagtgacgaggaaggctgcacttgctcgagatcctctagcgccctgcaccggatcatcggagggacggatactctggagggcggatggccctggcaggtctctctgcacttcgtgggatctgcatattgcggcgcttcagtgatatcaagggagtggctgttgagcgccgcacattgttttcacggcaacagactctctgatcctaccccttggactgcccatctcggaatgtacgtacagggcaacgccaagtttgtaagccccgtgagacggatcgtggtgcatgagtattataactcgcagacattcgactacgatatcgcgcttttacagctgagcatcgcttggccagaaacacttaagcaattaattcagcccatatgtattccacctactggccaaagggtgcgctcgggcgagaagtgctgggtcaccggatggggccgtcggcacgaggcggacaacaaagggtcgttggtgttgcagcaagccgaggtagagctcatagaccagacgttgtgcgtcagcacatatgggatcatcacatcccgcatgctctgcgcgggaattatgtcaggcaaacgtgatgcctgcaagggggatagtgggggacccctctcatgtcgccgaaagagtgacggaaaatggattctcactggaatcgtgtcctggggccacggatcagggcgtcccaactttcccggagtgtacactagggtgagcaattttgttccttggatccataagtatgtacccagtttgctttag

SEQ ID NO: 55081 - DNA, 2454 bp, Artificial Sequence
  Description of Artificial Sequence: Synthetic coding sequence
atggataaggagaattccgacgtgtctgccgcacccgctgatctgaagatttctaacatcagcgttcaggtggtgagcgctcagaagaaacttccaccgggacgacgtccgccacagaggcctatcgggaaggcgaaaccaaagaagcagagcaagaagaaagtgcccttttggaatgtacaaaataagataatcttgtttacggtgttccttttcattctcgccgtcatagcctggacacttctatggctttacatctccaagaccgagagtaaggacgccttctacttcgccggaatgttcaggataaccaacatagaatttctgcctgagtacagacagaaagagtccagggagttccttagcgtgtccagaactgtgcagcaggtcatcaatcttgtttacacaaccagtgcattctctaagttctacgaacagagtgtggtagctgatgtaagtagtaataacaaggggggactgttggtccacttttggattgtatttgtgatgcctcgcgctaagggacacatattctgtgaagactgcgtggccgcaatcctgaaggacagcattcagacaagtataattaacaggacaagtgtcggctccttgcagggcctggccgtcgatatggactctgtcgtgttgaacgacaaaggttgttcacagtatttctacgccgaacacctctctctccactacccactggaaatttctgcagcttctggccgtctgatgtgtcactttaaattggtcgctatcgtcggttatctgatacgcctctcaattaagtccatacaaatcgaagccgacaactgtgtcaccgattctctgaccatctatgactccctactgccaatccgcagtagcatcctctaccgtatttgtgaacctacgagaacgctgatgtcctttgtatctacgaataatcttatgctggtaacatttaaatctcctcacattagacggctgagcggtattcgggcatatttcgaagtaattccagagcaaaaatgcgaaaatactgtgctggttaaagacattacaggctttgaaggcaaaatcagtagtccttactatcccagctattaccctccaaagtgcaagtgcacatggaagtttcaaaccagtctgtctactttagggattgccttgaagttctataattacagcatcacaaagaaatcaatgaaaggatgtgagcacggatggtgggagataaatgaacatatgtattgtggaagttacatggaccaccagacgatttttcgcgtcccatccccattagtgcacatccagttgcaatgtagctctcggctgtctgataagcctctcttggccgagtatggttcctacaatatttcccagccgtgccctgtagggtcatttaggtgttccagcggtctgtgtgtccctcaggctcaacggtgcgatggagttaatgattgcttcgacgagtccgatgagctgttctgcgtgtcgccccagccagcatgcaacactagttcattccgccaacacgggccactgatctgtgatggctttcgggactgcgaaaatggtcgagacgaacagaactgtacccaatccatcccctgtaacaatagaacgttcaaatgcggtaacgacatctgctttcggaagcaaaacgctaagtgtgatgggactgtggactgcccggatggctctgacgaggagggttgtacatgcagccgctcatcctcagccctccaccgcattattgggggtacagacacactggaaggcggatggccatggcaagtgagtcttcattttgttggctccgcttattgtggcgcaagcgtgatcagccgagaatggttgctcagtgcggcacactgtttccatggtaaccgtttgtcggatccaaccccctggacagcccatcttggaatgtatgtgcaaggaaatgctaagttcgttagcccagtgaggaggattgtggtgcacgaatactataatagtcagacatttgactacgacattgcgctgctgcaacttagcatcgcttggcccgagaccctgaaacagcttatacagcctatttgcataccccctacagggcagagagtcaggtctggcgagaagtgttgggtcacgggttggggcagaaggcacgaggcagataacaaagggtctctcgtgctgcaacaggctgaggtggagttgatcgaccagacgctatgcgtctccacctacgggatcattacttcacgcatgctgtgtgcaggcatcatgtcgggcaaaagggatgcctgtaagggggattcaggtggcccactcagttgccgacggaagtccgacggcaagtggatactcactggtattgtgtcatgggggcatggatcaggcaggccaaattttccaggggtgtatactcgcgtatccaatttcgtgccatggattcacaagtacgtgccaagccttctgtag

SEQ ID NO: 55082 - DNA, 2496 bp, Artificial Sequence
  Description of Artificial Sequence: Synthetic coding sequence
atggacaaggaaaatagcgatgtcagcgcagcccctgccgacctgaagataagcaacatctccgtacaagtcgtatcggcacaaaagaaactccctccagggcgtcggccaccccagcgacccattgggaaggccaagccaaaaaaacaaagcaaaaaaaaggtccccttttggaacgttcaaaacaagatcatcctgttcacagttttcctctttatcctcgcagttatcgcctggaccctgttgtggttgtacatatctaagacagagtcaaaggatgcgttttactttgccggaatgttcaggattacaaacatcgagtttctgccggagtaccggcagaaagagtccagggagttcctatctgtatctcgtacagtgcagcaagtgatcaatctagtgtacaccacctcagccttctctaagttttatgagcagtctgtcgtagccgacgtgagcagcaataacaagggtgggttacttgtacatttttggatagtctttgtcatgccacgggcaaagggacatattttttgcgaggactgtgtggcagcgatccttaaagattccatccagacttcaattatcaatcgaacttccgtcgggtccctgcaggggcttgcggtggatatggattcagtggtgaatgccgcaggactgcggtctgactattcctctaccataggcagcgctgacaagggctgctcccaatacttttacgcggagcacctgagtctgcactaccctctggaaatctcggcagccagtggacggctcatgtgtcacttcaagctggtggccatcgtggggtatttaatacgcctgtcgattaagtctatccagattgaagcagacaactgcgtcactgatagtctcactatctacgactcactgcttcccattcggagcagcattctgtacagaatctgcgaacccactcgcacccttatgtccttcgtatccacaaacaatctgatgttggtgacatttaagtccccacacattaggagactatcagggatccgcgcttattttgaagtgataccagaacaaaagtgtgagaataccgtgctggtgaaggacatcacgggttttgagggcaaaattagctcaccgtactacccgtcgtattatccacctaaatgtaagtgtacttggaaattccagacctcattgtctactctgggcattgcactgaagttttataactatagcatcacaaaaaagtctatgaagggatgcgagcatggttggtgggaaattaacgagcatatgtattgtgggagttacatggatcaccagacaatcttccgtgtgccctcccctcttgtacatatacaacttcagtgcagctccaggctgtctgataagcctctattggcagaatatgggagctataacatctctcagccctgtcctgtgggtagtttcaggtgcagcagcgggctgtgcgttccacaggctcaacgatgtgacggagtgaatgattgtttcgacgagtcagatgagcttttctgcgtatcgccgcagccagcatgtaacacatctagttttcgccaacacggcccacttatttgtgacggattccgggactgcgaaaatggcagagatgagcaaaactgcactcagagtattccgtgcaacaatcgcacatttaagtgtggcaatgatatttgcttccgcaaacaaaacgccaagtgcgatggtaccgtcgactgcccagatgggagcgatgaggaaggttgcacctgctctagaagcagctctgccctgcatcgcatcattgggggaacagatacactcgagggcggatggccatggcaagtcagtcttcatttcgtgggttcggcatactgcggagctagcgtcatatcacgggaatggctgctgtctgcggctcactgttttcatggcaatcggctgtccgacccgactccctggacagcccaccttgggatgtatgtacagggcaacgctaaatttgtaagtcccgtcaggaggatagtcgtccatgagtactacaattcccagaccttcgactatgacatcgccctgctgcaattaagcatcgcctggcccgaaaccctgaaacagcttatccagccaatatgcatccctccgaccggccagcgagtccgcagcggggaaaagtgctgggtaactggatggggaagaagacacgaggctgacaataagggatctcttgttctgcagcaagcagaggtagagctgatagatcagacactctgcgtgtcgacctatgggataataacaagtcgaatgctgtgtgccggaatcatgtccgggaagcgagatgcttgtaaaggcgactcggggggacccctctcctgccgtaggaagagtgatggcaagtggatcctgacaggaatcgtgagttggggccatggctcggggagacctaattttcccggagtctacacgagagtctccaacttcgtgccatggattcacaaatacgtaccctctctgctgtag

SEQ ID NO: 55083 - DNA, 2532 bp, Artificial Sequence
  Description of Artificial Sequence: Synthetic coding sequence
atggataaggagaatagcgatgtgagtgccgcacctgcggacctaaagatctctaacatcagcgtccaggtagtttccgctcagaaaaagctgcccgtgcggaggcctccactgccgggacgcagactgcctctgcctggaagacggccaccacagagacccatcggtaaagccaaacccaagaaacagtctaagaagaaggtgcctttctggaatgttcagaacaaaatcatcctgttcactgtatttctcttcattttggccgtgatcgcgtggactctgctatggctgtacatttcgaagacagaatcaaaggacgccttctactttgctggaatgtttagaataactaacattgagtttctgccagagtatcgacaaaaagagagccgggagttcttaagcgtgagtcggactgtccagcaggtcatcaatttggtatataccactagtgcattctccaagttctatgaacagtcggttgtcgcagatgtgtcaagtaacaataagggaggcttgttggtacatttttggatagtgttcgtcatgccccgagccaaaggccacattttctgtgaagattgtgtggctgctattctgaaagatagcattcagacctcgattatcaacaggaccagcgtgggatcacttcagggattggccgttgacatggatagcgtggtgctcaatgccggactgcgttccgattattccagcaccattggcagcgacaaggggtgtagccagtatttttacgcggagcacctctccctgcattaccccctcgagatttccgctgcaagcggcagactcatgtgtcacttcaaattggtcgccatcgtgggctatttaattcgcctgagtattaaatcaattcagattgaggcggataactgcgtgacagacagtctcacaatttacgacagtctgctgccgatacggtcctccatcctgtatagaatttgcgaacctacgcgcaccctgatgagttttgtgtcaacgaacaacctgatgttggtcacgtttaaaagccctcatatacgccgactgagcggtattagagcctattttgaagtcattcctgagcagaaatgtgagaatacagtgctcgtaaaagacatcactgggtttgagggcaaaatatcaagtccatactatcctagctactatccgccaaagtgtaaatgtacatggaaattccagaccagcctgagtacgttagggatcgcactgaagttctataattattctattaccaagaagtctatgaaagggtgtgagcacggatggtgggaaattaacgagcatatgtattgtgggagctacatggaccaccaaacaatattccgggttccatctccactcgtgcacattcagctgcaatgttcctcacgtctttcggacaagcctctgctcgcggagtacggctcatacaatatcagccaaccatgcccagtaggttcctttaggtgttcctctggactgtgcgtgccgcaagcgcagagatgtgatggagtgaatgactgcttcgatgagtctgacgagctgttttgcgtttcgcctcagccagcttgcaatacctctagcttccgccagcatggtccacttatctgcgatgggttccgggattgtgaaaatgggagggatgagcagaattgcactcagtccatcccctgtaacaatcgaacctttaagtgtggtaacgacatttgtttcagaaaacagaacgcgaagtgtgacggaacagtcgactgtccagatggttcagatgaggaaggttgtacctgctcccgaagtagctcagccctccatcgcatcatcggcggaaccgacactttggaaggcggatggccctggcaagtgtctctccattttgtggggtctgcttactgcggggcttcagtcatcagccgcgaatggttgttaagcgctgcacactgttttcacggtaaccgcctcagcgatccaacgccctggaccgcacatctggggatgtacgtgcaggggaacgccaagttcgtgagccccgtcaggagaatcgttgtacatgaatattacaacagtcagacttttgactatgatatagctttgctacaactgtctatcgcctggccggagacgttgaaacagctgatccagcctatttgtatcccccctaccggccagcgggtaagatcaggcgagaagtgctgggttacaggctggggtcgccgacacgaagccgataacaaaggcagcttagtcctgcagcaggccgaggtggagctcatcgaccaaactttgtgcgttagtacatatggcatcatcaccagccgtatgctttgtgccggaatcatgtccggcaagcgcgacgcgtgcaaaggagattccggtggacccctgtcctgtagaagaaagagcgacggaaagtggatcctgaccgggattgtgagttggggtcacggcagtggcaggcccaacttcccaggggtatacacccgcgtaagcaatttcgtcccatggatccataaatatgttccctctctcttatag

SEQ ID NO: 55084 - DNA, 3180 bp, Artificial Sequence
  Description of Artificial Sequence: Synthetic coding sequence
atggaaccgacggtcgcggacgtccaccttgtacctcgaacgaccaaagaagtacccgcactggatgcagcctgctgtcgtgctgcttccatcggggtggttgccacttcactcgtggtgctaactctgggcgtactcctagctttcctttcaacccagggttttcatgtcgatcacactgccgaactcagaggcatccgatggacttcctccctgcggcgtgagacttccgactaccacaggaccctgacccctaccttggaggcactgctgcacttccttctgcgacccctgcagaccctctcactggggctggaggaggagctgctgcagaggggcattagggccaggctgcgtgagcatgggatcagtttggccgcatatggtaccatcgtctccgcggagctgacgggcagacataagggtccacttgccgagcgagactttaagtccggcagatgtccagggaattcttttagctgcggcaatagtcaatgtgtgaccaaagtgaatcctgagtgtgatgatcaggaagactgcagcgacggatcagacgaggctcactgtgaatgtggacttcagcctgcctggaggatggctggccgaatcgtgggtgggatggaggcctccccaggcgaattcccctggcaggcctccctccgcgagaacaaggagcacttctgcggtgccgcaattatcaacgcccgttggttggtgagcgcagcccattgcttcaacgagtttcaggaccccacaaaatgggtagcctacgtgggcgctacctacttgagcggatctgaggcgtccactgtacgcgctcaggtggtccagatcgtgaaacacccgctctacaatgcggacacggccgatttcgatgtagccgtgcttgagcttacctctccacttcctttcggacgtcacatccagccagtgtgtctgcccgctgcgacccacattttccctccttctaagaagtgcttaatttccggatggggttacctaaaggaggattttctcgtgaaaccagaagtcctgcagaaggcaacggtcgagctgctggaccaagccctgtgcgcaagcctgtacggccacagcttgaccgatcgtatggtgtgcgctgggtatctggacggcaaggtggatagttgccagggagactctggcggaccactcgtctgtgaggagccctctgggcgtttcttcctggcaggaatcgtgtcctggggaatcggctgcgccgaggctagaagaccaggcgtttatgccagggtgacacggctgcgcgattggatactggaggctacaacgaaggcgtctatgcccttggctcctacaatggcacctgctcccgcagctccatctacagcatggcctacgtccccggagagtccggttgtttcaactccaacgaagagtatgcaggctctgtctactgtcccattggattgggtgacagtgcctaaattgcaggagtgcggtgcacgcccagctatggaaaaacctacacgggtcgtggggggtttcggggctgcatccggtgaggtgccgtggcaggttagcctgaaggagggaagcaggcacttttgtggcgcaaccgtggtcggcgaccgatggctgctcagtgccgctcattgcttcaatcacacaaaagtggagcaagtcagggcacatctggggaccgccagcctgctcggtctcgggggttctccggtcaagatcggcctgaggcgcgtagtactgcatccattatataaccccggaatcctggacttcgacctcgctgttctagaactcgcttccccattagcctttaataaatacatccagcccgtgtgtctacctctggccattcagaaatttccagtcggaagaaaatgtatgatatcgggctggggaaacactcaagaagggaacgccaccaagcccgaattacttcagaaggcgtctgtgggcataatagatcagaaaacttgttcagtgctgtacaatttttctctcacagataggatgatctgtgctggcttcttagaaggcaaggtcgattcctgccagggcgattctggtgggcctctggcttgtgaagaggcccctggagtcttctatttagccggaattgtaagctgggggattgggtgcgcacaagtgaagaaacccggtgtttatacccgcatcacgcgtttgaaaggctggatcttagaaatcatgtcgtcccagcccctgccgatgtcgcccccatctacaactagaatgcttgcaacaacttccccacgcactaccgctgggttgaccgtgccgggtgcaacacccagtagacctacccctggtgccgctagtcgagttacggggcaacccgcaaattctacactgtccgcagttagtaccaccgcccgtggccagacccccttcccagacgccccagaggccaccacccacacccagctgcccgattgtggactcgcccctgcagccctgacgcgcattgtaggcggttccgcagccggacgaggggaatggccttggcaggtgtctctgtggctgcgcagacgcgagcacagatgtggcgcagtgttagttgcagagcgttggctgctctcagccgctcattgttttgacgtgtacggagatccaaagcaatgggcagcatttctcggaactcctttcctgtctggcgctgaggggcaacttgagcgtgtagcacgaatttataagcatccattctacaatctttacaccctcgattacgatgtggccctgttagaactggccggacccgtaagacggtcacgcctggtaaggccaatctgcctccccgaacccgctcctcgacctcctgacggtactagatgtgttattactgggtggggtagtgtacgggaaggaggttccatggctcgccagcttcagaaagcggcagtacggctcctttccgaacaaacttgtcgacgattctacccggtccagatcagcagtcggatgttgtgcgcgggattcccacaggggggtgtggactcatgctcaggcgatgccggaggacccctggcatgtcgcgaaccttccggcagatgggtgctcacaggagtgacctcctggggctacggatgtggcagaccccatttcccaggggtgtacacaagagtggcggcagtccggggttggattgggcagcatattcaggagtag

SEQ ID NO: 55085 - DNA, 1596 bp, Artificial Sequence
  Description of Artificial Sequence: Synthetic coding sequence
atggagccaaccgtggcagacgtgcatctggtccctcggaccaccaaagaagttcctgcacttgatgcagcctgttgtagagcagcaagcataggagttgttgccaccagccttgtggttctgaccctgggtgtcctgctggcatttctttccacccaggggttccacgtggatcataccgcagagttgcgagggattcggtggacaagctccttgcggcgagagacgtcagactaccataggacactgactcccactctggaagccctgttcgtgagtagttttcaaaagacagagcttgaggccagctgcgtgggatgtagcgtgctgaattacagggatgggaactcgagtgtcctggttcacttccagctacatttccttctgcggcctctgcagactctttcactgggtcttgaagaggaactcctccagcgcggaatccgggcacgtctcagagaacacggcatctctctggcagcatacggcaccattgtttccgctgaacttaccgggaggcacaagggacccttggcagaacgagatttcaaaagtggtaggtgccccggtaattccttcagctgcggaaatagccagtgtgtgactaaagttaatcccgagtgtgacgatcaagaagattgcagcgacgggagtgatgaagcccattgcgaatgtggtctccagcccgcatggcggatggccggacgcatcgtgggtgggatggaggctagcccaggcgagttcccctggcaggcttcactaagagaaaacaaggaacacttttgcggcgctgccatcatcaacgctcggtggctggtcagcgcggctcactgttttaatgaatttcaggaccccacaaaatgggtggcctatgtaggagcaacttatctctcaggatcagaagcctctacagtgagagcacaggtggtgcaaatcgtcaaacaccctctgtataatgccgatacagcagatttcgacgtagctgtcttggagctgaccagccccctacccttcgggaggcatatccagcccgtctgtctgcctgcggcaacgcatatctttcccccttccaagaaatgcctgatatctggatggggctaccttaaagaggacttcctagtaaagccagaggtgctccagaaagcaacagttgagcttctcgatcaggccttgtgtgctagtctctacgggcactctctgacagacagaatggtgtgtgccggttacctcgacggtaaagtggattcttgccagggagacagtggagggcctctagtctgcgaagagccctctggtcgcttcttcctggctgggattgtttcttggggaatcggatgcgccgaggcacgtcgccctggagtctatgcgagggtaacgcgcctcagagactggattctggaggccacaaccaaagctagtatgcccctcgcaccgacgatggcacctgcacccgctgctccgtcgaccgcctggccaaccagcccggaatcaccagtcgtatccactcctaccaagtctatgcaagctcttagtaccgtgcccttagactgggttaccgtgccaaaattgcagggaatatttggagccgagaggtag

SEQ ID NO: 55086 - DNA, 405 bp, Artificial Sequence
  Description of Artificial Sequence: Synthetic coding sequence
atgaccgaggaaccgataaaggagatcctcggtgctccaaaggcacacatggcagccaccatggagaagtccccaaagtccgaggtggtgatcacgacggtgccgctggtaagcgaaatccagttaatggctgccacagggggaacagagctgtcctgctaccgttgtatcatccccttcgccgtcgtcgtctttattgcaggcattgtcgtgacggctgtggcttattccttcaattcccatggttcaattatttcaattttcgggctcgtagtactctcttccggcctcttcctgctggctagtagcgccctctgctggaaagtccggcaacgctcaaagaaagctaaaaggagagagtcccaaaccgcgctagtggctaatcaaaggagccttttcgcctag

SEQ ID NO: 55087 - DNA, 405 bp, Artificial Sequence
  Description of Artificial Sequence: Synthetic coding sequence
atgactgaggaacctataaaggagatcctgggtgcccctaaagcccacatggccgctacgatggagaagtctccaaagtctgaagtagttattaccactgtgcctcttgtgtctgagatccagcttatggcagctacaggagggactgaactctcctgctaccggtgtattatccctttcgccgttgtggtgtttatcgctggcatcgtagtgacggctgttgcctattcattcaattcccacggatctatcatctctatcttcgggctggtcgtgctctcaagtggattgttcctgctcgccagcagtgccctgtgctggaaggtaagacagagaagcaaaaaggcaaaacggagagaatctcaaactgcactagtggccaatcagaggagtctgtttgcatag

SEQ ID NO: 55088 - DNA, 405 bp, Artificial Sequence
  Description of Artificial Sequence: Synthetic coding sequence
atgactgaagaacctataaaagagatcttaggagctcccaaggcccatatggctgctactatggagaagtcccctaaaagcgaagttgtaataaccaccgtgcccctagtgtctgaaatccagttgatggctgcgacaggcggtacagagctgtcttgctacagatgtatcattccgttcgccgtagtggtctttattgccggtattgtcgtgaccgccgtcgcttactccttcaactcccacggttccattatttccatcttcggcctggtggtgctgagctcaggactcttccttcttgcaagctccgccctttgctggaaagtgcggcaacggtccaaaaaagctaagcggcgagagtcccagacagctctggtcgcaaatcaaaggtctttgtttgcgtag

SEQ ID NO: 55089 - DNA, 633 bp, Artificial Sequence
  Description of Artificial Sequence: Synthetic coding sequence
atgaggaagcggcagcagtcccagaacgaaggcacaccagcggtgagccaggccccagggaaccagagaccaaataacacatgctgtttttgttggtgttgttgttgctcttgcagctgcctgacagtcagaaacgaggagaggggtgagaacgccggacgccctacccacactactaagatggagtccatccaagtgctcgaagagtgtcaaaaccccactgcagaggaagtcctgtcttggagccagaattttgacaaaatgatgaaggcccctgctgggaggaacctgttccgggaattcctgaggaccgaatatagtgaagaaaatttactgttctggctcgcgtgcgaagacctcaagaaagaacagaataagaaagtgatagaagaaaaagcaagaatgatatacgaggactatataagcatcctcagtcccaaagaggtgagcttggactctcgcgtgcgtgaagtgatcaataggaacttacttgacccaaatcctcacatgtatgaggacgctcagttacagatctacaccctgatgcatcgagattccttccccagattcctaaactctcagatatacaagagctttgtggagagtacagcaggcagttccagtgaaagctag

SEQ ID NO: 55090 - DNA, 600 bp, Artificial Sequence
  Description of Artificial Sequence: Synthetic coding sequence
atgggggctgcggtattatgtgcgtctttcatgagctttggagtgaagcgcagatggtttgccctgggagcagcactccagttggccatcagtacttacgcggcatatattggcggatacgtccactatggagattggctgaaagtgcgcatgtattcaagaaccgtggccattatcggaggctttcttgtactggccagcggggcaggagagctttatcgcagaaagccacggagcagatcgcttcagtctaccggccaggtgtttctgggcatttacctaatctgtgtggcctactctcttcagcactcaaaagaggatcgcctggcatatctcaatcacctccccggaggagagcttatgatacagctgttctttgtcttatacgggatactggctctggcctttctgtccggatactacgtgactctggctgcgcaaatcctagctgtcttgttgcctcctgttatgctgttaattgatggcaacgtggcctactggcataacacccgcagggttgagttctggaatcagatgaagcttctgggcgagagcgtgggtatcttcggaactgctgtcatattggctacggatggctag

SEQ ID NO: 55091 - DNA, 774 bp, Artificial Sequence
  Description of Artificial Sequence: Synthetic coding sequence
atggcttctaagatcgggagccggaggtggatgctgcagcttattatgcagcttggctctgtcttgcttactagatgtccgttctggggctgtttcagccagttgatgctatacgctgaaagagctgaggccagaaggaaacccgatatcccagtgccctatctctattttgacatgggagctgctgtgctgtgcgccagttttatgagcttcggtgtgaaacgacgctggttcgccctaggtgccgctctgcagcttgccatcagcacctatgcagcttatattggaggatacgtccactatggcgactggctaaaggtcagaatgtattcaagaaccgtggcaatcattggcggtttcttggtgctcgccagcggagccggagagctgtataggcgcaagcctaggagcaggtcccttcagtctacaggtcaggtttttctcggtatctacttgatttgcgtggcctacagtctccaacactctaaggaagatcgactggcatatctgaaccaccttcctggcggtgagctaatgattcagctcttttttgtactctatggaatactcgcattggcctttctttctggctactatgtcaccctggccgcacagatactcgctgtgctcctacctccagtgatgctgttaatcgacggtaatgtcgcttattggcacaatacccggagggtggagttctggaatcaaatgaaattactgggtgaaagtgtcgggattttcggcacggctgtcatcctggcaaccgacggatag

SEQ ID NO: 55092 - DNA, 1491 bp, Artificial Sequence
  Description of Artificial Sequence: Synthetic coding sequence
atggccggtgagatcacagagactggggaactgtattcgtcatatgtgggcctagtctatatgttcaacttgatcgtgggcaccggagcactgaccatgcccaaggcctttgccaccgcaggctggctggtgagtctggtcctattagtattcctgggctttatgtcatttgtgacaaccacattcgtcattgaagccatggccgctgctaacgcacagctacattggaaacgcatggaaaaccttaaggaagaggaggacgatgactcaagtaccgctagcgacagtgatgtgctcatccgcgataattacgagcgggctgagaagcgacccatcctctctgttcaacgtaggggaagcccaaatccattcgaaatcactgaccgcgtggaaatggggcagatggcctcgatgttttttaataaggtgggggtgaacctgttctacttttgcatcatcgtctacttgtatggcgatcttgcgatttatgcagctgccgtgccattcagtctgatgcaggtaacctgctctgcgaccggaaacgacagctgcggcgtggaagctgatactaagtacaacgacaccgatcgttgctggggacccctgaggcgagtagacgcatataggatctacctcgccattttcaccctcctcctgggaccattcacattttttgacgttcagaaaactaagtacctgcaaatcctgacttccttgatgcgttggattgctttcgctgtcatgattgtcctagccctgattcgtatcggccacgggcagggagagggtcacccgcctctggctgacttttctggggtgcgaaacctctttggagtctgtgtgtattctttcatgtgtcaacattctctcccgtccttgatcacgcctgtgagttcaaagaggcacctcactaggctggtatttctggactacgtgttgatcctggctttctatggtctgctgtctttcaccgccattttttgcttcagaggagacagcctcatggacatgtacacgcttaactttgcccgatgcgacgtagtgggcttggcggcagtcaggtttttcctcgggctattccctgtctttaccatttctacaaactttccaatcatcgcagtgaccctccgcaataactggaagactcttttccacagggaagggggaacatatccttgggtcgtggacagagtggtctttccaactataacgctcgtgccaccagtgctcgtagccttctgcactcacgacttggaaagtctggttgggatcacaggtgcctatgccggtacaggcattcagtacgtgatcccagctttcctggtgtatcactgcagaagagatacccagctcgcctttggatgcggcgtttccaacaagcaccggtcaccatttagacacaccttctgggtgggatttgtgctgctctgggccttctcatgctttattttcgttaccgctaacatcatcctgagcgagaccaaattgtag

SEQ ID NO: 55093 - DNA, 984 bp, Artificial Sequence
  Description of Artificial Sequence: Synthetic coding sequence
atggcaggcgagataacggagaccggggaactgtactccagctacgtattcgtccgtgtagtcaagccgaacaaaattgccatgctgtttatcatgctgatacctggttgggctagatggctgactcctgtgatccctgctctgtgggaggcagaggccggtcggtcccctgaagtccgctctagccggccagcctggcctacatgtttcgtgacgacgaccttcgtgatagaggcgatggccgctgctaacgcccaactccattggaaaagaatggagaatctaaaagaggaggaagatgacgactcgagtacagcatctgatagcgacgtcctgattcgggacaactatgagcgtgcggagaagcgtcctattctgagcgtgcagaggcgcggttctcctaatccctttgagattaccgaccgagtggaaatgggtcagatggcctctatgtttttcaacaaagtaggggtgaacctcttttatttctgcataatcgtgtatctctacggcgatctggcgatctacgcagctgctgtgccttttagcctcatgcaagttacctgctcggctacaggaaatgactcttgcggggtcgaagccgacacgaaatataacgacacagacaggtgctggggacccctcagaagagttgacgcctacagaatctatttggcaatcttcacactgctgttggggcctttcacattcttcgatgtgcaaaaaaccaaatatctgcagatcttaacttccctaatgcgatggattgacggaccccctggttcggtcatgggacgggcagaagaggatgcaagcccagcatggcccagaagtcgctgcaggtgcggcggtaagcttaaattaaacagtctttacccgacatccgcgacctgcatggcacccgatgcaccaggagctgggcaagtgaaggtgggtgtcaactttttatgtttaccccctcacaggtccacgcgcccaacctag

SEQ ID NO: 55094 - DNA, 390 bp, Artificial Sequence
  Description of Artificial Sequence: Synthetic coding sequence
atgctgctcaaagtgaggcgggctagcctgaagcccccagcgactccgcaccagggggcttttcgcgcaggtaacgttattggacagttgatttatttgttgacatggtcattgttcaccgcctggctgaggccacctacgctactccagggtccaagaacatccccccagggtagccccccacggagcccgtggggggattgcgccgaaccctcctgcctgtgcgaaatgaaaatcaggcgcaggcgccatgaggggccagcatggggccaatccggatttctggccggtgggctccatctggtccccagctccctctcccttgccgcatgcggcgtcgtgaggatgaagggtctgtggggccgaggcgcaggtatcaggggcagatag

SEQ ID NO: 55095 - DNA, 789 bp, Artificial Sequence
  Description of Artificial Sequence: Synthetic coding sequence
atgggaaagacctttagtcagctgggcagctggcgagaagatgagaacaagagcattctgtcctccaaacctgccattggcagtaaagcagtaaactattccagcactgggagcagtaagtctttctgttcctgcgtcccctgtgaagggacagccgatgcctcctttgtcacttgccctacttgtcagggaagcggcaagattccacaggagttagaaaagcagctggttgctttaataccctatggcgatcagcgactgaaaccgaagcacacgaaactcttcgtgtttctcgccgtgctgatctgcctggtgacctcctcctttattgtcttttttctattccctcggtccgtgatagtccaaccagctggattaaattctagcacagtggcctttgatgaggcagatatttaccttaatattaccaacatccttaatatcagcaatggaaactattaccccattatggtgacgcaattaaccctggaagtcttgcacttgtcgctggtcgtggggcaggtgtccaacaacttactcttgcacattggtcccctggcctccgaacagatgttctacgctgtcgctacgaagataagggacgagaacacttacaaaatatgcacttggctggaaatcaaggtccatcatgtactgttgcatatccagggcactttgacctgctcctacctatcccatagcgaacagctggtgttccagagctacgagtatgttgattgccgtggcaatgcaagcgtaccacatcagttgacaccacaccctccctag

SEQ ID NO: 55096 - DNA, 648 bp, Artificial Sequence
  Description of Artificial Sequence: Synthetic coding sequence
atgggcaaaacctttagccagctgggcagttggagggaggatgagaataaaagtatcctctctagtaaaccagccattggctcaaaggccgtaaactactcctctacaggctctagcaagagtttttgttcttgtgtcccctgcgaagggaccgcagacgcctccttcgtgacctgcccaacctgccagggaagcggtaaaatcccacaggagctggaaaagcagctcgtagctctgatcccttacggagaccagagactcaagcccaagcataccaagctatttgtctttttggccgtgctgatctgccttgtcacgtcctcattcatcgtgttcttccttttcccacgatctgttattgttcagcctgccggtttaaactcttctacagtcgcttttgacgaagcggatatctaccttaatatcacaatgttttatgccgtcgccaccaaaattagggacgagaacacatacaaaatttgtacctggctggaaataaaagtgcaccacgtgctactccacattcaaggcactctgacttgctcctacctctcccatagcgaacagctggtatttcagtcttacgagtatgtggactgcagagggaatgcctctgtgcctcatcagctgaccccacaccccccatag

SEQ ID NO: 55097 - DNA, 645 bp, Artificial Sequence
  Description of Artificial Sequence: Synthetic coding sequence
atgggtacggctgacgcaagcttcgtcacctgccccacttgtcagggaagtggcaagatcccccaggagcttgagaagcaattggttgcccttatcccctacggtgaccagcgactgaaaccaaagcacaccaaactcttcgtgttcctggccgtgcttatctgtttagtgacctcgtcttttatcgtgttctttctcttcccaagatctgtcatcgtgcaaccggctggcctgaactcctccaccgttgctttcgatgaggccgatatatatctgaacatcaccaacattctcaatatttccaacggcaattactaccctataatggtaacccagttgactctggaagtgcttcatctgagtctggtagtgggacaggtctccaacaacctgcttctacacatcggccctctggcaagtgagcagatgttttatgccgtcgctaccaaaattcgggacgaaaatacatacaaaatctgcacttggcttgagatcaaagtccaccacgtgttgctgcacatccaaggcacattgacctgcagttatctcagccactcggaacagctggttttccaaagctacgaatatgtagactgcagagggaacgcctccgtgcctcatcagttgacaccacacccaccttag

SEQ ID NO: 55098 - DNA, 696 bp, Artificial Sequence
  Description of Artificial Sequence: Synthetic coding sequence
atggggagtcagcattctgccgctgctcgaccttccagctgccggaggaaacaggaggatgatagggacgggctgttggcagagagggaacaggaagaagctatcgcacagttcccttacgttgaatttacaggtcgggattccatcacatgcctaacatgccagggcacaggttacatcccaacggaacaggtgaacgaattggtcgctctgatacctcactccgaccaaaggttaagaccacagcgcacaaaacagtacgttctcctgagcatcctgctgtgtttacttgcttccggtctggttgtgttctttctgttccctcatagcgtgctcgtggatgatgatggcattaaagtggtaaaggtgacatttaataagcaggattcactagtgatcctcactatcatggcgactctgaaaattaggaactctaacttttacactgtggccgtaacaagtttatcgagtcaaattcagtatatgaacacagtggtcaactttacggggaaggcggaaatggggggtcccttctcttacgtctactttttctgcaccgtgccagagatcctcgtgcacaacatcgttatttttatgaggactagcgtgaagatctcctacataggcctgatgactcaatcctccctggagactcatcactacgtggattgcgggggaaattctactgcaatttag

SEQ ID NO: 55099 - DNA, 753 bp, Artificial Sequence
  Description of Artificial Sequence: Synthetic coding sequence
atgggctctcaacatagcgctgcagccagacccagttcctgcaggcgaaaacaagaggacgaccgcgatggactgctggcggagagagaacaggaggaggccatcgcccagtttccgtatgtggagtttaccggcagggactcaatcacatgcctgacctgccagggtacaggctatattcccacagaacaagtcaacgaacttgtagccctgataccacatagcgaccagagattacgccctcagcgtacgaagcagtacgtgttgctgtcaatattactgtgtctattagcgtccggtctggtggttttcttcctgtttccccactccgtgctggtggatgatgatgggattaaagttgtgaaagtgacattcaacaagcaggacagccttgttatcctgacgatcatggcaacccttaagattagaaacagtaacttttacacggtggcagtgacatcgctctcctcacagattcaatacatgaatacagttgtcagtacatacgtaacaactaacgtcagtctgattccgcctcggagcgagcagcttgtcaatttcactggcaaggcagagatggggggaccattctcatatgtttactttttttgcaccgtgccagagatcctggtgcacaatatcgtaatcttcatgagaactagtgtaaaaatatcttacattggtctgatgacgcagtctagtctcgaaacacaccactacgtcgactgtggaggaaactctaccgccatttag

SEQ ID NO: 55100 - DNA, 696 bp, Artificial Sequence
  Description of Artificial Sequence: Synthetic coding sequence
atgggtagccagcattcagcggcagcgaggccatctagttgccggagaaagcaggaggacgatcgggatggcctgcttgctgaacgggaacaagaagaggccatagcccaatttccgtatgttgagtttactggacgcgatagcatcacttgcctaacttgccaaggcactgggtatatacctaccgaacaagtcaatgaactggtggccctgattcctcattccgaccagaggctgcggccacaacggacaaagcagtacgtgctcttaagcattctcctgtgtttgcttgcttctggactggttgtgttcttcctgtttccccactcagttctggtggacgatgatggcatcaaggtggtgaaggtgacgttcaataaacaggactccctggtaattctgactataatggcaacactgaagataaggaacagtaacttttacaccgtggccgtgacatccctgagttcacaaatccagtatatgaacaccgtggtaaactttacagggaaagcagagatgggtggcccattctcctacgtctattttttctgcaccgtgccagagatactggtccacaatatagttatttttatgcggactagcgtaaaaatcagttatattggcctgatgacccagtcaagcttggaaacccatcattacgtcgactgcggtggcaacagcaccgctatctag

SEQ ID NO: 55101 - DNA, 753 bp, Artificial Sequence
  Description of Artificial Sequence: Synthetic coding sequence
atgggctcacagcactccgcagccgctagacctagctcttgtagaagaaagcaggaagatgacagggatgggttgctggctgagcgagaacaggaagaggctattgcccagtttccgtacgtggagtttacgggccgtgactcgattacatgcctcacttgtcagggcacagggtatatacccaccgaacaggtcaatgaactcgttgcattaatcccgcactccgatcaacggctgcgtccacagcgtacaaagcagtacgtcctcctgagtatcttattgtgcctgttggccagcggactagttgtgtttttcctgttcccccattcggtgttggtcgatgacgatgggatcaaagtcgtcaaggtaaccttcaacaaacaggattcacttgtcattctcactatcatggctacgttgaaaattaggaactcaaacttttacacagtggccgtgactagcctgagctcacaaattcagtatatgaacactgtggtgtccacttatgtgaccacaaacgtgagcctgatacccccaaggtccgaacagttagtgaattttacagggaaggccgagatgggcggtcctttctcatacgtgtacttcttttgcactgtgcccgagatcctcgtgcataacatcgttatcttcatgcggacttctgtgaaaataagctacatcggcttgatgacccaatccagcctggagacccatcactacgttgattgcggcggtaattccacagcaatctag

SEQ ID NO: 55102 - DNA, 441 bp, Artificial Sequence
  Description of Artificial Sequence: Synthetic coding sequence
atggggagagtttcaggcctggtgccgagccgcttcttaactctgctggcccatctggtagtcgtgatcactttattctggtctcgggatagcaacatccaagcttgcctgccactgacctttactcctgaagagtatgataagcaggacatccatcccctgccactgtgtagactggttgcagcactgagcgtgacacttggattgtttgccgtcgagcttgccggattcctgagcggcgttagcatgttcaacagcacacaatcgctcatttccattggtgcacactgtagtgccagtgtggccctgagcttttttatttttgagcgctgggaatgtacaacctattggtacatctttgtgttctgttcagcactcccagccgtgaccgagatggctctgttcgtgacggtattcgggttgaagaaaaaaccattttag

SEQ ID NO: 55103 - DNA, 492 bp, Artificial Sequence
  Description of Artificial Sequence: Synthetic coding sequence
atgggaagggtcagcggcctggtaccatcgagatttctgaccctgttggctcatttggtagtggtcattacactattctggagccgcgtaaggccaacggctgccctgaacccgtcccctttcccatccctttccggcccatctccgaccctgccaccccctagcgttcttcctagctgggtgtttctatttccggcagctcccaggcccgcactgcaaccggctcctttcagcctgctttccgctggctggtggcctaggagtctatctccttgggcttcgctgcaatggtcctggcctgtatccagccaggagtcaccatgtagcaccgcaccccgtgccagctcagtttcgtttctgcctgcacacctgtcccataccacccatttttaccaggacagcctccagccaccagatactatcgtctcagctgtggcgaatcctagcagctccaaaatcttcaacgatgtgctgaaccccgcagtgtattag

SEQ ID NO: 55104 - DNA, 423 bp, Artificial Sequence
  Description of Artificial Sequence: Synthetic coding sequence
atgggcagagtgagcggactggtaccctctagattcttgaccttattggctcatcttgtcgtggtcatcaccctgttctggagtcgggattctaacatccaggcatgtctccctctgacattcacacctgaggagtacgacaagcaggatatacagctggtcgctgccctttcagtcactttaggcctcttcgctgtagaactggctggtttcctgagcggagtgtctatgtttaacagcacacagtcactgatctcaattggggctcattgtagcgcgagcgtggcactctccttttttatctttgaacgctgggagtgtaccacttactggtacattttcgtgttctgttcagcgttgcccgcagtaacggaaatggccctgttcgttaccgtattcgggctcaagaaaaagcctttttag

SEQ ID NO: 55105 - DNA, 420 bp, Artificial Sequence
  Description of Artificial Sequence: Synthetic coding sequence
atgggaagggtgtctggccttgtcccctcacgcttcctgacgctattagcccacctggtagtcgtaataaccctattttggtcccgggacagtaacatacaggcatgccttccccttacatttacccccgaggaatacgacaaacaagacatccacccccttccactgtgcagactggttgccgcactcagtgtgactctggggctgtttgctgtggaactggcgggatttctcagcggtgtaagcatgtttaactctacccaaagcttgatctcaattggcgcacactgcagcgcgtctgttgctctctccttcttcatattcgagcggtgggagtgcaccacttactgtgctctgcctgcagtgacggaaatggctctctttgttacagtgtttgggcttaagaagaagcccttctag

SEQ ID NO: 55106 - DNA, 1728 bp, Artificial Sequence
  Description of Artificial Sequence: Synthetic coding sequence
atgaagcgttctctgcaggccttgtattgccaattgctatcatttcttttgatactggctctcaccgaagccctggcttttgctatccaagagccaagcccacgggaatctctgcaagtgctcccatccggaactcctcctggcacgatggtgacagctccccacagctccacacgccatacgtctgtagttatgctgacccccaaccccgatggtccccctagccaggccgcagcgccaatggcaacacccacaccaagagccgagggtcaccccccaacacataccatttctaccatcgcggcaacagtaactgctcctcactctgaatcttcattgtccaccggcccagcccctgctgccatggcaacaacatcctccaagcccgagggcaggccacgcggacaggcggctcccaccatcttattgaccaagccacctggagcgacctctcggccaacaactgctccccctcgcactacaaccagacgtccccctcgacctcccggttcttcccgcaagggtgccggaaactcatcccggcctgtgccgcctgcacctggaggccattcgcggtcgaaggaaggccagagaggtcggaatccctcaagcacgcctctcggccagaagaggccgctgggcaagattttccagatctacaagggcaatttcacagggtctgtggaaccagagccctcaactctcacccccagaacccccctgtggggatacagctccagcccgcagccccagaccgtggcggctaccaccgtgccttcaaacacttcttgggcacctactacgacgtcattgggccctgctaaagacaaacctggactgcgcagggccgctcaaggaggcggatccaccttcacctcacagggtggaacacccgatgccactgcagcctccggggcacccgtctcaccacaagcagccccagtgcccagccagcgaccccatcatggggaccctcaggacggaccctctcattctgatagctggctgacagttacccccggtacgtccaggcctctttcgacttcatcaggcgtgttcactgccgctacaggaccaactcctgctgccttcgatacttctgtgtcggcgccatctcaagggatccctcagggagctagtactacccctcaggctccgacccacccttcccgagtgagtgagtcaaccatttctggggcaaaggaagaaaccgtggccacgctaacaatgacagacagagtgccatcaccattgtcaacagtagtctccacagctacgggcaactttctgaatcgtctggtcccagcgggaacatggaaacctggcaccgccggtaacatcagccacgttgcggagggagataagccgcaacaccgcgctacaatttgtttgtctaagatggacatcgcgtgggtaatacttgctatctctgtccccataagctcttgctctgtgctactcactgtttgttgcatgaaaaggaagaagaagactgctaaccccgaaaataatctctcttattggaacaacactattacaatggattactttaaccggcacgcagtcgaactacctcgtgagatacagagtctagagacttctgaagatcagctgagtgaaccaaggtcacctgccaatggagattatcgggacacgggaatggtgctagttaatcctttctgccaagagaccctgttcgttggcaacgaccaggttagcgagatatag

SEQ ID NO: 55107 - DNA, 1728 bp, Artificial Sequence
  Description of Artificial Sequence: Synthetic coding sequence
atgaagaggtctcttcaggcattgtactgccagctattgtcctttctattaatcctggcactgaccgaagctctggccttcgctatccaagagccttctccaagagagtccttacaggtgctaccatccgggaccccccctggcacaatggttactgctcctcactctagtacgaggcatacttcagtggtgatgctgacaccgaatccggacggtccccctagccaggcagctgcacccatggccacaccaacaccaagggccgaaggacatcctccgacccacacaataagtaccattgcggctaccgtgaccgcccctcattcggaaagtagtcttagtaccggtccagcccctgcagccatggccaccaccagttctaaacctgaagggaggccaagaggacaggcagcaccaaccatactgctgactaagccaccaggggctacgtccagacctactacagccccacctcggaccacgacaagaagaccgcctcgcccacctggatcttccaggaagggagcaggaaatagttctaggcccgtacccccagctccaggcggtcatagtaggtccaaggagggtcaaagaggacgtaacccgagctcgacccctctcggccagaaaagaccattagggaaaatttttcaaatatacaagggaaatttcacgggcagcgtcgagccagaaccgagtactctgacccctaggactcccctgtgggggtattccagcagcccccaaccccagaccgtggcagccacaacagtgccaagcaacacatcctgggcccctacaacaacaagcctgggcccagctaaagacaaacccggtctgcgccgagcggctcagggagggggatccacattcaccagccagggagggacgcccgatgcgacagcggctagcggcgctccagtcagcccccaggctgcgccagttccaagccagagacctcaccatggtgatcctcaggatggtccaagccactcagactcatggctgactgtaacaccaggcacatcccgacccttatcaaccagctccggcgttttcaccgccgctaccggcccaaccccagctgcctttgacacttccgttagtgctcccagccaggggatcccccagggcgcttctactactccgcaggctccaacacacccgagccgcgtttcagaatctaccatatccggagcaaaagaggagacagtcgcaaccctaactatgaccgaccgtgtgccatcccccttatctactgtcgtatccaccgctacaggtaacttcctgaaccggctggtgccggcagggacttggaaaccaggaaccgccggtaatatctctcacgtggcagaaggcgacaaaccacagcaccgcgctacaatctgcctctcaaagatggacattgcctgggtgatactagcgatttccgtgcccatctcatcctgctccgtgctcttgactgtttgctgcatgaaaagaaagaagaaaacagcaaaccccgagaataatttgtcttactggaacaacacaatcacgatggactacttcaatcgacacgccgtcgagctgccccgagaaattcagagcttggagacttccgaggaccagctgagcgaacccagatctccagctaacggcgattatcgcgacaccggaatggtgttagttaaccctttttgccaggagaccctcttcgtgggcaatgaccaggtgagcgagatctag

SEQ ID NO: 55108 - DNA, 318 bp, Artificial Sequence
  Description of Artificial Sequence: Synthetic coding sequence
atgaagcggagcctgcaggctctgtattgtcagctcctgaccgtgcttctgaccgtgtgttgtatgaaaagaaaaaaaaagaccgctaaccccgagaataatctcagctactggaataacaccattacaatggactatttcaacagacacgcggtggagctcccgagggagatccagagtctggaaaccagtgaggatcagctgtccgagccccgttcccctgccaacggcgactaccgagatactggcatggtcttagtgaacccattctgtcaagagacactcttcgtcgggaacgaccaggtgtccgaaatctag

SEQ ID NO: 55109 - DNA, 462 bp, Artificial Sequence
  Description of Artificial Sequence: Synthetic coding sequence
atgaagcgcagcttgcaagctttgtattgccaactgctatcattcttactcattcttgccctgacagaagccctggcattcgccattcaagagccgtctcctcgtgaatcgttgcaggtgctgcctagcgggactcccccagggaccatggtgacggcacctcattcctccacccggcacacgagcgtcgtcatgctaacgccaaatccagacgggccaccaagccaggctgcggctccaatggctacacctacaccaagagcagaggggcatccccctacccacaccatctccactattgccgcaacggtgacagccccacatagcgagagctcactaagtacagggcctgctccggcagctatggccactacgtctagtaaacccgaggggcgaccacggggacaagcggcaccaactattctgctgacaaaaccacctggggctacgtcaagaccttag

SEQ ID NO: 55110 - DNA, 219 bp, Artificial Sequence
  Description of Artificial Sequence: Synthetic coding sequence
atgaaacggtccctacaagcgttatattgccagctcttgagctttctgttgatccttgcactcaccgaggcactggccttcgcgatccaggagccatccccccgagagtcgctgcaggtgctgccaagcggtacccctcctggtactatggtgacggcacctcactccagtacccgccacacatccgtcgtaatgctcacccctaatcctgatggttag

SEQ ID NO: 55111 - DNA, 450 bp, Artificial Sequence
  Description of Artificial Sequence: Synthetic coding sequence
atgaagcgcagcctgcaagcgctttactgtcagctgctgagcttccttctaattctcgcactgaccgaagctttggctttcgcgatacaggaaccatctccacgggaaagcctccaggtactgcccagcggtactcctcctgggaccatggttacggctccccacagctcaaccaggcacacatccgtggtgatgcttacgccgaatccagatggcccaccatcgcaggctgccgctcctatggcaacaccgactcccagggcagaggggcaccccccaacacacacaatctccactatagccgcaaccgtgaccgctcctcactccgaaagctctcttagtacaggaccagcccctgcggcaatggccactacatcctctaaacccgagggaagaccacggggtcaggccgcacctacaatcctcctgaccaaaccaccgggtgcatag

SEQ ID NO: 55112 - DNA, 1467 bp, Artificial Sequence
  Description of Artificial Sequence: Synthetic coding sequence
atgaagaggtcactgcaagcactgtactgtcagcttctgtcattcttattgatcctggcactgactgaggccctggcttttgccatccaggagcctagtcctcgcgaatcactccaggtgcttccaagcggcaccccaccaggaacaatggtgactgcaccccacagctccactcggcatacttcagtcgtgatgctgacccctaaccccgacgggcctccctcccaggcagccgcaccaatggcgacacctacacctagagccgaaggtcaccctccaacacacactattagcacaatcgccgcaacagtcacagccccacactccgaatcctctctaagtaccgggcctgctccggcagccatggctaccactagctccaagcccgaagggaggcctcgcggacaagctgcccctaccattctgctgaccaagcctccaggcgcaactagccgcccaaccacggcgccaccccgtaccactacacgtcgacccccaagaccacctgggtcatctcggaagggcgctgggaattctagtaggcccgtgccacctgctcccggtggacactctagatctaaagagggccagagaggccgaaacccaagctcaacaccactgggacagaaaagaccacttgggaagatctttcaaatctacaagggaaacttcaccggatcagtcgagcctgaaccttcaacgctgacaccacgcactccattgtgggggtatagttcctccccgcagccacagacagtggcggcaacaacggtccctagcaacacttcatgggcccctacgacaacttctctgggccctgctaaagataaacctggtctacgaagggctgcgcaaggaggagggtcaaccttcacctctcaaggcggaacaccggacgcaactgcagccagtggtgcccctgtgagccctcaggccgcacctgtgccgtcacagagaccccatcatggtgatccacaggatgggcctagccatagtgatagctggctgacggtgacccccggaacttcacggcctctctctactagctccggagtctttacagcagctacgggcccaacgcctgcagctttcgatacgagtgtgagcgccccttctcagggaatcccccagggcgcaagcacaaccccacaagccccaacacacccctctcgtgtttctgaaagcactatctcaggcgcaaaggaggagactgtggctacgcttaccatgaccgatagggtacctagtcccctgtccaccgtggtctccaccgcaacggggaattttctgaaccggctcgtgcccgctggcacctggaagccgggaactgcaggtaacatttcccacgttgcagagggggacaaaccacaacacagagcaacgatttgtctgtccaagatggacatagcgtgggtgatactcgccattagcgtgcctatctcttcatgcagtgaccctatcacttag

SEQ ID NO: 55113 - DNA, 1515 bp, Artificial Sequence
  Description of Artificial Sequence: Synthetic coding sequence
atgagtctcatttgctctatctccaacgaggtccccgagcatccttgcgtgagcccggtcagcaaccacgtgtacgagcgtcgccttattgaaaaatacatagcagaaaacggaaccgaccctataaacaatcagcctctttcggaggagcaactgatcgacattaaagtggcccatcctatccgaccaaagcccccttccgccacaagtatccccgctattttgaaagctttgcaagatgagtgggacgcagtgatgttacactcttttacactcagacagcagcttcagactacccgccaggagctgtctcatgctctctatcaacatgacgcagcatgtcgggtcattgctcgcttaaccaaggaggtgacggccgctagggaggccctggccactctgaagccccaggccggattgattgtcccacaggctgtaccaagcagccagccttctgtggtcggtgctggagagcctatggacttaggggaactggtaggcatgacaccggagatcattcagaagttgcaggataaagcgacagtcctgaccacagagcgtaagaagcggggaaaaaccgtgcctgaggaattagtgaagcccgaggagctgtctaaatatagacaggtagcatctcacgtgggtctgcattccgctagcatacctggaattctggctctggacttgtgccccagtgatacaaataagatcctgactggcggagccgataaaaacgtagtggtcttcgataagtcttccgaacaaattttggctacactgaaaggccacaccaaaaaagtcacctcagtagtgttccacccatcccaggatctcgttttcagtgcttcacctgacgccaccatccggatttggagtgtccccaacgcctcgtgtgtgcaagtagtgcgcgctcatgagtcggccgttactggattatccctccatgccacaggggactacttgctttcttcctccgacgatcagtactgggcattttctgatattcagacaggcagggtgctgactaaggtgactgacgagacttccgggtgcagcctaacctgcgcacaattccatcccgatggactcatttttggaactggtaccatggacagccagatcaaaatttgggacctgaaggaaaggactaatgtggccaacttccccggtcacagtggaccaattacctcgatagccttctcagaaaacgggtactaccttgccacagcagctgacgactcctcggtaaaactgtgggacctgcgaaaactcaagaatttcaagacactacagctggacaacaactttgaggttaagtcccttatcttcgatcagagcggaacttatcttgccctgggcggtacagatgtgcagatctatatctgcaaacagtggacagagatcctccattttacagaacacagtggcctgacaaccggagtggcatttggccaccacgcgaagtttattgcaagtaccggcatggataggagtctgaaattttactcgctgtag

SEQ ID NO: 55114 - DNA, 705 bp, Artificial Sequence
  Description of Artificial Sequence: Synthetic coding sequence
atggccgctagttccattagtagtccttggggaaaacatgtattcaaagccattttgatggtcttggtggcactgattctgctccattccgccctcgcacaatcccgacgggatttcgctcccccagggcagcagaaacgggaagctccagtcgatgtgctgacccagattggccgatctgtgagagggaccctcgacgcatggatcgggccagagaccatgcatctcgtgtccgaatccagcagccaggtgctttgggccattagctcagcaatctccgtcgccttcttcgcattgtccgggatcgcagcccagctcttgaacgcactgggtctcgccggtgactaccttgctcagggcctgaaattgagcccaggccaggtccagacatttcttttgtggggcgctggcgcactggtggtgtattggctcctctctctattactgggcctggtgctcgctttattgggcagaattctttggggccttaaacttgtgattttcctggccggattcgttgccctcatgagaagcgtgcccgacccctcgaccagggctctactattgttggcactgcttacaccctgccctttcctggcccttagcctgaatctccaaaacattgacccctgtcggtcccccacaagccaagaaaaacagagaaaaactattccgcctgcctgcccctgtggacccgtattttag

SEQ ID NO: 55115 - DNA, 732 bp, Artificial Sequence
  Description of Artificial Sequence: Synthetic coding sequence
atggctgcctccagtatctccagtccatggggcaagcacgtctttaaggccatactcatggtgctggtcgcactgattctcttacactcagctcttgcgcaatctagacgcgattttgcaccacctgggcagcagaaaagagaggccccagtagacgttcttactcagattggacggagtgttaggggcacacttgatgcatggattgggcctgagactatgcacttggtgtccgagagcagctctcaagttctgtgggccatctcaagcgccatctctgtggccttcttcgccctgtctggcatcgccgcacagctgttgaacgccctggggttggcaggcgattatttagcccaagggctgaaactgtcacccggacaggtgcagactttcttgctctggggggcaggggctctcgtggtgtactggctgttaagcctgcttttaggactcgtgttggcgctcctgggtagaatcctttggggtctcaagctagttatatttctagcgggattcgtggctttaatgaggtcagtgccagatcccagtacacgggcactgcttcttctggctctgttgatcctgtacgccctcctcagccgcctaactggaagtcgtgccagcggggcacagctggaggctaaagtcagggggttggagagacaggttgaagagctgagatggaggcagcgccgagctgccaagggggctcgcagcgtggaggaagagtag

SEQ ID NO: 55116 - DNA, 579 bp, Artificial Sequence
  Description of Artificial Sequence: Synthetic coding sequence
atggcagcttggggtaggcgccgactgggcccaggtagctcaggtgggtccgcgagggagagagtcagtctttccgcaacagactgctatatcgtccacgaaatctacaatggagaaaacgctcaggatcagttcgagtacgaactggagcaagctctagaagcgcagtataagtacattgtaatcgaacctacaaggattggagatgaaacagcgagatggatcactgtgggaaactgtctccacaaaaccgctgtcctcgcagggaccgcatgcttattcacacccctcgccctgccacttgattattctcactatatctcgcttcccgctggggtgctgtcattagcatgctgcacactgtacggaattagttggcagttcgatccttgctgtaagtatcaagtggaatacgatgcgtacaaactttctaggcttccgctgcataccttgaccagcagtacacccgtggtccttgtccgcaaggatgatctgcaccgcaagcgccttcataacactatagctctggccgcactcgtgtattgcgtgaagaagatatacgagctatacgctgtctag

SEQ ID NO: 55117 - DNA, 885 bp, Artificial Sequence
  Description of Artificial Sequence: Synthetic coding sequence
atgcaaggtcctgccggaaatgcaagccgcggtctacctggtggcccaccttccaccgtggcatctggggctggccgttgtgaatccggggctctcatgcacagtttcggcatctttctgcaaggtctgttgggtgttgtggccttcagcaccctgatgttgaaacggtttagggagcctaagcacgaaagacgaccctggagaatttggttcctagacacgtctaagcaagctatcggaatgttgtttatccacttcgcaaatgtctacttggccgatcttaccgaggaggacccttgttccttatacttaatcaacttcctgcttgatgctaccgtagggatgctgctgatctacgttggagtccgcgcagtgtctgtgttagtcgaatggcaacagtgggagagtctcaggtttggggagtacggggatcccttgcaatgcggtgcatgggtagggcagtgcgccctgtacatagtcattatgatcttcgagaaaagtgtggtgtttattgtcctgttgatactgcagtggaagaaagtggctctcttgaacccaatcgaaaacccagatctcaaactggcaattgtaatgctgatcgttcccttctttgtgaatgctctcatgttttgggttgtcgacaattttctcatgcgcaaagggaaaacgaaagctaagctagaggaacgcggagccaaccaggactcacggaacggtagtaaggtaagatacaggagggccgcatcccacgaggagtcagagagtgagattctgatctccgccgacgatgagatggaggaatccgacgtcgaggaagatctgcggcgactgacccccctcaaacctgttaagaagaagaagcatcgctttggacttcccgtgtag

SEQ ID NO: 55118 - DNA, 786 bp, Artificial Sequence
  Description of Artificial Sequence: Synthetic coding sequence
atggcagggcctgaacttctgttggacagcaatatccgactctgggtggtcctgccgattgttataattacgttttttgtgggcatgattagacactacgtctccattctgcttcagtccgataagaaattaacgcaagaacaggttagcgactcccaggtgctcatacggagtagggtcctccgggaaaatggcaagtacatcccaaaacagtcgtttttgacccggaaatactatttcaataatcctgaagatgggttcttcaagaaaaccaagagaaaagttgtgcctccatccccgatgacagaccctaccatgctgactgatatgatgaaaggaaacgtgacaaatgtacttccaatgattctaatcggtggatggattaacatgacattcagtggattcgtgactaccaaggtgccgtttcctctcactctccgatttaaaccgatgctgcaacagggaatcgaactactgacgctggacgcctcctgggtctcttctgcttcttggtacttcctcaacgttttcggacttcgatcgatctacagcctgattctggggcaggataacgctgctgatcagtcacgtatgatgcaagaacagatgactggcgctgcgatggccatgccagccgatactaacaaagctttcaagacagaatgggaagccttagaactgacggaccaccagtgggctttagatgatgtggaagaggagctgatggccaaagatcttcactttgaggggatgttcaaaaaggagctgcagaccagcatattctag

SEQ ID NO: 55119 - DNA, 612 bp, Artificial Sequence
  Description of Artificial Sequence: Synthetic coding sequence
atggctgggccagagctcctactggattctaatatcagactgtgggttgtgctgccgattgtgattataacgtttttcgtggggatgatcagacactacgtgagcatactgcttcagtccgataagaaacttacacaagagcaagtgagcgatagaaagtatcttagcggtttggttcagtggctgactcccatcattcccgctttatggggagctgaaatggggggatctctagaaccgaggaatctgcgccctactctggctgcgtgtcaagtcctgatacgctctcgcgtcttacgtgagaatggaaagtacatcccaaagcagagctttctgactcgcaagtactacttcaataaccccgaggacgggttcttcaaaaagactaagcgtaaagttgtaccaccaagtcccatgacagaccctaccatgctgaccgacatgatgaaaggaaatgtcacgaacgtccttcctatgatcttgataggtgggtggattaatatgacgtttagcggcttcgtgacgacaaaagtcccctttccgcttacgcttaggttcaaaccaatgctgcaacagggaatcgagctattgactcttgatgcaagctggtag

SEQ ID NO: 55120 - DNA, 1056 bp, Artificial Sequence
  Description of Artificial Sequence: Synthetic coding sequence
atgcagcgtgccctccctggagcccgacagcacctcggcgctatcttagcctccgctagcgtggtcgtgaaagccctttgtgccgcagtgttgtttctttatcttctgtcattcgccgttgacacagggtgtttagccgtcacaccaggatatttgttcccaccaaacttctggatctggaccctggccacacatggactaatggagcagcacgtctgggatgtggcaatctccttaacaaccgttgtcgtcgctggacggctgctggaacccctttggggtgctctcgaactcctaatcttcttctccgtggtcaatgtttcagtgggccttctgggggctttcgcctatctgctgacgtacatggcctctttcaacctggtttacctgtttactgtcagaatccacggagctctgggcttcctgggtggcgtgctggtggctcttaagcagaccatgggagattgcgtggtgctcagagtaccccaagtcagagtgtccgtgatgcccatgctgctcctggcgctgctcttattgttaaggctggctaccctgttacagtctccagcgttggctagctatggctttggattgctctcatcctgggtttacctaagattctatcagaggcattctcgtggaaggggggacatggctgatcactttgcattcgcaaccttttttcctgaaattctgcagcctgtagtcgggctactggctaatctcgtgcattctcttcttgtgaaagtcaaaatatgccagaagacagttaagcgttatgatgtcggagcccctagtagcatcacgatctccctccccggaaccgatcctcaggatgcggaacggaggagacagctcgccctcaaagctcttaatgagcggcttaagagagtggaggatcagtccatctggccaagtatggacgacgacgaagaggagagtggggcaaaagtcgactctccattgccgtccgataaagctcctactccccctgggaagggagcagccccagaatcctctttaatcaccttcgaagctgccccacctaccctctag

SEQ ID NO: 55121 - DNA, 738 bp, Artificial Sequence
  Description of Artificial Sequence: Synthetic coding sequence
atgaagcacacccaatccgggcaatctacatcacctctcgttatagattatacttgccgcgtctgtcagatggcttttgtgttctcctctctcatcccgctgcttctaatgaccccagttttttgtttgggcaatacatctgagtgcttccagaattttagccagagtcacaaatgtattttaatgcatagcccaccctctgcaatggccgagcttccaccatcggccaatacttctgtatgctccacgctgtacttttatggcattgcaatttttcttggcagcttcgtcctgagtttgttgacaatcatggttctgttaattcgggctcagacgttgtacaaaaaattcgtgaagagcaccggctttctgggcagtgaacagtgggcggttatccacatagtcgaccaacgggtgaggttctatcctgtggcatttttttgttgttggggtcccgctgttatcctgatgattattaagttgaccaaaccacaggacaccaagctccacatggccctatatgtgctgcaggcactgacagctactagccagggcctgctgaactgtggggtgtatggatggacacaacacaagtttcaccaactgaagcaggaagccagaagagacgcagatactcagacacctctactctgcagtcagaaacggttctatagtcggggtctgaactctctagagtccacgcttacatttcctgcctctacttctacaatcttttag

SEQ ID NO: 55122 - DNA, 738 bp, Artificial Sequence
  Description of Artificial Sequence: Synthetic coding sequence
atgaagcatacacagtccgggcagtctacaagccctctggtgattgattatacctgccgggtatgtcagatggccttcgtgtttagttcactgattccactgctacttatgaccccggtgttttgtctaggaaacacgagcgagtgttttcaaaatttttctcagtcacacaaatgcatcctgatgcactctccaccttccgctatggctgaactccctcccagtgccaatacatcagtctgtagcactttatatttctacggcatcgcaatctttttaggatccttcgtgttatcactgctgaccatcatggtcctgctgatcagagcccagaccctgtataaaaagtttgtcaagtcaactggttttctgggatctgaacagtgggccgtcattcacattgtggatcagagggttcggttctaccctgtagcgttcttctgttgctggggccctgccgttatcctcatgattatcaagcttaccaagccccaggatactaaactccacatggccctttatgtgctccaggcattaaccgctacctcccaggggctgctgaattgtggagtctacgggtggacacagcataaatttcatcagttgaagcaggaggccaggcgggatgccgatactcagactcctttgctgtgcagccagaaaaggttctactcacggggactgaactctctggaatctactctgacctttcctgccagtacatcgacaattttttag

SEQ ID NO: 55123 - DNA, 225 bp, Artificial Sequence
  Description of Artificial Sequence: Synthetic coding sequence
atggcaaccctgagtgtgattggctccagtagcttaattgcctatgctgtgttccataatattcagaagtcgccagaaatccggcctcttttttacctaagcttctgcgatttgctccttggactatgttggctgaccgagacccttctctacggcgctagcgtcgctaataaggatataatctgctataacctacaggccgtgggacaggtctcggctacctag

SEQ ID NO: 55124 - DNA, 321 bp, Artificial Sequence
  Description of Artificial Sequence: Synthetic coding sequence
atggcaacactttctgtcatcggttcgtcatccttgattgcttatgccgtcttccacaacattcagaaatcgccagagatccggcctctcttctatttgagtttctgcgacctgttgctgggtctgtgctggctcaccgaaactctgctctatggagccagcgttgccaataaggatatcatctgctacaatcttcaggcagttgggcagattttctacatttcatcattcctctacacagtcaattacatttggtacctgtacaccgagttaagaatgaagcacacccagagcggacaatctacttcaccgcttgtgtag

SEQ ID NO: 55125 - DNA, 528 bp, Artificial Sequence
  Description of Artificial Sequence: Synthetic coding sequence
atggcgactctgtcggtgatcggatcaagctccctcattgcttacgcagtattccacaatatccagaaaagccccgaaataaggccattattctacctgagtttttgtgacctccttctcggcctctgctggctgaccgagacactgctgtacggcgcatcagttgctaacaaggatatcatttgctacaacctgcaggccgtggggcaaattttctacatctctagttttctgtataccgtgaattacatctggtatttgtacacggaactgcgtatgaaacatacacagtccggacaaagcaccagtcctctagtgatcgattacacctgtcgcgtctgccagatggccttcgtgttcagttctttgattcctctgctcctgatgacacctgtgttctgtctggggaatacaagtgaatgttttcagaactttagtcagtcacataagtgtatattgatgcatagtcctccctctgctatggcggagctgccccctagtgctaataccagcgtgtgctcgacttag

SEQ ID NO: 55126 - DNA, 156 bp, Artificial Sequence
  Description of Artificial Sequence: Synthetic coding sequence
atggctaccctgtccgtgattggttccagctctcttatcgcttacgccgtgttccataatatccagaagagtcccgagatcaggcccctcttttatctgtctttttgcgatttactgttagggctttgctggctgaccgaaactctcctttactag

SEQ ID NO: 55127 - DNA, 738 bp, Artificial Sequence
  Description of Artificial Sequence: Synthetic coding sequence
atgaaacatactcagagtggccagtcaacctcccccctcgtgatcgattatacttgccgcgtctgccagatggcctttgtgttttccagcctgatccctctactccttatgacccctgtattctgcttagggaacacctccgagtgttttcagaacttttcccagagtcataaatgtattctgatgcacagccccccatcagccatggccgagctaccacccagcgccaacacttctgtctgctctacactttatttttacggcatcgctatcttcttgggctctttcgtgttgtccctgctgaccatcatggtactgcttattcgggctcagaccctgtacaagaaattcgtgaagtcgaccgggtttcttggcagcgaacagtgggcagttatccacatcgtggaccagcgagttcggttctaccccgtggcctttttctgctgttggggccctgccgtaatcctcatgataattaaacttaccaagccccaggacacaaagctgcatatggccctgtatgtgctccaagcccttactgcaacgagtcagggccttctgaattgcggtgtgtacggctggacccagcacaaatttcaccagctcaaacaggaagcgagacgcgacgcggacactcagacccccttgctgtgtagccagaaaagattctattccaggggactgaattctctggaatccactctcacttttccagcctcaactagcaccattttttag

SEQ ID NO: 55128 - DNA, 1014 bp, Artificial Sequence
  Description of Artificial Sequence: Synthetic coding sequence
atggccacactgtcagtcatcgggtctagcagtcttatcgcctatgccgtgttccataatattcagaagagccccgaaatcagacctctgttttacttgtccttttgtgacttgttactggggctttgttggttgaccgaaactcttctttatggggctagtgtcgccaataaagacataatttgctataatttgcaggccgtcgggcagatcttctacatatcatccttcctgtacactgttaattatatctggtatctttacactgagctgcggatgaaacatactcagtctggtcaatctactagcccgcttgttatcgattatacgtgccgggtgtgccagatggcctttgtgtttagttccctcatccccttgctattgatgacccctgtgttctgcttgggtaacacgtccgagtgttttcagaatttttcccagtcccataagtgtatattaatgcactctcccccttcagcgatggctgagttaccaccatccgcaaacacgtccgtttgctctacgttgtatttttacggcattgccatttttcttggatcttttgtgctttcgctgctcaccatcatggtgctgctcattagagcacagacgttgtataagaaatttgtaaaaagtaccggctttttgggatccgaacagtgggccgtgatacacatcgtggaccaacgcgtgcgtttttaccccgttgccttcttttgctgctggggacccgcagtcattctgatgatcatcaagctgactaagccgcaggacacaaaattgcacatggcactgtatgtgctccaggcattgactgccaccagccagggacttcttaattgcggggtttacggctggacccagcataaatttcatcagctgaagcaggaagcaaggagggacgctgatactcagacccccttactttgttctcagaaaaggttctactctcgcggattgaacagcctggagagcactttaactttcccagccagtaccagcaccatcttctag

SEQ ID NO: 55129 - DNA, 909 bp, Artificial Sequence
  Description of Artificial Sequence: Synthetic coding sequence
atggctacgctgagtgtgattggaagtagcagcttgattgcttatgccgtttttcataacattcagaagtctcctgaaattcgcccacttttctacctgagcttctgtgacctgctgctcggcctgtgctggctgaccgagactctcttatatggcgcatccgtggctaataaagacattatttgctataaccttcaggctgtgggccaagtgattgactatacttgtagagtgtgtcagatggcgttcgtgtttagctccctcattcccctcctccttatgaccccagtgttctgtctcggaaacacatctgagtgcttccaaaatttttcccaaagtcacaaatgcattcttatgcatagcccgccatcagctatggccgaactgccaccttccgctaacacatccgtttgttcgaccctctacttctatggcatcgctatatttctgggttccttcgtgctgtcactactgaccattatggtcctccttatacgcgctcagactctctacaaaaagttcgtgaagtctactggttttctgggctccgagcagtgggctgtgatacacatagttgatcagcgtgtccgcttttatccggtggcattcttttgttgctggggacctgctgtgattcttatgatcattaagctgacaaaaccccaggatacaaaactccatatggcattgtacgttctgcaggcactgactgccacctcccaggggctcttgaactgtggcgtgtacggctggacccagcacaagtttcaccaactaaaacaagaggccaggagggacgcagacactcagacacccctgctttgttcccagaagagattctactccagaggactgaattccttggagagcacgctaacttttcccgcatcgacctcaaccattttttag

SEQ ID NO: 55130 - DNA, 1545 bp, Artificial Sequence
  Description of Artificial Sequence: Synthetic coding sequence
atgggtaaggactttaggtactattttcagcacccctggagtaggatgatcgttgcgtatttggttatctttttcaactttctcatatttgctgaagatccagtctcccattctcagaccgaggctaacgtgattgtggtcggtaactgtttttcttttgtcactaataagtaccccaggggagtgggctggcgtatcctgaaggtactgctgtggctgctggccattctcacaggcctcatcgcaggcaagtttttattccatcagagattgttcggtcagctgttacgcctcaagatgttccgggaggaccatggttcctggatgaccatgtttttctcgaccatcctcttcctgttcatcttcagccatatctacaacacaatcctgttgatggacggaaacatgggcgcttatatcatcaccgattacatgggtattcgaaacgagagctttatgaagctggcggctgtcgggacttggatgggcgacttcgtcacggcctggatggtaacggacatgatgctgcaggataagccttatcctgactggggaaagtctgcccgtgccttctggaaaaaagggaatgtgagaatcacgctcttctggaccgtgctatttacgctgacatcagtggtggttctggtgatcactacggattggatctcctgggacaaactgaaccgcggattcttgccctccgatgaggtcagcagagccttcctggcctcattcatcctcgtgttcgatctgcttatagttatgcaggactgggagtttccccatttcatgggtgatgtcgatgtgaacctccctggtctccacactccgcacatgcagttcaagattcccttcttccagaaaattttcaaggaggagtatcgaatccacattacaggcaagtggttcaattacgggattatctttcttgttttaatcctggatctgaatatgtggaagaatcagatattctataaaccacatgaatatgggcagtatattggacccggacagaaaatctacaccgtgaaagacagcgaaagtctcaaggatctcaatcggactaagttgtcttgggaatggcggtccaatcacacaaatccacgcacaaataagacatatgtcgagggagacatgtttctacattccagattcattggggcttccttggatgtgaaatgtctggctttcgtgccttctctgattgcgttcgtgtggtttgggtttttcatctggttcttcggaaggtttttaaaaaatgagcctaggatggagaatcaggataaaacctacactcgtatgaaacggaagtctcccagcgagcattctaaagacatgggtattacgcgggagaacactcaagcctcggtagaagatccacttaatgatcccagcttagtgtgtataagatccgacttcaatgaaattgtatataagtcaagtcatttgacgtctgagaacctctccagtcagctaaatgaatctacgtcagccacagaagccgaccaagacccaaccacatccaaatccacgcctaccaactag

SEQ ID NO: 55131 - DNA, 789 bp, Artificial Sequence
  Description of Artificial Sequence: Synthetic coding sequence
atgtatattaaggattgggagttcccacattttatgggtgatgttgacgtaaacctcccagggctccacacccctcatatgcagtttaaaatccctttctttcaaaaaatctttaaagaagaatatcgaatccacattacagggaaatggttcaattatggcataattttcctggtcctaatcctggatctaaatatgtggaaaaaccaaatcttttacaaaccccacgagtacggccaatatattggtccgggacaaaagatctacaccgtgaaagattcagaatctctgaaagacctgaatagaaccaaactctcctgggagtggaggagcaatcatacaaaccccagaactaataagacttatgtggagggagacatgttcctgcacagccgctttataggagccagcctggatgtaaaatgcttggcgttcgtgccatctctcatcgccttcgtgtggttcggtttcttcatttggttttttgggagatttcttaaaaacgaacccaggatggagaatcaggataaaacgtacacacggatgaagcgaaagagcccaagcgaacactctaaagacatgggcattacgagggaaaatacgcaggccagtgtggaagatccgctcaatgatccttctctggtctgcattcgcagcgatttcaatgaaatcgtgtacaagagcagtcatttgaccagtgaaaacctgtcttctcagttgaatgaatctactagcgctaccgaagcagatcaggaccctactacttccaagtccactcctactaattag

SEQ ID NO: 55132 - DNA, 1233 bp, Artificial Sequence
  Description of Artificial Sequence: Synthetic coding sequence
atggctacctgccattcacataggaccaacagctggcagatctccgttccgagtgcctttgtgtggtccgtagccccaattaaaaacgtgtcaaggcgatcttgggtcgtggacgataacgtgttgcagcataacagcctgagtcttcacatattctcacacatacaacacgactcatctaatgggtgggaacacggcgtgacagatatgatgttgcaggataagccctaccccgattgggggaagtccgctcgagcattttggaagaagggtaatgtgagaatcacactgttttggacggtcctctttaccctcacctcggtggtggtgttggtgatcaccaccgactggatatcctgggataagttaaatcggggattcctgccaagcgatgaggtcagtagggcctttctggcctcgttcatcttggttttcgacctactgatcgttatgcaggactgggagttcccacacttcatgggagacgtggacgtaaacctgcccggtctgcataccccgcatatgcagttcaaaatccccttcttccagaagatcttcaaggaagagtaccgtattcacatcaccggaaaatggtttaactacggaattatcttcttagttctgattctcgacttaaatatgtggaagaaccaaatattctataagccacatgagtatgggcagtacatcggaccgggacaaaagatttataccgtgaaagacagcgagtccctgaaggacttaaacaggacgaagctcagttgggaatggagaagcaatcatacaaatcccagaaccaataagacctatgtcgagggagatatgttccttcactccaggttcatcggcgctagcctggatgtgaagtgcttggcttttgtgccaagcctgattgcatttgtgtggtttggcttctttatatggttcttcggacgctttctgaaaaacgagcctcgtatggagaaccaggacaaaacatacactcgaatgaagaggaagagtccttcggaacactctaaggacatggggattaccagagaaaacactcaagccagcgtggaagatccgctgaacgatccttccttggtgtgcattagaagcgactttaacgagattgtgtacaagagctctcatctgacatcagaaaacttgtcctctcagcttaatgaaagtacatccgctaccgaagccgatcaggatcctacgaccagcaaatccacccctaccaattag

SEQ ID NO: 55133 - DNA, 852 bp, Artificial Sequence
  Description of Artificial Sequence: Synthetic coding sequence
atggtcagcgccgctgccccatcccttctaatcctgctgctgcttcttctgggaagcgtgccggctactgatgctaggtcagtgcccttgaaagccactttcctggaagacgtcgccggttccggagaggccgagggatcatccgcatcctccccatccctcccccctccttggacccccgcattgtcaccaacttcaatgggacctcagccaatcactctcggaggaccgagtcctcccactaattttctcgatggtatcgtggatttcttccgccagtacgtcatgctgatagctgtggtgggaagtcttgccttcctgctaatgtttatcgtatgcgccgcagtgattacccgacagaagcagaaggccagcgcttattaccccagtagtttccccaagaagaagtacgtcgaccagagcgacagagctggtggacctagagccttctccgaggtcccagaccgcgcacccgactcaagacccgaagaagcccttgacagttcccgtcagttgcaggcagacattctcgccgctacccaaaacctgaaatcaccaacacgagcagccttaggtggaggggacggcgctcggatggttgaagggagaggtgccgaagaggaagagaaagggagccaggagggtgaccaggaagtgcagggccacggggttccagtcgagacacctgaagcgcaggaagagccttgttcaggggtcctcgagggtgccgtggtggctggagaaggccagggagaactggagggttccctgctcctggcacaggaagcccaaggacccgttggcccaccggaaagtccatgcgcatgttcctccgtgcacccatcagtctag

SEQ ID NO: 55134 - DNA, 654 bp, Artificial Sequence
  Description of Artificial Sequence: Synthetic coding sequence
atgggtccacagccaattaccttgggaggccctagtcctcccaccaatttcctggatggcattgtagacttttttagacagtatgttatgctcattgctgtcgttggttctctggccttcctgctgatgttcatcgtctgcgcagctgtgattaccagacagaagcagaaagccagtgcctactatccgtcgagcttcccaaagaaaaagtatgtggaccaatctgaccgggctggtggacccagagccttttcagaagtgcccgacagggcaccagactctaggccagaggaggctctggattcgtctcggcaacttcaggctgatatcctcgctgctacccagaaccttaaatctccaaccagggccgcattgggcggaggcgacggtgcacgcatggttgaggggagaggagctgaggaggaagaaaagggtagtcaggaaggggaccaggaggtccagggtcacggcgtccctgtagaaaccccagaggcacaggaggagccctgcagtggtgtgctggaaggcgcagttgttgcaggtgagggtcagggcgaactggagggttcattgctattggcccaggaggcacagggccctgttggtcctccagaaagtccatgcgcttgttcctctgtgcacccatccgtctag

SEQ ID NO: 55135 - DNA, 87 bp, Artificial Sequence
  Description of Artificial Sequence: Synthetic coding sequence
atggtgagcgccgcagcaccatccctgctgatcctactgttacttcttctcggcagtgtgcccgcaacagacgccagatccgtgtag

SEQ ID NO: 55136 - DNA, 423 bp, Artificial Sequence
  Description of Artificial Sequence: Synthetic coding sequence
atggtgtccgccgcagcaccatcccttctaattctgttactcttactgctgggttctgtccccgctaccgacgcacgatctgtcccactgaaggctacttttctggaagatgtggccggatctggggaagccgaggggtccagcgctagtagcccttccttgcccccaccctggacaccagccctctcaccaacgagcatgggaccccagcctatcactctggggggaccatctcctccaaccaattttctggacgggattgtggatttttttagacagtacgtgatgcttattgctgtcgtgggttctctggcattcctgctcatgttcattgtctgcgccgcagtaattacacgccagaagcagaaggcaagtgcgtattaccctagctctttccccaagaagaagtatgtggaccaatag

SEQ ID NO: 55137 - DNA, 135 bp, Artificial Sequence
  Description of Artificial Sequence: Synthetic coding sequence
atggtttccgccgcagctcccagcctccttatccttctgctcctgttgctaggcagcgtgcctgctacagatgcgcgtagcgtgccccttaaagctacatttttggaagatgttgcaggtagcggtgaggcatag

SEQ ID NO: 55138 - DNA, 1020 bp, Artificial Sequence
  Description of Artificial Sequence: Synthetic coding sequence
atgtctggtcagttggagaggtgcgaaagagaatggcacgaacttgagggggagtttcaggaactgcaggaaacccaccggatctacaaacagaagctcgaagagttggcagcattgcaaactttgtgctcgagttccatttcaaagcagaaaaagcacctgaaagacttaaagctgaccttgcagaggtgtaagaggcatgcatccagggaggaggccgagctggtgcagcagatggctgctaatataaaagaacggcaggacgtgtttttcgatatggaggcctacctcccaaaaaagaacggcctgtatctgaacctggttcttggcaacgtcaacgtcactttactgagtaatcaggccaagtttgcctacaaagatgagtatgaaaagtttaagctgtatctaaccattattttactcctgggggctgtggcgtgccgcttcgtccttcactaccgggttaccgacgaggtcttcaattttctccttgtctggtactactgcaccctaacaattcgggaatcaatcctgattagtaacggctctcggatcaaggggtggtgggtgtcacaccactacgtgtctactttcctctccggagttatgctcacatggccgaacggcccaatataccagaagtttcgaaatcagtttctggccttcagcatttttcaatcatgtgtgcaattcctacagtattattaccagcggggatgcctgtaccgccttagagctctgggagagcggaatcacctagacctcacggtcgaaggcttccaaagttggatgtggagagggctcacttttcttctgccattccttttctgtggtcacttctggcaactttacaacgccgtcaccctctttgaattgagctcccacgaagaatgccgagagtggcaagtattcgtactggcctttacattcctcatactatttctaggcaacttcttgacgacactgaaggttgtgcatgccaagttacagaagaataggggaaagaccaagcagccctag

SEQ ID NO: 55139 - DNA, 1020 bp, Artificial Sequence
  Description of Artificial Sequence: Synthetic coding sequence
atgagtggccaactcgaaaggtgcgagagagagtggcatgagctggagggcgagttccaggaacttcaggagacccacagaatttataagcagaaattggaagagcttgcagctctccaaaccctctgttcgtccagcatttctaagcagaagaagcacctgaaggatttgaagctcaccctccagcggtgcaagcgacatgcgtcccgggaagaagccgaactggtgcagcagatggcagcgaacattaaggagaggcaggatgtgttttttgacatggaagcttacctccctaagaagaatggactctacctgaacctcgtgcttggaaacgtgaacgttaccctgctgagtaatcaagcaaaattcgcttacaaagatgagtacgagaagtttaagctgtatttaactattatccttttgctcggagctgtggcctgcaggttcgtgttacattatagggtgaccgatgaagtgttcaacttcttactggtgtggtattactgtacgcttaccataagggaaagcattttgatctccaatggcagccggataaagggatggtgggtttcacaccattatgtgagtacattcctttcgggcgtaatgctcacctggcccaacggtccaatttatcagaagtttcgcaaccagttcctcgcattctctatctttcagtcttgtgtacaatttctccagtattactaccaacggggttgtctttaccggctccgagccctcggggagagaaaccatctggatcttacagttgaaggctttcaatcctggatgtggcggggattaactttcctcctcccatttctgttttgtgggcacttctggcagctgtacaacgccgtgacccttttcgaattgagcagccacgaagagtgcagagaatggcaggtgttcgtcctcgcctttacttttctgattctgttcctggggaatttcctcacaacacttaaggtagtccatgccaagctccaaaagaatagaggcaagacgaagcagccttag

SEQ ID NO: 55140 - DNA, 960 bp, Artificial Sequence
  Description of Artificial Sequence: Synthetic coding sequence
atggtactgccaccgccagaccgtaggcacgtgtgcttgaccacactggtgattatgggctctatggcggtaatggacgcctatttagtcgaacagaaccagggcccacgcaaaataggcgtttgtataatcgtactggtgggcgacgtgtgctttttgctggtcctgcggtatgtcgctgtatgggtgggggcagaggtcagaaccgcaaagcgcggttatgcaatgatcctgtggttcctttatatttttgtgctggagattaagctatactttatcttccaaaactataaggcagccagacggggagcggcagatcctgtcgccaggaaagcactgacgctgctgctcagtgtgtgcgtgccgggactcttcctgcttctggttgcccttgatcggatggaatatgttcgcaccttcaggaaaagagaggacctgcggggaagacttttttgggttgccttagacctactggacttgctggatatgcaagcaagcctgtgggagcccccacgtagcgggctgcctctgtgggccgaggggctcacctttttttattgttacatgttgctcttggtcctgccctgcgtcgcactctctgaggtgtccatgcagggggagcatatcgccccacagaaaatgatgctgtatccagtgttgagcctcgcaaccgttaacgtggtggccgtcctagctcgtgccgcaaatatggcactgtttcgcgacagccgtgtgtctgcgatctttgtcggcaagaatgtggtggcactggctaccaaggcatgtacctttttagagtaccgccgtcaggtgagagatttcccccctccagctctgtcgctcgaactgcagccaccacctccccagagaaattctgtcccaccaccaccgccacccctccacgggccacccggaagaccgcacatgtcgtctccaacaagagacccgttagacacatag

SEQ ID NO: 55141 - DNA, 960 bp, Artificial Sequence
  Description of Artificial Sequence: Synthetic coding sequence
atggtcctgccacccccagatcggagacatgtgtgtctaacaaccctcgtcatcatggggtcgatggccgtgatggatgcctatctggtggaacaaaatcaggggccaagaaagatcggcgtctgcatcattgtgcttgttggcgacgtgtgcttcttactggtgctgcgctacgttgcagtgtgggtgggagcggaggtacgaaccgcaaagcgcggttatgccatgatcctctggttcctctatatcttcgtgctggagattaagctgtatttcatttttcagaattacaaggcggcacgtcggggtgctgcagaccccgtggctcgtaaagcgctgaccttactgctgtccgtttgtgtccccggtttattccttttgttagtggccctcgaccgaatggaatacgttcgcacttttaggaagcgcgaggacttacgcggacggctgttctgggtggccctggacctattagacctgcttgacatgcaggctagtctttgggagcccccacgcagtgggctccctctatgggctgaaggacttacatttttctattgctacatgctgttattagtgctaccttgcgtcgccctgagtgaggtaagcatgcagggcgagcacatcgcccctcagaaaatgatgctgtatccagtactctctctcgctacagtaaacgtcgtcgccgtgctggcccgtgccgctaatatggcgcttttcagggacagcagggtgtctgcgattttcgttggcaaaaatgtggtggcattggccactaaggcttgcacatttctggagtataggcgccaggtgagggactttccaccgcctgccctctcactcgaactgcaaccacctcctccacagagaaactcagtcccacctccaccaccacctctccacggtccccctggacggcctcacatgagtagcccaacccgagacccacttgacacctag

SEQ ID NO: 55142 - DNA, 660 bp, Artificial Sequence
  Description of Artificial Sequence: Synthetic coding sequence
atgtctgagcaagaggcccaggcaccaggtgggaggggcctcccacccgacatgttggctgagcaggtggaactttggtggagtcagcagcctaggcgcagtgcactttgctttgtggttgccgttgggctcgtcgccggatgtggggctggcggagttgcactgctgagcactacgtctagccgatcaggcgaatggaggttagctactgggactgtgctgtgtctgctggcgctgctggttttagttaagcagctgatgagctccgcagtccaagacatgaattgtatccgccaagctcaccatgtggcattgctcaggtctggcggaggggctgatgctctggtcgtgctgctgagcggcctggttctcctcgtgaccggcctgacactagcaggtcttgctgccgcacctgcaccagctcgccctctggccgcaatgctgagcgtgggaattgctctggccgctttgggctcactgctactcctcggacttctgctgtatcaggtgggcgtgtccgggcattgcccgtcaatttgcatggcgacacccagtacacacagtggtcatgggggtcacggcagtatcttcagcatatccggacagctgagtgcgggtaggcggcacgagacaacctcctctatcgcttccctgatctag

SEQ ID NO: 55143 - DNA, 660 bp, Artificial Sequence
  Description of Artificial Sequence: Synthetic coding sequence
atgagcgagcaagaggcccaggcgccaggcggtcggggactgccacctgatatgctggccgagcaggtggaattgtggtggagtcaacaacctcgtcggagtgcactttgctttgttgtcgccgtggggctcgtggccggttgcggcgctggcggagtggcgctcctcagtacgacctcttcaaggagtggggaatggagactagccacaggaacggtgttatgcttactcgccctgctggtcctggtaaaacagctgatgtcgagtgccgtgcaagacatgaactgcattaggcaggcccatcatgtcgcgcttctccgttccggtgggggagccgacgcactggtcgttttgctaagcggcctggtccttctggtgactggactaacactagcaggactggcagcagctcctgcccctgccaggccactggccgctatgctgagcgtggggatcgcacttgccgcactgggttcgcttctgctcctcggtcttctgctgtatcaggtaggcgtgtccggccactgcccgagtatttgtatggcaactccaagcactcacagcggacatgggggacacggaagcatcttcagcatcagcggtcagctctccgccggaagaagacacgaaacgaccagtagcatcgcttccctaatttag

SEQ ID NO: 55144 - DNA, 51 bp, Artificial Sequence
  Description of Artificial Sequence: Synthetic coding sequence
atgagtgagcaagaagcacaagctcccggagggaggggccttccaccctag

SEQ ID NO: 55145 - DNA, 693 bp, Artificial Sequence
  Description of Artificial Sequence: Synthetic coding sequence
atggtggtgttcggctacgaagcgggaaccaagccaagggattccggggtcgttccagtaggaacagaagaagcccctaaggtgtttaagatggctgcaagcatgcacggacaaccctccccaagcctggaagatgcgaagttacggagaccgatggtaatcgaaattatcgaaaaaaactttgattatctgcgcaaagagatgacgcaaaacatctaccagatggccactttcggaactactgccggatttagcggcatattttctaattttttattccgtagatgttttaaggtcaaacacgacgctctgaagacttacgcgtctctcgccacgctgccatttctttctaccgtcgtgacggacaagctgttcgtaatcgacgctctctatagcgacaatatctccaaagagaattgcgtctttagatcctcgctaatcgggatcgtgtgcggcgtattttatccttcctcccttgccttcacgaagaacggccgactcgcaaccaaataccacactgtgccgctgccccctaagggcagggttctgattcattggatgactctgtgccagactcagatgaagctgatggccattccccttgtgtttcagattatgttcgggattctcaacggcctctaccactatgccgtcttcgaggagacattggaaaaaacaattcatgaggaatag

SEQ ID NO: 55146 - DNA, 603 bp, Artificial Sequence
  Description of Artificial Sequence: Synthetic coding sequence
atggccgcaagcatgcatggacaacccagtccctctcttgaggacgccaaattgcgcaggcccatggtcatcgagatcatagaaaagaacttcgactacctacgtaaagagatgacgcagaacatttaccagatggccaccttcggtaccaccgccggtttctctggcatttttagtaacttcctttttcgccgatgctttaaagtcaaacacgatgctttgaaaacatatgcctctctagcgaccctgcctttcctgtccactgtggtgaccgacaagcttttcgtcatcgatgccctgtactccgacaatatctcaaaggagaattgtgttttccggtctagtttgattgggatcgtttgtggcgtgttctatccttctagtctggcattcacaaagaatgggaggctggctaccaagtaccacaccgtgccgctaccccctaagggcagggtcctgattcactggatgactctgtgccagacccaaatgaaactcatggccatcccactggtgttccagatcatgttcggcatcctgaacggactttatcactacgcggtgtttgaggagacactggaaaaaacaattcatgaggagtag

SEQ ID NO: 55147 - DNA, 513 bp, Artificial Sequence
  Description of Artificial Sequence: Synthetic coding sequence
atggtggtgttcggctacgaggcgggaaccaaacccagggattccggggttgtgcctgtgggaaccgaagaagcacccaaagtttttaagatggccgcttctatgcacggtcagccgtcccccagtctcgaggatgctaaacttcgcagacctatggtgatcgaaataatcgagaagaatttcgattacctccgaaaggagatgacccaaaatatctaccagatggctacgtttggcactacggccggttttagcggcatattttctaacttcctgtttcgaaggtgttttaaggttaaacacgacgcccttaaaacgtacgccagtctagcaactctgccctttctgagcacagtagtgactgataagctttttgttatcgacgctctctactccgataacatctctaaagagaattgtgttttcagatcttcattaataggcatcgtgtgcggtgtgttctacccctcgagccttgcctttaccaaaaacgggaggctggcgacaaaatag

SEQ ID NO: 55148 - DNA, 177 bp, Artificial Sequence
  Description of Artificial Sequence: Synthetic coding sequence
atggtcgtgtttggttatgaggccggaactaaaccgagagactccggcgtggtgccagtggggacagaggaagccccaaaggatacgaagtacatatccaatggcgatatctggaacaatagctggtttctgtggaatatcctgaagttgcctgtgcagacactgctgcaagggtag

SEQ ID NO: 55149 - DNA, 426 bp, Artificial Sequence
  Description of Artificial Sequence: Synthetic coding sequence
atgcctccattcgggtataagaccgagacatctacagctgttgagaagaaggagaaacccttacccaggctgaatattcactccgggttttggatccttgccagtatagtggtgacatactacgtcgacttctttaagacccttaaggaaaacttccacacatctagttggttcttatgtggttctgctctgctgttggtgagtctgagtatcgccttctattgcatcgtgtatctagaatggtactgtggaatcggtgagtatgatgtgaagtaccctgcattgatcccaatcacaactgcaagttttattgctgccggaatttgcttcaatatcgcactatggcatgtgtggtcatttttcacacccctgttactgtttacccaatttatgggcgtggtgatgtttataacactgcttgggtag

SEQ ID NO: 55150 - DNA, 498 bp, Artificial Sequence
  Description of Artificial Sequence: Synthetic coding sequence
atggacagctcgcgggcaaggcagcagctccgcaggcgattcttgcttctgcccgatgcggaggctcagctggatcgtgagggcgacgccggacctgaaaccagtaccgctgtcgaaaaaaaggagaaacctctacctcggcttaatatccattcaggattctggattctggcttctatagtggtaacctactatgtggacttcttcaaaaccctcaaagagaatttccacacgtcctcttggtttctgtgtggtagcgccctgttgctggtctccctctcaatcgctttctattgcatcgtctatctggagtggtactgtggaattggggagtatgatgtgaaatacccagcgctgatacctatcacaactgccagctttatcgccgcaggcatctgttttaacattgccctgtggcatgtatggtctttttttactcccttattgctattcacacagttcatgggagttgtgatgtttatcaccctcctggggtag

SEQ ID NO: 55151 - DNA, 399 bp, Artificial Sequence
  Description of Artificial Sequence: Synthetic coding sequence
atggattcctcccgcgcacggcaacagctgagacgtcgctttctgctcctcccagacgcagaagcacaactggatcgagagggggatgccggtcccgaaacatcaaccgctgtggaaaaaaaagaaaaacctctcccaaggctgaacatacacagtgggttctggatcctcgcttccattgttgtcacatattacgttgacttcttcaagactctaaaagagaattttcataccagtagctggttcctgtgcggctctgcattactccttgtgtccctgtctatagccttttattgcatcgtatatctcgaatggtactgcggaatcggcgaatacgatgtgaaatatccagccctgattccgatcacgactgcttccttcatcgccgctggcatttag

SEQ ID NO: 55152 - DNA, 498 bp, Artificial Sequence
  Description of Artificial Sequence: Synthetic coding sequence
atggatagttctcgggctcgtcagcagctccgcaggaggttcctccttctgccggacgccgaagctcagttagacagggaaggcgatgccggacccgaaacctccaccgctgtggagaagaaagagaaaccactaccacgtctcaacattcactctggcttctggatcctcgcatccatagttgtgacatactacgttgatttttttaagacactgaaagagaacttccatacaagttcgtggtttctgtgtgggtcagctctcctcctggtctcactgtccatcgcattttactgtattgtctatctggagtggtattgcggtatcggggaatatgacgtcaaatacccggcactcattcccattacaaccgcatcctttatcgccgcaggtatctgttttaatattgctctgtggcacgtgtggtctttcttcaccccacttctcctcttcacccagtttatgggtgtagtgatgtttatcacactgcttgggtag

SEQ ID NO: 55153 - DNA, 1089 bp, Artificial Sequence
  Description of Artificial Sequence: Synthetic coding sequence
atggattcaccagaggtgacatttaccctggcttacctcgttttcgccgtatgctttgtgtttacgccaaacgagttccatgccgctggcctgacggtgcagaatctcctctctggctggttaggaagtgaggatgccgctttcgtgccctttcatttgcggagaaccgcagctacacttctgtgtcactccctgctccccctgggctattatgtaggcatgtgcctggccgctagtgagaagcgacttcacgcactgtcgcaggctcctgaagcatggcggctattccttctgctcgcagtcacgttaccttcaatcgcgtgcatactgatttattactggagccgagataggtgggcatgccaccctttggccagaacgctcgcactctacgctttgccacagtcaggctggcaggccgtggcctcctccgtcaatacagagttcaggagaatcgacaagttcgcaaccggtgcacctggagctagggtcatcgttaccgacacctgggttatgaaagtaacaacctatcgtgttcatgttgctcagcagcaggatgtgcatctgaccgttactgagagcaggcagcacgaattgtcacccgattctaatctgcctgtgcagctgttaaccatccgcgtggcctccacgaatcccgctgtgcaggccttcgacatttggctgaattccacagagtatggagagctgtgcgaaaagctgagagcccctatccgccgagccgctcatgtggtgatccaccagtctctgggggatctatttttggaaacattcgcttctctcgtggaagtgaaccctgcctacagtgtcccatcaagtcaagagctggaagcgtgcattggttgcatgcaaacccgcgctagcgtgaagctggtaaagacctgccaggaagctgcaacgggggagtgccaacagtgctattgtagaccgatgtggtgccttacgtgtatgggcaagtggtttgcttccaggcaagatccccttcgcccagacacctggcttgcatcacgagtcccatgtccaacttgtcgagcaagattctgtattttggacgtctgtactgtgcgctag

SEQ ID NO: 55154 - DNA, 1089 bp, Artificial Sequence
  Description of Artificial Sequence: Synthetic coding sequence
atggactccccggaggtgacttttacgttggcctatctcgtattcgcagtttgtttcgtgttcactccaaatgaattccatgccgctggccttaccgtacagaatctgctatccggctggctcggttcagaagacgcagcctttgtgcccttccatctgcgcaggaccgccgcaactctcctttgccattccctccttccattaggatactatgttggcatgtgtctggccgcatccgaaaaacgcctgcatgccctgtcacaggcccctgaagcatggcgactgtttctgcttctggcagtcactttgccatctattgcatgcatactgatttattactggagtagagaccgttgggcttgtcacccactggcgcgaactctggccctgtacgccctacctcaaagcgggtggcaggcagtggcatccagcgtgaacaccgaattccgcagaatagacaagtttgccaccggtgcccctggcgcacgagtcatcgttacagatacttgggtaatgaaagttacaacctatagagtacatgtggcccagcagcaggatgtgcacctgaccgtcacagagagcagacagcatgaattatcacccgattccaacttacccgtccagttacttacgattagggtcgcaagcactaaccccgctgtgcaggcatttgatatctggctgaattcaactgagtatggtgaactgtgcgagaagctccgggctcctattaggagagctgcgcacgtggttatacaccaatctctgggggacctctttctggagacctttgcctcactcgtggaggttaatccagcttactctgtgccttcatcacaggagctggaagcctgcatcggatgcatgcagacccgggcttcagtgaagttggtcaagacttgccaggaggctgcaaccggtgagtgtcaacagtgctattgtaggcccatgtggtgcctgacttgtatgggcaaatggtttgcatcccggcaagatccactgaggccggacacctggttagcgtccagggttccctgtccgacatgtagagcgagattctgtattctcgatgtctgtacggttcggtag

SEQ ID NO: 55155 - DNA, 699 bp, Artificial Sequence
  Description of Artificial Sequence: Synthetic coding sequence
atggacagtcctgaggtaaccttcaccctggcttacttagtttttgctgtgtgctttgtgtttacaccgaacgagttccatgcagcaggcctcaccgttcagaatcttctatctggatggctgggaagcgaagacgcggctttcgtcccgttccatctgcggaggactgccgctacactcctgtgccactcacttcttccactgggttattatgtcgggatgtgcctcgccgcaagcgaaaaacggttacacgcactaagccaggctcctgaagcatggagactgtttctgttgctcgccgtcactttgcccagcatcgcctgcatactcatatactactggagccgggataggtgggcctgtcaccctcttgctaggaccttggcactttatgctctgcctcagagtgggtggcaggcagtggcttcctctgtgaacacagaattccggagaatcgataaattcgccacaggagcgccaggcgctcgggttatcgtcactgatacatgggtgatgaaagtgacaacctatcgggtgcatgttgcacaacagcaggacgtccatctgaccgttacagagtccaggcaacatgagctatcacccgacagtaatctgcctgtgcaactgctgactattcgcgttgctagcacaaaccctgctgtgcaggctttcgacatctggtcctggcggcctgcctag

SEQ ID NO: 55156 - DNA, 1272 bp, Artificial Sequence
  Description of Artificial Sequence: Synthetic coding sequence
atggcacaggccgtgtggtcccgcctcggccgtattttgtggcttgcatgtctgcttccatgggcgccagctggtgttgccgctgggctgtacgaactgaatttaacaacagatagcccagcaaccaccggggctgtcgtaaccatctcggcatccctcgtagcgaaagataacggctcgctggcactgcccgctgatgcccatctctacaggttccactggatccatacccctttggtcttaaccgggaagatggaaaaagggctttctagcactatccgcgtggttggccacgtgcccggagagttcccggtttcggtgtgggtgacagctgctgattgctggatgtgccagcctgttgccaggggatttgtggtgctgcccattaccgagtttctcgtcggtgacctggtggtaactcagaacaccagcctgccatggccaagcagttaccttacgaagaccgtgctgaaagtgagctttctgttgcacgatccctccaattttctgaagacagcattattcctgtactcatgggactttggagatggcactcagatggttacagaagattccgtcgtgtactacaattactctatcataggcacattcaccgtgaagctgaaggtcgtggccgaatgggaagaggtggaaccagatgcaacgagagccgtgaagcaaaagaccggtgactttagtgcttccctcaaattgcaggagactcttcgcggaattcaagtgcttggtccaactctgatccagacattccagaagatgaccgtcactttgaattttttgggcagcccaccactgactgtttgctggcgccttaaaccagagtgtctgcccctggaagagggcgaatgtcatccggtcagcgtggcctccacagcgtacaacctgacgcacaccttccgcgatcctggcgactactgcttcagcatcagagcagaaaatataatctcaaagacacatcagtatcacaagatacaggtgtggccctctcgcattcagccggcagttttcgcattcccgtgcgctacccttattacagtaatgcttgccttcatcatgtatatgaccctgcggaatgctacacagcagaaagacatggtggagaacccggagccaccttcaggagtgcgctgctgttgccagatgtgctgcggtccctttctgctcgagactcctagcgagtaccttgagatcgtgcgggagaatcatggccttctcccaccgttatataaaagcgtgaaaacatacactgtgtag

SEQ ID NO: 55157 - DNA, 966 bp, Artificial Sequence
  Description of Artificial Sequence: Synthetic coding sequence
atggcccaggccgtctggtcccgcctcgggagaatcttgtggctcgcctgcctcctaccctgggcccctgctggcgtcgcggcagagtttctcgtaggggatctcgtggtgactcagaatactagcctcccctggccatcctcctaccttacaaaaacagtgctgaaggtgtccttccttctccatgaccccagcaacttcttaaaaactgccctttttctttattcttgggattttggagacggtactcagatggtcaccgaagatagcgtggtatactataattattcaattataggaaccttcactgtgaagctgaaggtagttgctgagtgggaggaggtagagcctgatgccactcgggctgtgaagcagaaaacaggtgactttagcgcatctctcaagctgcaagaaacgttgcgcggaatccaagtcttgggacctacacttattcagacctttcaaaaaatgacagtgaccctgaatttcctcggctcccccccactcacggtgtgctggcggctgaagcctgagtgcctaccacttgaggaaggcgagtgccaccccgtttccgtggcttcaacagcatacaatctgacacacacttttcgcgaccctggtgattactgcttttccattcgggctgaaaatattataagtaagacacaccagtatcataaaatccaggtgtggcccagcaggatccagcctgccgtgttcgctttcccctgcgccaccttgatcacagttatgttggccttcattatgtatatgaccctccggaatgccacacagcaaaaagacatggttgaaaaccctgaacccccttccggggtcaggtgctgttgccagatgtgctgcggtccattcctgttagaaacgcccagtgagtacctggagatcgtgagagagaatcatggtcttctgcccccactctacaagagtgtgaaaacttacactgtctag

SEQ ID NO: 55158 - DNA, 1308 bp, Artificial Sequence
  Description of Artificial Sequence: Synthetic coding sequence
atggcacaggcagtctggtcccgactggggcgtatcctttggctagcctgcctcctcccatgggcccctgccggagtagccgcagggttatatgaactgaaccttacaacggactccccagccacaaccggagcagtcgtcaccattagcgcctccctggttgcaaaagacaatggaagccttgccctcccagcagacgcgcatctatacagattccattggattcatactccgcttgtgctgacagggaagatggaaaagggactgagttccactattagggtggtgggccacgttcccggagagttccctgtctctgtttgggttaccgcggcagattgttggatgtgccaacctgtggccagagggtttgtcgtgctccccatcactgagtttctcgtcggcgacctagtagtgacccagaacacttccctcccttggccatcctcttacctcactaaaactgtgctcaaggtctcatttctgctgcacgaccccagtaactttttaaagactgcactgtttctgtattcgtgggattttggcgatggtacacagatggtgaccgaggatagcgtggtctattacaattactctataataggcacattcacagtgaaactaaaggtggtcgctgagtgggaagaagtggaacctgacgcaacgagagctgtaaaacagaagacaggtgatttttccgcctctcttaagctgcaggagaccctgcgcggaatccaggtgctgggaccaactttgatacagaccttccagaaaatgacggttacgctcaacttcctggggagccccccactgaccgtgtgctggagattgaaacccgagtgccttcctctcgaagagggggagtgccacccagtgtccgtggcgagtaccgcttacaacctaactcacaccttccgtgatcctggcgattattgctttagcattcgcgctgaaaacattatctcaaaaacccaccaataccataaaatacaggtgtggccctctaggatccagcccgcagtttttgcctttccatgtgcgacactgattactgttatgctggcttttatcatgtatatgactctgaggaatgctacgcagcagaaagacatggtggaagtggctgatttcgatttctcaccaatgtcagacaagaaccccgagcctcccagcggcgtccgttgctgttgtcagatgtgttgcggaccctttttgctggagactccatccgaatacctggagatcgtcagggaaaatcacgggctactgcctcccctttacaagtctgtcaagacatataccgtatag

SEQ ID NO: 55159 - DNA, 1215 bp, Artificial Sequence
  Description of Artificial Sequence: Synthetic coding sequence
atggaccctgagcttaccggcagctggggattatacgagctaaatttgaccacagatagtccagcaactactggcgcagtggtgacgatcagtgcaagtctcgtagcaaaggacaacggcagcctagcgctgcctgcagatgcgcacctgtatcggttccattggatccatactcccctggtgctgactgggaagatggagaagggcctgagctctacaatccgtgttgtcggccacgtaccaggcgagttccccgtgtcagtgtgggtaacagcagctgactgctggatgtgccaacccgtggcccgaggtttcgtggtgcttcctattactgagtttttagttggcgacttggtggtgacccagaatacttccctgccttggcccagtagctacctgaccaaaaccgtgctcaaagtgtcctttctcctgcacgatccgagcaatttcctgaaaactgctttgttcctctactcttgggatttcggcgacggcacacagatggtgaccgaagattccgttgtgtattacaactatagtatcattggaacatttaccgtgaagctcaaagtggtggcggagtgggaggaagtagagccagatgctaccagagcggtcaaacagaagaccggcgacttcagtgcgagcctgaaattgcaggaaacattgcgaggaatacaggtgttagggccaactctaattcagacttttcagaagatgaccgtcaccctcaacttcctaggttcacctcctctgaccgtgtgttggcgcctgaaaccagagtgtctcccacttgaagaaggtgaatgccacccagtatcagtggcctcaaccgcatacaaccttacgcacacgtttagggatcctggcgactactgtttcagcattcgcgctgaaaacattatatctaagactcatcagtaccacaagatccaagtgtggccatccagaatccagccggcagtctttgctttcccatgcgccacactcatcacggtgatgctcgcctttataatgtacatgactcttcggaacgccacacagcagaaggatatggtcgagaatccagaaccaccaagcggtgttcgatgttgttgccagatgtgttgcggcccattcctgctggagacccccagcgaatacctcgaaatagtgagagagaaccatgggttattgccacccctatataaatctgtcaagacttataccgtatag

SEQ ID NO: 55160 - DNA, 5652 bp, Artificial Sequence
  Description of Artificial Sequence: Synthetic coding sequence
atgggcaaaagggctggaggaggcgctacaggcgcaacgacggccgctgtgagcacttcagcgggagcaggtttagaacccgcagcagccagatcaggcggtccacggtctgccgctgcgggtctgctaggcgctcttcacctagttatgaccctagtagtggcagccgctagggccgaaaaggaagcattcgtccaatcagagtccatcatcgaggtgttgagattcgacgatgggggtctgctgcagacagaaactacactgggcttgtcgtcctaccagcagaaaagcataagcctatataggggaaactgtcggccaataagattcgagcctcccatgctggacttccatgagcagcctgtaggtatgcctaagatggaaaaagtctatttgcacaacccttcttctgaggagactattactctggtgagcatatctgccacaacttctcacttccacgcctctttcttccagaaccgcaaaattctgcccggagggaacactagcttcgatgttgttttcctggctcgggtggttgggaacgtggagaacactctgtttatcaatacctctaaccatggcgtgttcacataccaggtttttggtgtcggcgtcccaaatccataccgcctgagacctttcctcggagcccgagtgccggtcaattcatcgttctctcctattattaacatccacaatccccattcggagccactccaggttgtggagatgtattcctccggcggtgacctccacctcgagctccccaccggtcaacagggaggcacccgcaaattatgggaaatacctccatatgagaccaagggagtgatgcgagcgagcttctcctctagggaggccgataatcacaccgccttcattcgcattaagactaatgcatccgattccaccgaatttattattcttccagtggaagtcgaagttactacggcccctgggatctactcctcaacagagatgctggacttcggcactctccggacccaggacctccccaaagtacttaacctgcacctcctcaacagtgggactaaagatgtacctataaccagcgtccgtcctacaccacaaaatgacgcgattactgttcacttcaagcctatcacactaaaggcctctgagtcaaagtatactaaagtggcatcgatctccttcgacgcatcaaaagccaaaaagccctctcaattttcaggtaagatcacggtgaaggcaaaagagaaatcatactctaaattggagatcccctatcaagccgaagtgttagacggatacttaggctttgaccacgccgcaaccctctttcatatacgcgactctcccgctgacccggtggagaggcccatatatctaaccaatacctttagcttcgcgattctgattcacgacgtcttgctccccgaagaagccaaaactatgtttaaggttcacaatttcagtaagccagtgttgatcctgcctaacgagagtgggtatatattcaccctgctctttatgccctccacatcaagtatgcatattgataataacatccttcttattacaaacgccagcaaatttcatctgcctgtacgggtatacactggatttctagattactttgtgcttccaccaaaaattgaagagcgcttcattgatttcggagtattatctgccaccgaggctagcaacatcctgtttgcgatcatcaactccaatcccattgaattagccattaagtcttggcacattatcggcgacggacttagtatcgagttggtcgcagtggagcgtgggaacaggacaacaattattagttctctacccgaatttgagaagtcaagtctgagtgatcaaagctctgttacactagcgtccggctactttgctgtgtttagagtcaaattgaccgccaaaaagctcgagggaatccatgacggcgcaatccaaattactacggattacgaaatcttgaccattccggtaaaagccgtgatcgccgtcggctcgctcacgtgcttccccaagcacgttgtgctcccccctagctttcctgggaagattgtccaccagagcctcaatatcatgaactcattctcccagaaggttaaaatccagcaaatccggtctctgtctgaagacgtcagattctattacaaacgactccggggaaataaggaggacttagaacctggcaagaaaagtaagattgctaacatatattttgaccccggtctgcaatgcggcgatcattgttacgtggggctgccctttctctccaagtctgagcctaaggtgcagccgggagttgccatgcaggaggatatgtgggacgcagactgggatttacatcagtcactcttcaaaggctggaccggcatcaaggaaaattctggccacagactctcagctatattcgaggtcaatacagacctccagaaaaacataatctcaaaaataacagctgagctgtcttggccttccatactctccagccccaggcatctcaaatttccgctgactaacactaactgttcctctgaggaagaaatcaccctggaaaatccagccgacgtaccggtctacgtgcagtttattccgcttgcgctctattcaaatccttccgtgttcgtcgataagttggtgagtcgattcaatctaagcaaggtagcaaagatcgacctgaggactctagaatttcaagtctttcggaacagcgcacatcctttacagagctcgaccgggtttatggagggtttgtctaggcatttgatccttaacttaatccttaagccgggagagaagaagagcgtgaaggtgaagttcacacccgtgcacaacaggaccgtgagttccctcatcatcgtccggaacaacctgacggttatggatgcagttatggtgcaggggcaaggcaccacagaaaatctccgggtggcaggaaagttgccaggtcccggatccagcctcagattcaagattaccgaggcattgctgaaggactgcacggacagcctgaagctccgtgaaccgaacttcaccctaaagcggacctttaaggtagagaacaccgggcaacttcagatccatatcgagaccatagagatctccggatactcttgtgaggggtatgggtttaaggtagtcaattgtcaagagttcactctgtccgccaacgcatctcgcgacatcatcatcttgtttacgccagatttcacagcaagcagggtgattcgagagcttaaattcataactactagtgggtctgagtttgtatttattctgaacgcctctttgccgtaccatatgcttgcgacatgcgccgaggcccttcccaggccaaattgggagctcgccttatacatcataatcagcggcattatgagtgccctgttcctgctcgtcataggcaccgcctacctggaagcccagggcatatgggagccttttaggcgcaggctgtcgtttgaggcatccaacccgccatttgacgtaggacggccattcgaccttcggaggattgttggtatctcgagcgagggcaacctgaacacattatcatgtgatcccggacacagtagaggcttctgcggcgctggcggaagttcctccaggccgtctgcaggctctcacaagcaatgtgggccatccgtgcacccccactcctctcattctaatcgcaactcagccgacgtggaaaacgtgagagcaaaaaattcttcttcaacttcctcccgcacctccgctcaggctgcgagcagtcagtcagcaaataaaactagccctcttgtgctggatagcaacacagtcacacagggccacaccgccggtcggaagtccaaaggggctaaacaaagccagcacggttcacagcaccacgctcactccccgctggagcagcacccacaacctcctctaccgcctcccgtgcctcagccccaagagccccaacctgagcgcctgtctcctgctccactggctcacccctcacatcccgaacgtgcttcaagtgcaagacattcatcagaggatagtgatatcacttccttgatcgaagctatggacaaagacttcgatcaccacgactcccctgcacttgaggtttttacggagcagcccccttccccactgccaaaatctaaggggaaagggaagccgcttcagaggaaggttaaacctcctaagaagcaggaggaaaaggaaaaaaagggtaaaggcaaacctcaggaggatgagctcaaagatagcctcgccgatgatgactcctcctcaaccacgaccgagacctctaaccctgatactgagcctctgctcaaagaggatacagaaaagcagaaggggaaacaagctatgccggagaaacacgagagcgagatgtctcaagtcaagcagaagtctaagaagctcctcaacattaagaaagaaatcccaactgacgtcaaaccttcctccctggaactgccatacactccacctctcgagagtaagcagcgaagaaatctcccaagcaagataccactgccgacagccatgactagtggatctaagtcaagaaatgcccagaaaacaaaaggcactagcaaactcgttgataaccgccctcccgcattagctaagttcttgcccaattcccaggagttagggaacactagtagcagcgaaggggagaaagattctcctccgcctgagtgggattctgttcccgtgcacaaacccggttcctcaacagacagcctgtacaaattgagcctgcaaaccctgaacgctgatatcttcctcaagcagagacaaacatcccccacacccgcttccccctccccacccgcagccccatgtccttttgtagcacgtggtagttacagtagtattgtcaactccagctcttctagcgaccccaagatcaagcagccaaatggtagcaagcataagctcacaaaagcagcttcactccccggaaagaatggcaatcccacatttgctgctgtgactgccggttacgacaagagtccaggcggtaacgggtttgccaaagtgtcaagcaacaagactggcttctccagctctcttggcattagccatgctcctgttgacagcgatgggtctgattcaagtggcctgtggtcccccgtctccaatccttcctccccagatttcacgcccttaaactctttcagcgccttcggaaactcatttaacttaaccggagaagtgttctccaagctgggattgtctcggtcttgcaaccaagctagccaacggagctggaatgagtttaacagcgggcctagttatttatgggaatcacccgctacggatccgtctccttcatggcccgcaagctccgggtcccccactcatacagccacctccgtgttaggaaacactagcggcctctggtcgacaacgcctttctccagctctatttggtcgtccaacctgtcgtccgcacttcctttcaccaccccagctaatacacttgctagcatagggctgatggggacggagaacagcccagcaccacatgctccttctacgtcgagccccgcagatgatctcggccagacttacaacccgtggcgcatttggagcccaaccattgggaggagaagctctgacccatggagcaactctcacttcccacacgagaactac

SEQ ID NO: 55161 - DNA, 999 bp, Artificial Sequence
  Description of Artificial Sequence: Synthetic coding sequence
tgaggcttgctgggggctctccacctggtgatgaccctggttgtcgccgctgccagagcggaaaaggaagcgttcgtacagagcgaatccattatcgaagttcttcgcttcgatgacgggggactcttgcagactgaaactaccctgggattgtcatcatatcagcagaagtctatcagtctgtaccgaggaaattgtaggccgatcaggttcgaaccacctatgctcgacttccacgagcagcccgtgggcatgcccaagatggaaaaggtgtatctccacaatccttcaagcgaggagacaatcacactggtgtctataagtgccactacaagtcattttcacgcatccttctttcagaatagaaaaatcctccccggtggaaatacttccttcgacgtggtgttcctcgctcgggtggtggggaatgtggaaaataccctattcattaatacgagtaaccatggcgtgtttacttatcaagtgttcggagtaggggtgccaaacccctacaggctgcgaccctttctgggcgcacgggttcccgtgaatagttcattctccccaatcatcaacattcataatcctcacagcgaacccttacaggttgttgagatgtactctagcgggggagacctacacctcgagttgccaaccggtcagcaaggcggtacaaggaaactttgggagattccgccttacgagaccaagggtgtgatgcgggcttcttttagcagcagggaggcggacaatcacacagcctttattaggatcaaaaccaacgcctccgatagcaccgagttcatcatcctgcctgtcgaggtggaagtcaccaccgcccctggcatctactcgtcgactgagatgctcgactttggcaccctgcggactcaagacttacccaaagtgttaaatttgcacctgctgaattcaggaactaaggatgttcccatcactcatagacgacagaaatctcatctgtcgttcctcggcaagtag

SEQ ID NO: 55162 - DNA, 969 bp, Artificial Sequence
  Description of Artificial Sequence: Synthetic coding sequence
atgacactggtcgtggctgccgcacgagctgaaaaggaagctttcgtgcagtcagagagtattatcgaagtgctgaggttcgacgacggtggtctgctgcagactgagaccaccctgggactgagctcatatcagcagaaaagcatctcactttaccggggtaattgccggccaatcagatttgagccgcctatgctggatttccacgagcaacctgtgggaatgcctaaaatggagaaagtatacctgcacaaccctagcagcgaggagactattaccctcgtgtccatctctgcaactacatctcacttccatgccagcttcttccaaaaccgcaaaatactccctggcggaaatacaagctttgacgttgtttttttggctcgagtagtcggaaatgtggagaatacactctttattaatactagcaatcacggggtctttacctaccaagtgttcggagtaggggtgcccaatccttatagattgaggccattcctcggagccagggtgccagtgaattcctctttttctcccataattaacattcataatcctcactctgaaccactgcaggtcgttgagatgtattcctccggtggcgacttacacctcgaactaccgacgggccagcagggcggaacgcgaaagctctgggagatccccccttacgagacgaagggtgtcatgcgcgctagcttcagttcacgcgaggctgacaatcataccgcatttattcgcattaaaactaatgcctctgacagcacagaatttattatcttgcctgtggaggtcgaggtaacaacagcacctgggatctatagctcaactgaaatgctcgatttcggtacgctcagaacgcaggatctgcccaaagtgctaaatttgcatctccttaactcgggcactaaagacgtccctatcacacaccgacggcagaagagccatttgagctttctgggcaagtag

SEQ ID NO: 55163 - DNA, 3237 bp, Artificial Sequence
  Description of Artificial Sequence: Synthetic coding sequence
atgttcggggctgcgagtcggatggacaccacagctgtttgtaccgggggtgtgacagaatctcggggaatagtggactccctgcagaaattttcaagtcttcctgcctatctcccgactaatctgcatatatccaatgcggaggaatctttcttcctcaaggaggctaaccaggacctgactcggaacagtagtctgcaagctcgggtggagcccttttttatctaccgtgctagaacgcctcccattataaatgcctcctacggccctttttcagtcgaaaagatcatccctcaagagctgctcctgacatcaacagccttcggaaacatggataagttcccgtttaattggaaattgaagagccacatccttgactcatccatctatagcaataggccaaaggtccagactctcttctatgtgaccggcatgggctgggacgactccgacttgactgaagatcttccttgcgttaagatgttcgcctttccggaggcgagagaagtcgccgcaagttgtcgcctgcagggagcgccagggttatgcgtggctgagctggagctgctccctgagtggtttagttccgggctcgatctggagccagaagaggagattcctgccctgttaggtgggacaacaatggagttgttttttacgctgtaccccgctgacaaagccggacagtgcccactcgaggaagaaggtaaatgggagaataatatccacagtgggctggaatccccacagcaggcatttccagcaagagagagaatcgggtctgtcgtggtctatcccacccaggacgatcttaagtggtcccttgtgtcccttgacgagaatgtggtaataagcgttcccttgaatctcgtgcgagaaggggatactgccacgtttctggttagtctcacctcgagcagtgtagcagaccagttcacacttaggatcaaagctgctgcaggcgtgaagatcacggccgtccgggtcagttccgaagatcaatgggcggtgcaggaagagatcgataacggctcaacacagaccagtgccacccttacgtgcatgggtcaccgtccagatacccaaagtcgggtaaatggatccttttacgaaatactccaggtggattttggaatcgacaactctagcgacctcgctggtgctcaacagatcacatggcaggtagaatatcccatcgaagattccatgagcgagcttgtggtgagtgaaatcttcgtctcccagacaaccttcgtgggcattgtgcccttggccatggataccgaagtgttgaacacggctattttaactggcaaacctgtctccgtcccagtgaaagtcgtgggcgttcaggaggatggtagcgtcgtggacgttagcgaatccgtcgagtgtaagtccgcagacgaggatgtcattaaagtatcaaacaattgtgatagcatctttgttaatgggaaggaaatgaaatcaaaggtggacaccatcgttaattttacccaccaacatttcacttctcagttcgaagtaacggtctgggcacccaggttgcctctccagattgagattagcgataccgagttgtcccaaattaagggatggcggatccccgtggccgctaacagacggcctacacgggaatccgacgatgaggacgacgaggagaaaaaaggacggggttgttctcttcagtaccaacatgctacggtgagagttcttacacaattcgtggcggagagccccgacctgggccagctgacttacatgctgggccctgactggcagttcgacatcaccgatctggtcactgagttcatgaaagtggaggaaccgaaaattgcccagttacaggatggtagaacactagccggtagggaacctggcattacgacagtccaggtactgagtccactgagcgactctatcctggccgagaagactgtgattgtcctcgatgacagggtgacgatagccgagcttggagtgcagctggtggccggaatgtctcttagtctgcaaccccaccgggctgataagcgggctattgttagcacagccgctgccctagatgtcctccaatctccacaacaggaagccattgtttcaagctggatactgttctccgacggatcggtcaccccacttgacatctacgaccctaaggactactcagtcactgtgtcgagtctggacgaaatggtggtcagtgtacaggctaacctcgagtccaaatggccgatcgtagtcgctgagggagagggtcagggccctctcattaagttagagatgatgatctccgagccctgtcagaagacaaagcgtaagagtgtgctcgcggtgggcaagggcaatgtcaaggtaaagttcgagccttccagcgacgaacatcaggggggaagcaacgatatcgagggcatcaaccgagaatataaggatcatctttccaatagcattgaaagagagggcaaccaagagagggcagtacaggagtggttccatcggggtacacccgtcggccaggaggagtctactaacaagtcaactaccccacaaagccccatggaaggcaagaataagctgttgaaatcgggaggtcctgatgcctttacctcgttccctacccagggcaaaagccccgaccccaacaatcctagtgatctgaccgtgactagccggggactgactgacctggagatcggcatgtacgccctgttatgcgtgttttgtttggccatactcgtgttcctaatcaactgtgttgcattcgcatggaagtatcggcacaagcggtttgcagtgtctgaacagggaaacatcccgcactcacacgactgggtttggttaggaaacgaagtggagctgctcgagaacccagtggacattactctgcctagtgaggaatgtaccacaatgatcgatcgcggattacagtttgaggagagaaacttcttattgaacggttctagccaaaagacattccactcccagctgctcaggccctccgattatgtgtatgagaaagaaatcaagaacgaacccatgaactcctcaggtccaaaacggaagcgcgtaaagttcacgtcttacacgacaattctcccagaggacggtggaccttacacaaacagcattctgtttgacagcgatgacaacatcaagtgggtctgccaggatatggggttgggagactctcaggacttccgggactacatggagagcctacaggaccagatgtag

SEQ ID NO: 55164 - DNA, 3327 bp, Artificial Sequence
  Description of Artificial Sequence: Synthetic coding sequence
atgcgatctgaaggcgctgccccaggtcccgctgcacccctctgcggtgctttatctctgctgctgggcgctctgcttggaaaagtcattgagggccatggggtaactgacaatattcagaggttcagcagtctgccaccctatctgcccgtgagctaccacatcttgcgcgctgaaacgtcattcttcctgaaagaggccaaccaggatttactgcgaaattcctctttacaggccagagtggagtccttctttacctataaaacacgtcaaccacccgtgctaaacgcttcatacggtccattttccgtcgaaaaggtcgtgccgctggatcttatgctgactagcaacttcttgggacccacaaataaattctctttcgactggaaactgaaggctcacatcttgcgagataaggtttacctctcaagacctaaggtgcaagtactctttcatatcatgggaagagactgggacgatcatggggctggtgaaaagctcccctgtttgcgcgtgttcgccttccgcgagacccgcgaggtgcgcggaagctgcagactgaagggcgacctgggattgtgcgttgctgaactggagctgctcagctcctggttttccgcaccaacggtgggagccggtaggaagaagagcatggaccagccagaagggactcccgtggagctctattacacagtgcaccctgggaacgagcgtggggattgcgccggaggagactttcggaaggggaacgcaattagaccaggcaaggatggactagaagagaccacctctcacctgcagaggatcggcacagtgggcctttatagagcgcaggattcagcacagctcagtgaactcaggctagacggcaacgtggtgatctggcttccaagtcggcctgtaaaacagggtgaggtcgtaaccgcgtatgtaaccatctcatccaacagtagcgtggacctattcattctgagagctaaggtgaagaaaggggtgaacatcctaagtgcacaaactagagaacctcgccagtggggagtgaagcaggaggtgggttcaggtggaaagcatgtcactgctaccgtggcctgccagcgcttgggacccagccctcgcaaccgcagttcctcactttttaacgaagtggtacagatgaacttcgagatagcatccttcagctcactctcaggtacgcagccaatcacatggcaggtcgaataccccaggaaaggtaccacagatattgccgtatcggaaattttcgtgagccagaaggacctggtgggaatcgtgcccctggcaatggatacggaaatcttgaacaccgccgtcctgacgggcaagactgtggcaatgcccataaaggtcgttagcgtagaagagaactcggcggtgatggacattagtgagagcgtagaatgcaaatctaccgacgaagatgtgattaaagttagtgagcgttgcgattacatattcgtaaatggaaaagagattaaaggcaagatggacgccgtggtgaacttcacttatcagtatctctccgctcctctctgtgtgaccgtgtgggtgccacgtttgcccttgcagatcgaggtttctgacaccgaacttagccaaattaaggggtggcgggtgcctattgtgacaaataagcgtcccacaagggagtccgaggacgaagacgaagaggagaggaggggacgtggatgtgccttgcaataccagcatgccaccgttcgggtgttgacccagttcgtctccgagggggctgggccatggggtcaaccgaactacctcctctcgcctaattggcagttcgatatcactcacttggtggccgactttatgaaactcgaggagccccatgtggcaaccctgcaagatagccgggtgcttgtgggcagagaggtcggcatgactacaatccaggtgctcagccctctgagtgattcaatcctcgccgagaagaccatcaccgtgctggatgataaggtttcagtgacggatttggctattcagctcgtagcaggcctgagcgtcgccttgtaccccaatgccgaaaactcgaaagcggttacagctgtggtgacagcggaagaggtgctgagaaccccaaaacaagaggccgtattctctacctggctgcagtttagtgacgggagtgtgaccccactggacatctatgataccaaggacttctcccttgctgccaccagccaggatgaggctgtcgtgtccgtcccgcagccgaggtcacctcgatggccggttgtcgtggcggagggagagggtcaggggcctctgattcgcgtggacatgacaatcgcagaagcctgtcagaagtcaaagcgtaaaagcattctggctgtgggggttggaaacgtgcgggtcaagtttggccagaatgatgctgatagctcccctggcggagactatgaggaagacgaaataaaaaatcacgcttccgatcgtaggcagaagggacaacatcatgagcgcacaggacaagacggccacttatatgggtcgtccccagtcgagagggaagaaggcgctctacgacgagcaacgaccaccgctcgctcgttactcgataataaagtggtgaaaaactccagggcagacgggggacgcctggccggagaggggcagctgcaaaacattccaattgatttcacaaatttcccggctcacgtagatctccccaaggccggttccggcctcgaagagaatgatctagttcaaacaccacgcggattgtccgacctggagatcggtatgtatgccctcctgggagtattctgtctggcaatactagtctttctcattaattgtgctacatttgcactgaaataccgccacaagcaggtgcctttggagggccaggcaagtatgacgcattctcatgattgggtttggcttggaaacgaagcagagctccttgaaagcatgggggacgcacctccccctcaagacgagcatactacgatcattgatagagggccaggtgcatgtgaggaaagtaatcatctcctactgaatggagggagccacaagcacgtccagagccagatccatagatccgcagattctgggggtagacagggcagagagcagaaacaggaccccctgcattccccaacttcaaagagaaagaaggtcaagttcaccacctttacaactatacctccggacgatagttgtcccactgtcaactccatagtgagttccaacgacgaggacattaaatgggtgtgtcaagacgttgcggtgggagcgccaaaggaactcaggaattaccttgaaaagcttaaggacaaggcctag

SEQ ID NO: 55165 - DNA, 1914 bp, Artificial Sequence
  Description of Artificial Sequence: Synthetic coding sequence
atgcaacgtgacgaatcctcacccttcccccctttattcagcctcacatctagtcaggtgagtgatcggtgtgattatgtgttcgtcaacggaaaggaaatgaagggaaaagttaatgtggtggttaattttacctaccaacacctctcatcgcctttggagatgacggtgtgggtccctcgcctgcccctgcagatagaggtgtcggatacagagctgaatcagatcaaggggtggcgggtgcctatcgtttcatcccggcgtcccgctggggactctgaggaagaggaagatgatgagcgccgagggagaggctgcaccctccagtatcaacatgccatggttcgggtccttacacagttcgtggccgaggcggctgggcctgggggtcaccttgcccacctccttggtagcgactggcaagtcgatattactgagttaattaacgattttatgcaggtggaagaaccacggatcgcgaaacttcagggaggccagatattgatgggccaggaactgggcatgactaccatacagatactgtcgcccctcagcgacacgatcctggcagagaaaactatcacggtcttggatgaaaaggtgactatcaccgacctgggtgtacagctcgttactggcctctctcttagtctccagctgagccccggttccaaccgcgctatctttgccaccgctgtcgcccaggaactgctgcagcggcctaagcaagaggcagccatttcctgctgggtgcaattttccgacgggtcggtgactccattagatatctatgacggaaaagacttctctcttatggccacttcgctcgatgagaaagtggtctcaatccaccaggatcccaagttcaaatggcccatcatcgccgctgagaccgaaggccagggaacccttgtgaaagtggaaatggtgatctccgaaagctgtcaaaaatcgaagcgaaaatcggtcctggcagtgggcacggctaacataaaggtaaagtttggacagaatgatgctaatcccaatacatccgatagccgacatacaggcgcaggggtccacatggaaaacaacgttagcgaccggaggcctaagaagccttcacaggagtgggggtctcaagaaggacaatattacggcagcagtagtatgggactcatggaagggaggggcacaactactgatcggtcgatcctgcagaagaagaagggacaggaatctctactagacgacaatagccacctgcagacgatacctagtgacctcacatcctttcccgcacaagtggacctgcctcgctctaatggagaaatggatggcaacgacctgatgcaagccagtaagggactctctgatctggaaatcggcatgtacgccttgttgggggtgttctgtttggctattctcgttttcctgatcaactgtgtgacattcgcacttaaatatagacacaaacaggtgccatttgaggagcaggaaggtatgagccacagccacgactgggttgggctgagtaatcggaccgagctgttggaaaatcatattaactttgcgtcttcccaggatgagcagattacagcaattgataggggcatggatttcgaggagagcaagtatctgttaagcaccaactcccagaaatctatcaatggtcagcttttcaaacctctaggccctattatcattgatggaaaagatcaaaagtccgagccaccgaccagcccaactagcaaacgcaaaagggtcaaattcaccacttttacagcggtgtccagcgatgatgagtatcctactcggaactcaatcgtcatgagctcggaggacgatatcaaatgggtctgtcaggacctggacccgggtgactgcaaggagctccataattacatggaaagactgcacgagaacgtgtag

SEQ ID NO: 55166 - DNA, 3300 bp, Artificial Sequence
  Description of Artificial Sequence: Synthetic coding sequence
atgtgcccttccgagatgggcacactgtggcaccattggtccccagttctgatcagcttggcagcactctttagcaaagtcacagaaggtagagggatcctggagagcatccagcggttttccctgcttcctacttatttgccggtgacgtaccacattaacaacgctgacgtgtccttcttccttaaggaggcaaatcaagacatcatgagaaactccagtctccaaagtagagttgagtcttttttgatctataaaagcagaagattacccgtgctgaacgctagctatggacccttcagcatcgaacaggtggttccacaggatctcatgttgccgagcaacccattcggattcactaacaagttctcactcaactggaagctgaaagcgcatatattgagggataaggtttaccttagccggcctaaggttcaagttctcttccacattatggggcgtgattgggacgacagatctgccggagagaaactgccctgtctgcgagttttcgcattcagggaaaccagggaggtccgaggctcatgccggttacagggggacctggggctctgtgtggcagagcttgaactgctgtccagttggttttctccacccaccgtggttgccggtcggagaaaaagtgttgatcaaccggaaggcacccccgtggaactatactataccgttcacccaggaggcgaaagaggggattgtgtaagagaagatgctcgacgaagcaatgggattcggacgggccatagcgatatagacgagagtggaccgccactgcaaagaatcggatccatcttcttatatcagacacaccgtaagccctctctgcgggagcttcgactggataattctgtagcaatccactatattcccaaaactgttcggaaaggcgatgtgctgacatttcccgtgtcaatttccagaaattccaccgaggatcgcttcaccttgagggccaaggttaagaaaggtgtgaatattatcggagtgagagcctcaagcccctcaatatgggatgtcaaagagcggactgactataccggaaagtacgcgcctgccgtgatcgtgtgtcaaaaaaaggcagcgggtagtgagaattcggccgacggcgcaagctatgaagttatgcaaattgacgtggaggtggaagagccaggagacctccccgctactcagcttgtgacatggcaggtagagtatcccggtgagattactagcgatctaggtgtgagtaagatttacgtgagcccaaaggacctcatcggggtcgtgccactcgcaatggaagcggagattctcaataccgccattctgaccgggaagacagtggccgtgccagtaaaggtcgtttcggttgaagacgacggcactgtgaccgaattgctcgagtctgtagagtgcagaagtagcgacgaggacgtaatcaaggtctcagaccggtgtgactatgtgtttgtgaacgggaaagagatgaaaggaaaggtaaatgtggtggtcaacttcacataccaacatctgagtagccctttagagatgactgtttgggtgcctaggctcccactccagatcgaagtctccgatacagaactcaatcaaattaagggctggagggtgcccatcgtctcctctcggcgtcctgccggagactccgaagaagaggaagatgatgaaaggagaggacggggatgtacattgcagtatcagcatgcgatggtgcgagtgttaactcagtttgtggccgaggcagccggtcccggtggccatttggcgcaccttcttggcagcgactggcaggtcgacatcaccgaactgattaatgacttcatgcaagtagaagaaccgcgaattgccaagctccaagggggtcagattcttatggggcaggaactgggaatgactaccatccagattctgtcgccactgagcgatactattttagctgagaagaccatcactgtgctcgacgaaaaagtcacaataacggatctgggggtgcaactggtgaccgggttgagcctatccctccagctgtcacctgggtccaaccgagcgatcttcgcaacagccgtggcacaagaactcctccaaaggccaaaacaggaggccgctatatcctgttgggtgcaattcagcgatggttctgtgacgcccctggacatctacgatggaaaggatttctcactgatggcaacgtccttggatgagaaggtggtctctatccaccaggacccgaaattcaagtggccaatcattgccgctgaaactgagggccaagggaccctggtgaaggtggaaatggtgatctccgaaagctgtcaaaaaagtaagagaaagtccgtgttggcggtcgggactgctaatatcaaggtgaagttcggacagaacgatgccaatcctaatacatccgatagtaggcatactggtgcaggggtgcacatggagaacaatgtgtctgaccggaggccaaagaaacccagccaggaatggggatcccaggagggacaatactatgggagtagctcaatgggcttgatggagggacgagggacgacaaccgatcgcagcatactccagaaaaaaaaaggacaggagagtctgcttgatgataattcacatctgcagacaatcccatctgacctgactagttttcccgctcaggtagacttacctcgctccaatggcgagatggacgggaacgatctcatgcaggcatctaagggcctctctgatctagaaataggaatgtacgccctgcttggcgtcttttgtctcgccatactggttttcttgatcaattgtgtgacatttgctctcaagtacagacataagcaggtgcctttcgaggagcaggagggcatgtcacactctcatgactgggtgggactgtccaatagaacagagcttctggaaaaccatattaattttgcgtcaagccaggacgaacagataacagctattgatagaggcatggactttgaggaaagcaaatacctattatccaccaacagtcagaaaagcattaacgggcaactgtttaaaccactggggcctattatcatcgacggcaaagatcagaagtctgagccgcctacttctccgacatccaagaggaagagagtcaaatttacaacatttacggccgtctcttctgacgacgagtacccaacaagaaacagtatagtgatgtcttcagaggacgacatcaagtgggtttgtcaagatttggatcctggggattgcaaggaacttcacaattatatggaaagactgcatgagaatgtgtag

SEQ ID NO: 55167 - DNA, 2955 bp, Artificial Sequence
  Description of Artificial Sequence: Synthetic coding sequence
atggctccaggcatgtcaggcagagggggagccgcactcttgtgcctcagcgcattgctggcccacgcctcggggcgatctcaccctgccagtccctccccgcctggccctcaggctagcccagtgctgccagtcagttaccgcctctcccacacaaggctggccttttttctgcgcgaggcacggcctccttcccctgctgtcgctaattccagcctgcagcggagcgagcctttcgtggtgtttcagactaaagaactccccgtgctgaatgtgtctctggggccattttccacctctcaggtggtggcaagagagctcctgcagccttcctctactctcgatatacccgagaggcttactgtgaattggaaagtgcgtgcattcatagtaagaagccatgttcccgcttcgcagccagtcgtacaggttttgttctatgttgctggcagggactgggacgacttcggagtgactgaacggctgccatgcgtgcgtctgcatgcctttagggatgccagagagcatccactgctgcgaattggctccatatcacttttccgcccacctccgagaagaaccttacaggaacacagactagacagcaacctgatgatcagactccctgaccgaccgctgaaaccaggggaagtcttgtctatccttttatatctggctcccaacagttctagtcccagttctccatcggtggaacacttcacactgcgtgtgaaggctaagaaaggtgtcaccctgcttgggactaagtctcggtcaggtcaatggcatgttacctccgagctcctcacgggtgcgaagcacagcaccgctaccgtcgacgtggcctgggcccaatcaacacctctcccacctcgcgaaggccagggacccttggaaattctgcagctggacttcgagatggaaaacttcactagccagagcgtgaagagaaggatcatgtggcatatcgactaccggggtcacggtgccctccctgatttggaacgcgctgtcacagagctgacggtgatacagagggatgtccaggccattctccccctggcaatggatacagagatcataaatactgcaatacttacaggccgtactgtggccataccagtgaaggtgatcgccattgaagttaacggcctggttttagacatctcagcgctcgtcgaatgcgaatccgataacgaggacatcatcaaggtatcatcctcgtgtgactacgtgtttgtgagcggtaaggaatcccggggtagtatgaacgcacgcgtgacctttcgttacgatgtgttgaacgctccattggagatgactgtatgggtgccaaagctaccccttcacatcgaattgtcagacgcccgactctctcaagttaagggctggcgtgtcccaatacttcctgatcggagaagcgtgcgcgaaagcgaggatgaagatgaagaggaagaggaacggagacagtctgcctcacgcggttgcaccctccaatatcagcatgccacactgcaggtgttcactcaattccatactacctcaagcgagggaacggatcaggtggtcaccatgcttggacctgactggctggtggaggtcacagacttagtttctgactttatgcgggtcggcgatcccagggtcgctcacatggtggactcaagcaccttggccggactggagccaggtacaaccccttttaaagtcgtttcccctctgaccgaggccgtgctgggagagaccctgctgacagtgactgaggaaaaagttagcattacccaactgcaagcccaggtcgttgctagcctggctttgtcactgaggcctagtcctgggagctcccataccattcttgccactacagctgcccagcagaccctctcattcctcaagcaggaagctctcttgtctttgtggttaagctactctgacgggaccacggcaccacttagcctgtacagcccaagagactacggcctcctggtatcttccttggacgagcatgtggccacagtgacccaagaccgcgcattccctctggtggtggctgaagcggagggcagtggcgagctcctccgggcagagttgaccatagcagaatcgtgtcagaaaacaaagagaaagtcagtgttggccactactccagtaggcttgagagtacactttggacgtgacgaggaggatcctacttacgattaccccggaccttcacagccaggcccagggggaggggaggatgaggctcgcggagctggacccccaggctcagctctaccagcgccagaggcccctggacccggtaccgcctcacccgtcgtacctcctaccgaggacttcttacctctccctaccggtttcttacaggtgccgaggggtctgactgatctggaaataggcatgtacgcattgctcggtgtcttctgcctcgctatattggtgttcctaataaactgcattgtattcgtgttacggtacagacataaacgtatccctcccgaaggccagactagtatggaccactctcaccactgggtgtttctgggcaatgggcagcccctgcgtgtccaaggggaactctctccacccgctggcaaccctttggaaactgtgcctgccttctgtcacggggatcatcactccagcggctctagtcagacatctgtgcagtctcaagttcacgggaggggcgacggcagttcaggaggcagtgcccgtgatcaggccgaggatccggcatccagtcctacatccaagaggaagcgcgtgaagtttaccacttttaccaccctcccaagtgaggagcttgcctatgatagtgtgccggcaggagaagaggatgaagaagaggaggaagacttgggatggggctgccccgacgtggccggtcctacacgcccaacagctcctcccgatctgcacaactacatgagacggatcaaggaaattgcctag

SEQ ID NO: 55168 - DNA, 390 bp, Artificial Sequence
  Description of Artificial Sequence: Synthetic coding sequence
atgacctcccaccactgtgtaggtccaggtaaccatatttcctggtccgggcacgagaaagagcatcggttggactattgtcctgaggtgaccttccccctcactaaaggtttccccctgggatatactttgttgtttaactttgctagctaccctttcctcctgccttccaagatcaagactctcctgcggaataaagactctttcttaaatattctttgcccagcctgcctgcttctgattcgaaggtgcaacatcgaatattcaagtacaggacttaacttcctaaatacttttaccgtcagtctgatcgtgacagttatccctctgcttcaaaacgtgccagtgccgcttgggaacaacgtggggaagatgcaggtctacgagtag

SEQ ID NO: 55169 - DNA, 588 bp, Artificial Sequence
  Description of Artificial Sequence: Synthetic coding sequence
atgagtgccgcacgaccacagttcagcatcgacgacgccttcgagttatccttagaagatggcggacctggcccagaatcatctggggtggcgcgatttggaccgctgcatttcgagcgcagggccagattcgaggtggcggatgaggacaaacagtcccgtttgcggtaccagaacttagaaaatgacgaagacggcgctcaagcgtcaccagagccagatggaggtgtagggacacgggactctagtagaacgagtattagatccagtcagtggagcttttcgaccatttcctcctcaacccagcgcagctataatacatgctgtagctggacacagcatcctctaatccagaagaaccggagggtggtgttagcatcgttccttttactgctgttgggcctggtgttaattctggtcggggtgggcctcgaagccaccccatctcccggagtttcgtccgcgatctttttcgtgcctgggtttcttctgctggtgcctggtgtgtaccacgttattttcatttattgtgccgttaagggacatcggggtttccaattcttttatttgccctactttgaaaagtag

SEQ ID NO: 55170 - DNA, 543 bp, Artificial Sequence
  Description of Artificial Sequence: Synthetic coding sequence
atgtctgccgctagaccccagttctctattgatgatgccttcgagctctcattggaggatgggggaccaggccctgagagtagcggagtcgccagattcggccctttacattttgaacgtagggcaagattcgaagtggccgatgaagacaaacagagccggctgcgctaccagaacttggagaacgacgaagacggggcacaggcaagcccagagccggatggtggtgttggtacccgggattcctcccgcacatccatccgtagttcccagtggagcttttccactatttccagcagtacccagcgaagctacaatacatgctgtagttggacccagcacccgctgattcagaaaaaccgcagggtggttctggccagcttcctcctgcttttgttgggtttgggcgtttcaagcgctatttttttcgtacctggcttcctgctactggtgccaggggtgtatcacgtgatctttatatactgtgccgtgaagggacatagaggatttcagtttttctacctcccttacttcgagaaatag

SEQ ID NO: 55171 - DNA, 1377 bp, Artificial Sequence
  Description of Artificial Sequence: Synthetic coding sequence
atggccgcactgagcaaatccatcccacataactgctatgagattgggcatacatggcacccttcatgtcgcgtttcttttctgcagattacagggggagccctggaggaaagcttaaagatctacgcccctctatacttgattgccgcaattttgcgaaaacggaaactcgactactacttgcataaactcctgcccgagatcctccagtccgcatcgtttctgacggctaacggggcactctacatggccttcttctgcatcttaaggaaaatcctcggtaagttttattcatggactcctgggttcggggcagcattgcccgcatcttacgtggccattctgatagagaggaaatctagaagaggcttactcaccatctatatggcgaaccttgctacagagacactattcagaatgggcgtcgccagggggaccattacaacgcttcgtaacggagaggttttgctgttctgcatcacagcagcaatgtacatgtttttcttccgctgcaaagatggcctcaagggattcaccttctctgctctccgctttatcgtaggaaaggaggagatccccacccattcgttcagtcctgaagccgcttacgcaaaagtggagcaaaagcgcgaacagcacgaggagaaacccggaaggatgaacatgatcggcttagtccggaaattcgtggacagcatctgtaaacacggccctcgacacaggtgttgtaagcattatgaagataattgtatttcttactgcatcaagggtttcatcaggatgttctctgtgggttatctgatacaatgctgcctcagaattccgagcgcctttaggcatctgttcactcaaccaagccggctcctgtcgctgttttacaataaggagaacttccagctaggcgctttcttgggcagctttgtttccatttataagggcacatcatgttttctacgatggattcggaatttggatgacgagctccatgccattatcgccggttttctggcaggaatatctatgatgttctacaagtcaacaacaatttcaatgtacctggctagcaaactagttgagaccatgtacttcaaagggatcgaggccggaaaggtcccctactttccacacgcagacaccattatctatagcatctctacagcaatctgttttcaggccgctgtgatggaggttcagaccctccggccttcctactggaaatttctcctgagactgactaagggtaagttcgccgtgatgaacaggaaggtgcttgatgtgtttggtaccggagcctctaaacacttccaagacttcatacctagattggatcccagatatacaacagtgacacctgaactgcccactgagttcagctag

SEQ ID NO: 55172 - DNA, 1311 bp, Artificial Sequence
  Description of Artificial Sequence: Synthetic coding sequence
atggcagcgctgtcaaagtcaatcccacacaattgttacgaaatcggccacacctggcatccatcttgtagggtatcgttcctgcaaattacaggcggagccctggaggagagcctgaagatttacgccccactgtatctgatcgccgcaatcctgcggaagagaaagctcgactattaccttcacaaacttctgccagaaatcctccagagcgcttcatttcttaccgctaacggagccctgtacatggcgttcttctgcatattgcgcaagattttgggcaagttttattcatggacccccggttttggagctgccttgcccgcatcatatgtcgcaatattgattgagcgaaagagtaggcgagggttgctgactatctatatggccaaccttgttctcctgttctgtatcaccgccgctatgtacatgttcttttttaggtgtaaggacggcctgaagggttttacttttagcgctctccgcttcatcgttggaaaagaggagatccccacacactccttcagtcctgaggcggcatatgcaaaggtggaacaaaaacgcgagcagcatgaggaaaaacccggacggatgaatatgatcgggctggtgagaaaattcgttgatagcatctgcaaacacgggccacggcatcgatgctgcaaacactatgaggacaactgcatcagctattgcatcaagggttttatccgcatgttcagtgtcggctacctcatccagtgctgtctgcgcatcccctcagcctttcgacatttattcacccagccatccagactcctgtcattattttataacaaggaaaactttcagttgggcgcttttctgggcagtttcgtttccatttacaagggaacgagctgtttcctgcggtggattagaaatctggatgacgaactacatgctataatcgccggttttctcgcaggtatcagtatgatgttttacaagtccacgaccatcagcatgtacctggctagcaaacttgttgagactatgtattttaaagggattgaggcgggaaaagtgccatactttcctcacgcagatactatcatatactctatatccaccgcaatttgctttcaggccgcagtaatggaagtgcaaaccctgcgtccaagctactggaagttcctcctgcggctcacgaaaggaaaattcgctgtgatgaacagaaaggtgttggacgtcttcggcacaggggcttctaaacatttccaggattttattcccagactggatcctcgatacacaaccgtgactcccgagcttccgacagagttctcgtag

SEQ ID NO: 55173 - DNA, 483 bp, Artificial Sequence
  Description of Artificial Sequence: Synthetic coding sequence
atggccgcactctccaagtctattccccataattgttacgagatcggccatacatggcacccgagctgccgagtgagttttctccagattactgggggagcactcgaggaatccctcaaaatctatgcccctctgtacttaatagcggctatcctccggaaaagaaaactcgattattatttgcataagcttctgccagaaatcctgcagagtgcctctttcctgactgcaaacggagccctgtacatggcttttttttgtattttgcggaagatattaggcaagttttattcctggaccccaggattcggcgctgccttgcccgcttcctatgtcgcaatcctgattgaaagaaagtcaaggcgcggactgctgaccatatacatggcgaacttgatggaatcacattgtctcccgcaagccggtgtcatcagtgcgccatgctctctgtgcttgcccggatctcgcgacagcccagcatag

SEQ ID NO: 55174 - DNA, 960 bp, Artificial Sequence
  Description of Artificial Sequence: Synthetic coding sequence
atgggggtggcacgaggtacaattaccactctgaggaacggcgaagtcctactgttttgcataacagccgcaatgtacatgtttttcttccgctgcaaggacggactgaagggttttacattcagtgctctcagattcatagtcgggaaggaagaaatccctacacattcgttttctcccgaggccgcatatgcgaaagtggagcagaaaagggagcaacacgaagaaaaacctggccgtatgaacatgattggtctggtgaggaagtttgtggatagcatctgcaagcacggccctcgacacaggtgctgtaagcattatgaggacaattgcatctcatattgcattaagggctttatacgtatgttttcagtcggttacttaatccagtgctgtctgcgcatcccaagcgcgtttcgacaccttttcactcaaccaagcaggctgctctctctgttctacaataaagagaactttcagctcggcgcatttctcgggtctttcgtgtcaatatacaaaggcacctcgtgctttctgcgctggatccgaaacctcgatgacgaactccatgcaatcattgcgggttttctggcagggataagcatgatgttctacaaaagcacaaccatctcaatgtacctggcctcgaaacttgttgaaactatgtacttcaagggaattgaagccggtaaggtcccatattttcctcatgcggacactattatttacagcatctccactgcgatctgtttccaggctgcagtgatggaggtacagaccctgcggccttcctattggaagtttcttctacgtctaacaaaggggaaattcgctgtgatgaatcgcaaagtgctggatgtctttgggacaggcgctagtaagcatttccaagatttcatacccagacttgaccctcgttataccacggttacacccgagttgcccaccgaattttcgtag

SEQ ID NO: 55175 - DNA, 888 bp, Artificial Sequence
  Description of Artificial Sequence: Synthetic coding sequence
atgtatatgtttttcttccgttgtaaggatgggttaaagggatttacattttctgccctgcgcttcattgttggtaaggaggaaatacccacccactccttcagtcctgaggcagcttacgctaaggtggagcagaagagggaacaacacgaagagaaaccaggacggatgaacatgatcggcttggtgaggaaattcgtggatagcatttgcaaacacgggcctcgccacaggtgctgtaaacactacgaggataactgtatctcatattgtatcaaaggattcatacgaatgttctcggtgggctatcttatacagtgctgtctccgtattccgtcagcctttcgccacctgtttactcagccctctcgactcctgagcttgttctataataaagagaattttcagttgggggctttcctgggatcattcgtgtccatatacaaaggaacttcatgcttccttagatggatccgcaatcttgacgacgagctccatgccatcattgcagggtttttggccggtatcagcatgatgttctataagtcaactactatctccatgtaccttgccagtaaactggtggaaaccatgtactttaaggggatcgaggctggcaaagttccttatttcccccacgcagacaccattatctattctatttctaccgcaatctgtttccaggccgcagtcatggaagtgcagacattgagaccctcatattggaaattcctgttacgtctgacaaaggggaagtttgcggttatgaatcgaaaggtccttgatgtatttgggacaggcgcatctaaacacttccaggacttcatcccgaggcttgaccctagatatacaactgtgaccccagagctgccgactgagtttagctag

SEQ ID NO: 55176 - DNA, 804 bp, Artificial Sequence
  Description of Artificial Sequence: Synthetic coding sequence
atgactcagtgctgcttcctcagagtccaccctctctttttctggttctggagttttcaccaccgtatggctttggccctttgtttacaagtgctatgctctctgtgcggctggctgagtctgtatatttccttctgtcatctgaacaaacaccgaagttatgagtggtcatgtcgcctggtaacattcacgcatggtgttctgagcattgggttatcagcatacattggattcatagacggcccatggccctttacccaccccggatctccaaacacaccactccaggtgcacgttctgtgcctgactctgggctattttattttcgacttgggatggtgtgtctactttcaatcggaaggtgctctcatgctcgcccatcacaccctcagcatattaggcataattatggccctggtcctcggtgagtcaggaacagaggtgaacgctgttctgtttggcagcgagctgaccaatccattactccagatgcggtggttcttgcgtgagaccggccattaccactcatttaccggtgacgtggtagacttcctcttcgtagcactcttcactggcgtgaggattggcgtgggagcctgtctgctgttctgcgaaatggtgtccccaacacccaaatggttcgtcaaagccggtggagtggctatgtacgctgtgtcatggtgcttcatgtttagtatttggagatttgcctggcgtaaatctatcaagaaataccacgcttggaggagcaggcgttctgaggagcggcagctgaaacataatggccatctgaaaattcattag

SEQ ID NO: 55177 - DNA, 738 bp, Artificial Sequence
  Description of Artificial Sequence: Synthetic coding sequence
atggctcttgccttgtgtctgcaggttctgtgctctctgtgtgggtggctctctctgtacattagcttttgccatctgaacaagcaccggagctacgaatggtcctgccggctcgtcacatttacgcacggtgtgttaagcatcggcctttccgcctatatcggcttcatagacgggccttggccttttactcatccgggatccccaaatactcccctccaggtgcacgttctctgccttacgttgggctactttatattcgacctgggatggtgtgtgtactttcagagcgagggggctttaatgctcgcgcatcacacccttagtatcctgggcatcataatggcccttgtgctgggggagtctgggaccgaagtcaacgctgtgctttttggtagtgagttaactaacccccttctgcaaatgcggtggttcttgagagagacaggacactaccactcattcactggggacgttgtcgacttcttgttcgtggcccttttcaccggcgttaggattggtgtgggtgcctgcctgctgttttgcgaaatggtgtctcccacccccaagtggtttgttaaggcgggtggagtagccatgtacgcggtgtcctggtgctttatgttttccatttggcggtttgcctggagaaaaagcatcaagaagtatcatgcttggcgcagtcggaggtcagaggaaagacagctgaaacacaatggccacctgaaaatacattag

SEQ ID NO: 55178 - DNA, 447 bp, Artificial Sequence
  Description of Artificial Sequence: Synthetic coding sequence
atgactcaatgttgctttttgagggtgcacccactctttttctggttctggtcctttcaccaccgcatggccctggccctgtgtctgcaggtgctgtgcagcttgtgtggctggttgagcttatacatatctttctgtcacttaaataaacatcgctcctatgagtggtcctgcaggttggtgacgtttacccatggggtgttatccatcggcctgagtgcttacattgggttcattgacggcccttggccctttactcacccaggctcaccgaacacgcctctccaggtccacgttttgtgcttaaccctgggatatttcatttttgaccttggttgtatatggaggtttgcatggcggaagagcattaaaaaataccacgcttggaggtccaggcgaagcgaggagagacagttaaagcacaatggacatcttaagattcattag

SEQ ID NO: 55179 - DNA, 651 bp, Artificial Sequence
  Description of Artificial Sequence: Synthetic coding sequence
atggtgccaatgcaccttctgggccgattagaaaaacctttactccttctctgttgtgctagctttttgctggggctggcccttttaggcattaagaccgacattacccctgtcgcctattttttcctgaccctgggtggcttctttttattcgcctatctcctcgtgcgctttctggagtggggcctccggagccagttgcagagcatgcaaactgaatcgcccggtccctcgggcaacgccagggacaatgaggctttcgaagtgcccgtgtacgaagaagcagtggtcgggcttgaatcccagtgtcgaccccaggagcttgaccagccgcctccctatagtacagtcgtcataccccctgcccctgaggaggagcagcctagtcacccagagggaagccgcagagcaaaattggagcagcgacgtatggcctcagaaggttcaatggcccaagagggctctccaggcagggctccaatcaacttgaggctgcggggtcccagagccgtctctaccgcccctgatctgcagtcacttgcggcagtgccaacgttggaacctctcactcctccccctgcctatgatgtctgcttcggacatcccgatgacgattctgtgttttatgaggacaactgggcccctccatag

SEQ ID NO: 55180 - DNA, 651 bp, Artificial Sequence
  Description of Artificial Sequence: Synthetic coding sequence
atggtgccaatgcatttgcttggtcgcctggagaagccactcttactgctctgctgtgcttcatttctcctgggactcgctctcctcggaatcaagactgatatcacgccggtagcatatttcttcttaaccctgggcggttttttcctctttgcctaccttcttgtccggtttctggagtgggggctccgatcacagctccagtctatgcagactgagtccccagggccaagcggcaatgctagagacaatgaggcatttgaggtcccagtctacgaggaagccgttgttgggctggagagccagtgcagaccgcaagaattggaccagccacccccttatagcacagttgtgattcccccagcccctgaagaagaacagccatcccatccagaggggagtagacgggcaaaactagagcaacgcagaatggcttctgaaggctcaatggctcaggaaggttcgcccggtcgtgccccaatcaatctccgtcttcggggacctagagccgtcagtactgccccagatcttcaatccctggctgccgtccccacactggagccacttacgccaccgccagcctacgatgtttgctttggacatccagacgacgactctgtgttctacgaggacaactgggcacctccctag

SEQ ID NO: 55181 - DNA, 651 bp, Artificial Sequence
  Description of Artificial Sequence: Synthetic coding sequence
atggtgcctatgcaccttctgggtcggctggaaaaaccccttcttctcctttgctgcgcttcattcctgctaggcctggccctcttaggtattaaaacagatattacccctgtcgcctacttctttctgaccctaggaggattctttctatttgcctaccttttggtccggtttctggaatggggattaagatcccaactccagtctatgcaaaccgagagccctgggccttcaggaaacgctagggacaatgaggctttcgaggtgccagtctacgaggaggccgtggtagggctcgagtcgcagtgtcgtccccaggagctggatcagcctcctccttacagtactgtggttatccctcccgcacctgaggaggaacagccctcacacccagagggctcacgacgcgctaagctggagcaacgacgtatggccagcgagggatccatggctcaagaaggatctcctgggcgagctcccatcaatcttcgtttgcggggacctcgcgcagtgtccacagctccagacctgcagagcctcgctgccgtgcctactctcgagccactgacccctcctcccgcatatgacgtgtgctttggccaccctgacgacgatagtgtattctacgaagataactgggcacctccatag

SEQ ID NO: 55182 - DNA, 651 bp, Artificial Sequence
  Description of Artificial Sequence: Synthetic coding sequence
atggtccctatgcatctgttgggacgcttggagaaaccactcctgctgctctgctgcgcctcctttctcctagggctggcattactgggaattaagacagacatcaccccagtagcgtatttttttctcactctcggtggtttcttcctgttcgcttacttactggtccgctttttggaatggggactaaggtctcagctgcagtcgatgcagaccgagagccccggaccctccggaaatgccagggacaatgaggcctttgaggtgccggtttacgaggaggctgtggttgggctcgagtcccaatgcagacctcaggaactcgatcagcctccaccttacagcactgtcgtgatccccccagcgcctgaggaggaacagccctcccatccagagggtagccgaagggcaaaactggaacagagacgcatggctagcgaaggttcaatggcgcaggaaggcagtcctggaagagcccctatcaacctcaggcttagggggccacgcgctgtgtccactgcccctgatctgcagtctctggctgccgtacccacacttgaacctctgactcctcccccagcttacgatgtgtgcttcgggcatccagatgatgactccgtcttttacgaggataattgggcccctccgtag

SEQ ID NO: 55183 - DNA, 651 bp, Artificial Sequence
  Description of Artificial Sequence: Synthetic coding sequence
atggtgcctatgcaccttctggggaggctggagaagccactgctcctgctgtgttgcgcctccttccttctggggctcgcactgcttggcatcaagacggacattacacccgtcgcctatttcttcctgaccctgggcggtttctttttattcgcgtacctactagtgaggtttttggagtggggtttaaggtcccagctgcagtcaatgcaaactgaaagtcccggtccctctggtaacgccagagataatgaggcattcgaagtccccgtgtatgaggaagcagttgttggactggaatcccagtgccggcctcaagaacttgaccagcctccaccatactctacagtggtcatccctccggctccggaagaggaacagcctagccaccctgagggaagccggagagcaaagctggagcagcgaaggatggcaagcgaaggcagcatggcacaagaggggtcaccaggacgtgccccaattaatttgagactgcgtggccctagagccgtgagtaccgctcccgaccttcagtctctggcagcggtgcccaccctcgagcctttaacgcccccacctgcctatgatgtgtgcttcggccatccggacgacgatagtgtgttctatgaagataattgggctcctccatag

SEQ ID NO: 55184 - DNA, 558 bp, Artificial Sequence
  Description of Artificial Sequence: Synthetic coding sequence
atggccggacctagacctagatggcgtgatcagctgctgttcatgagcattattgtgttagtgatcgtggtgatctgcctgatgttctacgccctgctctgggaggccggtaatttaactgaccttccaaacctgcgaataggattttataacttttgcctgtggaacgaggatacgagtacactccagtgccaccaatttccggaactcgaagcactcggcgtacctagagtcggtctgggcttagcacgactgggtgtctacggttcactggtcctgacattatttgcgcctcagccacttttacttgcccaatgtaattcagatgagcgagcttggcggctggcagtggggtttctcgctgtctcttcggttctgctggcaggaggtctggggctatttttgtcctatgtgtggaagtgggtgagactgtccctgcccggacctggcttcttagccttgggaagtgctcaagcccttctgattctgctgctgattgccatggccgtcttccccttgagagctgagagagctgagagcaagcttgagagctgttag

SEQ ID NO: 55185 - DNA, 447 bp, Artificial Sequence
  Description of Artificial Sequence: Synthetic coding sequence
atggcaggaccacggccacgatggcgggatcaactgctatttatgtccatcattgtattggtgatagtcgtgatttgcttgatgttttatgctctgctgtgggaagccggtaacctcaccgaccttccaaatcttaggattgggttctacaatttttgtctgtggaatgaggacacaagcacattgcagtgccaccaattcccggaactggaagccctgggtgtgcccagagtcggcctgggcctggcacgactcggtgtgtacggttcgctggtcttgactcttttctttctgtcttacgtctggaagtgggtgcgactctctctaccaggtcctggcttcctggcactgggcagcgctcaggctttactgatcttgctgctaatcgccatggcggtatttcctctgcgggcagagcgcgcagaaagcaagctggagtcttgttag

SEQ ID NO: 55186 - DNA, 327 bp, Artificial Sequence
  Description of Artificial Sequence: Synthetic coding sequence
atggtaaatctaggcctatcacgcgtggacgacgcagtggccgcaaaacacccagggttgggagagtatgccgcatgccagtctcatgcttttatgaagggggtgttcactttcgtcacaggaacggggatggcgttcgggctgcaaatgttcatccagcgaaagtttccttatccactccagtggtccttgctagtggccgtcgtggcgggtagtgtcgtaagctacggcgtaacacgcgtcgaaagcgaaaaatgtaacaacctgtggctcttccttgagactggacagcttcccaaagatcgtagcaccgaccagaggtcatag

SEQ ID NO: 55187 - DNA, 1380 bp, Artificial Sequence
  Description of Artificial Sequence: Synthetic coding sequence
atgacggtggaactgtggcttaggcttagggggaaaggactggccatgctgcacgtgactcgaggagtttggggctcccgcgtgagggtgtggcctttgttacctgcgttactgggcccacccagggctctcagctcactcgctgccaaaatgggggagtacaggaagatgtggaacccacgcgagcctcgagattgggctcaacagtatcgcgagagatttattcccttttcaaaggagcaacttctgaggcttcttatccaagaatttcactcgtcccccgctgaaaaagccgctctcgaggcctttagcgcccacgtggatttttgcactctgtttcactatcatcagatcctggcaaggctccaggcgctctacgatcccattaacccggatagagaaacactggatcagccatccttgacggacccacagcgcttatcaaatgagcaagaggtcctcagggccctggaaccgttgctggcacaagcaaatttctcccccctgtccgaagacactctagcgtatgccctggtggtccatcacccccaggacgaggttcaagttaccgtaaatttggatcaatacgtctacattcatttttgggcactcggccagcgcgttggccagatgccccttaagagctccgttggatcacgacgaggcttttttaccaaattgccacctgccgagagaaggtacttcaagagagttgtgctggccgctcggactaaaaggggccatctcgtgctgaagtcattcaaagacacacctttggagggcttagaacaattattacccgagctcaaagtgcgaacccctaccctccagcgagccctgctgaacctgatgctggtggtttccggggtcgccatttttgtgaatgtcggtatggtggttctcacagaccttaaggtcgccacttctctcctgctcctgctctttgccattttcatgggcctgcgcgcatccaaaatgtttggccagaggcgcagcgctcaggccctggagctggcgcacatgctctactacaggagtacatccaataattctgagttgctttccgccctggccctgagggcacaggacgaacatacaaaggaagcgctcttggcgcattcctttcttgcgagacgcccaggcggaactcagggcagcccagaagagacgtcccggtggctcaggtcagaggtggagaactggcttctggctaagagcggatgcgaggtcacattcaatggcacacgcgctctagcacatctgcaggccctgaccccgagcatgggcctctatcccccaccaggatttccaaagctcgatccagttgctccaatcactagcgaaccccctcaggctacaccaagttccaacatttcctag

SEQ ID NO: 55188 - DNA, 1080 bp, Artificial Sequence
  Description of Artificial Sequence: Synthetic coding sequence
atgacagtagagttgtggctgcggttacgcggaaaggggttggccatgctacatgtaacacgcggagtatggggcagcagagtcagggtttggcctctgttgcccgcattgctgggccctccgagagcgttaagttctttggccgctaagatgggcgaatacagaaagatgtggaacccccgtgagccccgtgactgggctcagcagtaccgggagcgcttcatccccttttcaaaagaacagcttcttagactgttgatccaagtgacagtaaacctcgatcagtatgtttatattcacttttgggccttaggccagcgagtgggtcaaatgccccttaagagctcagtcggcagcagacgtggcttctttacgaagctgcctcctgccgagagaaggtactttaaaagagtggtgttggcagctaggaccaaaagggggcaccttgtgctgaaatcctttaaagacacaccactggaggggctggagcaattgctgcctgagttaaaagtgagaacccccaccctgcagcgcgctttgctgaatctcatgttggtcgtgtctggggttgccatatttgtcaatgtagggatggtagtgctgacagacctcaaggtggcaacctccttgctcctcctgctgttcgctatcttcatgggcctgcgcgcttctaagatgttcgggcagcgaagatccgcccaggccctagaacttgcccacatgctctattaccgatctacttctaacaatagcgaactgctatccgctttggctctccgagctcaggacgagcataccaaagaggctttgctagcacacagcttcctggcacgccgacccggaggcacacaaggttcacccgaggagaccagtcgatggctccgcagtgaggtggaaaattggttgctcgccaagtctggttgcgaggtgacttttaacggcacaagggcactagcccacttgcaggccttaactccaagtatgggcctgtaccccccacccggttttcctaaattagaccccgtggcccctatcacatccgaaccaccacaggccaccccaagctctaacatctcgtag

SEQ ID NO: 55189 - DNA, 1275 bp, Artificial Sequence
  Description of Artificial Sequence: Synthetic coding sequence
atgacggttgagctgtggttgaggctgcggggaaagggactggccatgctgcatgttactcggggtgtgtgggggtcccgagtgagggtttggccgctacttccggctctcctcgggcctcctcgtgcccttagctctttagctgcaaaaatgggcgagtataggaagatgtggaacccaagggagccaagagactgggctcagcagtacagggagcgctttattcctttcagtaaagaacaactgctcagacttcttatccaggccctgtatgacccaatcaatcccgacagggaaactctggaccaaccaagcctgactgacccacaaaggctgagtaacgaacaggaagtcttgagggccttggaacctctcctggcacaggccaatttcagccccctgtccgaggatactcttgcgtacgccctagtggttcaccacccacaggatgaggtgcaggtgactgtcaatctggaccaatacgtgtatattcacttctgggccctcgggcagcgagtgggacaaatgcctttgaaaagctccgtgggctcccgcagaggtttttttacgaaactgccaccagccgaacgtagatacttcaaacgcgttgtgttagctgcaagaacgaaacggggacacctagtgctgaagtcctttaaggacacaccactcgaaggcctggaacaattgcttcccgaactcaaagtgcgcacccctaccctgcagagagccctgctgaacctcatgctagtggtgagcggcgtggccatcttcgtcaacgtgggtatggtggtgctgacagatctcaaggtcgcgacaagtctgctgttactattattcgcaattttcatgggtcttcgggcatcaaaaatgttcggtcagcgccgatcagcgcaggcccttgaattggctcacatgctgtattatagaagtacctccaataactccgagctgctgtctgcactggcacttagggctcaggacgagcatactaaggaagcactcctggcgcatagcttcctcgcccgacgccctggtggcacccagggcagccccgaggaaacaagtaggtggttgcggagtgaagtggagaattggctcctagccaaatcagggtgtgaggtaacgttcaatgggacgagagccctggcacatctccaggccctgaccccttcaatggggctgtatccccctcccggtttcccaaagctcgaccccgttgcacctatcacctctgagcctcctcaggctacaccctctagcaatatttcctag

SEQ ID NO: 55190 - DNA, 1185 bp, Artificial Sequence
  Description of Artificial Sequence: Synthetic coding sequence
atgaccgtggagctttggctgcgtctgcggggtaagggactggccatgcttcatgtcaccagaggcgtttggggatcgagggtacgcgtgtggccattactacccgctctgcttgggcctccgagggcgctgagtagcctggcagctaagatgggcgagtaccggaaaatgtggaatcctagggagccgagggactgggcacagcagtatcgggagcgttttatccccttctctaaagagcaactgctgcgtctgctgatacaggaatttcactcctcccctgcagagaaggccgcactcgaagctttcagcgcacatgtagacttttgtacgttatttcactatcatcagattttagctaggcttcaagtgactgtcaacctggatcaatatgtgtatattcatttctgggctctcggtcagagggtaggacagatgcccctgaagtcatctgtcggttctcgccgaggatttttcacaaaacttccgccagccgagagacgctactttaagcgggtggtcctcgccgcaagaacaaaacgtgggcatctggtgctgaaaagtttcaaggacacaccactggagggtctggaacaactcctgcctgaactgaaagtgcggacaccaactctgcagagggctctcttaaaccttatgctggttgtgtctggagtggcaatttttgtgaacgtgggtatggttgtgctgacagacttaaaagtagccacaagcttactgttgttgctcttcgccatctttatgggccttagagccagcaaaatgtttggacaacggcgaagtgcccaggccctggaactagcccacatgctgtattaccgaagtacatctaataatagcgagctcctttccgccctcgctcttcgggcacaggacgagcacaccaaagaggccctgttggctcatagttttttagccaggagaccagggggaacccagggatccccagaggagacttcacggtggcttcgttcggaagtcgaaaactggttgctcgccaagagcgggtgcgaggtcacattcaacggaactcgtgcacttgctcacctccaggccctaactccatcaatgggattgtacccgcctccaggttttccaaaacttgaccctgtggcccctataacctcagaacctccccaagctaccccatcgtccaacattagttag

SEQ ID NO: 55191 - DNA, 1050 bp, Artificial Sequence
  Description of Artificial Sequence: Synthetic coding sequence
atgcgcaggcgcttaaacgacagcagggccctggcgaaggctctgtatgatcccattaacccagacagagagacactggaccagccaagcctaaccgatccacagagactgagcaatgagcaggaagtccttcgagcactagaacccctcctcgcacaggctaatttctcacctttgtctgaggacacactggcatatgctctagttgtccatcatccgcaagatgaagtccaggttacggtgaatctggaccagtacgtttatatacatttctgggccctcgggcagagggtgggccagatgcccctgaaatccagtgtcggttcccggaggggcttcttcactaagctgcccccagctgagaggcgatatttcaagcgagttgtccttgcagcgaggacaaagcgaggacatctggtgctgaagtcattcaaagacactccactcgagggattggagcaactcttaccagagcttaaggttcgaacccctaccctgcagcgggctctcctgaatctaatgctggtggtgtctggcgtggctatcttcgtcaacgttggcatggtggtgctgacggatttgaaggtcgctacgtctctgctgctcctgcttttcgctatcttcatgggccttcgagccagcaagatgttcgggcagcgccgatccgcacaggcactggagcttgcccacatgctctactacaggtctaccagtaacaattcagaattgctcagcgccctggctctgcgcgcacaagacgaacacacaaaggaggctctactggctcattctttcctggcacgacggccaggcggaacacagggatccccagaggagaccagccgttggctgaggtctgaagtcgaaaactggctgttggccaagagcggatgcgaagtaacctttaatgggaccagagccctggcacatctccaggctttgacacctagcatgggcttgtatccccctccaggatttccgaaactagaccctgttgccccaattacatccgagccaccacaagctaccccaagctcaaacataagctag

SEQ ID NO: 55192 - DNA, 1038 bp, Artificial Sequence
  Description of Artificial Sequence: Synthetic coding sequence
atgagtaacaacggggcagatctgacattcggttacataagttgcttcgtcgccattctgctatttggctccaactttgttcctttgaagaagttcgacacgggagacgggatgtttcttcagtgggtactttgcgctgccatatggctggtggcactggtggtcaacctgattctccactgtcccaagttctggcctttcgctatgctcgggggatgcatatgggcgacgggtaatatagccgttgtgcccattatcaaaacaattggtctcggcctgggtatccttatatggggctctttcaacgccttgacaggctgggccagctcacgattcggctggtttgggctcgatgcagaagaagtgtctaaccccctgctcaactatataggggcagggctctccgttgtatccgctttcatttttctattcattaagtctgagattccaaacaacacttgctctatggatacaaccccgctgataacagagcacgtcatcaataccacccaggatccgtgcagttgggtagataagctgagcaccgtccaccatcgcattgtcggttgttcacttgctgtgatttctggtgttctgtacggatccacattcgtcccaattatttatataaaagaccatagcaagcgcaatgacagcatatatgctggggcaagtcagtatgatcttgattacgtcttcgcacacttctctggcatctttttgacctcgactgtatacttcctcgcctattgtatcgctatgaagaattctcccaagctgtatccagaagcagtgctcccaggcttcctctcaggagtgttgtgggccatagcaacttgttgttggttcatcgccaaccactccctgagcgccgtggtgagctttcccattattaccgctggtcccggttttatcgctgcgatgtggggaatctttatgttcaaggagatcaaagggctccagaattacttactgatgatcctggccttctgtatcattctcacaggggctctatgtactgccttcagcaagatctag

SEQ ID NO: 55193 - DNA, 234 bp, Artificial Sequence
  Description of Artificial Sequence: Synthetic coding sequence
atgtccaataacggggcagacctcacgtttgggtacatcagttgttttgtggccatcctgctgttcggcagtaattttgtgcccttgaaaaagttcgatacaggcgatgggatgtttctgcagtgggtcctttgtgccgctatctggctggtggccttggttgttaatctaatcctgcactgtccaaagttctggccgtttgccatgctcgggggatgcatctgggcaacctag

SEQ ID NO: 55194 - DNA, 333 bp, Artificial Sequence
  Description of Artificial Sequence: Synthetic coding sequence
atgtccaataacggagctgacttgactttcggatatattagctgctttgtagctatactgctttttgggagcaattttgtccccttgaagaagttcgacacaggagatggtatgtttctgcagtgggtactatgcgctgcaatctggctcgtggctctcgtggtaaatttgatactgcattgtcccaaattttggccttttgcgatgctgggtgggtgtatttgggccactgggaacatcgccgtggtacctattatcaagacaattgggttgggcctgggaattctcatctgggggagcttcaatgccctgaccggatgggcaagttcttag

SEQ ID NO: 55195 - DNA, 414 bp, Artificial Sequence
  Description of Artificial Sequence: Synthetic coding sequence
atgtcgaacaatggggctgatttgaccttcggttatatctcttgcttcgtggcaattttgctgtttggttctaattttgttcccctcaagaagtttgacacaggcgatgggatgtttcttcaatgggtactgtgtgctgctatctggctggtggctctggtggtgaacctgattcttcattgtcctaaattctggcctttcgcaatgctgggcggatgtatttgggccactggtaacatcgcagtcgtgcctataataaagacaataggtcttggcctgggcatactcatctggggctcctttaacgccctaacggggtgggcctcatctcgctttgggtggtttggtttagacgcagaggaggtgagcaatcctctcctgaactacatcggagccggactgagcgtcgtgtag

SEQ ID NO: 55196 - DNA, 234 bp, Artificial Sequence
  Description of Artificial Sequence: Synthetic coding sequence
atgagtaacaatggggcagacctgaccttcggatatatcagttgtttcgtggcaatcttactctttgggagcaacttcgtgccccttaagaagttcgacaccggtgacggaatgttcctacagtgggtcctatgtgccgctatatggctggttgccctcgtggtgaatctcattctccattgccctaagttctggcccttcgccatgctcggcggatgcatctgggccacctag

SEQ ID NO: 55197 - DNA, 264 bp, Artificial Sequence
  Description of Artificial Sequence: Synthetic coding sequence
atgtcgaacaatggggctgatctcacattcggctacatatcatgctttgtggcaattctgctcttcggctccaactttgtgcccctgaaaaagttcgacactggggatgggatgttcctccagtgggtgctttgcgcagccatctggcttgttgcactggtagtcaatctcatcctgcattgcccaaaattttggcctttcgccatgctgggaggctgtatttgggccactggtaacatcgccgtggtgccaatcattaagtag

SEQ ID NO: 55198 - DNA, 504 bp, Artificial Sequence
  Description of Artificial Sequence: Synthetic coding sequence
atgtccaataatggcgctgaccttactttcggttatattagctgcttcgtggcaattcttctgttcgggtctaatttcgtacccctgaagaaatttgacactggcgacggaatgttcctgcaatgggtcttgtgcgccgcaatatggctggtggcattggtggtgaacctgatcctgcactgtcccaagttttggcctttcgccatgctggggggatgcatatgggccacaggaaatatcgctgtggtacccataattaaaaccataggcctgggcttaggcatcctaatatggggctccttcaacgccttgaccggatgggcttcctcccggttcggttggttcggcctggatgcagaggaggtttccaacccccttctaaactatataggggcaggcctctctgtggtcagtgcatttatcttcttgttcattaagtccgagatacccaataacacatgctcaatggataccactccgctgatcactgagcacgtcatttag

SEQ ID NO: 55199 - DNA, 33 bp, Artificial Sequence
  Description of Artificial Sequence: Synthetic coding sequence
atgagtaacaatggagcagatttgaccttttag

SEQ ID NO: 55200 - DNA, 264 bp, Artificial Sequence
  Description of Artificial Sequence: Synthetic coding sequence
atgagtaataatggagcagatcttacgttcggatatatctcctgctttgttgccattctcctgtttggttctaatttcgtgccactcaaaaagtttgataccggggatgggatgttcctgcaatgggtgttgtgtgccgctatctggctagtggcattggtggtcaacttgatccttcactgcccgaaattctggccatttgccatgcttggaggctgtatttgggctacagggaatatcgccgtggtgccgataattaagtag

SEQ ID NO: 55201 - DNA, 510 bp, Artificial Sequence
  Description of Artificial Sequence: Synthetic coding sequence
atgtcaaacaatggagccgacctgacattcggttacatcagctgttttgttgccatcctgctgttcggaagcaatttcgtgcctttgaaaaagtttgataccggtgatggcatgtttttacaatgggtgctatgcgcggcaatctggcttgtagccctggtagtcaacctcattctgcactgcccaaagttttggcccttcgccatgctgggcggatgcatatgggctaccggcaatatagctgtggtgccaatcatcaaaacaatcggcctggggcttgggattctcatttgggggagtttcaatgccctaacaggctgggcctctagccggttcggctggttcggcctggatgccgaggaagtcagtaacccactactaaactatatcggagccggactgtctgtggtgagcgcttttatcttcctctttattaaatccgaaatacctaacaatacctgttccatggacaccaccccattaatcactgagcatgtttccatagtttag

SEQ ID NO: 55202 - DNA, 276 bp, Artificial Sequence
  Description of Artificial Sequence: Synthetic coding sequence
atgtctaacaacggagctgatctaacattcggctatatttcctgctttgtggcaatcctgctgtttggttccaattttgtgcccctgaaaaagtttgacacaggtgacggcatgtttctgcagtgggtgctctgtgcggctatttggctcgtagcactggtcgtgaatctaatcctccactgcccaaaattctggcccttcgcgatgttaggcggttgcatctgggctacagggaatatcgcggtggttccaatcataaagactattggcttgtag

SEQ ID NO: 55203 - DNA, 1482 bp, Artificial Sequence
  Description of Artificial Sequence: Synthetic coding sequence
atggagccactcagggctcctgcgttgcgtcgattacttccgccactgctgctactgctactcagtctgcctccacgtgcccgtgcaaaatacgtgagaggcaacctgagcagcaaagaagactgggttttccttacccggttttgttttctttcagactatggccgtttggatttccgcttccggtatcctgaggcaaagtgctgtcaaaatatcctgctttactttgatgatccgagccagtggccggctgtgtataaggccggtgacaaagactgcctcgccaaggagagcgtgattcggccagagaacaatcaggttattaacttaacgacccagtacgcgtggtccggctgccaggtggtttcagaggagggcaccagatacctgagctgctcttccggcagaagctttcgctccggagatggcctgcagctggaatacgagatggtgttaactaacggaaagagcttttggacaagacactttagcgctgacgaattcggaattctcgagaccgacgtgaccttcttgctgatatttattctgatctttttcctttcctgctatttcggctacttgctgaaggggaggcagcttctacacaccacctacaaaatgtttatggctgctgctggggttgaagtgctgtccctgctgttcttctgcatctattggggacaatatgctacagacgggataggtaacgagagcgtgaaaattcttgccaaacttctcttcagctcatccttcttgatcttcctgctaatgctgatcctgttaggcaagggctttactgtgacgcgaggtagaatcagccacgccggttcagtcaaattgtctgtctatatgaccttgtataccctgacccacgtcgtactgctcatttacgaggcggaatttttcgaccctggccaggttctgtacacctatgagagcccagccggatacggcctgattggtctccaggtggccgcttacgtctggttctgctacgccgtgttggtgtcgctacgccactttcctgaaaagcagcccttctatgtgccattctttgctgcctataccctttggttcttcgcggtccccgtgatggccctgattgctaacttcggtattcccaagtgggcccgagaaaagattgttaatggcattcagttggggattcacctctacgcccatggggtgttcttgataatgacgcggccttccgcagccaacaaaaactttccttatcacgtgagaaccagccagatcgccagcgcaggagtccctggcccaggcggatcccagagcgccgacaaggcattcccccagcacgtttacggcaacgtaacctttatatctgactccgtccccaactttaccgagcttttttccatcccaccccctgctacatcacccctgccaagagccgctcccgactctggtcttcctctatttcgcgatcttcggcctcctggcccactgcgcgacttgtag

SEQ ID NO: 55204 - DNA, 1404 bp, Artificial Sequence
  Description of Artificial Sequence: Synthetic coding sequence
cggcttagacattgcaccccgacatgggcgacagaacctgacagtgttaagaagaagcgtaacaggaagagatcaggtgctgtggcccacaactgtaacctgaagcattttggcagaccaaggtgggaggaccacctatgtcccggtatttgggatcaacgaggaaatattattgagtttctcacgggagaatttatttatcggatgtacacaattgacatgcattcccaactcgagctgaccgcttccttgatacctcaacccggaacaagcctcattccacttgtgatggtgtccaacccccacagtctcggatttcaagctacattttacgaaaacggatatacgtctgacgggaatacaaagtataagttggacatttttctcaagcagcagcaacactgggggaggacagactctaattttacttcgagcctgaagaaggcaactatgtccactctgacggttgatatcgccaataaagagatcagctgtgtggacataaaaccgttgtccaccctaatatcagtcggatgcgatctggacaaaaagattgtgatccagaataaagtgtctgcttgtagtatgggaatccttgacccactcaccctccaagataactattctttcatcattgagaaagaattttacgacccgggattccaggggcagcagtcctccgaggatctgcacgttttttactcctaccaacagctaggatgccctctcctggtatactatgatacgttatggaagcccgtggtggaactctggcggaaagattcgttccaggaggtgatcgatgccgaatacgttctgttagaagtcaatggacagtttagctatagttacagcctgactgcacagtcggccatgtgcacctcacaaccgcagaattggaccaccatgattaaggaatttggcggacctttcttttggaaccgggagaattacgtgtcatgccatgatcctaacaataatgccccactgcgatggccagacgttcaataccaaatcctcggcggtaggacagcaaatcagatcattttcggacataatgggttctacgtgttctacatttcaatagtggacccctattactcctattgtcagctcgaaaccatcttctccatctacgtttatggcgcattccccgtccagctggtgtccgctggagtggtcatcctgttaataataagctctattttgggatctgtctggttggcatataagacccccaaattgttaagaaccgctcgcggaagaagaattaaaaaatgcgccactcagttatgtaggcggtgtaagacagtttgccagttccgagcttctgccaccgctagggctggtaccgaacctcccggacggcatcgaacaccacatggtggccgaagtgaccactag

SEQ ID NO: 55205 - DNA, 1080 bp, Artificial Sequence
  Description of Artificial Sequence: Synthetic coding sequence
atgttcaggagccccggaactttggagattctcacgcccctgagagatacagccttccccgcatttgatttccaaaagtgcctagtgaacatccaagcactacttatggaccccgaactgcacgttggtaaatgcaagatcgagtttctcacgggggaatttatctataggatgtataccatagacatgcacagtcagctcgagcttaccgcgtcgttaattccgcagcccggaacctcccttatccccctggttatggtgtcaaatccccattccttaggattccaggcaacattttatgagaacggctacacatctgacggaaatacaaagtacaaattagatatctttcttaagcagcaacagcattgggggaggacagactctaattttacctcatcgctgaagaaagctacgatgagtacgttaacagtggacattgccaacaaagaaatctcatgcgtagacattaagcccttgtctaccctcataagcgttggctgtgaccttgataagaaaatcgtcattcagaacaaggtttctgcttgttccatggggattctggatcctctgactttgcaggataattactcattcattattgagaaagaattctatgacccaggcttccagggccagcaaagtagcgaagatctccacgtgttctacagctaccaacagctgggttgcccgctgcttgtgtactacgacactctctggaaacctgtagtggaactgctagaaagctccggaatgaacaccgtacactgttcattgaacctgcccggttcatctggtccaccagcttccgcctcgcaagtcgcagggacagcagtggcctaccacaatgcgagactgatcttcttctttttcttcttcttctttttcttacgacagagcctcgcgttaagccctaggctcgaatgcagtggagtcattctggctcaccgtaagctgtgtcttcctggcagtaggcactcccctgcctcagcaagcagggttgctggcattacgggggcaagacactgcgctagactgatcttctttatcttttctcgggatagagtttcgccttgttag

SEQ ID NO: 55206 - DNA, 2397 bp, Artificial Sequence
  Description of Artificial Sequence: Synthetic coding sequence
atgctgatgctgatgctagtggcggcagtaaccatgtggctgagacctctagttaccgctcagctgtgccgaagccggaccgtcagaactggtaaggtgtttaacctcatacaggatgtgcaaggtgaccgcttatacttccatcctaccaccactagattaatcaaacacccctgtgagaaaaacatcgcattgtacctcggaaagcaagttttcttcactatggacaatttcgagacaagcctgctccccttcacaatccctacctcaatgcaggtgggggtccccgaagtgacctctgcacattttgcgggttccctgctactgctggtggtagaccagaaagtttatatttacgactatgagaacaactcatggtcaatgagcctggggatcaaacacccagtcacccacgtgagtggagacaattgctgttatacggggtccttattctgcgtccacgtttcaaacctcgtcttcgcatactttcggggagaccagatctctcagacatacatctattactctaatacaggagggttttctttctggaaatatcattacgatcggcaggcagagattatcggctccctggggggtatattccatttcttttccctttctcaggtggctatgcttgtcgtgaatcagggcaagggaatgttcaagtattctgaccatcccctgaatcgctcctttggacttagttttgattacaatggcacactggacattctgatcgctccaggtcaaaggggtattctcttattgtggttcgagaacagcctgttgtttagccataatgctgggcaacttgtggacactgtgcgagttaagaagggagatcagactctcttttcttcaatttttgaagcgaagattacgatccacaatatcgcagtgacagaaaacgagcttgccgtcattaccagagaggacaacttgtactacggcaatctgggaattgttcccagcagcatcattaaattcgccgaccaatatatatggagcgaggatgtggctctcatgtttcggagtcccggaactcttgaaatcttaactccgctcagagacaccgccttccccgcatttgatttccaaaagtgtcttgtcaatatacaagctctgctgatggatcctgagctgcatgtagggaagtgcaaaatagagttcctcaccggcgagttcatttacaggatgtatactattgacatgcactcgcagttagaacttaccgcttcattgattcctcagcctggcactagccttatccctctggtgatggtctctaacccccactctctcggtttccaggctaccttttacgagaatggatacacctctgacggcaacaccaaatacaaattagacatttttctgaaacaacagcagcattggggcaggacggactctaactttacgtcttctctcaaaaaggcaacaatgtcaaccctgacggtggacatcgccaacaaggaaatcagctgtgtagatattaagccattgagcaccttgatcagcgtcgggtgcgatctagacaaaaagattgtgatccagaataaggtgtcggcctgttccatggggatcctggacccactgacgcttcaggataactatagcttcattattgaaaaagaattctatgatcctggatttcagggccagcagtccagcgaagatctgcacgtcttctattcatatcagcagcttggctgtccactactggtgtattacgataccctctggaagccggttgtagagttatggagaaaagactcattccaagaggtgatcgacgcggagtacgtccttctcgaggtcaatggccaattcagctactcatatagtctgaccgcgcagtccgccatgtgtaccagccagcctcaaaattggacaaccatgatcaaggagtttggcggacctttcttttggaatcgcgagaactatgtcagctgtcatgaccctaataataacgccccactgcggtggcccgacgtgcaataccaaattcttggcggacgcacagccaaccagataatcttcggccacaacggattttacgtgttttatatctccatcgttgatccatactatagctactgtcagcttgagaccatttttagcatttatgtatatggcgctttccctgttcagcttgtgtcagcaggggtagtcattttgttgatcatctcaagtatattagggtctgtatggctggcttataaaacccccaagcttttacggaccgctagaggcagacgcatcaaaaaatgtgccacacagctgtgcaggcgatgtaagactgtatgccagttccgcgcttctgcaaccgcacgcgctggaacagaaccccctggcaggcatcgtacaccgcatggcggaagaagcgatcactag

SEQ ID NO: 55207 - DNA, 777 bp, Artificial Sequence
  Description of Artificial Sequence: Synthetic coding sequence
atggccagcgcagctgctgctgaagccgaaaaaggatccccagtagtggtcggcttgcttgtggtgggaaatattatcatcctgctgagcggattaagtttgtttgccgagaccatttgggtgaccgccgatcagtaccgcgtgtaccccctgatgggggtttccggaaaggacgatgttttcgccggtgcttggatcgccatcttctgtggatttagtttttttatggtggcctctttcggagttggagcagccttatgcagacgcagatccatggtgctaacgtacctggtgcttatgttgattgtgtacatttttgaatgcgctagttgcatcaccagctatacccacagagattacatggtgtctaaccccagcctaatcacaaagcagatgctcaccttctatagcgcagacacggaccaggggcaggagttaacccgactttgggatagagtcatgatcgaacaggagtgctgcggcacttctggacctatggattgggtgaattttacttccgcttttagagccgcaacgcctgaggtcgtctttccatggcccccattatgttgccgacgcactggcaattttatccccctcaatgaggagggttgtcgacttggccacatggattatctgttcacgaaggggtgttttgagcatattgggcacgccattgattcatatacatgggggatcagttggtttggattcgccatcttgatgtggaccctccccgttatgctcatagcgatgtatttctacaccatgctgtag

SEQ ID NO: 55208 - DNA, 528 bp, Artificial Sequence
  Description of Artificial Sequence: Synthetic coding sequence
atgctgtttctagcaacatttttcccaacgtgggaagggggtatatacgacttcatcggtgaatttatgaaagcatctgtcgatgtggccgacttgattggactcaacttggtgatgagccgcaatgccggaaagggagaatacaagattatggtcgctgctctcgggtgggccactgccgagttgattatgtccagatgtatccccctgtgggtgggagctcggggaattgagttcgattggaagtatatacagatgtcaatagactcaaacatcagcctcgttcattacatcgtggctagtgcacaagtatggatgatcacaaggtacgatctctatcatacatttcggccagctgttctcctccttatgtttctcagtgtgtacaaggccttcgtcatggaaacattcgttcacctgtgctccctgggctcatgggccgctctgcttgcacgggcagtggtcacaggcctcctggctctatctaccctcgctttatacgtcgctgtcgtgaacgtgcacagctag

SEQ ID NO: 55209 - DNA, 555 bp, Artificial Sequence
  Description of Artificial Sequence: Synthetic coding sequence
atgaccctatttcattttggcaactgctttgccttggcatacttcccctatttcattacgtataagtgctcagggctgagcgaatataacgctttctggaagtgcgttcaggccggagtcacctatttatttgtccagctgtgcaagatgttgtttctcgctacatttttccctacatgggaaggcggtatctatgactttataggtgagtttatgaaggcatctgttgatgtggccgacctgataggattgaacctggtgatgagccgaaatgcagggaagggcgagtataagatcatggtggccgcactcggttgggctaccgcagaactcattatgtccagatgtatacccctttgggtgggcgctcggggtattgagtttgactggaagtacatccagatgagtattgacagcaacatttccttggttcactacattgttgcctccgctcaagtgtggatgattacaagatatgatctctaccatacatttcgcccagccgttctcttactgatgtttttgtccgtctacaaggctttcgtgatggagtag

SEQ ID NO: 55210 - DNA, 96 bp, Artificial Sequence
  Description of Artificial Sequence: Synthetic coding sequence
atgcgacctggctggagccacctccctctctgccctacactgcaggacgccgtgcttggacactttctcagccacctcggcagacgacatctctag

SEQ ID NO: 55211 - DNA, 1098 bp, Artificial Sequence
  Description of Artificial Sequence: Synthetic coding sequence
atgtctctgattcggaaaaaaggcttttataaacaggatgtgaacaaaactgcttgggaactgccaaaaacctacgtgtctccaacccacgtcggctcaggagcctacgggtcagtgtgctcagccatcgataaacggtccggcgaaaaggttgcaatcaagaaactgtcccgaccctttcagtccgagattttcgccaaaagggcgtatcgtgagttactacttctgaagcatatgcagcatgagaatgtcatcggactgctggatgtgttcacccctgcctctagcctgcggaatttttacgacttctatttggtcatgccttttatgcaaactgatcttcagaaaattatgggaatggagttcagtgaagaaaagattcagtacctggtttaccagatgctcaaagggctgaagtacatccactccgctggggtggtccatagggatctcaagccgggaaatctcgccgtgaacgaggactgtgaattgaagatcctcgacttcggcctagcacgccatgccgatgccgagatgacagggtacgttgtgacacggtggtatcgtgccccagaagtgatactgtcttggatgcactacaaccagactgttgatatctggagtgtgggatgcataatggcagagatgttgactgggaagacgctgttcaaggggaaggattatctcgatcagctgacccagatcctgaaagttaccggcgttccgggaactgagtttgtccagaaactgaacgacaaagctgcaaagtcgtatattcaatccctgcctcagactcctcgaaaagattttacacaactatttcccagagcaagtccccaggccgctgacctcctcgaaaaaatgctggaactcgatgtagataaaagactcacagctgcccaggcactgacacacccgttctttgagcctttcagagaccccgaagaggaaacggaagcgcagcaaccttttgatgattcactggaacacgaaaagttgacagtcgatgaatggaagcagcacatttacaaggagatagtgaacttcagcccaatagcgaggaaggatagtcggcgtaggtcggggatgaaactctag

SEQ ID NO: 55212 - DNA, 243 bp, Artificial Sequence
  Description of Artificial Sequence: Synthetic coding sequence
atggagaaacctcttttccccttagtacccctgcactggttcggctttggctacaccgccctggtggtctctggaggcatcgttggatacgttaagacagctgctacatcagtgacctttgtcggagtgatgggaatgcgctcctattactacggcaagttcatgccagttggtttgatcgccggagcttccctgttaatggccgcaaaagtaggagtccgaatgctcatgacgtccgactag

SEQ ID NO: 55213 - DNA, 345 bp, Artificial Sequence
  Description of Artificial Sequence: Synthetic coding sequence
atggagaagcccctctttcctcttgtccccctccactggtttggtttcggctacactgctcttgtcgtcagcggcggtatcgtgggatatgtaaaaacaggctctgtgcccagtctagccgcaggtctcctcttcggatcccttgccggactgggtgcataccagctgtaccaggatccaaggaacgtctggggctttcttgccgcaacgagcgtgacctttgtgggggtcatgggcatgcggagctattactatggaaagtttatgcccgtaggtctcatagcaggagcatcattgctgatggctgcgaaagttggtgtacgtatgctgatgacatccgattag

SEQ ID NO: 55214 - DNA, 345 bp, Artificial Sequence
  Description of Artificial Sequence: Synthetic coding sequence
atggaaaaacccttgtttccactcgtgcccttacactggttcgggtttggatacactgcgcttgtggtgagcgggggtatcgtgggatacgtcaagacaggatctgtaccatccttagctgccggactgctgtttggaagcttggccggacttggggcttatcaactttatcaggaccccagaaatgtgtgggggttcctcgccgctacctctgtgaccttcgttggtgtcatgggaatgaggagctactattacggcaagttcatgccagtcggcctcatcgcaggggctagcctcttgatggccgcaaaagtgggcgtgcggatgctcatgacctcagactag

SEQ ID NO: 55215 - DNA, 408 bp, Artificial Sequence
  Description of Artificial Sequence: Synthetic coding sequence
atggagaaaccactgttccctttagtgcctctccattggttcggtttcggttatacagccctcgtggtgagtggtggtatcgtcgggtacgtgaagactgggtccgtcccatccctcgcagctggactgctgttcggtagcttggccggtctgggggcttatcagttgtaccaggatccacggaacgtttggggttttttggctgcaacaagcgttacttttgtgggggtcatgggcatgcgaagctactactacggaaaattcatgcccgtgggcttaatcgccggagcaaggtattttcattctattaccctcctgtaccatgttgagttcagcttgcttccacggattctttacgcctttaagaccctgctcgtaagcgagtatttaatgctgtgtattaactag

SEQ ID NO: 55216 - DNA, 2151 bp, Artificial Sequence
  Description of Artificial Sequence: Synthetic coding sequence
atggaggatagcacctcgcctaaacaggaaaaggagaatcaggaggaattgggtgaaactaggaggccctgggagggaaaaaccgcagccagtccccaatattcagaacctgagtcctccgagcccctggaggccaagcagggccctgagaccggaaggcaaagcagatcaagccggccatggtctccccagtcaagagcaaaaacgcccctgggaggcccagctggccctgagacgtcttctcctgctccggtaagtccacgggagcctagtagttctccgagcccccttgcacccgctcgccaggatctcgcggctccccctcaaagcgataggacaacaagcgtgatccctgaagccggtacaccctatccagaccctctggagcagagttccgacaaacgagaatcaacaccccaccacacatcacagagcgaaggcaatacatttcaacagtcgcaacagcccaaaccccacctgtgcggcaggagagatgtctcttacaacaacgcgaagcagaaggaactgaggttcgatgtattccaagaggaagactcaaacagcgactacgaccttcagcagcccgcacccggagggtccgaagtggctccaagcatgctagagatcactatacagaatgcaaaggcatatcttctgaaaactagcagcaatagcgggttcaacctctacgatcacctgtccaacatgttaactaaaatcctgaatgagcgtccggaaaatgccgtggatatcttcgagaatatatcgcaagatgtgaaaatggcccacttttctaaaaagttcgacgctctgcaaaacgaaaacgaactcctgcctacttacgagattgccgagaaacagaaggcactgtttttgcagggccatttagagggagtcgaccaggaactggaggatgagatcgccgagaacgccttgcccaacgttatggagtccgctttttacttcgagcaagcaggcgtcgggttgggcacagatgaaacttataggattttcttggctttgaaacaactgactgatacccaccccatccagcgttgtagattttgggggaagatcctgggactggaaatgaactacattgtggccgaggtcgaattccgcgaaggggaggacgaggaggaagtggaggaggaagatgttgccgaggaacgggataacggtgaatctgaggcgcacgaggacgaagaggatgaattgcctaagtccttttacaaggccccacaggctatccctaaagaggagtccaggaccggcgcaaacaagtatgtatactttgtttgcaatgagccgggtaggccttgggtgaaactccctccggtcattccagcacagatcgttatcgcaagaaaaatcaagaagtttttcactggcaggctcgacgctccaattatctcataccccccattccccggtaacgaatccaattacctcagagcccagatcgccaggatctccgctgggacccatgtgagccctctgggcttttaccagtttggagaagaagaaggcgaagaggaggaggaggccgagggcggtcggaactccttcgaggaaaatcccgatttcgaagggattcaggtaattgacttggtcgagtctttgtctaattgggtccatcacgttcagcacatactctcgcagggcaggtgtaattggttcaatagcatacagaagaatgaagaggaagaggaagaagaggacgaggaaaaggatgattccgattacatcgagcaggaagttggattaccacttcttactcctatttctgaggacctggagatccagaacataccaccatggacgactcgtctcagtagtaatctcattccccaatatgccatcgcagtgttacaaagtaacctgtggcccggtgcatatgcattcagtaacggaaagaagtttgaaaacttttatattggatggggccacaaatattccccagacaattataccccgccagtgccccctccagtctatcaggaatatccctccggaccagaaatcacagagatggatgacccttctgtcgaggaagagcaggctttccgggcagctcaagaggcggtactgctcgccgcagaaaatgaagagtcagaggaagacgaggacgaggaagatgattacgactag

SEQ ID NO: 55217 - DNA, 315 bp, Artificial Sequence
  Description of Artificial Sequence: Synthetic coding sequence
atgcaggataccggctctgtggtccctctccactggtttggcttcgggtacgcggctctagtggcaagtggtgggatcattggctacgtgaaggcgggatccgtgccctctctggcagcagggctactgtttggaagtctggcaggactgggcgcttatcaagtgagtggatctaaagaaagactgggattccctagttacatatggtacttagggtggcattacgggaatgaagtgctgccgttgtggaaaatccacgcctgtcggttcaactgccgatgccagttcgctgatggacggcagtcttggtcatag

SEQ ID NO: 55218 - DNA, 339 bp, Artificial Sequence
  Description of Artificial Sequence: Synthetic coding sequence
atgcaagatactggttcagtagtcccactgcactggtttggctttggatacgctgccctggttgcgagcggcggaattatcggctatgttaaagccggatctgtcccctccttggccgcaggcctgttgtttgggtcgctcgccggactgggagcataccaattaagccaggaccctaggaacgtttgggtgtttctagccaccagtggaacgcttgccggaataatggggatgcggttttaccacagcggcaaatttatgccggctgggcttattgcgggtgcttctctgctgatggtggcaaaagtgggggtatccatgttcaatagaccccattag

SEQ ID NO: 55219 - DNA, 378 bp, Artificial Sequence
  Description of Artificial Sequence: Synthetic coding sequence
atgcaaatggacccgggtccccaggtgcccttatactggctcggattcgtgtatgcagccttggccgctttaggcggtatctcaggttacgccaaagtcggttccgtgcagtcacccagcgcaggattcttcttctccgagttggctggtctggatgctagtcagccatctaggaaccccaaagagcacttaagctctcccgtttatatttgggacctagcaaggtactacgctaataaaatcctgactctctggaacatttatgcctgcggcttctcttgccgttgcctgcttatagtctctaaattaggctctatgtatggtgagcagatcctctcagtggtggcgatgagtcaactgggcctcatgaaaaattag

SEQ ID NO: 55220 - DNA, 657 bp, Artificial Sequence
  Description of Artificial Sequence: Synthetic coding sequence
atgtacgctctttggagaactggccctactacctcaccagcactacttactttactatctaaaggtgtgcctcgccctgccgctccttggactatgtccccatcaagcgtagctctgatctgcctgctgagatatgggcagctactggagcagtcaaggcattcctgggtgaacaccacagctctgatcaccggttgcacgaatgcagccggtcttctggtggtcgggaactttcaagtggaccatgctagatcattgcattatgtgggagccggagtcgccttcccagcagggctgctgttcgtgtgtctacactgcgcccttagctatcagggtgcgactgcacctttggacttagctgttgcctaccttcgttccgtcttagccgttatcgcatttattaccctagtccttagcggcgtcttctttgtacacgaaagcagtcagctgcaacatggagcagctctgtgtgagtgggtttgtgtgatcgatatactcatcttctacgggaccttttcctacgaatttggggcagtatcatcggataccctggtcgccgctctacagcctacccccggacgcgcatgcaagagttctggctcctcctccacctctacgcacctgaattgtgcccctgagagcatagctatgatctag

SEQ ID NO: 55221 - DNA, 816 bp, Artificial Sequence
  Description of Artificial Sequence: Synthetic coding sequence
atgacggcctggatcctcctaccagtgtcgttatcagcattcagcataaccgggatatggactgtgtacgccatggcagtcatgaatcatcacgtgtgcccagtggaaaattggtcttacaacgaatcatgtccccctgaccccgcagagcagggtggtccaaagacctgctgcaccctcgacgacgtgccactaatcagcaagtgtgggtcctatccacctgagtcttgcttgttttccctcatcggcaatatgggtgcttttatggttgcactgatttgtctgctgaggtacggacagctgctagaacagagcaggcactcatgggtgaacacaacagccctcatcaccggttgcaccaacgcagctggattgctggttgtgggtaatttccaggtggaccacgcccgaagccttcattacgtaggagccggagttgcgttcccagctggactgctatttgtgtgtctgcactgcgccctgagctaccagggtgccaccgcccctcttgatctggccgttgcgtacctgcggtcagtgctagccgtaatcgcttttataaccttggtgttgagtggtgttttcttcgtccatgagagctcccagctccagcacggtgcggcactgtgcgaatgggtctgcgtgattgatatacttattttttatgggacattctcctatgaattcggcgcagtgagttccgacactctggtggcagctctgcagcctactcctggacgggcttgcaagagttcaggaagctccagcacctcaacacacctgaattgtgccccagaatctatcgcaatgatttag

SEQ ID NO: 55222 - DNA, 816 bp, Artificial Sequence
  Description of Artificial Sequence: Synthetic coding sequence
atgactgcctggatcctcttgcccgtgagtttgtcagcatttagcatcactggtatctggaccgtttacgcgatggctgtgatgaatcatcacgtttgcccagtggaaaattggtcctataatgagagttgcccgcctgaccccgctgagcagggaggccctaaaacttgctgcaccttggacgatgtgccacttatctccaaatgtggaagctatccgcctgaatcctgtctgtttagcttgattggcaacatgggagcatttatggtggctttgatttgtttgttaagatatggccaattgctcgagcagtcccgacatagctgggtgaataccaccgcccttatcacgggttgtacgaacgctgctgggttgctggtcgtggggaacttccaagtcgatcacgcaagatcactccactatgttggtgctggagttgccttcccagctggtctgctgttcgtttgcctgcattgcgctctctcatatcagggagcgaccgccccactagacctcgccgtagcttacctgcgaagtgtgctggccgttattgccttcatcactctggtgctgagcggtgtgttctttgtgcatgaatcaagccagctgcagcatggagctgccctttgcgaatgggtctgcgttatcgatatcctgattttctacggcaccttctcttatgaattcggagccgtgagtagcgatacgctggtggccgctctgcaacctactcccggaagagcctgcaaaagttctggcagcagttctacctctactcatttaaattgcgctccagagtccattgcgatgatttag

SEQ ID NO: 55223 - DNA, 204 bp, Artificial Sequence
  Description of Artificial Sequence: Synthetic coding sequence
atgtatgctctgtggcggacaggaccaacaacaagtccggctcttctgacgctgctgagcaagggagtcccgagaccagcggctccctggactatgagcccgtcgagcgtcgccctgatatgcctcttacggtatggacagctccttgaacaatcacggcactcgtgggtgaatacaaccgccctgattacaggctgtacctag

SEQ ID NO: 55224 - DNA, 702 bp, Artificial Sequence
  Description of Artificial Sequence: Synthetic coding sequence
atgtggggctatctgtcactgatgcccgtgttcctggcagtctgggccatcagcggggtgtggatagtctttgccatagccgtgacgaatcgcactgtggatctgtccaaggggtttccatacatttccatttgtggctctttcccacctcagtcatgcatcttttcccaggtcctgaacatgggcgctgctctagcagcctggatctgcattgtgcggtatcaccagcttagagattggggggtgcgccgttggccaaaccagctcatcctgtggaccggactgctgtgtgcactcggtacctcagttgtaggcaacttccaagagaagaaccagaggcctacccacttagcaggagctttcctcgcctttatcctgggcaacgtgtacttttggctacagctgttgctctggcggttaaagaggctgccacagccgggtgcagcctggattgggccacttaggttgggcctctgttccgtttgtaccattcttattgtggctatgattgttttgcatgcttgcagcttacggagcgtgagtgctgcctgcgagtgggtggtagcaatgttactcttcgccctgttcggccttctcgccgtggacttttccgctctcgaaagttgtaccctctgtgttcagccttggccaagtctctctccaccgcctgcctcaccaatatctctgccagtgcagctatag

SEQ ID NO: 55225 - DNA, 702 bp, Artificial Sequence
  Description of Artificial Sequence: Synthetic coding sequence
atgtggggctatctatccctgatgccggtattcttagccgtgtgggccatctccggggtctggatcgttttcgcaatcgcagtcacaaaccgaacagtcgatctatcgaaaggttttccctacatctcgatttgcggatcattcccgcctcagagttgcatcttttcccaggtactgaatatgggcgcagctctggccgcatggatctgtatcgttcgataccatcaactgagggactggggggttagaaggtggccgaaccaactaatcctatggacgggtctgttatgcgccctaggcaccagcgtggtgggtaacttccaggagaagaaccaacgacctacgcatttggccggtgcttttctagcttttatcctcggtaatgtttacttctggctgcaactgttgctctggagactaaaaaggttgcctcagcctggcgcagcctggatagggccactgcgcctaggactctgctctgtctgtactatcctgattgtggcaatgatcgtgttgcacgcatgttccctccggtccgtcagcgctgcgtgtgagtgggttgtagccatgctgctcttcgcactcttcgggctgctggctgttgatttctcagcccttgaaagctgtaccctatgtgtgcaaccgtggcccagcttaagccccccacctgcatcgcctataagcctgcctgtgcagctctag

SEQ ID NO: 55226 - DNA, 750 bp, Artificial Sequence
  Description of Artificial Sequence: Synthetic coding sequence
atggacggtaagaagtgctccgtctggatgtttctgcctctggttttcactctcttcaccagcgccggactgtggattgtgtatttcatcgctgtagaggacgataagatcctccctctcaatagcgctgagcgaaaacccggtgttaagcacgcaccgtacatttcgatcgctggggatgatcctcctgctagctgcgtgttttcccaggtgatgaacatggcggcattccttgccttagtggtggccgtgctccgatttattcagctgaagccaaaagtgctcaacccttggcttaacatttccggcctcgttgcactgtgcctcgcctcttttgggatgacactgctgggcaattttcagctcacaaatgatgaggaaattcacaatgtgggtacatctctcacttttggctttgggactctgacatgttggatccaagccgctctgacattgaaggtaaacatcaagaacgagggccgacgagtgggaatcccgagagtcatcctaagtgcctcgattacgctctgcgtggtgctgtattttattctcatggcccaatccattcatatgtacgccgcacgagtgcagtggggccttgtgatgtgcttcctttcatactttgggacattcgccgtagagttccgtcactataggtacgagatagtttgctcggaataccaggagaatttcctgtctttctcagaaagtttgagcgaggcctctgaataccaaacagaccaggtctag

SEQ ID NO: 55227 - DNA, 204 bp, Artificial Sequence
  Description of Artificial Sequence: Synthetic coding sequence
atggatggaaagaagtgctccgtgtggatgttcctcccgctggtgttcaccctgtttacttccgcaggactgtggatcgtctatttcattgcagtagaggatgacaagatcttgccactgaacagtgccgagagaaagcctggcgttaaacacgcaccatacattagcattgcaggtgatgacccacccgcttcctgtgtgtag

SEQ ID NO: 55228 - DNA, 750 bp, Artificial Sequence
  Description of Artificial Sequence: Synthetic coding sequence
atggacgggaagaagtgctccgtctggatgtttctgccgttggttttcacgcttttcacctcagccggactctggatagtgtactttatcgctgtggaggatgacaaaatactgccactcaacagcgcagagcgaaagccgggagtaaaacatgcaccttatatttctatcgccggagatgatccaccagcctcctgcgtgtttagccaggtgatgaacatggctgccttcttggccctggtggtggccgtcttacggtttatccaattgaagccgaaggttctgaatccgtggctcaatatctctggcttagtggccctgtgcttggcttcctttgggatgaccttactcgggaacttccagcttacgaacgacgaagaaatccataacgtcggaacatccctgacctttggatttggcacactgacttgctggatacaggcagcactgactctcaaggtgaacatcaaaaacgaaggcagaagagtcggcatacctcgggtgattttatccgcaagtataactctctgtgttgttctttactttatcttgatggctcaaagcatccacatgtacgctgcgagagtccagtgggggttagtgatgtgctttctgtcatacttcgggacctttgccgtagaattccgccattatagatacgagattgtgtgttccgagtatcaagagaatttcctgagtttcagtgaatccttaagtgaagccagtgagtaccagacggaccaggtctag

SEQ ID NO: 55229 - DNA, 1407 bp, Artificial Sequence
  Description of Artificial Sequence: Synthetic coding sequence
atgcccgaggatggtgccggagatggcggagaggttcctgccttgatccccgatggagaaccactaagggaggaacagcggccactgaaacagtcactgggcagtagcctttgcagggagtcacactggaaatgtctgctcctgactctgctgattcatgcctgcggggcagtcgttgcctggtgtcgcttggcaactgtgcctcgcctggtgctggggcctgaagcagctctggcccgaggggctggcggacccccacccacatatcctgcctcaccttgctctgacggatacctgtatatccccctggcattcgtttctctactgtaccttctgtacctagcagaatgttggcactgccatgtgcgatcttgccaggccccacggactgacgcgcataccgtcctggctctgattcgtcgtttgcagcaagcgcctccttgcgtgtggtggaaggccacatcataccactacgtgaggcgaacccgccagatcacaaggtataggaacggtgatgcgtatacgactactcaagtttaccacgagcgcgcagactctagaacagcaaggggtgaatttgactacagcgcccacggcgtgagggatgtgtccaaggaactcgtcggattggctgagcacgcagctactcgactgaggttcacgaaatgcttcagcttcggaagcgccgaggccgaagcttcctaccttacgcagcgtgctaggtttttctcggcaaatgagggtcttgacgactatttagaggcacgcgaggggatgcatctgaaggacgtggacttcagagagtctctgatggttttcgctgaccccaggagtccaccttggtacgctcgtgcctgggtgttttggttagtcagtgccgctactctgtcttggccacttcgggttgttgctgcttatggcactgcccatgtgcattaccaagtggagaaactctttggggcttcctctcctccgccaggagcagtgccctcggggccaccgctgtcccgggtggccaccgtggacttcaccgagctggagtggcatatctgcagcaaccgccagctcgtcccgtcttacagcgaggctgttgtgatgggagccggttcaggggcatacctgagaggatgccagcgctgccgtaggtccgtctcaagcaatagtctccccccagccaggccatctggacctcggctccctttctccagatcaaggctcagtttaggagctggcggaagagcgacaccaggcgttttccgatccctttcaggaggaccgttgggtagacggggtgaagatactgagccgcttgagtcgcccccttgctacgaggacgctctgtacttccctgttctgatcgtacatggtgatagtggctgtcagggggatggccaaggcgctctctag

SEQ ID NO: 55230 - DNA, 669 bp, Artificial Sequence
  Description of Artificial Sequence: Synthetic coding sequence
atgtcccctcctggatcggccgcaggggagtcagccgcaggaggcggtggcggtgggggtggccctggagtcagcgaggaattgaccgcagctgctgccgcagcagctgcagatgagggtccggctagagaagagcaacgtccaatacagccctcgtttaccaagagcctttgtagggaaagccactggaagtgcctcttactgtccctgctcatgtacgggtgtctgggcgctgtcgcatggtgtcacgtgaccacggtgacccgacttacatttagcagcgcatatcaaggcaatagccttatgtatcacgatagtccctgcagcaacggatatgtctatatccccctcgcctttctgctgatgctgtatgctgtttatctcgttgaatgctggcactgccaggcgagacacgaacttcagcacagagtagacgtcagcagcgtgcgggagcgcgtgggccgaatgcagcaagccactccctgcatatggtggaaggcaatcagctaccactacgtgaggcgcacccgccaggtcacccggtatcgcaacggtgatgcctataccacaactcaagtacctgggtgcctgggctcccaggtagtgcccctgcggtctccatggcggaatgcccagctggatgccggaagtgatgaagaacctgcttag

SEQ ID NO: 55231 - DNA, 1701 bp, Artificial Sequence
  Description of Artificial Sequence: Synthetic coding sequence
atgtctcctcctggtagcgccgcaggagagtccgcagccggagggggaggagggggagggggtcctggcgttagcgaggaactgaccgccgcagctgctgcggcagccgcagatgagggtcctgcacgcgaagaacagaggcctatacaaccaagctttactaaatctttatgtcgagaaagccactggaaatgtctgctgctttcattactaatgtacggctgcctcggcgcagtcgcttggtgtcatgtgacaactgtgacccgactgacattcagctccgcttatcaaggtaacagtctcatgtaccacgactcgccatgttcgaacggatacgtttatatccccctggcattccttctgatgctttacgccgtatatctggtcgaatgttggcactgccaggctcgccatgaattgcagcatcgcgtcgacgtttcctcagtcagggagagggtcggacggatgcaacaggcaacaccttgtatttggtggaaggccatttcctaccactacgtccgcaggacccgccaggtcacccgctaccgaaatggtgatgcctatactacaactcaggtgtatcacgagcgcgtgaacactcatgtcgctgaagccgagtttgactacgccagatgtggagtgcgtgatgtgtctaagactctggtgggactcgagggggcaccagccactagacttagatttaccaaatgttttagtttcgcaagtgttgaagctgagaatgcgtacctctgtcaacgcgcacgtttctttgcagagaacgaagggttagacgactacatggaagcacgtgaggggatgcatctgaaaaatgtggacttccgcgagtttatggtggccttccctgaccccgcacgcccaccatggtacgcttgctccagtgctttttgggctgctgcactcttgaccctctcttggccactgagagtgctggcagaatacaggactgcgtacgctcattaccacgtggaaaagctattcgggctggaaggcccaggcagcgcctctagcgccggaggtggcctgtcacctagtgacgaactcttacctcctctcacacataggttgcctagagtgaatactgtcgactctactgaactagagtggcatatcaggagcaatcagcagttggtcccaagctacagcgaggccgttctaatggacctggcgggtctggggaccagatgtggcggagcagggggaggatacgctccatcttgcaggtacgggggtgtgggtggtccgggagctgctggggtggcgccttaccggaggagctgtgaacactgccagcgcgctgtatcctctagcagtatcttcagcagatcagctctgagtatctgcgcgagtccgcgagccggacctgggcctggcggtggcgctggatgtggtgggagccgtttctccctgggtcgattatatggttcccggaggagttgcctttggcgctcccggagcgggtctgttaatgaagctagttgtcctacagaacaaacacgactgagcagccaagctagcatgggcgacgacgaagacgatgatgaagaagaggccggtcctcctccaccctaccacgacgccctgtactttccagtattaattgtacataggcaggaaggatgcctaggacatagccaccggccacttcacagacatggaagctgcgtcgagacctccttgtag

SEQ ID NO: 55232 - DNA, 552 bp, Artificial Sequence
  Description of Artificial Sequence: Synthetic coding sequence
atgcaggcccctcgtgccgcactggttttcgccttagtaatcgctctcgtgcctgtgggcagaggaaactatgaggagctcgagaattccggggacacaacggtggagagcgaacggccaaacaaagtgacaatcccctcaaccttcgccgctgtaactatcaaagaaaccctcaatgcaaatatcaattccaccaactttgctccggacgaaaaccaactggagttcattttgatggtcctgatcccgctcattcttctggtgcttctccttctttcggtggtcttcctagctacctactacaaacggaaacggacaaagcaagaaccatcaagtcagggcagtcagtccgccctccagacctatgaactgggatccgagaatgttaaggtaccaatctttgaagaggatacaccaagcgtgatggaaatagaaatggaggaactcgataaatggatgaactccatgaatcgtaacgcagatttcgagtgcctgccaaccctaaaggaagagaaggaatcaaaccataacccctcagactccgaaagctag

SEQ ID NO: 55233 - DNA, 378 bp, Artificial Sequence
  Description of Artificial Sequence: Synthetic coding sequence
atgcaggccccaagagctgccttggtgtttgcgctagtgatcgccttggtgcccgtcgggagaggcaactacgaggaactggagaactcaggggatacaacggtcgaatccgagagaccaaataaggttacgataccttccaccttcgctgctgttaccataaaggagactctgaacgccaacatcaatagcacgaacttcgcacccgacgaaaatcagctggagttcatcctgatggttctcattccgcttattttactggttcttctgcttctgtccgtggtgttcctggcaacttattacaagcgcaagcgcactaagcaggagcctagctcccagggatcacaatcagcgttgcaaacctaccttttggtttag

SEQ ID NO: 55234 - DNA, 891 bp, Artificial Sequence
  Description of Artificial Sequence: Synthetic coding sequence
atgacaaagactgctctgttaaagctctttgtcgctattgtgatcacctttattttaatccttccggagtacttcaaaacacctaaagaacgaactctggaactgagctgcctggaggtctgtctgcagagcaactttacttactcactctccagccttaatttttcatttgtgacatttttacagcctgttagggagacacaaatcattatgaggatcttccttaatccttccaactttcgcaattttacccgcacctgtcaagatataacaggcgagtttaaaatgtgcagttcctgtttagtttgtgaatcgaaggggaatatggacttcatttcccaggaacagacatccaaagtgctgatcaggaggggaagtatggaagtgaaggccaacgattttcatagcccttgtcagcacttcaacttcagtgttgcaccccttgtggaccatctcgaagaatacaatactacatgtcacctcaaaaatcacaccgggagatccaccatcatggaggatgagccgtcaaaagaaaagtccattaactatacctgcaggattatggagtatccaaacgactgcatacacatttctctgcatctggagatggatataaaaaacattacctgttctatgaaaatcacgtggtacatcctcgtacttctggtattcatatttttaattatactcacgattcgcaaaatcctggaaggccaacggagggtgcagaaatggcagagtcatcgcgacaagcctaccagcgttctgctgcgtggttccgactcagagaaacttagggcgctgaatgtgcaggtcctttcagctgaaactactcaaaggctcccactcgaccaggtgcaagaggttcttccacctatacctgaactgtag

SEQ ID NO: 55235 - DNA, 567 bp, Artificial Sequence
  Description of Artificial Sequence: Synthetic coding sequence
atgggaggcggttggtggtgggcaagggccgctagactagccagactgaggttccggagatcccttctcccaccacagcggccacggagcggcggtgccagggggtcatttgctccgggacacgggccacgagcgggtgcttctcccccacctgtgagtgaactggatcgcgcagacgcctggcttctgcgtaaagcccacgagaccgcattcctatcctggtttagaaacgggctgttggccagcgggataggagtaatcagcttcatgcagtccgacatggggcgtgaggctgcctatggctttttcttactgggaggactatgcgttgtatgggggtcagccagctacgccgttggtttggccgcactgagagggcctatgcagcttacgctcggtggagctgctgtgggtgccggagccgtccttgcggcaagcctgctgtgggcctgcgccgtgggcctttatatgggtcagctagagctggatgtggagctggtacccgaagatgatggcaccgcctcagctgaggggcctgacgaggcagggagaccaccacctgaatag

SEQ ID NO: 55236 - DNA, 1440 bp, Artificial Sequence
  Description of Artificial Sequence: Synthetic coding sequence
atggcggtcctgggggtgcagttggtggtgacattgctgacagctactttgatgcacaggttggcccctcactgcagtttcgctcgttggctgctgtgcaacggaagcctgtttaggtacaagcacccgtccgaggaggagctgcgtgcgctggccggtaaacctcgcccacgcggacggaaggaacgatgggccaacggtctgtctgaggagaagccccttagtgtgcccagggatgcgcctttccagctggaaacttgtcctctgactacggtggatgctcttgtacttagattctttctggaataccaatggttcgttgactttgcagtttacagcggcggagtgtacttgttcaccgaagcctattactacatgctggggccagcgaaagagacaaatatcgccgtgttctggtgcctccttacggtgacattcagcataaagatgttcctcactgtgacacgtttatactttagcgccgaagagggcggagaacggtccgtatgcctcactttcgcctttttgttcctactgctggctatgttagtgcaggtggtgagggaagagactttggaacttggattggagcccggattggccagcatgacccagaacctggagccactgttgaagaaacaggggtgggactgggccctgcctgttgcgaagctggccattcgggtcggattggctgtcgtcggtagcgtgcttggggcattcctcacattccccggactgcgcctggcgcagactcatcgcgacgccctgacaatgtctgaggatcgtcctatgttacagttcctactccatactagtttcctttcaccactctttatcctctggctgtggaccaagccaatcgcacgggatttcctccaccagccgccttttggggagactcggttcagcctgctcagcgattctgctttcgacagtgggcgtttatggctgctagtggtgctctgccttctccgactggccgttacacgacctcatctccaggcttacctctgcctggctaaggcacgtgttgagcaacttcgccgtgaagcaggccgtattgaggctagagagattcagcagcgagtggttcgagtctattgctacgtcaccgtcgtgtccctgcagtatctcaccccattgatcttgaccctgaactgcacacttctgcttaagaccctgggaggctacagttgggggctaggtcctgctccactcctgtctccggacccttccagcgccagcgccgcaccgattgggtctggggaggatgaggttcagcagacagctgcccgtatcgctggagcccttggcggtctccttactcctttgttcctgagaggggttctggcatacctgatatggtggacggcagcttgtcagctgctcgctagcctctttggcctatactttcatcagcatctggccggaagttag

SEQ ID NO: 55237 - DNA, 1131 bp, Artificial Sequence
  Description of Artificial Sequence: Synthetic coding sequence
atggccgtactcggcgtccagctcgtcgtcaccttactcaccgcgaccctgatgcaccggcttgccccacattgcagttttgcaaggtggcttctttgcaacgggagcctgtttcggtataagcacccttcggaggaggaattgagagcactggctggcaaaccacggccaagaggacggaaagagcggtgggctaacggactaagcgaggagaagcccttgtccgttccccgagatgcccctttccagctggaaacgtgtcctttgactactgttgatgccctgggcctggccagcatgacacagaacctggaaccactcctcaaaaagcaggggtgggattgggctctgcccgtggccaagctcgccattagagttggtctcgccgtggtcgggagtgtcctgggcgcttttctgacattcccaggtctgaggctggcccagacacacagggacgctttgaccatgagtgaggatagacccatgctccaatttctgttgcacacatcttttctgtcccccctcttcattctgtggctgtggaccaagccaatcgccagagatttccttcatcaaccaccgttcggcgaaactcggttctccttgctatccgacagtgcattcgactccggaagactgtggttgttggtggtgctgtgtttgttacgtctcgctgtgaccaggccgcatttacaagcttacctctgccttgcaaaggcaagggtggaacagcttagaagggaggcaggcaggatcgaagccagagagattcagcaaagagttgttagggtctactgttacgtaacggtggtcagtttgcagtacctcacgccgttaatcttgactctgaactgtactttgctgctgaaaactctaggcggatattcgtggggactaggcccagcgcctcttctatcccctgacccatcatctgcttccgcagcccctatcggcagtggggaggacgaggtgcaacagacagctgccaggatcgccggtgccctgggcggactgctcactccgttattcctccgtggagtgcttgcttacctcatttggtggaccgctgcctgtcagctgttggcatccctgttcgggctctatttccaccagcacttggcaggaagctag

SEQ ID NO: 55238 - DNA, 1464 bp, Artificial Sequence
  Description of Artificial Sequence: Synthetic coding sequence
atgggggtgattggaattcagcttgtggttacaatggttatggctagtgttatgcaaaagattattccacattactctctggcaaggtggctgctctgtaacggaagcctacggtggtatcaacaccccaccgaggaagagctgagaatactggccggaaagcagcagaaaggaaagactaagaaggatagaaagtataatggccacattgaaagcaagcccttgaccatcccgaaggatatcgatttacatctcgagaccaagagcgtgacagaggtagataccctggcgctccattattttccggagtaccaatggttggtagattttactgtggcggctaccgtggtgtacctcgtgactgaggtgtactacaactttatgaagcccacccaggagatgaacatctccctagtctggtgcctactggtgctctcatttgcaataaaagtgctgttttctctgactacacactattttaaagtggaggacggcggtgagcgtagtgtttgtgtgacatttggttttttttttttcgtgaaggcaatggcagtgcttattgttaccgaaaactacctggaattcggcctggagactggcttcacaaatttctcagacagcgcaatgcaatttttggaaaaacagggtctcgagagccaaagcccagtgtcaaaactgaccttcaaattcttcctggctattttttgttctttcattggagcattcctgacattcccaggcctgcggctggcacagatgcacctcgacgcattaaatttggccaccgaaaaaattacccaaaccttgttacacatcaacttcctcgcacctttatttatggttctgctgtgggtgaaacctattacaaaagactatataatgaaccctccattgggtaaagagtctatccccctgatgaccgaggctacatttgataccttacgactttggcttattatcctgctatgtgcgttacgcctggccatgatgcggagtcatctgcaggcatacctaaacctcgcacaaaagtgtgtggaccagatgaagaaagaggccggacggatctcgactgtggagctgcagaagatggttgctagagtcttttactacctgtgcgtaatcgctctgcagtacgtggccccactcgtgatgttactacatacaacacttctgctgaaaacactcggcaatcactcatgggggatctatcctgagtctattagtacactgcctgtagataactcccttctgtcaaattccgtgtacagcgagctgccctctgcggaaggaaagatgaaggtgacagtcactcaaatcactgtagcgctgtctagcctgaagaacatattcactcccctcctgttcaggggtctgctgagctttctcacctggtggattgccgcatgcctcttttctacatccctcttcggcctcttctatcaccagtacctaacagtggcttag

SEQ ID NO: 55239 - DNA, 924 bp, Artificial Sequence
  Description of Artificial Sequence: Synthetic coding sequence
atgggagtgattggtatacagctggtggtgaccatggtgatggcctcagtgatgcagaagataatacctcattacagccttgctcggtggttattgtgcaacggctcactacgatggtatcaacatccaacagaagaagagctccgcatcctggccggaaagcagcagaagggcaaaacaaaaaaagatcgaaaatacaatggccatatcgaatcgaagcctcttacaatccctaaagacatcgatttacatctggaaacaaaatcggtgaccgaggtcgacactttagcactacactatttcccagagtatcagtggctggtcgattttactgtggccgctacggtcgtgtacctcgtgactgaagtgtattacaatttcatgaagcccactcaagaaatgaatatcagtttggtctggtgtttgctggtgttgtctttcgcgatcaaggtgctgttttcacttactacccattacttcaaagtggaggatggcggtgagaggtcagtgtgcgtaacctttggcttcttcttcttcgtgaaggccatggccgtgttgatcgtaacagaaaattacctcgagtttggtctcgagaccggctttacaaacttttccgactccgccatgcaattcctggaaaagcaggggcttgaatcccagtcaccagtttctaagctcaccttcaagttcttcctcgcgatcttctgctcctttattggagcgtttctcaccttcccaggcctgcgcttggcccaaatgcacctggatgctctgaatttggctacagagaaaatcactcagacacttcttcacattaactttctggctccattgttcatggtactcctttgggtcaaacccataacgaaggactatataatgaacccaccgctcggaaaggagatctcgccttctggccgttag

SEQ ID NO: 55240 - DNA, 870 bp, Artificial Sequence
  Description of Artificial Sequence: Synthetic coding sequence
atggagcccgcagccggaatccaaagaaggtcatcacaggggccaactgtcccccctcctcctagagggcatgcgccacccgctgcagcccctggcccagccccactgagctcacccgtgcgggaacccccacagctggaagaagagaggcaggtccgtatcagtgaatctggccaattctccgatggcttagaagatagaggcctgctggagagctcaactcggttgaagcctcacgaggctcagaattatagaaagaaagcactatgggtttcatggttctccataattgtcacgctggcattggccgtagccgcatttacagtgtctgtcatgcggtatagcgcttctgcatttggattcgcatttgacgctatactggatgtgctaagctccgcgattgtgctgtggcgctattctaatgccgctgcagttcacagcgcacatcgcgagtatattgcttgcgtgatcttgggggtgatattcctgctgtccagcatctgcatcgtggtgaaggcaatccacgatctatctaccagattgcttcccgaagtagacgactttctcttttcagtgtccatcctctctgggattctatgttctattctggctgtgctcaagtttatgctgggcaaggtcctgacaagtcgcgctctcatcactgacgggtttaacagtttagtgggcggagtgatgggtttttccattctcctcagtgctgaggtctttaaacatgatagcgcagtgtggtatctcgacgggagcataggggtgctaatcggtttgacaatatttgcctatggtgtgaaactcttgatcgacatggtaccgagggtgcggcaaacacgccattacgagatgtttgaatag

SEQ ID NO: 55241 - DNA, 279 bp, Artificial Sequence
  Description of Artificial Sequence: Synthetic coding sequence
tgcggtatgagccgttccggccttctagagtcttcaacccggctcaaaccccatgaggcccagaactaccgcaaaaaagccctttgggtctcctggttctcgatcatagtcacactggccttagccgtggcagccttcacagtctctgttatgcggtattccgcttcagcctttgggtttgcctttgacgctatcctggatgtgctttcgagcgccatcgtgctgtggagatactccaacgccgctgctgtacactccgctcacagagagtacatgtag

SEQ ID NO: 55242 - DNA, 777 bp, Artificial Sequence
  Description of Artificial Sequence: Synthetic coding sequence
atgagtagatatagctatcagagtctcctggattggttatacggcggagttgaccccagcttcgctggaaatgggggtcctgattgcgctgcatttttgagttggcagcagaggctgcttgagtccgtcgtggtgctgaccttagcactccttgaaattttggtggcactccggcatattctgagacaaacaaaggaagatgggcgaggctctccaggcagtcagcccgagcaggtgacccagagacctgaggagggcaaggagtcactgtctaagaacttactactggtcgcactatgcctgacttttggggtcgaggtcggtttcaagttcgcaaccaagactgttatttatctgctgaatccctgtcatctggtcactatgatgcacctgcccttcgagctcgagatatactacatccagcacgtgatgctctatgtcgtacccatttatcttctctggaagggtggagcttacacacccgagccgctgagcagttttaggtgggccttactcagcactggactgatgtttttctaccatttctcggttctgcaaattctgggcctggtgacagaggttaacttgaacaatatgctctgtccagcgataagtgatcctttctacggcccatggtatcgcatatgggccagcggacaccaaaccctcatgaccatgacccacgggaagcttgtgatcctattttcctatatggcaggaccactctgcaagtacctgctcgatctcttgaggttgcccgctaagaaaatcgactag

SEQ ID NO: 55243 - DNA, 894 bp, Artificial Sequence
  Description of Artificial Sequence: Synthetic coding sequence
atgagccggtactcctatcagtcattgcttgattggctgtatggcggagtggatcccagctttgctggcaatggcggtcccgattgcgccgcttttctctcatggcagcagcgacttctggagagcgtggttgtcctgacactggccctcctggaaattctagttgcactccggcatattctgcgccagaccaaggaagatggccgtggtagccccggttcccagccggaacaggttacgcagagacctgaagagggaaaggagtcattgtccaagaatctgttgctggtagcactgtgcctgactttcggggtggaagtcgggttcaagttcgccactaagacggtgatataccttctaaacccttgtcacttggtcacgatgatgcatatatttttacttgcttgccccccttgtcggggtgccattgtcgttttcaagctgcagatgcacatgctgaatggtgcactgctggcactcttattcccagtagttaacacccggctgctcccgtttgagcttgaaatttactacatccagcatgtgatgctctatgttgttcctatctatctgctctggaagggcggtgcatatactcccgagccactctcaagctttcggtgggccctcctgagcacaggcctgatgttcttctaccatttcagcgtgcttcaaatcctcggactggttacagaggttaaccttaacaacatgctgtgtccagccataagcgacccattctacggtccatggtatcgtatctgggcttcaggccaccaaacgctgatgactatgactcatggtaaactagtgatcttattttcttatatggccggacctttgtgcaagtacctgctcgatctcctgcggttgccagcaaagaagatagactag

SEQ ID NO: 55244 - DNA, 447 bp, Artificial Sequence
  Description of Artificial Sequence: Synthetic coding sequence
atgcatatgctgaacggagcactgctggcactgcttttccccgtggttaacacacggctgctcccttttgaactggaaatctattacattcagcacgtgatgctctatgtcgtgcccatctatcttctctggaaggggggagcctataccccagaacccctgagcagcttccggtgggcacttttgagcaccggtctaatgttcttctatcatttttcggtgctgcagatcctgggcttagtcaccgaagtgaatctgaacaatatgctgtgtcctgctatttccgaccctttttatgggccatggtatcgtatctgggcttccggtcatcagaccctcatgacgatgacccatggtaagctggtcatcctttttagttatatggcagggcctctttgcaagtacctgctggatctgctgcgcctgccagctaagaagatcgactag

SEQ ID NO: 55245 - DNA, 894 bp, Artificial Sequence
  Description of Artificial Sequence: Synthetic coding sequence
atgtctcggtatagttatcagtccctgctcgattggctctacggcggtgtcgaccccagcttcgcaggcaatggcggaccagactgtgcggctttcctgtcttggcaacaacggcttctggaaagcgtggtggttcttacactcgcactgctcgagatcttggtagccttgcgccacatcctgcggcaaaccaaggaggatggcagaggaagtcctggatctcagccagagcaggtgacacagaggccagaggaagggaaagaatctttgtctaagaatctgttgttagtggccctgtgcttgacattcggagtcgaggtgggattcaaattcgccactaagacggtcatctatctcctgaacccttgtcatcttgtgaccatgatgcacattttcttgttggcgtgtcctccttgtcggggagcaattgtggtgttcaaactgcaaatgcacatgttaaatggcgctctgctggccctgttgttccccgtggtgaatacccgtttgctgccctttgagctggagatatactacatccagcacgtgatgctgtacgtggtcccaatctacctgctgtggaaggggggtgcatacactcccgagcccctttcttcttttaggtgggcgctgctgtctacaggtttgatgtttttctatcatttctcagttctgcagattctggggctcgttaccgaggtcaatctgaacaatatgctgtgccccgctatcagtgaccccttttatggcccttggtaccgcatctgggcctcaggtcatcaaaccctgatgacaatgacacacggaaagctggttatcctgttttcatatatggcagggccactctgcaagtatctactagacctactgaggctgccagccaagaagattgactag

SEQ ID NO: 55246 - DNA, 777 bp, Artificial Sequence
  Description of Artificial Sequence: Synthetic coding sequence
atgtcaaggtactcataccagtcactgttagattggctctatggcggagtagatccttcctttgctggtaacggcggaccggattgtgcagcgtttctgagctggcagcagcgcttacttgaatccgtggtagtgctgaccctcgccctcctggaaatattggtggccctacggcatattctccgccaaaccaaggaagatgggagaggatcccctggaagccaacctgaacaagtgacacagagaccagaggagggtaaggagagcctgtccaaaaacttattgctggttgccctttgcttaacttttggcgtcgaagtaggctttaaattcgctacaaagaccgtcatatacctcctgaacccgtgtcatttagtgaccatgatgcaccttcccttcgagcttgaaatctattatattcaacatgtgatgctgtatgtcgtgcctatctacctgctttggaagggaggcgcttatactcccgaaccactgtcatccttcagatgggccttgctttcaacaggcctcatgttcttctaccactttagcgttttgcagattctcgggctggtgactgaagtgaaccttaacaacatgctctgtcctgctatctccgacccattttacggtccttggtaccgcatctgggcaagtggacaccagacgctcatgaccatgacccacggaaaacttgtgatactattctcctatatggccggtcccctgtgcaaatatctgctggatctcctccggctgcccgctaaaaaaatcgattag

SEQ ID NO: 55247 - DNA, 975 bp, Artificial Sequence
  Description of Artificial Sequence: Synthetic coding sequence
atggctgccgcagctcctggaaacgggagagcatccgcccctcgtttgctcttactgtttttagtccccctcctctgggcccctgctgctgtccgggctggaccagacgaggacttgtcacataggaataaggagccacctgcacctgcccagcagctgcaaccacaacccgtggctgtccaaggtccggagcccgctagagtggaaaaaattttcaccccggctgctcccgtgcatactaacaaggaagacccagctacgcagacaaacttaggtttcattcatgccttcgtggccgctatatcagtgattatcgtatctgaactcggagacaagactttctttattgccgcaatcatggccatgaggtacaataggctaactgtcttggctggagcgatgctcgctctcggcttaatgacatgcctgagcgttctatttggctacgccacaacagtgatccctagagtttacacatactacgtgagcacagtcttattcgcaatatttggcatcagaatgcttcgtgaaggattgaaaatgtctcccgacgagggccaagaggagctcgaggaggtccaggctgaacttaagaaaaaagacgaggagttccagaggaccaaactgcttaacggcccaggggatgttgaaaccgggacgtccataacagttcctcaaaaaaagtggttgcattttatttccccaatctttgtgcaggcgttgactttaacattcctagctgagtggggcgataggtctcagcttaccaccattgtgctggctgcgagggaggacccctacggggtcgcggttggcggaactgtgggccattgcctgtgtacaggtctggcagtgatagggggacgcatgatcgctcagaagatctctgtgcgaacggttactatcattggtggtattgtgtttttagctttcgcattcagtgctctttttatttcgccagattccggattttag

SEQ ID NO: 55248 - DNA, 786 bp, Artificial Sequence
  Description of Artificial Sequence: Synthetic coding sequence
atggagattcctatgcaaaagattttcacgccagcagcccctgtccatacaaacaaggaagatcctgccacccagaccaatcttgggttcatccacgcctttgttgccgctatctctgtcattatcgtttccgaacttggcgacaagaccttctttatagctgcgattatggccatgagatacaacagactgacagtgctcgcaggagccatgttggctctgggccttatgacttgcctgagcgtgttgttcggctatgccaccaccgtaatacccagagtgtatacttactatgtgagcacagttctgttcgcaatttttggcattaggatgttgcgggagggcctgaagatgtctcctgatgaggggcaggaagaactggaagaagttcaggccgaattgaagaaaaaggatgaggaatttcagcgtaccaaactccttaacggccctggagacgttgaaacaggcactagtatcaccgtaccacagaagaaatggttgcactttattagtcccatcttcgtgcaagcgttaaccttgacgttcctcgccgagtggggagaccgctcccagctcactactatagtgcttgctgcaagggaggacccatacggcgtcgccgttggcggtactgtgggccactgtctctgtactgggctggccgtcatcggtggtagaatgatcgcgcaaaaaattagcgtgcgcactgtgactatcataggcggtattgtctttctggcctttgcatttagcgcgctgtttataagtcccgatagtggcttctag

SEQ ID NO: 55249 - DNA, 219 bp, Artificial Sequence
  Description of Artificial Sequence: Synthetic coding sequence
atgtccgctatctttaattttcagagtctgctgaccgtcatccttctgttgatttgcacttgcgcctacattagatctctagccccatccttattggacagaaataaaaccggtctgcttggcatattctggaagtgtgcgaggatcggagaacgcaagtcaccttacgtggctgtttgttgtatcgtgatggccttctctatattgttcatccagtag

SEQ ID NO: 55250 - DNA, 225 bp, Artificial Sequence
  Description of Artificial Sequence: Synthetic coding sequence
atgacgaatgtttactccttggacggcattttggtgttcggcctgctgttcgtttgtacctgcgcttacttcaagaaggttccgagactgaaaacttggttgctaagtgagaagaaaggtgtctggggtgtcttttacaaagcagccgtgattgggaccagattgcacgctgccgttgctatcgcatgtgtcgtcatggctttctacgtactatttatcaaatag

SEQ ID NO: 55251 - DNA, 2094 bp, Artificial Sequence
  Description of Artificial Sequence: Synthetic coding sequence
atgtgcaagtccctcagatactgtttttcccactgcttgtatctggcaatgacccgtttggaagaggtcaaccgtgaggtcaacatgcacagctccgtgcgctaccttgggtatctcgccaggataaatcttctggtcgccatttgcctaggactttacgttcgctgggagaaaacagccaactcccttatcctggttatcttcatactgggcctcttcgtgctgggtatcgctagcattctgtactactacttctcgatggaagctgccagcctgtctctgtccaacctgtggtttggcttcctcctgggactgttatgcttcctcgataatagctcctttaaaaatgatgtgaaagaagagtcaaccaagtatctcctcttaacaagcattgtactgcgcatactgtgctctctggtggagcgtatctcagggtatgtgaggcaccgtccaaccctccttaccactgttgaatttctggaactggtggggttcgcgatcgcctctaccacaatgctcgttgagaagagtctttctgtcattctgctggtggtggcactcgccatgctgatcattgacctgcgcatgaagtcgtttctagccattccaaatcttgtgatttttgcagtccttctcttttttagtagcctggagacccccaaaaaccccatcgcattcgcgtgcttcttcatatgccttatcaccgatccctttcttgacatctatttctctggcttatcagtgacggaaaggtggaaaccgttcttatataggggccgtatctgtcgccgtctgagcgtcgtgtttgcaggtatgatagagcttacattcttcatcctgtcagcattcaagctaagggacacccacctgtggtattttgtaatcccaggatttagcatttttgggatattctggatgatatgccatatcatatttcttctcacattgtgggggttccacactaagctaaatgactgtcataaagtgtactttacacaccggacggattataacagtctggacaggattatggctagtaaaggaatgcggcatttctgcctgatttcagagcagttagtgtttttttccctcctagccaccgcaattttaggggcagtctcgtggcagcccaccaatgggatctttctcagtatgttcttaatcgttttgccacttgaatcgatggctcacggcctcttccacgagcttggcaactgcctcgggggtaccagtgtgggctatgctatcgtgattcccactaatttctgcagcccagacggtcagccgaccctgctgccaccagagcatgtgcaggagctgaacctcaggtccacaggaatgctgaacgccatccagcggttcttcgcctaccacatgatcgagacttacggttgtgattacagtacctcagggctctcattcgatacactgcatagcaagttaaaggcattcctggagctcagaactgttgacggcccaaggcacgatacatacattctttattactccggacatactcacgggacaggcgagtgggccctggccggaggagacacattgcgcttggatacactcatcgagtggtggagagaaaagaacggctcattttgcagtagactgataatcgtgctggacagtgaaaactccactccgtgggtcaaggaggttcgaaagattaatgatcaatatatcgcagtgcagggcgcagagttaattaagaccgttgacatcgaggaagctgacccaccacagctgggagatttcacaaaagattgggtcgaatataactgcaacagtagcaataacatttgctggaccgagaagggccgaacagtcaaagccgtgtacggggtcagcaagcgctggtctgactatactctgcatttaccaaccggcagcgacgtcgccaagcattggatgttgcactttccacgaatcacatatccactagtgcacttagccaactggttgtgcgggctgaatctgttctggatctgcaagacttgttttcgctgtctgaaaagactgaaaatgtcatggtttctccctactgtgctcgatacaggacaggggttcaaactggttaaatcttag

SEQ ID NO: 55252 - DNA, 942 bp, Artificial Sequence
  Description of Artificial Sequence: Synthetic coding sequence
atgttcctgatcgtgcttcccttggagtccatggcacacggtctttttcacgagctgggtaactgcctggggggtacttctgtggggtatgctattgtcattcccacaaatttttgtagccctgatgggcaaccaaccctccttccacccgaacacgtgcaggagcttaatctccgaagcacaggtatgctgaatgccattcagaggttcttcgcgtatcatatgatagagacgtacggttgtgactactcaacttctggtctcagtttcgacactctgcactctaagttgaaggctttcctggaactccggaccgttgacggtcccaggcatgacacctacatcctatattactcaggccatacccacggcacaggtgaatgggcgctggccggaggggacactctccggctcgacaccttgatcgaatggtggagggaaaagaatggaagtttctgcagcaggctcatcatcgtgctcgatagcgaaaacagcacaccctgggtgaaagaggttaggaagatcaacgaccagtacatcgctgtgcagggagccgaactcatcaaaacagtagatatagaagaggccgatccccctcagctcggggattttaccaaggattgggtagagtataactgcaactcctctaataatatttgttggacagagaagggcagaactgtcaaggccgtatatggcgtgtccaagaggtggagtgactacacactgcatctgccaacaggaagtgacgtggccaaacattggatgctccattttcccaggattacctacccactcgtccacctggcaaattggctttgcggtctcaacctgttttggatttgcaagacctgtttccggtgcttgaagaggctgaaaatgagctggtttcttcccaccgtgctcgataccggacaggggttcaaactagttaagtcctag

SEQ ID NO: 55253 - DNA, 2094 bp, Artificial Sequence
  Description of Artificial Sequence: Synthetic coding sequence
atgtgtaaatctctgcgatattgcttctctcactgcctttatctcgctatgacaagattggaggaggtaaaccgggaggtgaacatgcacagttcagtgcgttatctgggatatttggccaggattaatctactcgtcgcaatctgtctcggtctgtatgttcgttgggagaaaactgcaaacagcctgattttagtgatatttatcctgggcctgttcgtcttgggaatcgccagtatcctctactattactttagcatggaagccgcttctctatcactctccaacctctggtttggctttctgctcggcctactctgcttcctagacaacagctccttcaaaaacgacgtgaaagaggagtccaccaaatacttgttactcacatctattgtgctgcgcatcttatgctctctggttgagagaatctccgggtatgtgcgacatcgccctaccctgctaaccacagttgaatttttggagctggtggggtttgccatagccagcacaacaatgctagtggaaaagtcattgtccgtaattctgctggttgtggctctggcaatgctgattatcgatctgcgtatgaaaagttttctcgccatcccaaacttagtgatattcgctgttctgttgttttttagttctcttgagactcctaaaaaccccattgctttcgcttgttttttcatttgtctcattactgatcccttcctcgacatttacttctctgggctgtccgtaacagaacgctggaagccttttctgtaccgcggaaggatatgccggcgtctatcagtcgtttttgctggaatgattgaacttacattcttcatactttccgcctttaagcttcgtgacacccacctctggtattttgtgattccagggttctccattttcgggattttctggatgatttgtcacattatcttccttctgaccctatgggggtttcacactaagttaaatgactgccacaaagtctatttcacacataggacagactacaactcactggatagaattatggcttccaaggggatgagacacttctgtctaatcagcgagcagctcgtcttcttttctttgcttgcgactgccattctgggcgcagtatcatggcagcccactaatggaatttttctcagcatgttcctaatcgtgttaccactggagagcatggctcacgggctgttccatgagctgggcaattgtctcggtggcacaagcgtgggttatgctatcgtgatacccactaatttttgcagtccggacgggcagccaacactcctcccaccggagcacgtccaggagttaaatcttagaagcaccgggatgctcaacgccatccaaaggtttttcgcctaccacatgattgaaacctatggctgcgattattccaccagcgggctgagctttgataccctccatagcaaattgaaagctttcctggaactgcggacagttgacggccctcgtcacgacacgtatatcctgtactattctgggcatacccatgggactggggaatgggcactggcaggcggagatactctgcggttagacactctcatagagtggtggcgcgagaagaacgggagtttttgctctagattaatcattgtgctcgacagtgagaactctactccgtgggtgaaagaggtgcggaaaattaatgatcagtacatcgccgtgcagggagccgaacttattaagaccgttgacattgaggaagcggacccccctcagctgggcgactttacaaaggactgggtagagtacaattgtaatagcagtaacaatatctgttggaccgagaaggggagaaccgttaaagcagtgtacggtgttagtaagcgctggagcgactatacactgcacctgcctaccggctccgatgttgcaaagcattggatgctccattttcctcgcattacgtaccctctggtgcatctggctaattggctgtgtggtctcaacttattttggatttgcaaaacctgttttcgatgtttgaagcgcctcaaaatgtcctggttcctcccgaccgtactcgacaccggtcagggcttcaaattggtgaaatcttag

SEQ ID NO: 55254 - DNA, 894 bp, Artificial Sequence
  Description of Artificial Sequence: Synthetic coding sequence
atggaggagccgaccgcggtggagggtcaggtgcaactgcccagtcctcaccagggaagcctgcgcaaagctgtagccgcagccctggcacttgatggggagagcaccatgggtcaccggaaaaagaagagaaaagaaagcaggccagagtctattatcatttatagaagcgacaatgagaagaccgacgaagagcccggtgaaagcgaaggcggtgatcagcccaaagaagaggagggcgacgacttcctcgattacccggtggatgatgacatgtggaacttacctctggattcaagatatgtgaccctcactgggacaattaccagaggcaaaaaaaagggccaaatggttgacatccatgtgactctgactgaaaaagagttgcaggaactgaccaagcccaaagaatcctcccgagaaacaacaccggaagggaggatggcatgtcagatgggagccgatcggggtccacacgtggtgttatggaccctcatctgcttacccgtggtgtttatactgagtttcgtggtgagcttttactacggaacaatcacctggtacaacatctttctggtctataacgaggaacgcacattctggcataagatttcttattgtccttgcctggtactgttctaccctgtgttgataatggcgatggcctcttcgttaggcctgtatgcagccgtggtccaactgagttggtcctgggaggcctggtggcaagccgctcgcgatatggagaaagggttttgcgggtggctctgctctaaacttggcctcgaagactgctccccgtattccatcgtggagcttctggaatcggataacataagttctacgttatctaacaaggaccccatccaagaagtggaaaccagtacagtgtag

SEQ ID NO: 55255 - DNA, 894 bp, Artificial Sequence
  Description of Artificial Sequence: Synthetic coding sequence
atggaagaaccgaccgccgtggaaggccaggtgcagctgccctctccacaccaggggtcattgagaaaagctgttgccgctgcattagctttggacggagagagtactatggggcatcgaaaaaagaagcgcaaggaatccagaccagaatcaattatcatatatcgcagtgataatgagaaaacagatgaagagcccggagaatctgagggtggtgaccagccaaaagaggaggaaggcgacgatttcttggattatccggtcgatgatgacatgtggaatctgcccctggatagccgatatgtgaccctaactggaacgattacacggggtaaaaagaagggccaaatggtcgatatccacgtcactctcaccgaaaaggagctacaggaactaaccaagcccaaagaatcctctcgcgagactacgcccgaaggcagaatggcctgtcagatgggagccgaccgcggaccccatgtggtcttgtggacactgatctgccttccagtggtgttcatcctctcttttgtagtgtcattttattacggtactatcacctggtataacatttttctggtgtacaacgaggaacggacgttctggcataaaatttcatactgcccttgcctagtgctgttttaccccgtgcttattatggccatggcttcctcattaggtctttacgcagcagtagtgcagttgtcatggtcgtgggaagcctggtggcaggctgcacgagatatggaaaagggcttctgcgggtggctgtgcagtaaactcggactggaggattgttcaccctattccatagttgaactcttggaatcggataatatcagctccacattgtcaaataaagaccccattcaagaggtcgaaacatccacagtctag

SEQ ID NO: 55256 - DNA, 351 bp, Artificial Sequence
  Description of Artificial Sequence: Synthetic coding sequence
atggaggagcctactgctgttgaaggtcaggtacagttaccgtccccacaccagggttccctgcggaaagcggtagcggcagcgttagccctggatggcgagtctaccatgggccatagaaaaaaaaagcgcaaggaatcaagacccgagtctataattatctaccgcagtgataatgagaagacagatgaggaaccaggggagagcgaaggtggagatcagccaaaagaggaagaaggcgacgactttctagattatccagtggacgacgacatgtggaacctgccgttggactcccggtacgttaccctgaccggaactataacacggggtaaaaagaaaggtcaatag

SEQ ID NO: 55257 - DNA, 894 bp, Artificial Sequence
  Description of Artificial Sequence: Synthetic coding sequence
atggaggagcccaccgccgtggaagggcaagtgcaattgcccagcccacaccaaggctctttgcggaaggctgttgcagctgctctcgccctggatggggaatcaactatgggccatcgcaagaagaaacgcaaagagagtagacctgagagcataattatctatcgaagtgataacgaaaagacagatgaggaacctggcgagtcagaaggtggagaccaaccgaaggaggaggagggagatgacttcctggattaccccgtggatgacgatatgtggaacctgcccttagactccagatacgtgacgctgactggtaccatcacccggggaaaaaagaagggccaaatggtggacattcatgtcaccctcaccgagaaagaactgcaggagctaacgaaacccaaagagtcatcccgtgagacaacacccgaagggagaatggcctgccagatgggggctgacaggggaccccatgtggtcttatggaccctcatctgtctgcctgtcgtcttcatcctgtcattcgtagtgtccttctattatggaacgattacctggtacaatatcttcttagtgtataacgaggaaaggacattctggcataaaatcagttactgtccctgccttgtcctgttttacccagttctcatcatggccatggcttccagccttgggctttatgcagccgtagtgcaactgtcctggagctgggaggcatggtggcaagctgccagagatatggaaaaggggttttgcgggtggctttgctcgaaactaggccttgaagactgttcgccctatagcatcgtggaactccttgagtccgacaatatctcctcaacactgtcgaataaggacccgatccaggaggttgaaacatctacagtgtag

SEQ ID NO: 55258 - DNA, 894 bp, Artificial Sequence
  Description of Artificial Sequence: Synthetic coding sequence
atggaggaacccacagccgtcgagggacaagtccagctcccctctccgcatcagggttccctcagaaaggctgtggctgctgcgctggcacttgacggcgagagtacaatggggcataggaaaaaaaaacggaaagagtctcggccagaaagcattatcatctatcgctccgacaatgaaaagaccgacgaggagccaggcgagtcggagggaggagaccagccgaaagaagaagagggcgacgactttctcgattacccggtggatgacgatatgtggaatctgcctctagattccaggtatgtgaccctcacaggtactattactcgcggtaaaaagaagggccagatggtcgacattcatgtgacactcaccgagaaggagctgcaggagttgaccaaacccaaagaaagtagtagggaaacaacacccgaaggcagaatggcctgtcagatgggggcagatagaggtccacatgtagtactatggacactgatctgtctccccgttgtctttattctgagtttcgtagtatctttttattatgggactatcacctggtataacatcttcctagtctataacgaggagcggacgttctggcacaagatttcttactgcccatgcctggtgctgttttacccagtgctaattatggcgatggctagtagccttggcctatacgcagccgtggtgcagctctcttggtcatgggaagcctggtggcaagccgcacgcgacatggagaaagggttctgtggttggctgtgttcaaagctggggttagaggactgctcgccctactctattgtggagctattggagtcagataatattagttctacactcagcaacaaagacccaatccaggaggtcgagaccagtaccgtatag

SEQ ID NO: 55259 - DNA, 309 bp, Artificial Sequence
  Description of Artificial Sequence: Synthetic coding sequence
atggaggagcccaccgcagtggagggccaagtgcagctgccctcccctcatcagggctccctcaggaaggcggtcgcagctgctctagcattggacggcgagtctacaatgggacaccgcaagaagaagcggaaagaatctcggccagagtctataattatatatagatcggacaatgaaaaaaccgatgaggaaccaggtgagtctgagggcggagaccagccaaaggaagaggagggtgacgatttcctcgactaccctgtcgacgacgatatgtggaatctcccccttgactccaggtacgtatag

SEQ ID NO: 55260 - DNA, 597 bp, Artificial Sequence
  Description of Artificial Sequence: Synthetic coding sequence
atggaacttcctgacccggttcgccagcgtctgggcaatttctccagggcagttttcagtgacagtaaccgcacaggccctgaatccaacgagggccctgaaaacgagatggtcagcagcctcgcccttcagatgtccttatatttcaatacctactacttccctctttggtgggtgagcagtatcatgatgttgcacatgaagtattctatattgccagattattacaagttcatcgtgatcaccgtcattattctgattacactgatcgaggctatccgcctgtacctggggtacgtgggaaatctccaggaaaaagtgccagagctggcaggtttctggctgttgagtctgctgctgcagctgcctcttattctcttcttacttttcaacgaaggattaactaacctaccattggagaaggccatccacatcatatttaccctcttcttagccttccaggtagtggccgctttccttactctcaggaaaatggttaaccagctcgcggttaggttccatctccaggattttgaccggctgtcagctaataggggggatatgcgtcgaatgcgcagttgcattgaagagatctag

SEQ ID NO: 55261 - DNA, 435 bp, Artificial Sequence
  Description of Artificial Sequence: Synthetic coding sequence
atggaaagggagggaagtggcggatctggaggctccgccggtctgctacaacagattctgtctctcaaagtggttccaagagttgggaatggcactctctgtcctaacagtactagtctttgttcatttcctgaaatgtggtacggtgtatttctatgggccctggtgtcttctttatttttccacgtgcccgctggtctcctggcgctctttacgctgcggcaccataagtatgggcgattcatgagcgtttccattctcctgatgggcattgtcggccctattaccgccggaatcctaacatccgctgccattgcaggtgtgtatcgggcagctggcaaggaaatgataccctttgaagctcttaccctcggtacaggacagaccttctgtgtcttagttgtgtctttcctgcgcatcttggccaccctctag

SEQ ID NO: 55262 - DNA, 435 bp, Artificial Sequence
  Description of Artificial Sequence: Synthetic coding sequence
atggagcgcgagggatccggcggtagcggaggaagcgccggattgctacagcagatcctgtctctgaaagtcgtcccacgcgtaggcaatgggactctctgcccgaacagcacttccctttgttctttcccagagatgtggtacggggttttcttatgggccctggtgagctccctgttttttcacgtgccagccggactgctcgcgctattcacactgcgtcaccacaaatatgggcgttttatgtcagtgagtattctcctcatggggattgtcggacctattactgcagggatactgacttccgccgcaatcgcaggcgtctaccgagcagcgggtaaagagatgattccctttgaggcccttactctcggaaccgggcagaccttctgcgtactggtagtctcttttcttcgcattttagccacactctag

SEQ ID NO: 55263 - DNA, 399 bp, Artificial Sequence
  Description of Artificial Sequence: Synthetic coding sequence
atgaaggccgaggggggagatcattcgatgatcaacctatccgtacaacaagttttgtccctctgggcacacggaaccgtcttgcgcaaccttacagagatgtggtattggatatttctctgggctctattttcttccctcttcgtgcacggcgcagccggagtgctgatgtttgtgatgctccagaggcacagacagggcagagtaatctctgtcattgctgtaagcataggatttttggctagcgtgactggtgccatgataacatccgccgctgttgcaggtatttacagggttgccggtaagaatatggcaccactggaggccctggtttggggggtcggacagactgtcttgacgttgatcatttcattcagcaggatattggccacgctgtag

SEQ ID NO: 55264 - DNA, 399 bp, Artificial Sequence
  Description of Artificial Sequence: Synthetic coding sequence
atgaaggctgaaggaggagaccacagtatgatcaacctgagtgtgcagcaggtgctctcactctgggctcatggtactgtcctcaggaatctcaccgagatgtggtattggatttttctctgggccctcttctctagtctttttgtacacggagcagccggagtgttgatgttcgtcatgttgcaaaggcacagacaaggtcgtgtgattagcgtgattgccgtgtccattgggttcctggcctccgtcacaggcgcaatgatcacatccgccgctgttgccggtatctatagggtggctggcaagaatatggccccactggaggctttggtttggggggtggggcagacagtccttactttaattattagttttagtaggatcctggccaccctctag

SEQ ID NO: 55265 - DNA, 972 bp, Artificial Sequence
  Description of Artificial Sequence: Synthetic coding sequence
atgtcaccagccgcagctgccgagcctgatggagatcagcaggatcggcacgtgagtaaactgattttttgtttctttgtgtttggcgctgtgctgttgtgcgttggtgtcctgctgtctatttttggattccaggcatgtcagtacaagcctctacccgattgtccaatggtcctcaaagtagcaggtcccgcatgcgcagtggttggcctcggagcagttatcctggctcgttcccgggctcagcttcagctgagagcaggcctgcagaggggacagcagatggaccccgacagagcattcatttgcggggagagcaggcaattcgctcagtgcctgatatttggctttctttttctgacgtctggtatgctgatcagcgtgctaggcatatgggtccccggatgtgggtctaactgggctcaggagccccttaacgagaccgacaccggggactccgaaccacgtatgtgtggattcttatcactgcagattatggggccactaattgtcctggtggggctttgcttcttcgtggtggcacatgtgaaaaagcgtaacacactcaacgccggtcaggacgctagtgagcgagaagagggtcagatacagatcatggaacccgtgcaggtgacggttggggattcagtgattatctttcctcctccccctcccccttactttccagagtcgagcgccagcgccgtagcggaatcccctggcactaattctctactcccaaacgaaaatcccccatcctattattccatattcaattacgggactccaacatcagagggcgcagctagtgagagagattgtgagagcatctacacaatctcaggtactaattcttcaagcgaggctagccacacaccccacttgcccagcgagttaccgccaaggtatgaagagaaggaaaatgccgctgcgacattcctacccctgtccagcgagccttctcccccatag

SEQ ID NO: 55266 - DNA, 975 bp, Artificial Sequence
  Description of Artificial Sequence: Synthetic coding sequence
atgtctcccgctgccgctgccgaacctgacggggaccagcaggaccggcacgtcagcaagcttatcttttgtttctttgttttcggtgcagtcctgttatgtgtgggtgttctgctgtccatatttgggtttcaggcgtgtcagtataagcctctgcctgattgcccaatggtgctgaaggtggcaggccctgcatgcgctgtggtaggcctgggcgcagtcattctcgccagatctagagcccagttacaactcagggctgggctgcaacgagggcagcaaatggaccctgacagggcgttcatctgcggagagtccaggcagttcgctcaatgtctgatttttggattcctgtttctcacatcggggatgctgatatctgtgttgggcatctgggtgcctggctgcggtagcaattgggcccaggagccattaaacgagacggatacgggggattctgagccacgaatgtgtgggttcctcagtttgcagattatgggcccactgatcgtccttgttggcttgtgtttctttgtcgtcgctcacgtcaagaaacggaacacccttaacgcaggccaagacgcatcggaacgtgaagagggccagatccaaatcatggaacccgtgcaggtgactgtcggcgatagcgtgatcatcttcccgcctcccccaccaccttactttccagaatcttctgcctcggcggttgccgagtccccgggtaccaatagcctgttgccaaacgaaaatccacctagctattactccatatttaactatggacgcaccccaacatccgaaggcgcagcttccgaacgtgactgcgagtctatttataccatctcagggaccaatagttcttctgaggcgtcccacactccccatctgccatcagagctcccgccaaggtacgaggagaaggaaaacgccgcagccaccttcctgccgctctccagcgaacccagccctccctag

SEQ ID NO: 55267 - DNA, 732 bp, Artificial Sequence
  Description of Artificial Sequence: Synthetic coding sequence
atggaacagggaagtggccgactggaagatttccctgtcaatgtgttctctgttaccccttatactccttcaacagcggatattcaggtttcagatgacgacaaggcaggtgctaccctgttgtttagtgggatattcctgggcctggtaggtatcacattcaccgtgatggggtggatcaagtaccagggggtctcccatttcgagtggacgcaactgctggggcctgtactgttatcagtaggagtgacctttatactgatcgccgtgtgcaaattcaaaatgctgagctgtcagctttgcaaagaaagcgaagagcgagtccccgactcagagcagactcctggcggaccatcgtttgtgttcaccggaattaatcagccgatcacttttcatggagccacagtagtgcagtatattccacctccttacggatcccccgaacccatgggaataaacacatcctacctgcaaagcgtggtctctccttgcggactcatcactagtgggggagccgctgctgcaatgtcctcaccccctcagtactacacgatctacccccaggacaactctgcttttgtggttgatgagggttgcctttcatttacagacggcggaaatcataggcctaatccagacgtggaccaacttgaagagacacagttagaagaggaggcctgcgcttgcttctcgcccccaccttacgaagaaatctactctctgccacgttag

SEQ ID NO: 55268 - DNA, 1515 bp, Artificial Sequence
  Description of Artificial Sequence: Synthetic coding sequence
atgagccagccgcgtacacccgagcaggctcttgatacaccgggagattgcccgcctggcaggcgggacgaagacgccggagagggaatacagtgtagtcagcgaatgctctcattctccgatgctctattgtcgatcatcgccactgttatgatacttcccgtgacgcacaccgagatctccccagaacagcagttcgaccggtccgtgcagcgcctgctggcaacacgcatcgctgtgtacctgatgactttccttatagtaaccgttgcttgggctgctcacacacggttgttccaggtggtcggtaaaacagatgataccctcgcactcctcaacttagcgtgcatgatgaccataacttttttaccttatacattcagcctgatggttacgttcccagatgtccctcttggtattttccttttttgtgtgtgcgtgattgctattggcgttgtgcaggcactgatcgtcggctatgcgtttcacttcccgcaccttctaagtccccaaattcagcgctcagcacatagagctctgtaccgtcggcacgtgctcgggattgtgctgcaaggtccagcattgtgtttcgcagccgctatattttccctttttttcgtccctcttagctatctgctgatggtgaccgtgatcttgctgccatatgtctctaaggtaacaggatggtgtcgtgataggttgctgggccatcgcgaaccaagcgctcaccctgtcgaggtgttttcattcgatttgcacgagccactgtcaaaagagcgagtggaggctttcagcgacggcgtgtacgccatagtggccactctcctcatccttgatatctgtgaggacaacgtgcctgaccccaaggatgtcaaggaaagattctccggttctctggtggcagccctttcggctaccggcccacggtttctcgcatacttcggtagctttgcaacagtgggcctactatggttcgcacatcactcactgtttctccacgtgaggaaggctactcgtgcaatggggctcctaaacaccttatctctggctttcgtcgggggtttgccactcgcctaccagcagacaagcgcatttgctcgacagccccgagacgaactggagagggtgcgagtgagttgcacaattatttttctggcaagcatctttcagctggctatgtggacgactgcgttattgcatcaggctgagaccctacaaccctcagtatggttcggtggcagagaacacgtgctgatgtttgccaagctggcactgtacccttgcgcttcactccttgcttttgcttccacctgcctcttaagtcggttttctgtggggatcttccacctgatgcaaattgcagtcccttgtgcatttctgctgttaaggttattggtcggactggcgctggctacccttcgcgttctgcggggtctggcacgtccagagcaccctcctcccgcacccactggtcaggatgacccccagtcccagctccttccagctccttgttag

SEQ ID NO: 55269 - DNA, 798 bp, Artificial Sequence
  Description of Artificial Sequence: Synthetic coding sequence
atgacatttctgatcgtgacagtcgcatgggccgcacacactagactgttccaagtggtgggcaagacggatgacactctcgccctgctcaatctagcttgtatgatgaccattactttcctcccatatactttctcactcatggttacctttccagatgtgcctttgggcatcttccttttttgcgtgtgtgtaatcgcaatcggtgtggtgcaggcccttatcgtgggatacgcattccattttccccatctgctttcccctcagattcaacggagcgcccatagggccctctatagaaggcatgtgctcggcatcgtcctacagggccctgcattgtgctttgcagcagctatttttagcctttttttcgttccattgtcctatctcctgatggtgaccgtgatacttctaccatacgtgagcaaggtgaccggttggtgtcgcgaccgactcctgggtcacagagaacccagcgcccacccagtggaggtattcagcttcgatctacacgagcccctgtcaaaggagcgtgtggaagccttctctgacggagtttacgccatcgtggctacccttctgatactggacatctgcgcaccccatcgattcgctgctcctccggctccattcggctggctgctgctcccaagttcagtctgctcttcagccgcaagcagtgcgagtagcagcgtgcgagcacgtgtgagttctcagtcttctcggttctggtttctgtggggatttttcttcttctttcttagacaatcatgttgtgtcgcccaggccggagtttag

SEQ ID NO: 55270 - DNA, 405 bp, Artificial Sequence
  Description of Artificial Sequence: Synthetic coding sequence
atgagccaacccaggacgcccgagcaggcccttgacactccaggggactgtccccctgggagacgcgatgaggatgcaggcgagggaattcagtgcagtcaacggatgttgtcgtttagcgatgccctgttgtctatcatagccaccgtgatgatacttccagtgactcatacagaaatctcacctgaacaacagtttgatagatctgttcaaagactgctggccacgagaattgccgtgtatctgatgacgttcctcatcgtgacagtagcctgggcagcccacaccaggctcttccaggtggtgggtaagacagatgacacattagctctgttgaacttagcgtgcatgatgacaatcaccttcctcccttatacgttctctctaatggtaaccttcccatag

SEQ ID NO: 55271 - DNA, 1167 bp, Artificial Sequence
  Description of Artificial Sequence: Synthetic coding sequence
atgatgaccataacgtttctgccctacacattttcactgatggttacattccccgacgtgccgttaggaatttttttattctgcgtgtgtgttatcgctatcggtgtcgtccaagctctgattgttggatatgccttccacttccctcatctgcttagtcctcagattcagagatcagcccatcgagccttgtacagaagacacgtgctggggattgtgctccaggggccagccttatgcttcgccgctgccattttctctctgttctttgtacccttatcctacctgcttatggttacagtcatcttgctaccttatgtgagcaaagtgacagggtggtgtcgcgatcgactcctaggccaccgagagccatccgcacaccctgtcgaggttttcagctttgatctccatgagccattgagcaaagaaagggtcgaagccttctcagatggcgtatatgccattgtggccacattgctgatacttgacatctgtgaagacaatgtcccagaccctaaagatgtcaaggaaaggttctctggaagtttggtggctgctcttagcgcgaccgggcctcgctttttagcatactttggatcttttgcgacagtagggctcctttggtttgcacatcacagtctgttcctccacgtacggaaggccacgcgggcaatggggttactaaatacgttgagccttgctttcgtgggcggactgcctctggcttatcagcagacaagtgcattcgcccgtcagccacgcgacgagctagaaagggttcgggtaagttgcacaattatcttcctagcatctatttttcagctagctatgtggacaacagccctgctgcatcaggctgaaaccttacaacccagcgtctggttcgggggtcgcgaacacgtgctcatgtttgctaagttggctttgtacccctgcgccagcctgctcgcttttgcctcaacctgcctgctcagtcgatttagcgtgggcatctttcatcttatgcagattgcagtgccatgcgccttcctcctcttgagattactggtcggcctcgccctggcgacactccgcgtattacggggactggcacgaccagaacatccccctcccgcacccaccggccaggatgatccccagtcacaactgctccccgctccatgctag

SEQ ID NO: 55272 - DNA, 708 bp, Artificial Sequence
  Description of Artificial Sequence: Synthetic coding sequence
atgggcactgccgatagtgacgaaatggctcctgaagctccccagcatactcatattgacgtgcacattcatcaggagagcgccctcgctaaacttctcctgacatgttgctccgcgttgcgcccaagagcgacccaggccaggggctcaagtcggcttctggtggcgtcatgggtcatgcaaattgttctgggcatcctcagcgccgttctgggcggattcttttacattagggactatactcttctggtgacctctggcgcagcgatttggactggtgccgttgcagtactcgctggcgctgccgcattcatatatgagaagcgcggtggcacatattgggcacttctcagaacactcctaaccttggcagccttctcaaccgccatcgccgcactcaagttgtggaacgaggatttccggtacggctatagctactacaacagtgcttgcaggatatctagttccagtgattggaatacacccgctcctacgcagtcacctgaggaagtgcggaggttgcatttgtgcacatccttcatggacatgctaaaggctctcttccggaccctgcaagctatgctgctcggtgtctggatcttactgctgctggcttctttgacccctttgtggttgtactgctggcggatgttcccgactaaaggaaaacgagaccagaaggagatgctggaagtttcgggtatctag

SEQ ID NO: 55273 - DNA, 708 bp, Artificial Sequence
  Description of Artificial Sequence: Synthetic coding sequence
atgggcacggctgactctgacgagatggctcctgaggcccctcagcacacccacatcgacgtacacattcatcaagagtcagccctggccaaactgctgctcacctgttgctccgcactgaggccaagagctacacaggcccgaggcagctcgagactgctcgtagctagctgggtgatgcagatcgtcttgggcattctgtcagccgtcctcggtggctttttttatattcgcgattacaccctgttggtgacctctggcgctgcaatttggacaggggcagtcgctgtccttgctggagctgccgctttcatctatgaaaagcggggaggaacttattgggccttactgcgtaccctcctgactctggctgcattttctacagccatcgccgcattaaagttatggaacgaggatttccggtacgggtatagttactataactcagcttgcagaattagctctagttctgactggaacactcccgctccgacccagtctccagaggaagtaagacgtctgcatctctgcacctcttttatggacatgctgaaagccctttttcgcactctgcaagccatgctgctcggtgtgtggatactgctgctactggcgagcctcaccccactgtggctgtattgctggagaatgtttccaacaaagggtaaacgggaccagaaagagatgctggaagtctcaggcatctag

SEQ ID NO: 55274 - DNA, 813 bp, Artificial Sequence
  Description of Artificial Sequence: Synthetic coding sequence
atgacacagaataccgtgatcgtgaatggggtggcaatggccagccgtccttctcagccgactcatgtgaatgtacatatccaccaggaatctgccctgactcaactcctcaaggccggagggagcctcaagaagtttctgttccacccgggagataccgttccttctaccgcccgtatcggctatgagcagctcgcgctgggagtgacgcagatcctgctgggtgtggtgagttgcgtactgggtgtgtgtctgagtttagggccttggaccgtcctcagtgcctcaggatgtgccttttgggcgggatccgtcgtaatcgcggctggtgctggggctattgtgcacgagaaacatccaggcaaacttgcaggttatatctcgagcttgctgacacttgcaggattcgcaacagctatggctgcagttgtgctgtgcgtcaattcttttatttggcagaccgagccctttttgtatattgacaccgtttgcgaccggtccgacccagtgttccccactactgggtacagatggatgaggcgcagccaagagaaccagtggcaaaaagaggagtgtcgggcatatatgcagatgttgcgaaaactatttactgcgattcgggctctgttcctggctgtgtgcgtgttgaaggttatcgtcagtctggtgtccctcggcgttggtctacgcaatttgtgtgggcagtcgtcccagcctctcaacgaggaagggtctgaaaaaaggctgctgggagagaacagtgtgccccctagccctagccgggagcagacgtctaccgccatagtgttgtag

SEQ ID NO: 55275 - DNA, 813 bp, Artificial Sequence
  Description of Artificial Sequence: Synthetic coding sequence
atgacccagaacacagtcatcgtaaatggggttgccatggcctccaggccatcacaacccacacacgtgaatgtgcacatccaccaagaatctgcgctgacccagctgctgaaagcgggaggttctttgaaaaaattcctatttcatcctggagataccgtgccttccacggcccgaatcggctatgagcagctcgccctgggtgtcacccagatcttgctcggtgtggtctcctgcgtgctgggagtttgcctgtccctgggaccctggactgtcctctctgcgagcggatgcgctttctgggccggatctgtcgtcattgccgctggcgctggagcaattgtacacgagaaacacccgggaaaactggctggctatatctcctctttactgaccctggctgggttcgcaaccgccatggccgcagttgtactatgcgtgaactcctttatatggcagacagagcctttcttgtacattgatactgtctgtgacagaagcgacccagtgtttccaaccacaggatatcggtggatgcggagaagccaggagaatcagtggcaaaaggaagagtgccgggcttacatgcagatgctccgaaaactgttcaccgccatccgagcactgttccttgccgtgtgcgttctaaaggtgattgttagcctcgtctctctgggcgtcgggttgcggaacctttgcggtcagtcttcacagcctcttaatgaggaaggatctgaaaaacgtttgctaggcgagaactctgtgcctccctccccctcccgtgagcagacatcaaccgcgatcgttctgtag

SEQ ID NO: 55276 - DNA, 813 bp, Artificial Sequence
  Description of Artificial Sequence: Synthetic coding sequence
atgacccagaataccgtcattgtcaacggggtggcaatggcctcaagaccatcacagccaactcacgtgaatgtacatattcaccaggagtccgctttgacccagcttttgaaggccggagggtctttaaaaaagttcttgtttcaccccggagatactgtcccttctaccgcgagaataggctacgagcaactggctctgggggtgacgcagattcttctgggggttgtcagctgtgtgcttggggtttgcctgtcccttggcccatggactgttctgagcgccagcggttgtgctttttgggctgggtccgtagtgattgcagctggtgccggagctattgtccatgaaaagcatccaggtaagctcgcaggatacattagtagcctcctgacattagcgggttttgccactgccatggcggcagtggttttgtgcgtgaattcctttatctggcaaactgaacccttcctctacattgatacggtgtgcgacagaagtgacccagtgtttcccaccaccgggtatcgctggatgcgacgttcccaggagaatcagtggcaaaaggaggaatgccgggcatacatgcagatgttacgcaaattgtttaccgccatccgagctttattcctggctgtgtgtgttctcaaagttattgtcagcttggtctctctgggggtaggactgaggaatctgtgcggccagagttcccagccactcaatgaggagggaagcgagaaacgcctcttaggagaaaattctgtgccgccatcccctagccgcgaacagacatcaacagctattgtcttatag

SEQ ID NO: 55277 - DNA, 813 bp, Artificial Sequence
  Description of Artificial Sequence: Synthetic coding sequence
atgacgcagaatacagtgatcgtgaatggagtggcaatggcctctagaccatctcagcctactcatgttaacgtgcatattcaccaggaatccgccttgacccagcttcttaaggctggcggtagccttaaaaaatttttattccatcctggggacaccgtcccatctactgcaagaataggctacgagcagctggccttgggagtgactcaaatactcctgggcgtggtcagctgtgtcctgggagtatgcctctcgttggggccttggaccgtgctatctgcttccggctgtgcgttttgggcgggttccgtggtgatcgccgcaggggctggcgctatcgtccacgagaaacaccccggtaagctcgcaggttatatcagcagtctgctgacactcgccggttttgcgaccgcgatggcagcggtggtactttgcgtcaattccttcatttggcagaccgaacctttcttatacatagacacagtgtgtgataggtccgacccagtgtttccgacgacaggatatagatggatgcgacgatcccaagagaaccaatggcaaaaagaagagtgtcgggcttacatgcagatgctccgtaagcttttcactgcgatacgggctctgtttctggcggtttgcgtgctgaaggtgattgtctccttggtgagtctaggcgttggactgcgaaatctgtgcggacagtcatcacagcctttgaacgaggagggaagcgagaagcgcttactcggggagaactccgtcccccctagcccgtcccgcgagcagacttctacagctattgttttgtag

SEQ ID NO: 55278 - DNA, 702 bp, Artificial Sequence
  Description of Artificial Sequence: Synthetic coding sequence
atgacccagaacaccgtaatagttaacggcgtcgctatggctagcagaccatcacagcctacccacgtgaatgtgcacatacatcaagagtcagccctgacccaacttctgaaggccggaggttccctgaagaagttcttatttcacccgggagacactgtgccaagcactgccaggattggatatgagcagctggccctaggcgtgatcgcagcaggtgcaggagctatcgttcatgagaagcacccaggtaagctggctgggtatatttccagtctgttgaccctggctggcttcgccaccgctatggctgccgttgttctatgcgtgaattcctttatctggcagaccgaacctttcctgtatatagatacagtatgtgatagatctgatcccgtgtttcctacaactggttatcggtggatgaggaggtcacaagagaaccaatggcagaaagaagaatgtcgcgcatacatgcagatgctgagaaagctgtttaccgccatcagggctctgttcctcgcggtgtgtgtgctgaaagtgatagtgagtcttgtcagcctcggcgtcggcctacggaacctgtgcggccagtcaagccaaccactgaacgaggagggaagcgagaagagattgttgggcgaaaattctgtgcctcctagcccatctagagagcagacatctaccgctatcgtgctatag

SEQ ID NO: 55279 - DNA, 813 bp, Artificial Sequence
  Description of Artificial Sequence: Synthetic coding sequence
atgactcaaaacacggtcattgttaacggggttgctatggcgagccgtccctcgcagccaacccacgtcaacgttcacatacaccaagaaagcgccctgacacagctactgaaggccggaggtagcttaaagaaattcctcttccacccgggtgatacagtaccaagtaccgcaaggattggatacgagcagctcgccctcggcgtgacccagatcctcctaggggttgtgtcttgcgttttgggggtatgcctgtcactcggaccttggacagtgctgtctgcaagtggatgcgccttctgggccggttctgtcgtcatcgccgctggtgcgggtgccatcgtccacgagaagcatcctggaaagttagctggatacatatcatcattgctcactctggccggattcgccaccgctatggccgctgtggtgttatgcgtgaactcgtttatttggcaaacagaaccgtttttgtatatcgataccgtgtgcgacaggagtgatccagtgttcccaacaactggttaccggtggatgaggagatcacaggaaaaccagtggcagaaggaagagtgtagagcatatatgcagatgttaagaaagctgtttactgctatcagggcactgttcctggccgtatgcgtgctgaaggttattgtgtcactcgtcagtctgggagtgggtttacgcaacttgtgtgggcaatcgagccaaccacttaacgaagaaggaagcgagaagcgactccttggggaaaactctgtgccaccctctcccagtcgcgaacagaccagcacggccatcgtgctgtag

SEQ ID NO: 55280 - DNA, 813 bp, Artificial Sequence
  Description of Artificial Sequence: Synthetic coding sequence
atgacacagaataccgtaatcgtgaatggcgtcgctatggcttccaggccttcacaaccaacccacgtgaatgtgcacatccatcaggaatctgcccttactcaacttctcaaggcaggtggaagtttaaaaaagttcctgttccatcctggtgacacggtacctagtaccgcaagaattggctatgaacaactcgcgctgggggtgactcagatcttgctcggagtcgttagttgtgtgctgggagtgtgtctctctctcgggccttggactgtgctgtcagcttcaggctgcgcattctgggccggaagcgtggtcatcgccgctggcgctggtgccattgtgcatgaaaagcatcctggcaaactggccggatatatttcaagtcttcttacgttggccggatttgcaacagctatggcagccgttgtgctgtgtgtgaattcgttcatatggcagacagaacctttcttgtatattgatactgtatgcgacagaagcgatcctgtcttccctacaacgggctaccgctggatgagacgatcccaagaaaatcagtggcagaaagaggaatgtcgcgcttacatgcagatgctgcgcaagctgttcacggcaatccgggctttgttcttggccgtgtgcgtattaaaagtgatcgtttctctggtttcactgggggtgggccttcgcaatctgtgcggacagtccagtcagcccctgaacgaagagggcagcgaaaaaaggcttctgggcgaaaatagcgtccctccgagcccttcccgggagcagacatcaaccgctatcgtcctttag

SEQ ID NO: 55281 - DNA, 936 bp, Artificial Sequence
  Description of Artificial Sequence: Synthetic coding sequence
atggcgggtcctctatggagaacggcagcgtttgtgcagcgccaccgaacaggcctccttgttggttcctgcgctggactttttggtgtcccaatttcctatcatctcttcccagaccctgtcgtgcagtggctgtatcaatattggccccaggggcagccagcacctttgccaccacaactgcagagcctctttcaggaagtccttcaagatatcggggtgccatctggccattgttacaagccgttcaccaccttcaccttccagcctgtgtcggctgggttccctcgcttacccgcaggagccgttgtgggcataccagcatcattcctcggagaccttgtcattaacaccaatcatcccgttgtcatccacggacacaccgtcgactggagatcacccgcaggagccaggttgagggcgtcccttactctcagccgggaagcccagaaattcgccttagcaagggaggtagtctacctagagtcctctaccacggctgtgcatgccttactggcccctgcgtgcttggctggaacatgggctcttggggtgggcgcaaagtacaccctggggttacacgcgggaccaatgaatctgagagccgcattttctctcgtggctgcagtcgcgggattcgtcgcctatgccttttcccaggattcactgacgcatgcagtagaaagctggttggatcgtagaaccgcctctttgtctgcagcttacgcctgtgggggtgtggagttctacgagaagctgctttctggcaacctcgccttgcggtctctgctgggaaaagacggggagaaactgtatactccgtcgggcaacatcgtgccgaggcacctgtttaggatcaagcacctcccatatacaacccggcgtgactcagtgttacagatgtggagggggatgctgaatccaggacgcagttag

SEQ ID NO: 55282 - DNA, 936 bp, Artificial Sequence
  Description of Artificial Sequence: Synthetic coding sequence
atggctggtcccctctggcgaacagcagcctttgtacagcggcatagaacaggactcttggtaggcagttgcgctggacttttcggggtccctatttcttaccacctttttcccgatccagtggttcagtggctttaccagtactggccacaaggccagccggcacccctgccaccccagctgcagtccctatttcaggaggtcctgcaagacataggcgtgccttctggtcactgctataaaccttttaccacctttaccttccagccagtttccgctggcttcccacggttacccgctggggctgtcgtgggtatccccgcttcctttcttggcgatttggtcatcaacacaaaccatccagtcgtaattcacggccacactgtggactggaggtctccagctggcgctcgattgcgggcatccctgaccttgtcccgggaggctcagaaatttgcacttgccagggaagttgtgtatttagagagttccacaacagctgtccatgctttgcttgcgccagcatgcctcgcaggcacctgggccctcggcgtgggagccaagtacacgctcgggcttcatgccggaccaatgaatctgagagcagcctttagcctggtggcggctgtagccggtttcgtagcttacgcgttcagccaggacagcctcacccacgcagtggagagctggttggatcggaggacggccagcctctctgccgcttacgcctgtggtggcgttgaattttatgagaagctgctcagtggcaacctggctctgcgtagtctcttgggtaaggacggagaaaaactgtacacccccagcgggaacatcgtgcctcggcatttgtttagaatcaagcacttgccgtacaccactagacgtgattccgtgcttcagatgtggcggggtatgttgaatccgggtagatcctag

SEQ ID NO: 55283 - DNA, 753 bp, Artificial Sequence
  Description of Artificial Sequence: Synthetic coding sequence
atggccggaccactgtggcgcactgcagctttcgtacagcggcatagaaccggactactggttgggagctgtgccggattattcggcgttcccatcagttatcatctgttccctgaccccgtcgtgcagtggctgtatcaatactggccccaaggccaacccgctccactgcctccgcagctccagtccctgttccaagaggtgctgcaggacattggcgtgcccagcggtcactgttataagccttttacaactttcactttccagcctgtgtctgccggatttccacgactgcccgctggcgctgtggtgggtattcccgcatcttttctgggcgatctcgttattaacacaaaccaccccgtggtgattcacggccataccgtcgattggcggtcacctgccggtgctaggctgagagcctcactgactttgtctcgcgaagctcagaagttcgccctagccagagaggtggtgtacctggagtctagcacaacggctgtacacgcccttctggcgcctgcttgccttgctggcacctgggcactcggggtgggggcaaaatacactctgggactgcatgccggaccaatgaatctgagggcggctagtttatctgcagcttacgcctgcgggggtgtagaattctatgagaagcttctttcgggtaacctggcactgaggagcctgctgggcaaagacggcgagaagctccagatgtggaggggaatgctgaatccaggacgatcatag

SEQ ID NO: 55284 - DNA, 936 bp, Artificial Sequence
  Description of Artificial Sequence: Synthetic coding sequence
atggccggacctctatggagaacagctgcgtttgttcagcgacatcgcaccggccttctcgtaggctcttgcgccggtctgttcggagtgccaatttcgtaccacctgttccccgacccagtagtacagtggctgtaccagtactggccgcaaggccagcccgcacccctgcctccccaactccagtctttgtttcaggaagttctgcaggacattggagttcccagcggtcattgctacaaaccttttaccacatttactttccagcccgtctctgctggatttccacggctgcccgctggagcagtcgtgggtatcccagcctcctttttgggggacttggtaatcaataccaatcaccctgtggttatccacggccacacagtagattggagatcgcccgctggtgccagacttcgggcatccctgaccctcagccgggaagctcaaaaatttgcactcgccagggaggttgtttacttagagtccagcacaactgcggtgcacgcactcctggcgcctgcttgcctcgccggaacatgggcactgggcgttggggctaaatacactctggggctgcacgcagggccaatgaatctgcgggcagccttttcactcgtcgcggcagtggccggattcgtagcttatgccttctcacaagattcactgacccacgcagttgagagctggttggaccggcgaactgctagcctgtccgcagcgtacgcctgcggaggagttgaattctacgaaaaactgctatccggtaacttagctcttagaagtctgttggggaaggacggggaaaaactgtatactccttccggcaacatagtcccccgtcacttgtttaggattaaacatttgccgtataccacccggagggactctgtgctgcagatgtggcgaggcatgctgaaccccggtcgaagctag

SEQ ID NO: 55285 - DNA, 345 bp, Artificial Sequence
  Description of Artificial Sequence: Synthetic coding sequence
atggccggtccactgtggcggacagcagcttttgtccagcggcaccggacaggtctgctcgtagggtcatgcgcgggactgttcggcgtgccaatcagctatcacctgtttcccgatccagttgttcaatggctgtaccagtattggccacagggccagcctgctccactacccccacagttgcagtcacttttccaggaagtgttgcaggatatcggtgtgccttccggacattgctacaagcccttcacgacattcaccttccaacctgtcagtgctggcttcccacgacttcctgccggagcagttgttgggattcccgctagctttctgggcgatctgtag

SEQ ID NO: 55286 - DNA, 894 bp, Artificial Sequence
  Description of Artificial Sequence: Synthetic coding sequence
atggagcccagagccttggtaacagcgctgagcttggggctctctctgtgcagccttggcctgctagtgaccgccatattcaccgatcactggtacgaaacagatcccagaaggcacaaagagagctgcgagcgaagtagagcaggcgctgatcctccagaccagaagaatcgtcttatgcctctcagtcaccttccacttagagactctcccccactcggaagacggttgctgccagggggtcccggaagggctgatccagaatcttggcgcagcctgctgggactcggcggtctggatgccgagtgcgggcgaccactctttgcgacgtattccgggctgtggcggaagtgttacttcctaggcatcgatagagacatcgataccctaatcctgaaaggaatcgctcagcgctgtacagcgattaaatatcactttagccaacctatcagacttagaaatattcccttcaacctcacaaagactatccagcaggacgagtggcacctgctgcacctgagaaggattactgcaggcttccttggcatggccgtggcagttcttctgtgtgggtgcattgtcgctacagtgtccttcttctgggaggaatccctcacccaacacgttgcaggactgctctttctaatgaccgggattttttgtactatctccttgtgtacgtatgcagcctccattagttacgatctcaatcgtctgcctaagctaatctatagcttgcctgccgacgtcgaacacggctattcatggtctatattctgcgcgtggtgctcacttggttttatcgtggctgcgggagggctctgtattgcataccctttcatctctcgcaccaaaatcgcgcagctaaagtctggccgtgatagcaccgtgtag

SEQ ID NO: 55287 - DNA, 336 bp, Artificial Sequence
  Description of Artificial Sequence: Synthetic coding sequence
atggagcctagggccctcgtcaccgcactgtctctcggcctctctctgtgtagcttgggactgctcgtgaccgcaattttcacagatcattggtacgagactgaccctcgacgccacaaggaatcctgcgagagatctcgagcgggagctgatcctcctgaccagaagaatcgccttatgcctctgtcgcatctcttgggcccactggaggaggtgctcctgcccggtcatcggcctgggcatcggcacccacatcctgaacggtattgtgcagcaatgcatggccaccaggttccactgttctccgcccaccccctggctaagcatagtttctag

SEQ ID NO: 55288 - DNA, 594 bp, Artificial Sequence
  Description of Artificial Sequence: Synthetic coding sequence
atggcactgaacaacttcttgttcgcccagtgcgcttgctacttcctggcattcttattctctttcgttgtggtggtgcctctgagcgagaacggtcacgatttccgcggtaggtgtttgctgttcaccgagggtatgtggctctctgcaaacctgacagtccaggagagggaacgattcactgttcaggagtggggtcccccagctgcctgccggttcagtcttttagcttctctgctatcacttcttcttgctgccgctcacgcttggcgcaccctattctttctctgcaaagggcacgaaggatcatttttttctgcctttctgaatttactagtaagcgcctttgtagtattccttgtgttcatcgcttccaccatagtcagcgtgggttttaccatgtggtgtgatacgatcaccgagaagggaactgtgccacacagctgtgaagaactccaggacattgacctcgagttgggggttgacaactccgccttttatgaccaatttgccatcgcgcaagtgggcggatccggacaagagggacgcttggcgatgctcggcggaggccatctgcttctggatatctgttag

SEQ ID NO: 55289 - DNA, 702 bp, Artificial Sequence
  Description of Artificial Sequence: Synthetic coding sequence
atggctttaaacaattttttatttgcccagtgcgcttgctactttctggcttttctgttcagttttgtggtggttgtgccactgtctgagaatgggcatgacttcagaggcaggtgtctcctttttactgaagggatgtggctgagcgccaatctcacagtacaagaaagagaacgctttaccgtgcaggaatggggtcccccagctgcgtgtcggttctcgctgctagcctcccttctgagcctcctgctggccgcagcccatgcctggcggacactgttctttctgtgcaaaggccatgagggatccttcttctccgcttttctcaaccttctggtatccgctttcgtcgtattcctagtattcattgccagtacaatcgtctctgtggggtttacaatgtggtgcgatacgattacagagaagggcaccgtcccccatagctgtgaggaattgcaggatattgatctagagttgggcgtggacaacagcgccttttacgatcagttcgctatcgcccaattcgggctttgggcaagctggctcgcttggctggccatcacaacgctcgccttcctgaaggtgtaccacaactatcgccaggaagatctcctcgactcccttatacatgagaaagaactgctgcttgcccgaccttcccccagaacttccttccaagaggagaaaagcgccgtgatctag

SEQ ID NO: 55290 - DNA, 660 bp, Artificial Sequence
  Description of Artificial Sequence: Synthetic coding sequence
atggctctgagctggctacaacgggtcgagttggccctctttgctgccgcatttctctgtggggcagtcgcggcagccgctatgacacggactcaggggagtttttccggtcggtgccccctctatggcgtggctaccctcaatggtagctccctggctttgtctcgaccctccgcaccttctctctgctacttcgtagccggagcaagtggactgttggccttgtactgcctgctgctcctccttttttggatctactcatcctgcatagaggactcacaccgcggagcaattggcctgcgaattgcgctcgctatttccgcaattgccgttttcctcgtgctggtttcagcctgtatcctccgctttggcacacgatctctttgcaatagcataatcagtctgaacactacaatctcgtgctccgaggcacaaaaaatcccatggacacccccaggaaccgctctgcagttctatagcaacttacacaacgccgagacttcgtcttgggtgaacctcgttctgtggtgcgtcgtgctggtgctccaggtcgttcagtggaaaagtgaggccactccctacagaccgctggagcggggtgatccagaatggtcctctgagactgacgccctggtgggcagtcgcttatcgcactcgtag

SEQ ID NO: 55291 - DNA, 1554 bp, Artificial Sequence
  Description of Artificial Sequence: Synthetic coding sequence
atggggcttggccagccacaggcttggttactcggcctccccaccgctgtggtgtacgggagtctcgcgctctttactacaatccttcataacgtatttctgctgtactatgttgacaccttcgtttcagtctacaagatcaataaaatggccttttgggttggcgagaccgtgttccttctgtggaattctctcaacgatcccctgttcggatggctgagcgacagacaatttttgtcaagtcagccacgatccggtgccggactctcttccagagcagttgtgctggctcgggttcaagctttggggtggcacggtcctttactggcacttagctttcttgctttttgggtgccctgggcgcctgctggcctgcaatttctgctgtgcctgtgtctttacgacggttttttgaccttggtggacctgcaccaccatgccctgctggcggacctggccttatctgctcatgaccggacacatctgaatttttattgctcactttttagcgcagctggtagcttgtcagtgttcgcgtcttatgccttttggaataaagaggatttctcttccttcagggccttctgcgtgacactcgccgtctcaagcggacttgggtttttaggagccactcagctgctccgccgtcgagttgaagctgccaggaaggacccaggatgttccggactagtggtggactcaggcttgtgtggggaagaactcttggttggtagcgaagaggccgattccatcacactgggaagatacctgcgccagttggccaggcacagaaactttctgtggttcgtgtcaatggacctggtgcaggtgtttcattgtcattttaactcaaactttttccctctgtttctggaacacttgctgtctgaccatatcagcctctctaccggaagcattctgctcgggctttcttacgtcgcccctcacctgaataacctgtacttcctgtcactctgcagacgatggggcgtctatgcagttgttaggggcctgttcctgctcaaactaggcctgagtctgctcatgcttttagccggacctgatcatctaagtttactatgcttgtttattgcctctaaccgagtcttcacagagggaacatgcaagctgttgaccctggttgtgacggacctggtggatgaggacttagtgttaaatcaccggaaacaagccgctagcgccctgctttttggaatggtagccttggtaacaaagcctggacaaaccttcgcaccactgctcggcacatggctcttatgcttctacacaggccacgacctcttccagcagtccctgatcactcctgtcggctctgcccacccatggcccgaacctcctgctcccgcacctgctcaagccccaacactgaggcagggctgcttctatcttctggtgctcgtgcccattacatgtgccctattacagctcttcacctggtcacagttcacactgcatggcagacgactgcacatggttaaagcacaacggcagaacctctctcaggcacagacgctggatgtgaaaatggtgtag

SEQ ID NO: 55292 - DNA, 741 bp, Artificial Sequence
  Description of Artificial Sequence: Synthetic coding sequence
atggatttagttcaagtgttccattgccacttcaatagtaacttttttccactgttcctggagcatctgttaagcgaccacatttctttgtctaccggatcaattctcctgggtctctcctacgtggccccacatctgaataatctatatttcctgtccctgtgcagaaggtggggagtctacgccgtcgtgcgagggctgttcctgctaaagctgggcctgtctctgctgatgctgctggcgggacccgatcacctgtctcttctttgccttttcattgcgagcaacagagtttttacagaaggcacatgcaagctgcttacactggtggtaaccgatctcgtggacgaagacctcgtgttgaatcataggaaacaggccgcaagcgccctgctgttcggaatggtggcccttgtgactaaaccgggacagaccttcgccccattgcttggaacttggctgctctgtttttatactggccatgacctgtttcagcaatctttaatcacccctgtggggagcgcccacccttggccggagccgcctgctcctgcgccagcccaggcccctaccttgcgccaggggtgcttttaccttctggtgctggtccccatcacatgcgcgcttcttcagctgttcacctggagtcagtttactctacatgggcgtaggttacacatggtaaaggctcaaagacaaaatctgagtcaagctcaaacgttggatgtaaagatggtatag

SEQ ID NO: 55293 - DNA, 741 bp, Artificial Sequence
  Description of Artificial Sequence: Synthetic coding sequence
atggacttggttcaggtcttccactgccatttcaactccaacttttttcctctgtttctcgaacatctcctctccgatcatattagccttagtactggtagtattctgctgggattaagctacgtggctcctcatctcaacaacttgtactttcttagcctctgcagaaggtggggggtgtacgctgtggtgaggggcctgtttctacttaaactagggctctcccttcttatgctgctggccggtcctgaccacctgagtttactctgtctgtttatcgcctccaatagagtgttcaccgaggggacttgcaaattacttaccctggtggtcactgaccttgtggatgaagaccttgtgcttaatcataggaagcaggcggcaagtgcccttttgtttggaatggtcgcacttgtaaccaagcccggacaaacttttgcgcctctgttggggacctggttactgtgcttctataccggccatgatttattccagcaatcgttgatcactcccgtgggcagtgcacacccttggccagaacctccagcacccgcacctgcccaggcccctactctgagacagggatgcttctacctgctcgtgcttgtgcccattacctgtgccctgttacagctgttcacatggagccagtttacgctccacggtcgcaggctacatatggtgaaagcccagaggcaaaacctgtcacaggcccagactctggatgtcaagatggtgtag

SEQ ID NO: 55294 - DNA, 462 bp, Artificial Sequence
  Description of Artificial Sequence: Synthetic coding sequence
atgggactaggccagccccaggcttggctcctgggcctgccaacggcagtggtctacgggtcacttgccctgttcacaaccatacttcacaatgtgttcttgctctactacgtcgacaccttcgtgagcgtgtacaagataaacaagatggcgttttgggtgggagagaccgtttttcttttgtggaatagcctgaacgatcccctttttgggtggctaagcgaccggcagtttcttagctcacagcccagactgtgcggagaagaattactggttgggagtgaagaggcggactcaatcaccttagggcgatacctacgtcagctcgcgagacacagaaattttctgtggttcgtgagcatggaccttgttcaggtccaatggctgacgcctgtgattcccgctctaagagatgcgaaggttgaaagacctcttgagcccaggagttcacgcctgcaatag

SEQ ID NO: 55295 - DNA, 948 bp, Artificial Sequence
  Description of Artificial Sequence: Synthetic coding sequence
atgggcctaggccagccccaggcctggctgctcggtctgccaaccgctgtggtgtacggttccctggctttgttcaccacaatcctgcataacgtttttctgctttactatgttgacacttttgtgtctgtgtacaagatcaataagatggctttttgggtcggggaaactgtctttctgttatggaattctctgaatgaccccctgttcgggtggctcagtgaccgccagttcttgtctagtcagccgagactgtgtggtgaagagctcctcgttggctccgaggaggccgacagcatcacattgggacgctacttaagacaactggccagacatagaaattttctgtggttcgtgtccatggatctggttcaagtgttccattgtcattttaactccaacttttttcccttattccttgagcaccttctgtctgaccacatctctcttagcaccggcagcattctccttgggttgtcttatgtagctcctcatttgaacaacctttatttcctatctttatgccgtcgatggggagtatatgccgtagtgcgaggactttttcttttgaagttgggcttaagccttctgatgctccttgctggtcccgaccacctgtcactgttatgtcttttcatagctagcaacagggtgtttacagagggcacgtgcaaactgcttacactggtcgtgacagacttggtagatgaggatcttgtcctgaatcaccgcaaacaggcagcctcagccctcctttttggtatggtcgcccttgttactaaacctggacaaaccttcgccccacttctgggcacatggttgctatgtttctatactggctgggaccttggctatgcgctggcccatagtctgttgaatcaggccggtccgaggtcacggatggcccaagaccagcccagaggagggcttccaacttcgacgacttag

SEQ ID NO: 55296 - DNA, 402 bp, Artificial Sequence
  Description of Artificial Sequence: Synthetic coding sequence
atgaggggagaacataatagcacaagctatgactctgcggtgatctatagagggttttgggcggtgctgatgctgctgggagtcgtcgcagttgtcattgcctctttcctgattatctgtgcggctccattcgcaagccactttctctataaggccggaggaggatcctatatagcagcagggatactgttttccctagtcgtcatgttatatgtgatctgggtccaggccgtggcagatatggagtcctaccgcaacatgaaaatgaaggactgcctcgattttacgcctagtgtcctgtatggatggagttttttcctggcacccgctggcatctttttttctttgctggccggactactcttcctggtcgtgggctggcacattcagatccaccattag

SEQ ID NO: 55297 - DNA, 690 bp, Artificial Sequence
  Description of Artificial Sequence: Synthetic coding sequence
atgcgcttgaacattgccatcttcttcggggcactgtttggcgcactcggcgttttgctctttctcgtcgcttttggctccgactattggttactggcgactgaggtcggccgatgcagcggagagaagaatatcgaaaacgtgacttttcatcatgagggctttttctggcggtgctggttcaatggcattgtggaggaaaacgactcaaatatctggaagttctggtatactaaccaacccccaagcaaaaattgtacccatgcatatctgagcccataccctttcatgcgcggagagcataactcaaccagctatgactcagcagtaatctacaggggattttgggcagtgctgatgctgttgggagtagtagctgtcgttatcgcctcttttcttataatatgcgcagcaccattcgcatcacattttttgtacaaagctgggggaggaagttacatagcggctgggatcctcttctcactggtggttatgctgtacgtgatctgggtacaggctgttgccgatatggagtcctaccgcaatatgaaaatgaaggattgcctggacttcacaccatctgtactgtacggctggagcttttttctcgcccctgcgggaattttcttttctcttctcgccggattgctgttcctcgttgtgggatggcatatccaaatccaccactag

SEQ ID NO: 55298 - DNA, 1131 bp, Artificial Sequence
  Description of Artificial Sequence: Synthetic coding sequence
atggcgagagggcctggcccactcggacggcctcggccagacacggtggctatgcccaaaaggggcaagagactgaaattcagagcccacgatgcatgcagtggcagggtaaccgtcgctgactacgccaattctgatcctgccgtggttcgaagtggcagggtcaagaaagccgtagcgaatgccgttcagcaagaagtgaagtctctttgtggcctcgaggcctcccaggtccccgcagaggaggccctgtcaggggctggcgaaccatgtgatattattgactcctctgatgagatggatgcgcaggaagagtcgatacacgaacgaaccgtctcacgcaaaaagaaatcaaaaaggcacaaggaagagttagacggcgctgggggtgaagagtatccaatggacatttggctcttactcgcttcgtacatcaggcctgaggacatcgtaaactttagtctgatatgtaagaatgcttggaccgtgacctgcaccgcagcattttggacacggctctatcgcagacattacactctggacgcctcgctcccccttcgtctccgtcccgagtccatggaaaagctccgatgtctcagagcctgtgtcattaggagcttgtaccatatgtacgaaccttttgcggcacggatcagcaagaatcctgctatcccggaatcaacaccatccacacttaagaatagtaagtgcctgctcttttggtgcagaaaaatcgtcgggaatcggcaagaaccaatgtgggagttcaactttaaatttaaaaaacagtcccctaggctgaaaagcaaatgtaccggagggctccagccccctgtgcagtacgaggacgtgcacacaaaccctgaccaagattgctgtctgctgcaagtgactactttaaatttcatattcatcccaattgtgatgggaatgattttcacactgtttactattaatgtctctaccgacatgcgccatcatcgcgtgagactcgtctttcaagacagccccgtgcatgggggtagaaagttgcgatctgagcagggagtccaggtaatcctggacccagttcacagtgtccggctctttgactggtggcatccccagtacccattctccctgcgggcttag

SEQ ID NO: 55299 - DNA, 1242 bp, Artificial Sequence
  Description of Artificial Sequence: Synthetic coding sequence
atgtctaacgtcagtggcatcctggaaactgcgggagtacctctggtgtccgcaaattggcctcagcccagcccccctcccgctgtccctgcaggccctcagatggaccacatgggtaactcttctcagggcgcaccatggctcttcctaaccagtgctcttgctcgcggagtgagcggaattttcgtttggaccgcactagtcctgacctgtcaccagatctatcttcacctccgctcttacacagtcccccaggaacagcgctatatcattcggctgttgctcatagttcctatatacgcttttgactcctggctatctctcctccttctaggtgatcaccagtattatgtttactttgactcggtgcgggactgctatgaagcatttgtcatctattcctttctgtccctgtgtttccaatatctgggtggcgagggagcaattatggcagagatccgcggtaagccaataaagagctcttgcttgtacggcacttgttgtctacgcggtatgacctattctatcggctttctccggttttgtaaacaggccaccctgcagttttgcttggttaagcccgttatggccgttaccacaatcatcctgcaggccttcgggaaatatcacgacggagactttaacgtcagaagcggctacctatacgtgacgctcatctataacgcctcagtcagtctggcactgtacgctctcttcctgttctactttactacaagggagctgcttcgaccttttcagcccgttctgaaatttctgacaatcaaggctgtcatattcctgtcattttggcaaggtctgttattagcaatcctggaacgttgcggcgtgataccagaggttgagacttccggaggtaacaaactcggggctggcactctagctgcaggataccagaactttattatttgtgtggagatgctgtttgcatccgtggcactaaggtatgcctttccctgtcaggtctatgcggagaaaaaggagaactcccccgctcctcctgcgcctatgcaatctatctcatcagggatcagggagaccgtgtctcctcaggacatcgttcaggatgctattcacaacttctctccagcctaccagcattacactcagcaggcgacccacgaggcacctaggcctggaacacatccttccggtggatcaggcggtagccgaaaaagccgtagcctggagaaacgcatgctgatacctagcgaagacctctag

SEQ ID NO: 55300 - DNA, 528 bp, Artificial Sequence
  Description of Artificial Sequence: Synthetic coding sequence
atgtccaacgtgagtgggattctggaaactgccggagtgcccctggtgagtgccaactggcctcagccttccccgccaccggcagtccccgctggtcctcagatggaccatatgggaaacagttcccagggcgctccgtggctctttctgacatctgcactagctcgaggggtgtctggtattttcgtgtggaccgcactcgtgctgacatgccaccagatctacctgcacttgcgctcgtacacagtgccacaggagcaacggtatatcattcggcttctcctcattgtccctatatatgcctttgatagctggctttcgctgctgcttctcggggatcaccagtattacgtgtacttcgattcagtgagggactgttacgaggctttcgtgatttacagtttcctctccctatgctttcagtatctcggaggcgaaggagccatcatggcagaaatacgcggaaaaccaatcaaaagttcatgcctctatggcacatgttgtctcaggggcatgacctattcctag

SEQ ID NO: 55301 - DNA, 420 bp, Artificial Sequence
  Description of Artificial Sequence: Synthetic coding sequence
atgagcaacgtctcagggattcttgaaactgccggagtgcccctggtgagtgcaaactggccccaaccaagccccccaccagccgtgcctgcagggcctcagatggatcacatgggtaacagctcccagggagccccttggctgtttctgacaagcgccctggcaagaggggtctcaggcatattcgtgtggactgccttagtgctaacgtgtcatcaaatctacctgcatctcagatcctacacagttccccaagaacaaagatatataatccgtctattgctgatcgtccctatttacgccttcgacagctggctgagccttctgctgctaggcgaccaccaatactatgtatacttcgactccgtgcgggattgctatgaggctttcgtcatctattcctttctctcgttgtgttag

SEQ ID NO: 55302 - DNA, 477 bp, Artificial Sequence
  Description of Artificial Sequence: Synthetic coding sequence
atgagcaacgtgtccggaatactggaaaccgcaggggtgccccttgtatccgcaaattggccacagccttctcccccaccagccgtgcctgccggacctcagatggaccacatgggaaactcaagtcaaggagccccatggctattcttaacctctgcgctggcaaggggcgtgagcggcatattcgtttggactgctcttgtcctgacatgccaccagatttatctgcatttgcgctcttatacagtgcctcaggaacaacgatacattatccggctgttgctgatagtcccaatatacgcctttgatagctggctttccctactcctgctcggagatcatcagtattatgtttatttcgacagcgttagggattgctatgaagcgttcgtcatctacagcttcttatcactgtgctttcagtacttgggcggtgagggcgctattatggcagaaatcaggggcaaaccaatttag

SEQ ID NO: 55303 - DNA, 1224 bp, Artificial Sequence
  Description of Artificial Sequence: Synthetic coding sequence
atgacggttcgcggagacgttttggccccagacccagcttctcctaccaccgctgctgcctcaccaagtgtcagtgtgatcccggaaggctccccaacagctatggaacagccggtgttcttgatgaccacagctgcacaggccatatcagggttttttgtctggacagcattgctgataacttgtcatcagatctatatgcacctcagatgctatagctgtcccaacgagcagagatacatcgtgcggattctcttcatcgtgcctatttacgcctttgattcttggttgtcactcctgttcttcaccaacgaccagtactatgtctatttcgggaccgtgcgagactgctatgaggccctcgttatttataattttttgagcctgtgttacgaataccttggcggagaatccagcatcatgtctgaaattcgcggaaagccaattgaaagttcttgcatgtacgggacctgttgtctctggggcaagacgtattcaataggctttctgagattctgtaagcaggccaccctacagttctgcgtcgttaaacccctaatggcagtatctacggtggttctgcaggcgtttggcaaatatcgggatggtgacttcgatgtgacatctggctacttgtacgttacaattatttacaacatttcagtaagtcttgcattgtacgcgttatttttgttttactttgccactcgggaattgctaagcccttactcacctgtgctgaagttttttatggtgaagtcagtgatctttctgtcattctggcaggggatgcttcttgctatactggagaaatgcggcgcaatcccgaaaatccattccgcacgggtcagcgttggggaaggcacggtggctgctggctatcaggatttcattatctgtgttgaaatgttcttcgccgctctcgcactccggcacgcattcacatataaagtttacgctgacaaaaggctcgacgcccaagggcgttgcgcaccaatgaaaagcatcagctccagcctgaaagagacgatgaacccgcatgatatcgtgcaagacgcaatccacaatttcagtcccgcttatcaacagtacacccagcagtcaacactcgaacctggacccacgtggcggggaggggcacatggactgagccgcagtcactctcttagtggggctcgcgacaatgagaaaactcttctgctgagtagtgacgatgaattttag

SEQ ID NO: 55304 - DNA, 1224 bp, Artificial Sequence
  Description of Artificial Sequence: Synthetic coding sequence
atgactgtgcgcggagacgtgttagctcccgaccccgctagcccgactaccgcagccgcttctcccagcgtctcagtgatacccgaaggtagcccaacagccatggaacagccagtgttcctcatgacaaccgccgcacaagctatctcagggttctttgtgtggactgccctcttgataacctgtcaccagatctacatgcaccttagatgctactcttgccccaacgaacagcgctatatagttagaatcttgtttatcgtgcccatctacgcctttgatagctggctttcacttctgttttttaccaacgatcagtactatgtgtacttcggaaccgtcagggattgctatgaggccctcgttatttacaatttcctgtcattatgctacgaatacctcgggggtgagtctagcattatgtccgagattagaggtaagccaattgaaagcagttgcatgtatggtacctgctgcctgtggggtaaaacatattcgatcggctttctgaggttctgcaagcaggcaacactgcagttttgcgtagtgaaacctctcatggctgtctctaccgtggtgctgcaggctttcggcaagtaccgtgacggggattttgacgtaacctccgggtacctttatgtgacaataatatataacatctcagtcagcctggccctgtatgccctgttcctgttctacttcgccacacgggaactcctgtccccttactcccccgttctgaaattctttatggtaaagagcgtaatttttctttcattttggcagggaatgttgctcgcaattctggaaaagtgtggggctattcctaagattcattccgctagggtgtcagtgggcgagggcaccgtcgcggctggctaccaggatttcattatctgcgtcgagatgttttttgcagccctggcattacgacatgcatttacgtataaggtgtacgcagacaaaaggctggatgcacagggcaggtgcgcccctatgaagtccatatcctcctcactgaaggagacgatgaatcctcatgacattgtacaggacgcaatccacaatttcagtcccgcataccagcagtacacacagcaatccacacttgagcctggacccacatggcgaggtggagcccacggactctcccgatctcactcactcagcggggcacgagataacgaaaagactcttcttctgtcatcagatgacgagttctag

SEQ ID NO: 55305 - DNA, 420 bp, Artificial Sequence
  Description of Artificial Sequence: Synthetic coding sequence
atgcacctgagatgttattcttgccctaatgaacagaggtatatagtacgtatacttttcatcgttccaatctatgcttttgacagttggctctccctattattttttacaaatgatcagtactatgtgtatttcgggaccgtgcgcgattgttatgaggcgctggtcatatacaatttcctttccctctgctacgaataccttggtggggaaagttcaattatgagtgagatcagaggcaaacccatcgagtcctcatgcatgtacggcacctgctgcctttgggggaaaacatactccattggattcctgagattttgtaagcaggcaacactccaattctgcgtcgtgaagccacttatggctgtgtcgacagtggtcctgcaggcctttggcaaatacagggatggggacttctag

SEQ ID NO: 55306 - DNA, 219 bp, Artificial Sequence
  Description of Artificial Sequence: Synthetic coding sequence
atgacagtgcgaggcgacgtcctggctcccgatcctgcttctccgacaactgctgctgccagtccctccgtgtcggtgatcccagaggggagcccgaccgctatggagcagcccgtattcctgatgacaaccgctgctcaggccatttctggcttctttgtttggacggcgctcctgatcacttgccatcagcccagagcccgtttgggccaggtctag

SEQ ID NO: 55307 - DNA, 1053 bp, Artificial Sequence
  Description of Artificial Sequence: Synthetic coding sequence
atgaatcccaggggcctgttccaggactttaaccctagcaagtttctcatctatacctgtctgctgctgttttcagtgctgctgccattgcgattggacggtatcatccaatggtcatattgggccgtattcgctccgatctggctgtggaaactcctggtagtcgcaggcgcttccgtgggggcaggagtatgggccaggaatccgcgttaccggacagagggagaggcttgtgtggaattcaaagcaatgttgattgccgtgggcatccatttactgctgctcatgtttgaggtccttgtgtgtgatcgcgtcgaaaggggcacccacttttggttactcgtattcatgccactcttttttgtttcgcccgtttccgttgccgcatgtgtctgggggttccgccacgatagatccctggagctcgaaatcctttgttcagtaaatattctgcagttcatcttcatcgccctgaaactggaccgcataatccattggccctggcttgttgtttttgtgccgctttggatcctgatgagtttcctgtgtctggtcgtcttgtactatattgtgtggtcattactttttttaagaagcctcgacgtggtcgcggagcagaggaggactcacgtgacgatggccatttcctggatcacaattgttgttcccctgcttacctttgaggtcctgctcgttcatcggctggatgggcataacaccttttcctacgtcagcatcttcgtccctttatggctgagcctcctgaccctcatggctactaccttcagacgaaaggggggaaaccattggtggttcggcattcggagagacttctgccagtttctcctggagatatttcctttcctccgggaatacgggaacataagctatgacttgcaccacgaggactcagaagatgcggaagaaacctcagtgcctgaagctccaaagattgcgccaatctttggcaagaaggctagggtcgtgataacacaaagcccagggaagtacgttccacctcctcccaagttgaatattgacatgcctgattag

SEQ ID NO: 55308 - DNA, 642 bp, Artificial Sequence
  Description of Artificial Sequence: Synthetic coding sequence
atggccgctttactgagagccgtccgcagatttagaggaaaggctgtctgggaacgcccactgcacggcttgtggtgctgcagcggccaagaggaccctaagcgttgggtgggatcaagctccccaatatccaaggaaaaactcccaaacgcggagacagaaaaattttggatgttctataggttcgatgccatacgcacatttgggttcctgtcccggctgaaactggcacagacagccctcaccgtggtcgccctgccacccggatattacctatacagccagggcctgctcacactcaacacggtgtgtttgatgtctggcatcagcgggttcgcccttacaatgctctgctggatgagctactttctgagacggctggtcggaattctctatctcaatgaatcgggaacaatgctgagagtcgctcaccttaacttctgggggtggaggcaggacacttactgccctatggcggacgtgattcccctgactgaaaccaaagataggccacaggagatgttcgtgcggatacagagatactcaggaaaacagacgttttacgtgaccctacggtatggccgaattcttgaccgggaaagattcactcaagtcttcggcgtccaccagatgctgaaatag

SEQ ID NO: 55309 - DNA, 786 bp, Artificial Sequence
  Description of Artificial Sequence: Synthetic coding sequence
atgaaccccgagtggggccaggcgtttgtacatgtcgcggtggctgggggactttgtgccgtggcagtctttacgggaatctttgactccgttagtgtgcaggttggatacgagcactacgcagaggctcctgtcgccggactgccggcttttctagccatgccttttaattcattggtaaacatggcatacaccctcctaggcctgtcttggttacacaggggcggagctatggggttgggcccacgctaccttaaggatgtatttgcagcgatggccctgctgtacggtcccgtgcaatggctgcggctgtggacacagtggagacgggctgctgttctcgaccaatggctcacactccctatattcgcatggcctgtggcctggtgcctttacctggatagaggctggagaccatggctgtttctgagcctggagtgtgtgagtcttgcatcttacgggcttgccctactgcacccacagggcttcgaggttgcccttggagcacatgtggtagctgccgtcggccaggcgcttcgcacacacagacattatggatctaccacctccgcgacttaccttgccctaggagttctgagctgtctgggtttcgtggtgctgaaactgtgtgatcatcagctggccaggtggagactattccagtgtctgacagggcacttttggagcaaggtctgcgacgtcttgcagtttcactttgcatttctcttcctgactcacttcaatacgcaccccaggttccacccctccggaggaaagactaggtag

SEQ ID NO: 55310 - DNA, 201 bp, Artificial Sequence
  Description of Artificial Sequence: Synthetic coding sequence
atgaaccccgagtgggggcaagcttttgttcacgtggccgtggccggaggactgtgtgccgtggccgtgttcacaggcatttttgatagcgtctccgtccaagtcggttatgagcactacgcagaagcgcctgtcgctggattgccagcatttctggccatgccttttaacagcttggtcaacatggcctatactctctag

SEQ ID NO: 55311 - DNA, 102 bp, Artificial Sequence
  Description of Artificial Sequence: Synthetic coding sequence
atgaaccctgagtgggggcaggctttcgtgcatgtggcggtggccggtggcctctgtgcagtagctgtgttcaccgggattttcgactctgtcagcgtttag

SEQ ID NO: 55312 - DNA, 144 bp, Artificial Sequence
  Description of Artificial Sequence: Synthetic coding sequence
atgaatagcttggaacaggctgaagatctgaaagctttcgagagaagactcactgaatacatccattgcctgcagcctgctactgggagatggcgttcagtgctcttgcatataataatggaaagcccaattttccatcactag

SEQ ID NO: 55313 - DNA, 378 bp, Artificial Sequence
  Description of Artificial Sequence: Synthetic coding sequence
atgaattccctcgaacaagccgaggaccttaaggcattcgagcgacggttaactgagtatatccactgtctgcaaccagctacgggaaggtggcgaatgctgctaattgtggtgagtgtgtgcaccgcaaccggcgcttggaattggctaatcgaccctgagacacagaaggtttcattctttacatctctgtggaatcacccgtttttcaccatctcttgcattaccttgatcggcctgttcttcgctggtattcataagcgcgtggtggctccttctatcatagcagccagatgccggacggtcctcgccgaatacaacatgtcatgcgacgatactgggaagctgatcttaaaaccaagaccccatgtgcagtag

SEQ ID NO: 55314 - DNA, 429 bp, Artificial Sequence
  Description of Artificial Sequence: Synthetic coding sequence
atgaacagtttggagcaggctgaggcaccaagagtggtatctcttatccctgccgtggtctcaggtaactgtcaagatcttaaagccttcgaaaggcgcctgactgagtacattcactgcctccagccggctaccggacgatggcgtatgttgctgatcgttgtgtctgtgtgcaccgcaactggagcttggaattggctcatagacccggaaacacaaaaagtatctttcttcacgtcactctggaatcaccctttttttactatctcctgcataacccttatcggcctgttcttcgccggaatccacaaacgggtggtcgcacccagcattattgccgcacgctgtcggacagtgctcgccgagtacaacatgtcttgcgatgatacaggtaagctgatcctgaagcccagaccccatgttcagtag

SEQ ID NO: 55315 - DNA, 804 bp, Artificial Sequence
  Description of Artificial Sequence: Synthetic coding sequence
atggctggcgctgaaaattggcctggtcagcagctggagctggatgaggatgaagctagttgctgccggtggggagcacaacatgcaggagccagagagctcgcggctctatacagccccggaaagaggctgcaggagtggtgctccgtaatactttgtttctctcttattgcccataatctggtccatttgctgctcctcgccaggtgggaagatacccccctcgtcatcctgggggtagtggcaggcgcactgattgccgatttcctttcgggtctcgtgcattggggcgctgacacatgggggtcggtcgaactccctattgcgtttatcaggcctttcagagagcaccacattgacccaacggcaattactcggcatgatttcatagaaaccaatggggacaactgtcttgttacattgttgcctctcctcaatatggcctacaaatttcgcacgcatagcccagaagcccttgaacagctctatccatgggagtgcttcgtgttctgtctgatcattttcgggacatttacaaaccagatacataaatggtcccatacttatttcggcctgcctaggtgggtgacactgttgcaggattggcatgttatccttccgagaaagcaccacaggatccatcacgtaagtccccatgagacctacttttgtataaccaccggttggttgaactatcctctggagaaaatcggcttctggcgccgattagaggacctaatccaaggactgaccggcgaaaagcctcgagcagacgacatgaagtgggctcagaagataaagtag

SEQ ID NO: 55316 - DNA, 813 bp, Artificial Sequence
  Description of Artificial Sequence: Synthetic coding sequence
atggccggagcggagaactggcccggacagcaactggaactggacgaggatgaagccagctgttgcaggtggggagctcagcacgctggcgcacgagagctggctgctctgtactcacccggtaagcgcttgcaagagtggtgctctgtcatcttgtgcttttctcttatcgcccacaatctggtgcacctactgttgctggcaagatgggaagatacacccctagtgattctcggtgtcgtcgcaggtgccctcattgcagacttcctcagcggcctggtgcactggggagctgacacgtgggggtccgtcgagctccccattgttggtaaggcattcataaggccattccgggagcaccacattgaccctactgccatcaccaggcacgacttcatcgaaacgaacggggacaactgccttgtaactttgttgccgcttttgaatatggcttataaattccgtacccacagcccggaagccttagagcagttatacccctgggagtgtttcgtgttctgcctgataatcttcgggactttcacaaatcagatccataagtggagccacacatacttcggactgcccagatgggtgacacttctccaggattggcacgtcattttaccgaggaaacaccaccgtatccatcacgtcagcccacacgaaacgtatttctgtataaccacaggatggctcaattatcccttggagaagataggtttctggcgcaggctggaggacctcatacaagggctgaccggtgaaaaacccagggcggatgacatgaagtgggctcagaaaatcaagtag

SEQ ID NO: 55317 - DNA, 588 bp, Artificial Sequence
  Description of Artificial Sequence: Synthetic coding sequence
atgaacgagagggccatcgccggagccctcatcgcggattttctttccggcctcgttcattggggcgcagacacatgggggtcggtcgagctgcccattgtagggaaagcatttatcaggcccttccgtgaacaccacattgatcccactgccattacgcgtcatgattttatagagaccaacggtgataactgcctcgtcacacttctacccctgctcaatatggcttacaaatttagaacccactctccagaggccttggagcagctatacccctgggagtgtttcgtcttctgtctgataatcttcggcaccttcacgaaccagattcataaatggagccatacatacttcgggttgccacgttgggtcaccctgctgcaggactggcacgttatcctcccgcgaaagcaccacagaattcaccacgtgtctcctcatgagacctatttttgcatcactacaggctggctgaactacccacttgagaaaatcgggttttggcgcaggcttgaagatctgatccagggtctgaccggcgagaaacctcgggcagacgatatgaagtgggcccagaaaattaaatag

SEQ ID NO: 55318 - DNA, 1113 bp, Artificial Sequence
  Description of Artificial Sequence: Synthetic coding sequence
atggcgggtgccgaaaattggcccggacagcaattggagctggacgaagacgaggcgagttgttgtaggtggggagcccagcatgctggcgctcgtgaactagccgctctatactctcctggcaaaagactgcaggagtggtgttccgtaatcctgtgtttttcacttattgcgcataatctggtgcacctgctgctattggccagatgggaagacacacctcttgtgatcctgggagttgtggccggagccctcatcgcagatttcctgtccggcttggtgcattggggagctgacacctgggggtcagtggaattacccatcgttgggaaggccttcatccgaccattcagggagcaccatatagaccctactgcaatcacacgtcacgacttcatcgagaccaatggggataactgccttgtgactttgttgccgctgctgaacatggcgtataaattcaggactcacagtccagaagccctcgagcagctgtatccatgggaatgtttcgttttctgcctcatcatcttcggcacatttaccaatcagattcataagtggagccacacctattttggactgcccagatgggtgaccctactgcaagactggcacgtcatcttgccgaggaaacatcaccggatccatcatgtatcgcctcatgagacctacttctgcataaccaccggcgtgaaggtgcccaggaactttagactgctggaagaactcgaggagggacaaaaaggggttggggacggtacagtttcctgggggttggaagacgacgaagatatgaccttaactcgttggaccgggatgatcatcgggcctccgagaactatctacgagaatcgcatctattcactgaaaattgagtgtgggcctaagtaccctgaggctccacctttcgtgaggttcgtgacgaagattaatatgaacggtgtcaactcctccaacggcgttgtggatccacgggcaattagcgtgcttgcaaagtggcagaattcatacagcattaaggtcgtgctgcaggaactgaggaggctgatgatgagtaaggagaatatgaagctgccacagcccccagagggccaatgttatagcaactag

SEQ ID NO: 55319 - DNA, 1011 bp, Artificial Sequence
  Description of Artificial Sequence: Synthetic coding sequence
atgactgacctgaacgacaacatctgcaaacgctacataaagatgatcactaatattgtgatactgtccttgattatctgcatttcacttgctttctggatcatctcaatgacagcctcaacctactacggaaatctgcggcctatcagcccctggcgatggttgtttagcgttgtggtgcctgtattaatagtctcaaacgggcttaaaaagaagtccctcgaccatagtggtgctctgggcggactcgtggtgggtttcatactcactatagctaacttttctttcttcactagtctgctcatgttcttcctctcatcttctaaattgacaaagtggaaaggggaagtgaagaagcgcctggacagcgagtataaggaaggcggacagagaaattgggttcaggtcttttgtaatggcgcagtcccgacagagctcgctctgctatacatgatagaaaacggcccaggagaaataccagttgacttctccaagcagtattcagcgagctggatgtgcctgtctctgctcgccgcacttgcctgtagcgctggcgacacctgggctagcgaggtcggccctgtactgtccaagtccagccctcgattaattaccacctgggagaaagttcctgttggcaccaatggcggtgttacagtggtgggtctggtgtcaagcttgctaggaggaacattcgttggaattgcgtacttcttgactcaattgatcttcgtgaacgacctcgatatttccgcccctcagtggcctatcattgccttcggcggtctcgctggcctgttggggtcaatcgtagactcatatctcggtgcaacaatgcagtatactgggctcgatgagtccaccggcatggtggtcaactctcccacaaacaaagcaagacacatagctggcaaacctattctggacaacaatgctgtgaacctgtttagttctgtactaattgctctgcttctccctacagctgcttggggcttttggcctaggggatag

SEQ ID NO: 55320 - DNA, 1011 bp, Artificial Sequence
  Description of Artificial Sequence: Synthetic coding sequence
atgactgatttgaatgacaatatctgtaagagatatattaaaatgatcactaatatcgtcatcctgtctctcataatttgtatctcactggctttctggataatatccatgacagcctctacttattacggtaatctacggcctatcagtccctggcgctggctgttttccgtggtggtgccagtgctaattgtcagcaacggtctgaaaaaaaagagcttggaccacagtggggctcttgggggtctggtggtgggttttattctgacaattgctaatttcagcttttttacctctctgctcatgtttttcctgagctcgagcaaactcactaagtggaagggggaagtaaagaaaagactggatagtgagtacaaggaaggtggtcaacgaaactgggtacaagtcttttgcaacggcgcagtccccaccgagctggcactcttgtacatgatcgagaacggacccggagaaatccccgtcgatttttccaaacagtactctgccagctggatgtgcctctccctgttagccgctctggcctgttccgccggagatacctgggcttcagaagtggggcctgtgctttccaaatcctctcctagattgatcaccacatgggaaaaggtgcctgtgggcacaaatggaggcgttacggtggtaggactggttagcagcctgctgggcggaactttcgtgggtattgcttatttcctgacccagctgattttcgtcaatgatctggatatcagcgccccacagtggcccatcatcgcattcgggggtctggccggactcctcggctctatcgtggactcttatttgggagcgactatgcaatacaccggcttggatgagagcacagggatggtggttaattcccctactaacaaagctcggcacatcgccggaaaacctatcttggacaacaacgctgtgaacctgttcagctctgttctcatagccctgttgctccccaccgccgcatggggtttttggcctcgcggttag

SEQ ID NO: 55321 - DNA, 897 bp, Artificial Sequence
  Description of Artificial Sequence: Synthetic coding sequence
atgacagacttaaacgacaatatctgtaagagatatataaaaatgatcaccaacattgtgatccttagtctgataatttgcatttcactagccttctggattatttccatgaccgcaagcacctactatggcaaccttagacccatctcaccttggcggtggctctttagtgtcgtcgtgcccgtgctgattgtttctaacgggttgaaaaaaaagagcttagatcatagtggagcactagggggtttggtagtcggcttcattctcacaatcgccaacttcagtttttttacgtccctgctcatgttttttttgtcctctagcaagttgaccaaatggaaaggagaggtgaagaaacggttagactcagaatacaaagagggcggtcagcggaattgggttcaggttttttgtaacggcgcagtccctacggagttggcactgctgtatatgatcgagaatggtcccggagaaatccccgtcgatttcagtaagcagtatagtgctagctggatgtgcctctctcttcttgccgcactcgcctgctctgcaggcgacacctgggcatcagaggttggcccagtattgtctaagagctcaccacgcctgatcaccacgtgggaaaaggtacctgtggggacaaatgggggagtaactgtcgtgggactcgtgagttcactgctgggaggaacatttgttggcatcgcttatttcctgacccaactcatctttgtgaacgacttagacatttccgcccctcagtggcccataattgctttcggaggcttggccggtttacttgggagtatagttgattcatacttaggtgccacaatgcagtacacagggaagaacattcccagcttcctgcagctgataggtatgctcaaaaagtag

SEQ ID NO: 55322 - DNA, 513 bp, Artificial Sequence
  Description of Artificial Sequence: Synthetic coding sequence
atgactgacctcaacgacaacatctgcaagcgttatattaaaatgatcaccaacatagttatattatctctaattatctgtatctccctcgccttttggattatttccatgacagcctctacatactatgggaacctgcggcctatcagcccctggaggtggctttttagcgttgtagtgccagtgctcatcgtatcgaacggtctgaaaaagaagtcactggaccattccggagcacttgggggactcgtcgtggggtttattctgaccattgccaactttagtttcttcacgtccctgctgatgttctttttgagctcgtctaaacttactaaatggaagggggaggtgaagaagcggctggatagcgaatataaagagggtggacagcgtaactgggttcaggtgttctgtaacggagctgtgcccactgagctggccttgctttacatgatcgaaaacggcccaggtgaaattccagtggactttagtaaacagtattctgcttcctag

SEQ ID NO: 55323 - DNA, 459 bp, Artificial Sequence
  Description of Artificial Sequence: Synthetic coding sequence
taggacacttgggccagcgaggtggggcctgttctgagtaaatcgagtcccagattgattactacctgggagaaagtgcctgtgggaactaacggaggtgtaaccgttgtcggactggtgtcttctctactgggtggaacgttcgtggggattgcgtattttcttacccagctcatctttgtgaatgacctcgacataagtgccccacagtggcctattattgctttcgggggattggctggtttattagggagcattgtagactcatatttaggagctacaatgcaatatacagggctggacgagagtacagggatggttgtcaacagccctacaaataaagccagacacatcgcaggtaaaccaatcctggacaacaacgccgtgaatctgttttcgagtgtgctgattgcactgctgctgccaacagctgcatggggcttttggccccgaggctag

SEQ ID NO: 55324 - DNA, 534 bp, Artificial Sequence
  Description of Artificial Sequence: Synthetic coding sequence
atgcttggctgcggtatccctgccctcgggctcctgctgttgttgcaaggttctgccgacgggaacggcatacagggatttttctacccttggtcttgcgagggggatatctgggaccgggaatcttgcgggggtcaggccgctattgatagtcccaacctttgcctcagactgcggtgctgttatcgcaatggcgtgtgctatcatcaacgccctgacgagaacgtgcgccgtaaacacatgtgggcccttgtttggacctgcagcggacttttgctcctgagctgctccatttgtcttttctggtgggcgaagagaagagatgtattgcacatgccaggcttcctggctgggccttgcgatatgtccaaatctgtcagcctcctctccaagcaccgcggtaccaagaagacaccatccacgggctccgtgccggttgccctgtctaaagagtctcgggacgttgagggcggaacggagggcgaaggcacagaggagggcgaagaaacggaaggagaggaagaagaagactag

SEQ ID NO: 55325 - DNA, 816 bp, Artificial Sequence
  Description of Artificial Sequence: Synthetic coding sequence
atggccgctggtgggagaatggaagacggaagcctggacataactcagtcaatcgaggatgaccctctattagatgctcagcttctgccccatcactcactgcaggcccatttcagaccaagattccatcctctgcccacagtaatcatcgtaaacctgctgtggtttatccacttggtgttcgtagtcctcgcatttcttacaggggtcctgtgtagctacccaaaccctaatgaggacaaatgtccaggcaactacaccaacccgctaaaagtccagaccgttatcattcttggaaaagtgattctgtggatcctccatctccttctggaatgttacattcagtatcaccactcgaaaatcaggaaccgagggtacaatctgatatacagatctacaaggcacctcaagcggcttgcgctaatgatccagtcttctggtaacaccgtattgctgctgattttatgtatgcagcatagctttcccgagcctggtcgcctgtacctggacctcatcctggcaattttggccctggaactcatatgtagcttgatatgtctgttgatctataccgtgaaaattcgccgtttcaacaaggccaaacccgagcccgacatcctggaagaagaaaaaatttacgcatatccctctaatattaccagcgaaacaggctttaggactatttcttctcttgaggagatcgttgagaaacaaggagacaccatcgagtatctcaagcgccataatgccctccttagcaagaggttgctggccctcacaagtagcgatctggggtgtcagccatcccgcacatag

SEQ ID NO: 55326 - DNA, 804 bp, Artificial Sequence
  Description of Artificial Sequence: Synthetic coding sequence
atgaacaaggcgactggttctttagacattactcagagtattgaagacgatcccctgctggacgcgcagctgctgccccatcactctctgcaggcccatttccgccctagattccacccacttcccactgtcatcatagtcaatctcttgtggtttatccatctggtctttgtcgtattggcctttctcaccggcgtactgtgtagctaccccaaccctaatgaggataaatgccccggaaactacacaaatcccctaaaagtgcagaccgtgataattctgggcaaagtgatcttgtggattctgcatttgttacttgaatgttatatccaataccaccattcgaaaatcagaaaccgaggatataatctcatttataggtcaactcggcatttaaagagattggcactcatgatacagagctctgggaacactgtcttactgctcattctatgtatgcagcattcttttcctgagcccggtcggctgtatctggatctcatcttggccattttggctctcgaattgatatgtagccttatttgcctcctgatttatactgtgaaaattcgcagattcaacaaggccaagccagagccagacattctggaagaagagaagatctatgcttacccatccaatatcacatccgaaaccgggttcagaacaatctcctcgctggaagaaattgtggagaaacagggagataccatcgagtacttgaaaagacacaatgcactactaagcaagagactcttagcgcttacaagcagtgatctgggctgtcaaccaagtaggacgtag

SEQ ID NO: 55327 - DNA, 1335 bp, Artificial Sequence
  Description of Artificial Sequence: Synthetic coding sequence
atggcaggaggtatgaaagtggcagtctcccctgccgttggaccaggtccatggggatcaggcgtgggcggaggtggtactgtgagacttttgctgatcctgtcaggatgcctcgtgtacggaaccgctgagaccgacgtgaacgtcgttatgctccaggaatctcaggtctgtgaaaaacgcgctagccagcaattctgctatacaaatgtccttatacctaagtggcacgacatttggacaagaattcaaattagagtgaactcctccagactggttagggtcacccaggtggagaatgaagagaagcttaaagaattagaacagttctcgatctggaactttttttccagcttcctgaaggaaaaacttaatgacacatacgtgaatgtggggctgtactccaccaaaacatgcctcaaagtggagatcattgagaaggacacaaaatattcggttatcgtgatacgcagatttgatcctaaactcttcctggtctttctgctgggcctaatgctgttcttctgcggggacttactctctcggagccagatcttctattactccacgggcatgaccgtgggcatcgtggcttccctgctgataattatcttcatactgtctaaatttatgcccaaaaaatcccccatctatgttattcttgttggcggttggtctttctccctttacctcatacagctggtgtttaaaaacctccaggaaatctggcgctgctattggcaatatctcttatcctacgtcttaacagttggattcatgagctttgccgtgtgctataagtacggcccacttgaaaacgagagatcaatcaacctgctgacatggacgctgcaactgatgggcctgtgctttatgtatagtggcattcagattccacatatagccttggctattatcatcattgctctgtgcacaaaaaacctggagcacccaattcagtggctgtatattacttgcaggaaggtgtgtaaaggagctgagaagccagtgcccccaaggttactgacggaggaggagtaccgcatccagggcgaagtcgagaccaggaaagcattagaggaattgcgcgagttctgcaattccccagactgctccgcctggaaaacggtgtcaaggattcagtcccctaagaggtttgccgacttcgtagagggatcctcccatttgacacctaacgaagtgtcagtccacgagcaggagtatgggctcgggagcatcatcgcgcaggatgagatctatgaggaagcaagtagtgaggaggaagatagctactctcggtgtcctgctatcacccagaacaacttcctgacgtag

SEQ ID NO: 55328 - DNA, 1116 bp, Artificial Sequence
  Description of Artificial Sequence: Synthetic coding sequence
atggccggtggaatgaaagttgctgtgtcacctgccgtgggacctgggccttggggatccggggtcgggggagggggaactgtaagactgctcctgattctgtctggatgcttggtttacggaaccgctgagacggacgtgaacgtagtgatgctgcaggagtcccaggtttgtgagaagcgggcaagccaacagttctgctacacgaacgtccttataccaaagtggcatgacatttggactagaattcagatacgtgtgaattctagccggctggtcagagtaacccaggttgaaaatgaagagaaactgaaagaactggaacagtctcaaattttttactactccaccgggatgactgttggaatcgtcgcgagtctcctcattattattttcatactcagcaaattcatgcccaaaaagtcgccaatctatgttattctagttggaggctggtcctttagcctgtatctgatccaactcgtgttcaaaaaccttcaagaaatctggcgttgttactggcaatatctgttatcctacgtgctcaccgtcggtttcatgtcattcgcagtttgctacaagtatgggcctctagaaaatgagagatctattaatcttcttacatggacattgcagctgatgggactatgctttatgtatagcggtattcagattcctcatattgcattggccatcattataatcgctctttgtacaaaaaacctagagcaccctatacagtggctatatattacctgccgtaaggtctgtaagggtgcagaaaagcctgttccacctcggttactcacagaggaggagtaccggattcaaggtgaggtggaaacgaggaaggcactcgaggaactacgcgaattctgtaatagccctgattgctccgcctggaaaactgtgtctcgcatccaaagtccaaagagattcgctgacttcgtcgaggggtccagccatctgacccctaatgaagtgagcgtccacgaacaggagtacgggttgggctcgattatcgctcaagatgaaatctatgaagaggcttcttctgaagaagaggacagttattcaaggtgtcctgccatcactcaaaacaactttctgacgtag

SEQ ID NO: 55329 - DNA, 519 bp, Artificial Sequence
  Description of Artificial Sequence: Synthetic coding sequence
atgtgcacaagcggccaaataatcgggtccttgttggttctctcagtgctcgagatcgggcttggcgtgagctcagtagccgtgggcgcagtctccttctctttggccttacgcgaacacaaacctcagttaggtgatagtagccccttcttgctttgtgggatatgtggaatcctttgcgccaagaagaagagcggcttggttatgatccttttctccgcgtgttgcatttgtggcctcattgggggaattctcaactttcaattcctacgcgctgtcactaaaaagacttcctcgctgtacccacttcatctggcttccatgtctttggcgtgcattggtatcggaggatgtacactgagctcttggctgacatgtcggctggcaagttacgaacagagacggatgttttctgagcgcgaacattccctgcaccactcccacgaaatggcagaaaaggaaataacggataacatgtccaatgggggtcctcagctcatcttcaacggtcgggtgtag

SEQ ID NO: 55330 - DNA, 270 bp, Artificial Sequence
  Description of Artificial Sequence: Synthetic coding sequence
atgattctcttttccgcctgttgcatctgcgggctgattggcggtattctcaactttcagttcctgcgtgcggtcacaaaaaaaacatccagcctgtatccactgcatctcgccagcatgtcacttgcatgtataggcattggaggctgcaccttgtcttcatggctgacatgtcggttagcctcatatgagcagcggcgaatgttctccgagagagagcactcactgcaccacagccatgagatggccgagaaaattgaggggtactag

SEQ ID NO: 55331 - DNA, 1083 bp, Artificial Sequence
  Description of Artificial Sequence: Synthetic coding sequence
atgccgggaacagtggcaaccttacgatttcagctgcttccacccgaacccgatgatgcattttggggtgctccctgtgagcagccgctggagcgacgatatcaagccttaccagcccttgtctgcattatgtgttgtctcttcggagtagtctactgctttttcgggtaccgctgcttcaaggctgtgctctttctgaccggactgctgttcgggagcgtagttattttcttgctttgctatcgggagcgcgtattggagactcagctttccgccggagcttcggccggtattgcactgggaattggactgctttgcggactggtagcaatgcttgtgaggtcggtcggcttgtttctggtcggcctgttgctgggcttgttgctggctgcagctgccctactgggctcggctccatattaccagccaggaagcgtctggggtccccttggccttctgttgggaggaggccttctgtgcgctctgctgaccctcagatggccccgaccgctgaccacactggccacggcagtgaccggcgctgcactgatagcaacagcggctgactactttgccgagcttctgctgctgggcaggtacgtggttgaaagacttagagcagccccagttcccccactgtgctggcggagctgggctttgctcgctctttggccactgcttagtcttatgggcgtcctggtgcagtggcgtgtgacagccgaaggcgattcacataccgaggtcgtgattagcagacagagacgccgagttcagctgatgaggatccggcaacaggaagaccgtaaagaaaaaaggcggaagaagcgccctccacgggctcccctcaggggccctcgagccccaccccgtcccggtccccctgatccagcctataggaggagacctgttccaattaagcggttcaacggcgacgttctctcaccaagttatatccaatcgttccgcgatagacagactgggtccagtctgtcctcattcatggcgtctcctacagatgctgattacgagtacggctcacgcggtccactgactgcttgctcaggcccacctgtgcgggtatag

SEQ ID NO: 55332 - DNA, 1083 bp, Artificial Sequence
  Description of Artificial Sequence: Synthetic coding sequence
atgcccggaactgtcgcaaccctgcgattccaactgttgccccctgagcctgacgatgcattctggggggctccgtgcgaacagcccctggaacggcgttaccaggctcttcctgccctcgtgtgtatcatgtgttgcctgtttggtgtggtgtactgttttttcggctaccgatgttttaaagctgtgctgtttctgactggcctccttttcggatccgtggttatctttctgctttgttaccgcgagcgagtcctagagacacagctgagcgccggtgccagtgccggtattgccctggggataggtctcttgtgcggcctagttgcaatgctcgtgcggtccgtgggactgtttttagtgggtttgctacttggcctgctgctagccgctgcggctttgctgggaagtgcaccttattaccagcccggatccgtctgggggcctttagggctcttactaggaggaggcttgctctgcgcgctgctcacgctcagatggcctagaccactgactactctggcaactgccgtcaccggtgctgctctgatcgccaccgccgctgattattttgccgagctgcttctgttgggtaggtatgtggtggaaagactgcgggcagctcctgtgcccccattgtgctggcggagctgggccctcctggctctgtggcccttattgtccctgatgggtgtgctcgtccagtggcgggtgacagctgagggcgactcccatactgaggttgtgattagtcgtcagcggcgaagggtgcagttgatgagaatccgccagcaagaggatcgcaaggagaagagacgaaagaagaggcctccacgcgctcctctgcggggacctcgggcacccccaagacccggaccgcctgacccagcctaccgaaggcgaccagtgcccattaaaaggttcaatggcgacgtcctgagcccatcctatattcaaagttttcgcgatcggcagactggatcgtcattgagcagttttatggccagccccacagatgctgattacgagtacgggtcccgtggcccattaaccgcctgctccgggcctccggtgcgtgtgtag

SEQ ID NO: 55333 - DNA, 684 bp, Artificial Sequence
  Description of Artificial Sequence: Synthetic coding sequence
atgcctgggaccgttgcgacgctgaggttccagctgctgccgcctgaacccgacgatgctttttggggggcaccatgtgagcaacccctcgagcgaaggtatcaggcactgcctgcactggtgtgtatcatgtgttgcttgtttggggttgtctactgctttttcggataccgttgctttaaagctgtccttttcctgaccgggctactctttggctccgtagttattttcctgctgtgttacagagagcgggtgctggaaactcagctgtctgccggtgctagcgctggcattgccctcggcattgggctcctgtgcgggctggtggctatgctcgtcaggtccgtcggattatttttggtgggtctattgctggggctgcttctggctgcggctgccctattaggatcagcaccctactaccagccgggtagtgtgtggggccctttggggttgttactaggaggagggcttctgtgcgccctgctgacgctgcgatggcccagacccttgacaaccctggctactgccgtaactggcgctgccctgatcgccacagctgccgattatttcgcagagctgctgttgctcggtaggtacgtggtagagagactgagggccgcacctgttcccccattgtgttggcgttcgtgggcattgcttgcactgtggcctctcctctag

SEQ ID NO: 55334 - DNA, 627 bp, Artificial Sequence
  Description of Artificial Sequence: Synthetic coding sequence
atggcttcatcgctactggccggtgaaaggttagtgagagccctgggacctggaggtgagttagagccagagcgtctgccacgaaaacttcgcgctgaactagaggctgcactggggaagaagcataaaggcggagattcatcttcaggacctcaaagactggtgagtttccgcctgattagggatctgcatcagcacctccgcgagcgcgattccaagctgtatctgcacgagctcctagaggggtccgaaatttaccttcccgaggtggtgaaacctcctcgaaatccagaactggtcgcgcgactcgaaaaaataaagatccaacttgcaaatgaggagtataaaagaattacgagaaatgtgacgtgccaggacacgcgacacggtggcacccttagtgaccttggcaagcaggttcggtctctgaaggccctcgtaattacaatattcaacttcatcgtcaccgtggtcgccgcatttgtgtgcacctacctaggtagccagtatatctttaccgaaatggccagtcgcgtgctcgccgcattaatcgttgcatccgtcgttggccttgcagagctgtacgtcatggtccgagcaatggaaggcgagttgggtgaactgtag

SEQ ID NO: 55335 - DNA, 900 bp, Artificial Sequence
  Description of Artificial Sequence: Synthetic coding sequence
atggcttcatccttgctggccggagaacgcctcgtgagagcactgggccctggcggtgagctagagccagagcgcctgcccagaaagttacgggctgagctggaggccgctttaggaaagaagcacaagggaggagatagctcaagtggcccacagcgcctggtgagttttagactgatccgggatttgcaccaacacctccgtgagagagacagtaagctttatctccacgaattgctggaaggaagcgaaatttacctccccgaagtggttaagccccctcgaaatccagaactggtggcgaggctggagaaaattaaaattcaactggccaatgaggagtacaagcggattacaagaaatgttacctgtcaggacaccaggcacggcggtaccttatccgacctcggcaaacaagtgaggtctctgaaggctctggttattaccatctttaattttatagttactgtggtagctgcgttcgtttgcacttacctgggctcacagtacatctttaccgaaatggcatctcgcccaaggggcgcacattgggcgggacgggaccccgagcccggtgaaggcacccgcaccaggcgcgctggggctgagtgggtcagacatctgggcgcacatgtccaggcctttggcggagacatgccagaagccggaggaggcagaaggcctgggaggggcgcagtgctggtcccacctcatggtcctcgcgcagccgcacccctccgagccggagccggtcaactgcgggcagcgcgagggcctgggggagctgcgacccacgggagagaagcccgatccagggtggctctgccagctagactcctacagggcggaagggccgcatttgccgctcggctccctagaagcagcggcgtcggtgactag

SEQ ID NO: 55336 - DNA, 1476 bp, Artificial Sequence
  Description of Artificial Sequence: Synthetic coding sequence
atgatcgccactgggggtgtgataaccggcctggcggctctgaaacgccaggattccgcccgaagccagcaacacgtgaatttgagcccttccccagccactcaggaaaaaaagcccattcgcaggcgccctcgcgctgatgttgtagtcgtccgaggcaaaatcaggctatatagtccctcgggtttcttcctgatcctcggggttcttatctctattatcggtatcgccatggccgttctggggtactggccccagaaggagcatttcatagacgccgaaacaaccctaagcacaaacgaaacgcaggtaattcgaaatgagggaggcgtggtcgtgaggttcttcgagcagcatttgcatagtgacaagatgaaaatgctaggacctttcacaatggggatcggaatattcatttttatctgtgctaatgccattctgcacgagaatagagataaggaaacgaaaatcatacatatgagagatatatacagtactgtcatcgacatccataccctccgaattaaggagcagagacagatgaacggaatgtacacggggctgatgggtgagaccgaggttaaacagaacgggtcttcgtgcgcttcgaggctcgcagccaatactatagccagtttctccggctttcgatcatcctttaggatggattccagtgtcgaggaggacgaactgatgttaaatgagggtaagtccagtgggcatctgatgccaccactgttgtccgattcttctgtttcggtcttcgggttgtatcccccaccctccaagacaacagatgataaaacaagcggctctaaaaaatgtgagaccaaaagtatcgtaagctcaagcatctccgcttttacactgcccgtgatcaaacttaacaactgcgtgatagacgagccttcaattgacaatatcaccgaggacgcggacaacctcaagtctagaagcaggaatttgtctatggattcgcttgtcgtgccgctgccaaacactagcgagtctttccagccagtgtcaactgtactgccccgaaataatagcatcggcgagtccctttccagccaatataaatcaagtatggcattaggacccggagccggacaattgctaagcccgggagcagcacgacgccagttcggctccaacacctcactccatctcctctcctcacactctaaatctttggaccttgatcgcggaccttccactctcacagtgcaagcagaacagcgcaagcatcctagctggcctcggctggatagaaacaactcaaagggatacatgaagctcgaaaataaagaggacccaatggatagactgctagtcccacaagtggcaattaagaaagatttcacaaataaagagaaactgttgatgataagtaggtcgcacaacaacctgtcattcgagcatgatgagttcctgtccaacaatcttaagcgcggaacctccgaaactagattctag

SEQ ID NO: 55337 - DNA, 1476 bp, Artificial Sequence
  Description of Artificial Sequence: Synthetic coding sequence
atgattgctaccggcggagtgataaccggtctggccgctttaaaacgccaggacagcgctcgcagccagcagcacgtaaatctaagccccagtcccgcaacacaggaaaagaagcccattaggcgtcgaccccgagccgacgtggtcgtggtcagaggcaagattaggctctattccccctctggcttttttctgattctaggcgtgttaataagtataatcggcattgctatggctgtgctaggatattggccacagaaagagcacttcatcgatgcagagacaacgctgagcactaatgaaacacaggtcatccgcaacgaaggaggcgtcgtcgttaggttctttgaacagcatttgcatagcgacaaaatgaagatgctggggccattcaccatgggaattgggatctttatcttcatttgcgctaatgctattctccacgagaaccgggacaaagagacaaaaattatccacatgcgggatatttacagcacagttattgatattcacactcttaggatcaaggagcagaggcagatgaacgggatgtacactggtctgatgggagagaccgaggtgaagcagaacggatcgtcgtgtgcaagtcgtctggcagctaacactatagcttcatttagcggattcaggtccagtttcagaatggactcaagcgtagaggaagacgagttgatgctgaacgagggcaagagcagcggacatctgatgccaccactcctgtcagattctagtgtatcagtgttcggactgtacccccctccttctaagacgactgatgacaaaacctccggatctaaaaaatgcgaaaccaagtctatcgtgtcatcctctatttccgcattcacccttccagtaattaaactgaacaattgcgtcatcgatgagccctccatcgataacattactgaggacgctgataacctcaagagccggtctcgtaatctgagcatggacagcctggtagttcccctccccaacacttcagagagtttccagcctgtgagtactgtgttgccacgaaataactccatcggtgagagcctgtctagccagtataagagttctatggctctaggacccggagctggccagttgctgagccctggagccgcacgtcgtcaatttgggtctaacacctccctccacttactgtcatctcatagtaaatcattggacctggatcgcggacccagtacgttaacggtccaggcagaacagcgcaagcacccctcttggccgcgtctggacagaaataacagtaagggatatatgaaactagagaataaagaggaccccatggaccggctgctggtgccacaagtcgcaattaaaaaggatttcacaaacaaggaaaagctgctgatgattagtaggagccacaataacctttcattcgagcacgacgagtttttatctaataatcttaaacggggaaccagtgaaacccggttttag

SEQ ID NO: 55338 - DNA, 1476 bp, Artificial Sequence
  Description of Artificial Sequence: Synthetic coding sequence
atgattgcaacggggggagttatcacagggctcgccgctctgaaaagacaagattctgcccgtagtcagcagcatgtaaatctctcccctagtcctgcgactcaagagaaaaaacctattcgtcgtcggcctcgtgccgatgttgttgtcgtgagaggaaagattcgcctgtattcccctagtggattttttctcatactcggagtgctgatttccatcatcgggatagctatggccgtcctgggctactggccacagaaggaacactttatcgacgctgagacgaccttgagcacgaatgagacacaagtgatcagaaatgaaggcggtgtggtagtgagatttttcgagcagcacctgcacagcgataaaatgaagatgcttggcccatttactatgggcatcggcatcttcatttttatctgtgctaatgccattttgcacgagaatcgggacaaggagaccaaaataatccacatgcgcgacatctacagtacagtgattgatatccatacattgaggataaaggagcaaagacagatgaatggcatgtatactggactgatgggagaaaccgaagtgaagcagaacggatcgtcttgtgctagccggcttgcggcaaatacaattgcaagcttcagtggattccggtcctccttccgaatggattcatcggtggaggaggatgaactgatgcttaacgaaggaaaaagcagcggacacctgatgcctccattgctgagtgactccagtgtcagtgtgtttggactgtatcctccaccctccaaaacaacagatgacaagacaagtggctcgaagaagtgcgaaacaaagtccattgtgagctcatccatcagcgcattcaccctgcccgtgataaaattgaataattgcgtgatcgacgaacccagcatagacaacatcactgaggatgccgacaatctgaaatcacgcagccgcaacctgagtatggactcccttgtagtgcccctgcccaatactagcgagtccttccaacctgtttccactgtccttccaagaaacaattccataggcgagtcactttcctctcagtacaaaagctcaatggcactgggccctggtgccggtcagctgctctcaccgggtgccgcaaggcgtcagttcggatctaacacatctttgcatctgttgtcaagccattctaaaagtctggacctcgacaggggaccctctacactcaccgtgcaggccgaacagagaaaacaccctagctggccaagactggacagaaacaactccaaaggttatatgaagctggaaaataaggaggacccgatggatcggttattagttccgcaggtggctatcaaaaaagattttacaaacaaagaaaagttactcatgatctctcgttcccacaacaatttgtccttcgaacacgatgagtttctctccaataacctcaaacgcggtacttctgaaacccgtttttag

SEQ ID NO: 55339 - DNA, 924 bp, Artificial Sequence
  Description of Artificial Sequence: Synthetic coding sequence
atgacagctgggtcccccgaggagtgtggagaagtgcggagatcgcccgagggcagagttagccgactcggtcgacggttaggcagaaggcgccgtcccagatcgcccccagaacccctccgggtccgggctcggctgcgcctacgatctccaagtggagcctttgcagccctgggagctctggttgtattggtgggcatggggattgcggtcgctggatattggccacaccgggctggggctcccggaagcagagccgcaaatgccagttctccccagatgtccgaacttcgaagggaaggaaggggaggaggtagggcccatggccctcacgagcgccttcggctcctaggccctgtgattatgggcgtcggactgtttgtctttatttgcgctaataccctcctatatgagaatagggacctggaaaccaggcggctcagacagggagtgctaagggctcaggctctaagaccacccgacgggccaggatgggattgtgccctgctgccctctcctgggccacggtccccacgggcagtaggatgcgccgagcctgagatctgggaccccagtccgagacgcggtacgtcccccgtcccttctgtgcggtctctccggagcgagcccgctaaccctaggttgggactgcctgcactcctgaatagctaccccctgaagggcccaggactccccccaccttggggtccccgaactcaaaccggccacgttatcattaccgtgcagccctccggaagctgcattgagcactctaaatccctcgaccttggactaggcgagctcctgctgggcgcaccggcagccagagattgtgctcacaggagctggccgaggttggaccgactgagccttgggggatatgccaaactgggcggaggaggagatctgggcgcacgggtgtag

SEQ ID NO: 55340 - DNA, 924 bp, Artificial Sequence
  Description of Artificial Sequence: Synthetic coding sequence
atgaccgccggtagtcccgaagaatgtggagaggtgaggaggtctcccgaaggaagagtgagtcgactcggtcggaggctgggtcggcgtagacggccacgctcccccccagagcctctacgcgtccgcgctcgtcttcgtcttagatctccttccggggctttcgccgcactgggagctctcgtagtgctcgtaggtatggggattgctgtggcgggttattggccgcaccgagccggtgcacctggctcccgcgctgcgaacgcatcctctcctcagatgagtgaactgcgacgtgagggcaggggcggtggtcgcgctcatggaccacatgaaaggctaaggctccttgggcctgtcattatgggcgtcggcctgttcgtgtttatctgtgccaatactctgctctacgagaaccgggatctggagacaaggaggctgcgccaaggcgtgctgcgtgcccaagccctcagaccaccagatgggccaggatgggattgtgcattattaccctcaccaggccctcgcagccccagggccgtggggtgcgccgagcctgagatttgggatccatcgcctcgccgagggacatccccagtccctagcgtccggagcctgaggtccgagcctgccaatcctaggctcggtctgccagctcttctgaattcttatcctcttaaggggcctgggctgccccctccttggggaccgaggacccagaccggccacgtgataattacagtccagccctccggctcttgtattgaacattccaaatcccttgacctcggcctgggagaactcctcctcggtgcacccgcagccagggattgcgcccacaggagctggcctagactcgatcgactgtccttgggcggttatgcaaagctggggggaggtggggatctgggggcaagagtgtag

SEQ ID NO: 55341 - DNA, 1866 bp, Artificial Sequence
  Description of Artificial Sequence: Synthetic coding sequence
atgatcgccacaggcggactcctccgcatatccgccagaaaacaggatcctctgagacccccaagtcaaataccaaagcggaagagaaaggcaaaaaaacgacgaaagaatgatgttgtggttgttaagggtaaactgaaactgtgtagcatctcaggtcttatcgcgctgtgtggcatcctcgtcttactagttggaattgcaatggctgtggtcggatattggcccaaagctactgggacgaaccgcgagggaggtaagcaactccctcccgcaggctcttcacatagggtgccaaccacggccaacagttcctcttcgggctcgaaaaacaggagcaggagccatccccgagcccctggcggtgtcaatagctcctctgccggagctcccagatccactccacctgcgcgagccgcatccccgagttcaagtagcacgtcagttggtttcttttttaggattttttccggctatctgcattcagataaacttaaggtgtttggtccattaattatgggcatcgggattttcctatttatatgcgctaatgccgtcctgcatgagaatcgcgacaaaaaaaccaagataataaacctgcgcgatctgtacagcaccgttatcgacgtccatagcttacgcgcaaaagatctggccgctgcagctgcagccgcagccgctgctgccgctagcagttctagttccgccccagcagcagctccacctggggcaattcccttgaatgggtttctgagctacgtgcagtctcgaggattggagctcaagcctgggggttgcgggggatctggggatgccttcggagctgctgctatgcttgctaaaggaagctggcctccccacccagcagctcctagcgggggtcgcccacggggagctgcgtcacccccagacctcgctagcagtcccagatgccccagagaacctccctccttagccgaagccgtgtatagtgtataccgcgaacggtccggggtagctggatccagaagggcggcagccgcaacagctgccgctgccgcatcatcttgtagttcacctgccccatgttctccccctgaatcgtggggtcgtcagagtaccgcctcatcctttgtggattcttctctcagcgcctttgccttactcccacttcaaggcggtcgcgaccgaggaggagacgccgagggggcatcctgcagctggcaacgcccaccaggcgagcgagggagccaggaaatccccagaggggaactggatctatcaatgactaacctgcgaggtgccgaaggaagcatgcgcggtgcgagacgtgaaccagaagagcccgagggtgcagtcgcagctcgcgcagccagagggcagggcggtcgcctcccgcgaaccggccgttatgcagcattgcgaaggcgatccacatctgggttaccagactacagagccccaccatcacctgagcctcctcccagccctggttctgcggacccagatagttctcccttagcaaaagctgcgtccccctctcccccactgcggctggagggatcacccccaacccgcagagactcaggctccagtcaatctgatgatcccagctcaagtaataaaggttatacccctctgagagaagccggaactagtaccgagtctgtcttggacgccgtggcaggccaaactcgcgattcagcggtggctgccccagtgcttggggctgagcagtcctcacctgagggcgcttcgcaagagcctcccacagccgaacagccccagccagtgcagcgacaattcaccaataaagaaaagctgatcatgatcagtagaagccatgctatcggagtcgaagaggaactcgagagcactggaatctag

SEQ ID NO: 55342 - DNA, 1866 bp, Artificial Sequence
  Description of Artificial Sequence: Synthetic coding sequence
atgatcgccaccggcggactgctgcgcataagcgcccgtaaacaggatcccctgaggccaccaagtcagatccctaaacgcaagagaaaggctaagaaacggagaaagaacgatgttgtggtggtcaagggcaaactgaagctttgtagtattagcggcctgatcgcactgtgtggaattctggttctcttagtcgggattgcaatggcagtggtggggtattggccaaaggctaccggtaccaatcgggaagggggaaagcagcttccccctgctggtagcagtcacagggtacccacaacagccaacagctcctcttctggcagtaagaatcgatccagatctcatcccagggccccagggggtgtgaattccagtagtgcgggagcacccagaagtaccccccctgccagggccgcaagcccttcaagttctagtacaagcgtcggtttcttcttccgtatcttcagtggctatcttcattccgataaactgaaggtgtttggacctctgattatgggaatcggaatcttccttttcatctgtgccaatgctgtgctgcacgagaatcgcgacaagaaaactaaaatcattaatctgcgagatctctattcaacagtgatagacgttcacagtttgagggctaaggatctggccgctgctgcagcagccgctgctgcggctgccgcaagtagttcaagctcagctcccgctgcggcaccgcctggggcaatcccgctaaacgggttcctatcctatgttcaatcccgtgggctcgaactcaaaccaggcggttgtgggggttccggcgatgcatttggggctgcagctatgctggctaaagggagctggccaccacatcccgcagcgccatcaggcggacggcctagaggcgctgcctcaccacccgatctcgcttcctctcccaggtgcccccgtgagccacctagccttgccgaggccgtatattccgtctacagagagagaagcggcgtcgccggatcaaggcgtgccgctgcagccaccgccgcagcggctgctagttcctgctcatctcctgctccctgctctcctccggaaagctggggtcggcagagcaccgcctcatccttcgtcgatagctctttgagcgcgtttgccttactgccactgcaaggcggaagggatcgaggtggcgacgcagaaggcgctagctgtagctggcagagaccccctggggaaagaggatcccaagaaattcctcgcggtgagctcgacctatctatgaccaacttgagaggggctgaaggctcaatgcgcggtgcgagacgggagcctgaagagccagaaggggctgtggcggctcgggctgccagggggcagggcggacgactgcccagaaccggacgctatgccgcactgcgtcggagatccaccagcgggctgccagattaccgcgcacctccgtctcccgagccccctcctagcccgggatcggcagatcctgatagctctccactcgctaaggccgcaagcccatccccacccctcagactggaaggcagccctcctactagacgggactcagggagtagccagtccgacgatcccagtagctccaacaaaggatatacgcctctgagggaggctggtacctcaacagaatcagtcctggatgccgtggccggacagacacgagacagtgcggtggctgcacccgtgctcggggctgaacaaagcagccctgagggtgccagccaggaaccacccactgccgagcagcctcagccagtgcaaaggcagttcaccaataaagagaagctgatcatgatcagtaggtctcatgccattggagttgaagaagagctggaatccactggaatttag

SEQ ID NO: 55343 - DNA, 1179 bp, Artificial Sequence
  Description of Artificial Sequence: Synthetic coding sequence
atggaaggtgtgtcagcgttactggctagatgtccgacagctggtctcgctgggggtcttggcgtgactgcatgtgccgcagccggtgtgctgctctatcgtattgctcgccgtatgaagccaacacacaccatggtgaattgctggttttgtaatcaggatacgttggtgccctatggaaataggaactgctgggattgtccccattgtgaacagtacaatggtttccaagaaaatggcgattacaacaaacctattcccgctcaatatttggaacatctgaaccatgttgtgtcctccgccccatccctccgggacccgtcccaaccccagcagtgggtgtcctctcaggtactgctgtgcaagcggtgcaaccaccaccaaaccacaaaaattaagcagttagccgcttttgctccgagggaagaaggccgatatgatgaagaggtcgaggtttaccgacatcacttagaacagatgtacaagctttgccgcccttgccaagccgcagtagagtactatatcaaacaccagaatcggcagctccgtgcgctgttgctgtctcaccaattcaaaaggagggaggctgaccaaacgcacgcgcagaacttcagttctgccgtaaaaagccccgttcaagttatcttgttacgcgcacttgcttttcttgcttgcgcatttcttttaacaactgcactctatggagcctccggacactttgcccctgggacaaccgtgcctctggccctacctccaggcggtaatggctcagccactcccgataacggcactacccccggagccgaagggtggaggcagttgctagggctccttcctgaacatatggccgaaaagctctgtgaagcctgggcctttgggcagtcccaccagactggtgtcgtggctctgggccttctcacttgcttactggcaatgctgttggccggtagaatcagacttaggaggattgacgccttctgcacctgtctgtgggccctcttgctggggttgcatctggcagagcagcatttgcaagctgcttcccccagctggctcgataccctcaagttttcaaccaccagcctgtgctgtctggtgggcttcacagccgcagtcgcaactcgaaaggccaccggacctcggaggttccgcccaagacgatccgagaagcaaccatag

SEQ ID NO: 55344 - DNA, 2001 bp, Artificial Sequence
  Description of Artificial Sequence: Synthetic coding sequence
atggagggtgttagtgctttgttagcccgatgcccaaccgccggtctggcaggaggcctgggggtgacggcgtgcgccgctgccggagttctgctatatcgcattgcacgccgaatgaagccaacccatactatggtcaactgttggttttgcaatcaagatacattagtaccttatgggaatagaaactgctgggactgccctcattgcgagcagtataatggattccaggagaacggggattataataagccaattccagcccagtacctggagcaccttaaccatgtcgtgtctagcgcgccaagtcttagggacccatctcagccccagcagtgggtttccagccaggtccttctttgtaagagatgcaatcatcatcaaacaaccaaaattaaacagttggctgcgttcgccccacgcgaggagggcagatatgatgaggaggttgaagtgtaccgccaccatcttgagcaaatgtataaactctgccgaccatgtcaagcagccgtcgagtactatattaagcaccaaaatagacagttgagggccctgctactgtctcatcagttcaagcggcgagaagcagaccagacccatgcacagaatttttcttcagctgtgaaatccccagttcaggtgatcctactcagggcactggcctttctagcctgcgcttttctactcactacagcgctatacggagcttctggccatttcgcaccagggaccacggttcccctagccctcccccctggcggtaatgggagcgcgactccagacaacggcacgacacctggcgctgaaggctggagacagctgctggggctcctgccggagcacatggctgaaaaactctgcgaggcatgggccttcggccaatctcaccagacaggcgtagtcgcacttggcttgctaacatgcctgctggcaatgctgcttgccggacgcatcagactgcgaagaattgatgctttttgtacctgtctgtgggcactccttctgggtttgcacttggccgaacaacatctgcaagcagccagcccaagttggctcgatactctcaagttctcgaccacctccctgtgctgtcttgtcggcttcaccgcagcagtcgcgacccgtaaggcaacgggcccacgacgtttcaggcctcgcaggttttttcctggcgactccgctgggctatttccaaccagcccttctcttgccatcccccatccctccgtgggtggctcccccgcatcacttttcattccgtcgccccctagttttctgccgctggcaaatcaacagctgtttcggtctcctaggaggacttcgccttcatctctgcccggaagacttagcagagcccttagccttgggacaatccccagcttaactcgtgcagattcaggctatttatttagcggcagccggcctccctcgcaagtgagtcgatcaggcgagtttcccgtcagcgactactttagtctcctgtccggcagttgccccagctcacctctgccatcacctgccccaagtgtggcaggctcagtcgcgtcttcttcaggcagtctaagacaccggagacccctgatctccccggcaagacttaacctaaaagggcagaaactgctgctattcccttcacccccaggtgaggctcccacgaccccatcctctagcgacgagcacagccctcacaacggttcactcttcactatggagccaccgcacgtgcctagaaaacctccattacaggatgtgaaacatgcgctggatcttcgatctaagctggagcgtggctctgcctgtagcaaccggtctatcaagaaggaagatgactcgagtcaaagcagcacctgtgtggttgatacaaccacaagagggtgctccgaagaggcggctacatggcgcggacgtttcgggccatcactcgtccgaggcttgcttgcagtttcactggctgccaacgcactgtttacttccgtctttttgtatcagagtcttagatag

SEQ ID NO: 55345 - DNA, 1929 bp, Artificial Sequence
  Description of Artificial Sequence: Synthetic coding sequence
atggagggagtttctgcactacttgctaggtgtccgaccgccggactggccggtgggctgggcgttacagcgtgcgctgctgccggagttctgctgtaccgaattgcacgcagaatgaagcctacacatactatggtcaattgttggttttgtaaccaagatacgctcgtaccctacggcaacaggaattgttgggactgcccacattgcgagcagtataatgggtttcaggaaaatggcgactacaacaaacccattccagcccagtatcttgaacatctcaatcacgtagtctctagtgccccttcgctgagggatccaagtcaacctcagcaatgggttagcagccaagttctcctctgcaagcggtgtaaccaccaccaaacaaccaagattaagcagttggctgcgtttgctccgagggaagaaggtcgatatgacgaagaagtcgaagtgtatagacaccatctggagcagatgtataagctctgcaggccctgccaggcagccgtggaatactacataaaacaccagaataggcagctgcgggctctgctgcttagtcatcagtttaaaaggcgcgaagccgaccaaacacatgcgcagaatttctcctcagcagtcaagtcgcctgtccaagtaatattgttgcgggctctagcttttcttgcctgtgcgtttctgctgacaacagcactttacggcgcttctggtcatttcgctcccggaactacagtgcctctcgcacttccaccaggcggtaacggaagcgcaacacccgacaacggcaccaccccgggtgcggaggggtggcggcagttgttggggcttctgccggaacacatggccgagaaactatgcgaggcatgggctttcggccagagccaccagacgggcgtggtcgcactcgggctcctcacatgcttgcttgccatgctcctcgctggtcggattcgcctgcgtaggatagatgcattctgtacatgtctgtgggcgctgctgctcgggctgcatcttgcagagcagcaccttcaggcggcatctccaagctggttagatactctgaaattttcgacaacatcactgtgctgccttgtgggcttcacggcagctgtggctacacggaaggccaccgggcctcggagatttcggccacgaaggttttttcccggtgattcagccggtctatttccaacttcaccctctctggccattccacacccttctgtggggggatccccagctagtctgttcatacctagtcctcccagctttttacccttggccaatcagcagttgttccgcagtccacgcaggacctccccatcttctctgcctggtaggctgagtagagctctgagcctgggaacaataccctcgctgactagagccgactatttctccttattaagtgggagctgtccatccagccccttgccaagtccagcccctagtgtggcaggatccgtggcttcttcctccggatctctgagacatcggagacccttgatttcgcccgcacgcctgaacttaaagggccagaagttgctgcttttcccttccccacccggagaggctcctacgaccccgtccagttccgatgagcatagcccacataatggctctcttttcacaatggaaccccctcacgtgcccagaaaacctccactgcaggatgtcaagcacgccttggacctgagatcaaaactggaaaggggaagtgcttgttcaaatcgctctattaagaaggaagacgattcttctcagtcttcaacttgtgtggtggacacgaccacacggggatgcagcgaggaggccgctacttggcggggaaggtttgggccaagtctcgtgaggggcttgctcgcagtctcgttagcagcgaacgccctgttcacttccgtctttctgtatcagtcattgcggtag

SEQ ID NO: 55346 - DNA, 411 bp, Artificial Sequence
  Description of Artificial Sequence: Synthetic coding sequence
atgctgttctctctgcgagaactggttcagtggctgggttttgcgacgtttgagatctttgtccatctcttggccttgctggttttttccgtgctgcttgccctgagggtggacggactggtaccaggattgtcatggtggaacgtctttgtcccattcttcgccgctgatggcctgtcgacatattttacaactatcgtgtcagtgcgcttgtttcaggacggggaaaaacgccttgctgtgctaaggctgttctgggtcctcacggtcttgtccttgaagttcgtgtttgagatgctactgtgtcagaaacttgccgagcagactcgggagctatggttcggcctcatcacctccccactgttcattttgctccagcttcttatgatcagagcttgcagggtgaactag

SEQ ID NO: 55347 - DNA, 411 bp, Artificial Sequence
  Description of Artificial Sequence: Synthetic coding sequence
atgttattctctctgcgcgagcttgtccaatggctagggtttgcgactttcgagattttcgtgcatctgctggcactcctggtgttctcagtgcttttggcgctaagagttgacggtctcgtcccagggttgtcttggtggaacgtgtttgttccatttttcgctgctgacggattaagtacatacttcactacgatcgttagtgttaggctgtttcaggatggagagaaacgcctggccgtccttcgattgttttgggtgctcacggttctgtctctgaaatttgtgttcgaaatgctcttgtgtcaaaaacttgctgagcagacaagggagctgtggttcgggcttattacgtcgcctttgttcattctactgcagctgcttatgattcgcgcatgtcgggtgaattag

SEQ ID NO: 55348 - DNA, 681 bp, Artificial Sequence
  Description of Artificial Sequence: Synthetic coding sequence
atgacggtgcagagactcgtggcagccgcagtactcgtggcactcgtgtcccttattcttaacaacgtcgctgccttcactagcaattgggtctgccagacgttagaggacgggcgacgcagatctgttgggttgtggcgatcttgctggcttgttgaccgaacaagaggaggtccctctccaggagctcgcgcaggccaggttgatgcccacgactgtgaggccctgggctgggggtctgaggctgcaggatttcaagaatctcggggaactgtgaagctacagttcgacatgatgagggcctgtaatctggtcgcaactgcagctctcacggcaggccagctgacctttttgttggggctggtcggcctgccgctgctgtctcctgatgctccttgctgggaggaagcaatggcagccgcatttcagcttgcttctttcgtgcttgtgattggcctggtcaccttctacaggataggaccttatacaaatctgagctggagttgctatctgaacatcggcgcatgtctcctggccactcttgccgcagccatgctcatctggaacattctgcataagagggaagattgcatggctcctagagttatcgtgatttcccggagtttgacagctaggttccgacgcggactagataacgactatgtcgagtctccctgttag

SEQ ID NO: 55349 - DNA, 681 bp, Artificial Sequence
  Description of Artificial Sequence: Synthetic coding sequence
atgaccgtgcagagactcgtcgctgctgccgtgctggtggcactagtgagcttaattctgaacaatgtggcggcttttacatcaaactgggtgtgccaaaccctcgaggacggcaggagaaggtctgtgggcttgtggcgcagctgctggctagttgatcgtacccgcggaggcccaagcccaggggctcgcgcaggccaggtggatgcccacgactgtgaagccctggggtggggatccgaggctgcgggatttcaggagtctcgcggtaccgtaaaactccaattcgatatgatgcgcgcttgcaatctggtcgcgaccgcggctctgactgctgggcaactgacttttctcctgggccttgtcggcctccccttattaagtcctgacgcaccatgctgggaggaggccatggcagctgctttccaactggcctccttcgttctggtaatcggactggtcactttctatcggattggaccatacacaaaccttagttggagttgttacctgaacatcggagcatgtcttctcgctacactggcagctgcaatgctgatctggaatatactgcacaagagagaggactgtatggctcctcgagttatcgtaattagcagaagcctgacagcccgtttcaggcgcggtctggacaatgattatgtggagagtccctgttag

SEQ ID NO: 55350 - DNA, 1053 bp, Artificial Sequence
  Description of Artificial Sequence: Synthetic coding sequence
atgatccgccaggagcgcagcacctcctatcaggagctaagtgaagaactcgtgcaagttgtggagaatagtgagttggcagacgagcaggacaaagagacagtgcgcgtccagggccctggcatattgcccggactggatagcgaatctgcgagttcgtctatccgattttctaaagcctgcctcaagaatgtattctctgtgctgctgatttttatctacctgctgcttatggctgtagccgttttcctcgtgtatcggaccatcactgactttagggaaaagttgaagcatccagttatgtctgtgagctacaaggaggtagatcggtatgacgcgcctggtattgcattatatcccggacaggcacagctactgagttgcaagcatcattatgaggtaatcccacccctgacctcccccggacagccgggagacatgaactgcaccacacagcgcataaactacaccgatcctttctctaaccagactgtcaaatccgccctgatagtgcagggaccaagggaggtaaaaaagcgagagttagttttcttgcagtttcgcctcaataagagttccgaagacttcagcgctatcgactacctcttattctctagtttccaagagtttctccagagtcccaaccgcgtaggctttatgcaggcctgcgaaagcgcctactcatcatggaagtttagcgggggttttagaacgtgggttaaaatgtcattggtcaaaactaaagaggaagacggtagggaggccgtcgaatttagacaggagactagcgtggtcaattacattgatcagagacctgctgccaagaagagcgcccagctgttctttgtggtattcgaatggaaagatcccttcattcagaaagtgcaggatattgtgactgccaatccttggaatacaattgcgctcctctgtggcgctttcctggcactctttaaggcagctgaatttgccaagctttcaattaagtggatgatcaaaatcaggaaacgctatctcaagcgcaggggacaggcgacctcccatatctcctag

SEQ ID NO: 55351 - DNA, 1236 bp, Artificial Sequence
  Description of Artificial Sequence: Synthetic coding sequence
atgataaggcaggagagatctacttcttaccaagaggctgtgaggccagcgttgccatcctctaagccgtgtcttctgacttcaccggctgtgctggtcaaactgctcagcagttcagcatcaacttcgcggccacccaacctcggccatctatggcagccttcaagttctgttcctctccatagggcggcatccctggctaaggtgcgacagtttcagcttagtgaggagttggttcaggtggtggaaaatagcgaattggctgatgagcaggataaggagactgttcgtgtgcagggtcccggaatattacctggactggatagtgaaagtgcctccagctctatcagattttcaaaggcatgtctgaagaacgtgttttcagtactgctcatcttcatatatttgcttttaatggccgtcgccgtctttctagtatacaggacaattaccgacttcagggagaaactcaagcacccggtgatgtctgtgtcttataaggaggtcgaccgatatgacgccccaggaatagccctttatcccggtcaggcccaactgctgtcctgcaagcaccattacgaagtaataccgccactgaccagccccggacagcccggagacatgaactgtactacccaaaggattaattacacagacccattctccaatcaaactgtaaagtccgcgttaattgtccaggggcctcgagaagttaagaagagggaacttgtgttcctccagttccgcctcaacaaaagttcagaagacttttccgccatagattatttgctgttcagttccttccaggaattcctgcagtcacctaatcgtgtggggtttatgcaagcgtgtgagtccgcttactcctcttggaagttcagcggtggattccggacgtgggtcaaaatgtccctcgtaaagactaaggaagaggatggccgtgaagctgtggaatttaggcaggaaacttccgttgtgaattacatcgaccaacgcccagctgctaagaaatccgcccaactgttttttgtggtcttcgagtggaaggacccctttattcaaaaggtgcaggacattgtcaccgcgaatccgtggaatactatcgccctgctttgtggtgcctttctcgccttgtttaaggcagctgaattcgcaaagctttctatcaaatggatgatcaagatcagaaaaagatatctcaagcgtcggggtcaagccacttcccatatcagttag

SEQ ID NO: 55352 - DNA, 441 bp, Artificial Sequence
  Description of Artificial Sequence: Synthetic coding sequence
atgagtcgtagcaggcttttctctgtgacctcagctatatcgacaatagggatactgtgcctgccactcttccagctcgtcctatccgacttaccctgcgaagaggatgagatgtgtgtgaactataatgatcaacatcctaacggttggtatatatggatcctgttattgctggtcctagttgcagccctgctttgtggcgcagtcgtgctctgcctgcagtgttggctccggagaccacgaattgatagtcatcggcgtacaatggcagtattcgcggtcggggatttggattccatttatggtacagaagcagcagtgagcccaacagtgggcatacatctgcaaacccaaacacccgacttataccctgttccagctccctgttttggcccattaggaagccctcccccttatgaagaaatcgtaaagaccacctag

SEQ ID NO: 55353 - DNA, 522 bp, Artificial Sequence
  Description of Artificial Sequence: Synthetic coding sequence
atggccccaaagggcaaggttggcactcgcggtaaaaagcagatcttcgaggaaaacagagagacgctgaaattctacctccggattattttgggggcaaatgctatatactgcctggtgacgcttgtctttttttactcctcagccagcttttgggcctggcttgcgttgggattcagtctagccgtatacggtgcctcctaccacagtatgtcaagtatggcccgagccgcttttagcgaagacggagccctgatggacggcggtatggatttgaacatggaacaagggatggccgaacacttaaaagatgtgatccttctgactgccatagtccaggtgctgtcctgcttctccctgtacgtatggtctttctggttactcgccccaggaagggcgctgtaccttctctgggtgaatgtcctgggaccctggttcacagcagattccggcacaccagcacctgagcacaacgagaaacgacaacggcgacaggagcgacggcaaatgaaacgcttgtag

SEQ ID NO: 55354 - DNA, 1557 bp, Artificial Sequence
  Description of Artificial Sequence: Synthetic coding sequence
atgcagggcgaagcccacccatccgcttctcttatcgaccggaccataaaaatgcggaaagagactgaggctcgtaaggtggtcctggcctgggggctcttgaatgtgtccatggccggtatgatatataccgaaatgactggaaagctgatctcgagctattacaatgtcacctactggcctttgtggtacatagagctggcactggcctccctgttcagtttgaacgccctgtttgacttttggaggtatttcaaatacactgtggcaccaacgtccctcgtggtatcccctggccagcagacgctgctgggtctcaagacggcagtggtgcagactacaccacctcacgatctcgcagctacgcaaatccccccagccccaccatctccatcaatacagggacagtccgtcttgtcctactctccatcacggtcaccttccacatcacctaagttcactacttcatgcatgactggttatagcccccagttgcagggcctgtcctctgggggaagcgggtcttattcaccaggcgttacctattcaccggtgtccggctacaacaagctggcatcattctccccctcaccgccttctccctaccccacgaccgtcgggcctgtggagtcatctggcctcaggtcccgatatcgcagcagccccacagtctacaactctccaactgacaaagaggactatatgactgatctcagaacattggatactttcttacgttcagaggaagagaaacagcatcgtgtgaagctaggctcccctgattctacaagccctagtagtagtcccacattttggaattattcaaggtctatgggcgattacgcacagaccctgaagaaatttcaataccagcttgcatgcagatcacaggccccttgcgcaaacaaggacgaagctgatctgtctagtaaacaggccgcagaagaggtctgggcccgagtggccatgaacaggcagctgctggatcatatggatagctggactgctaaatttcggaactggatcaacgagactatcctcgtcccacttgtacaggagattgaaagcgtttccacacaaatgcggcgtatgggatgccccgaattacagatcggggagctgagtcagggcggatgtatgagctcttttcgttggaaccgcggtggagacttcaaaggacgcaaatgggataccgatctccccactgactcggcaatcatcatgcacgtgttctgtacttacttggacagccggttaccgccacacccgaaatacccggacggaaagacatttactagtcagcactttgtccaaactcccaataagccagatgtcacaaacgagaatgtgttctgcatttaccagtctgctatcaaccctccacattatgagctcatttaccaaagacacgtttataacctgccaaaagggcgaaataatatgttccatacattgcttatgtttctctatatcattaagactaaagaaagcggaatgctcggccgagtcaacttagggctatccggggttaatatactgtggatttttggtgagtag

SEQ ID NO: 55355 - DNA, 1686 bp, Artificial Sequence
  Description of Artificial Sequence: Synthetic coding sequence
atgatgcaaggtgaggcccatcccagcgccagtctaatagacaggaccatcaaaatgagaaaagaaactgaagctagaaaggtggtgctagcatggggcctgcttaatgtatcgatggctggcatgatttacacggagatgaccggaaagctgatctctagttactataatgtaacttattggcctctctggtacatcgaacttgctctagcatccttattctcactcaacgccttatttgatttctggcgctattttaagtacactgttgcgccaacttccctggtggtgtcgcccggacaacagacgttgctgggccttaaaactgcagtggtgcaaacaacacccccacacgatctcgcggcaacccagatacctcccgctccccctagcccaagcatacagggacagagtgtgctcagttattctcccagtagaagtccatcaacttctcctaaatttactaccagctgtatgaccggatattccccccagctacagggactaagctccgggggtagcggaagttactcaccgggtgtaacctactcgcccgtgtctggttacaataagctggctagcttcagtccgtccccaccatctccgtaccctaccacagtcggcccagtggagtctagcgggttgcggtctaggtatcgctcctcccccaccgtctataactctcctaccgacaaagaggactatatgactgacctgcggactctcgacactttccttcgtagcgaggaagaaaaacagcatagagtaaagctgggctcccctgactccactagtcctagcagtagcccgacgttctggaattatagtaggtctatgggggactatgcccagacactgaaaaaattccaataccagctcgcatgtcgctcacaggcaccctgcgcaaataaagacgaggctgacttaagttcaaagcaggcagcagaggaggtgtgggccagagtcgctatgaatcggcaacttttggaccacatggattcttggaccgccaagttcagaaactggatcaacgaaactatcctcgttccactggtccaggaaattgaatcagttagcacccagatgaggcgaatgggttgccccgagctccagatcggcgaggcaagtattactagcttgaaacaggccgctctcgtaaaagctccgttgatcccgactctcaacacgatcgtgcagtatttagacctgactccaaatcaagagtacctgttcgagagaatcaaggaacttagtcagggtgggtgcatgagtagtttccgctggaaccgcggaggtgacttcaaaggcaggaagtgggatacagatttgccgaccgatagtgccatcattatgcacgtattctgtacatatctggacagcagacttcctcctcatccgaaataccccgatggaaaaacctttacatcccagcactttgtccaaacccccaataaacccgatgtcaccaacgaaaatgttttctgcatttaccaaagtgccattaatccacctcattacgagctaatctaccaacggcatgtgtacaacctgcccaaaggacggaacaacatgttccataccctgttaatgtttctgtacatcattaaaacaaaggaatcgggaatgctgggcagggtaaatctggggctgtctggtgttaacatcctatggatttttggagagtag

SEQ ID NO: 55356 - DNA, 1683 bp, Artificial Sequence
  Description of Artificial Sequence: Synthetic coding sequence
atgcaaggagaggctcacccctccgcatcattgattgacagaaccattaagatgcgcaaggaaacagaagccaggaaagtggtcctagcgtgggggttgcttaatgtcagcatggccggaatgatttacacagagatgaccggtaagctgatttcatcctattataatgtcacatactggcctctgtggtatattgaactggccttggcaagcctgtttagtctgaatgcactgtttgacttctggaggtatttcaaatacaccgttgccccaacatcactcgtggtttcacccggtcagcagacgctgttgggccttaagacagccgtggtacagaccacaccccctcacgatttggctgctactcaaattcctcccgctccccctagcccatctatccagggccagtcagtgctctcctattctccatctaggtcaccaagcacctcacctaagttcaccacatcctgcatgacagggtacagtcctcagctgcagggcctgtcgagcgggggatccggttcctactcccctggcgtaacatactcgcctgtttccggctataacaaactcgcgagcttttctccaagccctccgagcccttaccccaccactgtggggcctgttgagtcatcaggactgcggtcgcgataccgctccagcccaacagtctacaattcacccacagataaagaggattacatgactgatctccggacccttgacaccttcctgaggagcgaggaggaaaaacagcaccgggtgaaattgggatcacccgactctactagcccatcttcgtcccccacattttggaattacagcagatccatgggagactacgctcagaccctcaagaagtttcaataccaactggcttgtcgttcacaggcaccttgtgctaataaggacgaagccgacttgtcttccaagcaagcggcagaggaggtctgggcgagggtcgccatgaatcggcagctgctagatcatatggattcttggacagccaaattcaggaattggataaacgagaccattcttgtgccgctcgtgcaggaaatagaatcagtgtccacgcagatgaggcgcatggggtgcccggaattacaaattggcgaagcttccattacctctttaaagcaggccgctctagtcaaggcccctctgattcctacactcaacacaatcgtccagtatctcgacctcaccccaaatcaggagtatttgtttgagagaatcaaggaactgtcacaaggagggtgcatgagctcattcagatggaaccgcggtggcgattttaaagggaggaagtgggataccgacctgccaacagacagtgccatcatcatgcacgtgttttgcacctatctagactctagactgccacctcacccgaaataccctgacggtaaaacgttcacaagccagcattttgtccagacccccaataagccagatgtcacaaacgagaacgtcttctgcatttatcagtccgcaatcaaccctccacattatgagttgatttaccagcggcatgtttacaacctgccaaagggtagaaacaacatgttccacacgttactcatgtttctgtacataattaagaccaaggagtcgggtatgctggggcgagtaaacctggggctctctggagtgaacatcttgtggatcttcggggaatag

SEQ ID NO: 55357 - DNA, 171 bp, Artificial Sequence
  Description of Artificial Sequence: Synthetic coding sequence
atgcaaggcgaggcacatcccagcgcctctctgatcgataggactatcaagatgcgcaaggaaaccgaagcacggaaggtggttttggcctggggtttgttgaacgtgtcgatggccggaatgatttataccgaaatgacagggaagttaatatcctcttactacaactag

SEQ ID NO: 55358 - DNA, 1560 bp, Artificial Sequence
  Description of Artificial Sequence: Synthetic coding sequence
atgatgcagggggaagcccatcccagtgcctcattaattgatcggacgatcaagatgcgtaaagagactgaggccaggaaagtggtgcttgcctgggggctccttaatgtctccatggccggtatgatctatactgaaatgacagggaaattaatttcttcttactataatgtgacctattggcccctgtggtacattgagctggccctggccagcctctttagcctgaatgctctgtttgacttttggcgctatttcaaatatacagttgcacctacatccctcgtggtttcccctgggcagcaaaccctgctgggattaaagaccgctgtggtgcagactactcccccacacgacttggcagcaacccagattccaccggctccaccatccccttccatccaggggcagtccgtgttgagctactccccatctcggagcccctcaaccagcccaaaatttaccactagttgcatgacgggatacagcccacaactacagggcctttcgagcggcggaagcggatcttacagccctggagtaacttatagcccagtttctggttacaataaactggcatcctttagccccagcccgccaagcccctatcccaccacagtggggcctgtggagtcaagtggattacggtctagatatcgctcatcacccacagtgtataattctccaactgacaaggaggactatatgacagatttgcgcacccttgacacttttctccggtctgaggaagagaagcagcacagagtgaaacttggcagccccgattctacatctccatcctcatcacccaccttttggaattattctagatcaatgggagactacgcccagactctgaagaaatttcagtaccagctggcctgcaggtcgcaagcgccatgcgccaataaagatgaagctgacctctcaagtaaacaggcagctgaggaagtgtgggcgagggtagccatgaataggcagctcctcgatcatatggattcatggacagccaagttccgcaactggatcaatgagacaatactggtcccactggtgcaagaaatcgagtccgttagtacccagatgcggaggatgggctgtccggagctgcaaattggcgagttgtcccagggcggttgcatgagctctttccgatggaatagaggaggagattttaaaggcaggaaatgggacactgacctcccgaccgacagtgctatcatcatgcatgtgttttgcacgtacctggactccagacttcctccacatcccaaataccctgacggcaaaactttcaccagccagcatttcgtgcagacacccaacaagcccgatgtgactaacgaaaatgtgttctgcatttatcagagcgcaatcaatcctccgcattatgaactgatttaccagaggcacgtgtataacctgccaaaaggccgaaacaatatgtttcacacgttgttgatgtttctgtacatcattaaaacaaaggagtcggggatgttaggtcgggttaacctaggactaagcggggtaaatattttatggatctttggtgagtag

SEQ ID NO: 55359 - DNA, 612 bp, Artificial Sequence
  Description of Artificial Sequence: Synthetic coding sequence
atgatgcaaggcgaggctcatccgagcgcatccctgatcgataggaccatcaagatgagaaaggaaaccgaggcaagaaaggtcgtgctagcctgggggctgctgaacgtgtctatggccggtatgatctacacagaaatgaccggcaaactgatatcctcctactacaatgttacatactggccactgtggtacatagagctcgcccttgcttcactgttcagcctgaacgctctgttcgatttctggcgttacttcaaatacacagtggcgccaacatcgctcgtcgtgagcccagggcagcagactctcttaggcttgaaaaccgcagtggtacagactactcccccacacgatctcgcagccacccagatcccgcctgctcccccatcaccatcgatacagggccagagcgtgttatcctactcaccaagccgtagcccgagtacctccccaaagttcactacctcgtgcatgactggatacagtccacaattgcaggggctatcatccgggggaagcggctcatacagccctggggtcacctacagccccgtcagcggttacaacaaggtgatgactttattctcatgcctggttaccttgttttag

SEQ ID NO: 55360 - DNA, 390 bp, Artificial Sequence
  Description of Artificial Sequence: Synthetic coding sequence
atgctgctgggcggatggctcctccttgcatttaatgcaatcttcctgctgagttgggcagtggcacccaaaggactctgtccgaggagatcatccgtacccatgccaggcgtccaggcagtagcagcaacagcaatgatagtaggcttgctgattttccccatcgggcttgcttctccattcatcaaggaggtgtgtgaggcttcctccatgtactacggtggtaagtgccgcctcggatggggctacatgaccgcaatcctcaatgctgtactggcgagcttattaccaatcatctcttggccgcacacaacgaaagtgcaggggcgaaccatcatcttcagttcagctacggagcggattatctttgtccccgagatgaataagtag

SEQ ID NO: 55361 - DNA, 390 bp, Artificial Sequence
  Description of Artificial Sequence: Synthetic coding sequence
atgctccttggcggttggctcctgctggcattcaacgctatcttcttgctgagctgggccgttgccccaaagggcttgtgtccgcgtcgctcatctgtccctatgcccggagtccaggctgtggctgcaacagcaatgatcgtgggcttacttatctttcctatcggcctcgcctcacccttcatcaaagaggtttgcgaggcaagctccatgtactacgggggaaagtgtcgactgggatgggggtacatgaccgccatcctgaacgccgtgctggcctctctgctccctattatcagctggccccacacgaccaaggtccaggggcgaaccatcattttttcatcagcaacagaacgaattatcttcgtccccgagatgaataagtag

SEQ ID NO: 55362 - DNA, 603 bp, Artificial Sequence
  Description of Artificial Sequence: Synthetic coding sequence
atgctgagttcggtttgggtcgcattgggactgagcctgacttgcacgagcgctttctccctgatttccccagcatggttccagactcctacatttagtttcggcattctcacctactgcagttggccacaaggcaattcttggaaccagtcgtgtgtgactttttcttcattggaggatatcccggacttcgcatggaaggtttctgccgtcatgctgctgggaggctggctgctcctcgcatttaatgcaatcttccttctgagttgggctgtcgcgcctaagggattgtgcccaagaagaagctcggttccaatgccaggcgtacaggccgttgccgctaccgccatgattgtggggctcctgatctttcccattggcctcgcaagtccctttatcaaggaagtttgcgaggccagttccatgtactacggtggtaagtgtcgtttgggttggggatacatgaccgcaattctaaacgcggtcttggccagcctgctgccgattatcagttggccccataccaccaaagtccaaggacgaaccataatcttttccagcgctaccgagcgaataatattcgtgcctgagatgaacaaatag

SEQ ID NO: 55363 - DNA, 474 bp, Artificial Sequence
  Description of Artificial Sequence: Synthetic coding sequence
atggtgttcccccctaacacacagcataagttcactagtgggagggtggcctttcagctcttacaggtcggagtggacagcccggcagccggtacaaggcacaacagcgcaggaccagctcacctgcacagagccctgtcgacggccagcagtatgcagcgacttccagctgcgactcgggctactctgattctgagtctggctttcgcaagccttcacagcgcctgcagtgctgcctctagctccaacagctcttcgctgaccgcccatcaccctgaccccggtactctggaacagtgcttgaatgttgacttttgccctcaagcagcaaggtgttgccggactggcgtggacgaatacgggtggatagctgcagccgtagggtggtccctgtggttcctcaccttgattttgctttgcgtcgataagctcatgaagctgacgccagacgagcccaaggaccttcaagcctag

SEQ ID NO: 55364 - DNA, 324 bp, Artificial Sequence
  Description of Artificial Sequence: Synthetic coding sequence
atgcaacgtttacctgcagctacccgcgctactttgatactctccttggcttttgctagtctgcacagcgcatgctccgccgaggcctcatcatcaaactcttcttccctgacagctcatcatcctgatccgggaacattagagcagtgcttgaatgtagacttttgtcctcaggcagcaagatgctgtaggacaggggtggatgaatatggttggatcgctgctgcagttgggtggagcctgtggtttctcacgctcatattgctctgcgttgacaagttgatgaagctgactccagatgagcctaaggacctgcaggcctag

SEQ ID NO: 55365 - DNA, 2070 bp, Artificial Sequence
  Description of Artificial Sequence: Synthetic coding sequence
atggccacaaaaaccgctggcgtgggcaggtgggaagttgtgaaaaaaggcaggaggccaggcgtgggggcaggggcaggcggaaggggcggtggcagaaatcgtcgcgctctcggagaggctaacggagtgtggaagtatgatttgacgcctgccatccaaaccactagcactttgtacgaaagggggttcgaaaacatcatgaaaaggcaaaacaaggaacaagtgcctcctcctgcggtcgaacccaaaaagccgggtaataaaaagcagcccaaaaaggtggcgaccccaccaaaccagaaccaaaagcaggggagattccgttcacttgaggaggctctcaaagccctggatgttgccgacttgcaaaaggagctagacaaaagtcaaagcgtcttctcaggaaacccttctatatggttaaaagatctggcatcctatctcaattataaattacaggcgccactgagcgaacctactctatcccagcacacacacgattatccctattccctcgtctctagggagttgaggggaattatccgaggactgctggccaaggctgccggttcacttgaactattcttcgatcattgtctcttcaccatgctccaggagctggacaagactcctggcgagtctctgcatggctacagaatttgtatccaggctatcctgcaagacaaaccaaagattgcgacagccaatctaggtaagttcctggagctgttgcgttctcaccagtccaggccagcaaagtgcctgaccataatgtgggccctgggccaggcgggattcgccaacctcacagaggggcttaaggtgtggttgggtattatgctgcctgtgctcggcatcaagagcctgtctcccttcgccatcacttacctcgacaggttgctgttgatgcacccaaatctgactaagggctttgggatgattggtccgaaagacttttttccattattggactttgcatatatgccgaataactctctgactccatcattgcaggagcagctatgccagctttatccacgtttgaaggttctggcctttggtgcaaagcccgattccaccctccacacgtactttcccagttttctttcgcgcgctacccccagctgtccgccagagatgaagaaggagctgctcagcagcctgaccgaatgtctgactgtcgacccattgtctgctagcgtatggagacagttgtatccaaaacatctgtcgcaatcctccctgctactagagcacctgctgtccagctgggaacagatcccaaaaaaggttcagaagtctttacaggaaaccattcagagtctgaaattaactaatcaagaactgcttcgaaagggcagcagcaacaatcaggatgtggtgacttgcgacatggcatgtaagggattgctccagcaggtgcaaggccctaggctgccatggacccggttgctcctgcttctgctcgtgtttgcagtgggcttcctatgccacgacttacgcagtcactcatcattccaggcatctctgacagggaggctactgcgctccagtgggtttctgcctgcatcacagcaggcctgtgccaaattgtactcctactccctacagggctattcttggctcggggagaccttgcccctatggggttcccacctgctcactgtggtgaggccttccctgcagctggcctgggcccataccaacgcaactgtgtcattcctgtcagcccattgcgcttcccaccttgcttggttcggggatagccttactagcctatctcaaagattacagatacaattgcccgattcagtcaaccagctcttgcgctaccttcgggagctccctctgttgtttcaccagaatgtcctgctccccctgtggcatttgttgctggaggccctcgcctgggcccaggagcactgccatgaagcgtgtaggggtgaggtcacctgggattgtatgaagactcaattatctgaagccgtccactggacatggctgtgcctccaggacattactgtggcatttttagattgggcattggctctaataagccagcagtag

SEQ ID NO: 55366 - DNA, 2070 bp, Artificial Sequence
  Description of Artificial Sequence: Synthetic coding sequence
atggctaccaagacagctggcgttgggcgatgggaggttgttaaaaagggcagacggccaggcgtgggcgcaggggctgggggacgtggagggggacgcaatcgaagagcactgggagaggcaaatggagtctggaagtacgacctgacacccgcaattcagaccacttccaccctgtacgagcggggatttgaaaacatcatgaaacggcagaataaggagcaggttccacctccagcggtggagcccaagaagccaggaaataagaaacaacctaagaaagtcgctacaccaccaaatcagaatcaaaaacaggggcgattccgtagtcttgaagaggctctcaaagctcttgatgttgctgatcttcagaaggagctggacaagtcccagagcgtgtttagcggtaatccctcgatatggttgaaagacctggcaagctacctcaattataagctccaggctcctttgagtgaacccacactgtcccagcatacgcatgactacccatatagcctggtgtcccgcgaacttcgaggcatcattaggggccttcttgctaaggcagcaggaagtttggagctgttttttgatcattgcttgtttaccatgcttcaggagttggataagacccccggtgaatccctccacggctatcggatttgcatccaggctatcttgcaggataaacctaagatcgccaccgctaatctgggaaagttccttgaactgcttcgcagccaccagtctcgtcccgcaaaatgcctcacaatcatgtgggccctgggccaggctgggtttgccaaccttacagaagggcttaaggtgtggctgggcatcatgctgcctgtgcttggcattaagtccctgtcaccatttgcgataacatatctcgacaggcttctcttaatgcacccgaatcttacaaaaggcttcggcatgataggtcccaaagacttcttccctcttctggactttgcttacatgcctaataacagcttgacccccagtttgcaagagcaactgtgccagctgtacccacggcttaaagtgctggccttcggcgcaaagcccgactcgactttgcatacatactttccctcattccttagccgagcaacccctagttgccctcctgaaatgaaaaaggaacttttgtcgtcccttaccgagtgcctgaccgtggatccgctgagcgcatctgtgtggcggcaactgtaccccaagcacttgtctcaaagctccctgttactagagcatttgctgtcatcctgggaacagattcctaagaaggttcagaagagcctgcaggaaaccattcaaagtcttaaactgaccaatcaagagctgcttcggaaaggatccagtaataatcaggacgtggtgacatgtgacatggcatgcaaaggcctgctccaacaggtgcagggcccacgcttgccatggacgaggctcctgcttctcttgctcgtgttcgccgtgggcttcctttgccatgatctgcgctcccattccagttttcaggcatcactgactgggaggctgttacggtcgtctgggtttctgcccgcttcccagcaggcctgtgcaaagctctatagctattctctgcagggttacagttggctgggagagactctgccgctgtggggctcccatctgttgacggtagtgcggccatctctgcagctagcctgggctcacaccaatgctactgtcagttttctgtctgcacattgcgcgagccatctggcatggtttggggacagtctaacctcactgagccagcgcctgcaaatacagctgccagatagtgtgaatcagctcttaaggtaccttcgggagctgcctctgctgtttcaccagaacgtcttgctgcctttgtggcatctccttctggaagcattggcttgggcccaagaacattgtcatgaagcatgcagaggggaggtaacttgggattgcatgaaaactcagctgagcgaagcagtgcactggacgtggctctgcctccaggacataactgtggctttcctcgactgggccctggcactaatttcccagcaatag

SEQ ID NO: 55367 - DNA, 1935 bp, Artificial Sequence
  Description of Artificial Sequence: Synthetic coding sequence
atggccaccaaaacagctggcgtaggacgctgggaggtagtgaaaaagggcaggcgccctggcgtcggcgctggcgctggcggacggggaggcggacggaacaggcgtgcattgggggaggctaatggtgtgtggaagtatgacctgacacccgctatccagactacttcaaccctgtatgaacgtggattcgaaaacatcatgaagaggcagaacaaagagcaagtgcctccacctgccgtggaacctaagaagccaggaaataagaaacagccaaaaaaggtggcaactccccctaaccagaatcagaaacagggacggttcagatctctggaggaagccctcaaggcccttgatgtagccgatcttcagaaagaactggacaaatctcagagcgtcttcagtggcaatccctcaatctggcttaaggacctcgcatcgtacctcaattacaaattgcaggcaccattatctgagccgacgttgtcccaacatacccacggcgaatccctccacggttaccgaatctgtattcaagctattctgcaggacaagcctaagattgccacagcaaaccttggcaagtttctggagttacttcggagccaccagtctcgcccagctaagtgcctgactatcatgtgggctctgggacaagccggattcgccaaccttacggagggcctgaaagtttggctgggaataatgctgccagtgttgggtattaaatcattgtcccccttcgccatcacttatcttgacaggctactgctgatgcacccaaacctcacaaaaggatttggaatgatcggccctaaagatttcttccctttgctggatttcgcctacatgccgaataattctctgacgcctagtcttcaggagcagctgtgccagctttacccacgcctgaaggtgctggccttcggggcaaaacctgactccacactgcatacctacttcccatcgttcttaagccgggcaacacccagctgccccccagagatgaaaaaggaactcctatctagtctcaccgagtgcctgaccgtggaccccttgagtgcaagcgtctggcgacagttatatcccaagcatttaagtcagtcgtccctcctacttgaacacctgctgtcctcctgggaacaaatccctaagaaagtccagaagtccttgcaggaaaccatccaaagccttaaactcactaaccaggagctactgagaaaaggaagcagcaacaatcaggatgtggtcacctgtgacatggcttgtaagggtctactacagcaagtgcagggaccccgactgccttggacaaggctcctccttctgctgctcgtgtttgctgtgggttttttatgtcatgatttgcgaagtcactctagcttccaagctagtctcacaggcaggctgctacgcagtagtggttttctgcccgcttctcagcaggcttgcgccaaactgtattcatatagccttcagggatattcgtggttgggcgaaactctgcccctctggggcagccatctactgacggtcgtccggccttcactgcagctcgcctgggcgcataccaacgcgaccgtatcctttctgtctgcacactgtgcatctcacttggcttggttcggggattcacttacgagcttgagccagagattacagatccaactgcccgactctgttaatcaactattgagatacttacgggagctgccactgctatttcatcagaatgttcttttgccactgtggcatctgctgttggaagccctggcatgggctcaggagcactgtcacgaagcctgccgtggagaagtgacatgggactgtatgaaaactcagctgagtgaagccgtgcactggacgtggttgtgcctccaggatatcactgtagcatttctcgactgggccctcgctctcatctctcagcaatag

SEQ ID NO: 55368 - DNA, 483 bp, Artificial Sequence
  Description of Artificial Sequence: Synthetic coding sequence
atggccacaaagacggccggagtcgggaggtgggaagtggtgaagaaaggtagacgccctggagtaggtgccggtgctggcggacggggaggaggcagaaaccgaagggctctcggagaagctaacggagtttggaaatacgacctgactccggctattcagactacatccactttgtacgagcggggtttcgagaatatcatgaaacgccagaacaaagaacaagtgcctccgccagctgttgaaccgaagaagcctggaaacaagaagcagcccaaaaaagtcgctactcctccgaaccagaaccagaaacaggggcgatttcgcagtctagaagaagccctgaaggctctcgacgtggctgatctgcagaaggaacttgacaagagtcaatcggtattcagtggtaaccctagcatttggctgaaagatctcgcttcctacttgaactataagctgcaggcccctgaacagccggactag

SEQ ID NO: 55369 - DNA, 1290 bp, Artificial Sequence
  Description of Artificial Sequence: Synthetic coding sequence
atgtgggcactgggtcaggctggattcgccaacctcaccgaaggactcaaggtgtggctcggtataatgcttccggtactcggcattaaatccctttcaccctttgccataacatacttggacagactcctactcatgcaccccaacttgacagggctgcggcacgattggccccagggtctcctccctactagtggcctgtgtctgtatgccgagcagctgccagatacacagcccgctggtgcctgtcagctataccctaggttaaaggttttggcctttggcgcaaagcccgactcaacactacacacatactttcctagctttctctcacgcgctaccccctcgtgtcccccagagatgaagaaagaactgctctcaagcttaaccgagtgcttgacggtggaccctctttccgcttccgtttggagacagttatacccaaagcacctgtcacagtcttcactcttgctcgaacatctcctgtcctcatgggagcagatcccgaagaaggtccagaaatccctccaggaaacaattcaatctctgaaactgacaaaccaggagctgctaaggaaggggtcatcaaataaccaggacgtagtaacatgcgatatggcttgcaagggcctactgcaacaggtgcaggggccaaggttaccttggacgaggctgctcttgctcttgcttgtcttcgccgtcggcttcctctgtcatgacctgagatctcattcatcttttcaagcctctctgaccggacggctgctgaggagctctggcttcctgcccgcttcccagcaggcgtgtgcgaagctgtatagctacagcctgcaaggatatagttggctcggggaaacactgcccctatggggcagccatctgttgacagtggtcaggcccagcctccagttagcctgggcccataccaatgccacggtgtcattcctgtccgcccactgcgctagtcatctcgcatggtttggcgactctctgaccagcctgtctcagcggcttcagatccagctgcctgactctgtgaaccagctactgagatacctgcgggagctccctctgctgttccaccagaatgtcctcctcccgctctggcacctgttactggaagctctggcctgggctcaggagcattgccatgaggcttgcagaggtgaggtgacctgggactgcatgaaaacacagctctcagaagccgtgcactggacctggctttgtctgcaggacataacagtcgcttttttagattgggctttggctttgataagccaacaatag

SEQ ID NO: 55370 - DNA, 708 bp, Artificial Sequence
  Description of Artificial Sequence: Synthetic coding sequence
atgaggccagatgatattaatccacgtaccgggctggttgtggctttggtgtccgtgtttctggtgtttgggtttatgttcaccgtgtcaggaatgaagggcgaaactctgggcaatatcccactgctcgccataggtccagccatttgtttgcctggtatcgctgccatagctctcgccagaaaaacggagggatgtacaaaatggccggagaacgaacttctctgggtccgaaaactcccctgcttccgaaagcctaaggataaagaggtggtagaactccttagaaccccaagcgatcttgagtccggaaaggggagttccgatgaactggccaagaaggcaggcctgcggggaaagcctccccctcagtcacagggtgaggtgagtgtggccagcagcataaattcgccaactcccaccgaggagggagaatgccagtccttggtacagaatgggcatcaagaagagactagtcgataccttgatgggtactgtccatctggaagctcactcacatatagcgccctggacgtgaagtgtagcgcgcgtgaccgctccgaatgtcctgaaccagaagatagcattttttttgtcccacaggattccattatcgtttgcagttacaaacaaaattccccgtatgaccggtattgctgctacattaaccaaatccagggtagatgggatcacgagactatcgtttag

SEQ ID NO: 55371 - DNA, 690 bp, Artificial Sequence
  Description of Artificial Sequence: Synthetic coding sequence
atgaagcaacagcagtggtgtggcatgacggccaaaatgggaactgtgttatccggcgtgtttaccattatggctgtggacatgtacctgatattcgagcaaaagcacctgggcaacgggagctgcacagagatcaccccaaagtacaggggtgcgtcaaacattatcaataattttataatctgctggtcatttaagatcgtgttgtttctctcatttattacgattcttataagctgctttctactatacagtgtctatgcccagatattcagaggactggttatttacattgtgtggatcttcttctacgagacggccaacgtggttatacaaattctgactaataatgatttcgatattaaggaagtgagaataatgcggtggtttgggctagttagccgcaccgtgatgcattgcttttggatgtttttcgtgattaactacgctcacattacttataaaaaccggagccagggtaacattatcagctacaaacggagaatttctaccgctgagatcctgcactcccgaaacaaaaggctcagcatctcgtctggtttttctggcagtcatttggagtcacagtattttgaaaggcagagttttcacacttctattttcacctgtctcagccccgtcccgtcctcagcaccttccacatgtcgatatacaattgatgtttgttag

SEQ ID NO: 55372 - DNA, 636 bp, Artificial Sequence
  Description of Artificial Sequence: Synthetic coding sequence
atgaagcagcagcagtggtgcgggatgaccgccaagatgggaactgtgttatctggcgtgtttacaatcatggccgtggatatgtacttgatctttgagcagaaacacctcgggaacggctcttgtacagaaatcacacctaagtatagaggtgcttccaacatcattaacaattttatcatttgttggagcttcaagatcgtcctcttcctgtcatttatcacaattctcatttcatgtttccttctttactccgtgtacgcccagatcttcagagggctggttatttacatcgtctggatattcttttatgagaccgccaatgtcgttatacagattctcaccaacaatgacttcgacattaaggaagtccgcatcatgagatggtttggtcttgtgagtagaactgtgatgcactgcttctggatgttttttgtgatcaattacgcacatatcacttataagaaccgaagtcagggaaacatcatctcctataaacgacggatctctaccgccgagattctccacagcaggaacaaaagattgagcattagctccgggttcagtggatcacacctggagtcgcagtattttgaacgtcaaagaagatgctctggaaagacctccatcaaatag

SEQ ID NO: 55373 - DNA, 348 bp, Artificial Sequence
  Description of Artificial Sequence: Synthetic coding sequence
atggctggcacagtgctgggggtgggcgctggcgtcttcatcttggctctgctctgggtagcagtactgctgctgtgtgtgcttctcagccgcgctagcggagccgctcggttcagtgtgatcttcctcttctttggcgctgtcattatcacatctgtgttgctgctgtttcccagggcgggagaatttcctgcaccagaggtcgaagtcaagattgtagacgatttctttatcggcaggtacgtgttactggccttcctcagtgccatcttcctcggcggactcttcctggtcctgattcactacgtcctggagcctatctacgctaagcccctccattcgtactag

SEQ ID NO: 55374 - DNA, 348 bp, Artificial Sequence
  Description of Artificial Sequence: Synthetic coding sequence
atggcaggcacagtgctgggcgtgggggcaggagtttttatcctcgccctgttatgggtcgccgtgctgcttctgtgcgtgttactgagccgcgctagcggagccgctcggttctccgtgattttccttttcttcggtgctgtcattatcacgtccgttctgcttctgttcccgagagctggcgaattcccagccccagaggtggaagtgaagatcgtggacgactttttcattgggcgttatgtgctgttggccttcctctctgcgattttccttggcggactgtttctggtgttgatccattacgtgttggaacccatctatgcaaaacctctgcattcatattag

SEQ ID NO: 55375 - DNA, 348 bp, Artificial Sequence
  Description of Artificial Sequence: Synthetic coding sequence
atggcaggaacggttctcggggtgggggcaggcgtcttcatcctggccctcctgtgggtagccgtgcttctgttgtgtgtgctgctgtctcgcgcttctggcgcagcgagattcagcgtaatatttctcttctttggcgcagtgatcattacttcagtccttcttctgtttccccgagcaggggaattccctgcccctgaagttgaagtaaaaattgtcgacgacttctttatagggaggtacgttttactagcatttctgtcagccatctttctcgggggactgttcctcgtgctcattcactacgtcctggaacctatttacgccaagcccctgcactcttattag

SEQ ID NO: 55376 - DNA, 348 bp, Artificial Sequence
  Description of Artificial Sequence: Synthetic coding sequence
atggcaggcaccgtgctcggtgttggagccggagtgttcatattggcgctgctgtgggtggccgtcctcctcctatgcgtattactctcacgggctagcggcgctgcccgattttccgtcattttcctcttttttggggctgttataatcacctcagtcttactgctgtttccacgtgccggtgagtttccagccccagaagtcgaggtcaaaatagtggatgatttcttcattggacgctacgtgcttctagcattcctttctgccatcttcctgggagggctgtttctggtgcttatccattacgtgctcgagcctatttacgctaaacctctgcactcctactag

SEQ ID NO: 55377 - DNA, 348 bp, Artificial Sequence
  Description of Artificial Sequence: Synthetic coding sequence
atggccggaactgtactcggggttggcgctggcgttttcattctggccctgctgtgggtggccgtcctcttattatgcgtactcctgagccgcgcatccggtgccgcacgcttctctgttatctttctgttctttggtgccgtcattataacctcagtgctgctgctattcccccgagctggcgaatttcccgctcctgaagttgaggtgaagattgttgatgacttttttattgggagatacgttctgctggcttttcttagcgctatttttcttggcggtttgtttctggtactcatccactacgtgctggagcctatttatgcaaagcctctgcattcctattag

SEQ ID NO: 55378 - DNA, 348 bp, Artificial Sequence
  Description of Artificial Sequence: Synthetic coding sequence
atggctggcaccgtgctcggcgtgggcgcaggtgtgttcatattggcactgctgtgggtcgcagtactgcttctctgtgtccttctctctagggcctccggagcggctcgtttcagcgtcatctttttgttcttcggggctgtgataatcacctccgttctcctcctgttccctagggctggggagtttcctgctcctgaagtcgaagttaagattgtagacgattttttcatcgggcgttacgtgctcctcgctttcttaagtgctatatttctagggggactgttcctcgtgctcatacattacgtgctagagccaatatacgcaaagcctctgcatagctactag

SEQ ID NO: 55379 - DNA, 348 bp, Artificial Sequence
  Description of Artificial Sequence: Synthetic coding sequence
atggccggaacggtgctgggcgttggagctggggtctttatactggcactgctctgggtggcggtgctgctgctgtgtgtcctacttagtagggcttccggagccgcaagattctccgtgatatttctcttctttggggcagtgataattacaagtgttctgcttctgtttcctagggctggtgagttccctgctcctgaggtggaggtgaaaatcgtagatgacttcttcattggacgctatgtattattagcgttccttagcgccatcttccttggcggactctttcttgtactgattcattacgtgttggagcctatctatgccaaacctctccatagctactag

SEQ ID NO: 55380 - DNA, 348 bp, Artificial Sequence
  Description of Artificial Sequence: Synthetic coding sequence
atggccggaacagtgttaggagtaggcgcaggcgtgtttatcttagccctactgtgggtcgctgtactacttctgtgcgtgctactctcccgagcttctggcgcagctagattctcagtgattttcctgttttttggggctgtcatcattactagcgtgctcttactgtttccacgcgctggggaattcccagcccctgaagtagaggtgaaaattgtggacgacttttttatcggcaggtacgtgttgcttgccttcctgagtgccatttttctcgggggtctcttcctggtgctcattcactatgtcctcgagcctatctatgctaagcctttgcattcatattag

SEQ ID NO: 55381 - DNA, 723 bp, Artificial Sequence
  Description of Artificial Sequence: Synthetic coding sequence
atgggcaactgtcaggctggacacaatctacacctctgccttgctcaccaccctcccctggtatgcgccacgcttattctgttgctgctgggactctctgggctcgggctcggatcattcttgttgactcacagaaccgggctacggtcacctgatattcctcaggactgggtgtcattcttaagatctttcgggcagctgactctatgccctcggaatggcaccgtgaccgggaagtggaggggctcccacgtggttggactcttaaccaccctgaactttggagacggacccgaccgcaataagacccggactttccaggccaccgtcttgggaagccagatgggcctgaagggctcttccgctggccaactcgtgcttataacggcgagggtcacaacagagcgcaccgctggtacttgtctgtactttagtgctgtacctggcatactcccgtcctctcagcctccaatctcatgctcggaagaaggggcaggtaatgcaactttgagcccgagaatgggtgaagaatgtgtttccgtgtggagccatgaggggctcgtgttgacgaaactgctgacaagcgaggaactggccttgtgtggctcccgccttttagtgctgggaagtttcttactgttgttctgtgggcttctatgctgcgtgaccgccatgtgcttccacccaagacgggaatctcactggtcccggacacggttatag

SEQ ID NO: 55382 - DNA, 723 bp, Artificial Sequence
  Description of Artificial Sequence: Synthetic coding sequence
atgggcaactgccaagctggacataacctgcatctctgtctcgctcatcaccctcccttagtttgtgcaacgctgatcctgttactgctagggctgagtggacttggattaggaagcttcttgctgacccataggactgggctcaggtcgcccgatatcccccaagattgggttagttttctgcgaagctttggccaactgacactgtgccctcggaacgggacggtgacgggcaagtggcggggatctcatgtggtggggttactaaccacactaaatttcggggatggccctgaccgaaataagacacggacattccaggccacggtattaggctctcagatgggtctcaaaggtagcagcgcgggacagctggtactaatcacggctagagtgaccaccgaacgcacagctggtacgtgcctctacttctccgccgtacccggtatcctcccctcctctcagcccccaatcagttgttctgaggagggggcaggaaacgctaccttgagtccaaggatgggcgaggagtgcgtgtcagtgtggtcacatgagggattggtgttgactaagctccttacaagcgaagaattggccctgtgtggatcccgactcctggtgctcggcagtttccttctcttgttttgcggcctgttgtgctgcgtgactgctatgtgcttccacccccgtagagagagccactggtcaaggactcgactctag

SEQ ID NO: 55383 - DNA, 1239 bp, Artificial Sequence
  Description of Artificial Sequence: Synthetic coding sequence
atggatacctcaccctcacgaaagtaccccgtcaagaagagagtcaagatccaccccaatacagtgatggtgaaatatacatcccattacccgcagcctggagacgacggctacgaagaaatcaacgagggctacggtaatttcatggaggagaaccctaagaaaggtttgctgagcgagatgaaaaagaaagggagggctttcttcgggaccatggacactctaccacctcctacagaggacccaatgatcaatgaaatcgggcagttccagtcttttgccgaaaagaatattttccagtcgagaaaaatgtggatcgtgctcttcggcagcgcattggcccacgggtgtgtcgccctcattacaaggcttgtttcagacagatccaaggttccttccctggagctcatatttatccgttctgtattccaagtcctgtctgtgcttgtcgtttgctactatcaggaagccccattcggaccatcaggttacagactccgattgtttttttacggggtgtgcaacgtgatctctatcacttgtgcctataccagctttagtatcgtgcccccaagtaatggcactaccatgtggcgggctaccacaacagtattttctgctatccttgcatttttgcttgtggacgagaagatggcgtacgtggatatggccacagtagtgtgtagcattctcggagtctgcctggtgatgattcctaacatcgtcgatgaggacaatagcctcctaaatgcctggaaggaggccttcggctataccatgaccgtgatggcaggactcaccactgctttgtctatgatagtttaccgtagcatcaaggagaaaatctccatgtggacggccttgttcactttcggatggaccggaacgatctggggtatatctaccatgtttatcttgcaggaacccattattcctttagatggcgagacctggtcctaccttatcgcgatttgcgtctgtagcactgctgcctttttgggcgtgtactatgcactcgacaagtttcacccagctcttgtgtctactgtccagcatctggagatagttgtggcaatggtgctgcagctcttggtgctgcacatattcccgagcatatacgatgtgttcgggggagtgatcattatgatctctgtgtttgtccttgcaggctataagctgtattggaggaacctccggaaacaggactatcaagagatcctcgatagtccgatcaagtag

SEQ ID NO: 55384 - DNA, 1239 bp, Artificial Sequence
  Description of Artificial Sequence: Synthetic coding sequence
atggacactagcccttcccgaaagtatcccgtcaagaagagagtcaaaatccatcccaacacagtcatggtcaagtatacgtcacattacccacagccaggggatgatggctacgaagaaatcaacgaggggtacgggaactttatggaggagaatcctaagaagggtctcctgtcagaaatgaagaagaaagggcgtgctttcttcggcaccatggataccctcccgccacccacggaagaccccatgatcaatgagattggacagtttcagtcttttgcagaaaaaaacatcttccagtcaaggaaaatgtggatagtcctgtttggaagtgccctggcccacggctgtgttgcactgattactcgccttgtatcagacaggagcaaggtgccttctctcgaactaatattcatccgtagtgtgtttcaggtgctgtcagtgcttgttgtgtgttactatcaggaagctcctttcgggccttctggctaccgccttcggctttttttttatggggtctgtaacgtcatatccatcacttgcgcctatacaagtttttccatagtgcccccatcaaacggcactaccatgtggcgggcaaccaccacagtgtttagcgccatcttagcgttcttgcttgtcgacgagaaaatggcctatgtcgatatggcaacagtggtgtgttccatcttgggggtctgcttggtaatgattcccaatatagtcgatgaggacaatagcctcctcaacgcttggaaagaggccttcggttacacaatgaccgtgatggctgggctgacgacagctctcagcatgatagtgtaccgctctattaaggaaaagatcagcatgtggacggcactgttcacattcggttggactgggaccatctggggaatctccacaatgtttattctgcaggagccgattattcctctcgacggagaaacttggagctatctgatagcaatttgcgtctgcagcactgccgcttttctgggagtgtattacgcactggacaagtttcaccctgcgttggttagcacagtccaacacttggaaatcgtcgttgctatggtcttgcagctgctggtgctccacattttcccaagcatttacgatgtgttcgggggtgttatcatcatgatctcagtttttgtgttagcagggtacaaattatactggagaaatctgcggaagcaagattatcaggagatattagattctcctataaaatag

SEQ ID NO: 55385 - DNA, 483 bp, Artificial Sequence
  Description of Artificial Sequence: Synthetic coding sequence
atggctcccgctttgtggcgagcttgtaacggtctaatggccgcatttttcgccctggcagccctagtgcaggtgaatgatcccgatgccgaggtctgggtggtggtgtatacgatccctgccgtcctgactctgctagtggggttaaacccagaagtcactggcaatgtcatctggaaaagcatttctgcaatccatatcctgttctgtacagtgtgggctgtgggcctcgctagttacctcctgcaccggacccaacagaatatactccatgaggaagagggcagagaactatctggacttgtgatcattacagcctggatcattttgtgtcatagctcgagcaagaacccagttggcggaaggattcagttggcaattgcaatcgttattactcttttcccttttatttcctgggtgtatatctacatcaataaggagatgcggtcatcatggccaacacattgtaagaccgtcatatag

SEQ ID NO: 55386 - DNA, 453 bp, Artificial Sequence
  Description of Artificial Sequence: Synthetic coding sequence
atggcccctgccctgtggcgcgcatgcaacggactgatggccgctttctttgcattggcagcactggtgcaggtggtttataccatcccagcagtcctaaccctccttgtgggccttaatcctgaggtgactgggaatgtgatctggaagagtatctctgctattcacatcctgttttgcacagtgtgggctgtgggactggcctcctacctgctccacaggacacaacaaaacatactgcatgaagaagaaggacgggagctctcaggcttggtcattatcaccgcctggattatcttatgtcactcctcatcaaaaaaccccgtgggagggcgtatccagctggcaatcgccattgtgattaccctgtttccctttataagctgggtgtacatctacattaacaaggagatgcggagcagctggcccacccactgcaagacagtcatctag

SEQ ID NO: 55387 - DNA, 603 bp, Artificial Sequence
  Description of Artificial Sequence: Synthetic coding sequence
atgaagcagtaccagggctctgggggagtggctatggatgtcgagaggtcacggtttccctattgcgtcgtttggaccccaattccagtattaacttggttctttcctattatcgggcacatgggcatctgtacttcgacaggcgtgatcagggactttgccggaccctacttcgtctcggaggacaatatggccttcggtaaacccgcaaaatgccatctacaggaggctttcagccatcccattcttgtcaggtccggatgtcacaacaaaatcagcagcatcggttactggaagcttgatccagctcaggtttacgcctccggtcccaatgcttgggacacggcagtgcatgatgcttcagaggagtataagcaccggatgcataatttatgttgtgataactgccattcccacgtagcgttagccttgaacttaatgcgctataacaacagtaccaattggaacatggtaaccctgtgctttttttgtctgctgtacggcaagtacgtgagcgtgggcgcattcgtaaaaacctggctgcctttcattctattattgggcattatcctaacagtgtcactggtgtttaacctacgctag

SEQ ID NO: 55388 - DNA, 627 bp, Artificial Sequence
  Description of Artificial Sequence: Synthetic coding sequence
atggccgaggctgaggggtccagtctcctgctcctgccccctccaccaccaccccctaggatggctgaggtggaggctcctacggccgctgaaactgacatgaaacaataccaggggtccggaggtgtggccatggatgtcgagcggtcacggttcccttattgtgtggtttggaccccaatccctgtcctgacatggttctttcctataatcgggcacatgggaatctgcaccagcaccggggtgattcgcgattttgccggtccgtattttgtgtccgaggataatatggcgtttgggaaacctgcaaagtattggaaactggatccggctcaagtatacgcctctggtccgaatgcgtgggatacagcagttcacgacgccagtgaagagtataagcaccgcatgcataacttgtgctgcgataattgtcactcacatgttgcactggcgctgaacctcatgcggtacaacaactctacgaattggaacatggtaacgctgtgctttttctgccttctttatgggaagtatgtttctgtgggcgcttttgtgaaaacttggctcccctttatactgctcctgggcatcattctcaccgtctccttggtgtttaatctccgttag

SEQ ID NO: 55389 - DNA, 609 bp, Artificial Sequence
  Description of Artificial Sequence: Synthetic coding sequence
atggccgctccctggaggcggtggccaactggtttattggccgtgctgcgccctctgctaacctgtcggccacttcagggaacaacacttcagcgggatgtgcttctattcgagcatgacaggggcaggttcttcaccatcctgggcttattctgcgccggacaaggcgtattctgggcatcaatggcagtggccgctgtatcacgacccccagtaccagtccagcccttagatgctgaggtgccaaatcgaggaccctttgatcttaggtctgcactctggcgatatggtctcgcagtcggttgtggggcaatcggggctcttgttctgggcgctggtctcttgtttagcctgcggagcgtgcgatccgtggttcttagggctggcggacaacaggttacactgacaacacatgctccattcggattaggggcacactttacagtcccactgaagcaggtctcatgtatggcacaccgcggtgaagtccccgctatgcttcctttaaaggtgaaaggtagaaggttctacttcctgttagacaagactggacacttccccaataccaaactgtttgacaatactgtcggagcctaccgttccctgtag

SEQ ID NO: 55390 - DNA, 678 bp, Artificial Sequence
  Description of Artificial Sequence: Synthetic coding sequence
atggtgcatgtatcaaaccggagcatccagggaatgaacattcttttctcgtcctgggcggttgtgttaatggtgatggggattaccttagacaaatgggtggagcttattagtgaagacgagagagctaaaatgaaccactctccttggatgatgtgctgcccagctctctggccagaagacgaccttaaagtggtccggattatgatgacttcaagtttgggcttgagcttcttactgaaccttatcctcgggatgaaattcacctatctgatacctcagaataaatacatacagttgtttacgacaatcctgagctttttttcggggataagtctgttatgggcccttattttgtatcataacaagctgaagcaaggccagagcatgcactttagcaattatcggattacttggattatgtacacggcttatctgaacgtctttttcttgagcgtctgcggagtactgtccctgctggagtgtaagctatccacatcttcctgtacatgcctgaacatccacaagagcgacaatgagtgtaaagagtccgaaaattctattgaggatatttcccttccagagtgcaccgccatgccacgatcaatcgtccgggcacacacggttaattcgctgaataaaaaggtgcagacaaggcacgtgacatgggccctgtag

SEQ ID NO: 55391 - DNA, 1143 bp, Artificial Sequence
  Description of Artificial Sequence: Synthetic coding sequence
atggccggttccgatgtggatagcgagggtcctgccagacgagggggagcagccagacggccaggggctccgggtggccctgggagcgaagcagcagccggttgccctgaacccctgtccacggccgaggccccagcagaatctgccactttacctgcgtggatgcgcctgtatttctacgggatgcacgggattacactggatgtgctggtctctagtgccagacggttcgctagatcccccgaccttcgtatgttagggttcagctcaccttatcggtgccttctgcattctctcacccactttgctctggaaaaggtatacctacagcagcgacgatgtcctaacgcgttcgtgttcaactttctgctgtacccttctgctcacgtcggtttgcaaaccctcgcgggacaggcgttgttgctgtcgctgggtggcggtgcaggcgttgcagtggcgcctggagccttagatctcgctctgcagtacgtccttgccctttaccattgccaggtttttctgaagcggtttctgcgactccggtacggacgccaacgccgaagacagcagcagcagcaacaacagcagcaacaacagcagagacggggagcgcttccagtcccacctggagcacgcgtgcccacagccgcaggcgctcgccgaagaaggccacggggtcccaggggagcaggaggcgcaccttctcagggacttcctgacttgccgagattcctatttttcgggatgcatggttttctcgacgaaatattctttacttttttcttcaatgtcctagggcagggcgacggcaccactagcggccacacttctctatggtccttctttatgtacgggagttgttcatttgtagtcgaaaagctgtacttccacttgcattactccagaggctggggcacatggaaacgggtccctatttatgtcattttcatctacgtgtgggaattgtcatgggggctgggactgcgcacctgtggcgcatgttcttgggactattcccattacccacttaacttcatgggattgattaccctgatgtatctccctgggtggatcttcctgagcgtatatcaagatctgatcagcaacgtgctgtggagggtgcagtatgtccccgctaactag

SEQ ID NO: 55392 - DNA, 504 bp, Artificial Sequence
  Description of Artificial Sequence: Synthetic coding sequence
atggcctccgccgagcctctgaccgctctgtcaaggtggtacctttacgcaattcacggttacttctgcgaggtgatgttcactgcagcctgggagtttgtcgtgaacctgaactggaaattccccggagtgacttcggtgtgggctctgttcatatatgggacttctatcctcatcgtggagcggatgtatttgcggctgcgcggaaggtgtcctctcctgctaagatgtctgatttacactctctggacatacttgtgggagttcactacaggcttcatcctacgtcagtttaacgcttgcccttgggattattcccagtttgacttcgacttcatgggcctgataacgctcgaatacgcggtgccttggttctgcggagctttgatcatggaacaattcattatcaggaatactctcaggctgaggttcgacaaggatgccgagcccggtgagccttccggggcacttgctctcgccaacggccacgtaaaaaccgattag

SEQ ID NO: 55393 - DNA, 405 bp, Artificial Sequence
  Description of Artificial Sequence: Synthetic coding sequence
atggcctccgccgagcctctaacagccttgtcaaggtggtatctgtacgctattcatgggtacttctgtgaagttatgttcaccgccgcatgggagttcgtcgtgaaccttaattggaaatttcccggtgttacatctgtttgggcgttgttcatttacgggactagcatcctcatcgtcgagcgtatgtatctccgactgaggggtaggtgcccgttactacttcggtgcttgatctatacactttggacatatctctgggagtttacaactggattcattctgaggcagtttaacgcctgtccgtgggattattctcagttcgacttcgattttatgggcctcatcaccctcgagtatgcagtcccttggttttgcggtgcgctgattatggaacagttttag

SEQ ID NO: 55394 - DNA, 240 bp, Artificial Sequence
  Description of Artificial Sequence: Synthetic coding sequence
atggctagcgcggagccgctgactgcacttagccgttggtatttgtatgcaattcatggctacttttgtgaggtaatgtttaccgccgcatgggagtttgtcgttaacttaaattggaagttccctggtgtcacaagtgtctgggccctcttcatttatggcaccagtattctcattgtggagcggatgtatctccgactgaggggaaggtgtcctcttttgttaagatgcctgatttag

SEQ ID NO: 55395 - DNA, 504 bp, Artificial Sequence
  Description of Artificial Sequence: Synthetic coding sequence
atggcctcagccgagcctttaactgctctttccagatggtacttatacgcaatccacgggtatttttgcgaggtaatgttcaccgcggcatgggagtttgtggtgaacttaaattggaagttccctggcgtgacttctgtgtgggcactcttcatttatggaacatctattctgatagtggaaaggatgtacctgagattgcggggacgctgccccctgcttctgagatgtctgatttataccctatggacatacctctgggagttcacaaccggtttcatactgcgccagttcaatgcctgtccatgggactacagccagttcgacttcgattttatgggcctcattacactggaatatgctgtgccatggttctgcggagccctcatcatggagcaattcattatccgcaacactctgagactgagatttgacaaagatgccgagccaggcgaaccatctggcgctctcgctttagccaatggccatgtgaagactgactag

SEQ ID NO: 55396 - DNA, 171 bp, Artificial Sequence
  Description of Artificial Sequence: Synthetic coding sequence
atggctagtgcagaacctttgacagccctgtctaggtggtatctgtatgctatacacggttatttctgtgaggtaatgttcaccgctgcctgggagttcgtcgttaatctaaactggaaatttcccggagttacttccgtgtgggcactgttcatatacggcacatcatag

SEQ ID NO: 55397 - DNA, 504 bp, Artificial Sequence
  Description of Artificial Sequence: Synthetic coding sequence
atggcatccgcagagcccctgacagccttgagtcggtggtacctatatgcgatccacggatacttttgcgaagttatgtttaccgctgcatgggaattcgtggttaatttgaactggaaatttccaggagtgacaagcgtatgggctctgttcatatacggcacctcgatactcatcgtggagcgtatgtacctgaggttgcggggaagatgtccccttctgctaagatgcttaatttatactctgtggacatacctctgggagtttacaaccggatttattctcagacagtttaatgcctgtccctgggattattcccaatttgatttcgatttcatgggactgatcaccctcgagtacgcggttccctggttctgtggggcattgatcatggagcagttcatcatcaggaatacccttcgcctgcgctttgacaaagacgcagagccaggagagccctccggagcactggctctggcaaatggccatgtgaagactgactag

SEQ ID NO: 55398 - DNA, 168 bp, Artificial Sequence
  Description of Artificial Sequence: Synthetic coding sequence
atggcttctgccgaacccctgacagctctgtcccgctggtacctttacgccattcacggatatttctgtgaggtgatgttcactgcagcctgggagtttgtggttaatctcaattggaagtttccaggggtcaccagtgtgtgggctcttttcatatacggaacctag

SEQ ID NO: 55399 - DNA, 951 bp, Artificial Sequence
  Description of Artificial Sequence: Synthetic coding sequence
atggccctttacgaattattctcgcaccctgtggaacgcagctaccgcgctgggttatgttccaaggcggctttgtttttattactcgcggctgccctcacctatattccaccactactcgtggccttccgatctcacggcttttggctcaagaggtcctcttacgaagaacaacccaccgtgcgatttcagcatcaagttctgttggtggcactgcttggtccggaatccgacggctttctcgcctggtcaacattccccgcttttaataggcttcagggcgaccgactgcgggtcccacttgtttcaactcgcgaagaggataggaaccaggacggcaagaccgatatgctgcattttaagctggaactgcccttgcagagcactgaacatgtactaggtgtgcaactaatcctcactttcagttaccggttacaccgcatggccaccctcgtcatgcaatctatggccttcctgcaatcttctttccccgtacctggctcccagctttacgtgaatggcgaccttcggttgcagcagaaacagcccttgagttgtggcggactggatgctagatataatattagcgtcatcaacggaacaagccccttcgcttacgactacgacttgacacacatcgtcgccgcttaccaggaacggaacgtgacgactgtgctgaacgaccctaaccctatctggctggtgggcagggccgctgacgcccctttcgtcatcaatgccattatacgataccccgttgaagtaatcagctatcaacctggcttttgggagatggtgaaattcgcatgggtgcagtacgttagtattctgctcatcttcctatgggtatttgagcgaataaagatctttgtattccagaaccaagtcgttaccaccatccccgtgactgtcacacctcggggtgatttgtgcaaggaacacctgtcatag

SEQ ID NO: 55400 - DNA, 1038 bp, Artificial Sequence
  Description of Artificial Sequence: Synthetic coding sequence
atgtcctccagtctgactaggagttcagcagtgaccgctcgtggctccgcgccaaaacctcggtgcagctgttgctggcccttacgctcccgtactagccggcgatgctggtggccctccggagcaaccgtgtcgctacctcggcctctctgccacgaggccccacgggctcgaagtgccagagccggtctaccgaatcgattgccaaccgcgcttttcaattcaggcttttggctgaagaggtcctcctacgaagagcaacctactgtgagatttcagcatcaggtgctcctggtggccctactgggcccagaatctgatggctttttagcctggagcacatttcccgctttcaacaggctacaaggagacagattgagggtgcctctagtgtcaactagggaggaggatcgcaaccaggatggcaaaactgacatgcttcattttaagctggaattaccacttcaatccacagagcacgttctgggggtccagctgattcttacctttagctaccgacttcatcggatggccactctggttatgcagagtatggccttcctgcagtcgagctttcctgtgccaggcagtcagttgtatgtgaacggcgatctgcgcctgcagcagaaacagcccctgtcttgtggtgggcttgatgcgagatataacatctctgtaattaatggcacgtccccatttgcatatgactacgatctaactcacattgtcgctgcataccaggagcgaaatgtgactactgtccttaatgacccgaatccgatctggttggtcgggcgagccgcagacgcaccatttgtaatcaatgcaatcatcagatatccagtggaagtgatttcttatcagcctggattctgggagatggtgaagtttgcatgggtacaatacgtgagcatcctgctgatcttcctgtgggtgtttgagcgaattaagattttcgtttttcagaaccaggtggtgacaaccattcctgtcactgtgactcctcgaggtgatctctgtaaggaacacctctcatag

SEQ ID NO: 55401 - DNA, 1521 bp, Artificial Sequence
  Description of Artificial Sequence: Synthetic coding sequence
atgaatatgcctgtgaacaagagcccaatgatcaatacatgcggaggtatcagctcaccctaccacgaggagctttggaaactgaactttcagcacctatcaggtgaaaggggccacaagtctcgcccaacatttagcattaccaaggagtttatcctgcgattcaatcagacacagaattccaaggagaaagaggagcttcttgagctggcgagaaaaattattctgagatgcaagcgaaagttgggcctcaaaacgctggggtcgggtcgtcacgtccatttaccggcagcatggaccgaggtcatctatttggcgcagtgtaagggcgaaatccaagacgagtccctcaatatgttgtacgcctctcttgaccatgcatcctttgactatgaccacctgcccgcactgttctttgtggctgaatccgtcttataccgcctctgctgcgacgcatccctgaaaacatacttgtatagtgtcgaaattaagcttgcgaaaatcggctacctggttttcctgagactgtttatcttcttcctgcacggtcacctcgaaagctttaaacaacacctacttagattgcaaccatatctttacgctcttagcttctccggtgcttcctaccataaataccctaatatattttccaacgtccagttcatcctaaaagccagtgaaattattggcaagagagagctcaggtccgagagcatcttcagacctgtggaggataagaagcgctacgaaaacaccgacagcgatatgggaggctacgagattaaccatctcctctggcattgcgtggctgcctggagctgtgtacagaataattccccacagctgaataacgtgctggagcacctggtctttcataagacccagcttcagaaaaagtgttggctggatagtgtcctcgcactgctggtgctcggggaggccgcaaagcttaatatggcatgcctgaaagcgctgatggatgtggtgcgcgatttcgtgagtagcattatgagtgtgcagaatcaggaggagtcttgtaaagtggacgacttctcctgggcttggaatgtagtgtacatatacaccgtaatccttgccgagatctgcctctacgccgcaacgagtgacttaaggaagacagcacttatcggattttgtcattgtaaaagctcccagaaaaacatactatacttggacaagtcggtgcccccagaacttaaggaaacttctatactgtctcttctggagtatttctcttcaaagatgtctgaaaattgcgatcaggtggtatggactgggtactacggtctggtgtacaaccttgtgaagatttcctgggagctacagggggacgaagagcaagacggcctgaggaatatgatctggcaaacactgcaaaaaacaaaagattatgaagaggacgttcgcattcaaaatgcgataaatattgcccagggaacctccttttgtatccgcaactcccatgtgtctatcagtcggtttctccaccagggtaggtag

SEQ ID NO: 55402 - DNA, 1974 bp, Artificial Sequence
  Description of Artificial Sequence: Synthetic coding sequence
atgaacatgcccgtcaataagagtcccatgattaacacatgcggcggtatatctagtccataccacgaagagctgtggaaactcaatttccagcacctgagcggtgagcgtggccataagtcgcgtcctacattctctataaccaaagaatttatcctgaggttcaatcagactcagaactcaaaagaaaaagaggaattgctggagctggcccgtaaaataatcctcaggtgcaagcgaaaactgggcctgaagacactgggttcaggacgccacgtgcacctgcctgcggcttggactgaggtgatctatctagctcaatgtaagggggagatccaggatgagtccttgaacatgctatatgcttcactagaccacgcctcatttgattatgaccacctgcctgcactgttctttgtagccgagtccgtcctgtatcgactctgctgcgatgccagtctgaaaacgtatctctatagcgtcgagattaaactggccaagatcggctacctcgttttcttaaggctcttcattttcttcctgcacggccatttagagagcttcaaacaacacttactccgcctgcagccctacctctacgcactgtcatttagcggcgctagctatcataagtatcctaatattttctcaaacgttcagttcatcctgaaagcttccgagatcatcgggaagcgtgaactccgaagtgagtctatttttagaccagttgaagataagaagcgctatgagaacacagattcagatatgggaggttacgaaattaaccatctcttgtggcactgcgttgccgcttggagctgtgtgcaaaacaatagtccacagctgaacaacgtcctcgaacaccttgtttttcataaaactcagctgcagaaaaaatgctggctcgattctgtgctcgctcttctggttctcggggaggccgctaagctcaatatggcatgcctgaaggcactcatggacgtagtgagagattttgtctcctctattatgtccgtccagaaccaggaggagtcctgcaaagtggacgatttctcatgggcctggaatgtcgtgtacatttacactgttatactagcagagatctgtctttacgctgccacttcagacctccgaaagactgctctgatagggttttgccactgcaaatcaagccagaaaaacatcctgtacctcgataagtctgtgccccctgagcttaaggaaacttcgattctgtctctgcttgagtactttagctccaaaatgtccgagaactgtgatcaggtcgtgtggacagggtattacggcctagtctataatctggtcaagatctcttgggagcttcagggtgatgaggagcaggatggcttgagaaacatgatatggcaaacactgcagaaaactaaggattacgaggaagacgtccgaatccagaatgccatcaacatcgcccaggcggaattgaacgacccaactgacccatttactcgctattcaaccaatatttcctccaacgtgggcgaggaggtgttcagcaaatatatcgggtggcggatcgctaacactctgtccaaactcttcttcccacctatcgaggcacatttcctgccactgaaaaagccctcgatcaaaaaggaccaaactaaataccctaataagaagctcgagtcggtgaagaagcaggtgctccactttaccgtgagagaacatccctctgtctctgagatccccatgtttccctaccccgacttcttcacaaaggcagataaagagctcgccaagattattgaccaccattggcaggaagaactgaagattagagagaaagaagatgctatctgcaaagcccaagaactcaaggataagaagctagccgagaagaaccacttccaggaggtaatgaaaaaaagggaggagaagctgcataagcaaacaaaaccctacgaactgccatacagaaaggaagttatctag

SEQ ID NO: 55403 - DNA, 330 bp, Artificial Sequence
  Description of Artificial Sequence: Synthetic coding sequence
atgtcccaatacgcaccatctcctgattttaagcgcgctctggacagcagccctgaggccaacactgaggacgataaaactgaggaagacgtcccaatgcctaagaactacttgtggcttactatcgtgtcctgcttttgtcccgcttaccctatcaacattgtcgcccttgttttctctattatgtccctaaactcctataacgacggggactatgagggcgcaaggcggctggggaggaatgctaaatgggtcgcgatcgcatcaatcatcatcggactcctgatcatcggaataagctgtgccgtgcattttacaagaaatgcctag

SEQ ID NO: 55404 - DNA, 423 bp, Artificial Sequence
  Description of Artificial Sequence: Synthetic coding sequence
atggctgcatcgttgggccaggtactagccctggtcctcgttgccgctctgtggggcggtacccagcccctgctgaaaagggccagtgctgggcttcagcgagtacacgaacccacctgggcccagcaattacttcaggaaatgaaaaccctgttccttaacaccgagtacctgatgcccttcctgctgaaccagtgtggatcacttctctactacctcactctcgcatctacagatctcacactggccgtaccaatctgcaatagtcttgcgatcatttttaccctgatcgtgggtaaggcactgggggaggacataggaggaaagagagccgtggcgggaatggttcttactgtcatcggtattagcctctgcatcactagtagcgtatctaaaactcagggccagcagagtacattatag

SEQ ID NO: 55405 - DNA, 495 bp, Artificial Sequence
  Description of Artificial Sequence: Synthetic coding sequence
atggcggcaagccttggacaggtcctagctctggtgttggtggccgctctctgggggggaacacagcctctccttaaaagagcctctgccggattacagagggtacatgaacctacctgggcgcagcagctgcttcaggagatgaagactctgtttctcaatacagaatatctcatgccctttctactgaatcagtgtggctccttgctatattacctcaccctcgcctctaccgaccttacactggccgtccctatatgtaattccctggcgatcatcttcaccctcatcgtcggcaaggctctcggcgaggacatcggagggaaacgggcagtcgcaggaatggtgttgactgtcatcgggattagcctgtgtatcacttcaagtgttccgtggacagctgaacttcagttgcacggaaagggccagctgcagacgctctcacaaaaatgtaagagagaggccagcgggacccagtccgagagattcggatag

SEQ ID NO: 55406 - DNA, 495 bp, Artificial Sequence
  Description of Artificial Sequence: Synthetic coding sequence
atggctgcctccttgggccaggtgctggccctggtgctcgttgctgcactgtggggcggtactcaacccttgctgaagagggctagtgccggattacagcgcgtgcacgagccaacctgggcccagcagctcctgcaggagatgaagacactctttctcaacacagaatacttaatgccttttctcctgaaccagtgcgggtcccttttatactatctgacgctggccagtacagatcttacactggccgtgccaatctgcaattctctggctattatttttactctcattgtgggcaaggccctaggggaagatataggtggaaaacgagcagtggctgggatggtgctgaccgttattgggatctccctatgcattacaagctccgttccctggacagctgaactgcagctgcatgggaaaggacaactgcagaccctcagccaaaagtgcaagagagaagcctctgggactcagtctgagaggttcggctag

SEQ ID NO: 55407 - DNA, 495 bp, Artificial Sequence
  Description of Artificial Sequence: Synthetic coding sequence
atggccgcaagtctggggcaggttctcgcactggtcctagtggcggctctctggggcggtacccagcccctgttgaaacgcgcttcagcaggactgcagcgcgtgcatgagccaacatgggcgcagcagctgctgcaggaaatgaaaaccttgttcttgaatactgagtacttgatgccttttctgctgaaccagtgcggatctctgttgtattatctaaccttggcttcaacggatctgacactggcagtcccaatatgcaattccctggccattatatttactctgatcgtcgggaaagcactgggagaagacatcggaggcaagcgcgctgtcgccggaatggtgcttaccgtcattggtatcagcctgtgcatcactagttcagtaccttggactgcggagctacagctccacggcaaaggccagctccaaacactgagtcaaaagtgcaagagagaagcttctggcacccagtccgagcgatttggatag

SEQ ID NO: 55408 - DNA, 495 bp, Artificial Sequence
  Description of Artificial Sequence: Synthetic coding sequence
atggccgcttctcttggacaggtactagcgctggttctggttgccgctctgtggggagggacacagcctctattaaagcgagcttctgccggtctgcagcgcgtgcacgagcccacctgggcccagcaacttctccaggagatgaagactctgtttctgaacaccgaatatctcatgccatttctgctgaaccaatgcggatcgctcctgtattatttgactctcgcaagcaccgacctgactttggctgtcccaatctgtaacagtttggccatcatatttaccctgattgtgggcaaggccctgggggaggatatcggcggaaaacgagcagtcgctggaatggtgcttactgtaataggcatatccctgtgtatcactagttctgtgccgtggacagcagaactgcagttgcacgggaaggggcagctgcagacattaagtcagaaatgcaagagggaagcctctggtactcagagcgagaggttcggatag

SEQ ID NO: 55409 - DNA, 486 bp, Artificial Sequence
  Description of Artificial Sequence: Synthetic coding sequence
atggcagccagtctcggccaggtcttggccctagtgctggtggctgcactctggggaggcactcagcctctgctcaaaagggctagcgctggcctccagcgcgtccacgagccaacctgggcccagcagctgctgcaggagatgaaaaccttgtttctgaacactgagtacctcatgccattcctcttgaaccagtgcggaagccttctgtattacctgacactggcatccacagaccttaccctggccgtgccaatttgtaattcccttgccatcatcttcaccctaatcgtggggaaggccctgggagaggacatcggtggtaaacccgtgctgctgccttgcgggcatcaatcctcactacctcttgacagcctcgaaaaggatagggggtggggccttgggctcaagacgcgtccacatctgagcccttcttcctcccctgtccctgctcccacgggcatggccgaactgcgtcccagctag

SEQ ID NO: 55410 - DNA, 591 bp, Artificial Sequence
  Description of Artificial Sequence: Synthetic coding sequence
atggcacggctgggcgcactgttgctggccgctgctctgggcgcattactgtccttcgctctcttggcagcagcggtagcctccgattattggtacatccttgaggtggctgatgcagggaatgggtctgcatggcccggtagagccgagctcctgagctcgcacagtggtttgtggagaatttgcgaggttctgcaccgcgctgttatcgtggttctaccactgagccttgtgctactggtgtgtggctggatctgtgggctcctgtcatcgctggcacagtccgtctcgctactcttgttcacaggctgttattttcttctcggcagtgtattaaccctggccggagtaagtatttatatatcatactcacatctcgccttcgcggagacggtccagcagtacggaccccagcacatgcagggggtgcgggtgtcttttggttggtccatggcactcgcctggggatcttgtgccctggaagcatttagcggcacactcctgctcagtgccgcttggaccctttccctgtcgccccctatctgcgggcatctcagtccacagcaggtggggggaagaggtggagactag

SEQ ID NO: 55411 - DNA, 1185 bp, Artificial Sequence
  Description of Artificial Sequence: Synthetic coding sequence
atgcctagtgggtggtcttctggtcttatccagaccaggacacctggccctgccagggctcgcctgctctgtttccaggagcatgggtgggtcgtgctgctgcctggacgcccttccagttggggcaggtcgctggccgacccaccaagctcttcccaggcacttcatagtcccgcaaggcaggttcacttagtttggctgctccggagcagggggttcagagaaattaaggaacgcgctcaaggacccggagcgagcccttggggtcgctgggattggagtccttccccaaggttcgccgctagactttccactagcagtccattcccacaggggagagctcagcgcccacagagagggggtgtggatttacctgctacccctggaggaccgagaggtcagtgcgctggcagatccggggatgttttacggcgtgcaggcagacgcagagcgagaccaccaccagtgccacggctaccagctcctcgggctccacggcgacctcgcggacctgctactcctgatcccagtcctcccgcaggacggccacacggtcccgctgggagagccgcacctggcaggcgaccaggctgtactgctcagctgcgtgcacccggtcgccgtgggaggcagcggcttcttgttcaccctggaggcggtggcaggaggcagtggcagcgacttgcaagggccaggcgcgcagctctgctagctctaggcgcacttgcgcatctacgcagatgccccgacaccggaggcggacagcatttacaccagctactggccccaggtctctgcggggacggtgctgcagtgtggccagcagcccacgccggtcgcccacggcagctgcgcctggtccatggccctggattagggctgctatgtctcgggggtatccagcgcaatccccctgcattgtcctgtcttgacccccagcccgaaccaccaaatctgtggtcatcagagtcccccgctggtggcagggaaagaggccgtctccgcccaagggcagctgaaggcccaacacagatcgcatggagacagcgagatgcagtgtcaggacaagggttgccgggactttgcagcgttcactctccccgaagagctggcctggtggagaagaggctcatgaggggcccagagtcgccttctgatctgcaaggttggggtgcacggtcctag

SEQ ID NO: 55412 - DNA, 453 bp, Artificial Sequence
  Description of Artificial Sequence: Synthetic coding sequence
atggcaaggctcggtgccctccttctagcagccgcacttggggctctgctgtccttcgcactgctcgctgctgccgttgcttcggactactggtatatactggaggtcgccgatgctggaaacggctcagcctggcccggaagagccgagttactgtcctcccacagtggcctctggaggatctgcgagggagtcctgacattggctggcgtcagcatctacataagctatagccacctcgcctttgccgagactgtgcaacaatatggacctcaacacatgcagggcgtccgggtctctttcgggtggagcatggcactagcctggggaagctgtgctctcgaagccttctcgggcaccctgctgctctctgccgcatggacgctctcactgtcacccccaatctgcgggcacctctcccctcagcaggtgggcggacgaggtggagactag

SEQ ID NO: 55413 - DNA, 591 bp, Artificial Sequence
  Description of Artificial Sequence: Synthetic coding sequence
atggctaggctcggggctctactgcttgccgctgccctgggagcactgttatcctttgccttactggcagccgctgtggcttccgattattggtacatcctggaggtggctgatgccggaaacggttccgcctggcccggacgcgctgagctactgtctagccacagtggcctgtggagaatttgtgaggtcctccaccgggctgtgattgtggtgcttccgttaagtctggtgctgctcgtttgtgggtggatatgcggcctcctttctagccttgcccagtcagtatcacttctcctgtttaccgggtgttatttcctactgggctccgtgctcactctagccggtgtgagtatttatatcagttactcccacttagcctttgccgagaccgttcagcaatacggccctcagcacatgcagggagtccgcgtgtcttttgggtggtcaatggctctagcctggggaagctgtgctctagaggcattcagtggtacacttttactgagtgccgcttggacacttagtttaagccccccaatatgcgggcacttatccccacagcaggtcgggggacgaggaggggactag

SEQ ID NO: 55414 - DNA, 672 bp, Artificial Sequence
  Description of Artificial Sequence: Synthetic coding sequence
atggccagactgggcgcactcttgttggccgctgcactgggcgcattattgtccttcgcgctgcttgccgcagctgtcgctagcgattattggtatatcctcgaagtagcagatgccggaaacgggagtgcgtggcctgggcgagcagaactgctgtccagccacagcggactgtggagaatttgcgagggacaaaacggctgtatcccactggtggacccatttgcttctgagtctttagacgtgagcacatctgtccagcacttgatactgctgcaccgggctgtgatcgttgtcctgccgttgtctctggtgctcttggtgtgcgggtggatctgtggactgctctcctccttggcacagtctgtgtcactgctcttattcacaggctgttatttcctgctggggtccgtgctcaccctcgcaggcgtgtccatttatattagttatagtcacctcgcattcgcggagaccgtgcagcagtatggcccacagcatatgcaaggagtgagagttagcttcggttggtctatggcccttgcgtggggttcatgtgccttagaagccttctcgggcaccctactcctgagtgccgcttggacactgagcttaagccctcctatctgcgggcacctgtccccccaacaggtcggcggacgtggtggagattag

SEQ ID NO: 55415 - DNA, 453 bp, Artificial Sequence
  Description of Artificial Sequence: Synthetic coding sequence
atggccagactaggggcactcctccttgctgcggctctgggtgcactgcttagcttcgccctgttagcagcggctgttgcttcggactattggtacatcctagaagtggccgatgctggtaacggctccgcatggccgggtcgcgcagagctcctctcaagccattcaggcctatggcgcatctgcgaaggcgtgctgaccttagcaggggtgagcatctacatctcatattcacatctggcctttgctgagaccgtgcagcagtatggtccacagcatatgcaaggcgttcgggtttccttcggttggagtatggctctggcctggggatcttgcgcgctggaggccttctcgggcactcttctccttagcgctgcctggaccctcagtctctcaccacccatttgtgggcacctgtcaccgcagcaggtaggcggtaggggcggagactag

SEQ ID NO: 55416 - DNA, 1056 bp, Artificial Sequence
  Description of Artificial Sequence: Synthetic coding sequence
atggcttccggccgactcatcaagttcgtcgtgtttgagctcctggaatttgcagccttcagtatacctacactggtcatcactgagcaattcgcaacggcttatcaggggaccagggcacggtctgacaacacccactactggctgatcatttcctgtagcattgcatatgttgccctcgtcacgttactgatttgggtaccagttaaagtgattttacacaaaaagagatatatttacaggaagatcaagggttggaggccagtgctaatgatgtgtgtggtgctgaccacactgccatgtttgacctttagcatcgctgtaaccgaggtgcagaaatcaattaacgggagcgctgacgtgctgcccgacatgctgcctgacttgccggtgtctctggtactattgtcgctaatcatggtggacatcattgagaagttgaggatttaccctttaagaggttctcagaagagctctgaaaacggacatattcactctacctccttacagcatatcaagaccgtgaccgagcaagtcagacagtctccagagaacgccgcttcgccacaggccacaaactctacacaggtcagccagccaagtggggcaatgacccggtcacaggaatctgtatttatgggacctcaggaacccagttgcgacagcgggattctgaggatgatgagccggcgtgatgttagagccgagctcttcctttggagcttcctgctatggagtgatacaatcgaaatggtccgagtggccggacaccccaatgtatataagagcagttggctgtacccggtgtatattttttcatttatttcactgctgcggattacctttactccccaaaatcccttgttaaactcactgtccgtgttgctgcaggaccttccattcgttttcgtacgcttgggactgattatcgccctaggcaccattactccggtcctgggcctgtgcaaaaatattttagtgacattaagctatatctacttcaactatctgactcgaattcgtatcttctccgcgttcgagatgagtcccttttag

SEQ ID NO: 55417 - DNA, 1056 bp, Artificial Sequence
  Description of Artificial Sequence: Synthetic coding sequence
atggcttcagggagactgatcaaattcgttgtgttcgagctcctagaattcgccgcattcagcattccaactcttgtgatcacagagcagttcgccactgcctaccagggaacccgggctcgatctgacaatacacactattggctgatcatcagttgttcgattgcctatgtcgctctggtgactctcctgatatgggtccccgttaaggttattctccacaagaagcgttacatctatagaaagattaaaggatggaggcctgtcctcatgatgtgcgtggtcttgacgactttaccctgcttgacattctccatcgcagtcaccgaagtgcaaaaatcaatcaacggcagcgcggatgtcctgccagacatgctgccagacttgccagtgtcactggtgctgctgagtctaatcatggtcgacataattgaaaagctgaggatttaccccctgcgtggcagccaaaagagtagcgaaaatgggcacattcattctactagccttcagcatatcaagaccgtgacagagcaggttaggcagtcacccgaaaacgccgcaagccctcaagccaccaattcaactcaggtgtctcagccaagcggggctatgaccagatcacaagagtcagtgtttatgggccctcaggagcctagttgcgatagtggaatactcagaatgatgtcaagaagggacgttcgagcagaactgttcctatggtccttcctgctctggtctgatacaatcgagatggttcgtgttgcaggccacccaaatgtgtacaagtctagctggttatatccagtttacatttttagtttcattagcctgctacgaataacattcaccccccagaatcctctgttgaattctcttagtgtattattgcaggatcttccctttgtgtttgtgcgcctgggtctgattatcgcgctcggcaccattacaccagtgttgggtctttgtaagaacatcctggtaaccctgagctacatctattttaactacctcacacgcatacggatcttttctgcgttcgagatgtctcctttctag

SEQ ID NO: 55418 - DNA, 1056 bp, Artificial Sequence
  Description of Artificial Sequence: Synthetic coding sequence
atggcctccggccgtctgatcaaattcgtcgtgttcgaactgctggagtttgcagcattcagcatcccgactctcgtcataacggagcagtttgcgacagcgtatcagggaaccagagcgagaagcgacaatacgcactactggcttattatttcctgctccattgcctatgtggccttggttactttgctcatctgggtgcctgtgaaggtgatccttcataagaaaaggtacatctataggaagatcaagggatggcgaccagttcttatgatgtgtgtagtccttacaacactgccttgcttgacattctcaattgccgtgactgaggtgcaaaagtcaatcaacggaagcgccgacgtgctgccagacatgcttcctgacctccctgtgtcactcgtgctgctgtctcttataatggtggatatcattgaaaagctcaggatctaccccctccggggatcgcagaagagctccgagaacggccacatccactctaccagcctacaacatatcaagactgtaaccgagcaggttcgtcagtctccagagaatgctgcctccccccaggctactaattcaacgcaggtgtcccaaccctcaggcgctatgacaagaagccaggaatcagtgttcatggggccacaagaacccagctgtgattcaggcatcctccgaatgatgtcgaggcgggatgtgcgggcagagctctttctgtggagctttctcctgtggagtgatactatagaaatggtaagggtggctggccatccaaacgtgtataaatcaagctggctgtatcccgtgtatatcttctctttcatcagcctactcagaattaccttcacaccacaaaatcctttgctcaattcactgagtgtgctgcttcaagaccttcccttcgtgtttgttcgactcggactcatcattgccctgggcaccattacacctgtattaggcttgtgcaagaacatcctcgtcactctctcttacatttacttcaattatctcactcgtatccgtatattcagcgcttttgagatgagcccattttag

SEQ ID NO: 55419 - DNA, 1056 bp, Artificial Sequence
  Description of Artificial Sequence: Synthetic coding sequence
atggcttccggtaggctcatcaaattcgtggtgtttgaactgcttgagtttgctgcattctctatcccaacactcgttatcaccgaacagtttgctacggcctaccagggcacgcgagctcggtcagacaacacgcactattggctgattatatcttgttccatagcctacgtggccctcgtcactctgctgatatgggtcccagtaaaggtgattctgcacaagaagcgctacatatatcgaaagattaaaggatggagacctgtgctgatgatgtgtgtggtgcttacaactctcccctgcttgacattttctatcgccgtaacagaggtccagaagtcgatcaatggctccgctgatgttctgcctgacatgctgccggacctgccagtgtcgctggtcctcctgagtttgattatggtcgatatcatcgaaaagctgcggatctaccccctgaggggttctcagaagtcgtctgagaacgggcacatccactcaacctcactgcagcacatcaagactgtgaccgagcaagtgagacaatctccagagaacgcggcttcaccccaggcgaccaactccactcaggtgagccaaccctcaggagctatgacccgctcccaagaatcagtattcatgggcccacaggagccatcatgtgattcgggcatcctgcggatgatgtcaagaagagacgtgcgcgcagagctgttcctgtggtcattccttctttggagcgacaccatcgagatggtgcgcgtggcgggtcacccaaacgtgtacaagagttcatggctgtacccggtgtacattttcagtttcattagtctgttacgaatcacttttactccgcagaatccactgctgaattccctgagcgttctgctgcaagaccttccgttcgtgttcgtacgtctcggattaattattgccctcgggacgattacgcccgtcctcggactgtgcaagaacatcctcgtaaccctgtcctacatctatttcaattatttgaccaggatcagaatcttttccgcctttgagatgagccccttttag

SEQ ID NO: 55420 - DNA, 522 bp, Artificial Sequence
  Description of Artificial Sequence: Synthetic coding sequence
atgagcatgtcagcgaataccatgatcttcatgatattgggagccagtgtggtgatggcgatagcgtgcttgatggatatgaatgctctcctcgacaggttccacaactatattctgcctcatctgagaggcgaagaccgtgtctgtcactgcaactgtgggcgacaccacattcactacgtcattccatatgacggagatcagagcgtggtggatgcaagcgagaactacttcgtgaccgactctgtgacaaagcaggagatcgacctgatgttaggcctgctcctgggcttctgcataagttggtttctcgtatggatggacggcgtgctgcattgcgcggttcgcgcttggagagctggcagacggtatgatggcagctggacgtggctgccaaaactgtgctctctcagagaactgggacgcagaccccaccgaccctttgaagaggccgctggcaacatggtgcacgtcaagcagaaactctatcacaatggtcatccatccccgagacatctttag

SEQ ID NO: 55421 - DNA, 522 bp, Artificial Sequence
  Description of Artificial Sequence: Synthetic coding sequence
atgtcaatgagcgcaaacaccatgattttcatgattctgggcgcatccgttgtaatggccatcgcttgcctgatggatatgaacgccctcttggatcggtttcataattacatccttccacatctgaggggggaagaccgagtctgtcactgtaattgcggcagacaccacatccattacgtgatcccttatgacggcgatcagtcagtggtcgacgctagcgaaaactacttcgttaccgacagcgttacaaagcaggagattgacctcatgctggggctcctacttggcttctgcataagctggtttttggtctggatggacggcgttttgcattgcgccgtacgggcttggagggcaggacgcagatatgatgggtcctggacgtggctaccgaaactgtgttccctgcgagagcttggcaggcggcctcaccggccatttgaggaagcggctggaaatatggtgcacgttaagcagaagttgtatcacaacggtcaccctagcccaagacacctgtag

SEQ ID NO: 55422 - DNA, 891 bp, Artificial Sequence
  Description of Artificial Sequence: Synthetic coding sequence
atgtgcgtgagaagatcccttgtaggcttaacattctgtacctgttacttggcgagctatctaacaaataaatatgtgctgtctgtccttaaatttacatatcccacccttttccaaggatggcaaacccttatcgggggtctgctgttgcacgtgtcctggaaactaggttgggtggaaattaatagcagctcaaggtcccatgtgcttgtatggctgccagcatcagtgctgttcgttggaataatctacgctgggtctcgcgcattgtcaagactcgccatccctgtgttccttacccttcacaatgtggcagaagttatcatttgcggctatcaaaaatgctttcaaaaggagaagacatcccctgccaaaatctgctctgctttgttgctcttagcagcagcaggctgcctgcccttcaatgactctcagttcaatcccgatgggtacttctgggccattatccacctgctttgcgtgggggcatataaaatactacaaaagtcccagaagcctagcgccttatcagatattgaccagcaatatctgaattatatctttagtgtcgtgctgcttgccttcgcaagtcatcccactggcgaccttttttctgtgcttgactttcccttcttatacttttatagatttcatggtagttgctgtgcgtctggcttcctggggttcttccttatgttcagcacagtcaagttgaagaacctactagccccaggacagtgtgccgcatggatttttttcgctaagattattaccgctggattgagtatactcctgttcgacgccatcttaacaagcgccaccacgggctgtctgttgctaggagccctgggagaagccttgcttgtgttctcagagcgtaagagcagctag

SEQ ID NO: 55423 - DNA, 372 bp, Artificial Sequence
  Description of Artificial Sequence: Synthetic coding sequence
atgtgcgtgaggcgatcactcgtgggacttactttctgtacatgctatttagcctcataccttacaaacaagtacgtgctttctgtgctaaaattcacataccccaccttgtttcagggcagtcatgtgctcgtgtggctgcccgcaagtgtactcttcgtggggataatttatgcagggtccagggctctctccaggttagctatccccgtgttccttacccttcataatgtcgcggaggtgattatctgtggctaccagaagtgtttccagaaggagaaaacaagtccagcaaagatatgtcggcttcatctggagcggactaggcaaaatcaaacatctcggttaagctcatgtcttaagggcgactag

SEQ ID NO: 55424 - DNA, 468 bp, Artificial Sequence
  Description of Artificial Sequence: Synthetic coding sequence
atgatcccagacgtcatttctgcgttgctccttcttgccgctgcaggctgtctcccgttcaatgattctcagttcaatccggacggatatttttgggctattattcaccttttatgtgtgggggcatacaaaatcctgcagaaaagccagaaaccaagcgccctgagcgatatagatcaacagtacctcaattatattttcagtgtcgtgctgctggcattcgcttcacatccaactggcgatctcttctccgtgctagactttcccttcctgtacttttataggttccatggatcctgttgcgccagcggtttcctcggattcttcttaatgttttcgaccgtcaaactcaagaatttgcttgccccaggacaatgtgctgcatggattttcttcgcgaaaattatcacagcaggacttagcatcctgttgttcgacgctattttaacttccgcaacaaccggctag

SEQ ID NO: 55425 - DNA, 507 bp, Artificial Sequence
  Description of Artificial Sequence: Synthetic coding sequence
atgtgtgtacggagatccctcgtgggactgactttttgtacgtgctatctggcttcatatctgactaacaagtacgtgttaagcgtacttaagtttacatatcccactctgtttcagggatggcaaacactgatcgggggtctgctgctgcatgtatcgtggaaacttggatgggtcgaaatcaatagttcaagccgctctcacgtcctagtgtggcttccggcttcagttctcttcgtggggatcatctatgctggttcccgtgcgctttctcgcctcgcgatccctgtcttcctgacactgcataacgttgctgaagtgatcatttgcggatatcagaaatgtttccaaaaggagaaaacctcccctgcaaaaatctgctctgcccttcttctgttggccgcagctggctgcctccctttcaacgactcacagttcaacccggacggctacttttgggcaatcatccatcttctgtgcgtggtgacgttaacatccaacacctag

SEQ ID NO: 55426 - DNA, 387 bp, Artificial Sequence
  Description of Artificial Sequence: Synthetic coding sequence
atggagaccgccggtgctgcaacgggccaacccgcttcgggcttagaggctcctgggagcactaacgataggctcttccttgtaaagggagggattttccttggcaccgtggctgcggcaggtatgctcgcaggcttcatcacaaccctgtccctcgccaaaaagaagtcccctgaatggttcaacaaaggctcaatggctaccgcagcgttgcctgagagtggatcctcccttgcactgcgtgctctagggtggggcagcctgtatgcatggtgcggggtgggtgttatctcatttgctgtatggaaagctcttggagtccactctgtctcaaattactgcctggtacctggcatctacatgttcattctgctcacagtattttag

SEQ ID NO: 55427 - DNA, 426 bp, Artificial Sequence
  Description of Artificial Sequence: Synthetic coding sequence
atggagaccgcaggagccgcaacaggtcagccggctagtggattggaagccccaggaagtactaatgaccggctgttcctcgtgaaagggggaatcttcttaggaacagtggccgcagccggtatgttggcgggatttatcacaaccctctcactggccaaaaaaaagtccccggaatggttcaataaagggtctatggctaccgctgctctgcctgagtctgggtcatccctcgctctgcgcgctttaggatggggtagcctgtacgcctggtgtggggtgggtgtgatcagctttgctgtgtggaaggccctgggcgtgcattctatgaatgactttaggtccaagatgcagtctatattcccaaccattcccaaaaacagcgaaagcgccgtcgaatgggaggaaactctcaagagcaaatag

SEQ ID NO: 55428 - DNA, 651 bp, Artificial Sequence
  Description of Artificial Sequence: Synthetic coding sequence
atgccaaaggggagggcaggctcgctgccgacgacatctattgggtggagatttcagttatggtttcttggactaacttgcccagaacggcatctggcgaggaggcttaagaataactccttctatcccttcgttcagcaggaacccaacggggcagaggcacgcgacctcggactcccgcgagtgaggcgcggtcgagggccagttgctcgggacctggtggctgccgcagcaccccctggggctgagccacatgccagaagagtcccacttcttcacccgggtccacatagggtgccaggaccactggctagtggcctccgggctccaggggcacagctgcgctgccccaggaaagtgctgctgccccctggccctagacgcccacaggtgggcgctcccggagctggagccgctgtcggggcacttcgcgcaaatggaattctaggccctttgcaccgcccagagacacagcaccagctgttaagactcccaggccatttgctccctgcccgaggctctccacttgctaccccctggcgctggcattgcgacgggcaagagcctcacggatcacaggcacaactgttgtctgtgcaaccgggaggggtgacgctcagagcctctcccactagcggactctgtagttag

SEQ ID NO: 55429 - DNA, 672 bp, Artificial Sequence
  Description of Artificial Sequence: Synthetic coding sequence
atggaaggcttagtttttctgaatgcattagccaccaggctcctgttcctattgcattcgctggttggagtctggcgcgtcacagaagtgaaaaaggaaccaaggtactggctcctcgcacttcttaacctcttactgttcctagaaaccgcattaacactgaagtttaagcgcggtagaggatacaagtggttctctcccgctatctttctctacctgatctccattgtaccgtcgctgtggttactcgagttgcaccatgaaacccaatactgtagcatccaggccgagggaacttctcagaacaccagtcgcaaggaagactttaatcagacgcttactagcaacgaacagacatcccgtgcagacgacctgatcgaaaccgctaaagtcttcgttaacaatctatctactgtgtgcgaaaaggtgtggaccttaggactgcatcagacttttctccttatgctgatcattggacggtggcttctgcccatcggtggaggtatcactcgggaccagctgagccaattgctgctgatgttcgtgggaaccgccgcagacatcttagagttcacctcagagacgctagaggagcagaacgtaaggttatgctggaagaattccaccaataggcggcacacaaaccccaaatggcagctggtccttttctag

SEQ ID NO: 55430 - DNA, 1107 bp, Artificial Sequence
  Description of Artificial Sequence: Synthetic coding sequence
atggagggactggtgtttcttaacgccctggccacacgcctgctcttcctgctccattcacttgtgggggtgtggcgtgtgactgaagtgaaaaaagaaccacggtattggctactggctctattaaatttattgctgttcctggagacagccttaactctgaaattcaaacgtggcaggggatataagtggttctcccctgcaatcttcctctatctgatttccattgtgccaagcctgtggttgctcgagctgcaccacgaaacccagtactgtagtatccaggcagaaggaacgtctcaaaacaccagccgtaaagaggacttcaaccaaacgctcaccagcaacgaacagaccagtagagcggatgatctgattgagacggccaaggtcttcgtcaataacctttctacggtctgtgagaaggtctggaccctgggcctgcaccagacttttcttctgatgctgatcattggacggtggctcctgccaataggcggaggcatcacgagagatcaactgagtcagctgctcctgatgtttgtgggtacggctgcagacatcctcgaattcactagtgagacactggaggagcaaaatgtgagaaactcacccgcacttgtttacgctatcctcgtcatttggacatggtcaatgctgcagtttccactggatctggctgtgcagaatgtggtgtgccccgtgtctgtaacagagcgcggattcccatcgctcttcttctgtcagtatagcgctgacctttggaatatcggcattagcgtgttcatccaggacggcccatttttggtggtccggctgatcctcatgacctattttaaagtgatcaatcagatgctagtgttttttgcagcaaaaaacttccttgtggttgtattgcaactgtatcgtctcgtagtgctcgccctcgcagtgcgcgcatcgctgcgtagccagagcgagggcttgaagggagagcacggctgtcgcgcacagacatctgaatctggtccctcccaacgtgattggcagaatgagtcaaaggagggcctcgccattcctctgcgaggatctcctgttaccagcgacgattcccaccacacaccttag

SEQ ID NO: 55431 - DNA, 1107 bp, Artificial Sequence
  Description of Artificial Sequence: Synthetic coding sequence
atggagggtctcgtgtttctcaatgcactagccactcgcctgctgttcttgctccactctctcgtcggcgtgtggcgggtgacggaggtcaaaaaggaacctcggtactggttactcgcattgctgaacctgctcctgtttctggagaccgctttaactctgaagttcaagagagggaggggctataaatggttttctcctgctatcttcctgtatcttatcagtattgttccaagtctttggcttctggagcttcatcacgagacccagtattgtagcattcaagccgagggaacctctcagaacacgtccaggaaggaagatttcaaccagaccttgacgtcaaatgagcagacatcaagggcagatgacttaattgaaaccgcgaaagtgttcgtgaataatctttcaaccgtgtgtgagaaagtttggactctggggttgcaccaaactttcctgctcatgctgatcattgggagatggttactgcctatcggaggaggaatcactcgggatcaattgtcccagctgctgcttatgtttgtcgggacagcggcagatattctagagtttacctctgagacgctggaggagcagaatgtcagaaattccccggctctggtgtacgcaattcttgtaatctggacctggtcgatgctgcaattcccgctggacttagctgtgcagaacgtcgtctgccccgttagcgtgacagagcggggtttcccatcattattcttttgtcagtattccgcagacctgtggaacattggtatttctgttttcatccaagatggaccctttctggtggtgaggttgattttgatgacttatttcaaggtgattaatcagatgttggtgttttttgccgcaaagaactttctggtagtcgtgctccagctctatagactggtggttctagctttagctgtgcgggcatctttacgttctcaatccgaaggcctcaaaggcgaacatgggtgcagggcccaaacgagcgaaagtgggccatcccaacgtgactggcagaatgagagtaaggaaggtctggccatccctctaagaggatcaccagtgacatcagacgattctcatcacacaccttag

SEQ ID NO: 55432 - DNA, 507 bp, Artificial Sequence
  Description of Artificial Sequence: Synthetic coding sequence
atgcgtttgaccgagaagtcggagggcgaacagcagctcaaaccaaataattcgaacgcacccaatgaagatcaggaagaggaaattcagcagtcagaacagcacacaccggcacgtcagaggactcaacgtgccgatacccaaccgtctagatgccgcctcccgagtcgacggaccccaacaacaagcagtgaccgaacaattaacctcctggaggtgcttccgtggcccactgaatggattttcaacccatacaggttgccagcccttttcgagttatacccggagtttctccttgtttttaaggaagcttttcacgatatttctcattgtctcaaagcccagatggagaaaattggacttccgatcattctgcatttgttcgcattatcaaccctgtatttttacaagtttttccttcccacaatcttgtccctgtccttctttatccttcttgtacttttattgctactgtttatcatagtgttcatccttatttttttctag

SEQ ID NO: 55433 - DNA, 744 bp, Artificial Sequence
  Description of Artificial Sequence: Synthetic coding sequence
atggccgatactacacccaacggcccacagggggctggtgcagtccaatttatgatgaccaataagcttgatacagcaatgtggttaagtcgcttattcactgtgtactgtagcgcacttttcgtgctaccactgctgggtctgcacgaagctgcttccttctaccagcgagcgctcctggctaacgccctcacttcagccttgagactacaccagagactgccacattttcagctgtcccgagcattcctcgctcaggcactcctagaggacagctgtcactatctgctatattccttaatctttgtcaactcttaccccgtgaccatgtctatctttccagtgcttctcttcagcttgctacatgctgcaacctacactaaaaaagtactggacgccaggggaagcaatagcctgccgctgctccgatcagtcctggacaaattgtctgccaatcaacagaacattctgaagtttatcgcctgcaacgaaatctttttgatgcctgccacagtgttcatgctgttctcagggcagggctctctgttgcaaccgttcatttattataggttcctaaccctgcgttatagctcacgtaggaacccctactgcagaacactctttaatgagctgcgaatcgtggtggaacacatcatcatgaaaccggcatgcccactgttcgtgcggaggctctgcctccagtccatcgctttcatcagcaggctggcacccacagtgccttag

SEQ ID NO: 55434 - DNA, 744 bp, Artificial Sequence
  Description of Artificial Sequence: Synthetic coding sequence
atggcagatacaaccccgaatggaccacagggcgcaggagccgtgcagtttatgatgaccaataagctggacaccgccatgtggctgagccgcctcttcaccgtttactgcagtgcgcttttcgtgctacctttgctgggtctgcatgaggccgcaagtttctaccaaagagccctgctggctaacgctctcacaagcgccctgaggcttcatcagaggttgccccatttccagctgtcgagagccttccttgcgcaggctttgctggaagatagttgtcactatctgctgtactcactgatttttgtcaacagttatccggtaacaatgagcatttttcccgtcctgcttttttccctattgcatgccgcaacatatacgaaaaaggtgctcgatgcccgtggctcaaatagtctgcctctgctgcgcagcgtattagataaattgtctgccaaccaacagaacattctgaagtttattgcctgtaatgagatattcctgatgcccgctactgtgttcatgttattctccggccaggggtctctcctgcagccttttatctactaccgcttcttgaccttgcgttacagctcccgaaggaatccgtattgtcgaacacttttcaatgagcttcggatagttgtagagcacataattatgaagcccgcttgcccccttttcgtgcgaaggctctgtcttcagtccattgcgttcatctctaggttggccccaactgtgccctag

SEQ ID NO: 55435 - DNA, 669 bp, Artificial Sequence
  Description of Artificial Sequence: Synthetic coding sequence
atggcagacacaactccaaatggtccccagggagcgggagctgtgcagttcatgatgacaaacaaactcgacaccgctatgtggctctcccggctgttcacagtttattgttccgcactcttcgtgctcccgttgctcggtctgcatgaggctgcatcattctaccagagagcccttttagccaatgctttgaccagtgcgctgcgtcttcatcagagacttccacatttccagctgagtagggcctttctggctcaggcccttctggaggactcctgccattaccttctgtattcgcttattttcgtcaatagctacccagttacaatgagtattttccccgtcttattgttttccttgctgcacgccgcaacatacactaaaaaggtgttagacgcgcgtgggagcaattccctccctctactgaggagtgtgttagacaagctgtccgccaaccaacagaatatcttgaagttcattgcttgcaacgaaatctttttaatgcctgccaccgtgtttatgctgttctccggtcagggcagcctcttgcagccttttatctattacagattcctcacgctgcgttattcaagcagacgaaacccatattgtcggacactctttaacgagctgaggatcgtggtagaacacatcattatgaaaccttag

SEQ ID NO: 55436 - DNA, 744 bp, Artificial Sequence
  Description of Artificial Sequence: Synthetic coding sequence
atggcagatactacaccaaatggcccacagggggcaggggcagttcagtttatgatgacaaacaagctcgatacagccatgtggctgagcagactatttactgtgtattgcagtgccctgtttgtgctgcccctgctgggactgcacgaggccgcttcgttctaccagagagccctgctggcaaatgcccttacaagcgccttgcgactgcatcagagactccctcatttccagctgagcagggcgttcctggctcaggcactcttggaagattcttgccactatctcctgtactctttgatattcgttaactcttatcctgtaactatgagcattttcccagtgctcctattttctctcctacacgccgctacctatacgaaaaaggtgctcgacgcccgaggtagtaacagcctccctcttctacggtctgtactggataagctctccgcaaatcaacaaaacatcctgaagtttatcgcctgtaacgagatatttctgatgccagccacagtgttcatgctgttttccggacaggggtctttgctacagccgtttatctactacaggttcctgaccctgcggtattcaagccgacgcaatccttactgtcggaccttgttcaacgaacttcggatagtcgtcgaacacatcatcatgaaacccgcttgtcccctgttcgtccgtagactgtgccttcaatcaattgcattcatctcacgcctggcacccaccgttccttag

SEQ ID NO: 55437 - DNA, 504 bp, Artificial Sequence
  Description of Artificial Sequence: Synthetic coding sequence
atggcctctccaagaaccgtcactatcgttgcactaagcgtggccttgggattgttctttgtatttatgggtaccataaagctgacccccaggttgagtaaggacgcctactcagagatgaaaagagcttacaagtcatatgttcgggctctccccctactgaaaaagatggggataaattccatccttctcagaaaaagtattggcgctttggaggttgcatgtgggatagttatgacactcgtccctggcaggcctaaagatgtcgccaatttttttctccttctgttggtcctggctgtcctcttcttccatcagctggtgggggatcctctcaaaaggtatgctcacgccttggtttttggaattttattgacatgccgcttacttatcgcaagaaaacccgaggaccggagctcagaaaagaagccgctccctggaaatgcggaagagcagccttccttgtacgaaaaggccccacagggcaaagtaaaggttagctag

SEQ ID NO: 55438 - DNA, 381 bp, Artificial Sequence
  Description of Artificial Sequence: Synthetic coding sequence
atggcaagtcctcggaccgtgaccatcgtggcgctgtccgtcgctctcgggctgtttttcgtgttcatggggactataaagttaacacccaggttgagcaaggacgcctacagcgaaatgaaaagagcgtacaaatcttatgtgcgcgctttgcctctcctgaaaaagatggggataaactccatactgcatcagttagtaggcgaccctctgaagagatacgctcatgccctcgtgtttggcatcctgctgacctgtcggctcctaatcgctaggaagcctgaggataggagtagtgagaagaaacctctgcccggaaacgcagaagagcagccatccctatacgagaaagctccacagggtaaggtgaaggtttcttag

SEQ ID NO: 55439 - DNA, 573 bp, Artificial Sequence
  Description of Artificial Sequence: Synthetic coding sequence
atgaccgccgtgggcgtgcaggcgcagcgcccactgggccagcgccagcccagaagaagcttcttcgagagcttcatccgcactctgatcatcacttgcgtggcccttgcagtcgtgctgagctcagtgtccatttgcgacggacattggctgttagcggaagatcggctattcggactgtggcatttttgcaccaccacaaaccagactatttgtttcagggatctggggcaggcacacgtcccagggctcgctgtgggtatgggactcgtgaggagtgtgggcgctctggctgttgtcgcagcaatttttggcctggaatttcttatggtgagccagctgtgcgaagacaagcatagccagtgcaagtgggtcatgggatccattttacttctggttagttttgtgctgtcttctggtggactgctaggatttgttatactcctgcggaaccaggtcactctaattggatttacccttatgttttggtgcgaattcaccgcatcattcctgttgtttttgaatgcaattagcggcctgcatatcaacagcataacccacccctgggagtag

SEQ ID NO: 55440 - DNA, 900 bp, Artificial Sequence
  Description of Artificial Sequence: Synthetic coding sequence
atggaattactgagcgccctgtcgctcggagaattggccctctccttctctagggtgccactttttcccgtgttcgatctgtcgtactttatagtgtctatactctacctcaagtatgaacctggagcagttgaactgtctagacgacaccctatcgcttcctggctgtgtgccatgctgcattgttttggttcctacatactagccgacctcctcctaggcgagccattaattgattatttctcgaacaactcctccatcctgctggcaagcgctgtgtggtacctgatatttttttgtcccctggacctgttctataaatgtgtctgcttcctgcccgttaaactaattttcgtggctatgaaagaggtggtaagagttcgcaagatcgctgtgggtattcaccacgcccaccaccactaccaccacgggtggttcgtgatgatcgctacaggatgggtcaagggctctggagtggcacttatgtccaattttgaacagcttcttagaggggtatggaagccagagactaacgaaatcctccatatgagtttccctacgaaagcttcactctacggtgcaattctcttcacacttcagcaaacccgctggctccccgtgtctaaggctagtctgatcttcatctttaccctgttcatggtgagctgcaaggtgttcctcacagccacccacagccatagtagccccttcgacgccctcgaagggtacatttgtccagtcttgttcggaagcgcctgcggcggagaccaccatcacgacaaccatggcggatctcacagcggaggcggtcccggagctcaacactcagccatgccagcaaagtccaaagaagaactcagcgaaggctctagaaagaaaaaggctaaaaaggctgattag

SEQ ID NO: 55441 - DNA, 714 bp, Artificial Sequence
  Description of Artificial Sequence: Synthetic coding sequence
atgctccattgcttcggaggaggaatcttgtcatgtctactgctggctgagccccctctgaagttcttggccaaccacacaaatattctgctggcttctagtatctggtacatcacattcttttgcccccacgacttggtttctcagggctactcgtacttgcctgtgcaactgctggcctcaggaatgaaggaggttactaggacgtggaagatcgtggggggagtaactcacgccaactcgtattataagaatggctggatcgtgatgattgctatcggatgggccaggggggctggcggaactattattaccaactttgagagactggtgaagggcgactggaaacctgaaggtgacgaatggttaaaaatgtcatatccggctaaggtgactttgctgggctctgtgattttcacattccagcacacacagcatctggccatatccaaacacaacctgatgttcctctatacaatcttcattgtcgccactaaaatcactatgatgaccacacagacttcaaccatgaccttcgctcctttcgaagatacactgtcatggatgctgttcggttggcagcaaccgttcagcagctgcgagaaaaaaagcgaggctaaatccccaagcaatggcgtgggatcgcttgccagcaagcctgtggatgtagcatcagacaacgtgaaaaagaagcatacgaagaagaacgagtag

SEQ ID NO: 55442 - DNA, 876 bp, Artificial Sequence
  Description of Artificial Sequence: Synthetic coding sequence
atggatagcccctgggacgagctggcactggccttttctagaactagcatgttcccattcttcgatatagcccactatctggtgtccgtcatggcagtaaagagacaacccggtgcagccgctcttgcgtggaaaaacccaatctctagctggtttacagctatgcttcactgctttggaggaggtatcctgtcctgtcttttacttgctgaacccccactgaaattcctcgccaaccatacgaacatactcctggctagcagcatctggtatattacctttttttgccctcacgatctggttagccagggttactcatacttgcctgtccagttgcttgctagcgggatgaaggaggtcacacgcacctggaagatagtcggaggtgttacccatgccaattcttactataaaaatggctggattgtgatgatcgctattggatgggcccgaggcgcagggggaacaataataaccaatttcgaacgtcttgtcaaaggggactggaaacctgagggagacgaatggctgaaaatgtcgtatcccgctaaggtcacattgctgggcagcgtgatcttcacattccaacacacacagcatcttgcaatctccaagcacaatcttatgtttttgtatacaatcttcatcgtggcaacaaaaataaccatgatgactacacagaccagcacgatgacttttgcaccattcgaggacactctgagctggatgttgttcggctggcagcagcccttttcctcatgtgaaaaaaaatcagaggccaagagcccatccaacggagtagggtcacttgcgtcaaagcccgtcgatgttgctagcgataacgtgaagaaaaagcacacaaagaagaatgaatag

SEQ ID NO: 55443 - DNA, 108 bp, Artificial Sequence
  Description of Artificial Sequence: Synthetic coding sequence
atgcttcactgcttcggtgggggtatactgtcatgtctgcttttggccgagccacctttgaagttcctcgcaaatcatacaaacattctcctcgcctcttccatctag

SEQ ID NO: 55444 - DNA, 489 bp, Artificial Sequence
  Description of Artificial Sequence: Synthetic coding sequence
tagtcctgcctgctcctggccgaaccaccgcttaagtttctagccaaccatacgaatattctattagcctcaagtatctggtacatcacattcttctgtccccatgatctggtatctcagggctacagttaccttccggttcaattgctggccagcggaatgaaagaggttacaaggacttggaagatcgtgggcggtgtcacacacgctaatagctattacaagaacgggtggattgtcatgatcgcaattggatgggccaggggtgccggagggaccattattactaactttgaacgcctggtgaaaggggactggaagcccgaaggggacgagtggctcaagatgtcttacccagccaaagtaacactcttgggcagtgtcatttttacctttcagcatactcagcacctggctatcagcaagcacaatctcatgtttctctataccatattcatcgtcgccacaaagtcattaaactggcgttag

SEQ ID NO: 55445 - DNA, 246 bp, Artificial Sequence
  Description of Artificial Sequence: Synthetic coding sequence
taatggatcgtcatgatagccatcggatgggctcggggtgccggtggcactattattacgaacttcgaaagactcgtcaaaggggattggaagccagaaggggacgaatggcttaagatgagctacccggctaaggtgaccctgctggggagtgtgatttttacattccaacatacacagcacctggccatatcaaagcataatctgatgtttctatataccatctttatcgtagctactaaatag

SEQ ID NO: 55446 - DNA, 1467 bp, Artificial Sequence
  Description of Artificial Sequence: Synthetic coding sequence
atgcccggtggacggcgtgggccttcaaggcagcaactcagcaggtccgccttacctagcctccagactctggtgggcggtggttgcgggaacggcaccgggctccggaaccgcaatggtagcgccattggccttcctgtaccaccaatcacggccctgatcacgcccggacccgtaagacactgtcagatccccgacctaccagtggacggctccctgttgttcgaattcctattctttatttatctcctggtggccttatttatacagtacattaatatttacaagacagtgtggtggtatccttacaatcaccccgcatcctgcacatctcttaattttcacttgatcgactatcacctagcggcttttattactgtgatgctggctagacgcctcgtttgggcactgatctcagaagctacaaaggccggagcggcatccatgattcactatatggtcttgatttcagcacgtctagtgctgctgacactgtgtggatgggtgttatgttggacgctggtgaatctgtttagaagccattctgttctgaatctgctcttcctggggtatcccttcggtgtgtacgtgcccctttgttgcttccaccaagatagtcgcgctcacctgctgctgactgactacaactatgtagttcaacacgaagccgtcgaggagtccgcctcaacagtaggcggacttgccaaatccaaagactttctctctctcctgttagagagtttaaaagagcagttcaacaatgcaacccccatccctacacactcatgcccgcttagccccgacctgattcgaaacgaggtcgagtgccttaaagccgacttcaaccaccggatcaaggaagtcctttttaactctctgttttccgcgtactacgtggctttcctgcccctatgcttcgtcaagagcacccaatactatgacatgcggtggtcctgtgaacacctgattatggtctggataaatgcgttcgtcatgctgaccacacagctgttgcctagcaaatactgtgatctgctgcacaagagtgccgcacatttaggtaaatggcagaagttagagcacggatcttactccaacgctcctcagcacatttggtcagagaataccatctggccccaaggagtgctggtcaggcactctcgttgcttgtatcgagcgatgggtccgtacaatgtggcagtgccgtcagatgtgtcccacgccaggttttacttcctgttccaccggcctctgcggctgttgaatctgctgattctcattgaagggtctgttgtcttttatcagctctattctctcctgcggagtgaaaaatggaatcacaccctgtccatggccttgatcctgttctgcaattactacgtccttttcaaactgcttcgggacagaatcgtgctcggaagagcatattcctatccgctcaacagttatgagctcaaggccaactag

SEQ ID NO: 55447 - DNA, 339 bp, Artificial Sequence
  Description of Artificial Sequence: Synthetic coding sequence
atgcctgggggtaggcgcggaccttcccgacagcagctctctcggagcgctctgccaagccttcaaacactagtgggagggggatgtgggaacggaaccggcctgaggaaccgtaatggctctgcgatagggctgcctgtgcccccaataactgcgcttataacgcccggaccagtaaggcactgccagatcccggaccttcctgtggacggcagcctgttgtttgagttcctcttcttcatctatttgcttgtggccctgtttatccaatacataaatatatataagaccgtgtggtggtacccatataaccaccctgccagttgtacctctttatag

SEQ ID NO: 55448 - DNA, 579 bp, Artificial Sequence
  Description of Artificial Sequence: Synthetic coding sequence
atgcccggaggaagaagaggcccaagcagacagcaattgtcacgatccgccctcccctccctgcagactctggtaggtggaggctgtgggaacggcacaggactgcgaaacaggaacgggagcgcaattggtctcccggtcccaccaatcacggccctgattaccccagggcctgttaggcattgccaaattccagacctgccagttgacggatcattgttatttgaatttctgttctttatttatctgctagtggcgcttttcatccagtacatcaacatctacaaaactgtgtggtggtacccttataatcaccccgcaagttgcacctcattgaatttccatctgattgactaccacttagcggctttcatcaccgtgatgctggctaggcgtctcgtgtgggccctcatatcagaagccactaaggctggcgcagccagcatgatacactacatggtgctgattagcgcgcgtcttgttctgctcaccttatgcggatgggtgttgtgttggaccctggtgaacttgtttcggtctcactctgtgctgaatttgctcttcctgggctacccctag

SEQ ID NO: 55449 - DNA, 423 bp, Artificial Sequence
  Description of Artificial Sequence: Synthetic coding sequence
atgcctggtggcaggcgaggccctagtagacaacaactcagcaggtccgccctgccctccctgcagactctggttggagggggatgcggtaatggcaccggactcaggaaccgaaacggctccgccattggcctgcccgtccccccaatcaccgccctcatcacaccaggacctgtgaggcattgccaaatcccagatctgcccgtcgacggctctctgctattcgagtttctgtttttcatttatctgttagtggcccttttcatccagtacattaacatctacaaaacagtgtggtggtatccttataatcatcctgcctcttgcacctcgctgaatttccaccttattgactaccacttggccgcatttattaccgtaatgctggctaggcgcctagtgtgggctctgatttcggagtag

SEQ ID NO: 55450 - DNA, 1479 bp, Artificial Sequence
  Description of Artificial Sequence: Synthetic coding sequence
atgggtggtcgcagagggcctaacagaacctcttactgtagaaatccattatgcgagcccggatcgtctggtggctcgtcagggtctcacacttccagcgccagcgtgaccagtgttcgcagccgcacaaggagcagcagcggcactggactgtctagcccccctctggctactcagaccgtagtgcctcttcaacactgtaagatccccgaacttcctgtacaggcctccatcctcttcgagctacaactgttcttctgccagctgattgcactgtttgttcactatattaacatctataagacagtctggtggtatccaccttctcacccaccttcccatacctcacttaacttccacctgatagattttaatctgctgatggtgactaccattgttttggggcgaagatttatcggctccattgtaaaagaggccagccagaggggcaaggtgtctctgttcagatcaattctgctgttcttaaccagattcaccgtactgacagcgaccgggtggagcttatgtcgatctctaatacacctgttcaggacgtactcattcctgaatctcctgtttctttgttatcccttcggaatgtacatccctttcttgcagctcaattgcgatctgaggaaaacttcgctgtttaaccacatggcttccatgggacccagggaagccgtgagcggcttggccaaaagcagagactaccttctgacgttacgtgagacatggaagcaacacaccaggcagctgtacggacccgacgctatgccaacccatgcctgttgtctctcgcccagcctgatacgcagcgaagtggaattcctgaagatggatttcaattggcgaatgaaagaagtgctcgtgagtagcatgctgtctgcttactacgtcgctttcgtacctgtgtggtttgtgaagaatactcactattacgacaaaaggtggtcatgtgagctttttttactggtgtctatatccacatctgtgatcctcatgcagcatctccttccggcaagttactgcgacttacttcacaaggccgctgcacacctcgggtgctggcagaaggtggacccagctctgtgtagcaacgtccttcagcatccctggaccgaagagtgcatgtggccacagggggttctagtcaagcactccaaaaacgtctacaaggcagtgggccattacaatgtggctattccatccgatgtgagccattttcgcttccatttttttttctctaagccacttaggatcctgaatatcctccttctgctggagggagcagtgatcgtctaccagctctattcactcatgtcttcagagaagtggcatcagacgattagtctcgccctcatcctgttctctaattactacgcgttttttaagctccttagggaccgtctcgttctggggaaagcctattcctactctgcgtccccacagcgggatcttgaccaccgcttcagttag

SEQ ID NO: 55451 - DNA, 579 bp, Artificial Sequence
  Description of Artificial Sequence: Synthetic coding sequence
atggggggacggagagggcctaatagaacatcttactgccgcaaccctctctgtgagcccggttcctctggtggctcgtccgggagccatactagttcggcctctgtcacatcagtgaggtccaggacccgaagcagctcgggcacagggctctcaagcccccctttggctactcagaccgtagttccactgcagcactgtaagatccccgaattaccggtgcaggcctcaatacttttcgagctgcagctatttttttgtcaactcatcgccttattcgtccactatataaatatttataagaccgtctggtggtaccctccctcccacccaccctcccatacctcactggcaagccagaggggaaaggtttcattgttcaggtcgatcctcttgtttctgacccggttcaccgtgctgactgccaccggctggtctttatgtcgaagtttgattcatctgtttaggacctacagttttctgaatttattgttcttgtgctacccttttggaatgtacattccattcctgcagctgaactgtgatctccgcaagacctcattgtttaatcacatgtag

SEQ ID NO: 55452 - DNA, 882 bp, Artificial Sequence
  Description of Artificial Sequence: Synthetic coding sequence
atgtatatccctttcctgcagctgaactgcgacctcaggaaaacaagcttgttcaaccacatggctagcatgggtcccagggaggctgtatctggcctggccaagtcccgcgactacctgctcaccctaagggagacatggaaacagcacaccagacagctttacggtcccgacgctatgcctacccatgcctgctgtttgagtccaagcctaatacgaagtgaagtcgaatttctaaagatggattttaactggaggatgaaggaggtgcttgtgagttctatgctatcagcatactacgttgcctttgtgccagtctggttcgtgaaaaatacacactactacgataaacggtggagttgcgaattattccttctggtcagcatttcgactagcgtgattcttatgcaacatttactcccagcaagctattgcgaccttctccataaagcggcagcccacctgggatgctggcagaaggtcgaccctgccctgtgctccaacgtactgcaacatccgtggacagaggaatgtatgtggcctcagggagtcctagtcaagcacagcaagaatgtctataaagcagtgggccattataatgtcgccatccctagtgatgtgagccactttcgattccacttcttctttagtaagcccctgcgaatcttgaacatcctgctgctgctggaaggcgctgtgatcgtgtatcaattgtactcactgatgtccagcgaaaagtggcatcagactatttctctggccctaatattgtttagtaactactatgctttttttaagctgctgcgtgaccgactggtgctgggcaaagcctactcttattctgcaagtccccagagggaccttgatcacagattctcatag

SEQ ID NO: 55453 - DNA, 1029 bp, Artificial Sequence
  Description of Artificial Sequence: Synthetic coding sequence
atgaaaaacttccatttgatcgactttaatctgctgatggtgaccaccatcgttctaggcaggaggttcatcggatctattgttaaggaggcctctcaaagaggcaaggtgtctctgtttcggtcgattttactattcctgacacgctttacagttttaaccgccacagggtggtccctgtgccgctctcttatccatcttttcaggacgtacagcttcctcaatctgctgttcctctgctacccctttggtatgtatattcctttccttcaactgaactgcgacctgagaaaaaccagtctgtttaaccatatggcctcgatgggtcccagagaggctgtgagtggcctcgccaagtctcgcgactatctgctgaccctgcgagaaacttggaaacaacacacgcggcagttgtatggacccgatgctatgcccactcatgcttgctgtctgtcgcccagtttgatcaggagcgaagtggaattcctgaaaatggactttaactggaggatgaaggaggtgctggtgtcgtctatgctgtcagcctactatgtcgccttcgttccggtttggttcgtgaagaatactcactactacgacaaacgatggtcctgtgaattgttcctgctcgtcagtatcagcacaagtgtgatcctgatgcagcatctcctgcccgcatcctattgtgacctgctgcataaagcagcggcacatttaggatgttggcaaaaggttgatccagccctgtgtagcaacgtgctccagcacccatggaccgaggagtgcatgtggccacaaggggtactcgtcaaacattcaaaaaacgtttataaagccgtcggacattataacgtggctatcccatctgacgtatctcacttccgcttccatgtaagtctgcttcccggtgaaggtgggttgggccctgaaagggtcggaggaagcgctggtcaggagtgtgatgtgatcgcacgagagtcctattttcaatacttcccgaatccgaaggaagactccgctcacatgtag

SEQ ID NO: 55454 - DNA, 579 bp, Artificial Sequence
  Description of Artificial Sequence: Synthetic coding sequence
atggggggtcgtagggggccaaacagaacatcctattgtcgaaatcccctttgtgagcccggaagttctgggggttccagcggcagccatacctctagcgccagcgttacaagcgtcagatccaggactcgatcctcttccgggaccggactttcttccccacccctggctacccagacagtcgtgccactacagcactgtaagattccggaactcccagtgcaggccagcattctttttgaactgcagctgttcttttgccagctgatagctctatttgtgcattacataaatatctataagactgtgtggtggtatccccctagtcaccctccgagccacacctctcttgcttcccagcgaggcaaggtttccctgtttcggtctatcctgctgttcctaacaagattcactgtacttacagcgacgggatggtccttgtgtcggagccttatccatctttttaggacatactcatttctgaacctgttgtttctgtgctacccattcgggatgtatattccattcctgcaactgaattgcgatttgaggaagacctctttatttaaccacatgtag

SEQ ID NO: 55455 - DNA, 666 bp, Artificial Sequence
  Description of Artificial Sequence: Synthetic coding sequence
atgggtggacggaggggacctaacagaacatcttattgtcggaatcctctctgcgagcccggttcctcgggcggatcctcaggctcacacacatcaagtgcttccgttaccagcgttaggtcacgaacaagatcaagctcgggtaccggtctgtcatccccccctttagccacacaaaccgtcgtgcctctgcagcattgcaagataccagaactgccggtgcaggcgtctatacttttcgagcttcaattgtttttctgtcagcttatcgcactgtttgtacactacattaatatctataaaaccgtgtggtggtaccccccttctcacccgccatcccacacatccttaaatttccacctgatcgatttcaatctcctcatggtaaccacaatcgtgctcggcaggcgttttatcgggagcatcgtgaaagaagtgtgggacgttcatagtgtgccagctgctgaacttcgacccccacaggataagcccctgcagccccacggactacatggggctccagggggtggacagtggcccggaaaagagccgggtcttcctccagacacagccggagatgttgaggcagcccataaaaccgcagtgtggccaggtcgccacgcccacccctgcctattacctgtcacacagccgcacccccagtag

SEQ ID NO: 55456 - DNA, 702 bp, Artificial Sequence
  Description of Artificial Sequence: Synthetic coding sequence
atggagactagcgcgtcatcaagccaaccacaggacaattcacaagtccacagggagacagaagatgtggactacggggaaaccgactttcataagcaagatgggaaggccggactgtttagccaggagcagtatgagcgcaataaatcctctagcagttcgagtagctcttcttcaagttcctcctcttctagctcttccagtagttctgaatctaatgacgaagatcagcaaccaagagccaccggcaagcatagacgttcgctgggcgctgggtaccctcacgggaatggaagccccggacccggacatggcgaaccagatgttctgaaggacgagttgcaactctatggggatgcccctggtgaagtcgtgccctcaggcgagtctggactgcggaggcgaggaagcgatcctgcctcgggtgaagtcgaggcctcccagcttcggagactgaatataaaaaaagacgacgaatttttccatttcgtgctgctgtgcttcgccatcggcgctcttctggtatgttaccactattacgcggattggttcatgtctctcggcgtgggcttgctgacttttgcgtcgctcgagactgtggggatatactttgggctggtgtaccgcattcactccgtccttcagggcttcattcctttgttccagaaatttcgactcaccggatttcgtaagacagactag

SEQ ID NO: 55457 - DNA, 702 bp, Artificial Sequence
  Description of Artificial Sequence: Synthetic coding sequence
atggagacgagcgcctcctcaagccagccccaggataactcccaggtgcacagggaaacagaagatgtcgattatggggaaacagacttccacaagcaagatgggaaggctggtctcttttcacaagaacagtacgaaaggaataagtcaagttcctcctcaagctcttcaagcagctctagctccagcagcagcagcagtagtagtagcgaatccaatgatgaggaccagcagcccagggccaccggcaagcaccgacgctctttgggagccggttacccccatggaaacggtagtcctggtccaggacacggggaacccgacgttttgaaagacgagctccagctgtatggcgatgctcccggagaagtggtcccgtcaggggagtccggtctcaggcggagaggttcagaccctgcctccggcgaggtagaggccagtcagctgagacgactgaacatcaagaaggacgatgaattctttcattttgtcctgctttgcttcgcgatcggagccctcctggtgtgctaccactactatgccgattggtttatgagtctcggcgtcggactgctcactttcgcatcattggagactgtgggtatttatttcggcctcgtctataggatacattctgtgcttcagggtttcatcccccttttccagaaattcagattgaccgggttccgcaagacggattag

SEQ ID NO: 55458 - DNA, 750 bp, Artificial Sequence
  Description of Artificial Sequence: Synthetic coding sequence
atggccgaggccggagcaggctcactgagcttgcccggtgggaaggcgatggaaacatctgcttccagctcccaaccccaggataacagtcaagtacacagggagaccgaagacgttgactacggagagacggactttcacaaacaggacggtaaggctggcttgttctcccaggaacagtacgagaggaataaatccagttcctcctcatcctcaagcagctcatcatcatcatcttcttcatcatcctcctcgtccgaaagcaatgatgaagaccagcagcctcgggctacaggcaaacatcgtcggtctctgggagcaggctatcctcacggaaatggtagtcccggtcctggccatggagagccagacgtgcttaaagatgagctccagctgtacggcgatgctcccggagaggttgtcccttcaggggagtctggcctacgcagacgcggtagcgatcctgcctcaggtgaagtggaagcatctcaactgcgtcgtctgaacatcaaaaaggacgacgagttttttcatttcgtactgctctgtttcgcgatcggcgctctccttgtttgttatcattactacgcagattggttcatgtcgctgggtgtcggactgctgactttcgcaagccttgagacggttggcatctatttcgggctcgtctaccggatccattccgtcctccagggtttcatccccctgtttcagaaattcagactgacaggatttagaaagacagactag

SEQ ID NO: 55459 - DNA, 612 bp, Artificial Sequence
  Description of Artificial Sequence: Synthetic coding sequence
atggaaacatcggcaagtagctctcagccgcaggataactctcaagtgcacagggagaccgaggacgtggattacggcgaaaccgattttcacaagcaggacgggaaggccggattgtttagtcaagagcagtacgagcgaaataagagttcttcctcaagctcatccagctctagtagctcctcttcttctagcagtagtagttcctctggtccagggcatggggaacctgatgtactgaaggacgagttgcagctgtacggggatgcaccgggtgaggtcgtacccagcggcgaatccggtttgcgtcgtcggggttctgaccccgcttccggcgaggtggaggcttcgcagcttcgtagactgaatatcaagaaagatgacgagttctttcactttgtcttactctgcttcgccattggggctctgctggtgtgctaccattactatgccgattggttcatgagcctgggcgtggggctgctgacctttgcatccctagagaccgtcggtatctactttggcctcgtgtataggatccactcagtgttgcagggatttatccctttgttccagaagttccggttgacaggctttaggaagacggactag

SEQ ID NO: 55460 - DNA, 474 bp, Artificial Sequence
  Description of Artificial Sequence: Synthetic coding sequence
atggaaaccagtgccagctcttcgcagccgcaggacaacagccaggttcaccgagaaactgaagatgtagattgcccaggtcatggagaacccgatgtcctgaaagacgagcttcagctatatggagatgccccaggggaagtggttccatctggagagtcagggctgcgaaggagaggttccgatccagcctcaggcgaggtcgaggcttcgcaactcaggagacttaacataaagaaagatgacgaattcttccacttcgttctgctctgctttgccatcggggctcttttggtgtgctaccattattatgcggactggtttatgagtttaggcgtgggcctgctgacatttgcctccctcgagaccgtaggcatttattttgggctagtgtatcggattcactccgtcctgcaggggtttatcccccttttccagaagtttcgcttgaccggctttcggaagactgactag

SEQ ID NO: 55461 - DNA, 795 bp, Artificial Sequence
  Description of Artificial Sequence: Synthetic coding sequence
atgaggccattgctgggtctgctcctcgttttcgccggttgcaccttcgccctgtaccttctttctaccagactccctcgtggccgaagattaggatccaccgaggaggctggtggcagaagcttgtggttcccgagtgatctcgctgagctgcgtgagttatctgaggttctcagagaataccgtaaagaacatcaggcgtatgtctttttgttgttttgtggagcctatctgtataaacaggggttcgccattcccggatccagtttcctcaatgtgctagcaggagctctgttcggcccttggttgggcctgctgctgtgttgtgtactgaccagcgtgggcgctacttgttgttacctgctaagtagcatttttgggaaacagctggtggtgtcttacttccccgacaaggtggctcttctgcaaagaaaagtagaggagaacaggaactcactcttttttttccttttatttctgcggctgttccccatgaccccgaattggtttctgaatctgtctgcacctattttgaacataccaattgtccagttctttttctctgtattgatagggctcatcccatacaatttcatctgcgtccagaccggttccatactttcaaccctcactagtctcgatgctttattcagctgggataccgtgtttaagttgctcgcaatcgctatggtcgccctgattccgggaactcttatcaagaagttcagtcaaaaacacttacagctgaacgaaacgagcacagccaaccacatccattcgcgaaaagatacatag

SEQ ID NO: 55462 - DNA, 876 bp, Artificial Sequence
  Description of Artificial Sequence: Synthetic coding sequence
atggccaaggggagggtagctgagagaagtcagctgggcgctcatcataccaccccagttggagatggcgctgcagggacacggggtctggcagcaccaggctcgcgggatcaccagaaggagaaatcctgggtggaggcaggtagtgccagaatgagcctgttaatcctggtgagtatttttctcagtgcagcttttgtaatgttcctggtgtataagaactttccccagctctcagaggaggagagggtgaacatgaaggtgccacgggatatggacgatgctaaagcccttggaaaggttttgtccaagtataaggatacattctacgtacaggtgctcgtagcctactttgccacttacatctttctgcagacttttgctattccagggtccatatttctctccatattaagtgggttcctgtatccgttccctcttgctctttttcttgtatgtctgtgttctggcctcggcgcttccttctgctacatgctttcctacttagtaggacgccctgttgtctacaagtatcttacagagaaagctgtgaagtggtctcaacaggttgaacgccaccgtgagcacctgatcaattacattattttcttgcggattaccccgtttctgcccaactggttcattaatatcacttcccccgtcatcaacgtgcctctgaaagtgttctttatcggcacgttcttgggtgtcgcaccgccttcttttgttgctattaaagcaggcacaactctttaccaacttacgacagcgggagaggccgtttcatggaattctatttttatcctaatgattctggctgtgctctctatactgcccgctatttttcagaagaagttgaagcaaaaatttgaatag

SEQ ID NO: 55463 - DNA, 876 bp, Artificial Sequence
  Description of Artificial Sequence: Synthetic coding sequence
atggccaaagggagagtcgctgaaaggtcccagctcggggcacaccacactacgccagtgggagatggcgcagccggtacaagggggctagccgcacctgggtccagggaccatcaaaaggagaagagctgggtcgaagccggttctgccagaatgtccttactgatcttggtctcaatcttcctgtctgcagcctttgtcatgttcctcgtgtataagaactttccacaactctctgaggaagaacgtgttaacatgaaagttcccagggacatggacgacgcgaaagccctggggaaggtcctcagcaaatacaaggacaccttctacgtgcaggtactggtggcatactttgctacttacatctttttacaaacatttgctatccctggaagcattttcctcagcatcttaagtgggtttctgtatccttttccattggctctcttcctcgtatgcctgtgttcaggactgggagccagtttttgctacatgctatcatacctagtcgggagacccgttgtgtataaatacctgacagagaaggcagtcaagtggagtcagcaagtggagcggcatagagagcacctgatcaattacataatcttcctgcgaatcacaccgttcctgcctaattggttcatcaacattacctcacccgtgatcaatgtcccactgaaagtctttttcattggtacgtttctcggcgttgcacctcctagctttgtggccatcaaggccggaaccactctgtatcaactgacaaccgccggagaagctgtgtcttggaacagcattttcatactgatgattctcgctgtgctctccatcctccccgcaatttttcagaaaaaacttaagcagaaattcgaatag

SEQ ID NO: 55464 - DNA, 384 bp, Artificial Sequence
  Description of Artificial Sequence: Synthetic coding sequence
atggccaagggcagagtggcggaacgcagccagctgggcgcacatcatacaacccccgtcggcgacggcgctgccggaacccgcggactcgcggcaccaggcagcagggaccaccagaaggaaaagagctgggttgaagccggaagcgctagaatgtcgcttctgatcctggtttccatcttcctcagtgccgctttcgttatgttccttgtctataaaaacttcccacaactgagtgaagaggagagggtgaacatgaaggttcctagagatatggacgatgccaaggcactcggaaaagtgctaagtaaatacaaagataccttttatgtgcaggtgcttgtggcatattttgcaacctacatattgtatccattcaattag

SEQ ID NO: 55465 - DNA, 480 bp, Artificial Sequence
  Description of Artificial Sequence: Synthetic coding sequence
atggcagagagacctgggccaccaggaggtgcggtctctgcaactgcataccctgacacacccgctgaattcccgccacatctgcaagctggggcaatgcggaggagattctggggcgtgttcaactgtttgtgcgccggagccttcggggctctcgctgccgcatccgccaaactggctttcggaagtgaggttagcatggggctgtgcgtgctggggattatagtgatggcatctactaattcactgatgtggacctttttctctcgagggcttagcttctccatgtcttccgctattgcgtcagtgacggttacctttagtaacatcctgtcgagtgccttcctgggatacgtgctctatggagagtgtcaagaggtcctttggtggggaggagtgtttttgattctctgcggactgaccttgatccataggaaattgccaccgacttggaagccactccctcataagcagcagtag

SEQ ID NO: 55466 - DNA, 828 bp, Artificial Sequence
  Description of Artificial Sequence: Synthetic coding sequence
atgggtaatttccgtggtcacgcactacctgggacgttcttctttatcatcgggctgtggtggtgcactaaatcaattttgaagtatatatgcaagaagcagaagagaacatgttatctggggtcaaagacactgttctacaggttggaaatactcgaagggattaccatcgtggggatggcgttgacaggaatggccggtgagcagttcatccctggtgggccacacctgatgttgtacgattacaagcagggccactggaatcaactccttggatggcatcatttcaccatgtattttttctttgggctgctgggggtggccgatattctgtgctttaccatctcatccctcccagtgagcctgactaagctgatgctttctaacgccctctttgtggaagcatttatcttttataatcatactcacggcagggagatgttggacatcttcgtgcatcagttgctcgtgctggtggtatttttgacggggctggtggcattcctcgaatttctggtacgcaataacgtcttactcgaactacttaggagttcactcatccttctgcagggatcgtggtttttccagattggcttcgtactgtatccaccctcaggtggcccagcatgggacctgatggaccacgagaatattttatttctgacaatctgtttctgttggcactacgctgttaccatagtgatcgtgggaatgaattacgcctttataacttggttggtgaagtccagattaaaacgcctgtgcagttctgaagtcggtctgctgaagaacgcagagagagaacaggagtcggaggaggagatgtag

SEQ ID NO: 55467 - DNA, 876 bp, Artificial Sequence
  Description of Artificial Sequence: Synthetic coding sequence
atgactaacgacagtgaggggaagatgggcttcaagcatccaaagattatgggaaacttccggggacacgctctccccggaacatttttttttatcatcgggctgtggtggtgcaccaagtccatactaaaatacatctgcaagaaacaaaaacgaacttgttatctgggctctaagaccttgttttataggctcgagatactagagggaattactatagttggcatggcactaactggaatggcaggagaacaatttatccctgggggaccgcacctgatgctttatgactataagcaggggcactggaatcagctcctgggatggcaccatttcaccatgtatttcttctttgggctgcttggggtcgctgacatcctgtgcttcactatatcttctctacctgtctccttgacaaaactaatgctgtcaaacgccctttttgtggaggcgtttatcttctacaatcatactcatgggagggagatgcttgatatcttcgtgcaccaattactcgttcttgtggtctttctaaccggcctggtggcctttctggagtttctggtccggaacaatgtgctgctcgagctgttgcggtcctctctgattctcctgcaggggagttggttcttccagattggctttgtattatacccgccatcagggggaccagcctgggacctgatggatcatgagaatattctgtttcttactatctgcttctgctggcattatgccgtgaccatcgtgattgtggggatgaattatgctttcataacgtggttggtaaaaagtcgattgaaacgcctctgcagctctgaagtaggactccttaaaaacgccgagcgcgaacaagaaagtgaggaggaaatgtag

SEQ ID NO: 55468 - DNA, 828 bp, Artificial Sequence
  Description of Artificial Sequence: Synthetic coding sequence
atggctaacttcaagggccatgccctgcctgggtcattcttcctgattattggcctgtgctggagcgtcaagtatcctctaaagtatttctcgcacacaagaaagaactctcctctgcactactatcagcggctggagattgtggaagcagccataaggacactcttctctgttacgggcattcttgcggagcaatttgtgcctgacggccctcacctgcatctttatcacgagaatcactggatcaaactaatgaattggcagcacagtacaatgtatctctttttcgccgttagtggcatcgtggacatgttgacatatctggtctcacacgtgccactgggagtcgatcggctcgttatggccgtggcggtcttcatggaaggatttctgttttactatcacgtgcacaatagacctccactggatcaacatatccactctttgctgctctatgccctttttggcggatgtgtttcaatctccctagaggtcatcttcagggatcacatcgtcctggagctgtttaggactagccttatcattcttcaagggacatggttttggcagattggcttcgtcctgttcccacccttcggcactcctgaatgggaccagaaggatgacgcgaatttgatgtttataactatgtgtttttgctggcattacctggccgcactgagcattgttgccgtgaattactccctggtgtactgcctgctaaccaggatgaaacgacatggaagaggggaaatcatcgggatccaaaaactgaactccgatgatacctatcaaaccgcactgctgagtggaagcgatgaggagtag

SEQ ID NO: 55469 - DNA, 828 bp, Artificial Sequence
  Description of Artificial Sequence: Synthetic coding sequence
atggcgaactttaagggtcacgcattaccaggatccttttttctgatcatcggactctgctggtccgtgaaatacccactgaaatatttttcccacactcgcaaaaattccccgctccactattatcagagactcgagatcgtcgaagcggctatcaggactctgttcagcgttaccggaatactcgctgagcagtttgtccccgacggcccacatcttcatctgtaccatgagaaccactggattaaacttatgaattggcagcacagcaccatgtatctgttttttgccgtgagcggtattgtcgatatgctcacctatctcgtgagtcatgtacctcttggtgtcgacagactcgttatggctgtggccgtttttatggagggctttctcttttactatcatgttcacaaccgtcctcccctcgaccagcacattcactccctgctgctctatgcgttatttgggggatgtgtaagtatatcccttgaggtgattttcagagatcatatcgtcttggaattattcagaacctccctcatcatcctgcagggtacttggttctggcaaatagggtttgtcctatttccgcctttcggaaccccagaatgggaccagaaggacgacgccaacctgatgttcataactatgtgcttttgctggcactacctggctgcactgtcaattgtcgctgtcaactactcattagtctactgcctactgacccggatgaagcgacatgggcgtggtgagatcataggaatccaaaaattgaacagcgacgatacgtaccagacggctctgctatcaggatctgacgaagagtag

SEQ ID NO: 55470 - DNA, 474 bp, Artificial Sequence
  Description of Artificial Sequence: Synthetic coding sequence
atgagcggatttctggagggtctcagatgttctgaatgcatcgactggggtgagaaaaggaatactatcgccagtattgccgctggcgtgttattcttcacaggctggtggatcattatagatgcagctgtcatctacccaaccatgaaggattttaatcattcatatcacgcctgcggtgtgattgcaacaatcgccttcctcatgataaacgccgtctctaatggtcaagtccgaggggatagctacagtgagggatgccttggccaaacaggggctcggatttggctctttgtgggctttatgctagcctttggaagcctgatagcgtctatgtggattttgtttggaggttatgttgcaaaggaaaaggacattgtttaccccggaattgcggtcttcttccagaacgctttcatctttttcggaggtctggtttttaagtttggcaggaccgaggatctgtggcagtag

SEQ ID NO: 55471 - DNA, 477 bp, Artificial Sequence
  Description of Artificial Sequence: Synthetic coding sequence
atggccggatttctcgataatttccgctggccagagtgcgaatgcattgactggagcgagcgcaggaatgcagtagcttccgtggtggctggaatactgtttttcactggatggtggatcatgattgacgccgctgtggtataccctaaaccagagcaactgaatcatgcttttcacacgtgtggagtgtttagcaccctggcgttttttatgatcaacgctgtttcaaatgcccaggtgcgcggtgatagttacgaatctggatgcctaggcaggacaggcgctagggtctggctttttatcggattcatgctcatgtttggctcactgattgcatcgatgtggatactttttggcgcttatgtaacgcagaataccgatgtttaccccggacttgcggtctttttccaaaatgcactgatatttttcagcaccctgatctacaagttcggtcggacggaagagctttggacgtag

SEQ ID NO: 55472 - DNA, 246 bp, Artificial Sequence
  Description of Artificial Sequence: Synthetic coding sequence
atggccggatttctggataatttccgctggcccgaatgtgagtgcatcgactggagtgagaggcggaatgcagtggcctccgtcgtggcaggaatcctgttttttaccggctggtggatcatgatagatgccgcagtcgtctaccctaagcctgaacagctgaaccatgctttccatacatgtggtgtgttctctacacttgctttctttatgatcaatgctgtttcaaatgcgcaggttagatag

SEQ ID NO: 55473 - DNA, 189 bp, Artificial Sequence
  Description of Artificial Sequence: Synthetic coding sequence
atggcaggtttcctggacaatttcaggtggcccgaatgcgaatgcatcgattggtccgaacgacgcaacgcagtggctagtgttgtcgctggtattctcttcttcaccggttggtggataatgattgacgcagcggtggtctacccgaagccagagcagctgaatcatgctttccacacttgcgggtag

SEQ ID NO: 55474 - DNA, 381 bp, Artificial Sequence
  Description of Artificial Sequence: Synthetic coding sequence
atggccggtttcttagataacttcagatggcccgagtgcgaatgcattgactggtctgaacgccgtaatgccgtcgccagtgtggttgccggaatactttttttcacggggtggtggataatgattgacgcagcagttgtttacccaaaacctgaacagttgaaccatgcttttcacacatgcggcgtgttctcgactctggccttttttatgatcaacgctgtcagcaacgctcaggtaaggggggactcttatgagtcaggctgtctcggacggaccggagcaagggtgtggctgttcattggatttatgctgatgttcgggtcgctcattgcttccatgtggatcctttttggtgcttatgtgacacagaacctgtag

SEQ ID NO: 55475 - DNA, 477 bp, Artificial Sequence
  Description of Artificial Sequence: Synthetic coding sequence
atggctggttttctcgacaatttccgttggccggaatgcgagtgtatagattggagcgagagaagaaatgctgttgcatctgtcgtcgccggtattcttttcttcaccggctggtggataatgatcgatgccgcagtggtgtatcccaaaccagaacagctgaatcacgcctttcacacgtgtggggtgttcagtaccttagctttcttcatgatcaacgctgtctccaacgctcaggtgaggggagactcctacgaaagcggctgtctgggtagaacaggggcacgtgtgtggttgtttattggttttatgttgatgttcggcagcttgatcgcttccatgtggatcttatttggtgcgtacgtaacacagaacacagacgtgtatcccggactggcagttttttttcagaatgcactcatcttcttttctacattgatttacaaatttggtcggacagaggagttatggacatag

SEQ ID NO: 55476 - DNA, 762 bp, Artificial Sequence
  Description of Artificial Sequence: Synthetic coding sequence
atgatggctcagagcaaggcaaacggctcccattacgctctgacagccatagggctgggaatgctagtgctgggcgtgatcatggctatgtggaacttagtcccaggcttctcggccgctgaaaaacccacagcacaggggtcaaacaaaactgaagtgggaggcggtatcctgaagtccaaaacattcagtgtggcctacgttcttgtgggcgcaggagtcatgttgctgctgctttctatttgcctctccatccgtgataagcggaaacagagacagggcgaggacttggcccacgttcaacaccccactggggcagggccacacgcacaggaggaagatagccaggaggaggaggaggaggacgaggaggccgcatcccgttattacgtgccttcttatgaggaggtcatgaatacgaactatagcgaagcacgtggcgaggagcagaatcctcggctcagcatatctcttccttcatacgaatcactgaccggcctcgacgaaacaacccccacgtccactcgcgcagacgtggaggcctctcccggtaatccccctgatcgtcagaatagcaaactcgcaaaacggctgaaaccactgaaagtgcgaaggataaagagcgaaaagctacacctaaaagatttccgaattaatctgcccgacaaaaacgtcccacctccttctatcgaaccattgacacctcctccacagtacgacgaagttcaggagaaggcaccggacaccagacccccagactag

SEQ ID NO: 55477 - DNA, 762 bp, Artificial Sequence
  Description of Artificial Sequence: Synthetic coding sequence
atgatggcacaatcgaaggctaatggatcccactacgcactcaccgccattggactgggcatgctcgtacttggagtcattatggctatgtggaatttggtgccagggttctcagccgctgagaagcccaccgcccaaggctccaataagacggaagtgggtggcggaatccttaagagcaagacatttagcgtcgcctacgtgttggtcggtgcaggggtgatgttgctgctgctttccatttgtcttagcattcgggacaagcgaaaacagagacagggagaagacctggcccacgttcagcaccctactggcgcaggaccgcatgctcaggaagaggatagccaggaggaagaagaggaggatgaggaagctgctagccgttactatgttccctcatatgaagaagtgatgaacacgaactactcggaggcacgcggagaagagcagaaccccaggctgtctatctctctgccctcttacgagtcgctcactggtctggacgagacaactcccacctccaccagggcggacgtcgaagcaagccctggaaaccccccagaccggcagaacagcaaactcgcaaaacgactcaagccactcaaggttcgacgcatcaagagcgaaaagcttcacctcaaggatttcagaatcaacctgcccgacaaaaacgtaccacctccttctatcgagccactcaccccaccccctcagtacgacgaggtgcaagagaaagcccctgatacaagaccaccggattag

SEQ ID NO: 55478 - DNA, 762 bp, Artificial Sequence
  Description of Artificial Sequence: Synthetic coding sequence
atgatggcacagtcaaaagccaacggctcacactatgctttgacagccattggactgggcatgttagtgctgggagtgataatggccatgtggaatctggtccccggtttttccgccgcagagaagcccactgcccagggttctaacaaaacggaggtgggaggcggtatactgaaaagcaaaactttctcagtggcttatgttctggtgggggctggtgttatgctgctgctcctgtccatatgtctgagcattcgtgacaagaggaaacaacgccaaggggaggacctcgcccatgtgcagcatcccactggagccggaccacacgcacaggaggaagactctcaggaggaagaggaagaggatgaggaagctgcttctcggtactacgtaccttcctatgaggaagtgatgaatacaaattactccgaggccaggggggaggagcagaacccgagactgagcatatctttacctagctacgagtccttgaccggcctcgatgaaacgactcccacatccaccagagccgatgtcgaggcctcgccaggtaaccccccagacagacagaattcaaagctcgccaagagacttaaaccactaaaggttcgccgtatcaaatcagagaaactacatttaaaagacttcagaattaacttgccagataagaacgtgccaccacctagcatcgagccactgacccccccaccacagtacgatgaagtgcaggagaaggccccagacaccaggccgccagattag

SEQ ID NO: 55479 - DNA, 762 bp, Artificial Sequence
  Description of Artificial Sequence: Synthetic coding sequence
atgatggctcagtccaaggccaacgggtcccactatgcccttaccgccattggccttggaatgctggtgctgggcgtcatcatggctatgtggaatctcgtgcccggattctctgcagccgagaagcccaccgctcagggctccaataagacagaggtcgggggtggaatcctgaaaagtaagactttttccgtggcgtatgtactcgtgggagccggagtaatgctgttactgctgtccatttgtctttccattagggacaagcggaaacaacgccagggtgaagatcttgcccatgtgcagcacccgaccggagccggaccccatgcacaggaggaggatagccaggaagaggaagaagaagatgaagaggccgcatctcgctattatgttccatcctatgaagaagtcatgaacactaactattctgaggcgaggggcgaagaacagaatccccgtctgagtatatcactcccctcttacgagtcacttaccggcctggatgagacgaccccgacaagtactcgagcagacgttgaggcatcacccggtaatcccccagaccggcagaactccaagttggcaaagcgcttgaaaccactaaaagttcgcaggatcaagtctgaaaagttgcacctgaaagatttccgaataaatctccctgataagaacgttccaccgccaagtatcgaacccctgacacctccaccgcagtacgatgaggtgcaggaaaaagccccagatactcgaccacccgactag

SEQ ID NO: 55480 - DNA, 762 bp, Artificial Sequence
  Description of Artificial Sequence: Synthetic coding sequence
atgatggcccaatctaaggccaacgggagtcactatgctctcacagcaatcggtttgggaatgctggtgttgggcgtgattatggccatgtggaatttagtccctggttttagcgccgctgagaagcccacagcgcagggaagcaataagaccgaagtgggtgggggaatcttgaaatccaagactttcagcgtagcttatgttctcgtgggggctggcgttatgcttctgctgttgagcatttgcctgtctattcgggataaaaggaagcagcggcaaggagaagatctggcccatgtacagcacccgacaggagcaggcccacacgctcaggaagaggattctcaggaggaggaagaagaggacgaagaggccgcttcacgttattacgttccctcctacgaagaggtgatgaacactaattactctgaggcaagaggcgaagagcagaaccccaggctttccatttctctccctagttatgagagcctgaccggtctggatgaaaccacccctaccagtacccgcgctgacgtcgaggcatctcccggaaatccaccagatagacaaaattctaagttggctaaaaggttgaaacccctcaaggtaaggcgaataaagtctgaaaaactccacctgaaggacttcagaatcaatctgcctgataaaaacgtccctcctccttctatcgaacctctgactccaccaccccaatacgatgaagtccaggagaaagctcccgataccaggccacccgactag

SEQ ID NO: 55481 - DNA, 762 bp, Artificial Sequence
  Description of Artificial Sequence: Synthetic coding sequence
atgatggcacagtcaaaagccaacggttctcactacgcgctaaccgcaattggactcggtatgctcgtcctcggagtcatcatggcaatgtggaacttagttccgggattttcagctgccgaaaagccaacagcacaagggtcaaacaagacggaggtgggtggcggtattctgaaatccaagacctttagcgtggcctacgttcttgtgggtgccggagtcatgttacttttattgagcatatgcttaagtatacgtgacaagaggaagcagaggcagggggaggatctggcccacgtgcagcaccctaccggagctggtcctcatgcccaggaagaagactcccaagaggaggaagaagaagacgaagaagcagctagtagatattatgtaccaagttacgaggaagtcatgaatacgaactacagcgaagctcgtggagaagagcagaatccgaggttgtcaatttccctcccaagttatgagagccttaccggtctggacgagacaaccccaacaagcactagagcagacgtcgaagccagcccgggaaacccccctgaccgccagaatagcaagctcgcaaaacgactgaaaccactgaaagtgaggagaataaaatctgaaaagctgcatctgaaggattttcgtattaatctgcctgacaagaacgtgccaccgcctagtatcgagccactgactccacctccccagtatgacgaggttcaggagaaagcgccagatactcgacctccagattag

SEQ ID NO: 55482 - DNA, 528 bp, Artificial Sequence
  Description of Artificial Sequence: Synthetic coding sequence
atgatggcccaaagcaaggcaaatggcagccattatgccctgacagctatcggattggggatgctcgtgttgggtgtgatcatggcgatgtggaacctggtgcccggatttagtgctgccgagaagccaaccgcacagggatccaataaaacagaggtgggtggtggaatactcaagtccaagacctttagtgtggcctatgtccttgttggggcaggcgtgatgctgctgctcctttcaatttgtctttccatacgcgacaagaggaagcagcgacagggcgaggaccttgcccatgtgcagcaccccacgggagcaggtcctcatgcacaggaggaggactcccaggaggaagaggaggaagacgaggaggccgctagcaggtactatgtgccatcatatgaggaagttatgaacaccaattatagtgaagcccgtggcgaagagcaaaaccctcgcctctctatctcactacctagctatgagtccctgacagggctggacgagacaactcctactagcacttag

SEQ ID NO: 55483 - DNA, 630 bp, Artificial Sequence
  Description of Artificial Sequence: Synthetic coding sequence
atggctcgcggacccctagccgctcgcggacttcgtttgctgttaccccttctgcctctccttccccttttgccgttgcctcaggtcgccttagggtttgccgatggcagctgtgacccttctgatcagtgcccccctcaggcccgatggtctagcctctggcacgtgggactgattctcttagccgtgctgctgctgctgttatgtggggtaacggccggatgtgtgcggttttgctgtctccggaagcaagcacaggctcagccacacctgccccctgcacgtcaaccatgtgacgtggctgtaataccaatggactctgatagcccggtacactccactgtaacctcttatagtagcgtccaatacccactgggcatgcgcctacctctcccatttggcgaactcgacctggacagcatggccccaccagcctactccctatatacgcctgaacccccaccgtcctatgatgaagccgtgaaaatggccaagcccagagaggaaggtccagccctgagccagaagcccagtcccctgctgggcgcatcggggctggaaaccacccccgtgcctcaggagagcgggcctaatacacagctgcctccatgttcacccggagcaccctag

SEQ ID NO: 55484 - DNA, 375 bp, Artificial Sequence
  Description of Artificial Sequence: Synthetic coding sequence
gggggtcgctggccgcctgccgattgcggatgctgttgtcgttcctgtagaagctgtcggtcctgccggtgtagaaggtgggtgggaagacgcagtttgtccgtccggcctcccaggggaggttccctgctcggcccacgcccatctcgcgcacacccttgtcctcacagatggcgctgggcaagtagaactgccgctgctacccctagaacttctgcccgtccaagacccgctggggcagcttgtggcacttgggcctgcacgcccagaagcctgcaccctcccacaatgaaactgtcaaggtggccctcgccagagcggaaggatcagcacagcccccgaaaccctgcgctctctctggggcctcgggcttag

SEQ ID NO: 55485 - DNA, 585 bp, Artificial Sequence
  Description of Artificial Sequence: Synthetic coding sequence
atggagcggcactgcctgctattcatcctgctaacatgtctccggtggctgtgtcatgatattcctcaaggggctggagcaagatggcctagggtgagtccagtcgtggagccatgttccccaaggctaattcttctggcggtgctgctgctgcttctgtgtggcgtgacggctggctgcgtaaggttctgttgtctgcgcaaacaggcacaggcacaaccccacctccccccagccagacagccctgcgatgtggcggttattccgatggacagcgattccccagttcattccactgtaacatcatattcttctgtacagtaccccctaggaatgcggctgccgctgcctttcggggagctggacctggattctatggctcccccagcatacagtttgtatacacccgagcccccaccgtcttatgacgaggccgtcaaaatggccaagcccagggaagaaggtccggctttgtcccagaagccgtcccccctcctgggagccagcggattggaaaccacccccgttcctcaggagtctggcccaaacactcagctgccaccatgctcccctggcgctccttag

SEQ ID NO: 55486 - DNA, 312 bp, Artificial Sequence
  Description of Artificial Sequence: Synthetic coding sequence
atggcccgagggcctctcgcagccagggggctccgcctgttgctgcccctgttaccattactgcctctcctaccattacctcaagttggtcgcgcagccttttctctgggctctgccactgcgggaagagtgccagctcgtacaaccccactgcccggatccccgctgtccccacaggtggctttgggctttgctgatggctcttgcgacccctcggatcaatgccctccccaggctcgatggtcctccctgtggcacgtaggattaatcctgctggctgttcttctgctgttgctgtgcggagtaacctag

SEQ ID NO: 55487 - DNA, 744 bp, Artificial Sequence
  Description of Artificial Sequence: Synthetic coding sequence
atggcatccgctgaacttgactacacaattgagatccctgatcagccatgctggtctcagaaaaactcaccttcccctggaggtaaagaggcagaaactcgccagcccgtggtgattttgcttggatgggggggatgcaaagacaagaacctagccaagtattcggcaatttatcataagcgaaaactcctagagttgttgttcgattatgaaattgaaaaggagccactgctgtttcatgtgttcagcaatggcggagtaatgctctaccgctacgtcttggaacttctgcagacgagaaggttctgccgcctacgcgtagtgggcaccatcttcgactcagcccctggagactctaacctcgtgggagccctcagggctctggccgctatattagaacgaagggcagcgatgctgagactactcctgctcgtggccttcgctttggtcgtcgtcctcttccacgtgttgctggcacccatcaccgccttatttcacactcatttctacgaccgccttcaggatgcgggaagcagatggcccgaattgtacctgtacagtcgcgctgatgaagtcgtcctggcgagggacattgaacgcatggttgaggcgagactggccaggcgcgtgctggccaggagtgtcgatttcgttagttccgcacatgtctcacacttacgagattatccgacctactatacgtcgctgtgcgttgacttcatgcggaactgtgtacgttgctag

SEQ ID NO: 55488 - DNA, 834 bp, Artificial Sequence
  Description of Artificial Sequence: Synthetic coding sequence
atggcatccgccgaactggattatactatagagatccctgaccagccctgctggagccagaaaaactccccatctccaggtggcaaggaagcagagactcggcaacccgtagtaattttgcttggatggggcggttgtaaggacaagaatttggccaagtactcagcaatataccataagcggggatgcattgtcattcgctataccgccccatggcacatggttttcttctctgaaagcctaggcatcccctctctaagggttcttgcccagaagttgcttgagctcttgttcgattatgaaatcgaaaaagagcctctgttgttccacgtgtttagcaacggaggggtcatgctgtaccgctacgtgctggaattgttgcagactaggcggttctgccgactgagagtggtgggcactatctttgattccgcacctggcgattctaaccttgttggggctctgcgcgctctggcggcaattttggagcgcagagctgcgatgctgcgccttctactccttgtggcctttgctctcgtggtcgtcctgtttcacgtgctcttagcacccattacagccttatttcacacacacttctacgataggctgcaagatgctggcagccggtggcctgagctctatctttattctcgtgcagatgaagtcgttcttgcccgagacattgaacggatggtggaggcgagacttgcccgacgtgtgctcgctagatctgtggactttgttagcagtgcccatgtgagtcacctcagggattatcccacatactacacaagcctctgtgtcgacttcatgagaaattgtgtgagatgctag

SEQ ID NO: 55489 - DNA, 606 bp, Artificial Sequence
  Description of Artificial Sequence: Synthetic coding sequence
atggccagcgctgagctggactacaccattgaaatcccagaccaaccttgctggtcacagaaaaacagcccatctcccggaggcaaagaagcagagactcgacagcctgtagttatcctgttaggttggggtgggtgcaaggacaaaaacttagcaaagtattctgcaatctaccataaacgcggatgtattgtcattcggtacactgcgccttggcacatggtctttttctccgagagcttaggtattccctcattacgggtgctggcccagaagctgctggaactgttgtttgactacgaaattgaaaaggaacctttgctttttcatgtctttagcaatggcggagtgatgctgtaccgctacgtgctcgaactgttgcaaacaagaaggttctgtcgccttcgtgtcgtaggaacaatttttgactcagcccctggagattctaatttagtcttttgtatggcctcctgccttctgctcagccctttgctggtggacggcatttcagcgggaaccgaggggcagctgactttgcggcctgattgggcagcacaagtgctgacgcggcttgggtgccacttgcagtgtattacccggagctag

SEQ ID NO: 55490 - DNA, 336 bp, Artificial Sequence
  Description of Artificial Sequence: Synthetic coding sequence
atggctagtgcagaactcgattacactatcgagatacctgaccagccatgctggagccagaaaaatagtccctcccctgggggaaaggaagccgagacacgtcagccagttgtaatccttctcggctggggaggctgcaaggataagaatttggccaagtactccgccatctaccacaagcgggtcttttgtatggccagttgtctgctgctgtctccacttttagtggacggcatttcagccggaaccgaaggccagctcacccttcggcctgactgggccgctcaagtgctgacaaggttgggctgccatctgcagtgcattactcgctcctag

SEQ ID NO: 55491 - DNA, 237 bp, Artificial Sequence
  Description of Artificial Sequence: Synthetic coding sequence
atggcgtccgccgagctcgactacaccattgagattccagatcagccttgctggtcccagtctttgctccatggcctccttcttgcagctttcactatcgcagggggatggcatctctgctgggaccggggtgctacccacactccggctagattgggttccaccggggctaatgccgcttggctcagtccttccatgcaccaccctaaattacgagccccacttagacactcctag

SEQ ID NO: 55492 - DNA, 408 bp, Artificial Sequence
  Description of Artificial Sequence: Synthetic coding sequence
atggccagtgcagaattggactacaccatcgagatccccgaccagccctgttggtctcagaaaaactccccttcacccggaggcaaggaagcagagacgcgacagcccgtggtgatacttctcggttgggggggatgcaaagacaaaaacttggccaagtattctgctatctaccataagcgcctgctggagctgcttttcgactacgagattgaaaaggaacccctcctgtttcacgtttttagcaacggaggagtcatgctgtaccgatacgtcctggagttactgcagacgcgccgattctgcaggttgagggtggtgggcacaatcttcgactctgcccctggcgacagcaatcttgttggcgctctccgcgcactggcagcaatcttggagaggagagcttag

SEQ ID NO: 55493 - DNA, 510 bp, Artificial Sequence
  Description of Artificial Sequence: Synthetic coding sequence
atgtgcttacgcctcggagggttgagtgtgggagactttcgcaaagttctgatgaagactggccttgtgttggtggttctagggcacgtgtcgttcattacagcggctctgttccatggcaccgtgctcaggtatgtgggtacaccacaggatgctgtcgcgctgcagtactgcgtggtgaatatcctgtccgttacttctgccattgtgggaaaggccctgctcgctgcgtgcacttttggctctagtgaattgctggcactggcccctgattgccctttcgatcccacaagaatatactcgagcagcctgtgcctgtggggtatagccttggtattgtgcgtggccgaaaatgtgtttgcagttcggtgtgcgcagctcacacaccagctgctggaattgcgcccttggtgggggaagagctcccaccacatgatgcgagaaaatcccgaattagtggaaggccgagatctcctgagctgtacctcatcagaacctctgacattatag

SEQ ID NO: 55494 - DNA, 669 bp, Artificial Sequence
  Description of Artificial Sequence: Synthetic coding sequence
atgtgcttgagactaggcggactttcagtcggcgattttagaaaagttctgatgaagactggactcgtcctggttgtgctgggccatgtcagctttattacggccgctctttttcacgggaccgtgctgcgatatgtcggaacccctcaagacgccgtggcccttcagtattgtgtcgtgaatatcttgagcgtaacctccgcaattgtcgtcatcaccagcggtattgctgctatcgtactgtcgaggtatttgcccagtacgccacttcggtggaccgtgttcagctcatccgtcgcctgcgcccttctgagtctgacctgtgctttgggattattagcttctatagccatgacatttgcaactcagggcaaagcactactggccgcttgcactttcggctctagcgaattattggcactggctcccgattgtccttttgaccccactcgaatatacagctcatcactttgcctgtggggaatcgcgctagtactgtgtgttgctgagaacgtgtttgctgtgagatgtgcccagttgacgcatcaactcctggagctgaggccttggtgggggaaatcctctcatcacatgatgagagaaaaccccgagttggttgagggcagagatcttttgtcttgcaccagctccgagcccttaacactgtag

SEQ ID NO: 55495 - DNA, 834 bp, Artificial Sequence
  Description of Artificial Sequence: Synthetic coding sequence
atggcggctgatggcgagagatctccattacttagcgagccgatcgatgggggtgcaggcggaaatggactggtggggcctggcggaagcggcgcagggcctggaggaggactgactccctctgcacctccgtacggggcagcgtttcccccttttcccgaaggacatcccgcagtgctgcctggggaagatccaccaccatattctcccctcacatcccctgacagcgggtcggctcctatgataacctgtcgcgtatgtcagtcactgattaatgttgaggggaaaatgcatcagcacgtggtcaaatgcggcgtgtgtaacgaagccacgcccatcaagaatgcacctccaggtaaaaagtatgtgcgctgtccctgcaactgcctgctgatctgcaaggtcaccagtcagaggattgcatgtcccagaccctactgcaagcgcattataaaccttggtcccgtgcatccaggtcccctctctcccgagccacaaccaatgggggtaagggtgatctgtggccattgtaagaacacattcctgtggaccgagtttacagaccgaactttagcgagatgtcctcactgcaggaaagtgtccagtattggcagaaggtacccaagaaagaggtgtatttgctgcttcctcctgggcttgcttctggccgttaccgccacgggactagcatttggaacctggaagcatgctcgcaggtacggtggcatatatgccgcttgggcatttgttattctgctggctgttctttgtctcggcagggctctatattgggcttgcatgaaagtaagccatccagtgcaaaatttctcttag

SEQ ID NO: 55496 - DNA, 855 bp, Artificial Sequence
  Description of Artificial Sequence: Synthetic coding sequence
atggccgctgacggggaaagaagtccacttctctcagaaccaatcgacggtggcgcaggcggtaacggattggtgggacctggcggaagcggggctgggcctggcggtggcctcacaccgtctgcccctccttatggtgccggtaagcacgccccacctcaggccttcccgccttttcccgaggggcatccggcagtgttaccgggagaggatcctcccccttattcccctctgacctcacccgattccggatctgcccctatgattacatgcagggtttgccagagcttgataaatgttgaggggaagatgcaccagcatgtggttaagtgtggcgtttgcaatgaggctaccccaatcaagaacgcgcctcccggtaagaagtacgtccgctgtccatgcaactgcctgctgatctgtaaagtgacctctcagcggatcgcatgtcctcgaccatattgcaaaaggattattaacctcgggccagtccacccaggaccactgtcaccagagcctcagccaatgggcgtccgagtgatttgtggccactgcaagaatactttcctgtggaccgaatttactgatcgcaccctggctagatgccctcattgtaggaaggtgagctccattggacgcagataccctcgcaagcggtgcatctgttgcttcctgctcggcctgctgctcgcggtgacagcgacaggcttggcgtttggcacatggaaacatgcacgtcggtacggcggaatctatgccgcatgggcgttcgttatcctgctggccgttctctgcctgggcagggctctgtactgggcctgtatgaaagtcagccatcccgtgcagaatttcagctag

SEQ ID NO: 55497 - DNA, 792 bp, Artificial Sequence
  Description of Artificial Sequence: Synthetic coding sequence
atggagatcaacacaaaactcctcatttctgtgacatgcatcagctttttcaccttccagctcttattttatttcgtttcatattggtttagtgcaaaggtatccccagggtttaattctcttagtttcaagaagaagatcgagtggaatagccgagtcgtgtcgacctgccattcactggtggtcgggattttcggactttatatttttctttttgatgaagctacaaaagcagatccactctggggcggaccctccctggccaatgtgaatatcgccatcgcctccggatacttaatttccgacttgagcatcattattctttactggaaagtgataggcgacaaattctttatcatgcaccattgtgctagcctgtacgcctattacctcgttctaaaaaacggtgtgctggcgtatatagggaattttcggctgctggcggagctgtcatctccctttgtgaatcagcggtggttctttgaagctcttaaatacccgaagttctccaaggccattgtgattaacggcatactcatgactgtggttttcttcatagtgaggatcgcttcaatgttaccgcactatggattcatgtactctgtttatggaaccgagccttatatcagactgggagtgctgatccagctatcttgggttatttcatgcgttgttttggatgtgatgaatgtgatgtggatgattaaaatctcaaaaggttgtattaaggtgatctctcacattaggcaggagaaggccaagaattccctgcagaatggaaagctggattag

SEQ ID NO: 55498 - DNA, 432 bp, Artificial Sequence
  Description of Artificial Sequence: Synthetic coding sequence
atggagattaacaccaagctactgatcagcgtcacttgtatctccttcttcacatttcagctcctcttttacttcgtgtcatattggttcagtgccaaggtatcaccaggctttaacagcttgagctttaaaaaaaagatcgagtggaatagtcgggtcgtatccacatgtcacagtctcgtggtgggcatcttcgggctgtacatatttctgtttgatgaggccacgaaagcagatcccctgtggggagggcctagcctggcaaatgtaaacatcgcaatcgcatcgggatatctcatcagtgacctgtctattattattctatactggaaggtgatcggtgacaagttttttatcatgcatcactgcgcttctctgtacgcatattatctggtccttaaaaacggagttctcgcttatatcggcaactag

SEQ ID NO: 55499 - DNA, 465 bp, Artificial Sequence
  Description of Artificial Sequence: Synthetic coding sequence
atggaaattaacactaagctgctgatttccgtgacatgtatcagctttttcactttccaattgttattttatttcgtgagctattggttttcagcgaaagtgagtcctgggtttaacagcctgtcatttaagaagaaaatcgaatggaattctcgcgtggtcagcacatgccactccctggtagtcggaatttttggtttatatatctttctattcgacgaggcaacaaaggccgatccattgtggggcggtccaagcctcgcgaatgtgaatatagcgattgccagcggctacttgatctctgacttaagcattatcattctgtattggaaggtaatcggtgacaagttcttcattatgcaccactgtgcttccctctatgcctattacctggttctgaaaaatggcgtgctggcttatataggcaacttccggctgctagcagagctcagctctcccttctag

SEQ ID NO: 55500 - DNA, 1995 bp, Artificial Sequence
  Description of Artificial Sequence: Synthetic coding sequence
atgaagcgcaggaacgcagactgctctaagctgcgaagacccctcaagaggaaccgtatcacagaggggatctatgggtcgaccttcctgtatcttaaatttctcgttgtgtgggcccttgtgctcctcgctgacttcgttctcgaattccggttcgaatacttgtggcctttctggcttttcatcaggtctgtttacgactcatttcgataccaaggtttggccttttcagtgttcttcgtgtgtgtggcatttacaagtaatatcatctgtctgttgttcataccgatccaatggctattttttgccgctagtacctatgtgtgggtacagtacgtgtggcatacggaacgcggtgtgtgcctccccacggtctccctgtggattctcttcgtttacatcgaggccgctatccggtttaaagatttaaaaaattttcacgtcgatctctgccgaccctttgccgctcattgcataggctaccctgtcgtgacgcttggcttcggttttaaatcatacgtgtcatacaagatgcgcctgaggaagcaaaaggaagtgcagaaagagaacgagttctacatgcaactgctgcagcaggccttgcccccagagcagcaaatgttgcagaagcaggagaaggaggccgaggaggccgctaaagggttgcctgatatggacagttctatcctgatccatcataatggaggcattcctgctaacaaaaaactatcaacaacgctcccagaaatcgagtacagagaaaagggaaaagaaaaggacaaggatgccaaaaagcataacctgggaatcaacaataataatattctgcaaccagtggactcgaaaatccaggagattgaatacatggaaaatcacataaattccaaacgtctcaacaacgatctggtgggcagtaccgaaaacctcctcaaagaagactcctgcacagcttctagcaaaaattacaagaatgcatccggagtcgttaattcctccccacgaagccactcagcaacaaatggttcgattccctcaagcagtagcaagaatgagaagaagcagaagtgcacttcgaagtcaccttctacccataaagacctgatggaaaattgtattccgaataatcagctgtccaaacctgacgctctggttagacttgaacaggatattaagaaactgaaggccgacctccaggcttcacggcaggttgagcaggaactgcggagtcagatttcctccttgagttctacggagcggggaatacggtccgagatgggccagctgcggcaggaaaacgagctgctgcaaaacaagttgcataacgccgtccaaatgaagcaaaaagataagcagaacatcagccaactggagaagaagcttaaagccgaacaggaggctcgctcgttcgtggagaaacaattaatggaagaaaagaaacgcaagaagctggaagaggccaccgcggctagagcagttgctttcgctgcagctagcagaggcgaatgcaccgagacccttcgtaatcggattagagaactggaagccgaaggtaaaaagttgaccatggatatgaaagtgaaagaagatcagattcgtgagttagagctgaaagttcaggagctgagaaagtataaggagaatgaaaaggatacagaagtgctgatgtctgcactttccgccatgcaggacaagactcaacacttagagaattcccttagcgcagaaacgcgcataaagttggatctgttttccgctctcggcgatgctaagcgccagttggaaattgcgcaagggcagattcttcagaaagatcaagagataaaggacctgaagcaaaagatcgctgaggtgatggcagtgatgcccagcataacttattctgctgccaccagccccctgagtccagttagtcctcactattcgtctaagtttgtggagacctctcctagcggactcgaccccaacgctagtgtttatcaacccttgaagaaatag

SEQ ID NO: 55501 - DNA, 921 bp, Artificial Sequence
  Description of Artificial Sequence: Synthetic coding sequence
atgaagcggagaaacgccgattgtagcaagctgcggcgaccactgaagcgtaaccggattaccgagggaatctacggacgcctggagcaggatatcaagaagcttaaagccgacttgcaggccagtaggcaggtcgaacaggaattgaggagtcagattagcagcttatcaagcacagagagaggcattcgtagcgaaatgggacagctgaggcaggagaacgaactgttgcagaataaactgcacaatgcagtgcaaatgaagcagaaagacaaacaaaatatcagccaactggagaagaaattgaaagccgaacaggaagctagatctttcgtagagaaacagctaatggaggagaagaaaagaaagaaactggaagaggccacagctgcgagggcagtggctttcgctgccgctagccgaggggagtgcacagaaactttgaggaatcggatacgagaactcgaggccgagggaaagaagttaaccatggatatgaaagttaaggaggatcaaatcagggagctggaactgaaggtgcaggagctccgcaagtacaaggaaaatgagaaggacaccgaggttcttatgtctgccttatcggccatgcaggacaagacacagcatctagaaaacagcctctccgcggagactaggatcaagctggacctgttctcagcgttgggcgatgccaaacggcaactggaaatcgctcaggggcagattctccaaaaagaccaggagattaaagatctgaaacagaaaattgccgaggttatggctgtcatgccctctatcacctattctgcagctaccagccccctgagcccagtcagtccacattactcatctaagttcgttgaaacatcccccagcggccttgaccctaacgcatctgtgtaccagccattgaagaagtag

SEQ ID NO: 55502 - DNA, 1314 bp, Artificial Sequence
  Description of Artificial Sequence: Synthetic coding sequence
atgaaacggagaaatgcagattgtagcaagttaagacgaccactgaagcggaataggatcactgagggaatttatgggagcacttttttgtacctgaaatttttagtggtctgggcgctggtgctgctcgccgacttcgtgctggagtttcgatttgagtacctgtggcccttctggctgtttatcaggtctgtttacgacagctttcgctatcaaggtcttgctttcagcgtgttcttcgtctgcgtggcttttacgtccaacatcatctgcttgctgttcattccaatacagtggttattttttgctgcttccacctatgtgtgggtgcaatacgtgtggcacacagagaggggtgtgtgcctccccaccgtctcactgtggattctctttgtgtatatcgaggccgctatccgattcaaggacttgaagaacttccatgtggacctgtgtaggccctttgccgcacactggctcgagcaagatatcaagaaactaaaagcagacctccaagcatcgcgccaggtcgagcaggaactccgctcacagattagcagtcttagcagcacagagagaggtattcggtcggagatggggcagctgagacaggagaacgagctgctacagaacaaactgcataacgcggttcagatgaaacagaaggataaacagaatatttcacagcttgagaaaaagctgaaagctgagcaagaagctcgctcgttcgtcgagaagcagctcatggaggaaaagaagaggaaaaagcttgaagaagctactgctgcacgcgcagttgctttcgccgcagccagccgcggagagtgtacagagacactgcgaaaccgtattcgggaactggaggcggagggcaagaaactgacaatggatatgaaggtgaaggaggaccaaatcagggaactcgaactgaaagttcaggagctccgcaaatataaagagaatgagaaggatacggaggtgctgatgagcgctctatctgcaatgcaggacaaaacccagcacttggagaattcactgagcgccgagacacgcatcaaactggatctgttctccgcgctcggggatgctaagagacaattggaaatcgctcagggtcagatactgcagaaagatcaggaaatcaaagatcttaagcagaaaattgcagaggtgatggctgtgatgccctcaattacatattctgctgccacaagcccactctcacctgtctcaccgcattacagctccaaattcgtggaaacttctccgtccggattagatcctaacgcaagtgtttatcaacccctgaagaaatag

SEQ ID NO: 55503 - DNA, 627 bp, Artificial Sequence
  Description of Artificial Sequence: Synthetic coding sequence
atggataagttcgtgattcgaactcctcgtatccaaaacagcccacagaagaaggactctggcggaaaagtgtacaagcaggccaccattgagtcccttaaaagggtggtggtggtcgaggacattaagcgatggaagacgatgctggaactacccgaccagacgaaagaaaatttggtggaggctttgcaagaactgaagaaaaagatcccaagtcgggaagtgttgaaatccacacgcatcggtcataccgtgaacaagatgcgcaagcatagtgatagcgaggttgccagcctggccagagaagtgtataccgagtggaagacttttaccgagaaacatagcaacagaccctctatcgaagtgcgtagcgatccaaaaacggaatccctgagaaaaaacgctcagaagctgctgtctgaagctctggaacttaaaatggaccatctgctcgttgagaatatagagcgggaaacctttcacctgtgttctaggctcattaatggtccttaccgcaggactgtcagagccctggttttcaccctcaaacatagggccgagatacgcgcacaggtgaaatctggttcactgcctgtgggaactttcgtacagactcataagaagtag

SEQ ID NO: 55504 - DNA, 438 bp, Artificial Sequence
  Description of Artificial Sequence: Synthetic coding sequence
atggctgccccaaaagggagcctctgggttcggacacagctgggcttacccccacttcttttactgaccatggctctggccggtggttcaggaaccgctagcgctgaagcctttgattccgtactgggggacactgcatcctgccatagagcttgccagttgacctatccactccatacttaccccaaagaagaggagctgtatgcctgccaaagaggctgtcgcttgttctctatctgccagttcgttgatgacggaattgacctcaatcgcacaaagctggagtgcgagagtgcctgcacagaggcctattcccaatcagatgagcagtatgcttgccatctcggttgccaaaaccagctgccatttgccgagcttcgccaagagcaggttcggaacaacaccgcctttcaaacctccctcctgagatggcactag

SEQ ID NO: 55505 - DNA, 852 bp, Artificial Sequence
  Description of Artificial Sequence: Synthetic coding sequence
atggctgctccaaagggctcactgtgggtgcgaacgcagctggggttaccccctctccttcttctcacgatggccctcgctggcggttccggaacggcctcggcagaagcattcgacagtgtacttggcgatacagccagctgccaccgagcgtgccagctcacctaccctcttcacacctatcctaaagtgtcagcgtctctatatactgtagaccacattgaggaagaactctatgcttgtcagagaggttgccggctcttcagcatatgtcagttcgtcgatgacggaattgatcttaatcgtactaaattggagtgtgagagcgcttgtactgaggcttactcccaaagcgatgaacagtatgcatgtcatctgggatgtcaaaatcaactgccctttgctgagttgcgtcaggagcagctgatgtccctcatgcccaagatgcatctgctgttccccttgaccctggtgagaagcttctggtcagacatgatggattccgcccagtctttcatcacatcctcatggacgttctacctccaagccgacgacggcaagattgtcatttttcagtctaaacctgagattcagtacgcgccacacctagaacaggaacctacgaaccttcgtgaaagctccctttcaaagatgtcttacctacaaatgaggaacagtcaagcacatagaaattttctcgaggacggagagtctgacgggtttctgcgctgtctgagccttaatagtggctggatcttgactactacactcgtgctgtccgtcatggtgctcctttggatctgttgtgctactgtggcaacagccgtagagcagtacgtgccatcagaatag

SEQ ID NO: 55506 - DNA, 579 bp, Artificial Sequence
  Description of Artificial Sequence: Synthetic coding sequence
atgtcacttatgccaaaaatgcatttgctctttcccctcacacttgtacgctcattttggtccgacatgatggactcagcccagagctttataacaagctcttggaccttttatctccaagccgatgatggcaagatagttatctttcagagcaagccagaaatacaatacgcaccacatctggagcaggaacccactaacctgcgcgagagttcactttcaaagatgagctacttgcagatgcgaaacagccaggctcaccgtaattttttggaggacggcgagtccgatggctttctgaggtgcctgtcgctgaactcgggttggattcttactactactctggtgctgtccgttatggtcttgctatggatctgctgtgctacagtcgcaactgctgtcgaacagtacgtcccttctgaaaagctgagcatctacggtgacctcgagttcatgaatgagcaaaagctcaatcgctacccagcttcttccctggtcgtggtcaggagcaaaactgaagaccatgaggaggctggcccattaccaaccaaggtgaatctggcacactctgagatctag

SEQ ID NO: 55507 - DNA, 579 bp, Artificial Sequence
  Description of Artificial Sequence: Synthetic coding sequence
atgagcctgatgccgaaaatgcatctgctttttccccttactcttgtgcggtcattttggagtgacatgatggatagcgcacagtcctttatcacaagctcttggacattctatctccaggccgatgacggaaaaattgtaatcttccagtccaagcccgaaatacagtatgctccacacctcgagcaggagcccacgaatctgcgggagtcatctttaagcaaaatgagctacctccagatgcgaaactctcaggcacacaggaacttcctagaagacggagaatcggacggctttttacggtgtctgtccctgaattcaggatggatcttgacaactacgctggtgctgtcggttatggtattactctggatttgttgtgcgacggtagccaccgccgttgagcaatacgttccatcagagaaactctccatctacggtgaccttgaattcatgaatgagcagaaattaaaccgttatcctgcgtcttccctggtggtagtgaggtctaaaacagaagatcacgaggaggccggacctctccctactaaagtgaacctcgcacactccgagatatag

SEQ ID NO: 55508 - DNA, 579 bp, Artificial Sequence
  Description of Artificial Sequence: Synthetic coding sequence
atgtcgctgatgcccaaaatgcacctgctgtttccccttactcttgtcagatcattttggtccgatatgatggactcagcacagagtttcatcacaagttcatggacattttatctgcaggcagacgacgggaagatcgtgatattccagtctaagccagagattcagtatgcaccacatctggaacaggagcccactaacctgagggaaagcagtttaagcaagatgagctaccttcagatgagaaactcccaggctcacagaaattttctcgaggatggtgaatccgacgggttcctgcgctgcttgagcctaaatagtggctggattctcactactactctggtattgtctgtgatggtgctgttgtggatctgctgcgctacggtagccaccgccgttgagcagtacgtgcctagtgagaagctgagcatctacggcgatctggaattcatgaatgaacagaaactgaatcggtatcccgcttcttctctggtggttgtgcgttctaaaaccgaggaccacgaggaggcgggtcccctgcccaccaaagttaatttagcccattccgaaatctag

SEQ ID NO: 55509 - DNA, 435 bp, Artificial Sequence
  Description of Artificial Sequence: Synthetic coding sequence
atgtcactgatgccaaagatgcatctgttattcccattgaccctggttcgtagcttttggagcgacatgatggacagcgcccagtcgttcattacttccagctggaccttctatcttcaagccgatgatggtaagatcgtcatctttcagtccaagccggagatccagtatgcaccccatctcgagcaagaaccgacaaacctgagagaatcctccctaagcaagatgtcttacctgcagatgcgcaactctcaggcccaccgaaactttctggaggatggcgagtccgacggatttctgagatgcctgagcttgaattcaggatggatcttgaccacaacactcgtcctttcagttatggtacttctctggatatgctgcgccaccgtagccaccgccgtagagcagtatgttcctagcgaagttaacctatag

SEQ ID NO: 55510 - DNA, 435 bp, Artificial Sequence
  Description of Artificial Sequence: Synthetic coding sequence
atgagtctaatgcccaaaatgcatctgctgttcccattaacactggtcagatccttctggtccgacatgatggacagcgcccagtcctttattacctccagttggaccttttatttacaggcggacgatggcaaaatcgtgatcttccagagcaaaccagagattcagtatgctcctcatcttgagcaggagcccactaatctgcgcgagagctctctgtcaaaaatgtcctatcttcagatgcgaaatagccaggctcacagaaacttcctggaagacggggaaagcgacggtttcctgcgctgtctcagcctgaattccggctggattctcaccacaacactagtgcttagtgtgatggtgctgctgtggatctgttgtgccactgtggccaccgcagtggaacaatatgtcccatccgaggttaacctttag

SEQ ID NO: 55511 - DNA, 858 bp, Artificial Sequence
  Description of Artificial Sequence: Synthetic coding sequence
atggccgctccgaagggttccctgtgggtccgaacccaactcggccttccccctcttctactattaacaatggcactagcaggcggttccggcacagccagcgctgaagccttcgatagtgtcctcggcgacaccgctagctgtcaccgagcttgccagctgacatacccactgcacacttacccaaaagtcagcgcgtccttgtacacagtggatcatattgaagaagagctctatgcctgccagcggggatgcaggttgttttcaatttgccaatttgtcgatgacgggattgatctgaataggacaaagcttgagtgtgaatcagcttgtacagaggcctatagtcaatcggacgaacagtatgcttgccaccttggatgccagaaccagctacccttcgccgaactgaggcaggagcagttgatgtcactcatgccaaaaatgcacctgcttttccccctcacgcttgtaaggagtttttggtcagacatgatggattcagcccaatcttttatcacttcatcctggaccttctaccttcaggcagatgatggaaagattgtcatttttcagtccaaacccgaaatccagtatgcaccacacctggagcaggaacctacaaatctgcgcgaatcaagccttagcaagatgtcttacctacagatgaggaatagccaggcacatcgcaattttcttgaggacggagaatcagatggattcctgaggtgtctcagtctgaattctggatggattttgaccaccactctggtactcagtgtgatggtgctcctgtggatttgttgcgcaaccgtcgctacagctgtggaacaatacgtgcccagcgaggtcaactag

SEQ ID NO: 55512 - DNA, 1029 bp, Artificial Sequence
  Description of Artificial Sequence: Synthetic coding sequence
atggctgcagtggcgctgatgccacctccgttgctacttttgcttctgctggcgagcccccctgcagcatcagctcccagcgccagagatcccttcgccccacagctaggcgacacccaaaactgtcagcttcgttgcagagatcgtgatctgggtccccagccgagccaggctgggctggagggagcaagcgagagtccatatgatcgcgcagttctcataagtgcctgcgaacgtggatgcagactgttcagcatctgcaggttcgtcgctcgcagctcgaaacctaatgccactcaaacggaatgtgaggccgcttgcgtcgaggcatatgttaaagaggctgaacaacaggcgtgctcacacggctgttggagccagccagccgagcctgaacctgagcagaaaaggaaggtgctggaagccccaagtggtgcgttgagtctgcttgatctctttagcactctttgcaatgacttggtcaatagcgcccaggggttcgtttcctcaacttggacctattatcttcagaccgacaacggaaaagttgtggtcttccaaacgcagccaatcgttgagtccctgggctttcaaggcggacgtcttcaacgggtggaggtgacgtggcgtggtagccatccagaggcacttgaggtgcacgtggaccccgtgggacccctggataaggttcgtaaagccaaaataagagtcaagacttcaagtaaagcaaaagttgagtcagaggaaccgcaggacaatgattttctgtcctgtatgagcagaagatcaggtctgccccgttggattttggcttgttgtctttttctaagtgtcctggttatgctgtggctaagttgtagcacgctcgtgaccgcccctgggcaacacctgaagtttcagccgctaactctggaacagcacaagggcttcatgatggagccggattggcctctgtatccaccaccgtcccatgcctgcgaggatagcctacccccatacaagttgaaattggatcttactaaattgtag

SEQ ID NO: 55513 - DNA, 1029 bp, Artificial Sequence
  Description of Artificial Sequence: Synthetic coding sequence
atggcggctgttgccctcatgcctccacccttactgctccttctccttctcgccagtcctccagccgcatcggctccttcggccagagatccgttcgcccctcagttgggggatacacagaactgtcagctgcgatgtcgggatagagatttaggccctcagcccagccaggcaggcttagagggcgcatccgaaagcccctatgacagagctgtcttgataagcgcatgcgagcgaggctgtagacttttctcaatatgtcgttttgtcgcaaggtcaagcaagcctaacgccacacagacggaatgtgaggcagcctgcgtcgaagcttacgtaaaggaggcagaacagcaagcatgttctcacggatgttggtctcagccagccgagccagaacctgaacagaagagaaaggttctcgaggccccatctggagccctctctcttctggacctgttttcgactctgtgtaacgacctggtcaattctgctcagggctttgtcagtagcacctggacctactacttgcagaccgataacggcaaggtggttgtctttcagacccagcccattgtggaatcgctggggttccagggaggacgtctacaacgcgtggaagttacgtggcgcggtagtcatccagaagccttagaggtgcacgtcgacccggtcgggccactggataaggtgcggaaggccaagatccgcgtgaagaccagctcaaaagcaaaggttgagagcgaggagccccaagacaatgactttctctcttgcatgagcagaagaagcggactgccgaggtggatcctcgcatgctgcctcttcttgtcagtcttggttatgttgtggctgtcttgctccaccttagtcacagccccaggtcagcatcttaaattccaaccactgactctcgagcagcacaagggatttatgatggagcccgactggcccctctaccctccaccatcccatgcatgtgaggattcgctgcccccatataaactgaagctggacttaactaaactgtag

SEQ ID NO: 55514 - DNA, 402 bp, Artificial Sequence
  Description of Artificial Sequence: Synthetic coding sequence
atgaggatgtcactggcacagagagtccttttaacctggttgtttacactgttgttcctgatcatgcttgtgctcaaactggacgagaaggcgccatggaattggttcctgatctttatcccagtgtggatattcgataccattctgctcgtccttctgattgtgaaaatggccggtagatgtaaatccggcttcgacccccgacatggatctcacaacattaaaaagaaggcgtggtatctgatagctatgttactcaagctggctttctgtctcgccctctgtgccaaactagagcagttcacaaccatgaacctcagctatgttttcattccactttgggcactcctggccggagcgctaactgaactaggctataatgttttttttgtccgcgactag

SEQ ID NO: 55515 - DNA, 633 bp, Artificial Sequence
  Description of Artificial Sequence: Synthetic coding sequence
atggccctcccacagatgtgcgatggctctcacctggctagcactctgcggtattgtatgaccgtctcaggaaccgttgtgttagttgccggaaccctatgcttcgcgtggtggtcagagggagatgcaaccgcccagccaggccagttggcacctcccactgaatatcctgtgcccgagggcccaagtcccttactgaggtccgtaagttttgtgtgttgtggggctggagggcttctattgctgatcggtcttctgtggagtgtgaaagcctccatacccggaccacctagatgggacccgtatcacttatctcgggacctgtactacttgaccgtggagtcatccgagaaagagtcctgtcgcactcccaaagtggtggacattcctacatacgaggaggccgtatcctttcccgttgccgaggggcctcctacgccacctgcgtaccctacagaagaggcacttgaaccttccggctccagagacgcattgctttccactcagccagcgtggccgcctccctcctacgaatccatctccctggctctcgatgccgtcagcgcggagactacaccctccgctacccgtagctgtagcgggctggtgcaaacagctaggggtggtagttag

SEQ ID NO: 55516 - DNA, 1932 bp, Artificial Sequence
  Description of Artificial Sequence: Synthetic coding sequence
atggctgcggtgttggctctgagggttgtggcagggttggctgctgccgctctggtggcaatgttactggagcactacggcctcgcaggtcagcccagcccactgccgaggccagcacctcccaggcggccacatcctgccccagggccaggcgacagcaatatcttctgggggctgcagatatccgacatccatctttctcggttcagggatcctggaagggcagtggatctggaaaagttttgtagcgagaccatagatatcattcagcccgcacttgtgttagcgactggcgatctgacggacgctaagacgaaagagcagcttgggtctagacagcatgaggtagagtggcaaacttatcagggcatactgaagaaaacacgggttatggagaagaccaagtggctagacatcaagggcaaccacgacgcctttaatattcctagtctagactcgatcaagaactactatcggaaatattctgccgtgcgacgggatgggtcattccattacgtgcactccactcctttcggcaactacagttttatctgcgtcgatgccaccgttaatccgggaccaaagcgcccatacaatttttttggcatactggacaagaagaaaatggaagagttacttttgctcgccaaggagagcagtcggtctaaccacactatttggtttgggcacttcactacctcaacaatacttagccccagtccaggcatcaggtctattatgagctccgcgatcgcttatctctgcgggcacctgcatacactcggcggactgatgccagtgttacacacacggcacttccagggcactttggagttggaggtaggggactggaaagacaaccggagataccggattttcgcattcgaccatgacttattttctttcgccgatcttatattcggcaaatggccagtggtccttattactaatcccaagtcgctgttgtactcttgcggggagcacgaaccgctcgagagactcctgcatagcacccacatcagggtgcttgccttctctctctcttcaatcacgtctgttactgtgaaaattgacggagtgcaccttggccaggccgtccatgtatccgggcctatcttcgtcctgaagtggaatccacgtaattactcttctggcacacacaacatcgaagtaatcgtgcaggacagtgctgggaggtcaaaatctgtccaccacatcttttcagtccaggagaataatcacctgtcttttgatccgctggcatccttcatccttaggactgaccattacataatggccagagtgctctttgtgctgatcgtgctctcgcaacttactattctgatcattttccgatacagaggttatcccgagcttaaggagccgtctggctttatcaacttaactagcttctctctacatgtgctgtccaagatcaatatattttactattccgtgttattgctcaccctgtacacggtgctgggaccctggttctttggcgagatcatcgacggaaagttcgggtgttgtttttcgttcggaattttcgtgaatggccactttctccaaggcagtatcaccttcatcatcggaattctgcagcttgctttctttaacataccactgatggcttatatgtgctggagtttgctgcaaagatgcttcggacataatttcaggtctcacctgcatcaaagaaaataccttaaaatcatgcctgttcatctcctcatgctgctgctctatatttggcaggtttacagctgttacttcctttatgcaacatacggtaccctagctttcctgttttcaccgctccgtacatggctgactctgctgacccccgtgctgattcgttatgtgtggactctaaactctactaagtttggtatatttatggtgcaactaaaatcccatctgagtagctag

SEQ ID NO: 55517 - DNA, 2424 bp, Artificial Sequence
  Description of Artificial Sequence: Synthetic coding sequence
atgatggactcccctttcttagaattgtggcagagcaaagccgtttccatcagagagcaactgggactgggtgatcgacccaatgatagttactgctacaatagcgcaaagaattccactgtgctgcagggtgtgacgttcggcggtatccctactgtgttgctgatcgatgtcagctgttttctgttcctcattttggtgttttcaatcattcgcaggcgcttttgggactacgggaggatcgccctcgtgtccgaggccgactccgaaagcagattccagcggctttcgagtacatccagctcaggacagcaggactttgaaaatgagctcggatgttgcccatggctaaccgcgatctttcggcttcacgacgaccaaatcctggaatggtgtggggaggatgccatacactatctgagttttcagcgacatattattttcctgctggtagtcgtgtctttcttgagcctttgcgtaatactgcccgttaacttgagcggagatctcttagataaggacccatactccttcggaaggacgactattgccaacctgcagacggataatgacctgttgtggctgcacaccatttttgctgtaatctacctatttctaacggtcggttttatgcggcaccacactcaatctatcaaatacaaggaggaaaatctggttaggagaaccctcttcatcacagggctccctcgtgatgcgaggaaagagactgtcgagtcccatttcagagatgcctacccaacatgcgaggtggttgatgtgcagctctgctataacgtggctaagctcatctacctgtgtaaggaaaagaagaaaacagagaaaagtctgacctactacaccaacctccaggtgaaaaccggccagcgcactctgattaatcctaagccgtgtggacagttttgctgctgtgaagtgctggggtgcgaatgggaagatgcaataagctattatacacgcatgaaagaccggctgctggaacgaataacagaagaggagcggcacgtgcaggatcagcccctcggcatggccttcgtaacatttcaagaaaagtccatggctacatatattttgaaggactttaacgcatgtaaatgccaaagtctgcagtgtaaaggcgaaccgcagccgagctcacattcccgagagctatatacttcaaagtggaccgtcacatttgcggcagacccggaggacatctgctggaaaaacttgagcatccagggcctgcggtggtggctgcagtggttgggcatcaattttactctctttctggggctcttttttctcaccactcccagtattattttatccacgatggataagttcaatgttacaaaaccaatccatgcacttaacaaccctattatttctcagtttttccccaccctgctgctctggagcttttctgcactattgccctccatcgtgtactattcgaccttgctcgagagtcactggacaaaatctggcgagaatcagataatgatgaccaaagtgtacatcttcttaatcttcatggtcctcatccttcccagcctaggtcttacatcgctggatttctttttccggtggctctttgacaagacctcctccgaggcctccataaggctggagtgtgtgttcttgccagaccagggcgctttcttcgtgaactacgttatcgctagcgctttcatagggaacggcatggaactgctgaggttaccaggtctcatactttacacctttagaatgataatggccaagactgctgccgacagacgcaacgtgaaacaaaatcaggcctttcagtacgaattcggtgccatgtatgcctggatgctatgtgtctttacagtgattgtggcttactcaattacctgtcctatcatcgcccctttcggactcatctacattctcttaaaacacatggtggaccgtcacaacttgtattttgtctacctgccagcgaagctggagaagggaattcactttgcggcagtcaaccaggcccttgccgcaccaatactgtgtctgttttggctttattttttctctttccttagattgggtatgaaagcgccagctaccctgttcacctttctggtcctgctgttgacaattttggtgtgcttggcccacacatgtttcgggtgctttaaacacctctctcccctgaactacaagaccgaagagcccgcatccgataagggcagcgaggccgaggcccacatgcctcccccttttactccctacgtgccaaggatactgaatggcctggcatcggaacgcaccgccctgtctccacagcagcaacagcagcagacatacggagccatacataacatatcgggcaccattcctggacagtgtctcgcgcagagtgccacgggaagcgttgccgcagccccacaggaagcttag

SEQ ID NO: 55518 - DNA, 357 bp, Artificial Sequence
  Description of Artificial Sequence: Synthetic coding sequence
atgatggacagtccatttctggagctgtggcagtccaaagcggtgagcatccgcgaacagctcggtctgggagacaggcccaatgacagctactgttacaatagtgctaagaacagtactgtgcttcagggcgtcacgtttgggggaatcccaaccgtgctccttatcgatgtgtcttgctttcttttcctgatcttagtgttctctatcattaggcgcaggttctgggactatgggagaatcgcccttgtatcagaagcggactccgagagccggttccaacgtctcagtagtacttcaagttccggccaacaggattttgagaacgaactggggtgctgtccatggctgacttag

SEQ ID NO: 55519 - DNA, 249 bp, Artificial Sequence
  Description of Artificial Sequence: Synthetic coding sequence
atgaaagaccgcctgttagagagaatcacggaggaagaacgacacgtacaagaccagccactggggatggctttcgtcacattccaggagaaatcaatggcaacttatatactgaaggattttaatgcatgcaagtgccagagcctgcaatgtaaaggtgagcctcagccatcgagccatagtagggaactgtatacctccaaatggaccgttacattcgcagcggacccagaagatatctgttggtag

SEQ ID NO: 55520 - DNA, 2499 bp, Artificial Sequence
  Description of Artificial Sequence: Synthetic coding sequence
atgctgcccttcttacttgccacgctcggaaccaccgcactcaacaattccaaccccaaggattactgttacagcgccagaatccggtctacagtgttgcagggattacccttcggcggagtcccgactgtgctcgccctggatttcatgtgttttcttgccctgcttttcctcttttcaattctcagaaaagtggcttgggactacggacgattagctctggtgactgatgctgatcgcctgagaaggcaggagcgcgatcgagtggagcaggagtacgtggcatccgcaatgcacggtgatagtcacgaccggtacgaaaggttgacttccgtctcaagcagcgtggatttcgaccagcgtgataatggtttctgctcctggctaacggcaatttttcggattaaagacgacgagatcagagacaagtgtggtggagatgccgttcactatctgtcgttccagcgacacataatagggctgctggtggtcgtcggggtattgagcgtggggattgtcctgcccgtgaacttctcaggcgacttgttggaaaacaacgcatattcattcggacgcaccacaatagccaacctgaaaagcggaaataacctgttatggctccacacttcgttcgctttcctttatctgctccttactgtgtatagcatgcggaggcacactagcaagatgagatacaaggaagacgacctggttaaacgtactcttttcatcaacggcattagcaaatacgcggagtcagagaagatcaagaagcacttcgaagaagcttatcccaactgtaccgtactcgaggccagaccctgctataacgtggccagactcatgttcctcgacgcagagcgaaaaaaggccgaaagaggcaaactatattttactaacctgcagagcaaggagaacgtcccaaccatgatcaaccccaaaccctgcggccacttgtgctgctgcgtggtaagaggatgcgaacaggtggaagctattgaatattacacaaaacttgagcagaagctgaaagaggactataagagagaaaaggaaaaggtcaacgaaaaacctctgggtatggcttttgtgacttttcacaatgagacaatcacagctatcatcttgaaagacttcaacgtgtgcaaatgccagggttgcacctgtaggggagaacccaggcctagcagctgctccgagagtctgcatatctctaattggactgtgtcatatgcaccagaccctcagaacatctattgggagcacctaagcatcagaggctttatctggtggctcagatgcctcgtcatcaatgtcgtgctgttcatccttctgttcttccttacaactccagccattattatcactacaatggacaaattcaacgtgaccaagccagtcgaatatcttaataatccaatcattactcagttttttcccaccctgttattatggtgtttcagcgccttgctgcctaccatcgtatattacagcgctttcttcgaggcccactggacacgttccggcgaaaaccgtacaactatgcataagtgttacaccttcctgatttttatggtactcctcctcccgtccctaggcctgagttccctggacctctttttccggtggctgtttgataagaaattcctcgccgaagcagccatccgcttcgagtgcgtgtttcttccagataatggggcattttttgttaactatgtgatcgcgtctgcatttattgggaacgcgatggacctcttacgaatccccggactcctcatgtacatgatacgactttgcttagccagaagcgcggctgaaagaagaaacgttaagcggcaccaggcttatgaattccagtttggcgcagcctatgcctggatgatgtgtgttttcacagtagtgatgacatactccatcacttgtcccataatcgtcccctttggcttgatgtatatgctcttgaaacatctggtcgatcgatacaacctgtattacgcctaccttccagctaaactcgacaagaaaattcactcaggtgccgtgaaccaggttgtggccgcaccaatcctatgccttttttggctgctgttcttttccaccatgaggacaggattcctcgcgcctaccagcatgttcactttcgttgtccttgtgatcaccatcgtgatatgtctgtgtcatgtttgctttggacacttcaagtatttgtccgcgcacaattataaaattgaacacaccgaaacagatacagtggatccaaggagcaatggacgaccccctacggcagccgctgtgccaaaatccgccaagtatatcgcccaagtgctgcaggattcggaggtcgatggggacggggacggcgcacccggatcatccggagatgaacccccttccagttcgtctcaggatgaggagctgcttatgccccctgacgccctgacagataccgatttccagtcatgtgaggattcactgatagagaacgaaatacatcaatag

SEQ ID NO: 55521 - DNA, 2499 bp, Artificial Sequence
  Description of Artificial Sequence: Synthetic coding sequence
atgcttccctttctcctggctacgctagggacaaccgccctgaataattctaaccctaaggactactgttacagtgcaagaattaggtccacggtccttcaaggcctgccttttggcggtgtcccaacagtcctggctctcgatttcatgtgtttcctggccctgcttttcctgttctctattctgaggaaggtcgcatgggactatggccgactggccctcgtaactgacgctgaccgactacgcagacaggagcgggaccgggtggagcaggaatatgttgcttccgcgatgcatggagattctcacgatagatacgaacgcctcacatctgtgtctagctcagtggactttgaccagcgtgacaacggcttctgcagctggctgacagccatctttagaattaaagatgatgaaatcagagataagtgtgggggagacgcggtgcactatctgtccttccaaaggcacatcatagggctactcgtcgtggttggagttctgagcgttggaatagtgcttcccgtcaatttcagcggcgatttgcttgagaataatgcatactctttcggccgaaccaccatcgctaacctgaaaagtggaaataatctcctgtggctgcatacatcatttgcattcttgtacctcctcctcacagtgtactcaatgcgccgtcatacgtcaaaaatgaggtataaagaagacgatctggtcaaaaggaccctctttatcaacgggatctctaagtatgcagaatccgagaagatcaaaaagcattttgaggaggcatatccaaattgcacagtgctggaagcccgtccttgctataacgttgctcggctcatgtttctggatgccgaaagaaaaaaggcggaacgcggaaagttatactttacaaacctccagagcaaggaaaatgttccaaccatgataaatcccaaaccatgcggccatctgtgctgctgtgtggtgcgcggatgcgaacaggtcgaagctatcgaatattacactaagctcgaacagaagctgaaggaggactataaacgcgaaaaagagaaggtcaacgaaaaaccacttggcatggcatttgtgacattccacaatgagactatcacagctattattctgaaggactttaatgtgtgtaaatgccagggttgtacttgccgtggcgagccccgtccttccagctgtagcgaatccctgcacatctctaactggacagtaagttacgcaccagatccccagaatatctattgggaacatctgagtatccgaggcttcatctggtggctgagatgccttgtgatcaacgtcgtcctgtttatcctcctgttctttctgacaactcctgccataataataaccactatggacaagttcaacgtcactaagccggtggagtacctcaacaaccccataattacacagtttttcccgaccctcctcctctggtgtttcagtgccttgctgcctacaatcgtttattactctgctttctttgaagcccactggacacgcagcggggagaatcggacaaccatgcacaagtgttacactttcctcatttttatggttctgctcctcccaagcctgggtttatcatctttagaccttttctttcgctggttattcgataaaaagttcctggcggaggcagcaattcgttttgagtgtgtctttctgcctgataatggcgcttttttcgtaaattacgtgattgcttctgcctttatcgggaatgccatggatctccttagaatcccagggctcctcatgtacatgatccggttatgccttgctagatccgcagctgagcgcagaaatgtaaagagacaccaagcctacgagtttcagttcggggctgcctacgcctggatgatgtgcgtctttaccgtcgtcatgacttactctattacctgcccaattatcgtcccgttcggcttgatgtatatgttgcttaagcatctggtcgaccgatataacctttactatgcctatctgccagctaaactcgacaaaaagatacactccggtgccgtgaatcaggtggtcgctgctccgattctctgccttttctggctgctattctttagtacaatgaggacagggtttctggcccctacttcgatgttcaccttcgttgtgctcgtgataaccatagtgatttgcctttgccatgtttgctttggccactttaagtacctctccgcacacaattacaaaattgagcataccgaaacggacactgtggatcccagatctaacggcaggcccccaactgcagccgctgtccccaaatccgctaagtacatcgcccaggtgcttcaggatagcgaagtagatggggacggagatggtgcccctggaagctcaggagatgagcctccaagctcgagctcccaggacgaagagttactgatgccgccagatgccctaacggacactgatttccagtcttgcgaggacagcctgattgaaaatgagatacaccagtag

SEQ ID NO: 55522 - DNA, 681 bp, Artificial Sequence
  Description of Artificial Sequence: Synthetic coding sequence
atgctgccttttttgctggccactctgggcactacagccttgaataattctaatcctaaggattactgttacagcgcacggatacgttccacagtgttgcagggactgcccttcggcggagtgccgaccgttctggctctggattttatgtgcttcctggccttgctgttcctattttccatactgaggaaagtcgcgtgggactatgggaggctcgcattggtgaccgatgccgacagacttcggaggcaggagagggatagagtggagcaagaatacgtcgcctccgccatgcatggggatagccatgatagatatgaacgtttgacatccgtgagcagcagcgttgatttcgatcagcgggacaatggcttttgctcttggctgactgccatttttcggatcaaagacgatgagattagggataaatgcggtggcgacgcggtgcattatctgtcgtttcaacgccacattatcggactcctggtggttgtgggcgtactgtccgtaggcattgtgctaccagtgaacttttccggagacctgctggaaaacaacgcatactcgtttgggaggacgaccattgcaaacctgaagagcgggaataacctcttgtggctccacacctctttcgccttcttgtacctcctgctgacagtgtattcaatgcggagacattag

SEQ ID NO: 55523 - DNA, 2421 bp, Artificial Sequence
  Description of Artificial Sequence: Synthetic coding sequence
atgagcgcttctcccgatgatttgtctacgggaggaaggctccaaaacatgaccgtggatgagtgttttcaatcccgcaacacggttcttcaggggcaaccatttggtggagtcccaaccgtgctgtgtttaaacatcgccttatgggttttagtactagtcgtgtacagcttcctgcgcaaggcggcatgggattatgggagactggccctgttaattcacaatgacagtctgactagcctgatctacggggagcagagtgagaaaaccagtccttcagagacatctctagagatggaacgaagagataaggggttctgcagctggtttttcaactccattactatgaaagatgaagatctgattaataaatgcggtgacgacgctcgcatctacatcgtttttcagtatcacctgattatcttcgttttgatcatctgcattccctccctgggcataatcttacccattaactacaccggatccgtcttagattggtcatctcatttcgccaggacaacgatcgttaacgtgtcaacagaatccaaactcctgtggctacattctttactctcttttttttacttcatcaccaactttatgtttatggctcatcattgcctggggttcgccccaagaaacagccaaaaggtcacgagaaccctgatgatcacttacgttccaaaggacatcgaggacccagaactgattattaaacatttccacgaagcctatccagggagcgttgtgacaagggtgcatttttgttacgacgtgaggaacctgattgacctcgacgatcaaagaaggcacgcgatgagagggaggcttttctacaccgccaaggccaagaaaaccggtaaggtgatgattcgaatacacccctgtgcgcgtctgtgcttttgcaaatgctggacttgttttaaggaggtggacgcagagcaatattactcagaattggaggagcaattgaccgatgaattcaacgccgaattgaaccgggtgccgcttaaacgtctcgatcttatctttgtcacatttcaggactcacgaatggctaaaagagtaaggaaggactataagtacgtccagtgcggtgtgcagccccagcagtcatcggtgaccacaatcgtgaagtcctactactggagggtcactatggccccacatcctaaagatatcatctggaaacatctgtcagtccgaaggttcttctggtgggcgcgattcatcgcgattaacacctttttgtttttcctcttcttttttctgacaacccctgccattattatgaataccattgatatgtacaatgtgacccgaccaatcgaaaagctgcagaacccgatcgtgactcagtttttcccctcagtgatgttatggggttttactgtgatcctccccctaatagtttatttttccgcgtttctggaagcccattggactcgctcatctcaaaatctcgtgatggtgcataaatgctatatctttttggtttttatggtcgtgatcctgcccagtatgggccttacatctttggatgtttttctgcggtggctgtttgatatctactatctggagcaagcctcaattcgctttcagtgcgtgtttttgccagacaatggggcatttttcgtcaactacgttattacagccgctctgctcggtaccggaatggagctgctcaggctaggctcactgttctgttacagcacgcgtctgttctttagccgctccgagcccgagcgggtaaatatccggaagaatcaggctattgacttccagtttggcagggagtacgcgtggatgatgaatgttttcagcgttgtgatggcttacagcatcacttgtcctatcatagtgccttttggcttattgtatctgtgtatgaaacatcttacagatcgctataacatgtattattcttttgcccctacaaagctgaacgagcagattcacatggcggcagtgagccaagcaattttcgcgcctctactggggctgttttggatgcttttcttcagtatcttacgcctggggtctttgcacgccattacaattttctctctgtccacccttctaatcgcgatggttatcgcatttgtgggcatctttctgggtaagctgagaatggtagcggactacgaacccgaggaagaggagattcaaaccgtatttgacatggaaccctcaagcacatcctccacaccaacatccttactctacgtggctaccgttttacaagagccggaactgaacttgactccagccagcagcccagctcgacacacatacggaacgatgaacaaccagcctgaggagggggaggaggaaagcggactgaggggcttcgcacgcgagctggatagcgcgcagttccaggaagggctggaattggagggtcagaaccagtaccattag

SEQ ID NO: 55524 - DNA, 1131 bp, Artificial Sequence
  Description of Artificial Sequence: Synthetic coding sequence
atgaacacgattgatatgtataatgtaactaggccaatagaaaagctgcaaaatccaatagtgacacagttctttccaagcgtgatgctgtgggggtttaccgtgatcctccctctgattgtttactttagcgctttccttgaggcacattggacaaggtcctctcagaacttggtgatggttcacaaatgctatattttccttgtgtttatggtggtaattctcccttccatgggcctcacctctctcgatgtgttccttcgctggctctttgatatctactatttggaacaagcctcaatacgcttccaatgcgttttcctgcccgacaatggtgcctttttcgtgaactatgtcattaccgccgcacttcttggaacggggatggagctgttacggctgggcagcctcttttgttactctaccagactcttcttttctcgttcagagcctgagagagtgaatataaggaagaaccaggcgatcgatttccaatttggccgtgaatacgcatggatgatgaatgtatttagcgtggttatggcctacagcattacttgcccaatcatcgtaccattcggtctgctttatctctgcatgaagcatttgacggaccgatataacatgtactattcgttcgcccctacaaaactcaacgagcaaatccacatggcagctgtgtctcaagccatttttgcccctctcttagggttgttttggatgttattcttcagtatcctgcgtcttggttccctacatgccatcactatctttagtctatccacccttcttatagccatggtgattgcatttgttggtattttcctgggcaagctaagaatggttgcagattacgaacctgaggaagaggagattcagacagttttcgatatggagccatcgagcactagctcaacccccacctctcttctgtacgtggccaccgtgctgcaggagccggaactcaacctgacccctgcttcttctccagccagacatacatatggcaccatgaacaatcaacccgaagagggagaagaagagagtggtctccgtggcttcgcgagagagttagacagcgctcaatttcaggaagggctggagctggagggacagaaccagtaccactag

SEQ ID NO: 55525 - DNA, 153 bp, Artificial Sequence
  Description of Artificial Sequence: Synthetic coding sequence
atgagtgcctctcccgacgacctttccaccggaggcaggcttcagaatatgaccgtcgacgagtgcttccagagcagaaacaccgtgttgcaaggacagcccttcggaggcgtgcccacagttctgtgcttgaatattgccctttgggtgtag

SEQ ID NO: 55526 - DNA, 495 bp, Artificial Sequence
  Description of Artificial Sequence: Synthetic coding sequence
atgtctgctagtcctgatgacctgagcaccggaggacgactacagaatatgaccgtggatgagtgcttccagtcccgtaacaccgtgttacaagggcagccgttcgggggagtgccaactgtgttgtgcctcaacatcgccttgtgggtgttggtcctcgtcgtgtacagtttcttacgtaaggcggcttgggattatggacgactcgccctgctgattcataatgattctctcacatccttgatatatggtgaacaatccgaaaagaccagcccaagtgaaacctcacttgagatggaacgccgagacaagggcttctgtagctggttttttaactctatcactatgaaagatgaggatttgatcaataagtgtggggacgatgctaggatttacattgtgtttcaataccatttgatcatcttcgttcttatcatctgcataccctcactagggatcattctccctatcaactataccgggagcgtcttgtag

SEQ ID NO: 55527 - DNA, 156 bp, Artificial Sequence
  Description of Artificial Sequence: Synthetic coding sequence
atgagtgccagccctgacgacttgagcacaggcggacggcttcagaacatgactgtggacgaatgcttccagagtaggaacacagtgctgcagggtcagccgtttggcggagtgcccactgtgctatgccttaacatcgcactctgggtcctctag

SEQ ID NO: 55528 - DNA, 111 bp, Artificial Sequence
  Description of Artificial Sequence: Synthetic coding sequence
atgtcagccagccccgatgacctcagcactggcggtaggttgcaaaatatgacagttgacgagtgctttcaaagccgtaacacagttctgcagggccagccttttgggtag

SEQ ID NO: 55529 - DNA, 72 bp, Artificial Sequence
  Description of Artificial Sequence: Synthetic coding sequence
atgtccgcctccccggacgacctttcaacaggtggccgattgcaaaacatgacggttgatgaatgtttttag

SEQ ID NO: 55530 - DNA, 987 bp, Artificial Sequence
  Description of Artificial Sequence: Synthetic coding sequence
atgcggagtcctgggggaatactgctgcaggcccttcctcgtttgcttcaacacgcggcattaccagggctcgccgaactgccagcacgttgggcattgcctagaggcgctggcggagacggacctgcagatcggctcccacggggaggcggagccagcgccgctgcagcagcagctgccgcttctggggctttgctgggcgcttatttggaaaggcacgggccacctgaagcatctgaactcccagagcctggcggtgccctggctggcggacctgggtccggaggcggtggagtggtggtgggcgtagcggaagtgcgtaattggcgatgttgctgcctcggctcgacctgctggtgtagatcgttggtgctcgtctgtgtgttagccgctttatgctttgcctcgctggccctcgtcaggcgctacctgcatcacctgctcttgtgggtggagtccctcgatagcctattgggagtactgttatttgtggtaggtttcattgttgttagtttcccttgtggctggggatacattgtgcttaacgttgctgctggatacctctatggatttgtgctgggcatggggttgatgatggttggtgtgctgattggaactttcattgcccacgttgtgtgcaaaaggctgctgactgcatgggtagcagctaggatacagagctcggagaagttgagcgcagtgattcgcgtggtggaaggcggaagtggactgaaggtagtggccttagctcggttaacaccaatccctttcgggctccagaatgccgtctttagtatcatcattagcataggcctcatgttttatgtggtgcaccgggctcaagtagagcttaatgctgctatagtagcctgcgagatggagctcaaatccagcctggtcaagggtaaccagccaaatacttcaggcagttcgttttataataaacggaccttaacttttagcggtggcggaattaatgtagtctag

SEQ ID NO: 55531 - DNA, 1143 bp, Artificial Sequence
  Description of Artificial Sequence: Synthetic coding sequence
atgcgatctcccggaggcattttgctccaggctcttcctagattactccaacatgcagctttacctgggctggccgagttaccagcacggtgggctttaccgaggggagccggtggcgacggccctgccgacagattgcccagaggcggtggagctagcgctgctgccgctgcagcagccgcatctggagccctgcttggagcttatctggaacgccacgggcctcccgaggcctctgaactgcccgaaccaggcggagcactggcaggcggaccaggaagcggagggggaggagtggtggttggagtcgctgaggttcggaactggcgctgttgttgtctgggcagcacctgttggtgcagatcactcgtcttggtgtgtgttttagccgctctgtgcttcgcctctcttgccctggttcgacgctatctccatcacctgctgttatgggtggagtccctggatagcctcctgggtgtcttgctgttcgttgtggggtttatagtggtctctttcccctgcggatggggctacatcgtgttgaacgtggcagccggttacctctacgggtttgtcctgggaatgggcttgatgatggtgggagtcctgatcggcaccttcatcgcacatgtggtctgcaagagactgctgactgcctgggtggccgcacgaattcaatcgtcagagaagctttccgccgtaatcagagtcgtcgaaggtgggtccggactaaaggtggtggcgctggctcggttgacccccattccttttggccttcagaacgctgtgttctccattacagacctgtcactgccaaattacctcatggcctcttctgtgggactgctgccaacacagctactgaattcttatctgggcacgactctgaggaccatggaggatgtaatcgccgagcaaagcgtctccggttacttcgtgttttgtctccagatcatcatttctatagggttgatgttctacgtagtacatagagcgcaagttgaactcaacgcagcaattgtggcctgtgaaatggaactaaaatcaagcctggtcaagggcaaccaaccaaataccagcggcagctctttttataacaagagaaccctcaccttctctgggggagggatcaatgtggtgtag

SEQ ID NO: 55532 - DNA, 360 bp, Artificial Sequence
  Description of Artificial Sequence: Synthetic coding sequence
atgccacctagaatcacagatctgtcattgcccaactatcttatggcttcatcagtgggtcttctgcctacgcagctcctaaattcttacctgggcaccactctgagaactatggaggatgttattgccgaacagagcgtttccgggtactttgtgttttgtctgcagattattatttccataggcctcatgttttacgtagtacatagagcacaggtggaactcaatgccgctatagtggcatgtgagatggaactaaagtcttcgcttgtaaagggtaatcagcctaacacaagcggaagtagcttctataacaagcgcaccctcactttctctggcggaggcatcaatgtcgtctag

SEQ ID NO: 55533 - DNA, 156 bp, Artificial Sequence
  Description of Artificial Sequence: Synthetic coding sequence
atgcctcctagaatcacagatttaagcctgcctaactatctgatggcctccagcgtcggattgttgcccacacagctgcttaattcttacctaggaaccaccctcaggacaatggaggacgtcattgctgaacagagtgtgtcaggatacttctag

SEQ ID NO: 55534 - DNA, 723 bp, Artificial Sequence
  Description of Artificial Sequence: Synthetic coding sequence
atgtcaaggttgctgccacttttgcgctctagaactgctagatcactccggccaggccctgctgctgcagcagccccacgcccacccagctggtgttgctgcggacgcggactattggccctagcacctccgggtgggctgccaggaggacctcgcaggctgggaacacatcccaaaaaagaaccaatggaggctcttaacaccgcccagggagctcgcgattttatctactccctccatagcacagagcgaagttgcctgttgaaggaactgcaccggttcgagagtatcgcaatcgctcaggaaaaactcgaggctcccccacccacaccaggccaactgagatatgtgttcatccataatgctatcccgtttataggctttggatttctcgacaatgcgataatgatcgtcgcaggcactcatatagaaatgtcaattggcatcattttgggaatttccaccatggctgctgcagccctgggcaatcttgtatctgatcttgcagggctcggcctcgccggttacgtggaagcgctggcttcaagattggggctgtctatccctgatctcacaccaaagcaggtagatatgtggcaaactagactgtcaacacatttagggaaggcagtgggagtcacaatcggatgtatcctaggcatgtttcctttgatctttttcggcggtggggaggaggacgaaaaactggaaactaaatcatag

SEQ ID NO: 55535 - DNA, 1020 bp, Artificial Sequence
  Description of Artificial Sequence: Synthetic coding sequence
atggcagcggcttgcggtccaggcgctgccggatactgtctgcttctgggcttgcatctgttccttctgacagccggacccgctttaggatggaacgatcccgacaggatgctcttgcgcgatgtgaaggccctgaccctgcattacgaccggtacaccacctccagaagattggaccccataccccagctgaagtgcgttggtggaactgcaggttgcgattcctacacccccaaggtcatccagtgtcaaaataagggctgggacggctacgatgtgcagtgggaatgtaagaccgaccttgacatcgcgtacaagtttgggaaaaccgtggtatcttgcgaggggtacgagtcatctgaggaccagtacgtgctgagggggtcctgcggactggaatataatctagactatacagagttgggactccagaagctgaaggagagcggtaagcagcacggcttcgcatcattctcagattattattataagtggtcatctgccgattcttgtaacatgagtgggctgattacgatagttgtcttactcggaatcgcctttgtagtgtacaagttgttcctgtccgatggacaatacagtcctcctccatacagcgaatatccacccttctctcatcggtatcagaggttcaccaattccgccggaccacccccacctggctttaagtctgagtttacaggcccacagaacaccggccatggcgcaacttccgggttcggctccgcctttacggggcaacagggctacgagaactctggcccaggcttttggaccggcctgggtaccggcggaatcttgggttacttgtttggatcaaatcgggctgccactccttttagcgatagctggtactatccttcataccctccatcttaccctggaacgtggaatcgcgcatactctccactacatgggggaagcgggtcatattccgtgtgttctaattctgacactaaaactcgcacggcatccggctacgggggaacccggaggcgatag

SEQ ID NO: 55536 - DNA, 504 bp, Artificial Sequence
  Description of Artificial Sequence: Synthetic coding sequence
atgagtggtctgatcacaatagtggtgttgctcgggatcgcatttgtggtgtataaattgtttttgagcgacgggcagtattctccccctccatacagcgagtacccccctttctcccatagatatcagcggttcacaaacagtgccggaccacccccacctgggtttaagtctgagttcacaggccctcagaatacaggccacggcgcaacttctggctttggatccgcctttacgggacagcagggatacgaaaatagcggtcctgggttttggacagggcttgggacgggtggaatcctcgggtatctgttcgggagcaacagagccgcaaccccgtttagtgactcgtggtactacccctcatatcccccaagctatcccggaacatggaatcgcgcatatagccccttgcacggcggatctgggtcctactccgtctgctctaattccgacacaaagacccgaaccgcctccgggtacggagggacgcggcgtcggtag

SEQ ID NO: 55537 - DNA, 912 bp, Artificial Sequence
  Description of Artificial Sequence: Synthetic coding sequence
atgctgttacgggatgtcaaagccttaactctccattacgatcggtacaccaccagtcgaaggctcgaccctatcccgcagctaaagtgtgtgggcggtactgctggatgtgattcctatacccctaaagtaatccagtgtcaaaacaaaggatgggatggctatgacgtacagtgggagtgtaagaccgacctcgacattgcatataaattcgggaaaaccgtggtatcttgtgagggctacgaatccagtgaagaccagtacgtcctcaggggcagctgcgggcttgagtacaatctcgattacaccgagttgggactccagaaactgaaagaatcaggtaaacagcacggttttgcttctttctctgactattactataaatggtcctccgcggatagctgtaacatgtccgggctcatcactatcgtagtcctgctcggcattgccttcgtggtttataaactatttttatcagatggccaatactcaccacctccctattccgaatacccaccgttctctcatcggtaccagcggtttacaaattctgctggaccccctccccctggcttcaaatcagaattcaccggacctcagaacacgggtcatggagctacaagcggatttggtagcgcgttcactggtcagcagggatacgagaattcgggacctggattctggactgggctgggtaccggcggtatccttggctatctgttcggcagtaacagggctgcaacccccttttcggactcctggtactaccccagctatcccccttcatatcccggaacctggaaccgggcatactctccactgcacggagggtccggatcttatagtgtatgcagtaatagcgacacaaagacaaggacagcctctgggtatgggggtacaaggcgcagatag

SEQ ID NO: 55538 - DNA, 504 bp, Artificial Sequence
  Description of Artificial Sequence: Synthetic coding sequence
atgtcaggccttattactatagttgtgcttctggggattgcgtttgtcgtctataagctgttcctgtctgacggtcaatactctccaccaccttactctgagtaccccccattcagtcaccgctatcaaagatttacaaacagcgcagggcctcccccacctgggttcaaaagcgagttcaccggaccacagaatacgggacacggggctacgtcaggcttcggcagtgcgtttaccggacagcaaggttacgagaattctggcccaggcttctggaccggcctgggaaccggagggatactgggctacctgttcggcagcaatcgggctgccacacctttcagcgactcctggtactatccgtcctaccctcccagctatccaggcacatggaatagggcctacagccctctgcacggaggctctgggagctattcggtctgcagcaactcagatacgaagaccagaactgcaagcggatatgggggaaccagacgcaggtag

SEQ ID NO: 55539 - DNA, 774 bp, Artificial Sequence
  Description of Artificial Sequence: Synthetic coding sequence
atgattgacaaaaaccaaacatgtggggttggccaagattctgtgccctacatgatctgtctgattcacattttggaggaatggtttggcgtcgaacaattggaggattatcttaacttcgctaactatctgttgtgggtcttcactcccctgattctcctcatactgccatactttaccatcttcctcctgtacttaacaatcattttcctgcacatttacaaacggaaaaatgttctgaaggaggcgtatagtcacaacttgtgggacggcgctcgcaaaacggtggcaacactctgggacggacacgcggcagtctggcacggatacgaggtgcatggcatggagaagattcctgaagatggccctgccctgatcatcttctatcacggagctatcccgattgatttttactatttcatggcaaaaatctttatacataagggcagaacttgtagggtggttgcagatcacttcgtatttaagatcccaggatttagcctgctgcttgacgtattttgcgctctgcacggccctagggaaaaatgtgttgagatcctgcgctcaggccacctcttggctatttcacctggcggtgtccgcgaagccctcatctccgacgaaacatacaatatagtgtggggacatcgcagagggttcgctcaggtagcaatagatgcaaaagtgacaaagaatgctgtacaagctctgatcgataagcatcagcgaattcccggaaacatcatgtctgccctgctcgaaagatttcactag

SEQ ID NO: 55540 - DNA, 975 bp, Artificial Sequence
  Description of Artificial Sequence: Synthetic coding sequence
atgattgacaaaaaccagacatgcggagtgggacaggactccgtgccatatatgatctgtcttattcatatcctggaagaatggtttggagtggagcagctggaagattatctgaacttcgcaaattatctgctgtgggtgttcacacctctaatcctgttgattcttccctattttacaattttcctgctatatctaactatcatcttcctgcacatctataaaaggaagaacgtacttaaggaagcctacagccacaatttatgggacggtgctaggaaaactgtcgccaccctatgggacggacacgctgctgtgtggcacggttatgaagtgcacgggatggaaaagatccccgaggacggtcctgccctcatcatattctatcacggagccatccctattgatttttactatttcatggcgaagatttttatacacaaaggcaggacatgtcgcgtggtagccgaccacttcgtcttcaaaatcccaggattctctctactgctagatgttttttgtgcgcttcatggtcctagagaaaaatgtgtcgaaatccttaggtccggccatctgctggccatatcaccagggggtgtgagggaagctctcattagcgacgaaacctacaacatcgtctggggacatcgcagaggattcgcacaagtcgccatcgacgcaaaagtgcccatcatccctatgtttactcagaacatccgggaagggtttaggagtctgggcggaacacgcttgttcaggtggctttacgaaaaattcaggtatccatttgcccctatgtatggcggatttcccgttaagttgcgcacctaccttggcgatcccataccatatgacccacaaattaccgcggaggagttagcagaaaaaacaaaaaatgccgtgcaagcattgatcgacaaacaccagagaatccccggaaatatcatgtctgcccttctagagcgtttccactag

SEQ ID NO: 55541 - DNA, 381 bp, Artificial Sequence
  Description of Artificial Sequence: Synthetic coding sequence
atgattgataaaaaccagacctgtggggttgggcaggactctgttccttatatgatatgcctgattcacattctggaagagtggttcggcgtcgagcaattagaggactatctaaacttcgccaattatcttttatgggtgtttactccactgatcctccttattttgccttactttactatttttttactgtatctaacaattattttcctccacatctataagcggaagaacgtactcaaagaggcctactcccataacttgtgggatggcgcaagaaagaccgtcgcgactctgtgggatggtcatgctgccgtctggcatggctatgaagtccacggaatggaaaaaatacccgaggatgggccagcattgatttag

SEQ ID NO: 55542 - DNA, 408 bp, Artificial Sequence
  Description of Artificial Sequence: Synthetic coding sequence
atgatcgacaaaaatcagacatgcggagttgggcaggattcagtcccctacatgatctgccttatccacattctcgaggagtggtttggcgtggaacagctcgaggactacctgaatttcgccaactacctgctgtgggtctttacacctttaatactgttgattctgccctactttaccatctttctgttatatcttactatcatctttctgcacatctataagcgaaagaacgtgctaaaagaggcttattctcataatttgtgggacggagctcgaaagaccgttgccacactctgggacgggcatgccgctgtgtggcatgggaaacagggctactttcatctgtgcgttgctattcatgtatgctgcattgggaccgtactaccattccatttcatagactag

SEQ ID NO: 55543 - DNA, 732 bp, Artificial Sequence
  Description of Artificial Sequence: Synthetic coding sequence
atgatcgataagaaccaaacatgcggcgtcggtcaggactctgtaccatacatgatttgcctgatccacatcctcgaggaatggttcggcgttgagcaactggaggactatctgaacttcgccaattacctactctgggtttttactcctctgattcttctgattctgccatattttacaattttcctgctttacttgacaatcatttttttacacatttataagagaaagaatgtgctgaaagaggcctattctcacaatctgtgggatggggctaggaagacagtggcaaccctgtgggatggccacgctgccgtctggcacgggtatgaggtccatggcatggagaaaatccctgaagatggcccagcattgattatcttttaccacggggcaatccccatcgatttctactattttatggcaaagattttcattcataagggaaggacgtgccgggtggtagccgatcactttgttttcaagatccccggatttagtcttcttctggacgtattctgcgctctacatggcccacgggaaaaatgcgtcgagatcctgcggagtggtcacctgttagctatttcaccaggcggagtgcgcgaggcactgatctctgatgaaacctacaatattgtctggggccatcgaaggggcttcgctcaggttgctattgacgccaaggttccaattatcccgatgtttacacagaatattagggagggcttttag

SEQ ID NO: 55544 - DNA, 408 bp, Artificial Sequence
  Description of Artificial Sequence: Synthetic coding sequence
atgattgataagaatcagacttgtggcgtcggacaggatagcgtcccatacatgatttgcctaattcatattttagaggaatggtttggcgtggaacagctagaagactatctgaatttcgctaattacttgctgtgggtattcaccccactcatcctgctaatactgccatactttactattttccttctttatttaaccattattttcctccacatttacaagcgaaaaaacgtgctgaaggaggcctactcccataatctatgggacggcgctcgaaaaacggtcgcgaccttgtgggacgggcacgctgctgtttggcacgggaagcaagggtatttccacctgtgcgtcgccatccacgtgtgttgcatcgggacagtgcttcccttccatttcattgactag

SEQ ID NO: 55545 - DNA, 9 bp, Artificial Sequence
  Description of Artificial Sequence: Synthetic coding sequence
atgatatag

SEQ ID NO: 55546 - DNA, 495 bp, Artificial Sequence
  Description of Artificial Sequence: Synthetic coding sequence
atgatcgacaagaatcaaacatgtggtgtgggccaggactccgtcccttacatgatctgtttaatacacatcctcgaagagtggttcggcgtcgagcagcttgaggactatctcaatttcgcaaactacctactgtgggtttttactccactgatcctactcatcctgccatacttcactatttttctgctgtacctgactattatttttctgcacatttacaagcgtaagaacgtcctgaaggaagcttacagccacaatctctgggacggggctagaaaaacggtcgcgactctgtgggatggacacgcagccgtttggcacggctatgaggtgcatgggatggaaaagataccagaagacggtcccgctctcattatcttctatcatggggcaatacccattgatttctactatttcatggccaaaatctttatccataaggggaggacatgtcgggtagtggcagatcacttcgtgttcaagatcccctag

SEQ ID NO: 55547 - DNA, 276 bp, Artificial Sequence
  Description of Artificial Sequence: Synthetic coding sequence
atgtttacacagaatatccgggagggcttccgtagtttgggcggaaccagactctttagatggctgtatgaaaagttcagatacccgttcgccccaatgtacgggggattcccagtaaagctgcgcacttacctgggtgatcctatcccttatgatcctcaaattacagccgaggagctcgccgaaaaaactaaaaacgccgtccaggcactgatcgacaagcaccaaagaatcccgggtaacatcatgtccgcgctgcttgaaagatttcattag

SEQ ID NO: 55548 - DNA, 744 bp, Artificial Sequence
  Description of Artificial Sequence: Synthetic coding sequence
atgttgaggtttattcagaaattttcccaagcatcttccaaaattttaaaatattccttcccggtggggttacgcacttcccggaccgatatcctgtcactaaagatgtcactgcagcagaattttagcccatgccctcgaccctggctgagtagcagcttcccggcttacatgtctaaaactcaatgttaccatacctccccgtgttcatttaaaaagcagcaaaagcaagctctgctggctcggccttcttctacaatcacctatctcactgatagccccaagcctgcactgtgcgtgacactggctggcctgataccatttgtggcacctccgctcgtcatgttgatgaccaagacatacataccaattctagctttcacacagatggcctacggagcctctttcctgagcttcctcggcggaatccgttggggatttgcgctccctgagggctccccagccaagcccgactacctaaatctggcttcatcagccgcaccactgttcttttcatggttcgcctttttgataagtgagcgtctgtccgaagccatcgtcacagtaatcatgggcatgggagttgccttccaccttgaactctttctgctgccacattatcctaattggtttaaggctctacgaattgtcgtgacccttttggcaacttttagcttcatcattacgctcgtggtaaagtctagcttcccggaaaaaggccacaaacgcccaggacaagtgtag

SEQ ID NO: 55549 - DNA, 828 bp, Artificial Sequence
  Description of Artificial Sequence: Synthetic coding sequence
atgcagttgcaggtgttctggacagggctcgagtatacatgccgcctgctggggatcacgactgcggctgtccttatcggagtggggaccgaaacgttccttcagggacagtttaaatccctggccttctatctgctcttcacgggcgctgccgtgtccatttgcgagggtgcttacttcgtcgcacagctgctagctatatgctttcaatgccagcccggaagtctagctgacagagtgcgggagaaagcccattggctaggatgtttccaaaagtttctggcttacctcttgctttcagttgcttgctttctccaccctgtattggtatggcacgtcaccattcccggttctatgctgattatcaccgggttagcgtattttcttctctcaaagcggaagaaacgaaaggccgcacccgaggtgctggcgtcaccggaacaatacaccgatccttcatcttctgccgtgagcacaaccggctcgggggacacagagcaaacctacaccttccacggggcacttaaggaaggaccctcctctctgttcatccatatgaagagtatcctcaagggaacaaaaaagcctagcgccctccagcccccaaacacactgatggaactctcattagagccagctgatagtctggcaaagaaaaagcaagtgcatttcgaggacaacctggtgagaatcgtgccttccctggctgaaggattggatgacggtgattctgagccagaagaaacaactagcgacactactccaataatccccccacctcaggccccattgttcctgagctccctaacggccactggcctgttctag

SEQ ID NO: 55550 - DNA, 474 bp, Artificial Sequence
  Description of Artificial Sequence: Synthetic coding sequence
atgctgattattaccgggctggcctatttcctgttgagcaagcgtaagaaaaggaaggccgcacctgaggtcttagcctcacctgaacagtataccgatcccagcagctccgccgtaagcacaaccggcagcggtgatacagagcaaacctatacattccacggggctctgaaggaaggtccctcaagcttgtttatccacatgaagtctatccttaagggcaccaagaaaccttctgcccttcagccacccaataccctgatggagctctccttagaaccagccgactctcttgccaagaagaaacaggttcacttcgaagataatttagtaagaattgttccaagcctcgccgagggccttgatgacggcgactccgagcctgaggagaccacgtctgataccactccaattatcccgccaccccaggccccattgttcctgtcatccctcacagccacaggcctgttttag

SEQ ID NO: 55551 - DNA, 771 bp, Artificial Sequence
  Description of Artificial Sequence: Synthetic coding sequence
atgcctcctgcccaggggtatgagttcgcagccgcaaaggggcctcgcgacgagctggggccaagctttccaatggccagccctccagggttggagctcaagactctttcaaacggcccacaagcaccccgtaggtctgctcctttggggccagtagcacccacacgcgaaggggtcgagaacgcctgcttttcaagcgaagaacatgagactcactttcagaatcccggtaacacgaggctcggtagctctccgtcacctcccggtggcgtgagtagcttacctagaagccaacgggacgatctctcgttacacagcgaagaggggccagctctggaacccgtgtcccgccctgtggactacggcttcgtgtctgcacttgtctttctcgtgtccggcattttgttggtcgtaaccgcatacgccattccacgagaagccagagttaatcctgataccgtaaccgcgagggaaatggagcggctggagatgtattacgccagattagggtcacacctcgaccgctgcatcatagccggattagggctgctcacggtggggggaatgttgcttagcgtactgctgatggtatcactctgtaagggtgagttgtatcggcgtagaacttttgtgcctggtaagggatcacgcaaaacctatggcagcattaacctgagaatgagacagctgaacggggatggcggacaagccctggttgaaaacgaggtggtacaggtctcagaaacaagtcacaccctacagagatcttag

SEQ ID NO: 55552 - DNA, 465 bp, Artificial Sequence
  Description of Artificial Sequence: Synthetic coding sequence
atgccgccagcacagggatatgaattcgcggctgcaaaaggcccaagggatgagctgggtccctcatttcccatggccagcccacccggtctagagttaaagactctttctaacggaccacaggccccacgccgatcagcccctctcggacctgtggcccctactcgagaaggagtggaaaatgcctgcttcagctccgaagaacatgagacccacttccaaaatccgggtaacactagattaggtagctccccgtctccccctgggggagtcagcagtctgccgcgaagtcagagggacgatttgtcattacattctgaggagggcccagccctcgagcccgtttcaaggcctgtcgattatgggtttgtctccgccctcgtgtttttagtctccggcatcttacttgttgtaaccgcctacgcaattcctagggaggctagagttaaccccgacactgtatag

SEQ ID NO: 55553 - DNA, 417 bp, Artificial Sequence
  Description of Artificial Sequence: Synthetic coding sequence
atgcgacccactgccgactcgttccgcctcaagaaaggcaacgtttttcctaactttgatccctgcgcccaggccttgcagaagagctgccacttcgcccttagcttccttattggtaaaatgggcatcattatcctgtccgtttgcctgatctgcacccgactgcttcaggagggaatagcccagagcaagtgtttaatcaatgttagcttttcgctgtacagctgctttatagtcttcgtgacaatttctcaggacagcgagactctgtctctcgactgtgatcacagactctttttcagcctccctttcactgaccccgctagtgggggtcaatcccagcattcttggccttgccccgagcgcagtaaaaatctgccccaggtctccaaacagcttaggaatcgcgctggttag

SEQ ID NO: 55554 - DNA, 411 bp, Artificial Sequence
  Description of Artificial Sequence: Synthetic coding sequence
atgtggctggacacacgaaacttggggatcgttatttcttgctggaagggagtgtgcgttccacaaaccaccacactggagatgttttataacgataacgatcgtgtagaggaatccagcaacagttaccagattcgcagggagttcctgttgccagcctgcctcccagcatttctgtcattttccacttctttctccttttttctgagctttctaccactgtcgcttagtctgtttttgccctttttcccaagcttcttcttatcattgagtctgtctccttctttcctgccaagctttctgcggcaggggcttgccctgtctcccaggctggaatgcgatggtgcaatcatgatacactgttctttgaacatccctggcagctcggatccaccaactagtgcatcatag

SEQ ID NO: 55555 - DNA, 1185 bp, Artificial Sequence
  Description of Artificial Sequence: Synthetic coding sequence
atgactgaacaggaaacactagccttgctggaggtgaaacgctcagattcacctgagaagtcaagcccacaagccctggttcccaacggtcgacagcccgaaggcgagggcggtgctgagtccccgggagccgaatccctgcgggtgggtagtagcgctggctcccctacggcaatcgagggcgctgaggacggattggatagcacagtgtctgaggccgcaacacttccgtgggggactggcccacagccctcagctcccttccccgacccaccgggttggcgtgatatagagccagaaccccctgaatcagagcctcttacaaagttggaagagctccctgaagacgatgccaatctcttgcccgagaaagctgccagggctttcgtgccaatcgatctccagtgtattgagcgacagcctcaggaggatctgatcgtgcggtgtgaagctggggagggcgagtgccgcactttcatgcctccgagagtgactcatccagatcctacggagcggaaatgggctgaggctgttgtgaggcccccagggtgctcgtgcgggggatgtggcagttgcggcgaccgggaatggctaagggccgtggcgtcagtgggtgcagcattgatccttttcccctgcctcctgtacggcgcatatgcattcttgcctttcgatgttcccaggctgccgactatgtcttccagactcatttacactttgcgatgtggcgtattcgccacgttccccattgtcctcggcatactggtctatggcctatccctattatgtttttcagcactccggccttttggggaacccagacgggaggttgagatacaccgcagatacgtggcacaaagcgtccaattgttcatactctacttctttaacttagccgtgctcagcacctatctccctcaggacacactgaaactgcttcctctcctgacgggactcttcgcagtctcacgattgatttactggttaacctttgccgtcggacggtctttccgaggtttcggctacggactgacatttcttcctttattgagtatgctgatgtggaacttgtactacatgttcgtcgtggagcctgagcgcatgctgaccgctactgagtcacggctggattacccagatcacgcccgatccgccagcgactaccgacctcgtccctggggatag

SEQ ID NO: 55556 - DNA, 528 bp, Artificial Sequence
  Description of Artificial Sequence: Synthetic coding sequence
atgacagaacaggagaccttggcactgttagaggttaaaagggatccaggcgtaagagcggagcctgttatgttgttctgcccctccgccttatggggagcaactgcaggcggtggagatccacccgcaatatgtggccctgtgggccctgccctttattctctccttctgcaacccggaagggcattccacttgccagctcctgggtatcctcagaccgccccaagtgcgcactggagtctctgccgtctgccagctgatctactggccgacctgtgccgcggacctctcctcccacggttgcgcttgaggcccgacgtgtcagcaaccgctgtggacgcagacgtagaacccctcctgcacgtccgcggaggggctggagcacacgctcactgccatagagagcctcccggacttccgggaccccgacccctggggttgcgcttgcaggcacctccactaggcttaagcctctcagcgttagcccttggcgtcgggggttccggcctcggcctcacccatctctag

SEQ ID NO: 55557 - DNA, 1185 bp, Artificial Sequence
  Description of Artificial Sequence: Synthetic coding sequence
atgaccgagcaagaaaccctggctctgttggaggtgaagcgcagcgatagtcctgagaaaagcagccctcaggccttagttcctaatgggaggcagcccgaaggcgaggggggagcggagagtcctggcgctgagagcctgcgagtgggtagtagcgcgggttcacccaccgctatcgagggggcagaagatggtttggattccacagtgtctgaggctgccaccttgccatggggcacaggtcctcagcccagcgccccatttccagacccccctggatggcgcgatattgaacccgaaccacccgaaagcgagcctctgaccaaactggaggagctgccggaggatgatgccaacctgctgcccgaaaaagcggctagagccttcgtgcccatcgacttgcaatgtatcgaacgacagccacaagaagaccttatcgttagatgtgaagccggagaaggggagtgccggacatttatgcctccaagggtaactcatcccgacccaaccgaacggaagtgggctgaggccgtcgtaaggcccccaggttgctcgtgtgggggttgtggctcgtgcggagatcgcgaatggctccgagctgtcgcctctgtaggggcagccctcatcctctttccctgccttttgtacggagcctatgccttccttccgttcgatgtgccaaggctgcctacaatgtctagccggttaatctacactctacgatgtggcgtcttcgcaacctttccaatcgtactgggtattctcgtctacggcttgtcactgctttgtttctctgcactccgccctttcggggagcctcgaagagaagtggaaattcataggcgctacgtcgcccaatctgtgcagcttttcattttgtatttttttaatttggcggtcttatcgacatacctgccccaggatacacttaagctgttgccattgctgactggactcttcgccgtgagcaggctgatctattggctgactttcgctgtgggcaggtcctttagaggcttcggctacggactcacattcctccctctgttgtccatgctgatgtggaacctgtattacatgttcgttgtggaaccagagcggatgcttacagccaccgagtctcgcctcgattatccagatcatgcaagatccgccagtgactataggccgcgtccatggggttag

SEQ ID NO: 55558 - DNA, 399 bp, Artificial Sequence
  Description of Artificial Sequence: Synthetic coding sequence
atgacggagcaggaaaccctcgcactcctggaggtcaagagagacccaggcgtcagagcagaaccggtgatgctcttttgcccttccgccctgtggggggcaacagccggaggtggagatcccccagccatctgcggacctgtggggccagctctctactcacttctcctgcaaccaggtcgcgctttccatctacctgctccaggctatccacaaacagcaccatctgcccactggtccctgtgtaggctacccgctgaccttctagcagatctttgtagagggccacttttgccaagacttcgtctgagaccagatgttagcgcaacagccgtcgacgccgatgtggaacccctgctgcacgtcaggggcggagctggcgctcatgctcattgctag

SEQ ID NO: 55559 - DNA, 507 bp, Artificial Sequence
  Description of Artificial Sequence: Synthetic coding sequence
atggcggagggagcacgggctaggggacccagaggttgtcgcgatagagacggacccgctggaggagcgggtaaaatggccgctccccgtaggggcaggggatcctccacagttctctcatctgtcccactccagatgctgttctacctatccggaacctattacgctctttattttctggccaccttgctgatgatcacttacaaaagccaagtgttcagctatcctcaccgttacctggttctggacctggccctcctgtttctcatgggaattctggaggctgtgaggctctatcttggaacccgtgggaacttgactgaagccgaacgtccactagccgcatcattggccctgacggcaggtactgcactgctgagcgctcacttcctgctgtggcaggctctggtactctgggctgattgggcgctttccgcaaccctgttggccctgcatggtctggaagccgttctacaagttgtggctatagctgccttcacacggtag

SEQ ID NO: 55560 - DNA, 483 bp, Artificial Sequence
  Description of Artificial Sequence: Synthetic coding sequence
atggctgagggtgcaagagcaagagggcctagaggttgccgggatcgcgatggcccagctggtggcgcaggcagagggagttccactgttctttcatccgttccccttcaaatgttattctacctgagcggcacctactacgccctgtatttcctggctacactgttaatgatcacctacaagtcccaagtattctcgtacccacaccgatatctggtcctggaccttgccctcttgttcctgatgggaatcctggaggccgtacggttgtacttaggcactcgagggaacctcacggaggctgagagacctctagcagcctcattggctctgactgctggtacggctctcctcagcgctcattttctcctgtggcaggctttggtgctctgggcggattgggctctaagcgcaactctgttggctctgcatgggctggaggccgttctgcaggtcgtggcaattgccgcatttactaggtag

SEQ ID NO: 55561 - DNA, 768 bp, Artificial Sequence
  Description of Artificial Sequence: Synthetic coding sequence
atgaaggtgctggcaacaagttttgtcctggggtccctgggcctggcgttctacctccccctggttgttacaacacccaagactctcgcaatccccgaaaaactccaggaagccgtcgggaaggttataattaacgctacaacatgtacggtaacctgcggtctgggttataaggaggagactgtgtgtgaggtggggccagacggcgtgcggaggaagtgtcagactcggagacttgaatgcctgactaattggatctgtggcatgctgcatttcacaatcctgatcggtaaagagtttgaactgagctgtctgtcaagcgatatcctggagttcggtcaggaagccttcaggtttacctggaggcttgccagaggagtgatttccaccgacgatgaggtgttcaagccctttcaagccaacagccacttcgtgaaatttaaatatgcccaagagtatgatagcggcacatatcgatgcgacgtgcaactggtgaaaaaccttcgcctggtgaagaggctctactttggcttacgggtcctgccacccaaccttgtgaacctgaactttcatcaatccttaaccgaagatcagaagctgattgacgaggggctggaggtgaaccttgatagttactctaagcctcatcaccccaaatggaagaagaaggttgcctctgcgctggggatcggcatagctataggcgtcgtcgggggagtcctggtgcgcatcgtactttgcgccttgaggggcggactccagcagtag

SEQ ID NO: 55562 - DNA, 1032 bp, Artificial Sequence
  Description of Artificial Sequence: Synthetic coding sequence
atgttcagcctcccatcacttccttcctggctgccaggcttgccaagtctggagtggggcagcagtttgctggattccctgttgcagggactgattggagccttgggggtgttggttttaaactcccttttgaaagtgtactttttcgtgggctgcgccaacgacccccaacgacgacctgagaaggaacgactgagggctcaatgggctagtcttgaaaccgtccacctggctgggctcgccctgttcctcactgtggtcggaagtcgcgttgctgctctggttgttcttgaattttccttgcgagccgtttctaccctcctgtccctgggcaaggggtcccagggtgccgcagagcgcctgcaattgtatcttctctgtcaatatagtctggggtgcggcttgacctgcggtctcagtttcctccaggagggagctcctcataggacgctcaacctgctattatctcttggtctcgcaactctgctcgggcttggcgcaagacgccttcatagacatgtgtgcaggttgtacgaactacattctagtcagaggtattgcggcgtgtgtcttggattgttagcccacgcacacggcttaccccagctcctcggaagggcgctggccatcgccttcgccgttggggaccttgccgctgtcgccctcattaatcaggatttcctgaccaccagcgaagctatgcgtttttggacacccctgactatttgctatacgctgttggtcatatacatgcaggaggagcagagacaacatcccggtctccagtcccaggttcagactgtcctggtcaggatgggcggtctcttcgtcctgctccttacagtcggacgctggcttgacctcttgggcatcttagtttctttactgggagaactatggtgcctagtcggagtaagaacccttctggacctgtgtcaaatccaagacttcccctcacagcgaccccctgttagtaccccaagccagcctctgcccagcgcgcctcagagccagtctagcgcacccagttag

SEQ ID NO: 55563 - DNA, 450 bp, Artificial Sequence
  Description of Artificial Sequence: Synthetic coding sequence
atgacagctcaggggggtcttgtggctaatcgaggtcggaggtttaagtgggccatcgaactcagtggcccaggagggggaagcaggggcagatccgatagaggctccggacagggggactcgctgtaccctgtgggatatcttgacaagcaggttcccgatactagtgtccaggaaaccgacagaatcctcgtagagaagaggtgctgggatatcgccctgggtcctctcaaacaaattcccatgaacctgttcattatgtatatggccggaaacacgatctcgattttccctaccatgatggtttgcatgatggcttggcgccctattcaggccctgatggccataagtgccaagaatggggtgcagtggtggcgcaccgcatttgtcaatatgaggaagcaacggctggtgcctatgtacttgggcttgatttacatcctgctgtag

SEQ ID NO: 55564 - DNA, 552 bp, Artificial Sequence
  Description of Artificial Sequence: Synthetic coding sequence
atgacagcacagggaggactggtcgcgaacagaggaaggaggtttaaatgggcaatcgagttgtcaggtcctggagggggatctcgcggacgatcagaccggggtagcggccagggcgatagtttgtatcccgttggctacctggataagcaagtgccagacaccagcgtacaagaaactgaccgcattctcgtcgaaaagagatgctgggacatcgcgcttgggcctctgaagcaaatccccatgaatctattcattatgtacatggcgggaaacaccatctcgattttcccaactatgatggtatgtatgatggcttggcgccctatacaggcactgatggccatcagcgctacctttaagatgttagagagttccagtcaaaaattcttgcaagggctggtgtatctgataggcaacctgatggggctggcgctggcagtctacaaatgtcagagcatgggtctgctgccaacacatgcttccgactggttggcttttatcgaaccccctgagaggatggaattcagcgggggaggacttctgctttag

SEQ ID NO: 55565 - DNA, 723 bp, Artificial Sequence
  Description of Artificial Sequence: Synthetic coding sequence
atggtttcgcctgtcacagtggtgaagtcagagggcccaaaacttgtgccattcttcaaggccacttgtgtttacttcgttctctggttgccatcttcaagccctagctgggtctctaccctaattaagtgcctaccaatcttctgcctttggctatttctcctggctcatggactgggtttcctgctcgctcacccttcagccacccgcatctttgtgggattggtttttagcgccgttggagacgcattcttaatctggcaggaccagggctattttgttcacggcttgctgatgttcgccgtgacccatatgttttacgccagcgcattcgggatgcagcccctggccctacgaaccggcctggtgatggccgcactcagcggtctatgttacgccttactctacccatgtctgtcgggggcttttacctacctggtgggagtgtatgtggcgctcatcgggttcatgggatggcgagcgatggccggattgcgcctagccggagcagactggcgatggactgaactcgccgctggtagcggtgcactcttcttcattatctcagatttgactatcgctttgaataaattttgcttcccggtcccctacagtagagccctaatcatgtcaacatactacgtggcgcagatgcttgtggcactcagcgcggtcgagtccagggaacccgtagaacactaccgtctcaccaaggccaattag

SEQ ID NO: 55566 - DNA, 723 bp, Artificial Sequence
  Description of Artificial Sequence: Synthetic coding sequence
atggtgtcccctgtgaccgtcgtcaagtcggaaggccctaagcttgtcccttttttcaaagctacttgcgtgtacttcgtgttgtggctgccctcaagcagccccagctgggtttccacgctgattaagtgcttgcccattttctgtctctggcttttcctgctcgctcatggcctggggtttctgttggcccacccatccgccacgaggatcttcgttggattggtattttctgccgtcggggacgcgtttttgatttggcaagaccagggttacttcgttcacggccttcttatgttcgcagtcactcatatgttctatgccagcgcttttggaatgcagccattggctttgcgcaccggcctcgtcatggctgctctgtcaggactatgttacgccctcctgtacccttgtctatccggcgcatttacctatctggtgggagtttatgtggctcttatcggttttatgggctggcgcgctatggccggacttagacttgctggcgcagattggagatggaccgagttagccgcaggcagtggcgctttatttttcattatatccgatttaactatcgctttgaataagttttgtttccccgtgccgtactcacgagcgctgattatgagcacgtactatgtcgcacaaatgctggtggcgctatctgccgtcgagagtcgtgaacccgtagagcactatcgcctgaccaaggccaactag

SEQ ID NO: 55567 - DNA, 681 bp, Artificial Sequence
  Description of Artificial Sequence: Synthetic coding sequence
atggacgccggtaaggccggacagactctgaaaacgcattgctcagcccaacgcccagatgtctgccgctggctgtcaccatttatcctctcatgttgcgtttacttctgcctttggatccccgaggatcagctctcttggttcgccgctctcgtaaagtgcctccctgtcctttgcctggccggatttctgtgggtgatgtcaccatctggtggctatacccagttactacagggagcactggtgtgttctgccgtgggggacgcttgtctaatctggccagccgcatttgttccaggcatggccgcttttgcaaccgcccatcttctgtatgtgtgggctttcggtttctcccctctccaacctgggctgctcctgctgatcatcctggccccaggcccttacctttctctcgtgctgcaacacctcgaacccgacatggtgctacctgtcgcagcatatgggctcatcttgatggcaatgctgtggagaggactcgcccaagggggttcagccggatggggagccctgttgtttacgctgagcgatggcgttttggcctgggacacatttgcacagcctctgcctcatgctcatctggtgattatgactacgtactacgctgcccagctgctgatcacactgtctgctctgcggtctcctgttcctaagaccgattag

SEQ ID NO: 55568 - DNA, 546 bp, Artificial Sequence
  Description of Artificial Sequence: Synthetic coding sequence
atggctgcagctgcctggttacaagtactgcccgtgatcttgctcctgctgggtgctcatcctagccctctaagcttctttagtgctggcccagcgactgtggccgcagcagacagaagcaagtggcatatacccatccctagtgggaagaattacttttccttcggcaagatcctgtttagaaatacgacaatcttcttgaagttcgacggggagccatgtgaccttagccttaacatcacgtggtatctgaaatcagctgattgctataacgaaatatataattttaaggctgaagaggtggaactttacctggagaagctgaaggagaagcgcggactgtcaggcaaatatcagactagttcaaaactgtttcagaactgctccgagttgtttaagacacaaacattttctggcgactttatgcaccggctgccactcctgggagagaaacaagaagccaaagagaacggaactaatctcacatttattggagacaaaaccatacaaatgccatttttgaagaagcatttcttagactgctag

SEQ ID NO: 55569 - DNA, 1668 bp, Artificial Sequence
  Description of Artificial Sequence: Synthetic coding sequence
atggcagccgctgcttggctgcaggtcctcccggttatccttctgctgctcggcgctcatcccagcccattgagctttttcagcgcgggacctgccactgtggctgctgcagaccgcagcaaatggcacatccccatccctagcggcaagaattattttagtttcggcaagattctcttccgtaatactacgattttcctgaagtttgatggagagccttgtgatctgtccttaaatatcacctggtatcttaagtccgccgactgctataatgaaatttataactttaaggccgaagaagtcgaactgtatttagagaagcttaaagagaagagaggtctgtccggtaagtatcaaacttcttcaaagctgttccaaaactgttcggaactgtttaagactcagaccttctcaggggacttcatgcacagattgccgctgttgggagagaagcaggaagctaaagaaaatggtactaacctcacttttataggagacaagaccgcaatgcatgagccactgcagacgtggcaagacgccccatatattttcatcgtccacatcggaatcagctcttctaaggaatctagtaaggaaaactccctgagcaatctcttcaccatgactgtggaagtcaaagggccatatgagtacttgactctggaggattacccgctgatgatctttttcatggtgatgtgtatagtctacgtccttttcggtgtgctctggctcgcctggtctgcttgctactggcgggatctccttagaatacaattttggattggcgctgtgatttttctgggcatgctcgagaaggcagtcttctatgccgagtttcagaacatccgttacaaaggcgaatctgtgcagggggcactgatcctcgctgagctgctgtccgcagtgaaacggtccttggcacgtacactggtgatcattgtctctttggggtacggtattgtgaaaccacggctgggagtgaccttgcacaaggttgtggtcgcgggagcactgtatctcctgttctctgggatggaaggggttctgcgggtgaccggcgcacagaccgatctcgcgtcactcgcgttcatccccctggcctttcttgacacagcactgtgttggtggattttcattagccttactcagaccatgaaattgcttaaactccgcaggaatattgtaaagttgtccctctacagacactttacaaacaccctgatcctggccgtagccgcttctatagtgtttataatttggactaccatgaagtttcggatcgtgacctgccagagtgactggcgagaactgtgggtggacgatgccatttggcgactgctgttctcaatgatattattcgtgattatggtcttgtggcggccatccgctaacaaccagaggttcgcattttctcccttaagtgaagaggaagaagaagacgaacagaaggagcccatgctgaaagagagtttcgaaggaatgaaaatgcgttctaccaagcaggagcctaatgggaactccaaggtgaacaaagcccaagaggacgacctcaaatgggtcgaagaaaatgttccaagctcagtgacggacgtagccctgcctgcccttttggactcggacgaggaaagaatgattacacacttcgaacgcagcaagatggagtag

SEQ ID NO: 55570 - DNA, 1485 bp, Artificial Sequence
  Description of Artificial Sequence: Synthetic coding sequence
atggctcatagcgataccgtcgtggacggggaaccatgcgacttatctcttaacattacctggtatttgaaatcagctgactgttacaatgagatctataattttaaggcggaagaagtggaactgtacctcgagaagttaaaggaaaagaggggactctctgggaaataccagacctcgtccaagctttttcaaaattgctcagagctttttaagacccagacgttttctggcgacttcatgcatcgactgcccctactcggtgagaaacaggaggctaaagagaatggcactaatctgaccttcatcggagacaagacggccatgcacgaaccgttacaaacctggcaggatgcaccctacatcttcatcgtacacattggaatctcctcctccaaggagtctagcaaagagaacagcttgtccaatctcttcaccatgacagttgaggtcaaaggcccatacgaatacctcacactggaagactaccctctgatgattttttttatggtgatgtgtatagtgtacgtcctttttggcgtactctggttagcctggagtgcctgttactggcgtgatttactgagaatccagttctggatcggggcagtcattttcttaggaatgctggagaaagctgtgttctatgcagagtttcaaaacatccggtacaaaggcgagtctgtacagggcgctcttattctcgctgagctcctgtcagccgtcaaacgttccctggccagaactcttgtgatcatcgttagtctgggttacgggattgtgaagcccaggctgggagtaacactgcacaaggtggtggttgctggagcattgtacctcctgtttagcggtatggaaggtgtgctaagagtgactggcgcacaaactgacttagcctcgctggcgttcataccactggcttttctggacactgccctgtgttggtggatcttcatctctctgacccagaccatgaagctgttgaagctccgacgcaacattgtcaagctgagcctctaccgacactttaccaacacactgatcttagcagtagccgctagcatcgtgtttatcatctggaccaccatgaagtttcggatcgtgacatgtcagtccgactggagagaactgtgggttgatgatgccatttggcgcctgttgttctccatgattctgttcgttatcatggttctttggaggccttctgccaataatcagcgttttgccttttcccccctgagcgaagaggaggaggaagatgagcaaaaggaacctatgcttaaagagtccttcgaagggatgaaaatgaggtctactaagcaggaaccaaatggaaatagtaaagtaaataaggctcaggaggacgacctcaaatgggttgaggaaaatgttccgagcagtgttaccgacgttgccttgcctgccctcctggattctgacgaagaaagaatgatcacacatttcgaaagatcaaaaatggaatag

SEQ ID NO: 55571 - DNA, 1596 bp, Artificial Sequence
  Description of Artificial Sequence: Synthetic coding sequence
atgtataagcggagagtggtgtacctttctgacgtgtcacagaacccagtgagcccaggctggatcaggaaaggtaaaaattacttctctttcggaaagattctgtttagaaataccacaattttccttaagttcgatggcgaaccctgtgacttgtcactgaatattacatggtatctgaagagcgctgattgctacaacgagatatacaacttcaaggccgaggaagtggagctttatctggaaaaactaaaggaaaaacgcggactctccggtaagtatcaaacctcctctaaactgtttcagaactgcagcgagttgttcaagactcagacttttagcggcgacttcatgcacagacttccactcttaggtgagaaacaggaagctaaggagaacggcaccaatttaacctttattggggacaaaaccgcaatgcatgagcccctgcagacatggcaggatgccccttatattttcattgtccacatcggtattagttcaagcaaagaaagttcaaaggagaactctctgtcaaatttgttcacaatgactgtggaggtaaaaggcccatatgaatatctgacactggaagattacccgttaatgatcttctttatggttatgtgtattgtgtatgtcttgttcggagtgctttggttggcctggtctgcttgttattggcgcgatctgctccggatccaattctggattggtgctgtgatttttttgggaatgctcgagaaggccgtcttttatgccgagtttcagaacatccgatacaaaggggaaagcgtacagggcgcacttattttagcagaattgttatccgctgtcaagaggtcactcgcccgtacactcgtgatcatagtgtccctgggatacgggatcgtaaaaccacgcctgggcgtcacattgcataaggtcgttgtagctggcgcactgtatttactcttttctgggatggaaggcgtcctgcgcgtcactggggcacagaccgacctcgctagtctggcctttatcccactggcttttcttgatactgcactgtgttggtggatcttcatcagcctgacccagacaatgaaactgcttaaactgcgacgtaacattgttaaacttagcctatatcgacactttacaaacacattgattctggccgtggccgcttcaatagtattcataatctggaccacgatgaagtttagaattgttacgtgccagtcagattggagggagttgtgggtagatgacgccatatggcggctgttgttcagtatgatcctgttcgtaatcatggttctgtggagacccagcgccaacaaccagaggttcgctttttccccgctgtcagaagaggaagaagaggacgagcagaaggaaccaatgctcaaggagtctttcgagggtatgaaaatgcggtcgacaaaacaggaacccaatggcaacagcaaagtgaataaggctcaggaggatgatcttaagtgggtggaagagaatgtcccttcctccgtgaccgatgtggctctacccgctctgctggattctgacgaagagagaatgatcacacactttgagcgatcgaaaatggagtag

SEQ ID NO: 55572 - DNA, 1668 bp, Artificial Sequence
  Description of Artificial Sequence: Synthetic coding sequence
atggtggccgcttgtcggtcggtcgctggtttgttaccacgccgacgaagatgttttcccgctcgagccccactgttacgggtcgcactgtgcctactttgttggactcccgctgcagtccgtgccgtgcccgagctgggattgtggcttgaaacagtgaatgataaatccgggccattgatcttcagaaagaccatgttcaattcaacagatatcaagttgagtgttaagtctttccactgctccggtcccgtcaaattcacgattgtgtggcatctgaaataccatacctgccataatgagcattcgaatttagaagagctgtttcaaaagcacaaactgagcgtcgacgaggacttttgccactacctgaaaaacgataattgctggactacaaagaacgagaatctagactgcaactctgatagccaggtattccccagtctgaataacaaggagctgattaatatacggaatgtgagcaaccaggaacgttcgatggatgttgtggctcggacccagaaagacggtttccatatttttatagtgagcataaaaacagagaatacagacgctagttggaatctcaatgtgtctctgtctatgatcggtccccacggctacatcagtgcaagcgattggcccctgatgatcttctacatggttatgtgtattgtgtacatcctatacggaattttatggcttacatggagcgcatgttactggaaggatatcctgaggatacagttttggatcgcggctgtaatttttcttggcatgctcgagaaagccgtgttttactcagagtaccagaacatttccaatactggtctgtccactcaaggactcctcattttcgctgagctgatcagcgccattaagcgcactctggccaggctgctcgtcattatcgtgagccttggatatggcattgtgaagcctaggttgggcactgtcatgcatcgagtgattggcctggggctgctgtatctcattttcgccgcagtggagggagtcatgcgagttatcgggggatcaaatcacttggcagtggttctggatgacataatcttggctgtcattgattccatcttcgtctggttcatattcatctccctggcacagaccatgaagacgctccggctccgtaagaacaccgtgaaattctctctgtatcgccatttcaagaacacccttatttttgctgtgcttgcttccatcgtgtttatgggttggacaaccaagactttcaggatcgcaaagtgtcaatcggactggatggagcgctgggtggacgacgccttctggtcattcttgttttcactgatcctcattgtgattatgtttctgtggcgtccatcggccaacaaccagaggtacgccttcatgccactcattgacgatagcgatgacgagatcgaagaattcatggtcacaagcgaaaaccttacggaaggtattaaactgagagctagcaaaagcgtgagcaatggcaccgcaaagccagctacgtctgaaaatttcgatgaggatctgaaatgggtcgaagagaacattccgtcatcattcacggacgtggctctccccgttctcgtggattccgacgaggagatcatgacccgttccgaaatggctgaaaagatgtttagcagtgaaaagatcatgtag

SEQ ID NO: 55573 - DNA, 480 bp, Artificial Sequence
  Description of Artificial Sequence: Synthetic coding sequence
atggccgatgtgccaggtgcacagagggctgtgcctggggacggccctgaaccccgagaccccctggactgttgggcctgtgctgtattggtcaccgcccagaatttgctggtagcagccttcaatctcttgctcttagtcctggtcttgggaacgatactgctgcccgcagtaactatgctcggttttggattcttatgccactctcaattcctccgctcacaagctcctccctgtacggcccatttgcgcgaccccggatttactgccctgctggttaccggcttcctccttctcgtccccctgctggtcctcgcacttgcgtcttaccgaagattatgcctgagactgaggctggccgactgccttgtgccttatagtcgggcactttatagaaggcgaagagcccctcaacctagacagattcgcgcttctcccggatctcaggcggttcccacgtccggaaaggtttgggtgtag

SEQ ID NO: 55574 - DNA, 480 bp, Artificial Sequence
  Description of Artificial Sequence: Synthetic coding sequence
atgcttcacgtgttggcatctttacccctgctgctcctccttgtcacgtccgccagcactcacgcttggtcccggcctctgtggtatcaggtgggcctcgacctgcagccttggggatgtcaacccaaaagcgtcgagggttgcaggggcggtttaagctgtcccggatactggttgggccctggggcttcccggatttatccagtagcagcagtcatgattacgactacaatgctgatgatctgccgtaaaatcctgcaggggagacggcgatcccaggctaccaaaggcgaacacccccaggtgactactgaaccctgcggcccttggaagagaagagccccaattagtgaccatactctgctgcgaggtgttctacacatgctggatgcccttctggttcacatagaaggacacctgcgacatctggcaactcaaaggcagatccagattaagggtacttctactcaaagtggctag

SEQ ID NO: 55575 - DNA, 780 bp, Artificial Sequence
  Description of Artificial Sequence: Synthetic coding sequence
atgtgtcccgagaatgccgaggattgtgaacaggcagttgtgcatgtggaaaccaccttataccttgtgccatgtttgaacgactgcggcccatatgggcagtgcttgctgctcagaaggcacagttatttgtacgctagctgtagttgcaaggctgggtggagagggtggagctgtacagataacagtacagcccagaccgtggctcaacaacgggctgctaccctgttgcttaccttaagcaatctgatgtttctcgcccctattgccgtgtcagtcagaaggttctttttagtcgaggccagcgtgtacgcctataccatgtttttttcaacattctaccatgcgtgtgaccagcccggtgaagctgtgctgtgtattctgagctatgacaccctgcagtattgtgatttcctgggatcaggagccgcaatctgggtcactatcctgtgcatggcgaggctgaaaactgttctgaagtatgcttaccgctgcggacaccggagacagtgctaccctacctcgtggcagcggtgggccttttatttacttccaggtgtttcaatggcctccgtgggcatcgccatttatactagcatgatgacatcagacaattattattacacccactctatatggcacattctactagcagggtctgccgcattactccttcctcctccagaccagcccgctgaaccttgggcttgctcccagaaatttccatgccactaccagatttgcaagaatgacagggaggaattgtacgcagttacctag

SEQ ID NO: 55576 - DNA, 2316 bp, Artificial Sequence
  Description of Artificial Sequence: Synthetic coding sequence
atgggacgcgctggaactggcacagggggtgaggcggtggctgctgttgtggctggtcctctcctgctgctgttgcttgcccgtccacctcccgctagtgcaggatactcaggcaaatccgaagtgggcctggtgagtgaacactttagccaagccccacagcggctgagtttctacagctggtacggttccgccaggctgttcagatttagggttccacccgatgcagtactgttaaggtggctgctacaggtgagccgcgagtcaggggcagcttgtacagatgccgagatcactgtgcactttaggtctggcgctccaccagtgatcaaccctctggggaccagcttccccgatgatactgccgttcagccctctttccaggtgggtgtccccttatcgacaacaccacgctctaatgcctctgtcaatgtgagtcaccccgcaccgggagactggtttgtagctgctcatctccccccttcatctcagaagatcgagctgaaaggattggcaccaacttgtgcctatgtgtttcagcccgagctcctcgtcactagggtagtagaaatatctataatggaacctgatgtgcccttaccacagacattgctctcacaccctagctacttgaaggtctttgtaccagactacacgagagaactgctactcgaactccgggattgtgtgtcaaacggttctctgggttgtccagtccgcctgaccgtgggccctgtaacactgccctctaacttccagaaggttctgacctgtactggcgctccatggccatgcaggctccttctcccgtcccccccatgggatcggtggttgcaggttactgcagagtccttagtgggcccattgggaactgtcgctttctctgcggtggccgctttgaccgcctgtcggccacggagcgtaaccatccagccactgttgcagagcagccagaaccagtcatttaatgcgagttcagggctattgtccccaagtcctgaccaccaagacttgggcaggtcaggaagagtggatcgcagtccattctgtctgactaattaccctgtaactagagaggatatggatgtggtgtctgttcatttccagcccttggacagggtgtctgttcgcgtatgttccgacaccccgtccgttatgcgactgagactgaacactggaatggactcgggaggaagcttgacaatctcactacgtgctaacaaaacagaaatgcgcaatgaaaccgtagttgtagcatgtgtgaatgctgcaagcccttttcttggattcaataccagcctgaattgcaccactgcatttttccaaggttatccgctgagcctttccgcctggtcgagaagggcaaatttaatcattccgtacccagaaacagacaactggtacctgagccttcagctgatgtgcccggagaatgccgaggattgtgaacaggccgtggtgcacgtagagactaccctctacctcgtgccgtgtctgaatgactgtggaccctacggccaatgtttactcctgagaagacacagctacctgtacgcttcctgttcctgcaaggccggttggagaggatggtcatgcacggacaacagcacggctcaaacagtcgcccagcagcgggcagccaccctccttcttactctgtctaatctgatgttcttggctcccattgccgtatccgttaggcgtttttttctagttgaagcctctgtgtatgcctacaccatgttctttagcaccttttatcatgcctgtgaccagccaggtgaagcagtactttgtattctatcttatgacacgctgcagtattgtgattttctcggatcaggcgcagcgatttgggttacaatcctgtgcatggcgcgactcaaaactgtgttaaagtacgtgctgttcttgctggggaccctcgttatcgctatgtcattgcagctggacagaaggggaatgtggaacatgttaggaccatgtctctttgccttcgtgataatggcgtccatgtgggcctacagatgcggccaccggaggcagtgctaccccactagctggcagcggtgggccttttatctgcttcctggcgtgagcatggcctctgtagggattgcaatttacacaagcatgatgactagcgacaattactattatactcattctatctggcacatcctgctggccggttccgcagcccttctgctcccccctccagatcaaccagctgagccttgggcatgcagtcagaagttcccgtgccactaccagatctgtaagaatgatcgagaagagttatatgcagttacttag

SEQ ID NO: 55577 - DNA, 1419 bp, Artificial Sequence
  Description of Artificial Sequence: Synthetic coding sequence
atgaacatgccacagagtcttggcaaccagcctctcccaccagaacctcccagcttgggcacccctgcggagggaccgggaaccacctcccctccagagcattgctggcctgtccgaccaaccctgcggaacgagttggatactttctccgtccacttctacatattctttggcccttcggttgctcttcctcctgaacgtccggcagtgtttgctatgcgcctgctgcccgtcttggacagtggtggagtgttaagccttgaactgcagcttaatgcatcctccgtaaggcaggagaatgtaacagtctttgggtgtctgacacacgaagttccgcttagtctcggcgatgcagctgttacctgttcaaaggaaagtctggcaggattcctactaagtgtttccgctaccacaagagtggctcgcctgaggattccttttccccagacagggacgtggtttcttgccctgaggtccctgtgcggcgtaggccctcgcttcgttcggtgtagaaacgcaaccgccgaggtacggatgaggacatttctcagcccgtgtgtcgacgactgtgggccttacgggcagtgtaagctccttcgcacacacaactacctctacgcagcctgtgagtgcaaggccggttggaggggatgggggtgtactgacagtgccgacgctctgacctacggattccagctcctctccacactcctgctttgtctgagtaatttgatgtttttaccgcctgtggtgctggcaattagatctagatacgttctcgaggcagccgtctatacctttacgatgttcttctccactttttaccacgcctgtgatcagccagggattgtcgtgttctgtattatggactatgacgtactccagttctgcgacttcctggggtctctcatgtccgtgtgggtgaccgtgatcgccatggcacggctacagccggtggtgaaacaggtgctttatctgctgggcgctatgttactgagtatggcactacagctggaccggcatggactttggaacctccttgggccaagtctgtttgcgctgggtatcttagctacagcttggaccgtgcgcagcgtccgccgaaggcattgttacccacccacatggagacggtggctgttttacctgtgtcctggttcactaatcgccggttccgctgtgttactctatgccttcgtggagacacgtgataattatttttacattcatagtatctggcatatgttaattgcgggtagtgtcggcttcctactccctccgagagcaaagactgaccatggggtaccgtcgggggcaagggcgagggggtgtggttatcagttgtgtattaacgaacaggaggagctgggcctcgtaggacccggtggcgcaacagtgtcttccatctgtgccagttag

SEQ ID NO: 55578 - DNA, 1419 bp, Artificial Sequence
  Description of Artificial Sequence: Synthetic coding sequence
atgaatatgccacagagtcttggaaaccagccactgccaccagaaccacctagtctggggacaccagctgaagggcctgggacaacctccccccctgagcactgttggccggtgagacctacacttagaaacgagcttgatacttttagtgtacacttctacatattcttcggaccttcggtggcactgccacccgagcggcctgctgtgttcgctatgcggctgctgccagtcttggactccgggggagttctgagtctcgaactacagctgaacgctagcagcgtgcgccaggagaatgttacagtgttcggatgtctgacacacgaggtaccactttccctgggagatgcggcagtcacgtgttcaaaggaaagcttggcgggatttctgctgtctgtgtcagctacgactcgagtagcaaggctgcggatccctttcccacaaaccggcacatggttcctggccctgcggtcactatgcggagtgggaccacgcttcgtgcgttgccggaacgctaccgcagaagtgaggatgagaacgttcctatcgccatgcgtcgatgactgcggtccttacggtcagtgcaaactattaaggacccataattacttgtacgcggcatgcgagtgtaaggctgggtggaggggatgggggtgtacagattctgccgacgcattaacctatggattccagctgttgtcaactctgttgctgtgcctctcaaacctcatgtttctccctccggtagtgctggcaatccgaagcaggtacgttttggaggcagccgtgtataccttcacgatgttcttttccacattctaccacgcctgcgaccaaccaggaatcgtcgttttttgtatcatggattacgacgttttgcaattctgtgattttcttggatcactcatgtcagtctgggtgacggtgattgcaatggctagactgcaacctgtggtgaaacaggtgctgtacctgctcggggcaatgctcctctctatggctttacaactcgatcgacacggactgtggaacctgttgggacccagtttgttcgccctgggtattctggcaaccgcatggaccgttaggtcagtgcgaagaaggcactgttacccccctacttggagacgctggttattctatctctgtccgggatcactgatcgctggctccgcagtactgctttacgctttcgttgagactagagacaattacttctatatacactccatttggcatatgctgattgcagggagtgtcgggtttctgctcccgcctcgggcaaagacagatcatggagtgccgtccggtgcgagggccagaggctgcggctaccagctgtgtatcaacgagcaggaggagttgggtttagtgggccctgggggtgcaaccgtatcctcaatttgtgctagctag

SEQ ID NO: 55579 - DNA, 1017 bp, Artificial Sequence
  Description of Artificial Sequence: Synthetic coding sequence
atgaatatgccacagagcctgggcaaccagcccttgcctcctgagccaccctcgctcggcacgcccgctgagggccctggcacaaccagtcctcccgagcattgctggcccgtgagacccacactgcgtaatgaacttgatactttctcagtgcacttttacattttctttgggccttccgttgctttgcctccagagcgccctgccgtgttcgcaatgcggctgctgcccgtacttgacagtggtggcgttctgtcccttgaactgcagctgaatgccagctcagttcgacaggagaacgtgactgtctttggctgtctcacccacgaggtgcccttatctttgggcgatgccgcagtgacttgctctaaggagagcctggcgggattcctgctttccgttagcgccaccactcgggttgcccgtcttaggattccgttcccacagacgggcacctggtttctcgctctgagatcactgtgcggagtagggccaagatttgtccgatgtcgtaacgcgaccgccgaggtacgcatgagaactttcctgagtccatgtgtggatgactgtgggccttacggacagtgtaagctgctcagaactcacaactacctctacgcagcctgcgagtgtaaagcagggtggaggggatggggctgcactgattccgccgacgctctgacctatggcttccagctgttatcaacgttgctgttgtgcctgagcaatctgatgttccttccaccagtggtactggctattcgttcaagatatgtcctagaggccgcagtctatacgttcacaatgttcttctcgaccgtttgcgggggtgtgtgtatattgtccctaggtgcttgtgcatggtggtgggtcaccgtctgcatctctacaactttctcagagggcttgggcatgagcgttccaagcctgtgcttgctgcagacagagacagctgtgctgcccaaactgagctgtatcgataacggccacttttgtaaaactcattggtcaaaatag

SEQ ID NO: 55580 - DNA, 1017 bp, Artificial Sequence
  Description of Artificial Sequence: Synthetic coding sequence
atgaatatgccacagtctctgggaaatcagcctttgccccctgagcccccaagtctggggacccccgctgagggacccggtacgacgagccccccagaacattgctggccggtacgaccaaccctcaggaacgagctggacacctttagtgtacatttttatatatttttcgggccttcggttgctctccctcctgaacggccagccgtgttcgctatgcggctgttaccagtgctggacagtgggggtgtcctctcactggagctgcagctcaatgcaagctctgtccgacaggaaaacgtgactgtgtttgggtgcttaacacacgaagtgccactcagtctgggagacgcggcagtgacctgtagtaaagagagtctggctgggtttctcttgtcagtgtccgccacaacccgcgtggcacgactgagaatccccttccctcagactggaacatggtttctcgccttgagatcgctgtgcggcgttggccctaggtttgttcgctgccggaacgctaccgctgaagtcagaatgaggacgtttctgagcccttgcgtcgacgactgtggcccttatggacagtgtaaacttttgcgtacccataactatctgtatgccgcatgtgaatgcaaggccggttggcgcggatggggttgcaccgactcagctgacgctttaacctacgggttccagctgttatcgactcttttattgtgcctgtccaatctgatgttccttccgccagttgtgctcgccatccgctccagatacgtgctggaggctgccgtctataccttcaccatgttctttagcacggtctgtggaggagtgtgcattttgtccttaggtgcctgcgcctggtggtgggtgactgtttgcatatctaccaccttttccgagggtcttggcatgtccgtcccctccttatgtctgttgcagactgagactgctgtactcccgaaactaagttgcattgataatggtcacttttgcaaaacccactggagcaaatag

SEQ ID NO: 55581 - DNA, 552 bp, Artificial Sequence
  Description of Artificial Sequence: Synthetic coding sequence
atgaaattgctctctctggttgccgttgtagggtgcctgttggttccaccggctgaagccaataaaagctccgaggacattagatgcaagtgcatatgtccgccatatcgtaacattagcggccatatctataatcagaatgtgagccaaaaagattgcaattgcctgcacgttgtggagcccatgcctgttccgggacacgacgtggaggcctattgtcttctgtgtgagtgtcggtacgaggagcgaagcacgaccacaattaaggtaattatagtgatttacctgtcagtggtaggtgctctactgctatatatggcatttcttatgctcgtcgatccacttatccggaaacccgacgcctacaccgaacagttacacaatgaggaagaaaatgaggatgctaggtccatggccgctgcagccgcatcactcggaggcccacgcgcaaatacggtactggagagagtggaaggtgcgcagcagcggtggaagttacaggtacaggagcagcggaagactgtctttgataggcataagatgctgagctag

SEQ ID NO: 55582 - DNA, 552 bp, Artificial Sequence
  Description of Artificial Sequence: Synthetic coding sequence
atgaaactcctctccttggtggctgtcgtaggctgtcttctcgtgcccccagccgaggccaataagagttcagaggacatcagatgcaaatgtatttgcccgccatatcggaacattagcggacatatatacaatcaaaatgtgagccaaaaagactgcaactgtctgcatgtggtggagcctatgccagtaccaggccacgacgttgaagcgtactgtctgctctgtgagtgtaggtacgaggagcgcagcacaaccaccattaaagtgatcatcgtgatctatctaagcgtggtgggcgcactcctactctatatggccttcctgatgctcgtcgaccctctcatcagaaagccagacgcttatactgagcagttgcataatgaggaagaaaatgaggacgcacggagtatggcagctgctgctgcatctctcggcggtcctagggcgaacaccgtcttggagcgggtggagggtgcgcagcagaggtggaagcttcaggtccaagaacaacgcaagaccgtatttgacaggcataagatgttaagttag

SEQ ID NO: 55583 - DNA, 561 bp, Artificial Sequence
  Description of Artificial Sequence: Synthetic coding sequence
atgaagttgcttagcctggtcgcagtggttggctgcctgctggtgccacctgcggaggctaataaggtcagagaaagcagtgaagacatccgctgcaaatgcatatgtccaccatatcgaaacatttcaggacatatctataaccaaaacgtgagccagaaggactgtaattgcctgcacgtggtggagcctatgcccgtgcccggtcacgatgtcgaggcatactgtttattgtgcgagtgccgctacgaggagcggagtactaccacaattaaagtcatcatagtcatctacctgagtgtggttggcgcattgttactgtatatggctttcctaatgcttgtggatcccttaatccgcaaacccgacgcctacacagaacagctccacaatgaggaagagaatgaagacgcaagaagtatggccgcagcagctgcatcattaggaggccctcgcgcaaacactgtgctggaaagagtggaaggcgcacagcagcgctggaagttgcaggttcaagagcaacgcaaaactgtgtttgatcggcataaaatgctatcgtag

SEQ ID NO: 55584 - DNA, 561 bp, Artificial Sequence
  Description of Artificial Sequence: Synthetic coding sequence
atgaagctgttaagtctggtggccgtggtcggctgtctgttggtccccccagctgaagcaaacaaggttcgggaatcttccgaggacatccgctgcaaatgcatctgccccccttaccgtaacatttctggacatatctacaaccaaaatgtctctcaaaaggattgtaactgcctccacgtcgtggagccaatgcccgtgcctggtcatgacgtcgaggcctattgtctcctgtgcgagtgcagatatgaggagcgtagcacgacaacaataaaggtcatcattgtgatctacttgtcagtggtaggagcactgctgctgtacatggcgttcctgatgctggtcgacccccttatcaggaaacccgacgcatacactgaacagttacataatgaagaagagaacgaggacgccagatctatggcagccgcagcagcatccttgggcggtcctcgagccaacaccgtgctggagagagttgagggcgctcagcaacgctggaaactgcaggttcaggagcagcggaagactgtattcgatcggcataagatgctgagttag

SEQ ID NO: 55585 - DNA, 552 bp, Artificial Sequence
  Description of Artificial Sequence: Synthetic coding sequence
atgaagcttctgagcctcgtcgccgtggttggctgcctgttggtgcccccagcagaggccaataaatccagcgaagacattcgctgcaagtgcatctgtcccccttaccggaacatctctggccacatctacaaccaaaatgtgtcacagaaggattgcaattgcctgcacgtggtagaacctatgcctgtacccggtcatgatgtcgaggcttactgcctactgtgcgaatgtcggtacgaggagcgctccacaacaaccataaaggtgattatcgtgatctacctgtccgtggtgggcgcattgttgctgtacatggcatttctaatgcttgtcgaccccctgatccggaagcccgacgcctataccgagcagctccacaacgaggaggagaatgaggatgcccgtagcatggcagcagcggctgcaagcctgggaggacccagggccaataccgtgcttgaacgagtcgaaggcgcacagcagagatggaaacttcaggtgcaggagcagcgaaagacagtcttcgacagacataagatgcttagctag

SEQ ID NO: 55586 - DNA, 345 bp, Artificial Sequence
  Description of Artificial Sequence: Synthetic coding sequence
atgaagctgttgtccctcgtcgcggtggttggatgtctcctcgtgcctcctgccgaagccaacaaagttagggaagtcagcctccagcatctcgtgacaaccaccgtacacggccacccggtctatcgcgcagattctgagagctccgaggatatccggtgcaaatgtatctgcccaccctatcggaacataagcggccatatctacaatcagaatgtgtcccaaaaggactgcaattgtctgcacgtggtggaacccatgccagtccccggtcatgacgtggaagcatattgcctgctctgcgagtgtaggtatgaggagagaagcaccactacaatcaaatag

SEQ ID NO: 55587 - DNA, 417 bp, Artificial Sequence
  Description of Artificial Sequence: Synthetic coding sequence
atgaaactgctgtccctggttgccgtggtcggctgtcttctggttcccccagccgaggcaaacaagtcaagcgaagacatccgttgtaagtgcatttgtcccccttatagaaatattagcggacacatctacaaccagaacgtgtctcaaaaggattgcaattgtctacacgtagtggaacccatgcctgtgccaggccatgacgtggaggcatactgcctattgtgcgaatgccggtatgaagagcgctccacaaccaccattaaggtcataattgtcatatacctatctgtcgtcggggctttactgctgtatatggccttccttatgctcgtggatcccctcattcggaagcccgacgcttataccgagcagctccataatgaggaagagaacgaggacgcccgttctatgtag

SEQ ID NO: 55588 - DNA, 456 bp, Artificial Sequence
  Description of Artificial Sequence: Synthetic coding sequence
atgaaactgctctctctagtcgccgtagtgggttgcctgctggtccccccagccgaagcaaataaaagctctgaagatataagatgtaagtgtatctgcccgccatacaggaatatttcaggacacatctacaaccaaaatgtgagccaaaaagattgtcctgtgagtctctgttgctccaactgcttgcacgtggttgagcccatgccggttcccggacacgatgtcgaggcatattgtctcctctgtgagtgccgatacgaggagcgatcaaccaccacgattaaggtaatcattgttatctatctctctgttgtgggcgctctactgttgtacatggccttccttatgctggtcgaccctttgatccggaagcctgatgcctacacagagcagctgcacaacgaagaggaaaacgaagacgctcgttccatggccgctgctgccgcatcctag

SEQ ID NO: 55589 - DNA, 369 bp, Artificial Sequence
  Description of Artificial Sequence: Synthetic coding sequence
atggatagcccttccctgagagagctgcagcagccacttttggaagggaccgagtgcgagaccccggctcagaagcccggacgccacgagctcggcagtccgctccgggaaatcgcctttgcagaaagcctccgaggcttacagtttctgagccctcccctgcctagtgtgtctgccggtctgggagaacccagacccccagacgtagaggacatgtccagctccgacagcgatagtgattgggatggcggttctcgcctcagtcccttcctaccccacgatcacctgggcctggctgtgttcagtatgctgtgctgcttctggcctgtgggcatcgccgctttttgcctggcacagaagaccaattag

SEQ ID NO: 55590 - DNA, 420 bp, Artificial Sequence
  Description of Artificial Sequence: Synthetic coding sequence
atggatagccccagtctgcgggagctgcagcaacctctgctggaagggacagaatgtgaaacgcctgcgcaaaagcccggtaggcacgagctcggaagccccctcagagagatcgccttcgctgaatcccttcggggactgcagtttctgagccctccgctgcccagcgtgtcagctgggctcggcgaaccaaggccacctgatgtggaagacatgtcgtcctctgattccgacagcgactgggacgggggaagccgattgtcaccatttctacctcacgaccacctcggacttgccgtatttagtatgctgtgttgtttctggccagtaggcatcgccgcattttgcttggcccagaagcaccctcagtgtctgacatactccagatgttatgtttctgcttttggaatccacgcttag

SEQ ID NO: 55591 - DNA, 519 bp, Artificial Sequence
  Description of Artificial Sequence: Synthetic coding sequence
atggacagccccagcctgagagaattacagcagcccctgttggagggcacggagtgcgaaactcctgcccagaagccaggtagacatgagctgggatcacccctccgagagattgcctttgcagagagtcttcgcggtctccaatttctttccccaccattgcctagtgtctcagccggactgggagagccacggccacccgatgtcgaggacatgtctagcagcgacagtgattccgactgggatggcggaagtcggctgtctccttttttaccgcacgatcacctgggcctggcagttttttctatgctctgttgtttttggccagtcggcattgccgcattctgtctggcccagaagaccaataaggcttgggcgaagggcgacatccaaggggcaggggcagcttcccggagagcttttctgttgggtgttctggctgttggtctgggggtgtgtacatatgccgcagccctggtgactcttgctgcctatctggctagtcgggatcccccttag

SEQ ID NO: 55592 - DNA, 402 bp, Artificial Sequence
  Description of Artificial Sequence: Synthetic coding sequence
atggacagtccatctctaagagaactacagcagcctctgctggaagggacagaatgcgagacgccagctcaaaagcctggcagacacgaattgggatcacccctgcgagagattgcttttgctgagagtcttagaggacttcagttcctgtccccgcctctgccttcagtgagtgcgggtctcggcgagccgaggccccctgacgttgaggacatgagctcctccgactctgacagcgactgggacggcggttctcgcttgagcccctttctgccccacgatcaccttggcctggccgtgtttagcatgctgtgttgtttttggcccgtgggcatcgcagctttctgtctggctcaaaagacccgtccgtcctgcccttacagtccccattgcgagccatag

SEQ ID NO: 55593 - DNA, 372 bp, Artificial Sequence
  Description of Artificial Sequence: Synthetic coding sequence
atggatagtccgtcactgcgcgagctgcagcaaccgctcctggagggcaccgagtgtgagacccccgctcagaaacctggcagacacgaactgggatcccctctccgcgagatcgcgtttgccgaaagcttgcggggactgcagttcctcagccccccattgccctcagtgagcgccggattgggagaaccacgaccccctgatgtggaggacatgtcctcaagcgacagtgactccgattgggatgggggaagccggctctctccgttcctgcctcacgaccacctgggtctggcggtgttctctatgctgtgctgcttttggcctgtcggtattgcagctttctgtctcgctcaaaagccctccttgtag

SEQ ID NO: 55594 - DNA, 384 bp, Artificial Sequence
  Description of Artificial Sequence: Synthetic coding sequence
atggattcaccttctctgcgggaattacaacagccgctcctggagggaaccgagtgtgagacccctgcgcagaagcccggaagacacgagttaggttctcctctcagggagattgcattcgccgagtctctgcgaggactccagtttctctctcctcctctgccttctgtgtccgcaggccttggtgagcctcgtccaccagatgttgaagacatgtcaagtagcgatagcgactctgactgggatgggggaagccgcctgagcccattcttacctcacgatcacctcggtcttgcagtctttagcatgctttgctgcttctggcccgttggtatagcggcattctgtcttgcacagaagttgcccctgcaaccaagtctctag

SEQ ID NO: 55595 - DNA, 183 bp, Artificial Sequence
  Description of Artificial Sequence: Synthetic coding sequence
tgatgggatgggggatccaggctgtccccctttttgcctcacgatcacctggggctggctgtgttctccatgctttgttgcttctggccagttggaatcgccgcattttgtctggcacagaaacacccccagtgtctcacatacagcaggtgttacgtctctgcttttgggattcatgcttag

SEQ ID NO: 55596 - DNA, 345 bp, Artificial Sequence
  Description of Artificial Sequence: Synthetic coding sequence
atggatagtcccagcctaagggaactccaacagccactgctcgagggcacagagtgtgagacccctgcacagaaacctggcagacacgagctaggaagtccccttagggagatcgcattcgccgagagcctgagggggctgcagtttctgtcaccccctctcccaagcgtatccgctggattgggcgaacctcggcctcccgatgtggaggacatgagctcttcagattctgattctgactgggacggcggttcccgcctgagcccttttctaccccacgaccacctgggcttggctgtttttagtatgctgtgttgtttctggccagtcggtatcgctgcctag

SEQ ID NO: 55597 - DNA, 402 bp, Artificial Sequence
  Description of Artificial Sequence: Synthetic coding sequence
atggattctccctctctgagggagctgcaacagccacttcttgagggcaccgagtgcgaaacccccgctcagaagcctggccgacatgaactggggagtccacttcgcgaaatcgccttcgcggaatctctccgcggactgcagtttttaagtcctccactgccttctgtgtccgccggtttgggtgagccacgacccccagacgtcgaggatatgagtagttctgattcagatagtgattgggacggcggtagtcggctctcaccctttctgcctcatgatcacctcgggctggccgtgttcagcatgctatgctgcttctggcctgtgggtattgcagccttctgcctggcccagaagacacgccctagttgcccatatagcccacactgcgagccatag

SEQ ID NO: 55598 - DNA, 264 bp, Artificial Sequence
  Description of Artificial Sequence: Synthetic coding sequence
tagcttccctcagtatctgccggattgggtgaacccagacctcctgatgtggaggacatgagctcttcagatagcgattccgactgggatggtggatccagactcagccccttcctaccccatgaccacctgggactcgccgtgttctccatgctttgttgtttctggccagtcggtattgcggctttctgtttggcccagaaacaccctcagtgcctgacctacagtagatgctacgtgagtgcttttggaatccatgcctag

SEQ ID NO: 55599 - DNA, 480 bp, Artificial Sequence
  Description of Artificial Sequence: Synthetic coding sequence
atgtctcaagcctgggtgcccggtctcgcgccaaccctcctcttctctctgctcgccggaccccagaagatcgctgccaagtgcggtctgatcctggcatgtcccaaggggttcaagtgctgcggcgattcttgctgtcaggagaatgagctcttcccgggaccggtgaggatcttcgtcatcattttcctcgtgatcctctctgtcttctgcatctgcggcctggccaagtgtttttgcagaaactgtagagaaccagaacctgacagcccagttgattgccggggacctctggaattgccatccattatccctcctgagagagtcagggtatccctcagtgctccacctccgccttactctgaagtcatcctcaagccatcattaggacccactccaaccgagccccctccaccctatagcttccgcccagaagagtatactggggaccagcgcggaatcgacaatccggcattctag

SEQ ID NO: 55600 - DNA, 480 bp, Artificial Sequence
  Description of Artificial Sequence: Synthetic coding sequence
atgagtcaggcttgggttcctgggctggctcccaccctcttgtttagtttactcgctgggccacagaaaatcgcagccaaatgcggtctgatattggcctgtcccaagggatttaagtgctgtggggattcatgctgtcaggaaaatgagctctttccaggcccagtgcggattttcgtgattatctttctcgtgatcctctccgttttttgcatctgtggcctcgcgaagtgcttctgccggaactgtcgagagccagagcccgattctcccgtggattgtcggggtccactggaactgccttccatcatccctccagaacgagtgagagtgtcgctgagtgcgccaccacctccctacagcgaagtgatcttgaagccatccttagggcctactcccacggagcctccccctccttactctttcagacctgaggagtacacgggggaccagcgcggtatcgacaatcccgctttttag

SEQ ID NO: 55601 - DNA, 333 bp, Artificial Sequence
  Description of Artificial Sequence: Synthetic coding sequence
atggccgctgtggtcgctaagagggaaggccctccgtttatatcagaggcggcagtgcgcggaaacgctgctgtgctggattactgcaggacttcagtctcagcccttagcggcgcaacagccggaatcctagggttaaccggcctctacgggttcatcttttatttgctcgcaagcgttctgctgagtctgcttctgattttgaaagccggaaggcggtggaataaatacttcaaatcccggcgacctctatttactggcggtcttataggaggcctgttcacctacgttctcttttggacttttctgtatggaatggtacatgtgtactag

SEQ ID NO: 55602 - DNA, 333 bp, Artificial Sequence
  Description of Artificial Sequence: Synthetic coding sequence
atggcagcagtagtggctaaaagggagggccctcccttcatcagcgaagcagcggttcggggtaatgcagccgtattagactactgtagaactagcgtctcggctctttccggcgcaactgccggaatactgggcttgacgggtctgtatggtttcatcttctacctccttgcaagtgttctgctctcactgctcctgattctgaaagcaggtaggcgatggaacaagtactttaaatccaggagacctttattcaccgggggtctgatcggaggattgttcacatacgtcctcttctggacctttctatacggaatggttcatgtgtactag

SEQ ID NO: 55603 - DNA, 681 bp, Artificial Sequence
  Description of Artificial Sequence: Synthetic coding sequence
atggagaccgtggtgatcgtcgccattggagttcttgctaccatcttcctcgccagctttgcagctctagtgctggtgtgcaggcagagatattgccggcctagggacctcttgcagcggtatgattccaaacccattgtggacctaattggggcaatggagactcagagcgagccctctgaactcgaactggacgatgttgtgatcacgaacccacatatagaggctattcttgaaaacgaagactggatcgaggacgcaagcggcctgatgagccattgtattgcaattctaaagatttgtcataccctgaccgaaaagctcgtcgcgatgactatgggcagcggcgctaagatgaagacatcagcctcagtgtcggatattatcgtggtagcaaaacgaatatcaccacgtgtcgacgacgtggtgaagtccatgtacccgccattagaccctaagttgctcgacgcacggactacagccttactactgtcagtttctcatttggtgcttgtgacacggaacgcctgccatttgacaggcggtctggattggatcgaccaaagcttaagtgccgcagaggagcacttggaggtgctgcgggaggccgctcttgcctctgagcctgataagggtttacctggcccagaaggttttcttcaggagcagtcagccatttag

SEQ ID NO: 55604 - DNA, 681 bp, Artificial Sequence
  Description of Artificial Sequence: Synthetic coding sequence
atggaaacggtggttatagtcgcaatcggagtgcttgccaccattttccttgccagctttgcagcgctggtcctcgtttgccgtcaacgctactgccgcccacgggatttactgcagaggtacgactctaagcctattgtcgatttaattggtgctatggagactcagagcgagccttcagaattagaactggatgacgtcgtaatcaccaatccccacatcgaggccatcctggaaaacgaagattggatcgaggacgcgtcaggcctaatgtctcactgcattgccattctgaagatttgccatacactgacggaaaaacttgtcgctatgacaatgggaagcggggcaaaaatgaagactagcgcaagcgtctccgacattatagtggtcgcaaaacgaataagtccacgggtggatgacgttgtgaagagcatgtatcctccccttgaccctaagttgttggacgccaggacaactgccctcctactgagcgttagccacttggtgctggttacccgcaatgcatgtcaccttactggaggactagactggattgatcagagcttgagcgccgctgaagaacacctggaagtgctgcgggaggccgctttagccagcgagccggacaagggtctgccgggaccggaagggtttctccaagagcaatctgcgatttag

SEQ ID NO: 55605 - DNA, 414 bp, Artificial Sequence
  Description of Artificial Sequence: Synthetic coding sequence
atggagaccgtcgtgatcgtggcaattggagtcctggccaccattttcctggcctcgttcgcggctctggtcctcgtttgtagacagcgttactgccgcccaagagatctcctgcagcgttacgacagtaaacccatcgttgacctgattggagctatggagacgcagtctgaaccctctgagttggaattagacgacgtcgtgatcactaaccctcatatcgaggctatcctggagaatgaggattggatcgaagacgctagtgggcttatgtcacactgtatcgcaattttgaagatctgtcacaccctcacagaaaaacttgtggctatgaccatgggcagcggtgcaaagatgaaaaccagcgccagcgtgtcagacattatagtcgtggccaaaaggatttctccctag

SEQ ID NO: 55606 - DNA, 669 bp, Artificial Sequence
  Description of Artificial Sequence: Synthetic coding sequence
atggagactgtcgtcattgtggcaataggcgtgctggcaactatctttcttgctagcttcgcggctctggtcttagtctgtcggcagcggtattgtcgtccacgagacctgctgcagcgttatgattccaaaccgattgtggacctcatcggggctatggagacccagtctgaaccatccgagctagagcttgacgacgttgtgataactaacccacatatagaagccattttggagaacgaagattggatcgaggatgcttcaggcctcatgtcacactgtatagctatcctcaagatctgccatacactgacagaaaagttagtggctatgaccatgggatccggcgcaaagatgaaaacgagcgcgtctgtaagcgatataatcgtagttgcaaaacgaatctctcccagggtggatgatgtcgttaagagcatgtacccccctctagatcctaagctcctggatgcgcgtaccactgcgctgctgctgtcagtgtcacacctggtcctagtgacccggaacgcctgtcacttaaccggcggattagactggatagaccaatccctctcagccgctgaagaacatctcgaagttttacgcgaagcagcattggcctctgagccggacaaaggtctgcccggaccggagggttttctccaggagtag

SEQ ID NO: 55607 - DNA, 681 bp, Artificial Sequence
  Description of Artificial Sequence: Synthetic coding sequence
atggagacggttgtcattgttgctattggcgtgctcgccactatcttcttagcaagcttcgctgccctggtactagtttgccgccaacgttactgccgccctcgggacctcctgcaaagatatgactctaagccaattgtggacttaataggggcaatggaaacccagtcagagccgtccgagctcgaacttgatgatgtggttatcaccaacccccacatagaggccatactggagaacgaagattggattgaagatgcctctggcctgatgtctcactgtatagcgattttgaagatttgccacaccctgacagagaagctggtagcgatgacaatgggatctggcgctaagatgaagactagcgccagcgtgtctgacatcattgtggtcgccaaaagaatttctccaagggtggacgacgtcgtgaaaagcatgtatcctcctttagatcctaagctgctggatgctagaaccacagcccttttgctaagtgtgagccatctggtcttggtcactcgtaatgcttgtcacttaacagggggacttgactggatagatcagtctttatccgcagctgaggagcatctcgaagtactccgcgaagcagcccttgcatcggagcccgacaagggtctgcctggacctgaagggtttcttcaggaacagagtgccatttag

SEQ ID NO: 55608 - DNA, 777 bp, Artificial Sequence
  Description of Artificial Sequence: Synthetic coding sequence
atggtcggtattctgcccttgtgctgctcgggatgtgtcccctccttgtgttgctcgtcatacgtcccgagtgtggctcctacagcagctcactccgttcgtgttccacattccgcagggcactgcggccaacgcgtccttgcttgcagtctcccccaggttttcctcaagccctggatcttcgtggagcacttttcttcctggctgtcactcgagttattttccttcctgcggtaccttgggaccttgctgtgtgcttgtggccacaggctgagagagggcctgctgctgccatgcttgctcggagttggctcctggctgctgttcaacaattggaccggaggaagctggtttagcttgcatctgcagcaagtgtcactctcacaagggagccacgttgccgcatttctaccagaggccatcgggcctggcgtcccagttcccgtaagcggggagtctacttctgctcagcagagtcatgcaggatggcagctgtcggcggaggccgacgcctgcccatctgtgctgtactcagaggttttggaatggaataaaaatattaacacatatacatccttccatgatttctgtttgatcctcggcattttcctgttctgtttcgtattagctgtaataggtctgccttacatcaaacctggcctgtccctgtcggtggccctgctgtggcagtctctgatccttctcagcagcctggtacagcaggactcccaggtacacacctgggggtgcctgttttctacctttaccagcacatag

SEQ ID NO: 55609 - DNA, 570 bp, Artificial Sequence
  Description of Artificial Sequence: Synthetic coding sequence
atggttgggatcctgccgctctgttgttctggctgcgtgcctagcctttgttgcagtagctacgtgccctcggtggccccaaccgccgctcactcagttagagtcccccattccgctgggcattgcggtcagagggtgctcgcctgctcccttcctcaggtgtttctcaaaccttggatctttgtcgagcacttttcgagctggctgagcttggagctgttctcatttctgagatacctgggtacccttctctgtgcgtgtggccatagactgcgtgaaggacttctgctgccctgtcttctgggcgttgggagctggctcctgttcaataactggactggcggaagctggtttagcctgcacctccagcaagtcagtctgtctcagggcagccacgtcgccgcatttcttccagaagcaatcggtcctggggtcccagttcctgtcagcggtgaatcaacctcagcacagcaatctcacgcagggtggcaattgagtgccgaagctgatgcctgcccatccgttctctatagcgaagtgctggagtggaacaagaatattaacacatag

SEQ ID NO: 55610 - DNA, 507 bp, Artificial Sequence
  Description of Artificial Sequence: Synthetic coding sequence
atgccgaagggatggggggttcgaagttccacgtttctccccctttggctcccggtcaaaatcgagctgcatcaagttcaatttcattcctctagccaaatgatctttagcacactgcgaagcgagctatacaagctgctggcgttatgccagcacgctgtggtgccaatgggaaaatttctcggaaagactaagacacagtctcaaggacaggtggtgatttttagtgaaaaaggtaaggccataatttatctgtccctccctagaaccgtaccgatctatacttgtatcttttcccagagcgttggctgcctcttcatcctgctcatcatctcgctcaacttccttttgttcatttatttcattgagactgacctgattatgctgccccgagttatcctggatttgctggcgtcaagtgatcccccaactttggtctctcagtctgcgggaatcactgacgtgaattatcacacccagtcgacgtgccgcagatttagtgtctag

SEQ ID NO: 55611 - DNA, 1362 bp, Artificial Sequence
  Description of Artificial Sequence: Synthetic coding sequence
atggcaatctttaggcaactgtctctcggggctaaggccactcttgcagctgtcaccgtttttgttagcatgattgcttcaaggagctacctggccgagagccttgaactgagggcatggcgttggctacttaggctgcagctggcactgtttgtcaactccttgttgcttattggctctttgtacatatggaggagcaccgtcagtaacttatgtcactcccctgccgctgagagtacctgcttccaactgtggaaagttgtcgtgttggcattcctagccttggctcactcaagtttcttcacaatgttctttctggttgctgaagaaccatatctgttttccctggcggcttactcctgcttgggcgcatatatcattatgctattcttcctcttcatactctcagggatggagcaggcgtaccagctgctggcatggcgctctggcagggtcgtaggtagtctggaaaagacccggaaactcgtccttcgcccagcactcgcggttggtgttaccgccgtgctgtcagtcgccggtatcctgaacgctgcccagcctccagctgttaaaaccgtcgaggttcctatccaccagctcccagcctccatgaacaatctcaagatcgtgctgctgtccgatatccatctgggcccaacggtgggacggactaagatggagatgttcgtgcgaatggtaaacgtcctcgagcccgacattacagtgattgtgggtgacctgtcagattctgaggcttcagtactgcggaccgcggtcgctcccctgggccaactacatagccatctgggagcttacttcgtcaccggaaaccatgaatattatacctcggacgtgagcaactggttcgctctcttggagtcgcttcacgtgcagccgcttcacaacgagaacgtgaaaatctctgccaccagagcgcaaaggggcggtggaggctccggatctggaagcgaagatgaggattggatctgcctcgccggtgtagacgacatagaggccgatatcctccactacagcgggcatggtatggacctggataaagctctggagggatgctcccctgatcatacaattatcttgctggcccaccagccactggccgctaaacgagccttgcaggccagaccggatataaatctgatcctgagtgggcatactcacgcaggccagatctttcctctgaatgtcgccgcatatctgctcaatcctttttttgcgggtctgtatcaggtggctcaagcaacattcgtttatgtaagtcccggtacggcatactatggcatcccgatgagactaggatctcgcgctgagatcacagaacttatcttacagagatcaccttag

SEQ ID NO: 55612 - DNA, 951 bp, Artificial Sequence
  Description of Artificial Sequence: Synthetic coding sequence
atggagcaggcataccagctgctggcatggaggtcagggagagttgtcggcagtctggagaaaactagaaaactcgttctgcggccagcgctggctgtgggcgtcactgcagttttatccgtggccggtatcctaaatgcagcgcagccacccgctgttaagactgtggaagttcctatccaccagctgcccgcttccatgaataatctgaagatcgttctcctgtcggacattcatctaggccctaccgtaggcagaaccaaaatggagatgtttgttagaatggtcaacgtgcttgaaccagacatcacggtcatcgtcggcgacctaagcgattcagaggcctctgtcctgaggacagccgtggctccattggggcagctccactcccatcttggagcttattttgtcacaggtaatcatgagtattataccagcgatgtgtctaactggttcgccctgctggaatccctgcatgttcagcctcttcataatgaaaacgtaaagatctcagcaacccgcgcacaacgaggcggtgggggaagcggctcagggtccgaggatgaggattggatatgtctggcaggtgtagatgatatcgaggccgacatcctgcactatagcggtcatggaatggatctcgataaagctctggaaggctgtagtccagaccacactattattctccttgcccaccagcctttggccgcaaagcgggcactgcaggcacgcccagacattaatctgattctcagcggccacacccacgccggacagatcttcccgcttaatgtggcagcgtatctgctgaatccttttttcgccggtctgtaccaggtggcccaggctacttttgtgtacgtgtccccaggtacggcctactacggcataccaatgaggctggggtctagggcagagattacagagctgatactgcagcggagcccttag

SEQ ID NO: 55613 - DNA, 882 bp, Artificial Sequence
  Description of Artificial Sequence: Synthetic coding sequence
atggatacattggaagaggtgacctgggccaatgggtcaaccgcgctgccgccacccctcgccccaaatatctctgtgccacaccgatgcctgctgctgctgtacgaggacattgggacaagccgagtgcggtactgggacctactcctccttattcccaacgtgttattcctgatttttctgttatggaagctcccctccgcgcgagcgaagatccgcattacctcatctccaattttcatcactttttacatcctggtttttgttgtagccctggtgggtatcgctcgggctgtggtgagtatgacggtgtcaacctccaacgcagccacagttgcagataaaatcctgtgggaaataactaggttttttttgctggctattgagctcagcgtgatcatactggggctggctttcggacacctagagtcaaagtcatctatcaagcgggtcctggccatcacaactgtgctctcactagcttattctgttacacaagggactctagagatcttgtatcctgatgcccaccttagcgcagaggacttcaacatttatggccatggaggcaggcaattctggctcgtttccagctgcttcttctttctcctttgtagatgtcataatctaccggtgctccaactcttgcggagtgctcatcttagaggctttccccctggcctcctccgtctgggagcccaggacccactgttacttcaaatgcctagcggcagagaccgcggagccaggtgtacccccacccctgccctacgctgcggtcccgcaggagggcctggcggttgccgcggatgttggggcctctcatgtcagctccttgaacacgcggtcagactgtgtaggcgtggcggacttcccggttag

SEQ ID NO: 55614 - DNA, 1122 bp, Artificial Sequence
  Description of Artificial Sequence: Synthetic coding sequence
atggatactctggaagaggttacctgggccaacggctccaccgcactgcctcctcctctggctcctaatatttcggtgccacataggtgcctgctcctgctgtacgaagatatcggtactagccgggttaggtattgggatctgctccttcttatcccaaacgtgctgttcttaatatttctgctgtggaagttgccttctgcaagggcaaaaatccggatcacatcctcccccattttcattaccttttacatcctagtgttcgtggtcgccctcgtgggcatcgcccgtgccgtagtcagcatgacggtttctacatctaacgctgcgacagttgccgataagatcctgtgggagatcacacgtttctttctattagccatcgagctgtcggtcatcattctcggtctcgccttcgggcacctagaatccaaatcttctatcaaaagagtgctggccataacaaccgttctgagtctcgcctactcagtgactcaggggaccttagaaatcctctaccctgatgcgcacctgagcgctgaggatttcaatatctatggacatggcggacggcagttctggttagtgtcctcatgtttttttttcctggtgtatagcctggtggtcattcttccaaagacgcctctcaaagagcgcatttcacttccatcgcggcgatcgttctatgtatacgcaggcattctcgccctgctgaatcttctgcaggggttgggctccgttttgctgtgttttgacatcattgaaggcctttgttgtgttgatgcaacaacatttctgtacttcagcttttttgcaccattaatttatgtggctttcctacgcggatttttcggctcagaacccaagattctgttcagctataaatgccaagtggacgagacagaggaacctgacgtccatctcccacagccttacgccgtggcccgacgtgaaggtctcgaagccgctggcgcagctggggcatcagccgcaagctattcatcgacccaatttgactctgctgggggagtggcctaccttgatgacattgccagtatgccctgtcataccggcagtatcaacagcaccgattcggaacgctggaaagctattaacgcgtag

SEQ ID NO: 55615 - DNA, 1122 bp, Artificial Sequence
  Description of Artificial Sequence: Synthetic coding sequence
atggacactcttgaagaggtaacatgggccaatggctcgaccgccttgcctccccctctggctccaaacatttccgttccccatcgctgtctgctcctcctgtacgaggatatcggtacatccagagtccgttattgggacctcctcctgctgattcccaatgttctgttcttgatttttctgctttggaaactcccatccgcaagagcaaaaatcagaatcaccagcagtcccattttcattactttttatatcttggtctttgtagtagcccttgtcggcattgcacgcgctgttgtgagcatgacggtatccacttccaacgccgcaactgttgcagataaaattctgtgggagattacgcgattcttcttgttagctatcgaactttccgtaatcatactgggactcgcattcggacatctggagtcaaagagttccataaagcgagtgcttgccattaccaccgttctgtcactggcatactccgtcacacagggcaccttggagatactataccccgacgcacatctgagcgctgaggatttcaacatatacggccacggcggtagacagttttggctggttagctcatgctttttctttctggtatatagtttggtcgtcatccttccgaaaactcctctgaaagagagaattagccttccaagccggagatctttctacgtgtacgccggaatactggccctgctgaatctcctgcagggattgggcagtgtattgctgtgcttcgacattatagagggtttgtgttgcgtagacgccacgaccttcctctatttctcctttttcgcccctctcatctacgtcgcttttctccggggattctttggttctgagcctaagatcctgtttagctacaaatgccaggtggacgaaactgaggagcctgacgtacatctgccacagccctacgcggtcgcacgtcgagagggcctcgaggccgcaggcgcagcaggcgcttccgcagcctcctacagtagcactcagtttgacagcgcaggcggtgtagcttatctagacgacatcgctagtatgccctgtcacacaggatcaattaattctacagacagcgagcgttggaaagcgataaacgcctag

SEQ ID NO: 55616 - DNA, 126 bp, Artificial Sequence
  Description of Artificial Sequence: Synthetic coding sequence
atggacactttggaagaagtgacatgggcaaatggaagcactgccttacctcctccacttgcacccaacattagtgtgcctcatcgttgtctgttgctcctgtacgaggacataggaactagttag

SEQ ID NO: 55617 - DNA, 612 bp, Artificial Sequence
  Description of Artificial Sequence: Synthetic coding sequence
atggacacccttgaagaagtgacctgggctaatgggtctaccgcccttccacctccactggcaccgaatatttccgtcccgcaccgttgtttactgcttctttatgaggatattggtacctctagggtccggtactgggacctgctgttgctcattccaaacgtcctgtttcttatttttcttctgtggaaactccctagcgccagagcaaagattcgaatcaccagtagcccgatcttcataaccttttatatcctagtcttcgtggtggctttagtgggtatcgcacgggcagttgtgtctatgaccgtttcaacaagcaatgccgcaacagtggccgacaaaatcctgtgggagattactaggttcttcttattggcaatcgaactgtcagtaattatactcggcctcgcattcggccacctggagagtaaaagctccatcaagcgtgtcctggctataaccactgtcctgtctcttgcctactccgtgactcagggcacactggagatcctgtaccctgacgcacacctttcagccgaagattttaacatctacggacatggtgggaggcaattttggctggttagctcctgtttctttttcctgtag

SEQ ID NO: 55618 - DNA, 1122 bp, Artificial Sequence
  Description of Artificial Sequence: Synthetic coding sequence
atggatactctcgaagaggtgacctgggccaacggatctacagccctgccccctcctcttgctcctaacatctctgtgcctcaccggtgtctgctcctgttgtacgaggacatcggcacctctcgtgttagatactgggacctgcttcttctcattccaaatgtgctgttcttaatcttccttctgtggaagctgccatcggcacgggcaaagatcaggatcacctcttccccaatcttcatcacattctatattctggtttttgtcgtcgccctggtgggtatcgcacgtgcagtggtgtcaatgacggtgtccacctccaacgcagccacagtggcagacaagatactgtgggagattacacggtttttcctgctggcaatcgagctaagcgtgataattctcggcctggccttcggccacctcgaatccaaatcaagcatcaaacgcgtgttagctatcacaactgtgctgagtctggcatactctgtgacgcagggtaccctggagatcctttatcccgacgcacatctgtccgccgaggatttcaatatttatggtcacggaggccgtcagttctggctcgtgtcctcctgtttctttttcctagtgtactctctcgtggtaatcctgcccaaaaccccactgaaagaaaggatcagtttgccctcacgcagaagcttctatgtgtatgcaggcatactagcactgcttaaccttctccagggcctcggcagcgtgctgttatgtttcgacatcatcgagggactgtgctgtgtggacgcgacaacttttctgtattttagcttctttgccccactgatatacgtggccttccttagaggcttctttggttccgaaccaaagattctgttttcctataagtgccaagtggatgagactgaggaacctgatgttcatctccctcaaccttatgccgtggctcgtcgtgagggactggaggcggctggcgcagctggagcttctgcagccagttacagctcaacgcagttcgactcggcaggaggggtggcctacctcgatgacattgcatcaatgccatgccacactggatccattaacagcaccgattctgaacgatggaaggctatcaacgcttag

SEQ ID NO: 55619 - DNA, 615 bp, Artificial Sequence
  Description of Artificial Sequence: Synthetic coding sequence
atggatacacttgaggaggttacttgggccaacggctcaacagccttaccacctccactggccccaaatatcagcgttccgcacaggtgcctgcttttgctctacgaagacatcggcacgagccgagtgaggtattgggacttgttgttgctgattccaaacgtgctgttcctgatcttcctactgtggaagctaccctccgcacgtgcgaagatcagaataaccagttctccaatctttattaccttttatatcctcgtgttcgtggtagctctggtcggtattgccagggccgtggtctccatgactgtatctacttctaatgccgctacagtggccgacaaaatattgtgggagatcacaagattcttcctattagcgatagaactcagcgtgatcatcctggggctggccttcggccatctggaatcgaagtcatccatcaaacgggttctagccattaccactgtgctgtctcttgcctactccgtgacccaagggacattagaaattttgtacccggacgcacacctgtctgctgaagactttaacatctatgggcatggcggtcggcagttttggttggtttctagttgctttttctttctagtgtag

SEQ ID NO: 55620 - DNA, 501 bp, Artificial Sequence
  Description of Artificial Sequence: Synthetic coding sequence
atggatacacttgaagaagtgacctgggctaacggctcaaccgctctccctcctcctctcgcaccgaacatcagcgtcccccacaggtgtctgctgctgctatatgaggatataggtacaagtagggttcggtactgggacctgctgttgcttatccccaatgttttatttttgatttttctgctgtggaagcttcccagtgccagagccaagatacggatcacctcctcaccaatcttcataacattttacattcttgtgttcgtcgtggctctcgtcggaattgcacgggcagtggtcagcatgacagtcagtacctctaatgccgctacagtcgctgacaagatcctctgggaaataactcgatttttcctactggccatcgagttgagcgtcattatactgggtttggccttcggccaccttgaatcgaaaagctccatcaaaagagtcctggccatcaccacagtgctctcactggcctactccgttacccaatag

SEQ ID NO: 55621 - DNA, 390 bp, Artificial Sequence
  Description of Artificial Sequence: Synthetic coding sequence
taaagcgaggtgccacttcccccaggcgcactggcaaccctctcttcatcttgttcactcggggtggctctacatcggagcagtcccgcatctcgcggaccaggggagtcgtccttgccggcattctctggggtcgccctactgccacctgcttgcaaggccggactgccctacaatctgtcccggcaagagggacacctgacctgcttgagcatcccagacatcaaaaccgcattcagcgattgtaccagtaagatcggtcgtcgagactgcctgactcaggcttgtagtgccctgaccggtaagggagtgagagaggggatcgagtggatggtgaagtgcgtcgtaaggaacgttcaccggccacctcgccagcgcgacatcacttag

SEQ ID NO: 55622 - DNA, 1158 bp, Artificial Sequence
  Description of Artificial Sequence: Synthetic coding sequence
atggtcttaatgcatctcgctgtaaaaaataatcgtatgtcagcaaacaatgatcattttctcacaccaacttggcagcagatgagggccacccccctggctgcgcctgctgggtctctgtccaggaaaaaacgtttggagttagacgacaatctggacactgaaagacctgtgcagaaacgggcacggtccggtccccaacctcgcctccccccatgtctgctgcctctaagtcctccgaccgcaccagatagggccaccgccgtggccactgcctcccgccttggcccttatgtcctcctggagccagaggaaggtggaagggcctaccaggctcttcactgccccactggcaccgagtacacttgcaaagtgtatccagtacaagaagcactagccgtcctcgaaccttatgctcgattgccgcctcacaaacatgtggctcgaccaacagaggtgcttgccggaactcagcttctgtacgcctttttcactcggacgcacggcgacatgcactctcttgtgagatctcgacaccggatccccgaacctgaagccgcagtcctgttcaggcagatggctacagcccttgcccactgccatcagcacggcttggtgctccgcgacttaaagctgtgcagattcgtcttcgccgaccgagagagaaagaagctggtcctcgaaaaccttgaggactcatgtgtgctgaccggccctgatgattcactgtgggacaagcacgcctgtcccgcttatgttgggccagaaattctgagctccagggcctcctactccggaaaggccgctgacgtgtggtctctgggcgtggctctgttcactatgctggcaggacattacccattccaggatagcgagccggtgttgctcttcggcaagatacggagaggcgcttacgccttgccggctgggctttctgcccctgctaggtgcctggtgcgttgtttactgcgacgcgaacccgctgaacggctgacagccaccggaatccttctacacccttggctgcgccaagacccgatgcccctcgcccctacacgtagtcatctgtgggaggcggctcaagtcgtacctgacggactgggtctcgatgaggcgagggaggaagaaggagacagagaggttgttctgtacgggtag

SEQ ID NO: 55623 - DNA, 816 bp, Artificial Sequence
  Description of Artificial Sequence: Synthetic coding sequence
atgcgagcaactcctttggccgcaccagccggatccctgagccgcaagaagcgccttgagttggacgacaacctcgacacagagcgacctgtccagaagcgtgcccgtagcggacctcagcctcgcctccctccctgtctcctgcccctgtctccccctacggccccagaccgcgcaacggctgtggccactgcctcacgtttaggtccatatgtcctgctggaacctgaggagggcggaagggcataccaggctctccactgccctaccggcactgagtacacctgcaaggtttatcccgtgcaggaagctctagctgttctcgagccctacgccagactgcctccccataaacacgtggctaggcccacagaggtcctggcaggcacccagctgctgtatgcattttttacacgaacccacggggatatgcacagcctggtcaggtctagacataggatccccgaacctgaagctgcggtactgtttcgacagatggccacagctctggcgcactgccatcagcacggactggttctgcgcgaccttaaactgtgccgcttcgtgtttgctgaccgtgaaagaaaaaaactggtgctggagaatttggaagattcatgcgtgcttaccgggccagatgattcactctgggataaacacgcttgtcccgcttatgtcggaccagagattcttagtagccgggcatcttacagtggaaaagccgctgatgtgtggagcctcggcgtggcactttttaccatgctggcgggtcactatccattccaggatagcgaacccgtgttgctattcggctag

SEQ ID NO: 55624 - DNA, 1188 bp, Artificial Sequence
  Description of Artificial Sequence: Synthetic coding sequence
atggcgtcagctgcctccgttacatccttggctgatgaagttaactgccctatctgccagggcaccctccgggaaccagtgaccatagactgtggtcacaacttctgcagggcttgtctgacaaggtactgtgagattcctggtcccgacctggaagagtccccaacttgccctttatgtaaagagccctttaggccgggatcattcaggcccaattggcagctcgctaacgtggtggagaacatcgaacgtctccaactggtgtccactctcggtctaggggaagaagatgtgtgccaggagcacggtgagaaaatttactttttttgtgaggacgatgaaatgcagctttgcgtggtgtgccgggaagcaggcgagcatgccacccataccatgaggtttctggaggacgctgctgccccataccgtgagcagatccataagtgcctgaagtgtctcagaaaggaaagggaggagatccaggagattcaatctcgtgagaataagagaatgcaggtacttttaacccaggtgtctaccaaacggcaacaagtgattagcgagtttgcacacctgagaaaatttctggaagagcaacagtccattctgctcgctcagctcgaatctcaggatggggacatcctgagacagagggatgaatttgacttactcgttgcgggagaaatttgtcgcttcagcgctctgatcgaagaactagaggaaaagaatgaacgccctgcccgagaactgctgacagatattcgcagtacactcattagatgtgagacgagaaaatgcaggaaaccagtggctgtttctccagagctcggacagcgtatccgggacttccctcagcaggctttgccgttacagcgtgaaatgaaaatgtttttggaaaaactgtgctttgagttagattatgagcccgcacacattagcttagacccacaaactagtcaccccaagttgctcctgagcgaagatcatcaaagagcgcaattcagttacaaatggcaaaactcaccggacaacccacagaggtttgacagggccacttgtgtgctggcccacaccggtatcactggaggacgtcacacttgggtgtggatggctagggttccgggtgactctggatgctgccaattctgttccccaccgtctgtcttagggaccgaagtcgccgcatag

SEQ ID NO: 55625 - DNA, 1446 bp, Artificial Sequence
  Description of Artificial Sequence: Synthetic coding sequence
atggcatccgccgcatcggtcaccagcctggcagacgaggtcaactgtcccatctgccaagggacgctgagagaacccgtcactatcgattgtggtcacaacttctgtagagcttgcttgacccgatactgtgaaattcccggtccagatctggaagaaagccctacatgtcccctgtgcaaagagccatttaggcccggatcctttaggcctaattggcaactggccaatgtagtagaaaacatagagcgcttacagcttgtttccactctggggcttggggaagaagacgtatgtcaagagcacggcgagaaaatatattttttctgtgaagacgatgagatgcagctttgcgttgtgtgtcgcgaggcgggtgaacacgcgactcatactatgcgttttcttgaggatgccgcagccccatatcgcgaacagattcataagtgtctgaaatgtctccgaaaagagcgagaagagatccaagaaattcagagcagggagaataagcgcatgcaggtgctcctgactcaagtaagtactaagagacaacaagtcattagcgagttcgctcacctcaggaagttcctggaagagcaacagagtattctccttgcacagctggaatcacaggacggcgacattttgaggcagcgggacgagttcgacctattggttgccggagaaatctgtagattctctgccttgatcgaggagctcgaggagaaaaatgaaaggccagcaagagagcttttgacagacattcgcagcactctgatacggtgcgagacgaggaaatgtcgtaagcctgtggcagttagcccagaactaggtcagcgaatccgggattttccacagcaggccctcccgctgcaacgggagatgaaaatgttccttgaaaagctgtgcttcgagctagattacgaacctgcccatatctctctagacccccagacctctcaccccaaactcctcctatcagaggaccaccagcgagcacagttttcatacaagtggcagaattctcccgataacccgcaacggttcgaccgtgctacatgtgtccttgcccacactggtattacagggggaaggcatacctgggtcgtatccatcgatctggctcacggcggtagctgtacagtgggagtcgtcagtgaagatgtgcagaggaagggcgagctccgacttagacccgaggaaggtgtctgggccgtccgtctggcgtgggggttcgtgtctgcacttggctccttcccgacaaggttgacacttaaagaacagccaaggcaagttcgagtgtccctagattatgaagtgggttgggtgacatttactaacgcggtgacccgggaaccaatatatacattcaccgcctctttcacaagaaaggtgattccattttttgggttgtggggcagaggctcctccttcagcctctccagttag

SEQ ID NO: 55626 - DNA, 1446 bp, Artificial Sequence
  Description of Artificial Sequence: Synthetic coding sequence
atggcgtcagctgcatctgttacctccttggcggacgaggtcaattgtcccatatgccagggtactctcagagagcccgtcaccatcgactgcggccacaatttttgcagggcctgtctgacccgctactgtgaaatccccggtcccgatctggaggagagccccacctgtccactgtgtaaagaacccttcaggccgggatcatttcgtcccaattggcaacttgcaaacgtggtggaaaacatcgagagacttcagctcgtgtctacactgggcctgggggaagaagacgtctgccaagagcatggcgaaaaaatttacttcttttgcgaggacgacgagatgcagctgtgtgtggtttgcagggaagccggagagcacgctacccacaccatgcggttcctggaagacgcagctgctccataccgtgaacagattcacaagtgcttaaaatgcctgcgaaaagagagggaggaaatacaggagatccagagcagggagaacaagcgcatgcaagtgctgctcacacaagtctccaccaagcggcaacaagtgatcagtgagtttgcacatctcaggaagtttcttgaagaacaacagtccattctactcgcacagctcgagagccaggacggagatatcctgcgccagagagatgaattcgacctgctcgtggctggtgaaatctgcagatttagtgccctcatcgaggaacttgaggaaaagaacgaacgccctgccagagagctgcttacggacattagatctacgttgattagatgtgaaaccaggaaatgccggaaacctgtcgccgtctcaccagagctgggccaacgaatcagggacttccctcagcaggccctcccactgcagagggaaatgaaaatgttcctggagaaccttcctaaccacctagttatcccaaccgcccatatctccctggacccccagacctcacaccctaagctgttgcttagtgaggatcaccagcgagctcagtttagttacaaatggcaaaattccccagacaacccacagcggtttgaccgtgccacatgcgtccttgcacacaccgggatcactggtggtagacacacctgggtggtgagcatcgatcttgcccacggcggaagttgcacggtgggggtggtctccgaagacgttcagagaaagggggagctgcggctccgtccagaagaaggcgtctgggctgtccgcttagcgtggggttttgtgagtgctctggggagtttccccacccggcttactttaaaagaacagccacggcaggtgcgtgtatccctggactatgaggtggggtgggtgacgtttactaatgccgtgacaagagaacccatctacacttttaccgcaagctttactcggaaggtgatcccattctttgggctgtggggccgtggctctagcttcagcctaagtagctag

SEQ ID NO: 55627 - DNA, 1695 bp, Artificial Sequence
  Description of Artificial Sequence: Synthetic coding sequence
atggcagaactagatttaatggcaccaggtccactgccacgcgcaacagctcagccacccgcaccgctcagtccagacagcggcagcccttcccccgattctggttctgcctcccccgtggaagaggaggacgtgggcagctccgagaaactgggcagagagaccgaggagcaggattcggacagcgcagaacaaggagacccagcgggagaagggaaggaggtcctttgcgacttctgtctagatgacacccggagagtgaaggccgtgaagagctgtctgacttgtatggtgaactactgcgaagaacacctacagccgcaccaggttaatattaagctgcaatcacatcttttaaccgagccggtgaaggaccataattggcgctactgcccagctcaccattctcccctgagcgctttttgttgccctgaccagcagtgtatttgtcaagactgttgccaggagcactcaggccataccatcgtgtctctggatgcagcaaggcgggataaggaggccgaactccagtgtacacagctcgatttggagagaaagctgaagctgaacgaaaatgcgatctcacggctgcaggccaaccaaaagtccgtgttagttagtgtctccgaagtgaaggctgtggcggaaatgcagtttggcgagctcctggcagccgtgaggaaagctcaagcaaacgtcatgttgtttctcgaggaaaaggagcaggccgctctgtcccaggccaacgggatcaaggcccatctggagtaccggtctgccgaaatggagaagtccaaacaagagcttgagagaatggcagccatttctaacaccgtgcagttcttggaagaatactgtaagttcaagaacacagaggacatcacatttccttctgtctatgtgggtctgaaagataaactgtccgggattagaaaggtcattacagaaagcaccgtgcatctgattcagctgttggaaaactataagaagaagcttcaggaatttagcaaagaggaggagtatgatatccgcactcaagtcagtgcagtcgtgcagcggaaatattggaccagcaagcccgaaccctctactagagaacagttcctccagtatgcctatgatatcacctttgaccccgatactgcccataagtacttaagattgcaggaggagaatcggaaagtgactaacactacgccctgggaacacccttaccccgatctaccaagccgcttcttgcactggagacaggttctttcccagcaaagtctctatttgcaccgctattatttcgaggtcgagatctttggggcaggcacctacgtcggtcttacatgtaagggcatcgacaggaaaggtgaagaaagaaacagctgcatatccggcaacaattttagctggtccctacagtggaacggcaaagaattcaccgcctggtacagcgacatggagacaccgctgaaggcgggaccattccgcagactgggcgtgtacattgacttccccggtgggattcttagcttttatggcgtagaatacgacactatgaccctggtgcataagttcgcatgcaagttcagcgagcccgtctatgctgccttttggcttagtaagaaagagaacgccatccgcatcgtggacctaggagaggagccagaaaagccagctcctagtctggtcggcaccgcaccatag

SEQ ID NO: 55628 - DNA, 1695 bp, Artificial Sequence
  Description of Artificial Sequence: Synthetic coding sequence
atggcagaactggacctgatggctccaggacccctaccgagggctaccgctcaacccccagcccctttatcacctgattctgggtcaccaagcccagatagtgggtcagccagcccagttgaggaagaagacgtaggtagctctgaaaagttaggacgggagaccgaggagcaggatagcgacagtgcagagcagggagatcctgccggtgagggtaaagaagtgctctgcgacttctgtctcgatgatactcgccgtgtgaaggcggtaaaatcatgtcttacttgcatggtgaactattgcgaggaacacctccagcctcatcaggtgaacataaagctccaatcccatctgctaaccgagcctgttaaagaccacaattggaggtattgtccagcccaccacagtccgctgtctgctttttgttgtcccgatcagcagtgtatctgtcaagattgctgccaagagcatagcggacatacaattgtgagccttgatgcagctaggagggacaaggaggctgagcttcagtgcacccagctcgatctggaacgcaagctgaaattaaatgagaacgccatttctaggcttcaggccaaccagaagagcgtgctggtgtctgtctccgaggtcaaagcggtggcagagatgcagtttggcgagctcttagctgcagtgcgcaaggcccaggccaacgtaatgctctttctagaggaaaaagagcaggcggcactgtctcaggccaatggtatcaaagcacatctcgaatacagatccgctgagatggaaaagtctaagcaggagcttgagcggatggccgcaattagcaatacggtgcaattcctggaggagtattgtaaattcaagaacactgaagacattactttcccatctgtatacgtcggacttaaggacaagctgtcgggcattaggaaggtgattacagagtcgactgtccacctgatccaactgctcgagaattataagaagaaattacaggagttcagtaaagaagaggagtacgacatccgaacacaggtgagcgccgtcgttcagcggaagtattggacatcaaagcctgaaccatcaacaagggaacagtttctacaatacgcgtacgatatcacctttgaccctgacacagcacacaagtatctgcgacttcaggaggagaatcggaaagtaacaaatacaactccatgggaacacccctatcccgatcttccctcccgtttcctgcattggagacaagtccttagtcagcagagtctttacctccaccggtactatttcgaagtagaaattttcggggcagggacatatgtgggccttacctgcaagggaattgaccgtaagggcgaggagcgaaacagctgcatttcagggaataatttttcctggagcctgcagtggaacgggaaggagtttacggcatggtatagcgacatggagacaccgttgaaggccggacccttcagaaggctgggagtttacattgacttccccggagggattctgagcttttacggtgtggagtatgacacaatgactctggtccacaaatttgcttgtaaattttccgagccagtctacgccgctttttggctgtccaaaaaggaaaacgccatccgcatcgtagaccttggagaggagcccgagaagcccgcaccaagcctggttgggaccgctccatag

SEQ ID NO: 55629 - DNA, 1425 bp, Artificial Sequence
  Description of Artificial Sequence: Synthetic coding sequence
atggaggctgaagacattcaagaagagctcacctgcccgatttgcctggactactttcaagatcccgtctcgattgagtgtggacacaacttctgtaggggttgcctgcatcggaattgggcccctgggggaggcccatttccctgccccgaatgtcgacacccgtcagccccagctgcccttagaccaaattgggccctcgctcggttgaccgagaaaacacagaggcgtcggctgggaccagtcccccctgggctgtgcggcaggcactgggagccactgaggctgttctgcgaagatgaccagagaccagtgtgcttagtgtgtagagagagtcaggagcatcagacccatgctatggcaccaatagacgaggcttttgagtcttatagggagaaactgcttaaatctcagaggaatctagttgcaaagatgaaaaaggttatgcatttgcaggacgtggaggtgaagaatgcgacacagtggaaagacaagatcaaaagtcagcggatgaggatatccactgagttctcgaaactgcacaatttcctggttgaagaagaggatctatttttacagcgtttaaataaggaagaagaggagaccaagaaaaaattgaacgagaacaccctcaagctcaatcaaactattgcctccctcaaaaaattgatcttggaagttggggaaaagagtcaggcacctacactggagctcctacagaatccaaaggaagttctgacaagatctgagatccaagatgtgaattactccctagaagcggtgaaggtaaagactgtgtgtcagataccgctgatgaaggagatgcttaagagatttcaggtggccgttaatctagccgaggacactgcccacccaaagctcgtcttcagtcaggaaggcaggtatgttaagaatactgccagcgcatccagttggcccgtattcagctctgcatggaactacttcgcgggatggagaaatcctcagaaaacggctttcgtcgaacgttttcagcatctgccttgcgttctgggaaaaaacgtgtttaccagcgggaaacactattgggaggtggaatcccgagattctcttgaagtagctgttggagtgtgtcgagaggacgtcatgggcatcaccgaccggagcaaaatgtccccagacgtcggcatttgggccatctattggtctgccgctggctactggcccctgatcggcttcccaggtacgccaactcagcaggagcccgctctgcacagggtgggggtgtacctcgatagaggcaccgggaatgtaagtttctacagcgccgtggacggggtgcatttgcacaccttcagctgctcctctgtgagtcggctccgcccatttttttggcttagtcccctggccagcctggtgattcctcctgtgacagacaggaaatag

SEQ ID NO: 55630 - DNA, 885 bp, Artificial Sequence
  Description of Artificial Sequence: Synthetic coding sequence
atggaagcggaagatatccaggaggaacttacatgtcccatctgccttgactactttcaagatcccgtgagtatagaatgcggacacaacttttgtcgcggatgcctccaccggaattgggcaccaggaggtggtcctttcccttgtcctgagtgcaggcaccctagcgctcccgcagcacttagacccaactgggccttagccaggctgacagaaaagacacagcggagaaggctcggaccagttccgccagggctgtgcgggcgtcactgggaacctctccgactgttttgcgaagatgatcagcgaccagtctgcctggtttgtcgtgagagccaagagcatcagacacacgccatggcacccattgatgaagcattcgaaagctatcgggagaagctgctcaagtctcagaggaatctagtggccaagatgaagaaagttatgcacctccaagacgtggaagtgaaaaacgctactcagtggaaagacaagataaaatctcaaaggatgagaatatctactgaattctctaaactccataatttcttggtggaggaggaagacctatttctccagagactgaacaaagaggaggaggagactaaaaagaaacttaacgagaatacactgaaattgaatcaaacaattgcttccctgaaaaagctgattctggaagtaggggagaaatctcaagcccctacactcgaacttctccagaacccgaaggaagtactcactagatccgagattcaggatgtcaattatagtctggaggctgtgaaggtaaagacagtttgtcagattcccctaatgaaggagatgctgaaaagatttcaggccacaaagataaaaacacaaaagcagaaccggcacaatatgtag

SEQ ID NO: 55631 - DNA, 1503 bp, Artificial Sequence
  Description of Artificial Sequence: Synthetic coding sequence
atggaagcagaggatatccaggaggaattgacttgccccatatgcttggactattttcaggacccagtttcaatcgaatgcgggcacaatttttgtagggggtgcctgcacaggaattgggcccctgggggaggaccattcccttgtcccgaatgccgccaccccagtgctcctgcagccctccgtcccaattgggcactggctcgacttactgagaagacccaaagaagacgcctaggaccggttccacctggtctctgtggcaggcactgggaacctctccgcctgttctgcgaggatgaccagcgccctgtatgccttgtctgtagagagagccaggaacatcagactcatgcgatggctcctattgacgaagcatttgaatcatacagaactggcaattttgatattcatgtggacgagtggaagaggaggctgatcagactcctgctgtaccatttcaaacaggaagagaagcttcttaagtcccagcgtaatttagtggctaagatgaaaaaagtcatgcatttacaagacgttgaagtaaagaacgctacccagtggaaagataagatcaagtctcagcgaatgaggattagcacagagttctcaaaattacacaacttcctcgtggaggaggaagacctcttcctgcagcgcttgaataaagaagaagaggagacaaaaaagaagttgaatgagaatacactgaaactgaaccaaaccatagcctccctcaagaaactcattctcgaggtgggcgaaaagtcccaggcccctacattggaattgctgcaaaaccccaaagaagtgctcacccgaagcgaaatacaggacgttaattactccctggaggccgttaaagtcaagacagtttgccagatccctctgatgaaggagatgctgaaacggttccaagtcgcagtgaatcttgcagaagataccgcacaccctaaacttgtcttctctcaggagggtcggtatgttaaaaacactgccagtgcttcatcatggcccgttttttctagtgcgtggaactatttcgcgggttggaggaacccccaaaagaccgccttcgtggagcgcttccagcatcttccttgcgttctcggaaagaatgtgtttacgagtggaaaacactattgggaagtcgaatcgcgagacagcttggaagtggcagtgggggtgtgccgggaggatgtcatggggatcactgacaggtccaagatgagccccgatgtcgggatctgggcgatctactggagcgctgccggttattggcctctgattgggtttccaggcactcctacacagcaagaaccggcactgcaccgagtcggggtctacctcgaccgcggaaccgggaacgtgagcttctacagcgcggttgatggcgtgcatctgcataccttttcctgcagcagtgtgagccgcttgaggccctttttttggctgtcccctctggcctctctcgtgatacctcctgtgaccgatcgcaagtag

SEQ ID NO: 55632 - DNA, 993 bp, Artificial Sequence
  Description of Artificial Sequence: Synthetic coding sequence
atgaaaaaggtgatgcacctgcaggatgtagaggttaagaacgctacccagtggaaggataagatcaagtctcagaggatgcggatctctactgaatttagcaaacttcacaattttttggtggaggaagaggacctgtttctccagcgccttaacaaggaggaagaggagacaaagaaaaagctcaacgagaacaccctaaagcttaaccagacgattgcaagtctcaaaaaattgattcttgaggttggagagaaatctcaagcacccactcttgagttactgcaaaacccaaaggaggtcctgacgaggagcgagattcaagatgtcaattactctcttgaggcagtgaaggtgaaaacagtttgtcagatccccctaatgaaagagatgctaaagcgattccaggtagcagttaatctagcggaggacactgcacatcctaagctggtgttttctcaggaaggaagatacgtgaagaacaccgcttcagccagcagttggccagtgttctcatcagcttggaattattttgccggatggagaaatccacagaagacggcattcgttgagaggttccagcatctcccctgtgtgctcggaaaaaacgtcttcacgtcagggaaacactactgggaggtggagagccgggactctttggaagtggccgtgggcgtgtgcagagaagacgtgatggggattactgatcgttccaagatgtcccccgatgtcgggatttgggctatatattggtctgctgccggatattggccactgatcggctttcccggtaccccaactcagcaggaaccggctctccaccgcgtgggagtgtatttggacagaggaactggcaacgtctccttttacagtgccgtcgatggtgtccaccttcataccttcagttgttcctctgtgtcccggcttcgcccttttttttggctaagtccacttgcgagcctggttatacctcctgtgacagataggaagtag

SEQ ID NO: 55633 - DNA, 1212 bp, Artificial Sequence
  Description of Artificial Sequence: Synthetic coding sequence
atgcacaatttcgaagaggaactcacatgcccaatatgttactcgatatttgaggacccacgggtgttaccctgtagccacactttctgccgcaattgtcttgaaaacattctccaggcatcagggaacttttacatatggaggcccttgcggataccgttaaagtgcccgaattgtaggagcatcacagaaatagctccaacgggcatagagtctctcccggtgaattttgcgctgcgtgccattatcgaaaaatatcaacaggaggaccatccagatatcgtcacatgccctgaacactaccgtcagccattaaacgtatattgtttattagacaaaaaacttgtgtgcgggcactgcctgactatcggacagcatcatggccacccaatcgacgacctgcagagcgcctacttgaaagagaaagatacacctcaaaagctgctggaacagctcacggacacccactggactgacctgacacacttgatcgaaaaacttaaggaacagaaaagtcactccgagaaaatgatccagggcgacaaagaagcagtgctacagtatttcaaggagttgaatgacaccctagaacagaagaagaagtccttcttaacagcgttgtgcgacgttggcaaccttattaatcaggagtacaccccccagatcgagcgtatgaaggaaatcagagagcaacagctggagctgatggctctgaccataagtctacaggaagagtcacccctgaaatttctcgagaaagtggacgatgtgaggcaacacgttcagatacttaagcagcgaccccttccggaagttcagcctgtggaaatctacccccgtgtctccaagattctgaaagaggaatggtcacgaacagagataggtcaaattaaaaacgttctcatccctaagatgaaaatttctccaaaaaggatgagctgctcatggcctggcaaggacgaaaaggaggttgagttcctgaaaattcttaatatcgtcgtcgtcaccctgatcagtgtgatcctgatgtccatattattctttaatcaacacatcattacttttctgtcagaaataacattgatctggttttccgaagcctctctgagcgtgtaccagtcactttccaatagcctgcacaaagtcaaaaacatcttgtgtcatatcttctatctgctgaaggaatttgtgtggaaaatagtgagccactag

SEQ ID NO: 55634 - DNA, 345 bp, Artificial Sequence
  Description of Artificial Sequence: Synthetic coding sequence
atgcacaacttcgaagaggagctaacctgcccgatttgttactctatcttcgaagaccccagagtcctgccgtgttcccacacattctgccgaaactgcctggagaacattctccaagccagcggaaacttttatatttggcgtcccctgagaatccctttgaagtgccctaactgtagatccataaccgagattgcgcctacgggtatcgagtccctcccagtgaattttgcccttcgggcaataattgagaagtatcagcaagaagaccaccctgatattgtcacgtgtccagagcactaccgccagcccttgaatgtttattgtctgctggacaagaaatag

SEQ ID NO: 55635 - DNA, 468 bp, Artificial Sequence
  Description of Artificial Sequence: Synthetic coding sequence
atgcataatttcgaagaagagctgacatgccccatctgttactccatttttgaggatccaagagttcttccatgcagtcacaccttctgcagaaattgtttggagaatattctgcaggcctcagggaacttttatatctggaggccccttcgcatacctcttaaatgccccaactgccgcagcatcacggagatagccccaacggggattgaaagcctccccgtcaatttcgctctcagagctattattgaaaagtatcagcaagaagatcatcctgacatcgttacctgcccagagcactatagacagcccttgaacgtgtattgcctgcttgataagaaactggtctgcggacactgcttgaccatcggccagcaccacgggcaccctatcgacgaccttcaaagtgcctatctgaaagaaaaggatacgccacaaaaactgctggaacagctcaccgacacctag

SEQ ID NO: 55636 - DNA, 534 bp, Artificial Sequence
  Description of Artificial Sequence: Synthetic coding sequence
atgcataactttgaagaagaactcacatgccctatctgctattctatcttcgaggaccccagagtgttaccatgttcccatactttttgtcgaaactgtttggaaaacattttgcaggcatctggaaacttttacatatggaggccactccgaatcccactgaaatgccccaactgtcgctccatcaccgaaatcgctcccactggtattgaatctctgccagtcaactttgcactgagggctattattgagaaataccaacaggaggaccacccggacatcgtcacctgtcccgaacactacagacagcccctaaacgtgtactgcttgctcgataagaaactcgtgtgcggtcactgccttacaatcggacagcaccatgggcacccaattgatgatctgcagagcgcttacctcaaggaaaaggacactccccaaaagctcctcgagcagctgacagacacgcattggacagacctgactcacctgattgagaagctgaaagaacagaagtctcacagcgagaaaatgtag

SEQ ID NO: 55637 - DNA, 336 bp, Artificial Sequence
  Description of Artificial Sequence: Synthetic coding sequence
atgcacaatttcgaggaggaactaacttgcccaatctgttactcgatcttcgaggacccccgagttctgccttgttctcatacattctgtcgtaactgtctcgagaatattctccaggcttctggcaacttctatatttggcgtccactgaggattcccctgaagtgcccgaattgcagatccattacagagattgcgccaacaggtatcgagagtctgcccgttaacttcgctctgagggcaatcatagagaagtaccagcaggaagaccatccagatattgtgacgtgtcctgaacattatcggcaaccgcttaatgtctattgtctgctgtag

SEQ ID NO: 55638 - DNA, 972 bp, Artificial Sequence
  Description of Artificial Sequence: Synthetic coding sequence
atgcataacttcgaagaggagctgacctgccccatttgttattcaatctttgaggatcctagggtgcttccttgtagccatacgttctgccgtaactgccttgagaacatcctccaggcctcgggtaatttctacatatggagaccgctccggattccactaaagtgtcccaattgcagatccattactgaaatcgctcccacaggaatcgagtcgttacccgttaattttgcgctaagagctatcattgaaaaatatcagcaggaggaccaccctgacatcgtcacttgccctgaacattatcggcagcctctgaatgtgtattgcctcctggacaaaaagctcgtgtgcgggcattgccttaccattggacagcatcatgggcacccaatcgacgacttacagtctgcctatctcaaagaaaaagatacccctcaaaaattactcgagcagttgaccgacactcactggacggacctgacccatttgattgagaaactcaaagagcagaagtcacatagtgaaaagatgattcagggcgataaggaagccgtcctgcagtactttaaggaactgaacgacacactcgagcagaaaaagaagtcattcctgactgccctatgcgacgtcgggaaccttattaatcaggagtatacacctcagatcgaacgcatgaaggagattcgcgagcaacagctggagctcatggcattgactattagtttgcaggaagagagccctcttaagttccttgaaaaggtggacgatgtgagacagcacgtccagatcctcaaacagcgacctcttccggaggtccagccagttgagatctaccctagagtgagcaagatcttaaaggaggagtggtcacggacagagattggacaaatcaagaacgtgctgattccgaagatgaaaatctctcctaagcggatgagttgctcttggcccgacgagggcacggataagtag

SEQ ID NO: 55639 - DNA, 1380 bp, Artificial Sequence
  Description of Artificial Sequence: Synthetic coding sequence
atggctggtctgaaaaggcgcgtgcctttacattctctccggtactttatctccatggttggattgttcagcaaaccaggactactcccctggtatgcaagaaatccacccggttggagccaattattcctcggaaccgtctgtaagggagatttcactcgggtaatagctactaaatgtcagaaagggcagaagtcccagaagaaaccgtcccacctcggaccgctcgacggatcttggcaggagagactagcagatgtcgtgacaccattatggcggctgagctacgaagagcaactgaagcctgtgatcaatgggtataggaataagagtaccttcagtgtcaatagggggcctgatggtaatcccaaaacagtaggcttttacctgggcacttggcgcgatggtaatgttgtttgcgttcagtcgaaccacctcaagaacatacccgagaagcattcccaggtagctcagtattatgaggtgttcttgcgccagagccccctggagccttgcctggttttccatgaggggggatactggagagagctcaccgtgagaaccaactcacaaggtcatactatggccatcatcaccttccaccctcagaaactgagtcaagaggagctgcacgtgcagaaggaaatcgtcaaggaatttttcattagaggaccaggcgctgcatgcggccttacctcactgtatttccaggaaagtacgatgacccggtgcagccatcagcaaagcccataccaattactgtttggcgaaccctatatcttcgaggagctactcagcctgaaaataagaatctccccggacgccttttttcagattaatacagccggtgccgaaatgctatatagaactgtgggcgaactgaccggagtgaattcggacaccatcctcctcgatatatgctgcggaaccggggtgatcggccttagcctcgctcagcatactagcagagtgttgggcattgagctgctggaacaggccgtggaggacgctagatggaccgcagcttttaatggcatcacaaacagcgagttccatacaggccaagccgaaaaaatattgccaggcttgctgaaatccaaggaagacggacagtccattgtagccgtggtgaaccctgcaagagccggactccactataaggttatccaggcaattaggaatttccgcgcaatccacaccctagtctttgtgagctgtaaattgcacggggagtctacccgtaatgtcattgagctatgttgcccacctgaccctgccaagaaactgcttggcgagcccttcgttttgcaacaggccgtccccgtggacttattcccccatacacctcattgcgagctggttctcttgtttaccaggtag

SEQ ID NO: 55640 - DNA, 1485 bp, Artificial Sequence
  Description of Artificial Sequence: Synthetic coding sequence
atggccggtttgaaacggagagtccccctgcatagcctgcgttattttatatcaatggttggtctttttagtaaacccggacttctcccttggtatgcgaggaacccgccaggatggtctcagctgttcctcggcacagtctgcaaaggcgatttcaccagggtcattgctacaaagtgccagaaaggccagaagagtcaaaagaaaccctcacatctgggaccactggatggaagctggcaagagcggctggcagatgtggtgacccctctgtggcggctgtcatacgaagaacagctcaaggttaaatttgcggctcagaagaagatcctccagcggctggagagctacattcaaatgctgaatggcgtgtctgtaacaactgccgtgccaaagtcggaacgattgagctgtctgctgcaccccatcatccctagtcctgtcattaacggatataggaataagtccacattctccgtcaacagaggaccagatgggaaccccaaaaccgtggggttttatcttggtacgtggagagatgggaacgtcgtctgcgtccagtcgaaccatttgaagaacattcctgaaaaacattcgcaggtggcccagtactatgaggtttttctcagacaatcacctctcgaaccatgccttgttttccatgaaggcggttattggcgggaattgaccgttcggacaaatagccaaggacatacaatggcaatcatcacttttcatccacagaaactatctcaagaagagctgcatgtccagaaggaaatagtgaaagaattttttatccggggacccggagctgcctgcggactaacctccctttactttcaggaaagcacaatgactagatgcagccaccagcaaagcccatatcagttgttatttggggaaccgtatattttcgaggagttacttagcctgaagattcggatctccccagacgctttcttccaaataaataccgcaggggctgagatgctctaccgtacagtgggcgagctcaccggagtgaactctgacactattctgctggacatctgttgtggaactggcgtcatcggcttgtcgctggcacaacacacttctcgagtgttaggtattgagctgctagagcaggctgtggaggatgccaggtggaccgccgcattcaatggtataacgaactccgaatttcataccggccaggctgagaagatccttcctgggttgctcaagagcaaggaggatgggcaatccatagtggcggtcgtcaatccagctcgcgctggtctgcattacaaagtcatccaagctatcaggaactttcgagctatccatacactggtatttgtgtcttgcaaactgcacggagagtctacacggaacgtcatcgaaagaagcctcattttgctcgagtgctctgggatggtgagcgcccactatagcttgcatctgccgggaagttcagactcacccgctagtgcctcgtag

SEQ ID NO: 55641 - DNA, 1515 bp, Artificial Sequence
  Description of Artificial Sequence: Synthetic coding sequence
atggctggactgaagaggagagttcctctgcactccctgcgatatttcatcagcatggtgggtctctttagtaagccaggcctccttccatggtacgcaaggaacccacccggatggtcacagctatttctcggcacagtttgcaagggggacttcaccagagttatcgccacaaagtgtcagaagggccagaagtcgcaaaagaagccctcgcatctaggccctctggatggctcttggcaagagcgactggcagatgtggtgaccccattgtggcgattgtcatatgaagaacagctgaaggtgaagttcgcagcccagaaaaagatcctgcaacgcctcgaatcttacattcaaatgctgaatggcgtgtcagtcacaactgcagtacccaagagtgagcgcttgtcatgtctactccatcctatcatcccatcacccgtcataaacggatatcggaacaagagcactttttcagtcaaccggggaccagatggaaatcccaagacggtagggttttatcttgggacatggagagatggaaatgtggtgtgtgtccaatcgaaccacttaaagaatatcccggagaaacacagccaggtcgcacagtactatgaagtgttcctgcgccagtcgcccctcgagccatgtcttgtgtttcacgaaggaggatactggagggaactcacagtccgaactaattcacaggggcacacaatggcaattattacctttcatccacagaagctaagccaggaggagctacacgtgcagaaggaaatcgttaaggaatttttcatacggggtccaggtgccgcttgtggacttaccagtttgtatttccaggaatctaccatgacacggtgcagtcaccagcagtccccctatcaattattatttggggaaccatacatcttcgaagagttactgtctttaaagatcagaatcagtcccgacgcgttctttcaaattaacactgcgggagccgagatgctgtataggactgttggggagctaacgggggtgaattccgatacaattctgttagatatttgctgtggcactggcgtgataggcctgtccttggcccagcatacttccagagtgcttggcattgagcttctcgagcaggctgtggaagacgctaggtggacggcggcattcaatggtatcaccaatagtgagttccacactggccaggcagagaagattctgccaggtctgctaaaaagcaaggaagatggccagtccatcgtcgctgtggtaaacccagctcgagccggtcttcattataaagtcattcaggcaatacgaaatttccgcgctatccatacactggttttcgtaagctgcaaactccacggcgagagcacgagaaacgtgattgagctctgttgcccacctgaccctgcaaagaaactgctcggagaaccattcgtccttcaacaagcagtgccagtggatctctttcctcatactcctcactgcgaactcgtgctgctgtttacccggtag

SEQ ID NO: 55642 - DNA, 1515 bp, Artificial Sequence
  Description of Artificial Sequence: Synthetic coding sequence
atggcgggacttaagaggcgcgttccattgcactcccttagatatttcatcagcatggtcgggctgttcagtaagcccggtttgctgccatggtatgctcgcaaccctccaggttggagtcagcttttcctgggcacagtgtgcaaaggcgattttacgcgcgtcatcgctaccaagtgtcagaaagggcaaaaaagtcaaaaaaagcctagccatcttggccctctcgatgggagctggcaggagcggcttgcagacgtcgtcacccctctttggcgtctgtcctacgaagagcagctgaaagtgaagttcgcggctcagaagaagattctgcagagattggaatcctacattcaaatgctcaatggagtgagtgtcaccaccgccgtccctaagagcgagagactcagctgcttgttacaccctataatacccagtcctgtgattaacggctataggaacaaatccacattcagcgtcaaccgtggaccagatgggaatcccaagactgttggcttctatcttgggacatggagagacggcaacgtggtgtgtgtgcaatcgaatcatttgaagaacattcccgagaaacactctcaggtggcacaatactatgaagtcttcctgagacagtctccccttgagccctgtcttgtgtttcacgaaggcggatattggcgagagctgacagtcagaactaatagtcaagggcataccatggcaatcatcaccttccacccgcaaaagctgtctcaagaagaactgcatgtgcaaaaagaaatagtgaaggagttctttattcgcggaccaggcgctgcatgtggactcacctccctgtattttcaagaatccactatgaccaggtgctcgcaccagcagagcccataccagctgctgttcggggagccatacatcttcgaggaacttctctctcttaagatccgtattagccctgacgctttttttcagatcaatactgcaggtgcggagatgctttacagaactgtgggtgaattaacaggcgtcaattccgataccatattacttgatatttgctgcggcacgggcgtcataggattatcattggcccagcacacatccagagtgctggggatcgagctgctcgaacaagcagtggaggacgcgagatggactgctgcctttaatggaatcaccaattcggaatttcacaccggacaggcggagaagatcctgccaggtttgctcaagagtaaggaggatggtcagagcatcgtggccgttgtgaatccagcgcgagccggactccattacaaggtgattcaggctattagaaatttcagagctatccacaccctggtgttcgtatcctgcaaacttcatggtgaatctactagaaacgtgatagagttgtgttgcccaccagaccccgctaaaaaactgctcggggagccctttgttctacagcaagctgtacctgttgatctctttcctcatacaccccactgcgagttagtcctgctgtttaccagatag

SEQ ID NO: 55643 - DNA, 1380 bp, Artificial Sequence
  Description of Artificial Sequence: Synthetic coding sequence
atggcaggccttaagagaagggtacctctccactctctccgctattttatttctatggtcgggctctttagcaagcccggacttctgccatggtatgcgagaaatccaccgggatggtcacagcttttccttggcacggtatgcaagggtgactttaccagggtgatcgcaacgaagtgtcaaaagggtcaaaaaagccaaaagaagccttcccacctgggtccactggacgggagctggcaggaacgccttgccgacgtcgtgacccctctgtggcggctttcgtatgaagaacagttgaagccggtcataaatggttatcggaacaaatccaccttctccgtgaaccggggtcctgacggcaatcctaagacagtaggattctacctcggaacctggcgcgacgggaacgttgtctgtgtacagagcaaccatctgaagaatatcccggaaaagcacagccaagttgcccaatactacgaggtgttccttagacagtctcccctcgagccatgtctggtgtttcacgaaggcggatattggagagagctcactgtcagaactaatagccagggacatacgatggccatcatcacattccacccccagaaattatcccaggaagagctgcacgttcagaaggagattgtgaaggagttctttatccgaggtccaggagcagcatgcggcttaaccagtctgtactttcaagaaagtactatgacacgctgctctcaccagcaaagtccctaccagctgctctttggggagccatatatttttgaggaactgctcagcctgaaaatccgcattagtccagatgccttctttcaaatcaacacagctggtgccgagatgctctatcgcactgtgggagagctgactggggtcaacagcgatacaattttgctcgatatatgttgtggtacaggagtgattggattaagcttggctcaacacacatcaagagtactgggtatcgagctcctggaacaagcggtcgaggacgccaggtggaccgccgctttcaacggtatcacaaattcagagttccatactggccaggcggagaaaatcttgcccggacttctgaagtcaaaggaggatggacaaagcatcgtggccgtcgtcaatccagcaagagccggactgcattacaaagtgatccaggcaattaggaacttccgagccattcacaccctggtcttcgttagttgcaagctgcacggggagagcactcgaaatgttatcgagctatgctgccccccagatccagccaaaaagctgctgggagagccgtttgtgctgcaacaggccgtacctgtggatctgtttccacacacacctcactgtgagctggtgttacttttcactcgctag

SEQ ID NO: 55644 - DNA, 1515 bp, Artificial Sequence
  Description of Artificial Sequence: Synthetic coding sequence
atggcaggtctgaaacgacgggtacctttacactcactgcgctacttcatttcaatggtcgggctgttctctaaacctggacttttaccttggtatgccagaaatccccctggctggagccagctgtttctgggcactgtgtgcaagggtgattttacgcgtgtgattgccaccaaatgccagaagggccagaagagccagaagaagccaagccacctcgggccactcgatggctcatggcaggaaagactagcggatgttgtgacacccctgtggcggctcagctacgaggaacaactgaaggttaaatttgcggctcagaagaagatactgcagagactggagagttacatacagatgctgaacggtgtgagtgtgaccaccgcagtgcctaaatcagaacggttgtcttgcctgctgcatccaataattccatctcctgtcatcaacggctatagaaacaaatctactttttcagtgaaccgagggcctgacggtaaccctaagaccgtaggattttatcttgggacatggcgcgacgggaacgtggtgtgcgtccaatcaaatcatctgaagaacattccagaaaaacattcacaggtcgcacagtattacgaggtttttctgcgccagtcgcccttggaaccatgtctggtcttccacgagggaggctattggcgggagctgaccgtccgcacaaattctcaaggccataccatggcaattatcaccttccatcctcaaaaattgagccaggaggaacttcacgtacaaaaggagattgtcaaggaattctttattcgtgggccaggcgctgcctgcggactcacatcactttactttcaggaaagcactatgacacgctgctcacaccagcagtccccttatcaattgctgttcggtgagccatatatcttcgaggagcttcttagcctgaaaattagaatatcgcctgacgccttctttcagatcaacaccgccggtgctgagatgttataccggaccgtgggagagctgactggagtcaattcagacacaatcctgttagatatctgctgcgggaccggggtgatcggtctttcgctcgcacagcacactagccgcgtcctggggatcgagctcctagaacaagcagtcgaggatgccagatggaccgccgcattcaacggcattaccaactctgaattccacaccggacaggctgagaagatcctgccaggactgctgaagagcaaggaggatggccagagcatcgtggccgttgtgaatcccgctagagcagggctgcactacaaagttattcaggcaatccgtaattttcgtgccatccacaccttggtgttcgtgtcctgcaagcttcacggtgagtccacgaggaatgtgatcgaactgtgttgtcccccagatccagccaagaagctgctcggagagcctttcgtgcttcaacaggccgtgcctgttgatttgttccctcacacaccccattgcgagctggttctgctgttcacccgctag

SEQ ID NO: 55645 - DNA, 1542 bp, Artificial Sequence
  Description of Artificial Sequence: Synthetic coding sequence
atgtcttatggttctatcgccagaggagggggactgggatctcgcggtccctttgggggaccctcgcgacagggctgccagccattggagtgcgctaggtgttggacagaatacgggattaggcatttcccttgtccgtctcctgagagcaagctgcagaacaggtgtgtggggaaggatggagagggcgacttgggcccagccggtactccaatcgtgcctagggctcgtaagaggggcccaggggttgctcctgagggctcacggatgcctgagccaacctcatcccctacgatcggacccagaaaagatagtgccgctggtccccacggcaggatggccggaccatccactacacgcgcaaagaaacgtaagcctaacttctgtcctcaggaaactgaagtccttgttagcaaagtgagtaagcaccatcagctacttttcgggactggactgctgaaagccgagcctactagacgctatcgagtgtggagccgaatcttacaggctgtgaatgcattaggttattgtcggcgtgacgtggtggacttaaagcataaatggcgcgatcttcgggctgtcgtccggaggaagctgggagacctgcgaaaagccgctcatgggccttccccaggttcaggcaagccccaggcattggcactaactcctgtcgagcaggtggtggcaaagacttttagttgccaggcccttccgtcagaaggcttttcccttgaacccccacgggctacacaggtcgatccgtgcaacctgcaggaactgtttcaagagatgtccgccaacgttttcaggattaattcatccgtgacatccctggagcgtagcctccagagtttgggcaccccatctgacacccaggagctgcgagatagcctgcatacagctcagcaggagaccaacaaaacaatcgccgcttccgcttcttctgtgaagcagatggcagaattgctgcgatcttcatgcccacaagagagacttcaacaggagagaccgcagctagatagactgaagacgcagctgtcagatgctatacaatgctatggtgtcgtacagaagaagattgctgaaaaaagtcgagccctgctgcctatggcgcagcggggttccaaacaatcacctcaggccccattcgcagaactggccgacgacgagaaggtgtttaatgggagcgacaatatgtggcagggacaagagcaggcgctacttcccgacatcacggaggaagatctagaggctatccgcctcagggaggaggctattctccagatggagtcaaatctcctggatgttaaccagattatcaaagacctggctagcatggtgtccgaacagggcgaggcagtcgatagcattgaggcaagtctggaggcagcaagcagtcatgctgaggccgcacgtcagctcctcgcaggggcttcccgacatcaactccagagacacaagattaagtgttgcttcttgtccgcaggcgtaacagctcttcttgtcattattattatcattgccactagtgtgcgaaagtag

SEQ ID NO: 55646 - DNA, 834 bp, Artificial Sequence
  Description of Artificial Sequence: Synthetic coding sequence
atgtcatacggaagcattgcacgcggagggggtttgggcagtcgagggccttttggaggacctagccgacagggttgtcagccgctggctacgcaggtggacccctgtaacctgcaggagctatttcaggagatgagcgcaaacgtcttccgaataaattcatctgttacttccctggagcgttctctccagagcctgggcacaccgtccgatactcaggagcttcgggatagtttgcacactgcccagcaagaaaccaacaagacaatagcagccagcgcaagttctgtaaaacagatggctgagcttttacgcagcagttgccccgagcgactgcaacaggagcgccctcagttggatcgtctaaagactcagctctctgatgcgattcaatgctatggagtggtgcagaaaaaaattgcggagaaatctagggctcttcttcccatggcacaaaggggttccaagcagcagtcgcctcaagcccctttcgctgagcttgctgacgacgagaaggttttcaatgggtctgacaatatgtggcagggtcaggaacaggcactactaccggatattacagaggaagatcttgaagcaatacgcctgagagaggaagccatcctgcagatggaaagtaacttgctggatgttaaccaaattattaaagacctggcttctatggtttcggaacagggcgaggctgtagatagtatagaggcctcccttgaagcagcaagttcacatgcagaagcagcgaggcaactgctggccggagcaagccgacaccagctgatgaggcggacaagaccccctgcagcttgtggatgtccatag

SEQ ID NO: 55647 - DNA, 1542 bp, Artificial Sequence
  Description of Artificial Sequence: Synthetic coding sequence
atgagttacggttctatcgcgcgtgggggaggcctgggatctagaggcccattcggtggaccatcacgacaaggatgccagccattggagtgcgcccgatgctggacagagtatggcatccggcatttcccctgtccatcacctgaatctaagctacagaacaggtgcgtaggtaaggatggggagggagacctaggtcccgcaggcactcctatcgtccctagggccagaaagaggggcccaggggtggcaccagagggtagtcggatgcctgagcccacgagctctcctacaatcggacccaggaaagactcagccgctggacctcatggtagaatggcgggaccttcaaccaccagagctaagaagaggaagccaaacttttgtcctcaggagacagaagtccttgttagtaaggtcagcaaacaccatcagcttctgtttggcaccggattattgaaagctgaacctactagaagataccgcgtttggagtcgcatactgcaagcagtgaatgcactaggctactgccgccgagatgtggttgacctgaaacacaagtggcgggacttaagagccgtggtgcgccgaaaacttggggatttgaggaaggccgcacacggtccatcacctgggagtggcaagccgcaggcgttggcactgaccccagttgagcaagtggtggcaaagacattctcttgtcaggctctgcccagtgaaggattctcactcgagccgccaagggcaactcaggtcgatccctgcaatctccaggagctctttcaagagatgtccgccaatgtgttcaggattaactcctctgtcacgtcactcgagcgtagcctgcagtccctcggtaccccttccgatacacaggaattgcgcgacagcctgcacaccgctcagcaggagaccaataaaactattgccgcaagcgcttcaagtgtgaagcagatggccgaactcctccggtcaagctgcccagaacggctgcagcaagaaaggccacagctggaccgcttgaaaactcagctgagcgacgctattcaatgctatggtgtggtacagaagaaaatcgcagagaaatcccgggcactgttacccatggcccaaaggggatccaaacagcagtcacctcaggctccttttgctgagctggctgacgacgagaaagtgtttaatggtagcgataatatgtggcaggggcaggaacaggcactgcttccagatataactgaagaggatttggaggctattcggctccgggaggaagccatactgcagatggaaagcaatctgcttgacgtcaatcagatcataaaagatcttgcatcaatggtcagcgagcagggggaagcagtggacagcatcgaggccagcctcgaggccgcaagttcccacgccgaagccgcacgccagctgctggccggagcgtcccgccatcagctgcagagacacaagatcaagtgttgttttttaagcgccggagttactgcgctgctcgtaatcatcatcattattgctacatcagttaggaaatag

SEQ ID NO: 55648 - DNA, 453 bp, Artificial Sequence
  Description of Artificial Sequence: Synthetic coding sequence
atgagttacgggtcaattgccagagggggtgggctgggttcacgcggaccgttcggcggaccctctaggcaagggtgccagcctctggagtgcgcaaggtgttggacagagtacggcatccgccactttccttgccctagcccggagagcaagctgcagaatcgctgcgtgggcaaggacggtgagggtgatttagggccagcaggcactcctatcgtgcccagggcccgtaagagaggccctggggttgctccagaaggttccagaatgcccgagccaacaagtagccccactattggacccagaaaagatagtgctgctggaccacacggccgaatggccggaccctctactacccgggctaagaaacgcaaacctaacttttgcccacaggagactgaggtgctagtgtccaaggtgagcaaacatcatcagttgttgttcggcacttag

SEQ ID NO: 55649 - DNA, 1539 bp, Artificial Sequence
  Description of Artificial Sequence: Synthetic coding sequence
atgtcctacgggtcgatcgcacgcggaggagggcttggatccagaggtccattcggagggccttctcgtcaaggatgccaacctcttgagtgcgctagatgttggacagaatatggcataaggcatttcccttgtccgtctcccgagtcgaaacttcaaaacagatgcgtgggaaaagatggagagggtgatttgggcccagccggaactcccatcgtgccacgtgcgagaaaaaggggacccggagtggctcccgagggtagtaggatgcctgaacccacttcaagccccactatcggaccacgcaaggattcggctgccggaccacacggccgaatggccggtccgtcaacgacccgagccaaaaaacgaaagcctaacttctgcccccaagagacagaggtcctagtctctaaagtgtctaagcaccaccagcttctatttggcaccggattactgaaggccgaacctacgagacgctaccgagtatggtccagaatacttcaggctgtgaacgcgctgggctattgccggagggatgttgtcgatctgaagcacaagtggcgagatcttcgggcagtagtcagacgcaaacttggtgatcttcgcaaagcagcacacggacccagcccaggcagtggcaagccccaggccctggctctgacccctgttgagcaggtggtggcaaagacgttctcttgtcaggccctgccgtctgaaggtttctcactcgaacccccacgagccacccaggtcgacccctgtaatctgcaggaactttttcaggagatgagtgcaaatgttttcaggatcaactcgtcagtcacatccttggagaggagcctgcaatccctgggcaccccgtcagacacccaagagctgcgcgactccctgcataccgcacaacaggagacaaacaagacaatcgctgcctccgcctccagcgtgaagcaaatggcggagcttttgaggtcttcttgtcctgaacgcttgcaacaggagcggccacagctggatcggctcaagacacaattatcagacgccatccagtgctacggtgtggtccagaagaagatagcagaaaaatccagagccctgctgcctatggctcagagagggagcaagcaaagtccacaggcccctttcgcggagctggctgatgatgaaaaagtgttcaatgggagcgacaacatgtggcaaggccaggaacaggccttactgccagacattaccgaggaggatctagaagctatacgcctccgtgaagaggctattctgcaaatggagtccaatctacttgacgtaaaccagatcatcaaggacttggcaagcatggtgagcgagcagggggaagcagtggacagcatcgaagcttcccttgaggcagcttcatcccacgccgaggccgctcggcagctgctcgcaggagcctcccgacatcagctgcagcggcacaaaattaaatgttgtttcctgtccgctggcgtaactgctctccttgttatcattataattatcgctaccagcgtccgaaagtag

SEQ ID NO: 55650 - DNA, 1686 bp, Artificial Sequence
  Description of Artificial Sequence: Synthetic coding sequence
atgtctacagaaaggaccagctggacctccttatcaaccatacaaaagattgccctcggactcggcatccctgcctctgccaccgtcgcttacatcctgtatcggagatatagagagtcaagggaggagcggctgacctttgttggcgaggacgatattgaaatcgagatgcgcgtcccacaagaagcggtcaagttgattatcggacggcagggtgctaatatcaagcagttgcggaaacagaccggcgcacgcatcgatgtggacactgaggacgtaggtgacgaacgagttctcctaatcagcggattccccgttcaggtgtgcaaggcaaaagctgcgattcatcagattttgacagagaatacgcccgtgtcggagcagctgagtgtgccccaacgcagcgttggccgaattatcggaagaggaggcgaaaccatacgatccatttgtaaagctagtggagcgaaaattacatgcgataaagagtcagaagggactcttctgctgagcaggctaatcaagatctctgggactcagaaagaagtagctgccgctaaacatctgatccttgagaaagttagtgaggacgaagaactgcggaagcgcattgcccattcagccgaaaccagagtccctcgcaaacaacctatatccgtgcgaagggaggatatgacagaacctgggggagcaggcgagccggcactgtggaaaaacacaagttctagtatggagcctacagctccgcttgtgacccctccgccaaaggggggtggggacatggccgtggttgtgtcgaaagagggttcctgggagaaacccagcgatgactcctttcagaagtctgaggcccaagctattcctgagatgcctatgttcgaaattcctagtcctgacttttcattccacgcagacgaatatttagaggtgtacgtgagtgccagtgaacatcctaaccacttctggatccagattgttggtagtaggagccttcaattagataaactggtaaatgagatgacccaacattatgaaaactccgtccccgaggaccttaccgtgcacgtgggggacatcgtcgccgctccactaccaacgaatgggagctggtaccgtgctagggtgctcggtacattagagaatggtaacttggacctgtactttgtcgattttggggacaatggagattgtcccctgaaagacttgcgggcactccgttcggatttcctttcactgcccttccaggctattgaatgttcccttgccagaatagccccttcgggggatcagtgggaagaagaggccttggatgaatttgaccgcctaacacattgcgccgattggaagcccctggttgccaaaatcagttcatatgtgcagacaggcatcagtacatggccaaagatttatctttatgacacgtccaatggcaagaaactggacatcggactagaactggtgcacaaaggttacgcaatcgagctccccgaggatatagaagaaaacagagctgtcccagatatgctgaaggatatggcgactgagaccgacgcgtcactgtctaccctgctgacggagaccaaaaaaagcagcggcgagatcacacataccttgtcttgcctgtctctgagcgaggccgcttctatgagcggagatgataacctggaggacgattacttactgtag

SEQ ID NO: 55651 - DNA, 1674 bp, Artificial Sequence
  Description of Artificial Sequence: Synthetic coding sequence
atgtccaccgaacggacctcatggacttccctcagcacaattcagaagattgctctcggcctaggaatccctgcatcggccacggtagcatatatactatatagaaggtatcgggagagcagggaggaaagactgactttcgttggcgaggacgatatagagatcgagatgcgagttccccaggaggccgtaaagctgatcattggaagacagggagccaatatcaagcagacgggcgcacggattgatgttgacacagaagacgttggagatgaaagagtcctgctcatctcaggttttccagtgcaagtgtgcaaggctaaggccgctatacaccagatcttgaccgaaaacactcccgtgagcgaacaactctctgtcccacagagatctgtgggcaggatcatcgggaggggaggtgagacaattcggtcgatttgtaaagcctccggcgctaagattacatgtgataaagagagcgaaggtacactgctgctgtcacgacttattaagattagcgggactcagaaggaggtagctgctgccaagcatcttatcctggaaaaagtcagtgaggatgaagagctgcggaaacggattgcccattctgccgagacaagggtaccacggaagcagcccatcagcgtcagacgcgaagacatgactgaacccggtggtgcaggagagccggcattgtggaagaatacctcttcttctatggaaccgacagcgcctctagtgaccccaccccctaaaggcggaggagatatggccgttgtggtgagcaaggaaggctcatgggagaagccctctgatgactcttttcagaaatctgaggcacaggccatcccagaaatgcctatgtttgagatcccatcacccgacttctctttccacgcagacgaatatctggaggtctacgtttctgcctctgaacatcccaaccacttttggatacagattgtcggttctagaagcctccaactcgacaagctcgtgaatgagatgactcagcactatgagaatagcgtgccggaggatttgaccgtgcatgtgggcgatatcgtggccgctccactgccgaccaacggctcctggtacagagccagagtgctggggacgttggagaacggcaacttggacctctactttgttgattttggtgacaacggggactgccccttaaaagacctgcgcgcacttcgcagcgacttcctgtctctgccattccaggccatcgagtgcagccttgccaggatcgctccgtccggtgaccagtgggaggaggaggctcttgatgagtttgatagacttacgcattgcgcagactggaaacccctggtggctaagatctccagctacgtgcaaactggcatctctacttggcccaaaatttatctgtatgacacatcaaacgggaagaaactagatattggcctcgagctggtccacaaaggctatgccattgaacttccagaggatatagaggaaaaccgagctgtaccagacatgctgaaagatatggctactgagacagacgctagtctgagtaccctccttacagaaaccaagaaaagctccggagaaattactcatacgttgtcatgtctgtccctgtccgaggctgcatctatgagcggtgacgacaatctggaggacgattacctcctttag

SEQ ID NO: 55652 - DNA, 1686 bp, Artificial Sequence
  Description of Artificial Sequence: Synthetic coding sequence
atgtcaacggaaagaactagctggacaagtctgtcaactattcagaagatcgccctgggcttgggaatcccggcaagtgcgaccgtggcctatattctttacaggcggtacagagaatcccgggaagaaagattgactttcgtaggcgaggatgacatcgagattgaaatgagagttcctcaggaggcagtcaagcttattataggcaggcagggagccaatattaagcagctcagaaaacaaacaggcgcacgaatcgacgtcgacaccgaggatgttggcgacgagagagtgctgctgatatctggattccccgttcaggtttgtaaggcgaaggcggcaattcatcagatactcacagagaacactccggtgtcagagcaattaagcgtgcctcagagatctgtagggcgaatcatcggtagaggaggtgaaaccattcggtcaatttgcaaggcttctggggctaagatcacatgtgataaggagtcagaaggcacgctgctgctgagccgactgattaagataagcggtactcagaaggaagtggcagccgcaaaacatctgatcttggagaaagtgtctgaagatgaagagctgagaaagagaattgcacactcagccgagacaagagttccccgaaagcaacctatcagcgttaggcgggaagacatgactgagcccggaggcgctggcgagccagcgttgtggaagaacacatcctcaagcatggaacccacggccccattagtgacgccaccccctaagggaggcggtgatatggctgtagttgtgagtaaagagggatcttgggagaagccctcagatgattccttccaaaaaagcgaggctcaggctatcccagaaatgcctatgttcgagatccctagtccggacttttcctttcacgccgatgagtatctggaggtttatgtgtctgcctctgagcatccaaatcacttttggatccagatcgtgggcagccggagcctgcaactagataagctggtcaacgaaatgacacaacactatgaaaatagtgtgcctgaagacctgacagtgcacgtgggtgatatcgtggccgcacccctcccaaccaatggctcctggtatagggccagagttctgggaaccttggagaacgggaacctggatctttatttcgtcgatttcggtgataacggagattgccctctcaaggatcttcgggcattaaggagcgattttctcagtctgccgtttcaggctattgaatgttctttggctcggatagctcccagcggtgaccagtgggaggaagaagccctggatgagtttgaccgactgacacactgtgccgattggaagccactcgtcgccaaaatctctagctatgtccagactggaatctcgacttggcctaaaatctatctgtatgatacatctaacgggaaaaaacttgatatcgggctggaattggtgcacaaaggatatgctattgaactgcccgaagatatcgaggagaatcgcgctgttcccgacatgctgaaggacatggccaccgaaactgatgcatcactgagcaccctcctgactgagactaaaaagtcatctggcgaaatcacacacaccttgtcctgtctgtctctttcagaggcagcaagcatgagtggcgacgacaacctggaggatgattacctgctttag

SEQ ID NO: 55653 - DNA, 1551 bp, Artificial Sequence
  Description of Artificial Sequence: Synthetic coding sequence
atgtccactgagagaacatcctggacttcactgtcgacaatccaaaagattgcactggggctcggcattcccgcttcagccacggtcgcctatatactgtacaggagataccgtgaatctcgggaagagcggttaacatttgtcggtgaggatgacattgagatcgaaatgagagtcccacaggaagcggtgaagttgattattggccgtcagggagctaacatcaagcagctgcgcaaacagacaggagccaggattgacgttgacacggaggatgttggcgatgaaagagtgctcctgatttcggggtttccagttcaggccagcggcgcaaagatcacctgtgataaggaaagtgaaggcacgctgctgctcagccggcttatcaagatctcaggcacccagaaagaagtggcggctgctaagcacctcatcctggaaaaagtttcagaggacgaagaacttaggaaacgcattgctcactccgcggagacgcgcgtccctagaaaacagccaattagtgtgagacgagaggacatgacagaaccaggcggtgcaggggaaccagctctatggaagaacacaagttcttctatggaacccacagctcccttagtgacacccccaccaaagggaggcggtgacatggccgttgtggtgtctaaggaaggcagctgggagaaaccctcagatgattcatttcagaaatcggaagcccaggcgattccggagatgcctatgtttgagatcccgtcgcccgacttcagttttcatgctgacgaataccttgaagtgtacgtgtccgcaagcgagcaccccaaccatttctggatacaaatcgttggctcgaggagcctccagctagataaactcgtgaatgagatgacacagcactatgagaatagcgtacccgaagacctgactgtgcacgtcggagatatagtcgctgctccgctaccaacaaacggatcatggtatcgggctcgggtgctgggaactctggagaacggcaatcttgatctatacttcgtggattttggagataatggtgactgcccgttgaaggacctgcgcgctttacgtagcgatttcctgagcctcccatttcaggccattgaatgttcactggctcggatcgccccaagtggggatcagtgggaggaggaggcactggatgagtttgatcggctgactcactgcgcggattggaagccactggtagccaaaatctcttcttatgtgcaaacgggaatttcgacttggccgaagatttatctatacgacacatcgaacgggaagaaactggacatcggcctcgaactggtacacaaggggtacgccatcgaactacccgaagacatcgaagaaaatcgcgctgtgcccgatatgcttaaagacatggcgaccgagacggacgcatctctctccacgctcctcaccgagacaaaaaagagctcaggcgaaatcacccatactctctcttgcctcagcctgagcgaggcagcctcaatgtctggagatgataacctggaggacgactacctcttatag

SEQ ID NO: 55654 - DNA, 1686 bp, Artificial Sequence
  Description of Artificial Sequence: Synthetic coding sequence
atgagcactgaacgaacctcctggacaagcctttcaaccatccagaagattgctcttggtctcggaatccctgccagtgctaccgtcgcatacatcctttatagacggtaccgtgagtccagagaggagagactcactttcgtcggagaagacgacatcgaaatagaaatgcgggtccctcaggaagctgtaaagctcattatcggcagacagggagccaacatcaagcagttgaggaaacagactggtgccagaatcgacgtggacacagaggacgtgggcgatgaaagggttctgcttatttctggatttcccgtccaggtgtgtaaggcgaaggccgcaatccaccagatccttactgaaaacactccagtcagtgaacaattgtctgtgcctcagaggtccgttggtagaattattgggaggggtggcgaaaccatccgcagcatctgtaaagcctccggcgctaagattacatgcgacaaagaatccgagggcaccttacttctgagccggctcatcaagattagcggaacccaaaaggaagtggccgcagcaaagcacctcatattagaaaaagtctctgaggacgaagaactgcggaagcgcattgctcattctgcagagacacgggtcccaagaaaacagcccatctccgtacggagggaggatatgactgagccaggaggcgctggtgaacccgctttatggaaaaatacaagtagcagtatggaacccacagccccattggtgacaccaccacctaaaggtggaggggacatggctgtcgtggtgtctaaggaggggagctgggagaaacccagtgacgacagcttccagaagtccgaggcccaagcaatccccgaaatgccaatgttcgagatcccatcccccgacttcagtttccatgccgatgagtaccttgaagtatacgtgtccgctagcgagcaccccaatcacttctggatccagatcgtgggctcacgcagtctgcagctcgacaaactagtcaatgaaatgacccagcactatgaaaacagcgtgcccgaggacttgacagtgcatgtgggcgatattgtcgccgctcctttacccacaaatggttcctggtacagggctagagtgctgggaacccttgagaacggaaatctggacctgtattttgttgactttggcgacaatggggattgccctctcaaggacttaagagctctccggtcagattttctgtcactgccgtttcaagctattgagtgttctctggctcggattgccccttcaggcgaccagtgggaagaagaagctctggatgaattcgataggctgactcactgcgcagattggaaacccctggtcgctaagatttctagctacgtgcagacaggtatctctacctggccaaagatctatctgtatgacaccagtaatggcaagaagctggacattggcctggaacttgtgcacaagggttacgcaatcgagctgcctgaagatatcgaggagaaccgtgctgtgccggacatgctcaaggacatggccactgaaacagatgcatcactgagtacattgctgacagagaccaagaagagctcaggagagatcacgcacaccctgtcatgtctgtcactgtcagaggcagcctcaatgtccggagatgataacctggaggacgattatctactctag

SEQ ID NO: 55655 - DNA, 1014 bp, Artificial Sequence
  Description of Artificial Sequence: Synthetic coding sequence
atgactgagcctggcggagcaggagaacccgctctctggaagaacacttcttcatcaatggaacctaccgcgccacttgtgacaccgccaccgaagggcggaggagacatggcagttgtggtctctaaggaaggcagctgggagaagccaagcgatgactcatttcagaaatcagaggcccaggcgattcccgaaatgcccatgtttgagataccaagtccagatttcagttttcacgccgatgaataccttgaagtttatgttagcgcatccgaacaccctaatcacttctggattcaaatcgtagggagcagatctttacagctggataagctggttaatgaaatgactcagcattacgagaacagcgtccccgaggatctaaccgtccatgtgggcgacattgtggccgcaccactgccgaccaatggatcatggtatcgggcacgggttctcggaaccctcgagaacggcaatctcgatttatactttgtagacttcggagataacggggactgccccctgaaagacctacgggcattgcgcagtgatttcctctcgctgccattccaggccattgagtgctctttagcacgaatagctccctcgggtgatcagtgggaggaggaggctctggacgagtttgacaggttgacacactgcgcagactggaagcctctcgtcgccaaaattagcagctacgtgcagactggcattagtacctggccaaagatatacttgtacgacacaagcaatggaaaaaagctggacatcggattagagctggttcacaaaggttacgcgattgaacttccagaagatatcgaagaaaatcgagccgtgccggatatgctcaaagacatggccactgagaccgacgcttccctgtccacgctcctgaccgagactaagaaatctagtggcgagatcacccataccctttcgtgtctgtccttgtctgaggctgcgtctatgtcaggggatgataacttggaagacgactacttactttag

SEQ ID NO: 55656 - DNA, 1686 bp, Artificial Sequence
  Description of Artificial Sequence: Synthetic coding sequence
atgtcaaccgagaggacgagctggacatcactatccacgattcagaagattgcgttgggcctaggcattcctgcaagtgccacagtggcctacatcttgtaccgccgttatcgcgaatcccgcgaggaacgcttgactttcgttggcgaagatgacattgaaatcgagatgagggtaccacaggaagccgtgaaactgatcattggccgtcagggcgcaaatattaaacagcttagaaagcagactggtgcacggattgacgtcgataccgaagatgttggcgacgaacgcgtgctgttgatctccggtttcccagtacaagtgtgtaaagccaaagcagctattcaccaaatcctgaccgaaaatacaccggttagcgagcagctttccgttccacagaggagcgtcggaaggatcatcggaagaggcggtgagaccattagatccatctgcaaagcttcaggggcaaaaataacatgtgataaggagagtgagggcacactcttgctgtctcgactgatcaaaatttccggtactcagaaggaagtcgctgccgcaaaacatctaatcctcgagaaagtcagcgaagatgaggagctacggaagcgtatagcacattccgccgaaacacgcgtacctaggaaacagccaattagtgtccgcagggaggacatgacagagccgggtggcgcaggggagccagcactctggaaaaacacttcctcctcaatggagcccactgccccattagtgacaccaccacccaagggcggaggcgatatggctgttgtagttagtaaggagggatcatgggagaagcccagcgacgattcctttcagaagtccgaagctcaagctatccctgagatgccaatgttcgagattccatcacccgacttctccttccatgctgacgagtaccttgaggtctatgtcagcgcctctgaacacccaaatcatttctggatccagatcgtcgggtctcgatccctccagctggacaaattagtgaatgagatgacacagcactatgagaacagcgttcctgaagacctcacagtgcacgtgggggatatcgttgctgcacctttgcctactaacggcagctggtaccgcgcacgagtcctgggtacgctggagaacggtaatctggacttgtacttcgtggactttggggataacggagattgccctctcaaggatttgcgagctcttcgtagcgacttcctcagtctgcctttccaggcaattgagtgcagtctcgcccgtatcgcacccagtggcgaccagtgggaggaggaggcactcgacgaattcgaccgtctcacacactgcgctgactggaagcccctggtggcgaaaatctcctcttatgtccagacagggattagcacttggcccaaaatttatctgtatgacacgtccaatggcaaaaagttggacataggtcttgagctagtgcacaagggttacgctattgaattacccgaagacatagaagagaacagagctgtcccggacatgctgaaggatatggccaccgagacagacgcctccctatcgactctcctgaccgagactaagaagtcttcaggggagatcactcacaccctcagctgtcttagtctttcagaggcagcttccatgtctggagacgacaatctggaggacgattatctgctctag
